United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 191

SEQ ID NO: 7950678 - DNA, 22 bp, Homo sapiens
gggcactgaacaccctcttcgc

SEQ ID NO: 7950679 - DNA, 21 bp, Homo sapiens
gggcactgaaagggaatagca

SEQ ID NO: 7950680 - DNA, 21 bp, Homo sapiens
gggcactgaaagggaatagca

SEQ ID NO: 7950681 - DNA, 22 bp, Homo sapiens
gggcactgctggaggctccctg

SEQ ID NO: 7950682 - DNA, 22 bp, Homo sapiens
gggcactgctggaggctccctg

SEQ ID NO: 7950683 - DNA, 22 bp, Homo sapiens
gggcactgctggaggctccctg

SEQ ID NO: 7950684 - DNA, 22 bp, Homo sapiens
gggcactgagtggatgatgcag

SEQ ID NO: 7950685 - DNA, 22 bp, Homo sapiens
gggcactgagtggatgatgcag

SEQ ID NO: 7950686 - DNA, 22 bp, Homo sapiens
gggcactgagaattttccactt

SEQ ID NO: 7950687 - DNA, 22 bp, Homo sapiens
gggcactgagggcccacaggat

SEQ ID NO: 7950688 - DNA, 22 bp, Homo sapiens
gggcactgagggcccacaggat

SEQ ID NO: 7950689 - DNA, 22 bp, Homo sapiens
gggcactgaatgccaagctagg

SEQ ID NO: 7950690 - DNA, 22 bp, Homo sapiens
gggcactgacagggtcccaact

SEQ ID NO: 7950691 - DNA, 22 bp, Homo sapiens
gggcactgaatgccaagctagg

SEQ ID NO: 7950692 - DNA, 22 bp, Homo sapiens
gggcactgctttgctctgtcac

SEQ ID NO: 7950693 - DNA, 22 bp, Homo sapiens
gggcactggaaggctctcaggc

SEQ ID NO: 7950694 - DNA, 22 bp, Homo sapiens
gggcactggaaggctctcaggc

SEQ ID NO: 7950695 - DNA, 22 bp, Homo sapiens
gggcactggaaggctctcaggc

SEQ ID NO: 7950696 - DNA, 22 bp, Homo sapiens
gggcactggcagtcggggacgc

SEQ ID NO: 7950697 - DNA, 22 bp, Homo sapiens
gggcactggcaccaaagacttg

SEQ ID NO: 7950698 - DNA, 22 bp, Homo sapiens
gggcactggaggccaaggagct

SEQ ID NO: 7950699 - DNA, 22 bp, Homo sapiens
gggcactggaggccaaggagct

SEQ ID NO: 7950700 - DNA, 22 bp, Homo sapiens
gggcactggaggccaaggagct

SEQ ID NO: 7950701 - DNA, 22 bp, Homo sapiens
gggcactggaggccaaggagct

SEQ ID NO: 7950702 - DNA, 22 bp, Homo sapiens
gggcactggaaggctctcaggc

SEQ ID NO: 7950703 - DNA, 22 bp, Homo sapiens
gggcactggaggccaaggagct

SEQ ID NO: 7950704 - DNA, 22 bp, Homo sapiens
gggcagtgacaaaggggatgaa

SEQ ID NO: 7950705 - DNA, 22 bp, Homo sapiens
gggcagtgattttccttagagg

SEQ ID NO: 7950706 - DNA, 22 bp, Homo sapiens
gggcagtgacaaaggggatgaa

SEQ ID NO: 7950707 - DNA, 22 bp, Homo sapiens
gggcagtgacaaaggggatgaa

SEQ ID NO: 7950708 - DNA, 22 bp, Homo sapiens
gggcagtgacaaaggggatgaa

SEQ ID NO: 7950709 - DNA, 22 bp, Homo sapiens
gggcagtgacaaaggggatgaa

SEQ ID NO: 7950710 - DNA, 22 bp, Homo sapiens
gggcagtgacaaaggggatgaa

SEQ ID NO: 7950711 - DNA, 22 bp, Homo sapiens
gggcagtgacaaaggggatgaa

SEQ ID NO: 7950712 - DNA, 19 bp, Homo sapiens
gggcagtggcactagggag

SEQ ID NO: 7950713 - DNA, 19 bp, Homo sapiens
gggcagtggcactagggag

SEQ ID NO: 7950714 - DNA, 19 bp, Homo sapiens
gggcagtggcactagggag

SEQ ID NO: 7950715 - DNA, 19 bp, Homo sapiens
gggcagtggcactagggag

SEQ ID NO: 7950716 - DNA, 19 bp, Homo sapiens
gggcagtggcactagggag

SEQ ID NO: 7950717 - DNA, 19 bp, Homo sapiens
gggcagtggcactagggag

SEQ ID NO: 7950718 - DNA, 22 bp, Homo sapiens
gggcagtgaatattggtgggaa

SEQ ID NO: 7950719 - DNA, 22 bp, Homo sapiens
gggcagtgaatattggtgggaa

SEQ ID NO: 7950720 - DNA, 22 bp, Homo sapiens
gggcagtgacaaaggggatgaa

SEQ ID NO: 7950721 - DNA, 22 bp, Homo sapiens
gggcagtgacaaaggggatgaa

SEQ ID NO: 7950722 - DNA, 22 bp, Homo sapiens
gggcagtgaatattggtgggaa

SEQ ID NO: 7950723 - DNA, 22 bp, Homo sapiens
gggcagtgaatattggtgggaa

SEQ ID NO: 7950724 - DNA, 22 bp, Homo sapiens
gggcagtgaatattggtgggaa

SEQ ID NO: 7950725 - DNA, 22 bp, Homo sapiens
gggcagtgaatattggtgggaa

SEQ ID NO: 7950726 - DNA, 22 bp, Homo sapiens
gggcagtgaatattggtgggaa

SEQ ID NO: 7950727 - DNA, 22 bp, Homo sapiens
gggcagtgaatattggtgggaa

SEQ ID NO: 7950728 - DNA, 21 bp, Homo sapiens
gggcagtctggtggctatggc

SEQ ID NO: 7950729 - DNA, 22 bp, Homo sapiens
gggcagtcacagtgctggagca

SEQ ID NO: 7950730 - DNA, 22 bp, Homo sapiens
gggcagtcacagtgctggagca

SEQ ID NO: 7950731 - DNA, 22 bp, Homo sapiens
gggcaggttattggagtaggga

SEQ ID NO: 7950732 - DNA, 22 bp, Homo sapiens
gggcaggttattggagtaggga

SEQ ID NO: 7950733 - DNA, 22 bp, Homo sapiens
gggcaggttattggagtaggga

SEQ ID NO: 7950734 - DNA, 22 bp, Homo sapiens
gggcaggttattggagtaggga

SEQ ID NO: 7950735 - DNA, 22 bp, Homo sapiens
gggcactgggtcttctccacgc

SEQ ID NO: 7950736 - DNA, 18 bp, Homo sapiens
gggcactggggactggag

SEQ ID NO: 7950737 - DNA, 22 bp, Homo sapiens
gggcaggttattggagtaggga

SEQ ID NO: 7950738 - DNA, 22 bp, Homo sapiens
gggcaggttattggagtaggga

SEQ ID NO: 7950739 - DNA, 18 bp, Homo sapiens
gggcactggggactggag

SEQ ID NO: 7950740 - DNA, 22 bp, Homo sapiens
gggcactggccgcccatccctg

SEQ ID NO: 7950741 - DNA, 22 bp, Homo sapiens
gggcactggcgttttgttaaac

SEQ ID NO: 7950742 - DNA, 18 bp, Homo sapiens
gggcactggggactggag

SEQ ID NO: 7950743 - DNA, 18 bp, Homo sapiens
gggcactggggactggag

SEQ ID NO: 7950744 - DNA, 23 bp, Homo sapiens
gggcaggtttttataggcttcag

SEQ ID NO: 7950745 - DNA, 18 bp, Homo sapiens
gggcagtaagtgtggggt

SEQ ID NO: 7950746 - DNA, 22 bp, Homo sapiens
gggcagtagcttcgtaggcatc

SEQ ID NO: 7950747 - DNA, 23 bp, Homo sapiens
gggcaggtttttataggcttcag

SEQ ID NO: 7950748 - DNA, 22 bp, Homo sapiens
gggcaggttattggagtaggga

SEQ ID NO: 7950749 - DNA, 22 bp, Homo sapiens
gggcaggttattggagtaggga

SEQ ID NO: 7950750 - DNA, 22 bp, Homo sapiens
gggcaggttattggagtaggga

SEQ ID NO: 7950751 - DNA, 22 bp, Homo sapiens
gggcaggttggcatcccgggca

SEQ ID NO: 7950752 - DNA, 23 bp, Homo sapiens
gggcaggtttttataggcttcag

SEQ ID NO: 7950753 - DNA, 22 bp, Homo sapiens
gggcaggttggcatcccgggca

SEQ ID NO: 7950754 - DNA, 22 bp, Homo sapiens
ggctcccaggagggcctggagg

SEQ ID NO: 7950755 - DNA, 22 bp, Homo sapiens
ggctcccaggagggcctggagg

SEQ ID NO: 7950756 - DNA, 22 bp, Homo sapiens
ggctcccaggagggcctggagg

SEQ ID NO: 7950757 - DNA, 22 bp, Homo sapiens
ggctcccacccatagggcgagt

SEQ ID NO: 7950758 - DNA, 22 bp, Homo sapiens
ggctcccaggagggcctggagg

SEQ ID NO: 7950759 - DNA, 22 bp, Homo sapiens
ggctccagtttgtgccttcagc

SEQ ID NO: 7950760 - DNA, 22 bp, Homo sapiens
ggctccagtttgtgccttcagc

SEQ ID NO: 7950761 - DNA, 22 bp, Homo sapiens
ggctccagtttgtgccttcagc

SEQ ID NO: 7950762 - DNA, 22 bp, Homo sapiens
ggctccagtttgtgccttcagc

SEQ ID NO: 7950763 - DNA, 22 bp, Homo sapiens
ggctccagtttgtgccttcagc

SEQ ID NO: 7950764 - DNA, 22 bp, Homo sapiens
ggctccagggagtggagagaag

SEQ ID NO: 7950765 - DNA, 22 bp, Homo sapiens
ggctccagggagtggagagaag

SEQ ID NO: 7950766 - DNA, 22 bp, Homo sapiens
ggctccagggagtggagagaag

SEQ ID NO: 7950767 - DNA, 22 bp, Homo sapiens
ggctccagggagtggagagaag

SEQ ID NO: 7950768 - DNA, 22 bp, Homo sapiens
ggctccagggagtggagagaag

SEQ ID NO: 7950769 - DNA, 22 bp, Homo sapiens
ggctccaggctcctatttcact

SEQ ID NO: 7950770 - DNA, 22 bp, Homo sapiens
ggctaggcctcaggcctgcctg

SEQ ID NO: 7950771 - DNA, 22 bp, Homo sapiens
ggctaggcgggcacatggtgga

SEQ ID NO: 7950772 - DNA, 22 bp, Homo sapiens
ggctaggcgggcacatggtgga

SEQ ID NO: 7950773 - DNA, 22 bp, Homo sapiens
ggctaggcgggcacatggtgga

SEQ ID NO: 7950774 - DNA, 22 bp, Homo sapiens
ggctaggcgggcacatggtgga

SEQ ID NO: 7950775 - DNA, 22 bp, Homo sapiens
ggctaggctcacctggagagtt

SEQ ID NO: 7950776 - DNA, 22 bp, Homo sapiens
ggctccctgcctgtcctcagtc

SEQ ID NO: 7950777 - DNA, 22 bp, Homo sapiens
ggctccctgcctgtcctcagtc

SEQ ID NO: 7950778 - DNA, 22 bp, Homo sapiens
ggctccctgcctgtcctcagtc

SEQ ID NO: 7950779 - DNA, 22 bp, Homo sapiens
ggctccctgcctgtcctcagtc

SEQ ID NO: 7950780 - DNA, 22 bp, Homo sapiens
ggctccctggaaatcccgaggc

SEQ ID NO: 7950781 - DNA, 22 bp, Homo sapiens
ggctccctggaaatcccgaggc

SEQ ID NO: 7950782 - DNA, 21 bp, Homo sapiens
ggctccctggcaggggtctgg

SEQ ID NO: 7950783 - DNA, 21 bp, Homo sapiens
ggctccctggcaggggtctgg

SEQ ID NO: 7950784 - DNA, 22 bp, Homo sapiens
ggctccctggccctggggacac

SEQ ID NO: 7950785 - DNA, 22 bp, Homo sapiens
ggctccctgggggtcggagagt

SEQ ID NO: 7950786 - DNA, 22 bp, Homo sapiens
ggctccctgggggtcggagagt

SEQ ID NO: 7950787 - DNA, 22 bp, Homo sapiens
ggctccctgggtgctcctgctc

SEQ ID NO: 7950788 - DNA, 22 bp, Homo sapiens
ggctccctgcaacctccgcctc

SEQ ID NO: 7950789 - DNA, 22 bp, Homo sapiens
ggctccctgcaacctccgcctc

SEQ ID NO: 7950790 - DNA, 22 bp, Homo sapiens
ggctccctgcaacctccgcctc

SEQ ID NO: 7950791 - DNA, 17 bp, Homo sapiens
ggctccctgactatgga

SEQ ID NO: 7950792 - DNA, 17 bp, Homo sapiens
ggctccctgactatgga

SEQ ID NO: 7950793 - DNA, 17 bp, Homo sapiens
ggctccctgactatgga

SEQ ID NO: 7950794 - DNA, 17 bp, Homo sapiens
ggctccctgactatgga

SEQ ID NO: 7950795 - DNA, 22 bp, Homo sapiens
ggctccctcaccaccatcacat

SEQ ID NO: 7950796 - DNA, 22 bp, Homo sapiens
ggctccctcaccaccatcacat

SEQ ID NO: 7950797 - DNA, 22 bp, Homo sapiens
ggctccctcaccaccatcacat

SEQ ID NO: 7950798 - DNA, 23 bp, Homo sapiens
ggctccctcctagctttcccaat

SEQ ID NO: 7950799 - DNA, 22 bp, Homo sapiens
ggctccctagggagagtgggag

SEQ ID NO: 7950800 - DNA, 22 bp, Homo sapiens
ggctccccaggtccaggagctg

SEQ ID NO: 7950801 - DNA, 22 bp, Homo sapiens
ggctccccaggtccaggagctg

SEQ ID NO: 7950802 - DNA, 22 bp, Homo sapiens
ggctacagtggctcagtgctgg

SEQ ID NO: 7950803 - DNA, 22 bp, Homo sapiens
ggctacagtggcactgggcttt

SEQ ID NO: 7950804 - DNA, 22 bp, Homo sapiens
ggctacagtggctcagtgctgg

SEQ ID NO: 7950805 - DNA, 22 bp, Homo sapiens
ggctacagtggcactgggcttt

SEQ ID NO: 7950806 - DNA, 22 bp, Homo sapiens
ggctacagtggcactgggcttt

SEQ ID NO: 7950807 - DNA, 22 bp, Homo sapiens
ggctacagggcctggccaaggt

SEQ ID NO: 7950808 - DNA, 22 bp, Homo sapiens
ggctagaagtcagaggtcaaga

SEQ ID NO: 7950809 - DNA, 22 bp, Homo sapiens
ggctagaataattgacttcatt

SEQ ID NO: 7950810 - DNA, 22 bp, Homo sapiens
ggctagagtggaactggagcgg

SEQ ID NO: 7950811 - DNA, 22 bp, Homo sapiens
ggctagagtggaactggagcgg

SEQ ID NO: 7950812 - DNA, 22 bp, Homo sapiens
ggctactgtgatggtctgcaag

SEQ ID NO: 7950813 - DNA, 23 bp, Homo sapiens
ggctagagtggaggggaactgca

SEQ ID NO: 7950814 - DNA, 22 bp, Homo sapiens
ggctagagtggaactggagcgg

SEQ ID NO: 7950815 - DNA, 22 bp, Homo sapiens
ggctagagtggaactggagcgg

SEQ ID NO: 7950816 - DNA, 22 bp, Homo sapiens
ggctagagtggaactggagcgg

SEQ ID NO: 7950817 - DNA, 23 bp, Homo sapiens
ggctagagtggaggggaactgca

SEQ ID NO: 7950818 - DNA, 22 bp, Homo sapiens
ggctagattttggcattgctct

SEQ ID NO: 7950819 - DNA, 22 bp, Homo sapiens
ggctaggcctcaggcctgcctg

SEQ ID NO: 7950820 - DNA, 22 bp, Homo sapiens
ggctaggcaggctcagagccta

SEQ ID NO: 7950821 - DNA, 22 bp, Homo sapiens
ggctaggcaggctcagagccta

SEQ ID NO: 7950822 - DNA, 22 bp, Homo sapiens
ggctaggcaggctcagagccta

SEQ ID NO: 7950823 - DNA, 22 bp, Homo sapiens
ggctagcttagagtcatgctag

SEQ ID NO: 7950824 - DNA, 22 bp, Homo sapiens
ggctagcttagagtcatgctag

SEQ ID NO: 7950825 - DNA, 21 bp, Homo sapiens
ggctaggatgctggggtttcc

SEQ ID NO: 7950826 - DNA, 22 bp, Homo sapiens
ggctagctcctccgcgcatcca

SEQ ID NO: 7950827 - DNA, 22 bp, Homo sapiens
ggctagcttagagtcatgctag

SEQ ID NO: 7950828 - DNA, 22 bp, Homo sapiens
ggctagcaaggtagcagaatgc

SEQ ID NO: 7950829 - DNA, 22 bp, Homo sapiens
ggcggtggttgagaggacggcg

SEQ ID NO: 7950830 - DNA, 22 bp, Homo sapiens
ggcggtggttgagaggacggcg

SEQ ID NO: 7950831 - DNA, 22 bp, Homo sapiens
ggcggtggttgagaggacggcg

SEQ ID NO: 7950832 - DNA, 22 bp, Homo sapiens
ggcggtggttgagaggacggcg

SEQ ID NO: 7950833 - DNA, 22 bp, Homo sapiens
ggcggtggttgagaggacggcg

SEQ ID NO: 7950834 - DNA, 22 bp, Homo sapiens
ggcggtggttgagaggacggcg

SEQ ID NO: 7950835 - DNA, 22 bp, Homo sapiens
ggcggtggttgagaggacggcg

SEQ ID NO: 7950836 - DNA, 22 bp, Homo sapiens
ggcggtggcgtgaaggtggctg

SEQ ID NO: 7950837 - DNA, 22 bp, Homo sapiens
ggcgtgggaagtggggcttctg

SEQ ID NO: 7950838 - DNA, 22 bp, Homo sapiens
ggcgtgggaagtggggcttctg

SEQ ID NO: 7950839 - DNA, 22 bp, Homo sapiens
ggcgtgggaagtggggcttctg

SEQ ID NO: 7950840 - DNA, 22 bp, Homo sapiens
ggcgtgctgcccgggcctgctg

SEQ ID NO: 7950841 - DNA, 22 bp, Homo sapiens
ggcgtctgtttgaaggcaacgt

SEQ ID NO: 7950842 - DNA, 23 bp, Homo sapiens
ggcgtcggtcaggagagctggag

SEQ ID NO: 7950843 - DNA, 22 bp, Homo sapiens
ggcgtgggcgaggtgctctatc

SEQ ID NO: 7950844 - DNA, 22 bp, Homo sapiens
ggcgtggggccttctgcccgct

SEQ ID NO: 7950845 - DNA, 22 bp, Homo sapiens
ggcgtgggcgaggtgctctatc

SEQ ID NO: 7950846 - DNA, 22 bp, Homo sapiens
ggcgtgggcgaggtgctctatc

SEQ ID NO: 7950847 - DNA, 22 bp, Homo sapiens
ggctacagaggccgtgagcctg

SEQ ID NO: 7950848 - DNA, 22 bp, Homo sapiens
ggctacagcggggtggagacgg

SEQ ID NO: 7950849 - DNA, 22 bp, Homo sapiens
ggctacagcggggtggagacgg

SEQ ID NO: 7950850 - DNA, 22 bp, Homo sapiens
ggctacagaggccgtgagcctg

SEQ ID NO: 7950851 - DNA, 22 bp, Homo sapiens
ggctacactggctatgctggct

SEQ ID NO: 7950852 - DNA, 22 bp, Homo sapiens
ggctaaagatgtgttctttgga

SEQ ID NO: 7950853 - DNA, 22 bp, Homo sapiens
ggcgtttcaccatgttgaccag

SEQ ID NO: 7950854 - DNA, 22 bp, Homo sapiens
ggctaaggaacgcaggcttctc

SEQ ID NO: 7950855 - DNA, 22 bp, Homo sapiens
ggctaatatacccagctctgta

SEQ ID NO: 7950856 - DNA, 22 bp, Homo sapiens
ggctccctgggtgctcctgctc

SEQ ID NO: 7950857 - DNA, 22 bp, Homo sapiens
ggctccctgttctattccctgg

SEQ ID NO: 7950858 - DNA, 22 bp, Homo sapiens
ggctccctgggtgctcctgctc

SEQ ID NO: 7950859 - DNA, 22 bp, Homo sapiens
ggctccctgggtgctcctgctc

SEQ ID NO: 7950860 - DNA, 22 bp, Homo sapiens
ggctccctgttctattccctgg

SEQ ID NO: 7950861 - DNA, 22 bp, Homo sapiens
ggctcctctctggccgctcccg

SEQ ID NO: 7950862 - DNA, 22 bp, Homo sapiens
ggctcctctctggccgctcccg

SEQ ID NO: 7950863 - DNA, 22 bp, Homo sapiens
ggctcctgaaagactatgggaa

SEQ ID NO: 7950864 - DNA, 22 bp, Homo sapiens
ggctcctgaaagactatgggaa

SEQ ID NO: 7950865 - DNA, 22 bp, Homo sapiens
ggctcctgagaatgggccatca

SEQ ID NO: 7950866 - DNA, 22 bp, Homo sapiens
ggctcctgagaatgggccatca

SEQ ID NO: 7950867 - DNA, 22 bp, Homo sapiens
ggctcctgataggagaatgcgg

SEQ ID NO: 7950868 - DNA, 22 bp, Homo sapiens
ggctcctgataggagaatgcgg

SEQ ID NO: 7950869 - DNA, 22 bp, Homo sapiens
ggctcctgataggagaatgcgg

SEQ ID NO: 7950870 - DNA, 22 bp, Homo sapiens
ggctcctgataggagaatgcgg

SEQ ID NO: 7950871 - DNA, 22 bp, Homo sapiens
ggctcctgataggagaatgcgg

SEQ ID NO: 7950872 - DNA, 22 bp, Homo sapiens
ggctcctgagaatgggccatca

SEQ ID NO: 7950873 - DNA, 22 bp, Homo sapiens
ggctcctgaggaccaggcacag

SEQ ID NO: 7950874 - DNA, 22 bp, Homo sapiens
ggctcctgaggaccaggcacag

SEQ ID NO: 7950875 - DNA, 22 bp, Homo sapiens
ggctcctgaggaccaggcacag

SEQ ID NO: 7950876 - DNA, 22 bp, Homo sapiens
ggctcctgaggaccaggcacag

SEQ ID NO: 7950877 - DNA, 22 bp, Homo sapiens
ggctcctgaggaccaggcacag

SEQ ID NO: 7950878 - DNA, 22 bp, Homo sapiens
ggctcctgaggaccaggcacag

SEQ ID NO: 7950879 - DNA, 22 bp, Homo sapiens
ggctcctgaggaccaggcacag

SEQ ID NO: 7950880 - DNA, 22 bp, Homo sapiens
ggctctggggggaagtctgttg

SEQ ID NO: 7950881 - DNA, 22 bp, Homo sapiens
ggctctggggggaagtctgttg

SEQ ID NO: 7950882 - DNA, 22 bp, Homo sapiens
ggctctggggggaagtctgttg

SEQ ID NO: 7950883 - DNA, 22 bp, Homo sapiens
ggctctggggggaagtctgttg

SEQ ID NO: 7950884 - DNA, 22 bp, Homo sapiens
ggctctggggggaagtctgttg

SEQ ID NO: 7950885 - DNA, 22 bp, Homo sapiens
ggctctggggttggcccatctc

SEQ ID NO: 7950886 - DNA, 22 bp, Homo sapiens
ggctctggggggaagtctgttg

SEQ ID NO: 7950887 - DNA, 22 bp, Homo sapiens
ggctctggggttggcccatctc

SEQ ID NO: 7950888 - DNA, 22 bp, Homo sapiens
ggctctggggttggcccatctc

SEQ ID NO: 7950889 - DNA, 22 bp, Homo sapiens
ggctctgggtctgtggggagcg

SEQ ID NO: 7950890 - DNA, 22 bp, Homo sapiens
ggctctgggtctgtggggagcg

SEQ ID NO: 7950891 - DNA, 22 bp, Homo sapiens
ggctctgggtctgtggggagcg

SEQ ID NO: 7950892 - DNA, 22 bp, Homo sapiens
ggctctgggtctgtggggagcg

SEQ ID NO: 7950893 - DNA, 22 bp, Homo sapiens
ggctctgggtctgtggggagcg

SEQ ID NO: 7950894 - DNA, 22 bp, Homo sapiens
ggctctgggtctgtggggagcg

SEQ ID NO: 7950895 - DNA, 22 bp, Homo sapiens
ggctctgggtaaggcgtttgac

SEQ ID NO: 7950896 - DNA, 22 bp, Homo sapiens
ggctctggggttggcccatctc

SEQ ID NO: 7950897 - DNA, 22 bp, Homo sapiens
ggctctgggtaaggcgtttgac

SEQ ID NO: 7950898 - DNA, 22 bp, Homo sapiens
ggctctgggtaaggcgtttgac

SEQ ID NO: 7950899 - DNA, 22 bp, Homo sapiens
ggctctgggtaaggcgtttgac

SEQ ID NO: 7950900 - DNA, 22 bp, Homo sapiens
ggctctgggcctccaaggtctg

SEQ ID NO: 7950901 - DNA, 22 bp, Homo sapiens
ggctctgggcctccaaggtctg

SEQ ID NO: 7950902 - DNA, 22 bp, Homo sapiens
ggctctgggcctccaaggtctg

SEQ ID NO: 7950903 - DNA, 22 bp, Homo sapiens
ggctctgggcctccaaggtctg

SEQ ID NO: 7950904 - DNA, 22 bp, Homo sapiens
ggctctgggcctccaaggtctg

SEQ ID NO: 7950905 - DNA, 22 bp, Homo sapiens
ggctctggggaagctctcttca

SEQ ID NO: 7950906 - DNA, 22 bp, Homo sapiens
ggctctggggaagctctcttca

SEQ ID NO: 7950907 - DNA, 22 bp, Homo sapiens
ggctctggggaagctctcttca

SEQ ID NO: 7950908 - DNA, 22 bp, Homo sapiens
ggctctggggaagctctcttca

SEQ ID NO: 7950909 - DNA, 22 bp, Homo sapiens
ggctctggggaagctctcttca

SEQ ID NO: 7950910 - DNA, 22 bp, Homo sapiens
ggctctggggcctcctcccttg

SEQ ID NO: 7950911 - DNA, 22 bp, Homo sapiens
ggctctggggcctcctcccttg

SEQ ID NO: 7950912 - DNA, 22 bp, Homo sapiens
ggctctggggcctcctcccttg

SEQ ID NO: 7950913 - DNA, 22 bp, Homo sapiens
ggctctggggcctcctcccttg

SEQ ID NO: 7950914 - DNA, 22 bp, Homo sapiens
ggctctggggggaagtctgttg

SEQ ID NO: 7950915 - DNA, 22 bp, Homo sapiens
ggctctggggcctcctcccttg

SEQ ID NO: 7950916 - DNA, 22 bp, Homo sapiens
ggctgaggctcatgccatcttg

SEQ ID NO: 7950917 - DNA, 22 bp, Homo sapiens
ggctgagccatgggcactgcag

SEQ ID NO: 7950918 - DNA, 22 bp, Homo sapiens
ggctgagccatgggcactgcag

SEQ ID NO: 7950919 - DNA, 22 bp, Homo sapiens
ggctgagccatgggcactgcag

SEQ ID NO: 7950920 - DNA, 22 bp, Homo sapiens
ggctgagccatgggcactgcag

SEQ ID NO: 7950921 - DNA, 22 bp, Homo sapiens
ggctgagccatgggcactgcag

SEQ ID NO: 7950922 - DNA, 22 bp, Homo sapiens
ggctgagccactgcgcctggct

SEQ ID NO: 7950923 - DNA, 22 bp, Homo sapiens
ggctgagccatgggcactgcag

SEQ ID NO: 7950924 - DNA, 22 bp, Homo sapiens
ggctgagccactgcgcctggct

SEQ ID NO: 7950925 - DNA, 22 bp, Homo sapiens
ggctgagccactgcgcctggct

SEQ ID NO: 7950926 - DNA, 22 bp, Homo sapiens
ggctcttcacacagtgatgtca

SEQ ID NO: 7950927 - DNA, 22 bp, Homo sapiens
ggctcttcacacagtgatgtca

SEQ ID NO: 7950928 - DNA, 22 bp, Homo sapiens
ggctcttccgccaccagccaca

SEQ ID NO: 7950929 - DNA, 22 bp, Homo sapiens
ggctcttccgccaccagccaca

SEQ ID NO: 7950930 - DNA, 22 bp, Homo sapiens
ggctcttcacacagtgatgtca

SEQ ID NO: 7950931 - DNA, 22 bp, Homo sapiens
ggctcttctacttcagatgggg

SEQ ID NO: 7950932 - DNA, 22 bp, Homo sapiens
ggctcttctacttcagatgggg

SEQ ID NO: 7950933 - DNA, 23 bp, Homo sapiens
ggctctgtgctgggcctgcagga

SEQ ID NO: 7950934 - DNA, 23 bp, Homo sapiens
ggctctgtgctgggcctgcagga

SEQ ID NO: 7950935 - DNA, 23 bp, Homo sapiens
ggctctgtgctgggcctgcagga

SEQ ID NO: 7950936 - DNA, 23 bp, Homo sapiens
ggctctgtgctaattgctgaaaa

SEQ ID NO: 7950937 - DNA, 22 bp, Homo sapiens
ggctctgtggctggccatgatg

SEQ ID NO: 7950938 - DNA, 23 bp, Homo sapiens
ggctctgtgctgggcctgcagga

SEQ ID NO: 7950939 - DNA, 22 bp, Homo sapiens
ggctctgtgtctccacccaaat

SEQ ID NO: 7950940 - DNA, 22 bp, Homo sapiens
ggctctgtaaagtgacacctgc

SEQ ID NO: 7950941 - DNA, 22 bp, Homo sapiens
ggctctggttgaccatgatggc

SEQ ID NO: 7950942 - DNA, 22 bp, Homo sapiens
ggctctgtaagtgttgcaggta

SEQ ID NO: 7950943 - DNA, 22 bp, Homo sapiens
ggctctgtgagaacaaaggcta

SEQ ID NO: 7950944 - DNA, 22 bp, Homo sapiens
ggctctgtcacctatgagctga

SEQ ID NO: 7950945 - DNA, 22 bp, Homo sapiens
ggctctgggtctgtggggagcg

SEQ ID NO: 7950946 - DNA, 22 bp, Homo sapiens
ggctctgggtctgtggggagcg

SEQ ID NO: 7950947 - DNA, 22 bp, Homo sapiens
ggctctgggtctgtggggagcg

SEQ ID NO: 7950948 - DNA, 17 bp, Homo sapiens
ggctctgggtgtcacat

SEQ ID NO: 7950949 - DNA, 17 bp, Homo sapiens
ggctctgggtgtcacat

SEQ ID NO: 7950950 - DNA, 17 bp, Homo sapiens
ggctctgggtgtcacat

SEQ ID NO: 7950951 - DNA, 22 bp, Homo sapiens
ggctctgggtctgtggggagcg

SEQ ID NO: 7950952 - DNA, 17 bp, Homo sapiens
ggctctgggtgtcacat

SEQ ID NO: 7950953 - DNA, 17 bp, Homo sapiens
ggctctgggtgtcacat

SEQ ID NO: 7950954 - DNA, 17 bp, Homo sapiens
ggctctgggtgtcacat

SEQ ID NO: 7950955 - DNA, 17 bp, Homo sapiens
ggctctgggtgtcacat

SEQ ID NO: 7950956 - DNA, 22 bp, Homo sapiens
ggctctgggtgtgaccttgggt

SEQ ID NO: 7950957 - DNA, 22 bp, Homo sapiens
ggctctgggtgtgaccttgggt

SEQ ID NO: 7950958 - DNA, 22 bp, Homo sapiens
ggctctgggtgtgaccttgggt

SEQ ID NO: 7950959 - DNA, 22 bp, Homo sapiens
ggctctgggtgtgaccttgggt

SEQ ID NO: 7950960 - DNA, 22 bp, Homo sapiens
ggctctgggtgtgaccttgggt

SEQ ID NO: 7950961 - DNA, 22 bp, Homo sapiens
ggctctgggtgtgaccttgggt

SEQ ID NO: 7950962 - DNA, 22 bp, Homo sapiens
ggctctgggttctgcaatgcgt

SEQ ID NO: 7950963 - DNA, 22 bp, Homo sapiens
ggctctgggttctgcaatgcgt

SEQ ID NO: 7950964 - DNA, 22 bp, Homo sapiens
ggctctgggttctgcaatgcgt

SEQ ID NO: 7950965 - DNA, 22 bp, Homo sapiens
ggctctgggttctgcaatgcgt

SEQ ID NO: 7950966 - DNA, 22 bp, Homo sapiens
ggctctgggtgtgaccttgggt

SEQ ID NO: 7950967 - DNA, 22 bp, Homo sapiens
ggctctggtgtgaagcagcctc

SEQ ID NO: 7950968 - DNA, 22 bp, Homo sapiens
ggctctggtgtgaagcagcctc

SEQ ID NO: 7950969 - DNA, 22 bp, Homo sapiens
ggctctggtgtgaagcagcctc

SEQ ID NO: 7950970 - DNA, 22 bp, Homo sapiens
ggctctggtgtgaagcagcctc

SEQ ID NO: 7950971 - DNA, 22 bp, Homo sapiens
ggctctggttgaccatgatggc

SEQ ID NO: 7950972 - DNA, 22 bp, Homo sapiens
ggctctggttgaccatgatggc

SEQ ID NO: 7950973 - DNA, 22 bp, Homo sapiens
ggctctggttgaccatgatggc

SEQ ID NO: 7950974 - DNA, 22 bp, Homo sapiens
ggctctggttgaccatgatggc

SEQ ID NO: 7950975 - DNA, 22 bp, Homo sapiens
ggctctggtgtgaagcagcctc

SEQ ID NO: 7950976 - DNA, 22 bp, Homo sapiens
ggctctggtgtgaagcagcctc

SEQ ID NO: 7950977 - DNA, 22 bp, Homo sapiens
ggctgctgtttcagagactgtt

SEQ ID NO: 7950978 - DNA, 22 bp, Homo sapiens
ggctgctgtttcagagactgtt

SEQ ID NO: 7950979 - DNA, 20 bp, Homo sapiens
ggctgctgtgggcagagagg

SEQ ID NO: 7950980 - DNA, 20 bp, Homo sapiens
ggctgctgtgggcagagagg

SEQ ID NO: 7950981 - DNA, 20 bp, Homo sapiens
ggctgctgtgggcagagagg

SEQ ID NO: 7950982 - DNA, 22 bp, Homo sapiens
ggctgctgggtcatgatgcaga

SEQ ID NO: 7950983 - DNA, 20 bp, Homo sapiens
ggctgctgtgggcagagagg

SEQ ID NO: 7950984 - DNA, 20 bp, Homo sapiens
ggctgctgtgggcagagagg

SEQ ID NO: 7950985 - DNA, 22 bp, Homo sapiens
ggctgcttaaacagatgtgctg

SEQ ID NO: 7950986 - DNA, 22 bp, Homo sapiens
ggctgctgtttcagagactgtt

SEQ ID NO: 7950987 - DNA, 22 bp, Homo sapiens
ggctgctgtttcagagactgtt

SEQ ID NO: 7950988 - DNA, 22 bp, Homo sapiens
ggctgagttctcttgctgaatc

SEQ ID NO: 7950989 - DNA, 22 bp, Homo sapiens
ggctgctggggacgtgggagag

SEQ ID NO: 7950990 - DNA, 22 bp, Homo sapiens
ggctgctggggacgtgggagag

SEQ ID NO: 7950991 - DNA, 22 bp, Homo sapiens
ggctgagttgagaggattactt

SEQ ID NO: 7950992 - DNA, 22 bp, Homo sapiens
ggctgagttgagaggattactt

SEQ ID NO: 7950993 - DNA, 22 bp, Homo sapiens
ggctgagttctcttgctgaatc

SEQ ID NO: 7950994 - DNA, 22 bp, Homo sapiens
ggctgagttctcttgctgaatc

SEQ ID NO: 7950995 - DNA, 22 bp, Homo sapiens
ggctgctggggacgtgggagag

SEQ ID NO: 7950996 - DNA, 22 bp, Homo sapiens
ggctgctggggacgtgggagag

SEQ ID NO: 7950997 - DNA, 21 bp, Homo sapiens
ggctgctgggggttggcacag

SEQ ID NO: 7950998 - DNA, 22 bp, Homo sapiens
ggctgctgggtcatgatgcaga

SEQ ID NO: 7950999 - DNA, 22 bp, Homo sapiens
ggctgctgggtcatgatgcaga

SEQ ID NO: 7951000 - DNA, 22 bp, Homo sapiens
ggctggacatagacatagccat

SEQ ID NO: 7951001 - DNA, 22 bp, Homo sapiens
ggctggacatagacatagccat

SEQ ID NO: 7951002 - DNA, 22 bp, Homo sapiens
ggctggacatagacatagccat

SEQ ID NO: 7951003 - DNA, 22 bp, Homo sapiens
ggctggacatagacatagccat

SEQ ID NO: 7951004 - DNA, 22 bp, Homo sapiens
ggctggaatgtgtggatgtgat

SEQ ID NO: 7951005 - DNA, 21 bp, Homo sapiens
ggctggacatcccaggagact

SEQ ID NO: 7951006 - DNA, 21 bp, Homo sapiens
ggctggacatcccaggagact

SEQ ID NO: 7951007 - DNA, 21 bp, Homo sapiens
ggctggacatcccaggagact

SEQ ID NO: 7951008 - DNA, 21 bp, Homo sapiens
ggctggacatcccaggagact

SEQ ID NO: 7951009 - DNA, 21 bp, Homo sapiens
ggctggacatcccaggagact

SEQ ID NO: 7951010 - DNA, 20 bp, Homo sapiens
ggctggaagtgtgggtttgg

SEQ ID NO: 7951011 - DNA, 22 bp, Homo sapiens
ggctggaagtccaagatcaagg

SEQ ID NO: 7951012 - DNA, 22 bp, Homo sapiens
ggctggaaggtagaagatgagg

SEQ ID NO: 7951013 - DNA, 22 bp, Homo sapiens
ggctggaagtccaagatcaaga

SEQ ID NO: 7951014 - DNA, 22 bp, Homo sapiens
ggctggaatgtgtggatgtgat

SEQ ID NO: 7951015 - DNA, 22 bp, Homo sapiens
ggctggaatgtgtggatgtgat

SEQ ID NO: 7951016 - DNA, 22 bp, Homo sapiens
ggctggaatgcaactgtgtgtt

SEQ ID NO: 7951017 - DNA, 22 bp, Homo sapiens
ggctggaaaagacaaagctatt

SEQ ID NO: 7951018 - DNA, 22 bp, Homo sapiens
ggctggaaactcaggtagggtt

SEQ ID NO: 7951019 - DNA, 22 bp, Homo sapiens
ggctggaaactcaggtagggtt

SEQ ID NO: 7951020 - DNA, 23 bp, Homo sapiens
ggctggaagaaaacagaattgtt

SEQ ID NO: 7951021 - DNA, 22 bp, Homo sapiens
ggctggaaccagagtgaggcag

SEQ ID NO: 7951022 - DNA, 22 bp, Homo sapiens
ggctggaagagactgaggacac

SEQ ID NO: 7951023 - DNA, 22 bp, Homo sapiens
ggctggaaggtagaagatgagg

SEQ ID NO: 7951024 - DNA, 22 bp, Homo sapiens
ggctgagggtatagctgtccca

SEQ ID NO: 7951025 - DNA, 22 bp, Homo sapiens
ggctgagggtatagctgtccca

SEQ ID NO: 7951026 - DNA, 22 bp, Homo sapiens
ggctgagggtatagctgtccca

SEQ ID NO: 7951027 - DNA, 22 bp, Homo sapiens
ggctgagggtatagctgtccca

SEQ ID NO: 7951028 - DNA, 22 bp, Homo sapiens
ggctgagggtcccagaccctaa

SEQ ID NO: 7951029 - DNA, 22 bp, Homo sapiens
ggctgagggtatagctgtccca

SEQ ID NO: 7951030 - DNA, 22 bp, Homo sapiens
ggctgaggggcccagaggaaca

SEQ ID NO: 7951031 - DNA, 22 bp, Homo sapiens
ggctgagggtatagctgtccca

SEQ ID NO: 7951032 - DNA, 22 bp, Homo sapiens
ggctgagggtatagctgtccca

SEQ ID NO: 7951033 - DNA, 22 bp, Homo sapiens
ggctgagggtatagctgtccca

SEQ ID NO: 7951034 - DNA, 22 bp, Homo sapiens
ggctgagggccagggctagtct

SEQ ID NO: 7951035 - DNA, 22 bp, Homo sapiens
ggctgagggccagggctagtct

SEQ ID NO: 7951036 - DNA, 22 bp, Homo sapiens
ggctgagggccagggctagtct

SEQ ID NO: 7951037 - DNA, 22 bp, Homo sapiens
ggctgagggccagggctagtct

SEQ ID NO: 7951038 - DNA, 22 bp, Homo sapiens
ggctgagggccagggctagtct

SEQ ID NO: 7951039 - DNA, 22 bp, Homo sapiens
ggctgaggggcccagaggaaca

SEQ ID NO: 7951040 - DNA, 22 bp, Homo sapiens
ggctgaggggcccagaggaaca

SEQ ID NO: 7951041 - DNA, 22 bp, Homo sapiens
ggctgaggggcccagaggaaca

SEQ ID NO: 7951042 - DNA, 22 bp, Homo sapiens
ggctgagggccagggctagtct

SEQ ID NO: 7951043 - DNA, 22 bp, Homo sapiens
ggctgaggggcccagaggaaca

SEQ ID NO: 7951044 - DNA, 22 bp, Homo sapiens
ggctgaggggcccagaggaaca

SEQ ID NO: 7951045 - DNA, 18 bp, Homo sapiens
ggctgaggttgactagaa

SEQ ID NO: 7951046 - DNA, 22 bp, Homo sapiens
ggctgaggtgtggggaactata

SEQ ID NO: 7951047 - DNA, 18 bp, Homo sapiens
ggctgaggttgactagaa

SEQ ID NO: 7951048 - DNA, 18 bp, Homo sapiens
ggctgaggttgactagaa

SEQ ID NO: 7951049 - DNA, 18 bp, Homo sapiens
ggctgaggttgactagaa

SEQ ID NO: 7951050 - DNA, 18 bp, Homo sapiens
ggctgaggttgactagaa

SEQ ID NO: 7951051 - DNA, 22 bp, Homo sapiens
ggctgagtggaggtagccctgt

SEQ ID NO: 7951052 - DNA, 22 bp, Homo sapiens
ggctgagtctgtgacccatgcg

SEQ ID NO: 7951053 - DNA, 22 bp, Homo sapiens
ggctgagtggctgggtctagtt

SEQ ID NO: 7951054 - DNA, 22 bp, Homo sapiens
ggctgagtggctgggtctagtt

SEQ ID NO: 7951055 - DNA, 22 bp, Homo sapiens
ggctgagggttaagatcagaca

SEQ ID NO: 7951056 - DNA, 22 bp, Homo sapiens
ggctgagggttaagatcagaca

SEQ ID NO: 7951057 - DNA, 22 bp, Homo sapiens
ggctgagggttaagatcagaca

SEQ ID NO: 7951058 - DNA, 22 bp, Homo sapiens
ggctgagggttaagatcagaca

SEQ ID NO: 7951059 - DNA, 22 bp, Homo sapiens
ggctgagggttaagatcagaca

SEQ ID NO: 7951060 - DNA, 22 bp, Homo sapiens
ggctgagggtcccagaccctaa

SEQ ID NO: 7951061 - DNA, 22 bp, Homo sapiens
ggctgaggtgtggggaactata

SEQ ID NO: 7951062 - DNA, 18 bp, Homo sapiens
ggctgaggttgactagaa

SEQ ID NO: 7951063 - DNA, 22 bp, Homo sapiens
ggctgaggtgtggggaactata

SEQ ID NO: 7951064 - DNA, 22 bp, Homo sapiens
ggctgaggtgtggggaactata

SEQ ID NO: 7951065 - DNA, 22 bp, Homo sapiens
ggctgtgattggtggatgtgaa

SEQ ID NO: 7951066 - DNA, 22 bp, Homo sapiens
ggctgtgagcaggcagaatgct

SEQ ID NO: 7951067 - DNA, 22 bp, Homo sapiens
ggctgtgacaaggctgcgggaa

SEQ ID NO: 7951068 - DNA, 22 bp, Homo sapiens
ggctgtgacaaggctgcgggaa

SEQ ID NO: 7951069 - DNA, 22 bp, Homo sapiens
ggctggtggggaaagaggacca

SEQ ID NO: 7951070 - DNA, 22 bp, Homo sapiens
ggctggtgttacagtcggcagc

SEQ ID NO: 7951071 - DNA, 22 bp, Homo sapiens
ggctggtggggaaagaggacca

SEQ ID NO: 7951072 - DNA, 22 bp, Homo sapiens
ggctggtggggaaagaggacca

SEQ ID NO: 7951073 - DNA, 22 bp, Homo sapiens
ggctggtggggaaagaggacca

SEQ ID NO: 7951074 - DNA, 22 bp, Homo sapiens
ggctggtggggaaagaggacca

SEQ ID NO: 7951075 - DNA, 22 bp, Homo sapiens
ggctggtggggaaagaggacca

SEQ ID NO: 7951076 - DNA, 22 bp, Homo sapiens
ggctggtggggaaagaggacca

SEQ ID NO: 7951077 - DNA, 22 bp, Homo sapiens
ggctgtgcagggcagagtctca

SEQ ID NO: 7951078 - DNA, 22 bp, Homo sapiens
ggctgtgcagggcagagtctca

SEQ ID NO: 7951079 - DNA, 17 bp, Homo sapiens
ggctgtgccaggtgaga

SEQ ID NO: 7951080 - DNA, 17 bp, Homo sapiens
ggctgtgccaggtgaga

SEQ ID NO: 7951081 - DNA, 17 bp, Homo sapiens
ggctgtgccaggtgaga

SEQ ID NO: 7951082 - DNA, 22 bp, Homo sapiens
ggctgtgcagggcagagtctca

SEQ ID NO: 7951083 - DNA, 22 bp, Homo sapiens
ggctgtgccctcacatggggca

SEQ ID NO: 7951084 - DNA, 20 bp, Homo sapiens
ggctgtgcccttccgtggcc

SEQ ID NO: 7951085 - DNA, 20 bp, Homo sapiens
ggctgtgcccttccgtggcc

SEQ ID NO: 7951086 - DNA, 22 bp, Homo sapiens
ggctgtgccctcacatggggca

SEQ ID NO: 7951087 - DNA, 22 bp, Homo sapiens
ggctgtgccctcacatggggca

SEQ ID NO: 7951088 - DNA, 21 bp, Homo sapiens
ggctggtcgcgtgcatgtctc

SEQ ID NO: 7951089 - DNA, 22 bp, Homo sapiens
ggctggtctcagtgctgggttc

SEQ ID NO: 7951090 - DNA, 22 bp, Homo sapiens
ggctggtctcagtgctgggttc

SEQ ID NO: 7951091 - DNA, 22 bp, Homo sapiens
ggctggtctccaacccccgatc

SEQ ID NO: 7951092 - DNA, 22 bp, Homo sapiens
ggctggtctccaacccccgatc

SEQ ID NO: 7951093 - DNA, 22 bp, Homo sapiens
ggctggtgagttcagagaaccc

SEQ ID NO: 7951094 - DNA, 22 bp, Homo sapiens
ggctggtgagttcagagaaccc

SEQ ID NO: 7951095 - DNA, 22 bp, Homo sapiens
ggctggtgagttcagagaaccc

SEQ ID NO: 7951096 - DNA, 22 bp, Homo sapiens
ggctggtgagttcagagaaccc

SEQ ID NO: 7951097 - DNA, 22 bp, Homo sapiens
ggctggtggggaaagaggacca

SEQ ID NO: 7951098 - DNA, 23 bp, Homo sapiens
ggctggtgcccttggccagtcgg

SEQ ID NO: 7951099 - DNA, 23 bp, Homo sapiens
ggctggtgcccttggccagtcgg

SEQ ID NO: 7951100 - DNA, 23 bp, Homo sapiens
ggctggtgcccttggccagtcgg

SEQ ID NO: 7951101 - DNA, 23 bp, Homo sapiens
ggctggtgcccttggccagtcgg

SEQ ID NO: 7951102 - DNA, 23 bp, Homo sapiens
ggctggtgcccttggccagtcgg

SEQ ID NO: 7951103 - DNA, 23 bp, Homo sapiens
ggctggtgcccttggccagtcgg

SEQ ID NO: 7951104 - DNA, 22 bp, Homo sapiens
ggctggtcccgggtcctccggc

SEQ ID NO: 7951105 - DNA, 22 bp, Homo sapiens
ggctggtcctttctctgtccta

SEQ ID NO: 7951106 - DNA, 22 bp, Homo sapiens
ggctggtcccgggtcctccggc

SEQ ID NO: 7951107 - DNA, 22 bp, Homo sapiens
ggctggtcccgggtcctccggc

SEQ ID NO: 7951108 - DNA, 22 bp, Homo sapiens
ggctggtcctttctctgtccta

SEQ ID NO: 7951109 - DNA, 21 bp, Homo sapiens
ggctggtcgcgtgcatgtctc

SEQ ID NO: 7951110 - DNA, 21 bp, Homo sapiens
ggctggtcgcgtgcatgtctc

SEQ ID NO: 7951111 - DNA, 22 bp, Homo sapiens
ggctggtcacaccactgcaggg

SEQ ID NO: 7951112 - DNA, 22 bp, Homo sapiens
ggctggtcacaccactgcaggg

SEQ ID NO: 7951113 - DNA, 22 bp, Homo sapiens
ggctggtcacaccactgcaggg

SEQ ID NO: 7951114 - DNA, 22 bp, Homo sapiens
ggctggtcacaccactgcaggg

SEQ ID NO: 7951115 - DNA, 22 bp, Homo sapiens
ggctggtcacaccactgcaggg

SEQ ID NO: 7951116 - DNA, 22 bp, Homo sapiens
ggctggtcaggaaactaggctc

SEQ ID NO: 7951117 - DNA, 22 bp, Homo sapiens
ggctggtcaggaaactaggctc

SEQ ID NO: 7951118 - DNA, 22 bp, Homo sapiens
ggctgggttatttatggccaag

SEQ ID NO: 7951119 - DNA, 22 bp, Homo sapiens
ggctgggttctgagaaagagta

SEQ ID NO: 7951120 - DNA, 22 bp, Homo sapiens
ggctgggttctgagaaagagta

SEQ ID NO: 7951121 - DNA, 22 bp, Homo sapiens
ggctgggttctgagaaagagta

SEQ ID NO: 7951122 - DNA, 22 bp, Homo sapiens
ggctgggttatttatggccaag

SEQ ID NO: 7951123 - DNA, 22 bp, Homo sapiens
ggctgggttctgagaaagagta

SEQ ID NO: 7951124 - DNA, 22 bp, Homo sapiens
ggctgggtttgactcctggctt

SEQ ID NO: 7951125 - DNA, 22 bp, Homo sapiens
ggctggagacaacgtcctgccc

SEQ ID NO: 7951126 - DNA, 22 bp, Homo sapiens
ggctggagacaacgtcctgccc

SEQ ID NO: 7951127 - DNA, 22 bp, Homo sapiens
ggctggagacaacgtcctgccc

SEQ ID NO: 7951128 - DNA, 22 bp, Homo sapiens
ggctgggctgctgggtcagagc

SEQ ID NO: 7951129 - DNA, 22 bp, Homo sapiens
ggctggagacaacgtcctgccc

SEQ ID NO: 7951130 - DNA, 22 bp, Homo sapiens
ggctggagaagggtggttgaca

SEQ ID NO: 7951131 - DNA, 22 bp, Homo sapiens
ggctgggtacagggcagtgtgc

SEQ ID NO: 7951132 - DNA, 22 bp, Homo sapiens
ggctgggtacagggcagtgtgc

SEQ ID NO: 7951133 - DNA, 22 bp, Homo sapiens
ggctgggtacagggcagtgtgc

SEQ ID NO: 7951134 - DNA, 22 bp, Homo sapiens
ggctgggtacagggcagtgtgc

SEQ ID NO: 7951135 - DNA, 21 bp, Homo sapiens
ggctgggtcatgcagctggcc

SEQ ID NO: 7951136 - DNA, 21 bp, Homo sapiens
ggctgggtcatgcagctggcc

SEQ ID NO: 7951137 - DNA, 21 bp, Homo sapiens
ggctgggtcatgcagctggcc

SEQ ID NO: 7951138 - DNA, 21 bp, Homo sapiens
ggctgggtcatgcagctggcc

SEQ ID NO: 7951139 - DNA, 21 bp, Homo sapiens
ggctgggtcatgcagctggcc

SEQ ID NO: 7951140 - DNA, 22 bp, Homo sapiens
ggctgggtaccctgtttcccct

SEQ ID NO: 7951141 - DNA, 22 bp, Homo sapiens
ggctgggtcccagctgggagga

SEQ ID NO: 7951142 - DNA, 22 bp, Homo sapiens
ggctgggtcccagctgggagga

SEQ ID NO: 7951143 - DNA, 22 bp, Homo sapiens
ggctgggtcccagctgggagga

SEQ ID NO: 7951144 - DNA, 22 bp, Homo sapiens
ggctgggtcccagctgggagga

SEQ ID NO: 7951145 - DNA, 21 bp, Homo sapiens
ggctgggtcatgcagctggcc

SEQ ID NO: 7951146 - DNA, 21 bp, Homo sapiens
ggctgggtcatgcagctggcc

SEQ ID NO: 7951147 - DNA, 22 bp, Homo sapiens
ggctgggtcccagctgggagga

SEQ ID NO: 7951148 - DNA, 22 bp, Homo sapiens
ggctgggtcccagctgggagga

SEQ ID NO: 7951149 - DNA, 22 bp, Homo sapiens
ggctgggtcccagctgggagga

SEQ ID NO: 7951150 - DNA, 19 bp, Homo sapiens
ggctgggtctggcaggttc

SEQ ID NO: 7951151 - DNA, 19 bp, Homo sapiens
ggctgggtctggcaggttc

SEQ ID NO: 7951152 - DNA, 22 bp, Homo sapiens
ggctgggttatttatggccaag

SEQ ID NO: 7951153 - DNA, 19 bp, Homo sapiens
ggctgggtctggcaggttc

SEQ ID NO: 7951154 - DNA, 19 bp, Homo sapiens
ggctgggtctggcaggttc

SEQ ID NO: 7951155 - DNA, 19 bp, Homo sapiens
ggctgggtctggcaggttc

SEQ ID NO: 7951156 - DNA, 19 bp, Homo sapiens
ggctgggtctggcaggttc

SEQ ID NO: 7951157 - DNA, 19 bp, Homo sapiens
ggctggagaaaggaatcag

SEQ ID NO: 7951158 - DNA, 19 bp, Homo sapiens
ggctggagaaaggaatcag

SEQ ID NO: 7951159 - DNA, 19 bp, Homo sapiens
ggctggagaaaggaatcag

SEQ ID NO: 7951160 - DNA, 19 bp, Homo sapiens
ggctggagaaaggaatcag

SEQ ID NO: 7951161 - DNA, 19 bp, Homo sapiens
ggctggagaaaggaatcag

SEQ ID NO: 7951162 - DNA, 19 bp, Homo sapiens
ggctggagaaaggaatcag

SEQ ID NO: 7951163 - DNA, 19 bp, Homo sapiens
ggctggagaaaggaatcag

SEQ ID NO: 7951164 - DNA, 19 bp, Homo sapiens
ggctggagaaaggaatcag

SEQ ID NO: 7951165 - DNA, 19 bp, Homo sapiens
ggctggagaaaggaatcag

SEQ ID NO: 7951166 - DNA, 22 bp, Homo sapiens
ggctggagaagggtggttgaca

SEQ ID NO: 7951167 - DNA, 19 bp, Homo sapiens
ggctggagaaaggaatcag

SEQ ID NO: 7951168 - DNA, 22 bp, Homo sapiens
ggctggagaagggtggttgaca

SEQ ID NO: 7951169 - DNA, 22 bp, Homo sapiens
ggctggagaagggtggttgaca

SEQ ID NO: 7951170 - DNA, 22 bp, Homo sapiens
ggctggagaagggtggttgaca

SEQ ID NO: 7951171 - DNA, 22 bp, Homo sapiens
ggctggagaagggtggttgaca

SEQ ID NO: 7951172 - DNA, 22 bp, Homo sapiens
ggctggagaagggtggttgaca

SEQ ID NO: 7951173 - DNA, 22 bp, Homo sapiens
ggctggagaagggtggttgaca

SEQ ID NO: 7951174 - DNA, 19 bp, Homo sapiens
ggctggagaaaggaatcag

SEQ ID NO: 7951175 - DNA, 19 bp, Homo sapiens
ggctggagaaaggaatcag

SEQ ID NO: 7951176 - DNA, 19 bp, Homo sapiens
ggctggagaaaggaatcag

SEQ ID NO: 7951177 - DNA, 22 bp, Homo sapiens
ggctggaccatgctgccccttc

SEQ ID NO: 7951178 - DNA, 22 bp, Homo sapiens
ggctggacatgagcttggcagt

SEQ ID NO: 7951179 - DNA, 22 bp, Homo sapiens
ggctggacatgagcttggcagt

SEQ ID NO: 7951180 - DNA, 22 bp, Homo sapiens
ggctggacatgagcttggcagt

SEQ ID NO: 7951181 - DNA, 22 bp, Homo sapiens
ggctggactctgggcctctcca

SEQ ID NO: 7951182 - DNA, 22 bp, Homo sapiens
ggctggactctgggcctctcca

SEQ ID NO: 7951183 - DNA, 22 bp, Homo sapiens
ggctggactgcctcccagagtc

SEQ ID NO: 7951184 - DNA, 22 bp, Homo sapiens
ggctggactttctgctgggctc

SEQ ID NO: 7951185 - DNA, 22 bp, Homo sapiens
ggctggactttttgcaggtcat

SEQ ID NO: 7951186 - DNA, 21 bp, Homo sapiens
ggctggactgtgctttccttc

SEQ ID NO: 7951187 - DNA, 22 bp, Homo sapiens
ggctggactttctgctgggctc

SEQ ID NO: 7951188 - DNA, 22 bp, Homo sapiens
ggctggactttctgctgggctc

SEQ ID NO: 7951189 - DNA, 22 bp, Homo sapiens
ggctggactttctgctgggctc

SEQ ID NO: 7951190 - DNA, 22 bp, Homo sapiens
ggctggactttctgctgggctc

SEQ ID NO: 7951191 - DNA, 19 bp, Homo sapiens
ttccaccatcactctgttt

SEQ ID NO: 7951192 - DNA, 22 bp, Homo sapiens
ttccaccaggagatatttcaaa

SEQ ID NO: 7951193 - DNA, 22 bp, Homo sapiens
ttccaccaggagatatttcaaa

SEQ ID NO: 7951194 - DNA, 22 bp, Homo sapiens
ttccaaattccaatcccctgaa

SEQ ID NO: 7951195 - DNA, 22 bp, Homo sapiens
ttccaaattaaaatgtacaatg

SEQ ID NO: 7951196 - DNA, 22 bp, Homo sapiens
ttccaaattaaaatgtacaatg

SEQ ID NO: 7951197 - DNA, 22 bp, Homo sapiens
ttccacggtggcaaaggctgga

SEQ ID NO: 7951198 - DNA, 22 bp, Homo sapiens
ttccactctacacactgctggc

SEQ ID NO: 7951199 - DNA, 22 bp, Homo sapiens
ttccactctacacactgctggc

SEQ ID NO: 7951200 - DNA, 22 bp, Homo sapiens
ttccactctatgatagaagggt

SEQ ID NO: 7951201 - DNA, 22 bp, Homo sapiens
cgggaaagttccacagatggat

SEQ ID NO: 7951202 - DNA, 22 bp, Homo sapiens
cgggaaggtggaggttgcagtg

SEQ ID NO: 7951203 - DNA, 21 bp, Homo sapiens
cgggaaggaggttctgaccct

SEQ ID NO: 7951204 - DNA, 22 bp, Homo sapiens
cgggaaggtggaggttgcagtg

SEQ ID NO: 7951205 - DNA, 22 bp, Homo sapiens
cgggagcctctgggtcacactg

SEQ ID NO: 7951206 - DNA, 22 bp, Homo sapiens
cgggagcacgggaggcggagct

SEQ ID NO: 7951207 - DNA, 22 bp, Homo sapiens
cgggagcacgggaggcggagct

SEQ ID NO: 7951208 - DNA, 22 bp, Homo sapiens
ttccaaattaaaatgtacaatg

SEQ ID NO: 7951209 - DNA, 22 bp, Homo sapiens
cgggaggaaaggcgaggctctg

SEQ ID NO: 7951210 - DNA, 22 bp, Homo sapiens
cgggaggaaaggcgaggctctg

SEQ ID NO: 7951211 - DNA, 22 bp, Homo sapiens
cggctgggttcggctgcaggcc

SEQ ID NO: 7951212 - DNA, 22 bp, Homo sapiens
cggctgggtagaggtgccgggt

SEQ ID NO: 7951213 - DNA, 22 bp, Homo sapiens
cggctgggtagaggtgccgggt

SEQ ID NO: 7951214 - DNA, 22 bp, Homo sapiens
cggctgggttcggctgcaggcc

SEQ ID NO: 7951215 - DNA, 22 bp, Homo sapiens
cggctgggttcggctgcaggcc

SEQ ID NO: 7951216 - DNA, 22 bp, Homo sapiens
cggctggtgtcgggcacagcaa

SEQ ID NO: 7951217 - DNA, 22 bp, Homo sapiens
cggctggtgtcgggcacagcaa

SEQ ID NO: 7951218 - DNA, 22 bp, Homo sapiens
cggctggtgtcgggcacagcaa

SEQ ID NO: 7951219 - DNA, 22 bp, Homo sapiens
cggctggtgtcgggcacagcaa

SEQ ID NO: 7951220 - DNA, 22 bp, Homo sapiens
cggctgggttcggctgcaggcc

SEQ ID NO: 7951221 - DNA, 22 bp, Homo sapiens
cggctggtgtcgggcacagcaa

SEQ ID NO: 7951222 - DNA, 22 bp, Homo sapiens
cggctggtgtcgggcacagcaa

SEQ ID NO: 7951223 - DNA, 22 bp, Homo sapiens
cggctggtgtcgggcacagcaa

SEQ ID NO: 7951224 - DNA, 22 bp, Homo sapiens
cggctgtgtcttcacaggagcc

SEQ ID NO: 7951225 - DNA, 22 bp, Homo sapiens
cggcttccaacaagctttgctg

SEQ ID NO: 7951226 - DNA, 22 bp, Homo sapiens
cggcttccaacaagctttgctg

SEQ ID NO: 7951227 - DNA, 22 bp, Homo sapiens
cggcttccagcaggtgctgcgc

SEQ ID NO: 7951228 - DNA, 22 bp, Homo sapiens
ttcagtttccacttacatttaa

SEQ ID NO: 7951229 - DNA, 19 bp, Homo sapiens
ttcagtttcctcatctgga

SEQ ID NO: 7951230 - DNA, 22 bp, Homo sapiens
ttcagtttcgttatctatgaga

SEQ ID NO: 7951231 - DNA, 22 bp, Homo sapiens
ttcagtttcgttatctatgaga

SEQ ID NO: 7951232 - DNA, 19 bp, Homo sapiens
ttcagtttcctcatctgga

SEQ ID NO: 7951233 - DNA, 22 bp, Homo sapiens
ttcagtttctaaagatgttcct

SEQ ID NO: 7951234 - DNA, 22 bp, Homo sapiens
ttcagtttctaaatgctcctct

SEQ ID NO: 7951235 - DNA, 22 bp, Homo sapiens
ttcagtttcgttatctatgaga

SEQ ID NO: 7951236 - DNA, 22 bp, Homo sapiens
ttcagtttcttccctgtgaaat

SEQ ID NO: 7951237 - DNA, 22 bp, Homo sapiens
ttcagtttcttccctgtgaaat

SEQ ID NO: 7951238 - DNA, 22 bp, Homo sapiens
ttcagtttcttccctgtgaaat

SEQ ID NO: 7951239 - DNA, 18 bp, Homo sapiens
ttcagtttctagttcctt

SEQ ID NO: 7951240 - DNA, 18 bp, Homo sapiens
ttcagtttctagttcctt

SEQ ID NO: 7951241 - DNA, 22 bp, Homo sapiens
ttcagtttgaattctgtagaac

SEQ ID NO: 7951242 - DNA, 22 bp, Homo sapiens
ttcagtttgaattctgtagaac

SEQ ID NO: 7951243 - DNA, 21 bp, Homo sapiens
ttcagtttcttcctcatctat

SEQ ID NO: 7951244 - DNA, 22 bp, Homo sapiens
cgcagctgcacggggctgagcc

SEQ ID NO: 7951245 - DNA, 22 bp, Homo sapiens
cgcagctgcacggggctgagcc

SEQ ID NO: 7951246 - DNA, 22 bp, Homo sapiens
cgcagctgcaaaggaaacattt

SEQ ID NO: 7951247 - DNA, 22 bp, Homo sapiens
cgcagctgcaaaggaaacattt

SEQ ID NO: 7951248 - DNA, 21 bp, Homo sapiens
cgcagctgagaaatatacaga

SEQ ID NO: 7951249 - DNA, 21 bp, Homo sapiens
cgcagctgagaaatatacaga

SEQ ID NO: 7951250 - DNA, 22 bp, Homo sapiens
cgcagctgaccttttacaaaac

SEQ ID NO: 7951251 - DNA, 22 bp, Homo sapiens
cgcagctgaccttttacaaaac

SEQ ID NO: 7951252 - DNA, 22 bp, Homo sapiens
cgcagctctggccgagggcggc

SEQ ID NO: 7951253 - DNA, 22 bp, Homo sapiens
cgcagctcttaccctcccctta

SEQ ID NO: 7951254 - DNA, 20 bp, Homo sapiens
cgcagcagtggaagtggaat

SEQ ID NO: 7951255 - DNA, 20 bp, Homo sapiens
cgcagcagtggaagtggaat

SEQ ID NO: 7951256 - DNA, 22 bp, Homo sapiens
ttcagggcgttgtggctgactg

SEQ ID NO: 7951257 - DNA, 22 bp, Homo sapiens
ttcagggcgttgtggctgactg

SEQ ID NO: 7951258 - DNA, 22 bp, Homo sapiens
ttcagggcgttgtggctgactg

SEQ ID NO: 7951259 - DNA, 23 bp, Homo sapiens
ttcagggcctcagaggtgaagct

SEQ ID NO: 7951260 - DNA, 23 bp, Homo sapiens
ttcagggcctcagaggtgaagct

SEQ ID NO: 7951261 - DNA, 22 bp, Homo sapiens
ttcagggccctgagagggcagt

SEQ ID NO: 7951262 - DNA, 22 bp, Homo sapiens
ttcagggccctgagagggcagt

SEQ ID NO: 7951263 - DNA, 22 bp, Homo sapiens
ttcagggccctgagagggcagt

SEQ ID NO: 7951264 - DNA, 22 bp, Homo sapiens
ttcagtttccacttacatttaa

SEQ ID NO: 7951265 - DNA, 22 bp, Homo sapiens
ttcctctgaaatggcttggaaa

SEQ ID NO: 7951266 - DNA, 22 bp, Homo sapiens
ttcctctgaaatggcttggaaa

SEQ ID NO: 7951267 - DNA, 22 bp, Homo sapiens
ttcctctgaaatggcttggaaa

SEQ ID NO: 7951268 - DNA, 21 bp, Homo sapiens
ttcctctgcaactgatgctca

SEQ ID NO: 7951269 - DNA, 22 bp, Homo sapiens
ctaaatgatggatttaaacttt

SEQ ID NO: 7951270 - DNA, 22 bp, Homo sapiens
ttcctctgaaatggcttggaaa

SEQ ID NO: 7951271 - DNA, 21 bp, Homo sapiens
ttcctctgcaactgatgctca

SEQ ID NO: 7951272 - DNA, 21 bp, Homo sapiens
ttcctctgcaactgatgctca

SEQ ID NO: 7951273 - DNA, 22 bp, Homo sapiens
ttcctccttcccattcctgggg

SEQ ID NO: 7951274 - DNA, 22 bp, Homo sapiens
ttcctccttgtcctagttactg

SEQ ID NO: 7951275 - DNA, 22 bp, Homo sapiens
ttcctccttgtcctagttactg

SEQ ID NO: 7951276 - DNA, 22 bp, Homo sapiens
ttcctccttgtcctagttactg

SEQ ID NO: 7951277 - DNA, 22 bp, Homo sapiens
ttcctctcctcccaccaggtga

SEQ ID NO: 7951278 - DNA, 22 bp, Homo sapiens
ttcctctcctcacatgagtcac

SEQ ID NO: 7951279 - DNA, 23 bp, Homo sapiens
cgtcttgtcctcgggcgcctggg

SEQ ID NO: 7951280 - DNA, 22 bp, Homo sapiens
cgtctggcttctccacggtaaa

SEQ ID NO: 7951281 - DNA, 22 bp, Homo sapiens
cgtgaagcaggaaggctgccca

SEQ ID NO: 7951282 - DNA, 22 bp, Homo sapiens
cgtgacacattctggacatggt

SEQ ID NO: 7951283 - DNA, 22 bp, Homo sapiens
cgtctttattgattccttcaag

SEQ ID NO: 7951284 - DNA, 22 bp, Homo sapiens
ttcctccagcctggagcacttc

SEQ ID NO: 7951285 - DNA, 22 bp, Homo sapiens
ttcctaacaaacttcagtgaat

SEQ ID NO: 7951286 - DNA, 22 bp, Homo sapiens
ttcctccagcctggagcacttc

SEQ ID NO: 7951287 - DNA, 22 bp, Homo sapiens
ttcctcctacgcttatcacttt

SEQ ID NO: 7951288 - DNA, 22 bp, Homo sapiens
ttcctccctgcccacattgtgc

SEQ ID NO: 7951289 - DNA, 22 bp, Homo sapiens
ttcctcctacgcttatcacttt

SEQ ID NO: 7951290 - DNA, 22 bp, Homo sapiens
ttcctccagcctggagcacttc

SEQ ID NO: 7951291 - DNA, 22 bp, Homo sapiens
ttcctccagtcagagctgtccc

SEQ ID NO: 7951292 - DNA, 22 bp, Homo sapiens
ttcctccagtcagagctgtccc

SEQ ID NO: 7951293 - DNA, 22 bp, Homo sapiens
ttcctccagtcagagctgtccc

SEQ ID NO: 7951294 - DNA, 22 bp, Homo sapiens
ttcctccatccttagggagagc

SEQ ID NO: 7951295 - DNA, 22 bp, Homo sapiens
ttcctccagtcagagctgtccc

SEQ ID NO: 7951296 - DNA, 17 bp, Homo sapiens
ttcctcctcaccatgtt

SEQ ID NO: 7951297 - DNA, 21 bp, Homo sapiens
ttcctcctctggagaagaaga

SEQ ID NO: 7951298 - DNA, 17 bp, Homo sapiens
ttcctcctcaccatgtt

SEQ ID NO: 7951299 - DNA, 22 bp, Homo sapiens
ttcctcctctgtaaaacgggca

SEQ ID NO: 7951300 - DNA, 22 bp, Homo sapiens
ttcctccttcccattcctgggg

SEQ ID NO: 7951301 - DNA, 22 bp, Homo sapiens
ttcctccttcccattcctgggg

SEQ ID NO: 7951302 - DNA, 21 bp, Homo sapiens
ttcctcctctggagaagaaga

SEQ ID NO: 7951303 - DNA, 22 bp, Homo sapiens
ttccagaaaactctgcctggta

SEQ ID NO: 7951304 - DNA, 22 bp, Homo sapiens
ttccagaaaacgctttatttag

SEQ ID NO: 7951305 - DNA, 22 bp, Homo sapiens
ttccagaaaacgctttatttag

SEQ ID NO: 7951306 - DNA, 22 bp, Homo sapiens
ttccagaaaacgctttatttag

SEQ ID NO: 7951307 - DNA, 22 bp, Homo sapiens
ttccacttttctctctcatgcc

SEQ ID NO: 7951308 - DNA, 22 bp, Homo sapiens
ttccagaaaaaaatgtatatct

SEQ ID NO: 7951309 - DNA, 22 bp, Homo sapiens
ttccagaaagttctggaactgg

SEQ ID NO: 7951310 - DNA, 22 bp, Homo sapiens
ttccagaaagttctggaactgg

SEQ ID NO: 7951311 - DNA, 22 bp, Homo sapiens
ttccagaaacctgaaagtttct

SEQ ID NO: 7951312 - DNA, 22 bp, Homo sapiens
ttccagaaacctgaaagtttct

SEQ ID NO: 7951313 - DNA, 22 bp, Homo sapiens
ttccagaaaactctgcctggta

SEQ ID NO: 7951314 - DNA, 21 bp, Homo sapiens
ttccagaaatctctttcttca

SEQ ID NO: 7951315 - DNA, 21 bp, Homo sapiens
ttccagaaatctctttcttca

SEQ ID NO: 7951316 - DNA, 21 bp, Homo sapiens
ttccagaaatctctttcttca

SEQ ID NO: 7951317 - DNA, 21 bp, Homo sapiens
ttccagaaatctctttcttca

SEQ ID NO: 7951318 - DNA, 22 bp, Homo sapiens
ttccagaaatctttcagctcaa

SEQ ID NO: 7951319 - DNA, 22 bp, Homo sapiens
ttccactttgggtctgtgcagg

SEQ ID NO: 7951320 - DNA, 19 bp, Homo sapiens
ttccacttgggttagaatt

SEQ ID NO: 7951321 - DNA, 22 bp, Homo sapiens
ttccactggctttcagtgatct

SEQ ID NO: 7951322 - DNA, 22 bp, Homo sapiens
ttccacttagtggaagggcatg

SEQ ID NO: 7951323 - DNA, 22 bp, Homo sapiens
ttccacttagtggaagggcatg

SEQ ID NO: 7951324 - DNA, 22 bp, Homo sapiens
ttccactggctttcagtgatct

SEQ ID NO: 7951325 - DNA, 22 bp, Homo sapiens
ttccactgaaggatctagggaa

SEQ ID NO: 7951326 - DNA, 22 bp, Homo sapiens
ttccactctccagtcaatttca

SEQ ID NO: 7951327 - DNA, 22 bp, Homo sapiens
cgtcatcacggcaagcatctcc

SEQ ID NO: 7951328 - DNA, 22 bp, Homo sapiens
ttccagaaatctttcagctcaa

SEQ ID NO: 7951329 - DNA, 22 bp, Homo sapiens
cgtcatcacggcaagcatctcc

SEQ ID NO: 7951330 - DNA, 22 bp, Homo sapiens
cgtccagggcgggctcccctca

SEQ ID NO: 7951331 - DNA, 19 bp, Homo sapiens
cgtccaggtgctggaagat

SEQ ID NO: 7951332 - DNA, 22 bp, Homo sapiens
cgtccaggaagatcggccgatg

SEQ ID NO: 7951333 - DNA, 22 bp, Homo sapiens
cgtccagattcagcccctagag

SEQ ID NO: 7951334 - DNA, 22 bp, Homo sapiens
cgtcattgtcctggacttgcaa

SEQ ID NO: 7951335 - DNA, 22 bp, Homo sapiens
cgtcccagttccagccgcgctg

SEQ ID NO: 7951336 - DNA, 22 bp, Homo sapiens
cgtcccagcagataaatgagga

SEQ ID NO: 7951337 - DNA, 19 bp, Homo sapiens
cgtccaggtgctggaagat

SEQ ID NO: 7951338 - DNA, 22 bp, Homo sapiens
cgtcccgggttcacgccattct

SEQ ID NO: 7951339 - DNA, 22 bp, Homo sapiens
cgtcccgggttcacgccattct

SEQ ID NO: 7951340 - DNA, 20 bp, Homo sapiens
cgtccccttgagcaggtccc

SEQ ID NO: 7951341 - DNA, 22 bp, Homo sapiens
cgtcccctcgttcccactttgg

SEQ ID NO: 7951342 - DNA, 22 bp, Homo sapiens
cgtctcctgtgttcgagccatt

SEQ ID NO: 7951343 - DNA, 22 bp, Homo sapiens
cgtctcctgtgttcgagccatt

SEQ ID NO: 7951344 - DNA, 22 bp, Homo sapiens
cgtctagacagtttccaaaaga

SEQ ID NO: 7951345 - DNA, 22 bp, Homo sapiens
cgtctctccgcaggggccttca

SEQ ID NO: 7951346 - DNA, 19 bp, Homo sapiens
cgtctgagtcacgggggtg

SEQ ID NO: 7951347 - DNA, 22 bp, Homo sapiens
cgtctgcctaaggactgccttc

SEQ ID NO: 7951348 - DNA, 22 bp, Homo sapiens
cgtccttacagagggtcacagc

SEQ ID NO: 7951349 - DNA, 22 bp, Homo sapiens
ctaaattatcatgagaattatg

SEQ ID NO: 7951350 - DNA, 22 bp, Homo sapiens
ctaaattatcatgagaattatg

SEQ ID NO: 7951351 - DNA, 22 bp, Homo sapiens
ctaaattatcatgagaattatg

SEQ ID NO: 7951352 - DNA, 22 bp, Homo sapiens
ctaaatgccctacaatgactgg

SEQ ID NO: 7951353 - DNA, 22 bp, Homo sapiens
ctaaattatttgcacattagag

SEQ ID NO: 7951354 - DNA, 22 bp, Homo sapiens
ctaaattatcatgagaattatg

SEQ ID NO: 7951355 - DNA, 22 bp, Homo sapiens
ctaaattatttgcacattagag

SEQ ID NO: 7951356 - DNA, 18 bp, Homo sapiens
ctaacagggaaaatagaa

SEQ ID NO: 7951357 - DNA, 22 bp, Homo sapiens
ctaacatttattgagcacttag

SEQ ID NO: 7951358 - DNA, 20 bp, Homo sapiens
ctaactaaccactttctgat

SEQ ID NO: 7951359 - DNA, 22 bp, Homo sapiens
ctaacgaatatgtatgcatgtt

SEQ ID NO: 7951360 - DNA, 22 bp, Homo sapiens
ctaacgaaatacctcagacttt

SEQ ID NO: 7951361 - DNA, 22 bp, Homo sapiens
ctaaccatcttacaaatgtctg

SEQ ID NO: 7951362 - DNA, 22 bp, Homo sapiens
ctaactttagcttagattatca

SEQ ID NO: 7951363 - DNA, 22 bp, Homo sapiens
ttccttttgcaaggtcctctag

SEQ ID NO: 7951364 - DNA, 22 bp, Homo sapiens
ttcctttttacataatcacatt

SEQ ID NO: 7951365 - DNA, 22 bp, Homo sapiens
ttcctttttacataatcacatt

SEQ ID NO: 7951366 - DNA, 22 bp, Homo sapiens
ttcctttttacataatcacatt

SEQ ID NO: 7951367 - DNA, 22 bp, Homo sapiens
ttcctttttacataatcacatt

SEQ ID NO: 7951368 - DNA, 22 bp, Homo sapiens
ttcctttttacataatcacatt

SEQ ID NO: 7951369 - DNA, 22 bp, Homo sapiens
ttcctttttacataatcacatt

SEQ ID NO: 7951370 - DNA, 22 bp, Homo sapiens
ttctacatatatttttctcact

SEQ ID NO: 7951371 - DNA, 22 bp, Homo sapiens
ttctacaggtactgaagtacat

SEQ ID NO: 7951372 - DNA, 22 bp, Homo sapiens
ttctacaggtactgaagtacat

SEQ ID NO: 7951373 - DNA, 22 bp, Homo sapiens
ttctacagaataaatgtttaca

SEQ ID NO: 7951374 - DNA, 22 bp, Homo sapiens
ttctacagactataactgtgat

SEQ ID NO: 7951375 - DNA, 22 bp, Homo sapiens
ttctacacttttcattagctag

SEQ ID NO: 7951376 - DNA, 21 bp, Homo sapiens
ttctacaggatgaatgaaaac

SEQ ID NO: 7951377 - DNA, 23 bp, Homo sapiens
ttctacagcttcttcagttaagg

SEQ ID NO: 7951378 - DNA, 22 bp, Homo sapiens
ctacagtgtcgtgtggtttctg

SEQ ID NO: 7951379 - DNA, 22 bp, Homo sapiens
ctacagtgtcgtgtggtttctg

SEQ ID NO: 7951380 - DNA, 17 bp, Homo sapiens
ctacagtgtgtttcctg

SEQ ID NO: 7951381 - DNA, 22 bp, Homo sapiens
ctacagtgtgacaggcttggtg

SEQ ID NO: 7951382 - DNA, 17 bp, Homo sapiens
ctacagtgtgtttcctg

SEQ ID NO: 7951383 - DNA, 17 bp, Homo sapiens
ctacagtgtgtttcctg

SEQ ID NO: 7951384 - DNA, 22 bp, Homo sapiens
ctacataaatttatcacagact

SEQ ID NO: 7951385 - DNA, 22 bp, Homo sapiens
ctacataaatttatcacagact

SEQ ID NO: 7951386 - DNA, 22 bp, Homo sapiens
ctacataaatatttatgtgtct

SEQ ID NO: 7951387 - DNA, 22 bp, Homo sapiens
ctacataaatatttatgtgtct

SEQ ID NO: 7951388 - DNA, 22 bp, Homo sapiens
ctacataaatatttatgtgtct

SEQ ID NO: 7951389 - DNA, 22 bp, Homo sapiens
ctacatactgtgtgtaaagaat

SEQ ID NO: 7951390 - DNA, 22 bp, Homo sapiens
ctacatactgtgtgtaaagaat

SEQ ID NO: 7951391 - DNA, 22 bp, Homo sapiens
ctacatagatggatgattgtaa

SEQ ID NO: 7951392 - DNA, 22 bp, Homo sapiens
ctacatcagaacatttacccta

SEQ ID NO: 7951393 - DNA, 22 bp, Homo sapiens
ctacatcacttaattcttagaa

SEQ ID NO: 7951394 - DNA, 22 bp, Homo sapiens
ctacatacatatacatgcagtt

SEQ ID NO: 7951395 - DNA, 22 bp, Homo sapiens
ctacataatctggatttgtctg

SEQ ID NO: 7951396 - DNA, 22 bp, Homo sapiens
ctacattcaacagcagagtttt

SEQ ID NO: 7951397 - DNA, 22 bp, Homo sapiens
ctacattcaacagcagagtttt

SEQ ID NO: 7951398 - DNA, 22 bp, Homo sapiens
ctacattaaattggcttactta

SEQ ID NO: 7951399 - DNA, 22 bp, Homo sapiens
ctacattaaattggcttactta

SEQ ID NO: 7951400 - DNA, 22 bp, Homo sapiens
ctacattaaattggcttactta

SEQ ID NO: 7951401 - DNA, 22 bp, Homo sapiens
ctacattaaattggcttactta

SEQ ID NO: 7951402 - DNA, 20 bp, Homo sapiens
ctacatgttctgcttctctc

SEQ ID NO: 7951403 - DNA, 20 bp, Homo sapiens
ctacatgttctgcttctctc

SEQ ID NO: 7951404 - DNA, 22 bp, Homo sapiens
ttctacatgagaaaatgtattt

SEQ ID NO: 7951405 - DNA, 22 bp, Homo sapiens
ttctacatgagaaaatgtattt

SEQ ID NO: 7951406 - DNA, 22 bp, Homo sapiens
ttctacatatatttttctcact

SEQ ID NO: 7951407 - DNA, 22 bp, Homo sapiens
ttctacatgagaaaatgtattt

SEQ ID NO: 7951408 - DNA, 22 bp, Homo sapiens
ttctacattcatgtattacctc

SEQ ID NO: 7951409 - DNA, 22 bp, Homo sapiens
ttctacattgtgaagttcttta

SEQ ID NO: 7951410 - DNA, 22 bp, Homo sapiens
ttctacattgtgaagttcttta

SEQ ID NO: 7951411 - DNA, 22 bp, Homo sapiens
ttctaccagaccccagacttgt

SEQ ID NO: 7951412 - DNA, 22 bp, Homo sapiens
ttctacatttaaaaggaaaatc

SEQ ID NO: 7951413 - DNA, 22 bp, Homo sapiens
ctacagtgaagactagctatag

SEQ ID NO: 7951414 - DNA, 22 bp, Homo sapiens
ctacagtgaagactagctatag

SEQ ID NO: 7951415 - DNA, 22 bp, Homo sapiens
ctacagtgacagaattaaacag

SEQ ID NO: 7951416 - DNA, 22 bp, Homo sapiens
ctacagtgactgtgacagagca

SEQ ID NO: 7951417 - DNA, 22 bp, Homo sapiens
ctacagtgactgtgacagagca

SEQ ID NO: 7951418 - DNA, 22 bp, Homo sapiens
ttctacccgttgagagaatgct

SEQ ID NO: 7951419 - DNA, 22 bp, Homo sapiens
ttctaccagctactcactgata

SEQ ID NO: 7951420 - DNA, 22 bp, Homo sapiens
ttctacatttgaggagagtcag

SEQ ID NO: 7951421 - DNA, 22 bp, Homo sapiens
ttctacctcagtttcccactta

SEQ ID NO: 7951422 - DNA, 22 bp, Homo sapiens
ttctcatagagacatgattata

SEQ ID NO: 7951423 - DNA, 18 bp, Homo sapiens
ttctcatacctcacttag

SEQ ID NO: 7951424 - DNA, 22 bp, Homo sapiens
ttctcagtttcactgataacag

SEQ ID NO: 7951425 - DNA, 19 bp, Homo sapiens
ttctcagttcaggagaaga

SEQ ID NO: 7951426 - DNA, 22 bp, Homo sapiens
ttctcagtttcatagctgagca

SEQ ID NO: 7951427 - DNA, 22 bp, Homo sapiens
ttctcagtttcatagctgagca

SEQ ID NO: 7951428 - DNA, 22 bp, Homo sapiens
ttctcagtttcatagctgagca

SEQ ID NO: 7951429 - DNA, 22 bp, Homo sapiens
ttctcagtttcactgataacag

SEQ ID NO: 7951430 - DNA, 22 bp, Homo sapiens
ttctcagtttcactgataacag

SEQ ID NO: 7951431 - DNA, 22 bp, Homo sapiens
ttctcagtatgtgacgaggacc

SEQ ID NO: 7951432 - DNA, 23 bp, Homo sapiens
ttctcagtcctgcccagggaggc

SEQ ID NO: 7951433 - DNA, 22 bp, Homo sapiens
ttctcagtattacatgctaatg

SEQ ID NO: 7951434 - DNA, 23 bp, Homo sapiens
ttctcagtcctgcccagggaggc

SEQ ID NO: 7951435 - DNA, 19 bp, Homo sapiens
ttctcagttcaggagaaga

SEQ ID NO: 7951436 - DNA, 22 bp, Homo sapiens
ttctcagtagttagcatttgtg

SEQ ID NO: 7951437 - DNA, 22 bp, Homo sapiens
ttctcaggtgaggctgaggctg

SEQ ID NO: 7951438 - DNA, 22 bp, Homo sapiens
ttctcaggtgaggctgaggctg

SEQ ID NO: 7951439 - DNA, 22 bp, Homo sapiens
ttctcaggtgaggctgaggctg

SEQ ID NO: 7951440 - DNA, 22 bp, Homo sapiens
ttctatttttgtggaactgtag

SEQ ID NO: 7951441 - DNA, 22 bp, Homo sapiens
ttctcaggtcaccagggtgcca

SEQ ID NO: 7951442 - DNA, 22 bp, Homo sapiens
ttctcaggtgaggctgaggctg

SEQ ID NO: 7951443 - DNA, 22 bp, Homo sapiens
ttctcaggtgaggctgaggctg

SEQ ID NO: 7951444 - DNA, 22 bp, Homo sapiens
ttctcaggtgaggctgaggctg

SEQ ID NO: 7951445 - DNA, 22 bp, Homo sapiens
ttctatttttgtggaactgtag

SEQ ID NO: 7951446 - DNA, 22 bp, Homo sapiens
ctacatttacacagttaggctt

SEQ ID NO: 7951447 - DNA, 22 bp, Homo sapiens
ctacattctgggaaatcagatg

SEQ ID NO: 7951448 - DNA, 18 bp, Homo sapiens
ctacattcataggaaagg

SEQ ID NO: 7951449 - DNA, 20 bp, Homo sapiens
ttctccaaaggagacactag

SEQ ID NO: 7951450 - DNA, 22 bp, Homo sapiens
ttctcctgcccttggacttcca

SEQ ID NO: 7951451 - DNA, 22 bp, Homo sapiens
ttctcattctgactcagtgtag

SEQ ID NO: 7951452 - DNA, 22 bp, Homo sapiens
ttctcctgcgcaggcccaggga

SEQ ID NO: 7951453 - DNA, 22 bp, Homo sapiens
ttctcctgcgcaggcccaggga

SEQ ID NO: 7951454 - DNA, 22 bp, Homo sapiens
ttctcctggagtgcttgttggg

SEQ ID NO: 7951455 - DNA, 22 bp, Homo sapiens
ttctcctgcgcaggcccaggga

SEQ ID NO: 7951456 - DNA, 22 bp, Homo sapiens
ttctcctggagtgcttgttggg

SEQ ID NO: 7951457 - DNA, 22 bp, Homo sapiens
ttctcatgtaaatgccatcatc

SEQ ID NO: 7951458 - DNA, 19 bp, Homo sapiens
ttctcattcctttccactt

SEQ ID NO: 7951459 - DNA, 19 bp, Homo sapiens
ttctcattcctttccactt

SEQ ID NO: 7951460 - DNA, 22 bp, Homo sapiens
ttctcattctgactcagtgtag

SEQ ID NO: 7951461 - DNA, 22 bp, Homo sapiens
ttctcatgaaactcgcttcctc

SEQ ID NO: 7951462 - DNA, 22 bp, Homo sapiens
ttctcatgatgcaattcatccc

SEQ ID NO: 7951463 - DNA, 21 bp, Homo sapiens
ttctcatgggataagtacatg

SEQ ID NO: 7951464 - DNA, 22 bp, Homo sapiens
ttctcatgaaactcgcttcctc

SEQ ID NO: 7951465 - DNA, 22 bp, Homo sapiens
ttctcatgaaactcgcttcctc

SEQ ID NO: 7951466 - DNA, 22 bp, Homo sapiens
ttctcatgaaactcgcttcctc

SEQ ID NO: 7951467 - DNA, 22 bp, Homo sapiens
ttctcatgaaactcgcttcctc

SEQ ID NO: 7951468 - DNA, 22 bp, Homo sapiens
ttctcataggagcgcaaaccct

SEQ ID NO: 7951469 - DNA, 22 bp, Homo sapiens
ttctcatatgcactctatttga

SEQ ID NO: 7951470 - DNA, 22 bp, Homo sapiens
ctagtttaaagcagctgaaagg

SEQ ID NO: 7951471 - DNA, 22 bp, Homo sapiens
ctagttgtttaatattgattga

SEQ ID NO: 7951472 - DNA, 22 bp, Homo sapiens
ctagtttaaagcagctgaaagg

SEQ ID NO: 7951473 - DNA, 22 bp, Homo sapiens
ctagtttaaagcagctgaaagg

SEQ ID NO: 7951474 - DNA, 22 bp, Homo sapiens
ctagttgtttaatattgattga

SEQ ID NO: 7951475 - DNA, 22 bp, Homo sapiens
ctagtttggttagataagtctc

SEQ ID NO: 7951476 - DNA, 22 bp, Homo sapiens
ctagtttagtcagagccttgct

SEQ ID NO: 7951477 - DNA, 22 bp, Homo sapiens
ctagtttctccgttttctaccc

SEQ ID NO: 7951478 - DNA, 22 bp, Homo sapiens
ctagtttagagtatgcgtgtgt

SEQ ID NO: 7951479 - DNA, 22 bp, Homo sapiens
ctagttctagatccctgaggaa

SEQ ID NO: 7951480 - DNA, 22 bp, Homo sapiens
ctagttctaaatctgttgtcca

SEQ ID NO: 7951481 - DNA, 22 bp, Homo sapiens
ctagttctcctgaaatgtttgg

SEQ ID NO: 7951482 - DNA, 22 bp, Homo sapiens
ctagttctgccattcagtgtca

SEQ ID NO: 7951483 - DNA, 22 bp, Homo sapiens
ctagttctagatccctgaggaa

SEQ ID NO: 7951484 - DNA, 22 bp, Homo sapiens
ctagttctcctgaaatgtttgg

SEQ ID NO: 7951485 - DNA, 22 bp, Homo sapiens
ctagttgtttaatattgattga

SEQ ID NO: 7951486 - DNA, 22 bp, Homo sapiens
ctagttctgccattcagtgtca

SEQ ID NO: 7951487 - DNA, 22 bp, Homo sapiens
ctagttctgccattcagtgtca

SEQ ID NO: 7951488 - DNA, 22 bp, Homo sapiens
ctagttcttaactgttatgatt

SEQ ID NO: 7951489 - DNA, 22 bp, Homo sapiens
ctagtgtttattaatcatgagg

SEQ ID NO: 7951490 - DNA, 22 bp, Homo sapiens
ctagtgtttattaatcatgagg

SEQ ID NO: 7951491 - DNA, 22 bp, Homo sapiens
ctagttattagctactcattga

SEQ ID NO: 7951492 - DNA, 22 bp, Homo sapiens
ctagttctagatccctgaggaa

SEQ ID NO: 7951493 - DNA, 22 bp, Homo sapiens
ctagttctaaatctgttgtcca

SEQ ID NO: 7951494 - DNA, 22 bp, Homo sapiens
ctagttctagatccctgaggaa

SEQ ID NO: 7951495 - DNA, 22 bp, Homo sapiens
ctagttctagatccctgaggaa

SEQ ID NO: 7951496 - DNA, 22 bp, Homo sapiens
ctagtgtacaagtggtggagat

SEQ ID NO: 7951497 - DNA, 22 bp, Homo sapiens
ctagtggaaactaactggaatt

SEQ ID NO: 7951498 - DNA, 19 bp, Homo sapiens
ctagggcttggcagcaggc

SEQ ID NO: 7951499 - DNA, 22 bp, Homo sapiens
ctagtgaacgtggtactatgga

SEQ ID NO: 7951500 - DNA, 22 bp, Homo sapiens
ctagtgcaatgatgaatacaag

SEQ ID NO: 7951501 - DNA, 22 bp, Homo sapiens
ctagtgagtctgaatgagttgc

SEQ ID NO: 7951502 - DNA, 22 bp, Homo sapiens
ctagtgagtctgaatgagttgc

SEQ ID NO: 7951503 - DNA, 22 bp, Homo sapiens
ttctcctttgtaattctcatcc

SEQ ID NO: 7951504 - DNA, 22 bp, Homo sapiens
ttctcctttgtaattctcatcc

SEQ ID NO: 7951505 - DNA, 22 bp, Homo sapiens
ttctcctttgtaattctcatcc

SEQ ID NO: 7951506 - DNA, 22 bp, Homo sapiens
ttctcctttgtaattctcatcc

SEQ ID NO: 7951507 - DNA, 22 bp, Homo sapiens
ctagggctcgcaagggctggag

SEQ ID NO: 7951508 - DNA, 22 bp, Homo sapiens
ctagggctcgcaagggctggag

SEQ ID NO: 7951509 - DNA, 22 bp, Homo sapiens
ctagggcttccaagatgccttc

SEQ ID NO: 7951510 - DNA, 19 bp, Homo sapiens
ctagggcttggcagcaggc

SEQ ID NO: 7951511 - DNA, 19 bp, Homo sapiens
ctagggcttggcagcaggc

SEQ ID NO: 7951512 - DNA, 18 bp, Homo sapiens
ctagggctgtggctctca

SEQ ID NO: 7951513 - DNA, 22 bp, Homo sapiens
ctagggcttccaagatgccttc

SEQ ID NO: 7951514 - DNA, 22 bp, Homo sapiens
ttctccttgttcccttcaattg

SEQ ID NO: 7951515 - DNA, 22 bp, Homo sapiens
ttctccttggtttatgggacat

SEQ ID NO: 7951516 - DNA, 22 bp, Homo sapiens
ttctccttggtttatgggacat

SEQ ID NO: 7951517 - DNA, 22 bp, Homo sapiens
ttctccttgttcccttcaattg

SEQ ID NO: 7951518 - DNA, 22 bp, Homo sapiens
ttctcctttcattccctgtaga

SEQ ID NO: 7951519 - DNA, 22 bp, Homo sapiens
ttctccttgttcccttcaattg

SEQ ID NO: 7951520 - DNA, 22 bp, Homo sapiens
ttctccttgaaaagctgcatct

SEQ ID NO: 7951521 - DNA, 21 bp, Homo sapiens
ttctccttcttgatccaagca

SEQ ID NO: 7951522 - DNA, 22 bp, Homo sapiens
ttctccttcctggttttcaggc

SEQ ID NO: 7951523 - DNA, 22 bp, Homo sapiens
ttctccttcctggttttcaggc

SEQ ID NO: 7951524 - DNA, 22 bp, Homo sapiens
ttctccttcctggttttcaggc

SEQ ID NO: 7951525 - DNA, 21 bp, Homo sapiens
ttctcctgttttgcaccacag

SEQ ID NO: 7951526 - DNA, 22 bp, Homo sapiens
ttctcctggggccgtgatgtga

SEQ ID NO: 7951527 - DNA, 22 bp, Homo sapiens
ttctccttattcatagttgtct

SEQ ID NO: 7951528 - DNA, 22 bp, Homo sapiens
ttctccttattcatagttgtct

SEQ ID NO: 7951529 - DNA, 22 bp, Homo sapiens
ttgcaaaagcaattgcagtttt

SEQ ID NO: 7951530 - DNA, 22 bp, Homo sapiens
ttgcaaaagcaattgcagtttt

SEQ ID NO: 7951531 - DNA, 22 bp, Homo sapiens
ttgcaaaagcaattgcagtttt

SEQ ID NO: 7951532 - DNA, 22 bp, Homo sapiens
ttgcaaaagcaattgcagtttt

SEQ ID NO: 7951533 - DNA, 22 bp, Homo sapiens
ttgcaaaagcaattgcagtttt

SEQ ID NO: 7951534 - DNA, 22 bp, Homo sapiens
ttgcaaaagccgaggcactcca

SEQ ID NO: 7951535 - DNA, 22 bp, Homo sapiens
ttgcaaaagccgaggcactcca

SEQ ID NO: 7951536 - DNA, 22 bp, Homo sapiens
ttgcaaaagccgaggcactcca

SEQ ID NO: 7951537 - DNA, 22 bp, Homo sapiens
ttgcaaaatcatttctcaggat

SEQ ID NO: 7951538 - DNA, 22 bp, Homo sapiens
ttgcaaaagccgaggcactcca

SEQ ID NO: 7951539 - DNA, 22 bp, Homo sapiens
ttgcaaaaccatcctaagtaaa

SEQ ID NO: 7951540 - DNA, 22 bp, Homo sapiens
ttgcaaaaactgcaattacttt

SEQ ID NO: 7951541 - DNA, 22 bp, Homo sapiens
ttgcaaaaactgcaattacttt

SEQ ID NO: 7951542 - DNA, 22 bp, Homo sapiens
ttgcaaaaactgcaattacttt

SEQ ID NO: 7951543 - DNA, 22 bp, Homo sapiens
ttgcaaaaccatcctaagtaaa

SEQ ID NO: 7951544 - DNA, 22 bp, Homo sapiens
ttgcaaaagcaattgcagtttt

SEQ ID NO: 7951545 - DNA, 22 bp, Homo sapiens
ttgcaaaaccatcctaagtaaa

SEQ ID NO: 7951546 - DNA, 22 bp, Homo sapiens
ctcagcagtgacaagagagtat

SEQ ID NO: 7951547 - DNA, 22 bp, Homo sapiens
ctcagcagtgacaagagagtat

SEQ ID NO: 7951548 - DNA, 22 bp, Homo sapiens
ctcagcagtgacaagagagtat

SEQ ID NO: 7951549 - DNA, 22 bp, Homo sapiens
ctcagcagtatactctgaagat

SEQ ID NO: 7951550 - DNA, 22 bp, Homo sapiens
ttgcaaagaattttacattcta

SEQ ID NO: 7951551 - DNA, 22 bp, Homo sapiens
ctcagcagtgacaagagagtat

SEQ ID NO: 7951552 - DNA, 23 bp, Homo sapiens
ttgcaaaatgcaattgagttaga

SEQ ID NO: 7951553 - DNA, 22 bp, Homo sapiens
ttgcaaaatcatttctcaggat

SEQ ID NO: 7951554 - DNA, 23 bp, Homo sapiens
ttgcaaaatgagtcttgagtgaa

SEQ ID NO: 7951555 - DNA, 23 bp, Homo sapiens
ttgcaaaatgagtcttgagtgaa

SEQ ID NO: 7951556 - DNA, 22 bp, Homo sapiens
ttgcaaaatcatttctcaggat

SEQ ID NO: 7951557 - DNA, 23 bp, Homo sapiens
ttgcaaaatgcaattgagttaga

SEQ ID NO: 7951558 - DNA, 23 bp, Homo sapiens
ttgcaaaatgcaattgagttaga

SEQ ID NO: 7951559 - DNA, 23 bp, Homo sapiens
ttgcaaaatgagtcttgagtgaa

SEQ ID NO: 7951560 - DNA, 23 bp, Homo sapiens
ttgcaaaatgagtcttgagtgaa

SEQ ID NO: 7951561 - DNA, 22 bp, Homo sapiens
ttgcaaaaaccacaattacttt

SEQ ID NO: 7951562 - DNA, 22 bp, Homo sapiens
ttgcaaaaaccacaattacttt

SEQ ID NO: 7951563 - DNA, 22 bp, Homo sapiens
ttgcaaaaaccacaattacttt

SEQ ID NO: 7951564 - DNA, 22 bp, Homo sapiens
ttgcaaaaactgcaattacttt

SEQ ID NO: 7951565 - DNA, 22 bp, Homo sapiens
ttgcaaaaactgcaattacttt

SEQ ID NO: 7951566 - DNA, 22 bp, Homo sapiens
ttgatttttttctactatgcgc

SEQ ID NO: 7951567 - DNA, 22 bp, Homo sapiens
ttgcaaaaaccacaattacttt

SEQ ID NO: 7951568 - DNA, 22 bp, Homo sapiens
ttgcaaaaaccacaattacttt

SEQ ID NO: 7951569 - DNA, 22 bp, Homo sapiens
ttgatttttttctactatgcgc

SEQ ID NO: 7951570 - DNA, 22 bp, Homo sapiens
ttgatttttttctactatgcgc

SEQ ID NO: 7951571 - DNA, 22 bp, Homo sapiens
ttgatttttttctactatgcgc

SEQ ID NO: 7951572 - DNA, 22 bp, Homo sapiens
ttgatttttttctactatgcgc

SEQ ID NO: 7951573 - DNA, 22 bp, Homo sapiens
ttgatttttccagcttctagag

SEQ ID NO: 7951574 - DNA, 22 bp, Homo sapiens
ttgatttttccagcttctagag

SEQ ID NO: 7951575 - DNA, 22 bp, Homo sapiens
ttgatcaagtgggaaatagtaa

SEQ ID NO: 7951576 - DNA, 22 bp, Homo sapiens
ttgatttttccagcttctagag

SEQ ID NO: 7951577 - DNA, 22 bp, Homo sapiens
ttgatcaaatcagctactgagg

SEQ ID NO: 7951578 - DNA, 22 bp, Homo sapiens
ttgatcaaatcagctactgagg

SEQ ID NO: 7951579 - DNA, 22 bp, Homo sapiens
ttgatcaaatcagctactgagg

SEQ ID NO: 7951580 - DNA, 22 bp, Homo sapiens
ttgatattttgcacgcttggta

SEQ ID NO: 7951581 - DNA, 22 bp, Homo sapiens
ctcagaaagggttgctgagggc

SEQ ID NO: 7951582 - DNA, 22 bp, Homo sapiens
ctcagaaagcaatctggtgagg

SEQ ID NO: 7951583 - DNA, 22 bp, Homo sapiens
ctcagaaacggagctgccattt

SEQ ID NO: 7951584 - DNA, 22 bp, Homo sapiens
ctcagaaacggagctgccattt

SEQ ID NO: 7951585 - DNA, 22 bp, Homo sapiens
ctcagaaacggagctgccattt

SEQ ID NO: 7951586 - DNA, 22 bp, Homo sapiens
ctcagaaagcaatctggtgagg

SEQ ID NO: 7951587 - DNA, 22 bp, Homo sapiens
ctcagccatgtcatgcctacct

SEQ ID NO: 7951588 - DNA, 22 bp, Homo sapiens
ctcagccatggggtggatcagc

SEQ ID NO: 7951589 - DNA, 22 bp, Homo sapiens
ctcagccatgcaacatgctggg

SEQ ID NO: 7951590 - DNA, 22 bp, Homo sapiens
ctcagccatggggtggatcagc

SEQ ID NO: 7951591 - DNA, 22 bp, Homo sapiens
ctcagccatgcaacatgctggg

SEQ ID NO: 7951592 - DNA, 22 bp, Homo sapiens
ctcagccatgcaacatgctggg

SEQ ID NO: 7951593 - DNA, 22 bp, Homo sapiens
ctcagcccagcccaggaccagg

SEQ ID NO: 7951594 - DNA, 22 bp, Homo sapiens
ctcagcccagcccaggaccagg

SEQ ID NO: 7951595 - DNA, 22 bp, Homo sapiens
ctcagccatgtcatgcctacct

SEQ ID NO: 7951596 - DNA, 22 bp, Homo sapiens
ctcagccatgtcatgcctacct

SEQ ID NO: 7951597 - DNA, 22 bp, Homo sapiens
ctcagccccaattctccccatt

SEQ ID NO: 7951598 - DNA, 22 bp, Homo sapiens
ctcagccccaattctccccatt

SEQ ID NO: 7951599 - DNA, 22 bp, Homo sapiens
ctcaggagtagttcagcagctg

SEQ ID NO: 7951600 - DNA, 22 bp, Homo sapiens
ctcagccccaatttgccctctt

SEQ ID NO: 7951601 - DNA, 22 bp, Homo sapiens
ctcagcccagctcaggtctttc

SEQ ID NO: 7951602 - DNA, 22 bp, Homo sapiens
ctcagcccagcccaggaccagg

SEQ ID NO: 7951603 - DNA, 22 bp, Homo sapiens
ctcagccaggagagtgttcaca

SEQ ID NO: 7951604 - DNA, 22 bp, Homo sapiens
ctcagccagacatgacccagtc

SEQ ID NO: 7951605 - DNA, 22 bp, Homo sapiens
ctcagccagacatgacccagtc

SEQ ID NO: 7951606 - DNA, 22 bp, Homo sapiens
ctcagcattcaatgtccagtcc

SEQ ID NO: 7951607 - DNA, 22 bp, Homo sapiens
ctcagcatcatggtatctgggg

SEQ ID NO: 7951608 - DNA, 22 bp, Homo sapiens
ctcagcatggagggagaacaag

SEQ ID NO: 7951609 - DNA, 22 bp, Homo sapiens
ctcagccatgcaacatgctggg

SEQ ID NO: 7951610 - DNA, 22 bp, Homo sapiens
ctcagccagtgatctttccttt

SEQ ID NO: 7951611 - DNA, 22 bp, Homo sapiens
ctcagccatgcaacatgctggg

SEQ ID NO: 7951612 - DNA, 22 bp, Homo sapiens
ctcagccatgcaacatgctggg

SEQ ID NO: 7951613 - DNA, 22 bp, Homo sapiens
ctcagccagtgatctttccttt

SEQ ID NO: 7951614 - DNA, 22 bp, Homo sapiens
ctcaggagttggaggctacagt

SEQ ID NO: 7951615 - DNA, 22 bp, Homo sapiens
ctcaggccaataagctccagcc

SEQ ID NO: 7951616 - DNA, 22 bp, Homo sapiens
ctcaggccaataagctccagcc

SEQ ID NO: 7951617 - DNA, 22 bp, Homo sapiens
ctcaggccaataagctccagcc

SEQ ID NO: 7951618 - DNA, 22 bp, Homo sapiens
ctcaggagttggaggctacagt

SEQ ID NO: 7951619 - DNA, 22 bp, Homo sapiens
ctcaggagttggaggctacagt

SEQ ID NO: 7951620 - DNA, 22 bp, Homo sapiens
ctcaggccaataagctccagcc

SEQ ID NO: 7951621 - DNA, 22 bp, Homo sapiens
ctcaggagttggaggctacagt

SEQ ID NO: 7951622 - DNA, 22 bp, Homo sapiens
ctcaggagtagttcagcagctg

SEQ ID NO: 7951623 - DNA, 22 bp, Homo sapiens
ctcaggccaggtttctcccaca

SEQ ID NO: 7951624 - DNA, 22 bp, Homo sapiens
ctcaggccaggtttctcccaca

SEQ ID NO: 7951625 - DNA, 22 bp, Homo sapiens
ctcaggccaggtttctcccaca

SEQ ID NO: 7951626 - DNA, 22 bp, Homo sapiens
ctcaggccaggtttctcccaca

SEQ ID NO: 7951627 - DNA, 22 bp, Homo sapiens
ctcaggccaggtttctcccaca

SEQ ID NO: 7951628 - DNA, 22 bp, Homo sapiens
ctcaggccattcctaccaaggg

SEQ ID NO: 7951629 - DNA, 22 bp, Homo sapiens
ctcaggccattcctaccaaggg

SEQ ID NO: 7951630 - DNA, 22 bp, Homo sapiens
ctcaggccattcttccagctgc

SEQ ID NO: 7951631 - DNA, 22 bp, Homo sapiens
ctcaggccattcctaccaaggg

SEQ ID NO: 7951632 - DNA, 22 bp, Homo sapiens
ctcaggccattcttccagctgc

SEQ ID NO: 7951633 - DNA, 22 bp, Homo sapiens
ctcaggcccacagcagacccac

SEQ ID NO: 7951634 - DNA, 22 bp, Homo sapiens
ctcaggccattcttccagctgc

SEQ ID NO: 7951635 - DNA, 22 bp, Homo sapiens
ctcaggccattcttccagctgc

SEQ ID NO: 7951636 - DNA, 22 bp, Homo sapiens
ctcaggccattcttccagctgc

SEQ ID NO: 7951637 - DNA, 22 bp, Homo sapiens
ctcaggccattcttccagctgc

SEQ ID NO: 7951638 - DNA, 22 bp, Homo sapiens
ctcaggccattcttccagctgc

SEQ ID NO: 7951639 - DNA, 22 bp, Homo sapiens
ctcaggccattcttccagctgc

SEQ ID NO: 7951640 - DNA, 22 bp, Homo sapiens
ctcaggccattcttccagctgc

SEQ ID NO: 7951641 - DNA, 22 bp, Homo sapiens
ctcaggcccacagcagacccac

SEQ ID NO: 7951642 - DNA, 22 bp, Homo sapiens
ctcaggcctgagtggcagtccc

SEQ ID NO: 7951643 - DNA, 22 bp, Homo sapiens
ctcaggcctgagtggcagtccc

SEQ ID NO: 7951644 - DNA, 22 bp, Homo sapiens
ctcaggcctgagtggcagtccc

SEQ ID NO: 7951645 - DNA, 22 bp, Homo sapiens
ctcaggcccacagcagacccac

SEQ ID NO: 7951646 - DNA, 22 bp, Homo sapiens
ctcaggcccacagcagacccac

SEQ ID NO: 7951647 - DNA, 22 bp, Homo sapiens
ctcaggctaagaaggccaagtg

SEQ ID NO: 7951648 - DNA, 22 bp, Homo sapiens
ctcaggctaagaaggccaagtg

SEQ ID NO: 7951649 - DNA, 22 bp, Homo sapiens
ctcaggctaagaaggccaagtg

SEQ ID NO: 7951650 - DNA, 22 bp, Homo sapiens
ctcaggctaagaaggccaagtg

SEQ ID NO: 7951651 - DNA, 22 bp, Homo sapiens
ctcaggctaagaaggccaagtg

SEQ ID NO: 7951652 - DNA, 22 bp, Homo sapiens
ctcaggctccagacttccgtcc

SEQ ID NO: 7951653 - DNA, 22 bp, Homo sapiens
ctcaggctcatatcccatcagc

SEQ ID NO: 7951654 - DNA, 22 bp, Homo sapiens
ttgctgtagctcatttcactct

SEQ ID NO: 7951655 - DNA, 22 bp, Homo sapiens
ttgctgggtgctattatgaaca

SEQ ID NO: 7951656 - DNA, 22 bp, Homo sapiens
ttgctgggtcagaagccaggag

SEQ ID NO: 7951657 - DNA, 22 bp, Homo sapiens
ttgctggcaatttagagatttc

SEQ ID NO: 7951658 - DNA, 22 bp, Homo sapiens
ttgctggcttgaagatagagga

SEQ ID NO: 7951659 - DNA, 19 bp, Homo sapiens
ttgctggcatttgatctct

SEQ ID NO: 7951660 - DNA, 22 bp, Homo sapiens
ttgctggacagcttcacggaga

SEQ ID NO: 7951661 - DNA, 22 bp, Homo sapiens
ttgctgggtcagaagccaggag

SEQ ID NO: 7951662 - DNA, 22 bp, Homo sapiens
ttgctgggtcagaagccaggag

SEQ ID NO: 7951663 - DNA, 22 bp, Homo sapiens
ttgctggggtgtgaaatctgat

SEQ ID NO: 7951664 - DNA, 22 bp, Homo sapiens
ttgctgggcatgtcttaattct

SEQ ID NO: 7951665 - DNA, 22 bp, Homo sapiens
ttgctgggctcttcaacacaca

SEQ ID NO: 7951666 - DNA, 20 bp, Homo sapiens
ttgctgggacctttttcaac

SEQ ID NO: 7951667 - DNA, 22 bp, Homo sapiens
ttgctggcttgaagatagagga

SEQ ID NO: 7951668 - DNA, 22 bp, Homo sapiens
ttgctgagctttggcaaggaag

SEQ ID NO: 7951669 - DNA, 22 bp, Homo sapiens
ttgctgaggacgcagtgcagtg

SEQ ID NO: 7951670 - DNA, 22 bp, Homo sapiens
ttgctgataccatgaatgttaa

SEQ ID NO: 7951671 - DNA, 22 bp, Homo sapiens
ttgctgatctgaaacgttactg

SEQ ID NO: 7951672 - DNA, 22 bp, Homo sapiens
ttgctgagtctctaggtatgat

SEQ ID NO: 7951673 - DNA, 22 bp, Homo sapiens
ttgctgatggagggaatgctca

SEQ ID NO: 7951674 - DNA, 22 bp, Homo sapiens
ttgctgccagcgccctgcaggg

SEQ ID NO: 7951675 - DNA, 22 bp, Homo sapiens
ttgctgctcccaagaggcagct

SEQ ID NO: 7951676 - DNA, 22 bp, Homo sapiens
ttgctgctcccaagaggcagct

SEQ ID NO: 7951677 - DNA, 22 bp, Homo sapiens
ttgctgcctttgtactctgatg

SEQ ID NO: 7951678 - DNA, 22 bp, Homo sapiens
ttgctgccttggagaagctcct

SEQ ID NO: 7951679 - DNA, 22 bp, Homo sapiens
ttgctgcctttgtactctgatg

SEQ ID NO: 7951680 - DNA, 22 bp, Homo sapiens
ttgctgccttggagaagctcct

SEQ ID NO: 7951681 - DNA, 22 bp, Homo sapiens
ttgctgcctgaggagcaacact

SEQ ID NO: 7951682 - DNA, 22 bp, Homo sapiens
ttgctgcctgaggagcaacact

SEQ ID NO: 7951683 - DNA, 23 bp, Homo sapiens
ttgctgcctgagccttcctctgg

SEQ ID NO: 7951684 - DNA, 22 bp, Homo sapiens
ttgcactccagcccgagcaaca

SEQ ID NO: 7951685 - DNA, 23 bp, Homo sapiens
ttgcactgatcaatttgataagc

SEQ ID NO: 7951686 - DNA, 23 bp, Homo sapiens
ttgcactgatcaatttgataagc

SEQ ID NO: 7951687 - DNA, 22 bp, Homo sapiens
ttgcactgtaagcatctgtgtc

SEQ ID NO: 7951688 - DNA, 22 bp, Homo sapiens
ttgcacttaaggtaggtgtgaa

SEQ ID NO: 7951689 - DNA, 22 bp, Homo sapiens
ttgccctgtggggcctccagcc

SEQ ID NO: 7951690 - DNA, 22 bp, Homo sapiens
ttgcccttgtggagtttacatg

SEQ ID NO: 7951691 - DNA, 16 bp, Homo sapiens
ttgccgcacaggtcgc

SEQ ID NO: 7951692 - DNA, 22 bp, Homo sapiens
ttgcccttggctgaaggcactg

SEQ ID NO: 7951693 - DNA, 22 bp, Homo sapiens
ttgcccttgtggagtttacatg

SEQ ID NO: 7951694 - DNA, 22 bp, Homo sapiens
ttgcccttggctgaaggcactg

SEQ ID NO: 7951695 - DNA, 22 bp, Homo sapiens
ttgcccttggctgaaggcactg

SEQ ID NO: 7951696 - DNA, 22 bp, Homo sapiens
ttgccctgtggggcctccagcc

SEQ ID NO: 7951697 - DNA, 22 bp, Homo sapiens
ttgctgagcagtgtttaattgt

SEQ ID NO: 7951698 - DNA, 23 bp, Homo sapiens
ttgctgagataaagaatgcaggg

SEQ ID NO: 7951699 - DNA, 22 bp, Homo sapiens
ttgcctagagttgcacatctgg

SEQ ID NO: 7951700 - DNA, 22 bp, Homo sapiens
ttgcacatgttggttcttgaaa

SEQ ID NO: 7951701 - DNA, 22 bp, Homo sapiens
ttgcacatgttggttcttgaaa

SEQ ID NO: 7951702 - DNA, 23 bp, Homo sapiens
ttgcacattggagctggtcttct

SEQ ID NO: 7951703 - DNA, 23 bp, Homo sapiens
ttgcacattggagctggtcttct

SEQ ID NO: 7951704 - DNA, 22 bp, Homo sapiens
ttgcacatgttggttcttgaaa

SEQ ID NO: 7951705 - DNA, 22 bp, Homo sapiens
ttgcacatgttggttcttgaaa

SEQ ID NO: 7951706 - DNA, 22 bp, Homo sapiens
ttgcacatttcctagaatttca

SEQ ID NO: 7951707 - DNA, 21 bp, Homo sapiens
ttgcaccatgataaattcaga

SEQ ID NO: 7951708 - DNA, 20 bp, Homo sapiens
ttgcacagagaaggaggcag

SEQ ID NO: 7951709 - DNA, 20 bp, Homo sapiens
ttgcacagagaaggaggcag

SEQ ID NO: 7951710 - DNA, 22 bp, Homo sapiens
ttgcacagaatgacaatatgta

SEQ ID NO: 7951711 - DNA, 18 bp, Homo sapiens
ctcaggcctttccctgtg

SEQ ID NO: 7951712 - DNA, 18 bp, Homo sapiens
ctcaggcctttccctgtg

SEQ ID NO: 7951713 - DNA, 18 bp, Homo sapiens
ctcaggcctttccctgtg

SEQ ID NO: 7951714 - DNA, 22 bp, Homo sapiens
ttgcacagagtggatattcagt

SEQ ID NO: 7951715 - DNA, 20 bp, Homo sapiens
ttgcacagaggtttcaagtg

SEQ ID NO: 7951716 - DNA, 22 bp, Homo sapiens
ctcaggcctgagtggcagtccc

SEQ ID NO: 7951717 - DNA, 22 bp, Homo sapiens
ctcaggcctgagtggcagtccc

SEQ ID NO: 7951718 - DNA, 22 bp, Homo sapiens
ctcaggccttgaagtcttttct

SEQ ID NO: 7951719 - DNA, 22 bp, Homo sapiens
ctcaggccttgaagtcttttct

SEQ ID NO: 7951720 - DNA, 22 bp, Homo sapiens
ctcaggccttgaagtcttttct

SEQ ID NO: 7951721 - DNA, 18 bp, Homo sapiens
ctcaggcctttccctgtg

SEQ ID NO: 7951722 - DNA, 18 bp, Homo sapiens
ctcaggcctttccctgtg

SEQ ID NO: 7951723 - DNA, 22 bp, Homo sapiens
ttgcacagtttgaagatgactc

SEQ ID NO: 7951724 - DNA, 23 bp, Homo sapiens
ttgcacagtgtatacacatattt

SEQ ID NO: 7951725 - DNA, 23 bp, Homo sapiens
ttgcacagtgtatacacatattt

SEQ ID NO: 7951726 - DNA, 22 bp, Homo sapiens
ttgcacatgctatttatgtttt

SEQ ID NO: 7951727 - DNA, 22 bp, Homo sapiens
ttgcacatgctatttatgtttt

SEQ ID NO: 7951728 - DNA, 22 bp, Homo sapiens
ttgcacagatgagggtgatgct

SEQ ID NO: 7951729 - DNA, 22 bp, Homo sapiens
ttgcacagcaacgtgaatgtac

SEQ ID NO: 7951730 - DNA, 22 bp, Homo sapiens
ttgcacagatgcacatggttgc

SEQ ID NO: 7951731 - DNA, 22 bp, Homo sapiens
ttgcacagggctggaatgtcct

SEQ ID NO: 7951732 - DNA, 22 bp, Homo sapiens
ttgcacaggcagtaattgcttg

SEQ ID NO: 7951733 - DNA, 22 bp, Homo sapiens
ttgcacaggcagtaattgcttg

SEQ ID NO: 7951734 - DNA, 22 bp, Homo sapiens
ttcttcatctgtaagataagca

SEQ ID NO: 7951735 - DNA, 22 bp, Homo sapiens
ttcttcagtttggtaaatgtaa

SEQ ID NO: 7951736 - DNA, 21 bp, Homo sapiens
ttcttcatgatgattaatggc

SEQ ID NO: 7951737 - DNA, 22 bp, Homo sapiens
ttcttcagtgacaaaggcaaaa

SEQ ID NO: 7951738 - DNA, 22 bp, Homo sapiens
ttcttcagtgtagcaactgtat

SEQ ID NO: 7951739 - DNA, 22 bp, Homo sapiens
ttcttcatgggttcttttagga

SEQ ID NO: 7951740 - DNA, 22 bp, Homo sapiens
ttcttcatgggttcttttagga

SEQ ID NO: 7951741 - DNA, 22 bp, Homo sapiens
ttcttcatgggttcttttagga

SEQ ID NO: 7951742 - DNA, 21 bp, Homo sapiens
ttcttcatgatgattaatggc

SEQ ID NO: 7951743 - DNA, 21 bp, Homo sapiens
ttcttcatgatgattaatggc

SEQ ID NO: 7951744 - DNA, 22 bp, Homo sapiens
ttcttcatgctgttgctgcttg

SEQ ID NO: 7951745 - DNA, 22 bp, Homo sapiens
ttcttcccagccagcacagccc

SEQ ID NO: 7951746 - DNA, 23 bp, Homo sapiens
ttcttcattttcagagttgagca

SEQ ID NO: 7951747 - DNA, 22 bp, Homo sapiens
ttcttcattcccttacttccga

SEQ ID NO: 7951748 - DNA, 23 bp, Homo sapiens
ttcttcattttcagagttgagca

SEQ ID NO: 7951749 - DNA, 22 bp, Homo sapiens
ttcttcattcccttacttccga

SEQ ID NO: 7951750 - DNA, 23 bp, Homo sapiens
ttcttcattttcagagttgagca

SEQ ID NO: 7951751 - DNA, 22 bp, Homo sapiens
ttgaagtcagagttttcaagca

SEQ ID NO: 7951752 - DNA, 22 bp, Homo sapiens
ttgaagtctttagaacgacctc

SEQ ID NO: 7951753 - DNA, 22 bp, Homo sapiens
ttgaagttgcacattataattt

SEQ ID NO: 7951754 - DNA, 22 bp, Homo sapiens
ttgaagttgcacattataattt

SEQ ID NO: 7951755 - DNA, 22 bp, Homo sapiens
ttgaaatatcaagttattagtg

SEQ ID NO: 7951756 - DNA, 22 bp, Homo sapiens
ttgaaatatcaagttattagtg

SEQ ID NO: 7951757 - DNA, 22 bp, Homo sapiens
ttgaaatatcaagttattagtg

SEQ ID NO: 7951758 - DNA, 22 bp, Homo sapiens
ttgaagtatagagtttaagaac

SEQ ID NO: 7951759 - DNA, 22 bp, Homo sapiens
ttgaatctataatttcagtatt

SEQ ID NO: 7951760 - DNA, 22 bp, Homo sapiens
ttgaatcattacaatagataag

SEQ ID NO: 7951761 - DNA, 22 bp, Homo sapiens
ttgaatcattacaatagataag

SEQ ID NO: 7951762 - DNA, 22 bp, Homo sapiens
ttgaatgaagggatgaccgaag

SEQ ID NO: 7951763 - DNA, 22 bp, Homo sapiens
ttgaatctcatcccaatgttgt

SEQ ID NO: 7951764 - DNA, 22 bp, Homo sapiens
ttgaatctctctgagattcagt

SEQ ID NO: 7951765 - DNA, 22 bp, Homo sapiens
ttgaatcttagctctgccactt

SEQ ID NO: 7951766 - DNA, 22 bp, Homo sapiens
ttgaatctgggtacttgtaata

SEQ ID NO: 7951767 - DNA, 22 bp, Homo sapiens
ttgaatctcttgaatctctgtt

SEQ ID NO: 7951768 - DNA, 22 bp, Homo sapiens
ttgaatctctctgagattcagt

SEQ ID NO: 7951769 - DNA, 22 bp, Homo sapiens
ttgaagtttaatggtagattcc

SEQ ID NO: 7951770 - DNA, 22 bp, Homo sapiens
ttgaagttggtgtggaaagtag

SEQ ID NO: 7951771 - DNA, 22 bp, Homo sapiens
ttgaataatatgttcaggagga

SEQ ID NO: 7951772 - DNA, 22 bp, Homo sapiens
ttgaataaatgagcagtgaatt

SEQ ID NO: 7951773 - DNA, 22 bp, Homo sapiens
ttgaataaatgagcagtgaatt

SEQ ID NO: 7951774 - DNA, 22 bp, Homo sapiens
ttgaataatgtgtatgttgtta

SEQ ID NO: 7951775 - DNA, 22 bp, Homo sapiens
ttgaataatgtgtatgttgtta

SEQ ID NO: 7951776 - DNA, 22 bp, Homo sapiens
ttgaataattaattacactcag

SEQ ID NO: 7951777 - DNA, 22 bp, Homo sapiens
ttgaatactcagaaaatgacat

SEQ ID NO: 7951778 - DNA, 20 bp, Homo sapiens
ctcagaaaagctaaggagaa

SEQ ID NO: 7951779 - DNA, 22 bp, Homo sapiens
ctcagaaacggagctgccattt

SEQ ID NO: 7951780 - DNA, 22 bp, Homo sapiens
ctcagaaacggagctgccattt

SEQ ID NO: 7951781 - DNA, 22 bp, Homo sapiens
ctcagaaacggagctgccattt

SEQ ID NO: 7951782 - DNA, 20 bp, Homo sapiens
ctcagaaaagctaaggagaa

SEQ ID NO: 7951783 - DNA, 22 bp, Homo sapiens
ctcagaaaacctctttcttgat

SEQ ID NO: 7951784 - DNA, 22 bp, Homo sapiens
ctcagaaaacctctttcttgat

SEQ ID NO: 7951785 - DNA, 22 bp, Homo sapiens
ctcactgtttaatagctggatc

SEQ ID NO: 7951786 - DNA, 22 bp, Homo sapiens
ctcactgtttaatagctggatc

SEQ ID NO: 7951787 - DNA, 22 bp, Homo sapiens
ctcactgtgacctcagcagaca

SEQ ID NO: 7951788 - DNA, 22 bp, Homo sapiens
ctcactggcaagactacaggtg

SEQ ID NO: 7951789 - DNA, 22 bp, Homo sapiens
ctcactggcaagactacaggtg

SEQ ID NO: 7951790 - DNA, 22 bp, Homo sapiens
ctcactgcaagctctgcctccc

SEQ ID NO: 7951791 - DNA, 22 bp, Homo sapiens
ctcactgcaagctctgcctccc

SEQ ID NO: 7951792 - DNA, 22 bp, Homo sapiens
ctcactgcaagctctgcctcca

SEQ ID NO: 7951793 - DNA, 22 bp, Homo sapiens
ctcactgcaagctccgcctccc

SEQ ID NO: 7951794 - DNA, 22 bp, Homo sapiens
ctcactgcaagctctgcctcca

SEQ ID NO: 7951795 - DNA, 22 bp, Homo sapiens
ctcactgcaagctctgcctcca

SEQ ID NO: 7951796 - DNA, 22 bp, Homo sapiens
ctcactgccctgaagttgggtt

SEQ ID NO: 7951797 - DNA, 22 bp, Homo sapiens
ctcactggcaagactacaggtg

SEQ ID NO: 7951798 - DNA, 22 bp, Homo sapiens
ctcactggcaagactacaggtg

SEQ ID NO: 7951799 - DNA, 22 bp, Homo sapiens
ctcactgcaagctctgcctccc

SEQ ID NO: 7951800 - DNA, 22 bp, Homo sapiens
ctataaatctacccagcattgg

SEQ ID NO: 7951801 - DNA, 22 bp, Homo sapiens
ctataaatctacccagcattgg

SEQ ID NO: 7951802 - DNA, 22 bp, Homo sapiens
ttctcttttgtgatgtgagatg

SEQ ID NO: 7951803 - DNA, 22 bp, Homo sapiens
ttctctttttgcatctcaacct

SEQ ID NO: 7951804 - DNA, 22 bp, Homo sapiens
ttctctttttgcatctcaacct

SEQ ID NO: 7951805 - DNA, 22 bp, Homo sapiens
ttctgaaaacacactttgcagc

SEQ ID NO: 7951806 - DNA, 22 bp, Homo sapiens
ttctgaaaacacactttgcagc

SEQ ID NO: 7951807 - DNA, 22 bp, Homo sapiens
ttctgaaaacacactttgcagc

SEQ ID NO: 7951808 - DNA, 22 bp, Homo sapiens
ttctgaaaattgggtcatactt

SEQ ID NO: 7951809 - DNA, 22 bp, Homo sapiens
ttctgaaaacacactttgcagc

SEQ ID NO: 7951810 - DNA, 23 bp, Homo sapiens
ttctgaaaatagatagtggctcc

SEQ ID NO: 7951811 - DNA, 22 bp, Homo sapiens
ttctgaaaattgggtcatactt

SEQ ID NO: 7951812 - DNA, 22 bp, Homo sapiens
ttctgaaaccactgaccaacta

SEQ ID NO: 7951813 - DNA, 22 bp, Homo sapiens
ttctgaaaccttcagtatgaag

SEQ ID NO: 7951814 - DNA, 22 bp, Homo sapiens
ttctgaaaccttcagtatgaag

SEQ ID NO: 7951815 - DNA, 22 bp, Homo sapiens
ttctgaaaccttcagtatgaag

SEQ ID NO: 7951816 - DNA, 22 bp, Homo sapiens
ttctgaaaccttcagtatgaag

SEQ ID NO: 7951817 - DNA, 20 bp, Homo sapiens
ttctgaaagcagcagaggga

SEQ ID NO: 7951818 - DNA, 22 bp, Homo sapiens
ttctgaaagccaattcattgaa

SEQ ID NO: 7951819 - DNA, 20 bp, Homo sapiens
ttctgaaagcagcagaggga

SEQ ID NO: 7951820 - DNA, 22 bp, Homo sapiens
ttctgaaatttcaactttacta

SEQ ID NO: 7951821 - DNA, 22 bp, Homo sapiens
ttctgaaatttctgtagatctt

SEQ ID NO: 7951822 - DNA, 22 bp, Homo sapiens
ttctgaaatttcaactttacta

SEQ ID NO: 7951823 - DNA, 22 bp, Homo sapiens
ttctgaagctcccttttgtagt

SEQ ID NO: 7951824 - DNA, 22 bp, Homo sapiens
ttctgaaccattgagcactgcc

SEQ ID NO: 7951825 - DNA, 22 bp, Homo sapiens
ttctgaagctcccttttgtagt

SEQ ID NO: 7951826 - DNA, 22 bp, Homo sapiens
ttctgaaatttctgtagatctt

SEQ ID NO: 7951827 - DNA, 22 bp, Homo sapiens
ttctgtctccctgatgtagagc

SEQ ID NO: 7951828 - DNA, 22 bp, Homo sapiens
ttctgtctccctgatgtagagc

SEQ ID NO: 7951829 - DNA, 22 bp, Homo sapiens
ttctgtcctgttggatgaatca

SEQ ID NO: 7951830 - DNA, 22 bp, Homo sapiens
ttcttaaaattcaagctaggtt

SEQ ID NO: 7951831 - DNA, 22 bp, Homo sapiens
ttcttaaaattcaagctaggtt

SEQ ID NO: 7951832 - DNA, 22 bp, Homo sapiens
ttctgtctctgtgtttacatta

SEQ ID NO: 7951833 - DNA, 22 bp, Homo sapiens
ttctgaaatgagatataaggta

SEQ ID NO: 7951834 - DNA, 22 bp, Homo sapiens
ttctgaaataggagatagctgt

SEQ ID NO: 7951835 - DNA, 22 bp, Homo sapiens
ttctgaaagtctttttaagtta

SEQ ID NO: 7951836 - DNA, 22 bp, Homo sapiens
ttctgaaattcgactatccaat

SEQ ID NO: 7951837 - DNA, 22 bp, Homo sapiens
ttctgaaattcgactatccaat

SEQ ID NO: 7951838 - DNA, 22 bp, Homo sapiens
ttctgaaatgagatataaggta

SEQ ID NO: 7951839 - DNA, 22 bp, Homo sapiens
ttctgaaagccaattcattgaa

SEQ ID NO: 7951840 - DNA, 22 bp, Homo sapiens
ttctgaaagccaattcattgaa

SEQ ID NO: 7951841 - DNA, 22 bp, Homo sapiens
ttctgaaagtctttttaagtta

SEQ ID NO: 7951842 - DNA, 22 bp, Homo sapiens
ttctgaaagtctttttaagtta

SEQ ID NO: 7951843 - DNA, 22 bp, Homo sapiens
ttctgaaagtctttttaagtta

SEQ ID NO: 7951844 - DNA, 22 bp, Homo sapiens
ttctgaaaggcatgtcaggtag

SEQ ID NO: 7951845 - DNA, 22 bp, Homo sapiens
ttctgaaaggcaggttgtttgc

SEQ ID NO: 7951846 - DNA, 22 bp, Homo sapiens
ttcttaactggaaaatgtcaga

SEQ ID NO: 7951847 - DNA, 22 bp, Homo sapiens
ttcttaaagaggcaaaacacag

SEQ ID NO: 7951848 - DNA, 20 bp, Homo sapiens
ttcttaaagacctcactttg

SEQ ID NO: 7951849 - DNA, 20 bp, Homo sapiens
ttcttaaagacctcactttg

SEQ ID NO: 7951850 - DNA, 20 bp, Homo sapiens
ttcttaaagacctcactttg

SEQ ID NO: 7951851 - DNA, 22 bp, Homo sapiens
ttcttaaagaggcaaaacacag

SEQ ID NO: 7951852 - DNA, 22 bp, Homo sapiens
ttcttaagactgcaaatcaacc

SEQ ID NO: 7951853 - DNA, 22 bp, Homo sapiens
ttcttaagactgcaaatcaacc

SEQ ID NO: 7951854 - DNA, 22 bp, Homo sapiens
ttcttaactggaaaatgtcaga

SEQ ID NO: 7951855 - DNA, 22 bp, Homo sapiens
ttcttaagaggaacatttttgt

SEQ ID NO: 7951856 - DNA, 22 bp, Homo sapiens
ttcttaagaggaacatttttgt

SEQ ID NO: 7951857 - DNA, 22 bp, Homo sapiens
ttcttaagagggttaagtgaag

SEQ ID NO: 7951858 - DNA, 22 bp, Homo sapiens
ttcttaagactgcaaatcaacc

SEQ ID NO: 7951859 - DNA, 22 bp, Homo sapiens
ttcttaagaaaccatcacattc

SEQ ID NO: 7951860 - DNA, 22 bp, Homo sapiens
ttcttaagtcagtaagatgcaa

SEQ ID NO: 7951861 - DNA, 22 bp, Homo sapiens
ttcttaagtcagtaagatgcaa

SEQ ID NO: 7951862 - DNA, 22 bp, Homo sapiens
ttcttaagtatttcagagactg

SEQ ID NO: 7951863 - DNA, 22 bp, Homo sapiens
ttcttaagcacctaaaaagtgg

SEQ ID NO: 7951864 - DNA, 22 bp, Homo sapiens
ttcttaagtatgatcttaacgg

SEQ ID NO: 7951865 - DNA, 22 bp, Homo sapiens
ttcttaagcgtatgataatgaa

SEQ ID NO: 7951866 - DNA, 22 bp, Homo sapiens
ttcttaagcagtttggcatgtt

SEQ ID NO: 7951867 - DNA, 22 bp, Homo sapiens
ttcttaagcacctaaaaagtgg

SEQ ID NO: 7951868 - DNA, 22 bp, Homo sapiens
ttcttaagcacctaaaaagtgg

SEQ ID NO: 7951869 - DNA, 22 bp, Homo sapiens
ttcttaatggcaaaggatttta

SEQ ID NO: 7951870 - DNA, 22 bp, Homo sapiens
ttcttaatcccacaaatcttca

SEQ ID NO: 7951871 - DNA, 22 bp, Homo sapiens
ttcttacaaacaagatcattga

SEQ ID NO: 7951872 - DNA, 22 bp, Homo sapiens
ttcttaatggcaaaggatttta

SEQ ID NO: 7951873 - DNA, 22 bp, Homo sapiens
ttcttacaagtatgacgtagca

SEQ ID NO: 7951874 - DNA, 19 bp, Homo sapiens
ttcttacaacaccctggga

SEQ ID NO: 7951875 - DNA, 22 bp, Homo sapiens
ttcttaatctgtgtgggttcga

SEQ ID NO: 7951876 - DNA, 22 bp, Homo sapiens
ttcttaagtgagaaagcaggag

SEQ ID NO: 7951877 - DNA, 22 bp, Homo sapiens
ttcttaagtgagaaagcaggag

SEQ ID NO: 7951878 - DNA, 22 bp, Homo sapiens
ttcttaagtttagcaacttgtg

SEQ ID NO: 7951879 - DNA, 22 bp, Homo sapiens
ttcttaagtttagcaacttgtg

SEQ ID NO: 7951880 - DNA, 22 bp, Homo sapiens
ttcttcagggaagcttgttaat

SEQ ID NO: 7951881 - DNA, 22 bp, Homo sapiens
ttcttcagggaagcttgttaat

SEQ ID NO: 7951882 - DNA, 21 bp, Homo sapiens
ttcttcaggccaatgctcatt

SEQ ID NO: 7951883 - DNA, 22 bp, Homo sapiens
ttcttcagtcccactagccaca

SEQ ID NO: 7951884 - DNA, 22 bp, Homo sapiens
ttcttcagtcccactagccaca

SEQ ID NO: 7951885 - DNA, 22 bp, Homo sapiens
ttcttcaggaagagcctggact

SEQ ID NO: 7951886 - DNA, 22 bp, Homo sapiens
ttcttcaggatacgtcatccag

SEQ ID NO: 7951887 - DNA, 22 bp, Homo sapiens
ttcttcagcttctacctgcgtc

SEQ ID NO: 7951888 - DNA, 22 bp, Homo sapiens
ttcttacaagtattccaggtcc

SEQ ID NO: 7951889 - DNA, 22 bp, Homo sapiens
ttcttacaagtattccaggtcc

SEQ ID NO: 7951890 - DNA, 22 bp, Homo sapiens
ttaatatgctgcttcttgaaaa

SEQ ID NO: 7951891 - DNA, 22 bp, Homo sapiens
ttaatatacaattttacgggct

SEQ ID NO: 7951892 - DNA, 22 bp, Homo sapiens
ttaatagatttgattttaaagg

SEQ ID NO: 7951893 - DNA, 22 bp, Homo sapiens
ttaatagatttgattttaaagg

SEQ ID NO: 7951894 - DNA, 22 bp, Homo sapiens
ttaatagatatgcctctagagt

SEQ ID NO: 7951895 - DNA, 22 bp, Homo sapiens
ttaatagatttgattttaaagg

SEQ ID NO: 7951896 - DNA, 22 bp, Homo sapiens
ttaatactataatttgaagtac

SEQ ID NO: 7951897 - DNA, 22 bp, Homo sapiens
ttaaggaaacatttttccatag

SEQ ID NO: 7951898 - DNA, 22 bp, Homo sapiens
ttaaggaaacatttttccatag

SEQ ID NO: 7951899 - DNA, 22 bp, Homo sapiens
ttaagctctcattattattatt

SEQ ID NO: 7951900 - DNA, 22 bp, Homo sapiens
ttaagctcccagaagagggaga

SEQ ID NO: 7951901 - DNA, 19 bp, Homo sapiens
ttaagctaagatactagta

SEQ ID NO: 7951902 - DNA, 22 bp, Homo sapiens
ttaagctagtgaagtccctcaa

SEQ ID NO: 7951903 - DNA, 22 bp, Homo sapiens
cctgtcacgatgactgcactct

SEQ ID NO: 7951904 - DNA, 18 bp, Homo sapiens
cctgtcacgtccaggcct

SEQ ID NO: 7951905 - DNA, 22 bp, Homo sapiens
cctgtatttgcttccttctgca

SEQ ID NO: 7951906 - DNA, 22 bp, Homo sapiens
cctgtatttgcttccttctgca

SEQ ID NO: 7951907 - DNA, 22 bp, Homo sapiens
cctgtatttgcttccttctgca

SEQ ID NO: 7951908 - DNA, 22 bp, Homo sapiens
cctgtcacctaggtactgagca

SEQ ID NO: 7951909 - DNA, 22 bp, Homo sapiens
cctgtaggcgagggatggacag

SEQ ID NO: 7951910 - DNA, 22 bp, Homo sapiens
cctgtaggatattgtagaatac

SEQ ID NO: 7951911 - DNA, 22 bp, Homo sapiens
cctgtaccattttccctagtct

SEQ ID NO: 7951912 - DNA, 22 bp, Homo sapiens
cctgtaccgcgatctgctgcgc

SEQ ID NO: 7951913 - DNA, 21 bp, Homo sapiens
cctgtaccactgtaagatgcc

SEQ ID NO: 7951914 - DNA, 22 bp, Homo sapiens
cctgtaccgcgatctgctgcgc

SEQ ID NO: 7951915 - DNA, 22 bp, Homo sapiens
cctgtactagggtctcattgcc

SEQ ID NO: 7951916 - DNA, 22 bp, Homo sapiens
cctgtattaggtagacaactat

SEQ ID NO: 7951917 - DNA, 22 bp, Homo sapiens
cctgtattatttgtatgtgctg

SEQ ID NO: 7951918 - DNA, 22 bp, Homo sapiens
cctgtattaggtagacaactat

SEQ ID NO: 7951919 - DNA, 22 bp, Homo sapiens
cctgtattatttgtatgtgctg

SEQ ID NO: 7951920 - DNA, 22 bp, Homo sapiens
cctgtattatttgtatgtgctg

SEQ ID NO: 7951921 - DNA, 22 bp, Homo sapiens
cctgtattcaattttgtgtgat

SEQ ID NO: 7951922 - DNA, 22 bp, Homo sapiens
cctgtattcaattttgtgtgat

SEQ ID NO: 7951923 - DNA, 22 bp, Homo sapiens
cctgtattgtgcccagaatctc

SEQ ID NO: 7951924 - DNA, 22 bp, Homo sapiens
cctgtattggaagcagtaggga

SEQ ID NO: 7951925 - DNA, 22 bp, Homo sapiens
cctgtatttaaaaatattctaa

SEQ ID NO: 7951926 - DNA, 22 bp, Homo sapiens
cctgtattgtgcccagaatctc

SEQ ID NO: 7951927 - DNA, 22 bp, Homo sapiens
cctgtatttgcaacttttctta

SEQ ID NO: 7951928 - DNA, 22 bp, Homo sapiens
cctgtatttgcaacttttctta

SEQ ID NO: 7951929 - DNA, 22 bp, Homo sapiens
cctgtatttgcatctggcctct

SEQ ID NO: 7951930 - DNA, 22 bp, Homo sapiens
cctgtatttgcatctggcctct

SEQ ID NO: 7951931 - DNA, 19 bp, Homo sapiens
cctgtacattattctcccc

SEQ ID NO: 7951932 - DNA, 22 bp, Homo sapiens
cctgtacagtgaatgaatgtga

SEQ ID NO: 7951933 - DNA, 22 bp, Homo sapiens
cctgtacatctgctctcattgc

SEQ ID NO: 7951934 - DNA, 22 bp, Homo sapiens
cctgtacatggccatctttacc

SEQ ID NO: 7951935 - DNA, 22 bp, Homo sapiens
cctgtacattagctgtgaattg

SEQ ID NO: 7951936 - DNA, 22 bp, Homo sapiens
cctgtacatggccatctttacc

SEQ ID NO: 7951937 - DNA, 22 bp, Homo sapiens
cctgtacacggtctatgcctcc

SEQ ID NO: 7951938 - DNA, 22 bp, Homo sapiens
cctgtacacaattccgaggata

SEQ ID NO: 7951939 - DNA, 22 bp, Homo sapiens
cctgtacaagctcttggtgaca

SEQ ID NO: 7951940 - DNA, 22 bp, Homo sapiens
ttaaaatgaatattgattagca

SEQ ID NO: 7951941 - DNA, 22 bp, Homo sapiens
ttaaaatgaatattgattagca

SEQ ID NO: 7951942 - DNA, 21 bp, Homo sapiens
ttaaaatgaggaagtggtggc

SEQ ID NO: 7951943 - DNA, 22 bp, Homo sapiens
ttaaaatgaatattgattagca

SEQ ID NO: 7951944 - DNA, 21 bp, Homo sapiens
ttaaaatgaggaagtggtggc

SEQ ID NO: 7951945 - DNA, 22 bp, Homo sapiens
ttaaaatgcagattatgactca

SEQ ID NO: 7951946 - DNA, 22 bp, Homo sapiens
ttaaaatgcagattatgactca

SEQ ID NO: 7951947 - DNA, 22 bp, Homo sapiens
cctggtttttcaaacatacaag

SEQ ID NO: 7951948 - DNA, 22 bp, Homo sapiens
cctggtttgtatttttaacacc

SEQ ID NO: 7951949 - DNA, 22 bp, Homo sapiens
cctgtaactccttggctcaagt

SEQ ID NO: 7951950 - DNA, 22 bp, Homo sapiens
cctgtacaagagccatctggat

SEQ ID NO: 7951951 - DNA, 22 bp, Homo sapiens
ttaaaatgaatattgattagca

SEQ ID NO: 7951952 - DNA, 22 bp, Homo sapiens
ttaaaatctaaagcagttgtct

SEQ ID NO: 7951953 - DNA, 22 bp, Homo sapiens
ttaaaatcgctgttgcttctgt

SEQ ID NO: 7951954 - DNA, 22 bp, Homo sapiens
ttaaaatcgctgttgcttctgt

SEQ ID NO: 7951955 - DNA, 22 bp, Homo sapiens
ttaaaatcgctgttgcttctgt

SEQ ID NO: 7951956 - DNA, 22 bp, Homo sapiens
ttaaaatccagtgttggtggat

SEQ ID NO: 7951957 - DNA, 22 bp, Homo sapiens
ttaaaatcacagtcacccagta

SEQ ID NO: 7951958 - DNA, 22 bp, Homo sapiens
ttaaaatagccagtgcccctct

SEQ ID NO: 7951959 - DNA, 22 bp, Homo sapiens
ttaaaatagccagtgcccctct

SEQ ID NO: 7951960 - DNA, 22 bp, Homo sapiens
ttaaaatagccagtgcccctct

SEQ ID NO: 7951961 - DNA, 22 bp, Homo sapiens
ttaaaagggatgttatctgtaa

SEQ ID NO: 7951962 - DNA, 22 bp, Homo sapiens
ttaaaagggatgttatctgtaa

SEQ ID NO: 7951963 - DNA, 22 bp, Homo sapiens
ttaaaagggtaagcagcaactt

SEQ ID NO: 7951964 - DNA, 23 bp, Homo sapiens
ttaaaagtggagagagaagctgg

SEQ ID NO: 7951965 - DNA, 22 bp, Homo sapiens
ttaaaagtctgatgatttacat

SEQ ID NO: 7951966 - DNA, 22 bp, Homo sapiens
ttaaaatagccagtgcccctct

SEQ ID NO: 7951967 - DNA, 22 bp, Homo sapiens
ttaaaatagccagtgcccctct

SEQ ID NO: 7951968 - DNA, 22 bp, Homo sapiens
ttaaaatagccagtgcccctct

SEQ ID NO: 7951969 - DNA, 23 bp, Homo sapiens
ttaaaagtggagagagaagctgg

SEQ ID NO: 7951970 - DNA, 23 bp, Homo sapiens
ttaaaagtggagagagaagctgg

SEQ ID NO: 7951971 - DNA, 22 bp, Homo sapiens
tgttttctattacctgagattg

SEQ ID NO: 7951972 - DNA, 22 bp, Homo sapiens
tgttttctattacctgagattg

SEQ ID NO: 7951973 - DNA, 22 bp, Homo sapiens
tgttttctcttgaaaagcagtc

SEQ ID NO: 7951974 - DNA, 22 bp, Homo sapiens
tgttttctattacctgagattg

SEQ ID NO: 7951975 - DNA, 22 bp, Homo sapiens
tgttttctagaaacaatgccta

SEQ ID NO: 7951976 - DNA, 22 bp, Homo sapiens
tgttttctagaaacaatgccta

SEQ ID NO: 7951977 - DNA, 22 bp, Homo sapiens
tgttttctcttgaaaagcagtc

SEQ ID NO: 7951978 - DNA, 22 bp, Homo sapiens
ttaaaagagcagcccagcatat

SEQ ID NO: 7951979 - DNA, 22 bp, Homo sapiens
ttaaaagagcagcccagcatat

SEQ ID NO: 7951980 - DNA, 22 bp, Homo sapiens
ttaaaagagcagcccagcatat

SEQ ID NO: 7951981 - DNA, 22 bp, Homo sapiens
ttaaaagagcagcccagcatat

SEQ ID NO: 7951982 - DNA, 22 bp, Homo sapiens
ttaaaagagcagcccagcatat

SEQ ID NO: 7951983 - DNA, 22 bp, Homo sapiens
ttaaaaggcatcataggtgaat

SEQ ID NO: 7951984 - DNA, 22 bp, Homo sapiens
ttaatcttatattgttgggacc

SEQ ID NO: 7951985 - DNA, 22 bp, Homo sapiens
ttaatcttatatgtaaaggtaa

SEQ ID NO: 7951986 - DNA, 22 bp, Homo sapiens
ttaatctaagtaatggatgctg

SEQ ID NO: 7951987 - DNA, 22 bp, Homo sapiens
ttaatccatggcagttattaaa

SEQ ID NO: 7951988 - DNA, 22 bp, Homo sapiens
ttaatccaatatcctggctatt

SEQ ID NO: 7951989 - DNA, 21 bp, Homo sapiens
ttaatcagtctccctgtctcc

SEQ ID NO: 7951990 - DNA, 22 bp, Homo sapiens
ttaatccaatatcctggctatt

SEQ ID NO: 7951991 - DNA, 22 bp, Homo sapiens
ttaatccatggcagttattaaa

SEQ ID NO: 7951992 - DNA, 22 bp, Homo sapiens
ttaatccaataacaaggttcaa

SEQ ID NO: 7951993 - DNA, 22 bp, Homo sapiens
ttaatcacagatattaaacatg

SEQ ID NO: 7951994 - DNA, 22 bp, Homo sapiens
ttaatcacagatattaaacatg

SEQ ID NO: 7951995 - DNA, 22 bp, Homo sapiens
ttaatcacagctctgccatgag

SEQ ID NO: 7951996 - DNA, 22 bp, Homo sapiens
ttaatcacagctctgccatgag

SEQ ID NO: 7951997 - DNA, 22 bp, Homo sapiens
ttaatgatttggaaccctttaa

SEQ ID NO: 7951998 - DNA, 22 bp, Homo sapiens
ttaatgatacctatgttaattt

SEQ ID NO: 7951999 - DNA, 22 bp, Homo sapiens
ttaatcttcagggactcttgct

SEQ ID NO: 7952000 - DNA, 22 bp, Homo sapiens
ttaatcttcagggactcttgct

SEQ ID NO: 7952001 - DNA, 22 bp, Homo sapiens
ttaatgaatatgacaggagagg

SEQ ID NO: 7952002 - DNA, 22 bp, Homo sapiens
ttaatgaatatgacaggagagg

SEQ ID NO: 7952003 - DNA, 21 bp, Homo sapiens
cctgtggattttaaaattgga

SEQ ID NO: 7952004 - DNA, 22 bp, Homo sapiens
cctgtggagttcccatctgaat

SEQ ID NO: 7952005 - DNA, 22 bp, Homo sapiens
cctgtggaggctgctcagctgg

SEQ ID NO: 7952006 - DNA, 22 bp, Homo sapiens
cctgtggaggctgctcagctgg

SEQ ID NO: 7952007 - DNA, 22 bp, Homo sapiens
cctgtggagctttcagcagctc

SEQ ID NO: 7952008 - DNA, 20 bp, Homo sapiens
cctgtggagctgcctcctcc

SEQ ID NO: 7952009 - DNA, 20 bp, Homo sapiens
cctgtggagctgcctcctcc

SEQ ID NO: 7952010 - DNA, 22 bp, Homo sapiens
cctgtggccgcgtcgggcggcg

SEQ ID NO: 7952011 - DNA, 19 bp, Homo sapiens
cctgtggcagagtggaaac

SEQ ID NO: 7952012 - DNA, 23 bp, Homo sapiens
cctgtggcaagtagatgagatga

SEQ ID NO: 7952013 - DNA, 22 bp, Homo sapiens
cctgtggcacatgcagggattc

SEQ ID NO: 7952014 - DNA, 22 bp, Homo sapiens
cctgtggcacatgcagggattc

SEQ ID NO: 7952015 - DNA, 23 bp, Homo sapiens
cctgtggcaagtagatgagatga

SEQ ID NO: 7952016 - DNA, 22 bp, Homo sapiens
cctgtgctttaggcctcaaact

SEQ ID NO: 7952017 - DNA, 22 bp, Homo sapiens
ttaatgccaacaaagtgatttt

SEQ ID NO: 7952018 - DNA, 22 bp, Homo sapiens
ttaatgccaacaaagtgatttt

SEQ ID NO: 7952019 - DNA, 22 bp, Homo sapiens
cctgtgcttcagctggaggagg

SEQ ID NO: 7952020 - DNA, 22 bp, Homo sapiens
ttaatgcagaaatcaaactgac

SEQ ID NO: 7952021 - DNA, 22 bp, Homo sapiens
cctgtggaatagaatcttccct

SEQ ID NO: 7952022 - DNA, 22 bp, Homo sapiens
cctgtggaccaggaggcagccc

SEQ ID NO: 7952023 - DNA, 22 bp, Homo sapiens
cctgtggaccaggaggcagccc

SEQ ID NO: 7952024 - DNA, 22 bp, Homo sapiens
ttacaagtatttaagatgctgt

SEQ ID NO: 7952025 - DNA, 21 bp, Homo sapiens
ttacaaagctacagatgttgc

SEQ ID NO: 7952026 - DNA, 22 bp, Homo sapiens
ttacaagtactgaatatgattt

SEQ ID NO: 7952027 - DNA, 21 bp, Homo sapiens
ttacaaagctacagatgttgc

SEQ ID NO: 7952028 - DNA, 22 bp, Homo sapiens
ttacaagtgtcaggtactggca

SEQ ID NO: 7952029 - DNA, 22 bp, Homo sapiens
ttacaagtgtcaggcgctggca

SEQ ID NO: 7952030 - DNA, 22 bp, Homo sapiens
cctgtggctggtcaggccagca

SEQ ID NO: 7952031 - DNA, 21 bp, Homo sapiens
ttacaaagctacagatgttgc

SEQ ID NO: 7952032 - DNA, 22 bp, Homo sapiens
cctgtggctgccacttgggtga

SEQ ID NO: 7952033 - DNA, 22 bp, Homo sapiens
cctgtggctggtcaggccagca

SEQ ID NO: 7952034 - DNA, 22 bp, Homo sapiens
cctgtggctggtcaggccagca

SEQ ID NO: 7952035 - DNA, 22 bp, Homo sapiens
cctgtggctggtcaggccagca

SEQ ID NO: 7952036 - DNA, 22 bp, Homo sapiens
cctgtggcgggggccagtgcct

SEQ ID NO: 7952037 - DNA, 22 bp, Homo sapiens
cctgtggcgggggccagtgcct

SEQ ID NO: 7952038 - DNA, 22 bp, Homo sapiens
cctgtggcgggggccagtgcct

SEQ ID NO: 7952039 - DNA, 22 bp, Homo sapiens
cctgtggcgggggccagtgcct

SEQ ID NO: 7952040 - DNA, 22 bp, Homo sapiens
cctgtggcgggggccagtgcct

SEQ ID NO: 7952041 - DNA, 22 bp, Homo sapiens
cctgtggcgggggccagtgcct

SEQ ID NO: 7952042 - DNA, 18 bp, Homo sapiens
cctgtggctcagcccaca

SEQ ID NO: 7952043 - DNA, 18 bp, Homo sapiens
cctgtggctcagcccaca

SEQ ID NO: 7952044 - DNA, 22 bp, Homo sapiens
ttacaagttcagattttctcat

SEQ ID NO: 7952045 - DNA, 23 bp, Homo sapiens
ttacaagttctgaaatttccttc

SEQ ID NO: 7952046 - DNA, 22 bp, Homo sapiens
ttacaagttcagattttctcat

SEQ ID NO: 7952047 - DNA, 23 bp, Homo sapiens
ttacaagttctgaaatttccttc

SEQ ID NO: 7952048 - DNA, 20 bp, Homo sapiens
ttacaagtttctaataacca

SEQ ID NO: 7952049 - DNA, 22 bp, Homo sapiens
ttacaagtttctggcttcatcc

SEQ ID NO: 7952050 - DNA, 20 bp, Homo sapiens
ttacaagtttctaataacca

SEQ ID NO: 7952051 - DNA, 20 bp, Homo sapiens
ttacaagtttctaataacca

SEQ ID NO: 7952052 - DNA, 22 bp, Homo sapiens
ttacaagtttctggcttcatcc

SEQ ID NO: 7952053 - DNA, 22 bp, Homo sapiens
ttacaagtttctggcttcatcc

SEQ ID NO: 7952054 - DNA, 22 bp, Homo sapiens
ttacaagttttcatgaaattga

SEQ ID NO: 7952055 - DNA, 22 bp, Homo sapiens
ttacaagttttcatgaaattga

SEQ ID NO: 7952056 - DNA, 22 bp, Homo sapiens
ttacaatagttccttcttttgt

SEQ ID NO: 7952057 - DNA, 22 bp, Homo sapiens
ttacaatagttccttcttttgt

SEQ ID NO: 7952058 - DNA, 22 bp, Homo sapiens
ttacaatgacaggtgtatcatt

SEQ ID NO: 7952059 - DNA, 22 bp, Homo sapiens
ttacaatcatctaggataaaga

SEQ ID NO: 7952060 - DNA, 22 bp, Homo sapiens
ttacaatcatctaggataaaga

SEQ ID NO: 7952061 - DNA, 22 bp, Homo sapiens
ttacaatagttccttcttttgt

SEQ ID NO: 7952062 - DNA, 22 bp, Homo sapiens
ttacaatagttccttcttttgt

SEQ ID NO: 7952063 - DNA, 22 bp, Homo sapiens
ttacaatagttccttcttttgt

SEQ ID NO: 7952064 - DNA, 22 bp, Homo sapiens
ttacaatagttccttcttttgt

SEQ ID NO: 7952065 - DNA, 22 bp, Homo sapiens
ttacaataccacatcacctcat

SEQ ID NO: 7952066 - DNA, 22 bp, Homo sapiens
tgttttcctcctggtttctgcc

SEQ ID NO: 7952067 - DNA, 22 bp, Homo sapiens
tgttttccggcctcagcacgcc

SEQ ID NO: 7952068 - DNA, 22 bp, Homo sapiens
tgttttctagaaacaatgccta

SEQ ID NO: 7952069 - DNA, 21 bp, Homo sapiens
tgttttctaaagggcggatca

SEQ ID NO: 7952070 - DNA, 22 bp, Homo sapiens
tgttttcatttgatgtaacaaa

SEQ ID NO: 7952071 - DNA, 22 bp, Homo sapiens
tgttttcatttgatgtaacaaa

SEQ ID NO: 7952072 - DNA, 22 bp, Homo sapiens
tgttttcatttgatgtaacaaa

SEQ ID NO: 7952073 - DNA, 21 bp, Homo sapiens
tgttttccaccttgaggcaag

SEQ ID NO: 7952074 - DNA, 22 bp, Homo sapiens
tgttttcagtcatatagcaggt

SEQ ID NO: 7952075 - DNA, 22 bp, Homo sapiens
tgttttcatcacagaatgtaac

SEQ ID NO: 7952076 - DNA, 22 bp, Homo sapiens
tgttttcatcacagaatgtaac

SEQ ID NO: 7952077 - DNA, 17 bp, Homo sapiens
tgttttcattcattgct

SEQ ID NO: 7952078 - DNA, 17 bp, Homo sapiens
tgttttcattcattgct

SEQ ID NO: 7952079 - DNA, 17 bp, Homo sapiens
tgttttcattcattgct

SEQ ID NO: 7952080 - DNA, 17 bp, Homo sapiens
tgttttcattcattgct

SEQ ID NO: 7952081 - DNA, 22 bp, Homo sapiens
tgttttcatggttatgtgtcta

SEQ ID NO: 7952082 - DNA, 22 bp, Homo sapiens
tgttttcatggttatgtgtcta

SEQ ID NO: 7952083 - DNA, 22 bp, Homo sapiens
tgtttcttctcacacaaactca

SEQ ID NO: 7952084 - DNA, 19 bp, Homo sapiens
tgtttcttcctccatctga

SEQ ID NO: 7952085 - DNA, 22 bp, Homo sapiens
tgtttcttctcacacaaactca

SEQ ID NO: 7952086 - DNA, 22 bp, Homo sapiens
tgtttcttctcacacaaactca

SEQ ID NO: 7952087 - DNA, 22 bp, Homo sapiens
tgtttcttctcacacaaactca

SEQ ID NO: 7952088 - DNA, 19 bp, Homo sapiens
tgtttcttcctccatctga

SEQ ID NO: 7952089 - DNA, 22 bp, Homo sapiens
tgtttcttctcacacaaactca

SEQ ID NO: 7952090 - DNA, 22 bp, Homo sapiens
tgtttcttctcacacaaactca

SEQ ID NO: 7952091 - DNA, 22 bp, Homo sapiens
tgtttcttatccaagtggtctg

SEQ ID NO: 7952092 - DNA, 22 bp, Homo sapiens
tgtttcttatccaagtggtctg

SEQ ID NO: 7952093 - DNA, 22 bp, Homo sapiens
tgtttcttacgtttttagaggc

SEQ ID NO: 7952094 - DNA, 22 bp, Homo sapiens
tgtttcttacgtttttagaggc

SEQ ID NO: 7952095 - DNA, 22 bp, Homo sapiens
tgtttctgtctgttttctacat

SEQ ID NO: 7952096 - DNA, 22 bp, Homo sapiens
tgtttctgggtgtgtctcacct

SEQ ID NO: 7952097 - DNA, 22 bp, Homo sapiens
tgtttctgggtgtgtctcacct

SEQ ID NO: 7952098 - DNA, 22 bp, Homo sapiens
tgtttctatctggatcaataga

SEQ ID NO: 7952099 - DNA, 22 bp, Homo sapiens
tgtttctatctggatcaataga

SEQ ID NO: 7952100 - DNA, 22 bp, Homo sapiens
tgtttctatctggatcaataga

SEQ ID NO: 7952101 - DNA, 20 bp, Homo sapiens
tgtttctgacggtaggagag

SEQ ID NO: 7952102 - DNA, 20 bp, Homo sapiens
tgtttctgacggtaggagag

SEQ ID NO: 7952103 - DNA, 22 bp, Homo sapiens
tgtttataccttggtataacca

SEQ ID NO: 7952104 - DNA, 22 bp, Homo sapiens
tgtttataccttggtataacca

SEQ ID NO: 7952105 - DNA, 22 bp, Homo sapiens
tgtttctagagaaaatatttac

SEQ ID NO: 7952106 - DNA, 22 bp, Homo sapiens
tgtttctagagaaaatatttac

SEQ ID NO: 7952107 - DNA, 22 bp, Homo sapiens
tgtttataccttggtataacca

SEQ ID NO: 7952108 - DNA, 22 bp, Homo sapiens
tgtttctaggtcaataattttt

SEQ ID NO: 7952109 - DNA, 22 bp, Homo sapiens
tgtttctataacctctgaagca

SEQ ID NO: 7952110 - DNA, 22 bp, Homo sapiens
tgtttctatctggatcaataga

SEQ ID NO: 7952111 - DNA, 22 bp, Homo sapiens
cctggggctcaagatggcgccg

SEQ ID NO: 7952112 - DNA, 22 bp, Homo sapiens
tgtttataatatgcagtgagca

SEQ ID NO: 7952113 - DNA, 22 bp, Homo sapiens
cctggggctcaagatggcgccg

SEQ ID NO: 7952114 - DNA, 22 bp, Homo sapiens
cctggggctcaagatggcgccg

SEQ ID NO: 7952115 - DNA, 22 bp, Homo sapiens
cctggggctcaagatggcgccg

SEQ ID NO: 7952116 - DNA, 22 bp, Homo sapiens
cctggggccccgagccagaagc

SEQ ID NO: 7952117 - DNA, 22 bp, Homo sapiens
cctggggccccgagccagaagc

SEQ ID NO: 7952118 - DNA, 22 bp, Homo sapiens
cctggggccccgagccagaagc

SEQ ID NO: 7952119 - DNA, 23 bp, Homo sapiens
cctggggcacttgagtcctcatc

SEQ ID NO: 7952120 - DNA, 23 bp, Homo sapiens
cctggggcacttgagtcctcatc

SEQ ID NO: 7952121 - DNA, 23 bp, Homo sapiens
cctggggcacttgagtcctcatc

SEQ ID NO: 7952122 - DNA, 22 bp, Homo sapiens
cctggggattctgacacggagt

SEQ ID NO: 7952123 - DNA, 22 bp, Homo sapiens
cctggggattctgacacggagt

SEQ ID NO: 7952124 - DNA, 22 bp, Homo sapiens
cctggggattctgacacggagt

SEQ ID NO: 7952125 - DNA, 23 bp, Homo sapiens
cctggggagctgtatccagagtg

SEQ ID NO: 7952126 - DNA, 23 bp, Homo sapiens
cctggggagctgtatccagagtg

SEQ ID NO: 7952127 - DNA, 22 bp, Homo sapiens
cctggggagccgcctgagcccc

SEQ ID NO: 7952128 - DNA, 22 bp, Homo sapiens
cctggggagccgcctgagcccc

SEQ ID NO: 7952129 - DNA, 22 bp, Homo sapiens
cctggggagccgcctgagcccc

SEQ ID NO: 7952130 - DNA, 22 bp, Homo sapiens
cctggggagccgcctgagcccc

SEQ ID NO: 7952131 - DNA, 23 bp, Homo sapiens
cctggggagctgtatccagagtg

SEQ ID NO: 7952132 - DNA, 23 bp, Homo sapiens
cctggggagctgtatccagagtg

SEQ ID NO: 7952133 - DNA, 23 bp, Homo sapiens
cctggggagctgtatccagagtg

SEQ ID NO: 7952134 - DNA, 22 bp, Homo sapiens
cctggggattctgacacggagt

SEQ ID NO: 7952135 - DNA, 22 bp, Homo sapiens
cctggggagagaaagcccagcc

SEQ ID NO: 7952136 - DNA, 22 bp, Homo sapiens
cctggggagagaaagcccagcc

SEQ ID NO: 7952137 - DNA, 22 bp, Homo sapiens
cctggggagagaaagcccagcc

SEQ ID NO: 7952138 - DNA, 22 bp, Homo sapiens
cctggggagagaaagcccagcc

SEQ ID NO: 7952139 - DNA, 22 bp, Homo sapiens
cctggggagaagagcttccccc

SEQ ID NO: 7952140 - DNA, 22 bp, Homo sapiens
cctggggagaagagcttccccc

SEQ ID NO: 7952141 - DNA, 22 bp, Homo sapiens
cctggggagaagagcttccccc

SEQ ID NO: 7952142 - DNA, 22 bp, Homo sapiens
cctggggagccgcctgagcccc

SEQ ID NO: 7952143 - DNA, 22 bp, Homo sapiens
cctggggagccgcctgagcccc

SEQ ID NO: 7952144 - DNA, 22 bp, Homo sapiens
cctggggagagaaagcccagcc

SEQ ID NO: 7952145 - DNA, 22 bp, Homo sapiens
cctggggagagaaagcccagcc

SEQ ID NO: 7952146 - DNA, 22 bp, Homo sapiens
cctggggagccgcctgagcccc

SEQ ID NO: 7952147 - DNA, 22 bp, Homo sapiens
cctggggagccgcctgagcccc

SEQ ID NO: 7952148 - DNA, 22 bp, Homo sapiens
cctggggagccgcctgagcccc

SEQ ID NO: 7952149 - DNA, 22 bp, Homo sapiens
tggttccagttttcaatagagc

SEQ ID NO: 7952150 - DNA, 22 bp, Homo sapiens
tggttccagttttcaatagagc

SEQ ID NO: 7952151 - DNA, 22 bp, Homo sapiens
tggttccactaacctgagagcc

SEQ ID NO: 7952152 - DNA, 22 bp, Homo sapiens
tggttccaatcgcactggctca

SEQ ID NO: 7952153 - DNA, 22 bp, Homo sapiens
tggttcctcaagcgctggcggc

SEQ ID NO: 7952154 - DNA, 22 bp, Homo sapiens
tggttcctcaagcgctggcggc

SEQ ID NO: 7952155 - DNA, 22 bp, Homo sapiens
tggttcctcaagcgctggcggc

SEQ ID NO: 7952156 - DNA, 22 bp, Homo sapiens
tggttcctcaagcgctggcggc

SEQ ID NO: 7952157 - DNA, 22 bp, Homo sapiens
tggttcctcaagcgctggcggc

SEQ ID NO: 7952158 - DNA, 22 bp, Homo sapiens
cctgccttcccagcttggcttt

SEQ ID NO: 7952159 - DNA, 22 bp, Homo sapiens
tggttagatgaggctggtttca

SEQ ID NO: 7952160 - DNA, 22 bp, Homo sapiens
tggttagaggcttcttgcttgg

SEQ ID NO: 7952161 - DNA, 22 bp, Homo sapiens
tggttagactcaccttatagtt

SEQ ID NO: 7952162 - DNA, 22 bp, Homo sapiens
tggttcagagagttgctgacca

SEQ ID NO: 7952163 - DNA, 22 bp, Homo sapiens
tggttcagatatggagctggga

SEQ ID NO: 7952164 - DNA, 22 bp, Homo sapiens
tggttcagagagttgctgacca

SEQ ID NO: 7952165 - DNA, 23 bp, Homo sapiens
tggttcaagtgagaagtaatgtt

SEQ ID NO: 7952166 - DNA, 23 bp, Homo sapiens
tggttcaagtgagaagtaatgtt

SEQ ID NO: 7952167 - DNA, 22 bp, Homo sapiens
tggttcagttgcacaggctgtt

SEQ ID NO: 7952168 - DNA, 22 bp, Homo sapiens
tggttcatagcctcacaggata

SEQ ID NO: 7952169 - DNA, 17 bp, Homo sapiens
tggttccaaccatacgc

SEQ ID NO: 7952170 - DNA, 22 bp, Homo sapiens
tggttccaagatggctgccaca

SEQ ID NO: 7952171 - DNA, 22 bp, Homo sapiens
cctgccttctaaagcgcccgcc

SEQ ID NO: 7952172 - DNA, 22 bp, Homo sapiens
cctgccttgacgtaacgcatga

SEQ ID NO: 7952173 - DNA, 22 bp, Homo sapiens
cctgccttctaaagcgcccgcc

SEQ ID NO: 7952174 - DNA, 22 bp, Homo sapiens
cctgcgcgtctgggtctgtctc

SEQ ID NO: 7952175 - DNA, 22 bp, Homo sapiens
cctgcctttctcagtaatcttt

SEQ ID NO: 7952176 - DNA, 22 bp, Homo sapiens
cctgcgtcgtgtgggcagtgac

SEQ ID NO: 7952177 - DNA, 22 bp, Homo sapiens
cctgctagagacctggtgtgta

SEQ ID NO: 7952178 - DNA, 22 bp, Homo sapiens
cctgctaataaggtagaaatat

SEQ ID NO: 7952179 - DNA, 22 bp, Homo sapiens
cctgcgtctggccttgctccaa

SEQ ID NO: 7952180 - DNA, 22 bp, Homo sapiens
cctgctagagacctggtgtgta

SEQ ID NO: 7952181 - DNA, 22 bp, Homo sapiens
cctgctatcattctaggcttcc

SEQ ID NO: 7952182 - DNA, 22 bp, Homo sapiens
cctgctcacctgatgtggcaac

SEQ ID NO: 7952183 - DNA, 22 bp, Homo sapiens
cctgctcacctgatgtggcaac

SEQ ID NO: 7952184 - DNA, 22 bp, Homo sapiens
cctgctcagagcgtcttgtgtg

SEQ ID NO: 7952185 - DNA, 22 bp, Homo sapiens
cctgctcagccccagctcaccc

SEQ ID NO: 7952186 - DNA, 22 bp, Homo sapiens
cctgctccatgctcaccatcag

SEQ ID NO: 7952187 - DNA, 22 bp, Homo sapiens
cctgctcatgggtccctggcag

SEQ ID NO: 7952188 - DNA, 23 bp, Homo sapiens
cctgctcaggcgtgtgccctgct

SEQ ID NO: 7952189 - DNA, 22 bp, Homo sapiens
cctgctcagctgtcctcacgct

SEQ ID NO: 7952190 - DNA, 22 bp, Homo sapiens
cctgctcagctgtcctcacgct

SEQ ID NO: 7952191 - DNA, 22 bp, Homo sapiens
tgttgctgacaagagaggagca

SEQ ID NO: 7952192 - DNA, 23 bp, Homo sapiens
tgttgctgcctttctaggatcag

SEQ ID NO: 7952193 - DNA, 23 bp, Homo sapiens
tgttgctgcctttctaggatcag

SEQ ID NO: 7952194 - DNA, 22 bp, Homo sapiens
tgttggagcccgagtcagggag

SEQ ID NO: 7952195 - DNA, 19 bp, Homo sapiens
tgttggaggtgctgaatta

SEQ ID NO: 7952196 - DNA, 22 bp, Homo sapiens
tgttggatgaccttgtaattat

SEQ ID NO: 7952197 - DNA, 22 bp, Homo sapiens
cctggggagaagagcttccccc

SEQ ID NO: 7952198 - DNA, 22 bp, Homo sapiens
tgttggcttgaccttcgctgtt

SEQ ID NO: 7952199 - DNA, 19 bp, Homo sapiens
tgttggctgttctagctca

SEQ ID NO: 7952200 - DNA, 22 bp, Homo sapiens
tgttggcttgaccttcgctgtt

SEQ ID NO: 7952201 - DNA, 22 bp, Homo sapiens
tgttggcatctctgagagagtt

SEQ ID NO: 7952202 - DNA, 22 bp, Homo sapiens
tgttggctattattattactgc

SEQ ID NO: 7952203 - DNA, 19 bp, Homo sapiens
tgttggctgttctagctca

SEQ ID NO: 7952204 - DNA, 22 bp, Homo sapiens
tgttggcagtgctacagtcagt

SEQ ID NO: 7952205 - DNA, 22 bp, Homo sapiens
tgttggcagtgctacagtcagt

SEQ ID NO: 7952206 - DNA, 20 bp, Homo sapiens
tgttggcaattgttgtttcc

SEQ ID NO: 7952207 - DNA, 22 bp, Homo sapiens
tgttggcactatctcatgtttt

SEQ ID NO: 7952208 - DNA, 22 bp, Homo sapiens
tgttgcctgactttaaaatgtg

SEQ ID NO: 7952209 - DNA, 18 bp, Homo sapiens
tgttgcgagcataatgga

SEQ ID NO: 7952210 - DNA, 22 bp, Homo sapiens
tgttgcctggggaagctctgat

SEQ ID NO: 7952211 - DNA, 22 bp, Homo sapiens
tgttgcctggggaagctctgat

SEQ ID NO: 7952212 - DNA, 22 bp, Homo sapiens
tgttgctcttttttaggtgagt

SEQ ID NO: 7952213 - DNA, 22 bp, Homo sapiens
tgttgctactctccctgggagg

SEQ ID NO: 7952214 - DNA, 22 bp, Homo sapiens
tgttgcccaggttctctcctgc

SEQ ID NO: 7952215 - DNA, 22 bp, Homo sapiens
tgttgcccaggttctctcctgc

SEQ ID NO: 7952216 - DNA, 22 bp, Homo sapiens
tgttgcccaggttctctcctgc

SEQ ID NO: 7952217 - DNA, 22 bp, Homo sapiens
tgttgcctaactgccctctgaa

SEQ ID NO: 7952218 - DNA, 22 bp, Homo sapiens
cctgctcccgggacgcgttcac

SEQ ID NO: 7952219 - DNA, 22 bp, Homo sapiens
cctgctcctatctgggctcatt

SEQ ID NO: 7952220 - DNA, 22 bp, Homo sapiens
cctgctcctatctgggctcatt

SEQ ID NO: 7952221 - DNA, 22 bp, Homo sapiens
cctgctccatgctcaccatcag

SEQ ID NO: 7952222 - DNA, 22 bp, Homo sapiens
cctgctcctgctattcttctgg

SEQ ID NO: 7952223 - DNA, 22 bp, Homo sapiens
cctgctcctgctattcttctgg

SEQ ID NO: 7952224 - DNA, 22 bp, Homo sapiens
cctgctcctgctattcttctgg

SEQ ID NO: 7952225 - DNA, 22 bp, Homo sapiens
tgttcccacaccagcctcagcc

SEQ ID NO: 7952226 - DNA, 22 bp, Homo sapiens
tgttcccatggatatctgcata

SEQ ID NO: 7952227 - DNA, 22 bp, Homo sapiens
tgttcccacaccagcctcagcc

SEQ ID NO: 7952228 - DNA, 22 bp, Homo sapiens
tgttgattagtgtttagactta

SEQ ID NO: 7952229 - DNA, 22 bp, Homo sapiens
tgttgcagtaaaaatggagagg

SEQ ID NO: 7952230 - DNA, 22 bp, Homo sapiens
tgttgcagtagcagtagttgca

SEQ ID NO: 7952231 - DNA, 22 bp, Homo sapiens
tgttgcacggccttcacagagc

SEQ ID NO: 7952232 - DNA, 22 bp, Homo sapiens
tgttgcacacataggagtgatc

SEQ ID NO: 7952233 - DNA, 22 bp, Homo sapiens
tgttgatttgtgggctgcaaaa

SEQ ID NO: 7952234 - DNA, 20 bp, Homo sapiens
tgttgattggtgtcatctca

SEQ ID NO: 7952235 - DNA, 22 bp, Homo sapiens
tgttgattagtgtttagactta

SEQ ID NO: 7952236 - DNA, 20 bp, Homo sapiens
tgttgattggtgtcatctca

SEQ ID NO: 7952237 - DNA, 22 bp, Homo sapiens
tgttgattagtgtttagactta

SEQ ID NO: 7952238 - DNA, 22 bp, Homo sapiens
tgttgattagtgtttagactta

SEQ ID NO: 7952239 - DNA, 22 bp, Homo sapiens
ttatgtcaaaatggttgagatt

SEQ ID NO: 7952240 - DNA, 22 bp, Homo sapiens
ttatgtcatgtggtggtgaaga

SEQ ID NO: 7952241 - DNA, 22 bp, Homo sapiens
ttatgtatgaatatagtagaag

SEQ ID NO: 7952242 - DNA, 22 bp, Homo sapiens
ttatgtatgaatatagtagaag

SEQ ID NO: 7952243 - DNA, 22 bp, Homo sapiens
cctttctgatggcctcccagcc

SEQ ID NO: 7952244 - DNA, 22 bp, Homo sapiens
cctttctgatggcctcccagcc

SEQ ID NO: 7952245 - DNA, 20 bp, Homo sapiens
cctttctggagtgctgttca

SEQ ID NO: 7952246 - DNA, 22 bp, Homo sapiens
cctttctgatggcctcccagcc

SEQ ID NO: 7952247 - DNA, 22 bp, Homo sapiens
cctttctggtatttaaccaaag

SEQ ID NO: 7952248 - DNA, 22 bp, Homo sapiens
cctttctgtgttgccctatttg

SEQ ID NO: 7952249 - DNA, 17 bp, Homo sapiens
cctttcttcccagaggg

SEQ ID NO: 7952250 - DNA, 22 bp, Homo sapiens
cctttcttgcttagtggctcat

SEQ ID NO: 7952251 - DNA, 22 bp, Homo sapiens
cctttcttgcttagtggctcat

SEQ ID NO: 7952252 - DNA, 22 bp, Homo sapiens
cctttcttgctaagagtttatg

SEQ ID NO: 7952253 - DNA, 22 bp, Homo sapiens
cctttcttgctaagagtttatg

SEQ ID NO: 7952254 - DNA, 22 bp, Homo sapiens
cctttcttgctaagagtttatg

SEQ ID NO: 7952255 - DNA, 19 bp, Homo sapiens
cctttgaatcaggacactt

SEQ ID NO: 7952256 - DNA, 19 bp, Homo sapiens
cctttgaatcaggacactt

SEQ ID NO: 7952257 - DNA, 22 bp, Homo sapiens
cctttcttttatccaccagcca

SEQ ID NO: 7952258 - DNA, 22 bp, Homo sapiens
cctttcttttatccaccagcca

SEQ ID NO: 7952259 - DNA, 22 bp, Homo sapiens
cctttgatttcccccgtctcag

SEQ ID NO: 7952260 - DNA, 22 bp, Homo sapiens
cctttgcaacagaaagacctga

SEQ ID NO: 7952261 - DNA, 18 bp, Homo sapiens
cctttgcaaagggggtta

SEQ ID NO: 7952262 - DNA, 22 bp, Homo sapiens
cctttgcattctagatgtttag

SEQ ID NO: 7952263 - DNA, 22 bp, Homo sapiens
cctttgcattctagatgtttag

SEQ ID NO: 7952264 - DNA, 22 bp, Homo sapiens
cctttgccatgacatggcacaa

SEQ ID NO: 7952265 - DNA, 22 bp, Homo sapiens
cctttggagagtttgttagggg

SEQ ID NO: 7952266 - DNA, 22 bp, Homo sapiens
ttatgtagtcactgtggtcttg

SEQ ID NO: 7952267 - DNA, 22 bp, Homo sapiens
ttatgtagtgactgactgttag

SEQ ID NO: 7952268 - DNA, 22 bp, Homo sapiens
ttatgtaggataatgaattgcc

SEQ ID NO: 7952269 - DNA, 22 bp, Homo sapiens
ttatgtagtcactgtggtcttg

SEQ ID NO: 7952270 - DNA, 22 bp, Homo sapiens
ttatgtagcagaaagatgtttg

SEQ ID NO: 7952271 - DNA, 22 bp, Homo sapiens
ttatgtaggataatgaattgcc

SEQ ID NO: 7952272 - DNA, 22 bp, Homo sapiens
ttatgtactctgcaatgtttga

SEQ ID NO: 7952273 - DNA, 22 bp, Homo sapiens
ttatgtactctgcaatgtttga

SEQ ID NO: 7952274 - DNA, 22 bp, Homo sapiens
ttatgtacctgaattagtaaag

SEQ ID NO: 7952275 - DNA, 22 bp, Homo sapiens
ttatgtacctctttctgcttca

SEQ ID NO: 7952276 - DNA, 22 bp, Homo sapiens
ttatgtacctgaattagtaaag

SEQ ID NO: 7952277 - DNA, 22 bp, Homo sapiens
ttatgtacctctttctgcttca

SEQ ID NO: 7952278 - DNA, 22 bp, Homo sapiens
ttatgtacctgaattagtaaag

SEQ ID NO: 7952279 - DNA, 22 bp, Homo sapiens
ttatgtacccactcatattccc

SEQ ID NO: 7952280 - DNA, 22 bp, Homo sapiens
ttatgtacccactcatattccc

SEQ ID NO: 7952281 - DNA, 22 bp, Homo sapiens
ttatgtacccactcatattccc

SEQ ID NO: 7952282 - DNA, 22 bp, Homo sapiens
ttatgtacccactcatattccc

SEQ ID NO: 7952283 - DNA, 22 bp, Homo sapiens
ttatgtacaatgttaatgtaaa

SEQ ID NO: 7952284 - DNA, 22 bp, Homo sapiens
ttatgggagcaattggggaggt

SEQ ID NO: 7952285 - DNA, 22 bp, Homo sapiens
ttatggcttctgtgaagaattt

SEQ ID NO: 7952286 - DNA, 22 bp, Homo sapiens
ttatgggagcaattggggaggt

SEQ ID NO: 7952287 - DNA, 22 bp, Homo sapiens
ttatggggttgctgaattaggg

SEQ ID NO: 7952288 - DNA, 23 bp, Homo sapiens
ttatggggaaggtgactgggaca

SEQ ID NO: 7952289 - DNA, 23 bp, Homo sapiens
ttatggggaaggtgactgggaca

SEQ ID NO: 7952290 - DNA, 22 bp, Homo sapiens
ttatgggagcaattggggaggt

SEQ ID NO: 7952291 - DNA, 22 bp, Homo sapiens
ttatgtaagtggagtcatatag

SEQ ID NO: 7952292 - DNA, 22 bp, Homo sapiens
ttatgtaagtggagtcatatag

SEQ ID NO: 7952293 - DNA, 22 bp, Homo sapiens
ttatggtaattaaaacatgtat

SEQ ID NO: 7952294 - DNA, 22 bp, Homo sapiens
ttatggtagcttaatttgcctg

SEQ ID NO: 7952295 - DNA, 22 bp, Homo sapiens
ttatggtaattaaaacatgtat

SEQ ID NO: 7952296 - DNA, 22 bp, Homo sapiens
ttatggtaggagctgtcagttt

SEQ ID NO: 7952297 - DNA, 22 bp, Homo sapiens
ttatgtaatttgtttgctcttc

SEQ ID NO: 7952298 - DNA, 22 bp, Homo sapiens
ttatggtaggagctgtcagttt

SEQ ID NO: 7952299 - DNA, 22 bp, Homo sapiens
ttatgtaatttgtttgctcttc

SEQ ID NO: 7952300 - DNA, 22 bp, Homo sapiens
ttatgtacaatgttaatgtaaa

SEQ ID NO: 7952301 - DNA, 22 bp, Homo sapiens
ttatgtacaatgttaatgtaaa

SEQ ID NO: 7952302 - DNA, 22 bp, Homo sapiens
cgagcagagcagagacgtctgg

SEQ ID NO: 7952303 - DNA, 22 bp, Homo sapiens
cgagcagagcagagacgtctgg

SEQ ID NO: 7952304 - DNA, 22 bp, Homo sapiens
cgaggctcagagagggtgactt

SEQ ID NO: 7952305 - DNA, 22 bp, Homo sapiens
cgagcagaagcctggtggtctg

SEQ ID NO: 7952306 - DNA, 22 bp, Homo sapiens
cgagcagaatggagggtgccga

SEQ ID NO: 7952307 - DNA, 22 bp, Homo sapiens
cgagcagaatggagggtgccga

SEQ ID NO: 7952308 - DNA, 22 bp, Homo sapiens
cgaggtgactttggtttagaca

SEQ ID NO: 7952309 - DNA, 21 bp, Homo sapiens
cgaggtgagctcttggctcag

SEQ ID NO: 7952310 - DNA, 22 bp, Homo sapiens
cgagggtgtgctgacccagctc

SEQ ID NO: 7952311 - DNA, 22 bp, Homo sapiens
cgagggtgtgctgacccagctc

SEQ ID NO: 7952312 - DNA, 17 bp, Homo sapiens
cgagggcttgctggctc

SEQ ID NO: 7952313 - DNA, 22 bp, Homo sapiens
cctttggccctgagagatgatt

SEQ ID NO: 7952314 - DNA, 22 bp, Homo sapiens
cctttggcattttgaggatgcg

SEQ ID NO: 7952315 - DNA, 19 bp, Homo sapiens
cctttggatttgtttagtc

SEQ ID NO: 7952316 - DNA, 22 bp, Homo sapiens
cctttggagcaactgagagcta

SEQ ID NO: 7952317 - DNA, 22 bp, Homo sapiens
cctttggaggaagtgtggccct

SEQ ID NO: 7952318 - DNA, 19 bp, Homo sapiens
cctttggatttgtttagtc

SEQ ID NO: 7952319 - DNA, 22 bp, Homo sapiens
cctttggagcaactgagagcta

SEQ ID NO: 7952320 - DNA, 22 bp, Homo sapiens
cctttggagcaactgagagcta

SEQ ID NO: 7952321 - DNA, 22 bp, Homo sapiens
cctttggagagtttgttagggg

SEQ ID NO: 7952322 - DNA, 22 bp, Homo sapiens
cctttggagcaactgagagcta

SEQ ID NO: 7952323 - DNA, 22 bp, Homo sapiens
cctttggctgcatagggaaggg

SEQ ID NO: 7952324 - DNA, 22 bp, Homo sapiens
cctttggccgctttatggagga

SEQ ID NO: 7952325 - DNA, 22 bp, Homo sapiens
cctttggctgcatagggaaggg

SEQ ID NO: 7952326 - DNA, 22 bp, Homo sapiens
cctttgggaataggttccggct

SEQ ID NO: 7952327 - DNA, 22 bp, Homo sapiens
cctttggggctttactgtggaa

SEQ ID NO: 7952328 - DNA, 22 bp, Homo sapiens
cctttggggtcctgcctgggct

SEQ ID NO: 7952329 - DNA, 22 bp, Homo sapiens
cctttggggtcctgcctgggct

SEQ ID NO: 7952330 - DNA, 22 bp, Homo sapiens
cgcaccactgaattccagcctg

SEQ ID NO: 7952331 - DNA, 22 bp, Homo sapiens
cgcaccactgaattccagcctg

SEQ ID NO: 7952332 - DNA, 22 bp, Homo sapiens
cgcacagctgcaaggagttgca

SEQ ID NO: 7952333 - DNA, 22 bp, Homo sapiens
cgcaccactgaattccagcctg

SEQ ID NO: 7952334 - DNA, 22 bp, Homo sapiens
cgcaccactgaattccagcctg

SEQ ID NO: 7952335 - DNA, 22 bp, Homo sapiens
cgcaaagagctctaaatcagac

SEQ ID NO: 7952336 - DNA, 22 bp, Homo sapiens
cgcaaagagctctaaatcagac

SEQ ID NO: 7952337 - DNA, 22 bp, Homo sapiens
cgcaatcaagttttgagaccca

SEQ ID NO: 7952338 - DNA, 22 bp, Homo sapiens
cgcaatcatctctctttgtgcc

SEQ ID NO: 7952339 - DNA, 19 bp, Homo sapiens
cgcacagcctgccaggcgc

SEQ ID NO: 7952340 - DNA, 19 bp, Homo sapiens
cgcacagcctgccaggcgc

SEQ ID NO: 7952341 - DNA, 22 bp, Homo sapiens
cgcaactcagcaacttaactgc

SEQ ID NO: 7952342 - DNA, 22 bp, Homo sapiens
cgcaactcagcaacttaactgc

SEQ ID NO: 7952343 - DNA, 22 bp, Homo sapiens
cgatggagaggtcctgatagtt

SEQ ID NO: 7952344 - DNA, 22 bp, Homo sapiens
cgatgggggcagtgttacattg

SEQ ID NO: 7952345 - DNA, 22 bp, Homo sapiens
cgatggaattggaaagaggaat

SEQ ID NO: 7952346 - DNA, 22 bp, Homo sapiens
cgatgcttcttttggagaagtc

SEQ ID NO: 7952347 - DNA, 18 bp, Homo sapiens
cgatgtgtatgtgatttg

SEQ ID NO: 7952348 - DNA, 22 bp, Homo sapiens
cgatgggggcagtgttacattg

SEQ ID NO: 7952349 - DNA, 22 bp, Homo sapiens
cgatggtatcggccagccccgg

SEQ ID NO: 7952350 - DNA, 22 bp, Homo sapiens
cgatgtctaaactaaattcatt

SEQ ID NO: 7952351 - DNA, 16 bp, Homo sapiens
cgagtgaagccttttc

SEQ ID NO: 7952352 - DNA, 22 bp, Homo sapiens
cgaggtgatggcatttagactc

SEQ ID NO: 7952353 - DNA, 22 bp, Homo sapiens
cgaggtgggcagatcacagagt

SEQ ID NO: 7952354 - DNA, 22 bp, Homo sapiens
cgatgacagtgagttccttctt

SEQ ID NO: 7952355 - DNA, 22 bp, Homo sapiens
ttcaaaaaggtatgttcaagtc

SEQ ID NO: 7952356 - DNA, 22 bp, Homo sapiens
ttcaaaaaggtatgttcaagtc

SEQ ID NO: 7952357 - DNA, 22 bp, Homo sapiens
ttcaaaaaggtatgttcaagtc

SEQ ID NO: 7952358 - DNA, 22 bp, Homo sapiens
ttcaaaacaatctgtttgcatt

SEQ ID NO: 7952359 - DNA, 17 bp, Homo sapiens
ttattttttgggctgag

SEQ ID NO: 7952360 - DNA, 17 bp, Homo sapiens
ttattttttgggctgag

SEQ ID NO: 7952361 - DNA, 17 bp, Homo sapiens
ttattttttgggctgag

SEQ ID NO: 7952362 - DNA, 17 bp, Homo sapiens
ttattttttgggctgag

SEQ ID NO: 7952363 - DNA, 17 bp, Homo sapiens
ttattttttgggctgag

SEQ ID NO: 7952364 - DNA, 17 bp, Homo sapiens
ttattttttgggctgag

SEQ ID NO: 7952365 - DNA, 17 bp, Homo sapiens
ttattttttgggctgag

SEQ ID NO: 7952366 - DNA, 17 bp, Homo sapiens
ttattttttgggctgag

SEQ ID NO: 7952367 - DNA, 22 bp, Homo sapiens
ttatttttaaaagttcacacag

SEQ ID NO: 7952368 - DNA, 22 bp, Homo sapiens
ttatttttaaaagttcacacag

SEQ ID NO: 7952369 - DNA, 22 bp, Homo sapiens
ttatttttaaaagttcacacag

SEQ ID NO: 7952370 - DNA, 22 bp, Homo sapiens
ttatttttaaaagttcacacag

SEQ ID NO: 7952371 - DNA, 22 bp, Homo sapiens
ttatttttaaaagttcacacag

SEQ ID NO: 7952372 - DNA, 22 bp, Homo sapiens
ttatttttaaaagttcacacag

SEQ ID NO: 7952373 - DNA, 22 bp, Homo sapiens
ttatttttaaaagttcacacag

SEQ ID NO: 7952374 - DNA, 22 bp, Homo sapiens
ttatttttaaaagttcacacag

SEQ ID NO: 7952375 - DNA, 17 bp, Homo sapiens
ttattttttgggctgag

SEQ ID NO: 7952376 - DNA, 17 bp, Homo sapiens
ttattttttgggctgag

SEQ ID NO: 7952377 - DNA, 22 bp, Homo sapiens
ttatttttaaaagttcacacag

SEQ ID NO: 7952378 - DNA, 22 bp, Homo sapiens
ttatttttaaaagttcacacag

SEQ ID NO: 7952379 - DNA, 22 bp, Homo sapiens
ttatttttaaaagttcacacag

SEQ ID NO: 7952380 - DNA, 22 bp, Homo sapiens
cgcagcagccccgtggtaggtg

SEQ ID NO: 7952381 - DNA, 19 bp, Homo sapiens
cgcagagggcttctgagag

SEQ ID NO: 7952382 - DNA, 19 bp, Homo sapiens
cgcagagggcttctgagag

SEQ ID NO: 7952383 - DNA, 22 bp, Homo sapiens
cgcagagggcaggcagtgctgg

SEQ ID NO: 7952384 - DNA, 22 bp, Homo sapiens
cgcagagggagccgcgggctgc

SEQ ID NO: 7952385 - DNA, 22 bp, Homo sapiens
cgcagagggagccgcgggctgc

SEQ ID NO: 7952386 - DNA, 22 bp, Homo sapiens
cgcagagggagccgcgggctgc

SEQ ID NO: 7952387 - DNA, 22 bp, Homo sapiens
cgcagagggcaggcagtgctgg

SEQ ID NO: 7952388 - DNA, 22 bp, Homo sapiens
cgcagagggcaggcagtgctgg

SEQ ID NO: 7952389 - DNA, 22 bp, Homo sapiens
cgcagagggcaggcagtgctgg

SEQ ID NO: 7952390 - DNA, 22 bp, Homo sapiens
cgcagagggcaggcagtgctgg

SEQ ID NO: 7952391 - DNA, 22 bp, Homo sapiens
cgcagagggcaggcagtgctgg

SEQ ID NO: 7952392 - DNA, 21 bp, Homo sapiens
cgcagagcgaacttgcggcgc

SEQ ID NO: 7952393 - DNA, 22 bp, Homo sapiens
cgcagagacatggcgacagaga

SEQ ID NO: 7952394 - DNA, 22 bp, Homo sapiens
cgcagagaaatgccgggggtac

SEQ ID NO: 7952395 - DNA, 22 bp, Homo sapiens
cgcactggagctggaacgagtc

SEQ ID NO: 7952396 - DNA, 21 bp, Homo sapiens
cgcagagcgaacttgcggcgc

SEQ ID NO: 7952397 - DNA, 21 bp, Homo sapiens
cgcagagcgaacttgcggcgc

SEQ ID NO: 7952398 - DNA, 22 bp, Homo sapiens
cgcactggagctggaacgagtc

SEQ ID NO: 7952399 - DNA, 22 bp, Homo sapiens
cgcactggagctggaacgagtc

SEQ ID NO: 7952400 - DNA, 22 bp, Homo sapiens
cgcaccactgaattccagcctg

SEQ ID NO: 7952401 - DNA, 22 bp, Homo sapiens
ttcaaaacaatctgtttgcatt

SEQ ID NO: 7952402 - DNA, 22 bp, Homo sapiens
ttcaaaacagctagatattgga

SEQ ID NO: 7952403 - DNA, 22 bp, Homo sapiens
ttattattgtggttgcattatc

SEQ ID NO: 7952404 - DNA, 22 bp, Homo sapiens
ttattattgtggttgcattatc

SEQ ID NO: 7952405 - DNA, 22 bp, Homo sapiens
ttattattgtggttgcattatc

SEQ ID NO: 7952406 - DNA, 22 bp, Homo sapiens
ttattattgtggttgcattatc

SEQ ID NO: 7952407 - DNA, 22 bp, Homo sapiens
ttattattgtggttgcattatc

SEQ ID NO: 7952408 - DNA, 22 bp, Homo sapiens
ttattattgtggttgcattatc

SEQ ID NO: 7952409 - DNA, 22 bp, Homo sapiens
ttattattgtgacctgagaatg

SEQ ID NO: 7952410 - DNA, 22 bp, Homo sapiens
ttattattgtgacctgagaatg

SEQ ID NO: 7952411 - DNA, 22 bp, Homo sapiens
ttattattgtgacctgagaatg

SEQ ID NO: 7952412 - DNA, 22 bp, Homo sapiens
ttattattggtgagttaaggaa

SEQ ID NO: 7952413 - DNA, 22 bp, Homo sapiens
cgcaccactgaattccagcctg

SEQ ID NO: 7952414 - DNA, 22 bp, Homo sapiens
ttattattttgtgtacagcaaa

SEQ ID NO: 7952415 - DNA, 22 bp, Homo sapiens
ttattattttgtgtacagcaaa

SEQ ID NO: 7952416 - DNA, 22 bp, Homo sapiens
ttattattttgtgtacagcaaa

SEQ ID NO: 7952417 - DNA, 22 bp, Homo sapiens
ttattattttgtgtacagcaaa

SEQ ID NO: 7952418 - DNA, 22 bp, Homo sapiens
ttattattttgtgtacagcaaa

SEQ ID NO: 7952419 - DNA, 22 bp, Homo sapiens
ttattattttgtgtacagcaaa

SEQ ID NO: 7952420 - DNA, 22 bp, Homo sapiens
ttattcacaaatgttgccctgt

SEQ ID NO: 7952421 - DNA, 22 bp, Homo sapiens
ttattcacatgggctcattcta

SEQ ID NO: 7952422 - DNA, 22 bp, Homo sapiens
ttattcaccagtgtaaaacact

SEQ ID NO: 7952423 - DNA, 22 bp, Homo sapiens
ttattattttgtgtacagcaaa

SEQ ID NO: 7952424 - DNA, 22 bp, Homo sapiens
ttattattttgtgtacagcaaa

SEQ ID NO: 7952425 - DNA, 22 bp, Homo sapiens
ttattattttgtgtacagcaaa

SEQ ID NO: 7952426 - DNA, 22 bp, Homo sapiens
ttatttttaaaagttcacacag

SEQ ID NO: 7952427 - DNA, 22 bp, Homo sapiens
ttatttttaaaagttcacacag

SEQ ID NO: 7952428 - DNA, 22 bp, Homo sapiens
ttatttttaaaagttcacacag

SEQ ID NO: 7952429 - DNA, 22 bp, Homo sapiens
ttatttttaaaagttcacacag

SEQ ID NO: 7952430 - DNA, 22 bp, Homo sapiens
ttatttttaaaagttcacacag

SEQ ID NO: 7952431 - DNA, 22 bp, Homo sapiens
ttatttttaaaagttcacacag

SEQ ID NO: 7952432 - DNA, 22 bp, Homo sapiens
ttatttttaaaagttcacacag

SEQ ID NO: 7952433 - DNA, 22 bp, Homo sapiens
ttatttttaaaagttcacacag

SEQ ID NO: 7952434 - DNA, 22 bp, Homo sapiens
ttatttttaaaagttcacacag

SEQ ID NO: 7952435 - DNA, 22 bp, Homo sapiens
ttatttcattgatttctaagac

SEQ ID NO: 7952436 - DNA, 22 bp, Homo sapiens
ttatttcattgatttctaagac

SEQ ID NO: 7952437 - DNA, 23 bp, Homo sapiens
ttattttgtcagaagggactttt

SEQ ID NO: 7952438 - DNA, 18 bp, Homo sapiens
ttattcagacgcatatga

SEQ ID NO: 7952439 - DNA, 22 bp, Homo sapiens
ttatttcatgtaaaatttatgt

SEQ ID NO: 7952440 - DNA, 22 bp, Homo sapiens
ttattcacctctattagactca

SEQ ID NO: 7952441 - DNA, 22 bp, Homo sapiens
ttattcacttcttggtccctca

SEQ ID NO: 7952442 - DNA, 22 bp, Homo sapiens
ttattcactctgaagccatcct

SEQ ID NO: 7952443 - DNA, 22 bp, Homo sapiens
ttattcactcatttaacattat

SEQ ID NO: 7952444 - DNA, 22 bp, Homo sapiens
ttattcactcatttaacattat

SEQ ID NO: 7952445 - DNA, 22 bp, Homo sapiens
ttattcactcatttaacattat

SEQ ID NO: 7952446 - DNA, 22 bp, Homo sapiens
ttattcactcatttaacattat

SEQ ID NO: 7952447 - DNA, 22 bp, Homo sapiens
ttattcaccagtgtaaaacact

SEQ ID NO: 7952448 - DNA, 22 bp, Homo sapiens
ttattcaccgcaggtgcttccc

SEQ ID NO: 7952449 - DNA, 22 bp, Homo sapiens
ttattcaccatttattatgtga

SEQ ID NO: 7952450 - DNA, 22 bp, Homo sapiens
ttattcaccatttattatgtga

SEQ ID NO: 7952451 - DNA, 22 bp, Homo sapiens
ttattcaccagtgtaaaacact

SEQ ID NO: 7952452 - DNA, 22 bp, Homo sapiens
ttattcactcattaaagcagga

SEQ ID NO: 7952453 - DNA, 22 bp, Homo sapiens
ttattcactcattaaagcagga

SEQ ID NO: 7952454 - DNA, 22 bp, Homo sapiens
ttattcacctctattagactca

SEQ ID NO: 7952455 - DNA, 22 bp, Homo sapiens
ttattcacctctattagactca

SEQ ID NO: 7952456 - DNA, 22 bp, Homo sapiens
ttacagaaaggaaggactgact

SEQ ID NO: 7952457 - DNA, 22 bp, Homo sapiens
ttacagaaaggaaggactgact

SEQ ID NO: 7952458 - DNA, 22 bp, Homo sapiens
ttacaatgagacgttcttatct

SEQ ID NO: 7952459 - DNA, 22 bp, Homo sapiens
ttacaatgagacgttcttatct

SEQ ID NO: 7952460 - DNA, 19 bp, Homo sapiens
ttacaatgacccaatctgg

SEQ ID NO: 7952461 - DNA, 22 bp, Homo sapiens
ttacaatgacaggtgtatcatt

SEQ ID NO: 7952462 - DNA, 23 bp, Homo sapiens
ttacagaaagtatgcttttgttt

SEQ ID NO: 7952463 - DNA, 22 bp, Homo sapiens
ttacagaaaggttgtgggatag

SEQ ID NO: 7952464 - DNA, 20 bp, Homo sapiens
ttacagaaatgatgttattt

SEQ ID NO: 7952465 - DNA, 22 bp, Homo sapiens
ttacagaactgtcttgaaattt

SEQ ID NO: 7952466 - DNA, 22 bp, Homo sapiens
ttacagaactgccctagttggc

SEQ ID NO: 7952467 - DNA, 22 bp, Homo sapiens
ttacagaactgccctagttggc

SEQ ID NO: 7952468 - DNA, 22 bp, Homo sapiens
ttacagaactgtcttgaaattt

SEQ ID NO: 7952469 - DNA, 22 bp, Homo sapiens
ttacagaactgtcttgaaattt

SEQ ID NO: 7952470 - DNA, 20 bp, Homo sapiens
ttacagaaatgatgttattt

SEQ ID NO: 7952471 - DNA, 20 bp, Homo sapiens
ttacagaaatgatgttattt

SEQ ID NO: 7952472 - DNA, 20 bp, Homo sapiens
ttacagaaatgatgttattt

SEQ ID NO: 7952473 - DNA, 20 bp, Homo sapiens
ttacagaaatgatgttattt

SEQ ID NO: 7952474 - DNA, 20 bp, Homo sapiens
ttacagaaatgatgttattt

SEQ ID NO: 7952475 - DNA, 22 bp, Homo sapiens
ttacagaactgccctagttggc

SEQ ID NO: 7952476 - DNA, 22 bp, Homo sapiens
ttacagaactgccctagttggc

SEQ ID NO: 7952477 - DNA, 22 bp, Homo sapiens
ttacagaagtattgagagatcc

SEQ ID NO: 7952478 - DNA, 21 bp, Homo sapiens
ccttctccacagggtctccgg

SEQ ID NO: 7952479 - DNA, 21 bp, Homo sapiens
ccttctccacagggtctccgg

SEQ ID NO: 7952480 - DNA, 21 bp, Homo sapiens
ccttctccacagggtctccgg

SEQ ID NO: 7952481 - DNA, 20 bp, Homo sapiens
ccttctccagcttgttcttg

SEQ ID NO: 7952482 - DNA, 20 bp, Homo sapiens
ccttctctggaattgcctcc

SEQ ID NO: 7952483 - DNA, 21 bp, Homo sapiens
ccttctcttgcttcagcttca

SEQ ID NO: 7952484 - DNA, 21 bp, Homo sapiens
ccttctcttgcttcagcttca

SEQ ID NO: 7952485 - DNA, 21 bp, Homo sapiens
ccttctcttgcttcagcttca

SEQ ID NO: 7952486 - DNA, 20 bp, Homo sapiens
ccttctctggaattgcctcc

SEQ ID NO: 7952487 - DNA, 22 bp, Homo sapiens
ttacagaagagaaagaattcag

SEQ ID NO: 7952488 - DNA, 22 bp, Homo sapiens
ttacagaagagaaagaattcag

SEQ ID NO: 7952489 - DNA, 22 bp, Homo sapiens
ttacagaagagaaagaattcag

SEQ ID NO: 7952490 - DNA, 22 bp, Homo sapiens
ttacagaagagaaagaattcag

SEQ ID NO: 7952491 - DNA, 22 bp, Homo sapiens
ttacagaagagaaagaattcag

SEQ ID NO: 7952492 - DNA, 22 bp, Homo sapiens
ttacagaagagtaacttggcaa

SEQ ID NO: 7952493 - DNA, 22 bp, Homo sapiens
ttacagaaggaacactactcag

SEQ ID NO: 7952494 - DNA, 22 bp, Homo sapiens
ttacagaaggaacactactcag

SEQ ID NO: 7952495 - DNA, 22 bp, Homo sapiens
ttacagaaggaacactactcag

SEQ ID NO: 7952496 - DNA, 22 bp, Homo sapiens
ttacagaaggaacactactcag

SEQ ID NO: 7952497 - DNA, 22 bp, Homo sapiens
ttacctaaaatagctcaattta

SEQ ID NO: 7952498 - DNA, 22 bp, Homo sapiens
ttacctaaaatagctcaattta

SEQ ID NO: 7952499 - DNA, 22 bp, Homo sapiens
ttacctgattccaactggcgcc

SEQ ID NO: 7952500 - DNA, 22 bp, Homo sapiens
ttacctgagcggatttgttgca

SEQ ID NO: 7952501 - DNA, 22 bp, Homo sapiens
ttacctgagcggatttgttgca

SEQ ID NO: 7952502 - DNA, 22 bp, Homo sapiens
ttacctgaaaggttaatttcca

SEQ ID NO: 7952503 - DNA, 22 bp, Homo sapiens
ttacctaaaatagctcaattta

SEQ ID NO: 7952504 - DNA, 22 bp, Homo sapiens
ttacccagggaccaagagaaac

SEQ ID NO: 7952505 - DNA, 22 bp, Homo sapiens
ttacccacatttgggagtatat

SEQ ID NO: 7952506 - DNA, 22 bp, Homo sapiens
ttacccactgagcttcagccct

SEQ ID NO: 7952507 - DNA, 22 bp, Homo sapiens
ttacccagagcacttgagcttt

SEQ ID NO: 7952508 - DNA, 22 bp, Homo sapiens
ttacccaggaaagaaatggtat

SEQ ID NO: 7952509 - DNA, 22 bp, Homo sapiens
ttacccacctttctcatgccaa

SEQ ID NO: 7952510 - DNA, 22 bp, Homo sapiens
ttacccacctttctcatgccaa

SEQ ID NO: 7952511 - DNA, 22 bp, Homo sapiens
ttaccaattcagacatctcttc

SEQ ID NO: 7952512 - DNA, 22 bp, Homo sapiens
ccttgaaaccacatcttagaaa

SEQ ID NO: 7952513 - DNA, 22 bp, Homo sapiens
ttaccaagctctgcatgttaag

SEQ ID NO: 7952514 - DNA, 21 bp, Homo sapiens
ttaccaatggcttctctttcc

SEQ ID NO: 7952515 - DNA, 22 bp, Homo sapiens
ccttgaaaccacatcttagaaa

SEQ ID NO: 7952516 - DNA, 22 bp, Homo sapiens
ttaccaagctctgcatgttaag

SEQ ID NO: 7952517 - DNA, 22 bp, Homo sapiens
ttaccacagtgcctgtctaatg

SEQ ID NO: 7952518 - DNA, 16 bp, Homo sapiens
ttaccacctcaggccc

SEQ ID NO: 7952519 - DNA, 22 bp, Homo sapiens
ttaccacctgtatcacattttt

SEQ ID NO: 7952520 - DNA, 22 bp, Homo sapiens
ttaccacctgtatcacattttt

SEQ ID NO: 7952521 - DNA, 22 bp, Homo sapiens
ccttcttcaccagtttacctga

SEQ ID NO: 7952522 - DNA, 22 bp, Homo sapiens
ccttcttaaacatcattttggc

SEQ ID NO: 7952523 - DNA, 23 bp, Homo sapiens
ccttctgttaaccatctgggggg

SEQ ID NO: 7952524 - DNA, 22 bp, Homo sapiens
ccttcttctgtgtggcccaaga

SEQ ID NO: 7952525 - DNA, 22 bp, Homo sapiens
ccttcttgaggtagcacattct

SEQ ID NO: 7952526 - DNA, 22 bp, Homo sapiens
ccttcttgaggtagcacattct

SEQ ID NO: 7952527 - DNA, 22 bp, Homo sapiens
ccttctgggccaacttccagga

SEQ ID NO: 7952528 - DNA, 22 bp, Homo sapiens
ccttctggatgtgctaaggaag

SEQ ID NO: 7952529 - DNA, 22 bp, Homo sapiens
ccttctgtctccctcatattga

SEQ ID NO: 7952530 - DNA, 22 bp, Homo sapiens
ccttctgtgtgcccacgtttat

SEQ ID NO: 7952531 - DNA, 22 bp, Homo sapiens
ccttctgagcttcaatttcagt

SEQ ID NO: 7952532 - DNA, 22 bp, Homo sapiens
ccttctgagcttcaatttcagt

SEQ ID NO: 7952533 - DNA, 18 bp, Homo sapiens
ccttctgacgcttgagaa

SEQ ID NO: 7952534 - DNA, 21 bp, Homo sapiens
ccttctcttgcttcagcttca

SEQ ID NO: 7952535 - DNA, 22 bp, Homo sapiens
ccttctgatactgacatcattt

SEQ ID NO: 7952536 - DNA, 22 bp, Homo sapiens
ccttctgatactgacatcattt

SEQ ID NO: 7952537 - DNA, 22 bp, Homo sapiens
ccttctgataactgtgaaattg

SEQ ID NO: 7952538 - DNA, 22 bp, Homo sapiens
ccttctggaagctctaagggag

SEQ ID NO: 7952539 - DNA, 22 bp, Homo sapiens
ccttctgctggtcatcccagtg

SEQ ID NO: 7952540 - DNA, 22 bp, Homo sapiens
ccttctgctccctggccagggc

SEQ ID NO: 7952541 - DNA, 22 bp, Homo sapiens
ccttctgctccctggccagggc

SEQ ID NO: 7952542 - DNA, 22 bp, Homo sapiens
cctttaaatggatgttcaactg

SEQ ID NO: 7952543 - DNA, 22 bp, Homo sapiens
cctttaaatggatgttcaactg

SEQ ID NO: 7952544 - DNA, 22 bp, Homo sapiens
cctttaaatggatgttcaactg

SEQ ID NO: 7952545 - DNA, 22 bp, Homo sapiens
cctttaatttacaatgttaatt

SEQ ID NO: 7952546 - DNA, 22 bp, Homo sapiens
ttatcctgcatcctggaactca

SEQ ID NO: 7952547 - DNA, 22 bp, Homo sapiens
ttatcgtacgcttcagaaattt

SEQ ID NO: 7952548 - DNA, 22 bp, Homo sapiens
cctttacacatggaatgggtct

SEQ ID NO: 7952549 - DNA, 22 bp, Homo sapiens
ttatggcttctgtgaagaattt

SEQ ID NO: 7952550 - DNA, 18 bp, Homo sapiens
ttatggctgtgaaagagt

SEQ ID NO: 7952551 - DNA, 18 bp, Homo sapiens
ttatggctgtgaaagagt

SEQ ID NO: 7952552 - DNA, 22 bp, Homo sapiens
ttatggctaaatttcaatatta

SEQ ID NO: 7952553 - DNA, 22 bp, Homo sapiens
ttatcgtatctcttggtcttca

SEQ ID NO: 7952554 - DNA, 22 bp, Homo sapiens
ttatctacgtatttaaactctt

SEQ ID NO: 7952555 - DNA, 17 bp, Homo sapiens
ttatctactgctactgt

SEQ ID NO: 7952556 - DNA, 22 bp, Homo sapiens
ccttgtttctctcccagataag

SEQ ID NO: 7952557 - DNA, 22 bp, Homo sapiens
cctttaaagactgcataacttc

SEQ ID NO: 7952558 - DNA, 22 bp, Homo sapiens
cctttaaagactgcataacttc

SEQ ID NO: 7952559 - DNA, 22 bp, Homo sapiens
cctttaaatggatgttcaactg

SEQ ID NO: 7952560 - DNA, 22 bp, Homo sapiens
cctttaaagactgcataacttc

SEQ ID NO: 7952561 - DNA, 22 bp, Homo sapiens
cctttaaagactgcataacttc

SEQ ID NO: 7952562 - DNA, 22 bp, Homo sapiens
cctttaaagactgcataacttc

SEQ ID NO: 7952563 - DNA, 22 bp, Homo sapiens
ccttgtcttgcacagatgcagc

SEQ ID NO: 7952564 - DNA, 23 bp, Homo sapiens
ccttgtctggctggctggacttt

SEQ ID NO: 7952565 - DNA, 22 bp, Homo sapiens
ccttgtcctctggtttcctgtt

SEQ ID NO: 7952566 - DNA, 22 bp, Homo sapiens
ccttgtcctctggtttcctgtt

SEQ ID NO: 7952567 - DNA, 22 bp, Homo sapiens
ccttgtatcatatgctgggctt

SEQ ID NO: 7952568 - DNA, 22 bp, Homo sapiens
ccttgtgcaggttcatgatggg

SEQ ID NO: 7952569 - DNA, 19 bp, Homo sapiens
ccttgtctggtgaaggact

SEQ ID NO: 7952570 - DNA, 22 bp, Homo sapiens
ccttgggttccaagtcactgaa

SEQ ID NO: 7952571 - DNA, 22 bp, Homo sapiens
ccttgggtctaggccagggagt

SEQ ID NO: 7952572 - DNA, 22 bp, Homo sapiens
ccttgggtgtttaatagatata

SEQ ID NO: 7952573 - DNA, 22 bp, Homo sapiens
ccttggggtgttggaggcagcc

SEQ ID NO: 7952574 - DNA, 22 bp, Homo sapiens
ccttggggtgttggaggcagcc

SEQ ID NO: 7952575 - DNA, 22 bp, Homo sapiens
ccttggggtgttggaggcagcc

SEQ ID NO: 7952576 - DNA, 22 bp, Homo sapiens
ccttggggaatatccattcttc

SEQ ID NO: 7952577 - DNA, 22 bp, Homo sapiens
ccttggtgatctgggctggaag

SEQ ID NO: 7952578 - DNA, 22 bp, Homo sapiens
ccttggtgctctgctgggatgg

SEQ ID NO: 7952579 - DNA, 22 bp, Homo sapiens
ccttggtttccaggatgaggct

SEQ ID NO: 7952580 - DNA, 22 bp, Homo sapiens
ccttggttttaccaggtgttca

SEQ ID NO: 7952581 - DNA, 22 bp, Homo sapiens
ccttggtttccaggatgaggct

SEQ ID NO: 7952582 - DNA, 22 bp, Homo sapiens
ttacctgtgtcagtatatgaga

SEQ ID NO: 7952583 - DNA, 22 bp, Homo sapiens
ttacctgtaaaactgcgatata

SEQ ID NO: 7952584 - DNA, 22 bp, Homo sapiens
ttacctgtgtgtttgatacata

SEQ ID NO: 7952585 - DNA, 22 bp, Homo sapiens
ttacctgttttacatgcacaac

SEQ ID NO: 7952586 - DNA, 22 bp, Homo sapiens
ttacctgttttacatgcacaac

SEQ ID NO: 7952587 - DNA, 22 bp, Homo sapiens
ttaccttggaccgggtatcaga

SEQ ID NO: 7952588 - DNA, 22 bp, Homo sapiens
ttaccttggaccgggtatcaga

SEQ ID NO: 7952589 - DNA, 22 bp, Homo sapiens
ttaccttgaagagcttgagggc

SEQ ID NO: 7952590 - DNA, 22 bp, Homo sapiens
ttaccttttaggcaagcatctt

SEQ ID NO: 7952591 - DNA, 22 bp, Homo sapiens
ttaccttttaggcaagcatctt

SEQ ID NO: 7952592 - DNA, 22 bp, Homo sapiens
ttaccttggatttcacccttat

SEQ ID NO: 7952593 - DNA, 22 bp, Homo sapiens
ttaccttgggttaaactggctg

SEQ ID NO: 7952594 - DNA, 22 bp, Homo sapiens
ttaccttgtaaaacatattcct

SEQ ID NO: 7952595 - DNA, 22 bp, Homo sapiens
ttaccttgtaaaacatattcct

SEQ ID NO: 7952596 - DNA, 21 bp, Homo sapiens
ttactaaacaaaacatgcagg

SEQ ID NO: 7952597 - DNA, 21 bp, Homo sapiens
ttactaaacaaaacatgcagg

SEQ ID NO: 7952598 - DNA, 21 bp, Homo sapiens
ttactaaacaaaacatgcagg

SEQ ID NO: 7952599 - DNA, 21 bp, Homo sapiens
ttactaaacaaaacatgcagg

SEQ ID NO: 7952600 - DNA, 22 bp, Homo sapiens
ccttgcctccactgttttaggt

SEQ ID NO: 7952601 - DNA, 22 bp, Homo sapiens
ccttgcctccactgttttaggt

SEQ ID NO: 7952602 - DNA, 22 bp, Homo sapiens
ttaccttttaggcaagcatctt

SEQ ID NO: 7952603 - DNA, 22 bp, Homo sapiens
ccttggctggaattactctggg

SEQ ID NO: 7952604 - DNA, 22 bp, Homo sapiens
ccttggctggaattactctggg

SEQ ID NO: 7952605 - DNA, 21 bp, Homo sapiens
ccttggctggcatctagcacc

SEQ ID NO: 7952606 - DNA, 19 bp, Homo sapiens
ccttgcctgtccctgcagc

SEQ ID NO: 7952607 - DNA, 22 bp, Homo sapiens
ccttggctgtgttgcctgccct

SEQ ID NO: 7952608 - DNA, 22 bp, Homo sapiens
ccttggctgtgttgcctgccct

SEQ ID NO: 7952609 - DNA, 20 bp, Homo sapiens
ccttggcttaataataggga

SEQ ID NO: 7952610 - DNA, 22 bp, Homo sapiens
ccttggcttaccttctgtgtgg

SEQ ID NO: 7952611 - DNA, 22 bp, Homo sapiens
ccttggctgtgctgccctttgc

SEQ ID NO: 7952612 - DNA, 21 bp, Homo sapiens
ccttggctggcatctagcacc

SEQ ID NO: 7952613 - DNA, 21 bp, Homo sapiens
ccttggctggcatctagcacc

SEQ ID NO: 7952614 - DNA, 22 bp, Homo sapiens
ccttgggaccctgctggaggtt

SEQ ID NO: 7952615 - DNA, 22 bp, Homo sapiens
ccttgggagaaattgcagagtc

SEQ ID NO: 7952616 - DNA, 22 bp, Homo sapiens
ccttgggagaaattgcagagtc

SEQ ID NO: 7952617 - DNA, 21 bp, Homo sapiens
ccttgggatgcaagtgagact

SEQ ID NO: 7952618 - DNA, 22 bp, Homo sapiens
ccttgggcttgggcatagcttt

SEQ ID NO: 7952619 - DNA, 22 bp, Homo sapiens
ccttggggaactggacgtgctg

SEQ ID NO: 7952620 - DNA, 22 bp, Homo sapiens
ccttgggacagccagcttcaga

SEQ ID NO: 7952621 - DNA, 19 bp, Homo sapiens
ccttggctttaactatgaa

SEQ ID NO: 7952622 - DNA, 20 bp, Homo sapiens
ccttgggaaacaaagtagag

SEQ ID NO: 7952623 - DNA, 22 bp, Homo sapiens
ccttgggacagccagcttcaga

SEQ ID NO: 7952624 - DNA, 22 bp, Homo sapiens
ccttggcttgtgggctgcagcc

SEQ ID NO: 7952625 - DNA, 22 bp, Homo sapiens
ccttggcttgtgggctgcagcc

SEQ ID NO: 7952626 - DNA, 22 bp, Homo sapiens
ccttggcttgtgggctgcagcc

SEQ ID NO: 7952627 - DNA, 22 bp, Homo sapiens
ccttggcttgtgggctgcagcc

SEQ ID NO: 7952628 - DNA, 22 bp, Homo sapiens
ccttggcttgtgggctgcagcc

SEQ ID NO: 7952629 - DNA, 22 bp, Homo sapiens
ccttggcttgcacacggccacc

SEQ ID NO: 7952630 - DNA, 22 bp, Homo sapiens
ccttggcttgtgggctgcagcc

SEQ ID NO: 7952631 - DNA, 22 bp, Homo sapiens
ccttggcttgtgggctgcagcc

SEQ ID NO: 7952632 - DNA, 22 bp, Homo sapiens
ccttggcttccttccctctaga

SEQ ID NO: 7952633 - DNA, 22 bp, Homo sapiens
ccttggcttccttccctctaga

SEQ ID NO: 7952634 - DNA, 22 bp, Homo sapiens
ccttggcttaccttctgtgtgg

SEQ ID NO: 7952635 - DNA, 22 bp, Homo sapiens
tttttctagaccttaaaggcca

SEQ ID NO: 7952636 - DNA, 22 bp, Homo sapiens
tttttctagaccttaaaggcca

SEQ ID NO: 7952637 - DNA, 19 bp, Homo sapiens
tttttacaagtaggtgtga

SEQ ID NO: 7952638 - DNA, 22 bp, Homo sapiens
ttttctctccaggtggggtgat

SEQ ID NO: 7952639 - DNA, 19 bp, Homo sapiens
tttttaatgggctggagca

SEQ ID NO: 7952640 - DNA, 19 bp, Homo sapiens
tttttacaagtaggtgtga

SEQ ID NO: 7952641 - DNA, 19 bp, Homo sapiens
tttttacaagtaggtgtga

SEQ ID NO: 7952642 - DNA, 22 bp, Homo sapiens
tttttctctatgccaggggcct

SEQ ID NO: 7952643 - DNA, 22 bp, Homo sapiens
tttttctagctcaaagattcta

SEQ ID NO: 7952644 - DNA, 22 bp, Homo sapiens
tttttctagctcaaagattcta

SEQ ID NO: 7952645 - DNA, 22 bp, Homo sapiens
tttttctagctcaaagattcta

SEQ ID NO: 7952646 - DNA, 22 bp, Homo sapiens
tttttctagctcaaagattcta

SEQ ID NO: 7952647 - DNA, 22 bp, Homo sapiens
tttttctctatgccaggggcct

SEQ ID NO: 7952648 - DNA, 22 bp, Homo sapiens
tttttctcttctgtaaagtggt

SEQ ID NO: 7952649 - DNA, 22 bp, Homo sapiens
tttttctcttctgtaaagtggt

SEQ ID NO: 7952650 - DNA, 22 bp, Homo sapiens
tttttctgagaatatgagagga

SEQ ID NO: 7952651 - DNA, 22 bp, Homo sapiens
tttttctgccattcaaagagga

SEQ ID NO: 7952652 - DNA, 22 bp, Homo sapiens
tttttctgccattcaaagagga

SEQ ID NO: 7952653 - DNA, 22 bp, Homo sapiens
ttttctctacaaaataaccagc

SEQ ID NO: 7952654 - DNA, 22 bp, Homo sapiens
ttttctctacaaaataaccagc

SEQ ID NO: 7952655 - DNA, 22 bp, Homo sapiens
ttttctctacaaaataaccagc

SEQ ID NO: 7952656 - DNA, 22 bp, Homo sapiens
ttttctcctttcaagatagcat

SEQ ID NO: 7952657 - DNA, 22 bp, Homo sapiens
ttttctcctttctaggtcacat

SEQ ID NO: 7952658 - DNA, 22 bp, Homo sapiens
ttttctcctttctaggtcacat

SEQ ID NO: 7952659 - DNA, 22 bp, Homo sapiens
ttttctctatattgtctgtgaa

SEQ ID NO: 7952660 - DNA, 22 bp, Homo sapiens
ttttctctatattgtctgtgaa

SEQ ID NO: 7952661 - DNA, 22 bp, Homo sapiens
ttttctctacaaaataaccagc

SEQ ID NO: 7952662 - DNA, 22 bp, Homo sapiens
ttttctctatattgtctgtgaa

SEQ ID NO: 7952663 - DNA, 22 bp, Homo sapiens
ttttctctatattgtctgtgaa

SEQ ID NO: 7952664 - DNA, 22 bp, Homo sapiens
ttttctctatattgtctgtgaa

SEQ ID NO: 7952665 - DNA, 22 bp, Homo sapiens
ttttctcctttcaagatagcat

SEQ ID NO: 7952666 - DNA, 22 bp, Homo sapiens
ttttctctatattgtctgtgaa

SEQ ID NO: 7952667 - DNA, 22 bp, Homo sapiens
ttttctctatattgtctgtgaa

SEQ ID NO: 7952668 - DNA, 22 bp, Homo sapiens
ttttctccccagagaccatcat

SEQ ID NO: 7952669 - DNA, 22 bp, Homo sapiens
ttttctccccagagaccatcat

SEQ ID NO: 7952670 - DNA, 22 bp, Homo sapiens
ttttctccccagagaccatcat

SEQ ID NO: 7952671 - DNA, 22 bp, Homo sapiens
ttttctccagggaacaaggtga

SEQ ID NO: 7952672 - DNA, 22 bp, Homo sapiens
ttttctccagggaacaaggtga

SEQ ID NO: 7952673 - DNA, 22 bp, Homo sapiens
ttttctcccgctggctgctctt

SEQ ID NO: 7952674 - DNA, 22 bp, Homo sapiens
ttttctcccgctggctgctctt

SEQ ID NO: 7952675 - DNA, 22 bp, Homo sapiens
ttttctcccgctggctgctctt

SEQ ID NO: 7952676 - DNA, 22 bp, Homo sapiens
ttttctcccgctggctgctctt

SEQ ID NO: 7952677 - DNA, 22 bp, Homo sapiens
ttttctcccgctggctgctctt

SEQ ID NO: 7952678 - DNA, 22 bp, Homo sapiens
ttttctcccgctggctgctctt

SEQ ID NO: 7952679 - DNA, 22 bp, Homo sapiens
ttttctcctaagacccttcacc

SEQ ID NO: 7952680 - DNA, 22 bp, Homo sapiens
ttttctcctaagacccttcacc

SEQ ID NO: 7952681 - DNA, 22 bp, Homo sapiens
ttttctcctaagacccttcacc

SEQ ID NO: 7952682 - DNA, 17 bp, Homo sapiens
ttttctcctgcccattc

SEQ ID NO: 7952683 - DNA, 17 bp, Homo sapiens
ttttctcctgcccattc

SEQ ID NO: 7952684 - DNA, 17 bp, Homo sapiens
ttttctcctgcccattc

SEQ ID NO: 7952685 - DNA, 17 bp, Homo sapiens
ttttctcctgcccattc

SEQ ID NO: 7952686 - DNA, 17 bp, Homo sapiens
ttttctcctgcccattc

SEQ ID NO: 7952687 - DNA, 22 bp, Homo sapiens
ttttctcctttcaagatagcat

SEQ ID NO: 7952688 - DNA, 17 bp, Homo sapiens
ttttctcctgcccattc

SEQ ID NO: 7952689 - DNA, 22 bp, Homo sapiens
ttttctcctttcaagatagcat

SEQ ID NO: 7952690 - DNA, 22 bp, Homo sapiens
ttttctcaggtgcttatctaag

SEQ ID NO: 7952691 - DNA, 22 bp, Homo sapiens
ttttctccaactcaaaggaaag

SEQ ID NO: 7952692 - DNA, 22 bp, Homo sapiens
ttttctccaactcaaaggaaag

SEQ ID NO: 7952693 - DNA, 21 bp, Homo sapiens
ttttctccagctgtgatttta

SEQ ID NO: 7952694 - DNA, 22 bp, Homo sapiens
ttttctccaactcaaaggaaag

SEQ ID NO: 7952695 - DNA, 21 bp, Homo sapiens
ttttctccagctgtgatttta

SEQ ID NO: 7952696 - DNA, 21 bp, Homo sapiens
ttttctccagctgtgatttta

SEQ ID NO: 7952697 - DNA, 22 bp, Homo sapiens
ttttcctgttaaatctgggcac

SEQ ID NO: 7952698 - DNA, 22 bp, Homo sapiens
ttttccttaacagagggagaaa

SEQ ID NO: 7952699 - DNA, 22 bp, Homo sapiens
ttttcctgttaaatctgggcac

SEQ ID NO: 7952700 - DNA, 20 bp, Homo sapiens
ttttcctgtggtttgatatg

SEQ ID NO: 7952701 - DNA, 20 bp, Homo sapiens
ttttcctgtggtttgatatg

SEQ ID NO: 7952702 - DNA, 23 bp, Homo sapiens
ttttcctgtggagacatgactgg

SEQ ID NO: 7952703 - DNA, 22 bp, Homo sapiens
ttttcctgggctttctgtgtaa

SEQ ID NO: 7952704 - DNA, 22 bp, Homo sapiens
ttttcctggagatggagttgtt

SEQ ID NO: 7952705 - DNA, 22 bp, Homo sapiens
ttttcctggagatggagttgtt

SEQ ID NO: 7952706 - DNA, 22 bp, Homo sapiens
ttttcctggggcttctggactc

SEQ ID NO: 7952707 - DNA, 22 bp, Homo sapiens
ttttcctggggcttctggactc

SEQ ID NO: 7952708 - DNA, 22 bp, Homo sapiens
ttttcctggggcttctggactc

SEQ ID NO: 7952709 - DNA, 22 bp, Homo sapiens
ttttcctgtccaggcaattatt

SEQ ID NO: 7952710 - DNA, 22 bp, Homo sapiens
ttttcctgtccaggcaattatt

SEQ ID NO: 7952711 - DNA, 22 bp, Homo sapiens
ttttcctgtccaggcaattatt

SEQ ID NO: 7952712 - DNA, 22 bp, Homo sapiens
ttttcctgtccaggcaattatt

SEQ ID NO: 7952713 - DNA, 23 bp, Homo sapiens
ttttcctgtggagacatgactgg

SEQ ID NO: 7952714 - DNA, 23 bp, Homo sapiens
ttttcctgtggagacatgactgg

SEQ ID NO: 7952715 - DNA, 20 bp, Homo sapiens
ttttcctgtggtttgatatg

SEQ ID NO: 7952716 - DNA, 23 bp, Homo sapiens
ttttcctgtggagacatgactgg

SEQ ID NO: 7952717 - DNA, 23 bp, Homo sapiens
ttttcctgtggagacatgactgg

SEQ ID NO: 7952718 - DNA, 23 bp, Homo sapiens
ttttcctgtggagacatgactgg

SEQ ID NO: 7952719 - DNA, 22 bp, Homo sapiens
ttttcctgtccaggcaattatt

SEQ ID NO: 7952720 - DNA, 22 bp, Homo sapiens
ttttcctctgtatttgaaatgc

SEQ ID NO: 7952721 - DNA, 22 bp, Homo sapiens
ttttcctctgtatttgaaatgc

SEQ ID NO: 7952722 - DNA, 22 bp, Homo sapiens
ttttcctctgttattagtgtga

SEQ ID NO: 7952723 - DNA, 19 bp, Homo sapiens
ttttcctgcctcattgttt

SEQ ID NO: 7952724 - DNA, 22 bp, Homo sapiens
ttttcctctgttattagtgtga

SEQ ID NO: 7952725 - DNA, 22 bp, Homo sapiens
ttttcctctgttattagtgtga

SEQ ID NO: 7952726 - DNA, 22 bp, Homo sapiens
ttttcctgcctttgctcaggga

SEQ ID NO: 7952727 - DNA, 22 bp, Homo sapiens
ttttcctgcctttgctcaggga

SEQ ID NO: 7952728 - DNA, 22 bp, Homo sapiens
ttttcctgcctgtctctagagg

SEQ ID NO: 7952729 - DNA, 22 bp, Homo sapiens
ttttcctgcctgtctctagagg

SEQ ID NO: 7952730 - DNA, 19 bp, Homo sapiens
ttttcctgcctcattgttt

SEQ ID NO: 7952731 - DNA, 19 bp, Homo sapiens
ttttcctgcctcattgttt

SEQ ID NO: 7952732 - DNA, 22 bp, Homo sapiens
ttttcctgcctgtctctagagg

SEQ ID NO: 7952733 - DNA, 22 bp, Homo sapiens
ttttcagttgtgctctctagtt

SEQ ID NO: 7952734 - DNA, 22 bp, Homo sapiens
ttttcctctgtatttgaaatgc

SEQ ID NO: 7952735 - DNA, 22 bp, Homo sapiens
ttttcagttgtgctctctagtt

SEQ ID NO: 7952736 - DNA, 22 bp, Homo sapiens
ctctggagtgcagcctggtggc

SEQ ID NO: 7952737 - DNA, 22 bp, Homo sapiens
ttttcagttccatctctgctct

SEQ ID NO: 7952738 - DNA, 22 bp, Homo sapiens
ctctggagtgcagcctggtggc

SEQ ID NO: 7952739 - DNA, 22 bp, Homo sapiens
ctctggagtgcagcctggtggc

SEQ ID NO: 7952740 - DNA, 22 bp, Homo sapiens
ctctggagtgcagcctggtggc

SEQ ID NO: 7952741 - DNA, 22 bp, Homo sapiens
ctctggagtgcagcctggtggc

SEQ ID NO: 7952742 - DNA, 22 bp, Homo sapiens
ctctggagtcctgtatcactcc

SEQ ID NO: 7952743 - DNA, 22 bp, Homo sapiens
ctgaaacattgcaataacaaag

SEQ ID NO: 7952744 - DNA, 22 bp, Homo sapiens
ctgaaacattgcaataacaaag

SEQ ID NO: 7952745 - DNA, 20 bp, Homo sapiens
ctgaaagacgtaacagtgca

SEQ ID NO: 7952746 - DNA, 19 bp, Homo sapiens
ctgaaacacagagagggct

SEQ ID NO: 7952747 - DNA, 22 bp, Homo sapiens
ctgaaaatgttagtgatacgaa

SEQ ID NO: 7952748 - DNA, 22 bp, Homo sapiens
ctgaaaatgttagtgatacgaa

SEQ ID NO: 7952749 - DNA, 22 bp, Homo sapiens
ctgaaaatgttacacaggaaga

SEQ ID NO: 7952750 - DNA, 22 bp, Homo sapiens
ctgaaaatgttacacaggaaga

SEQ ID NO: 7952751 - DNA, 22 bp, Homo sapiens
ctgaaaatgttacacaggaaga

SEQ ID NO: 7952752 - DNA, 22 bp, Homo sapiens
ctgaaaatgttacacaggaaga

SEQ ID NO: 7952753 - DNA, 22 bp, Homo sapiens
ctgaaaaatatgttttggagaa

SEQ ID NO: 7952754 - DNA, 22 bp, Homo sapiens
ctgaaaaacgggatttggctgg

SEQ ID NO: 7952755 - DNA, 22 bp, Homo sapiens
ctgaaaaacgggatttggctgg

SEQ ID NO: 7952756 - DNA, 22 bp, Homo sapiens
ctgaaaagctttgaaccgttaa

SEQ ID NO: 7952757 - DNA, 22 bp, Homo sapiens
ctgaaaaatatgttttggagaa

SEQ ID NO: 7952758 - DNA, 22 bp, Homo sapiens
tttttcttgtgctggatctaat

SEQ ID NO: 7952759 - DNA, 22 bp, Homo sapiens
tttttcttgtgctggatctaat

SEQ ID NO: 7952760 - DNA, 22 bp, Homo sapiens
tttttcttgtgctggatctaat

SEQ ID NO: 7952761 - DNA, 23 bp, Homo sapiens
ttttttgtcttgctaggctgccc

SEQ ID NO: 7952762 - DNA, 22 bp, Homo sapiens
ttttttgttgggtagaacggaa

SEQ ID NO: 7952763 - DNA, 22 bp, Homo sapiens
ttttttgttgggtagaacggaa

SEQ ID NO: 7952764 - DNA, 22 bp, Homo sapiens
ttttttgttgggtagaacggaa

SEQ ID NO: 7952765 - DNA, 22 bp, Homo sapiens
tttttcttgtgctggatctaat

SEQ ID NO: 7952766 - DNA, 22 bp, Homo sapiens
tttttcttgtgctggatctaat

SEQ ID NO: 7952767 - DNA, 22 bp, Homo sapiens
tttttcttgtgctggatctaat

SEQ ID NO: 7952768 - DNA, 22 bp, Homo sapiens
tttttcttgtgctggatctaat

SEQ ID NO: 7952769 - DNA, 22 bp, Homo sapiens
tttttcttgtgctggatctaat

SEQ ID NO: 7952770 - DNA, 22 bp, Homo sapiens
tttttcttaaatgtgggttggc

SEQ ID NO: 7952771 - DNA, 22 bp, Homo sapiens
tttttcttaaatgtgggttggc

SEQ ID NO: 7952772 - DNA, 22 bp, Homo sapiens
tttttctggataactgtatctc

SEQ ID NO: 7952773 - DNA, 22 bp, Homo sapiens
tttttcttaaatgtgggttggc

SEQ ID NO: 7952774 - DNA, 22 bp, Homo sapiens
tttttcttaaatgtgggttggc

SEQ ID NO: 7952775 - DNA, 22 bp, Homo sapiens
tttttcttaaatgtgggttggc

SEQ ID NO: 7952776 - DNA, 22 bp, Homo sapiens
tttttcttaaatgtgggttggc

SEQ ID NO: 7952777 - DNA, 22 bp, Homo sapiens
tttttcttaaatgtgggttggc

SEQ ID NO: 7952778 - DNA, 22 bp, Homo sapiens
tttttctgtctcttacattgca

SEQ ID NO: 7952779 - DNA, 22 bp, Homo sapiens
tttttctgtctcttacattgca

SEQ ID NO: 7952780 - DNA, 18 bp, Homo sapiens
ctgaaggcaccagggcag

SEQ ID NO: 7952781 - DNA, 22 bp, Homo sapiens
ctgaaggcaccaggggtgccag

SEQ ID NO: 7952782 - DNA, 22 bp, Homo sapiens
ctgaaggctaaaatggactgaa

SEQ ID NO: 7952783 - DNA, 22 bp, Homo sapiens
ctgaaggctaaaatggactgaa

SEQ ID NO: 7952784 - DNA, 22 bp, Homo sapiens
ctgaaggcaccaggggtgccag

SEQ ID NO: 7952785 - DNA, 22 bp, Homo sapiens
ctgaaggcatttttgctgattt

SEQ ID NO: 7952786 - DNA, 22 bp, Homo sapiens
ctgaagtcagatggcacaaggt

SEQ ID NO: 7952787 - DNA, 22 bp, Homo sapiens
ctgaagggtctggggctgtgcc

SEQ ID NO: 7952788 - DNA, 22 bp, Homo sapiens
ctgaagtcagatggcacaaggt

SEQ ID NO: 7952789 - DNA, 22 bp, Homo sapiens
ctgaaggctgaggctgtgttgt

SEQ ID NO: 7952790 - DNA, 22 bp, Homo sapiens
ctgaaggcttgttgttttctta

SEQ ID NO: 7952791 - DNA, 22 bp, Homo sapiens
ctgaagtggacaaatggagtgg

SEQ ID NO: 7952792 - DNA, 22 bp, Homo sapiens
ctgaagtgccaaatcataatca

SEQ ID NO: 7952793 - DNA, 22 bp, Homo sapiens
ctgaagtggacaaatggagtgg

SEQ ID NO: 7952794 - DNA, 22 bp, Homo sapiens
ctgaagtggacaaatggagtgg

SEQ ID NO: 7952795 - DNA, 22 bp, Homo sapiens
ctgaagtgccaaatcataatca

SEQ ID NO: 7952796 - DNA, 19 bp, Homo sapiens
ctgaagtcttttcagctgg

SEQ ID NO: 7952797 - DNA, 22 bp, Homo sapiens
ctgaaggattcaaaatggcagg

SEQ ID NO: 7952798 - DNA, 22 bp, Homo sapiens
ctgaaggatgtgtggtgggagt

SEQ ID NO: 7952799 - DNA, 22 bp, Homo sapiens
ctgaaggattagagagcactta

SEQ ID NO: 7952800 - DNA, 22 bp, Homo sapiens
ctgaaggaggtagagtgacata

SEQ ID NO: 7952801 - DNA, 22 bp, Homo sapiens
ctgaaggacttggtgatagttg

SEQ ID NO: 7952802 - DNA, 22 bp, Homo sapiens
ctgaaggacacgtgaggagcca

SEQ ID NO: 7952803 - DNA, 22 bp, Homo sapiens
ctgaaggagaaggccactgttc

SEQ ID NO: 7952804 - DNA, 22 bp, Homo sapiens
ctgaaggagaaggccactgttc

SEQ ID NO: 7952805 - DNA, 22 bp, Homo sapiens
ctgaaggaggtagagtgacata

SEQ ID NO: 7952806 - DNA, 22 bp, Homo sapiens
ctgaaggagcatagtcagtttt

SEQ ID NO: 7952807 - DNA, 22 bp, Homo sapiens
ctgaagatttttggtaatcatg

SEQ ID NO: 7952808 - DNA, 22 bp, Homo sapiens
ctgaagcaaaggatcgagctaa

SEQ ID NO: 7952809 - DNA, 22 bp, Homo sapiens
ctgaagatttggctgtaaagca

SEQ ID NO: 7952810 - DNA, 22 bp, Homo sapiens
ctgaagatttggctgtaaagca

SEQ ID NO: 7952811 - DNA, 22 bp, Homo sapiens
ctgaagatttttggtaatcatg

SEQ ID NO: 7952812 - DNA, 22 bp, Homo sapiens
ctgaagatttttggtaatcatg

SEQ ID NO: 7952813 - DNA, 22 bp, Homo sapiens
ctgaaagcaaagtaattcttaa

SEQ ID NO: 7952814 - DNA, 22 bp, Homo sapiens
ctgaagatgtctgagatgctca

SEQ ID NO: 7952815 - DNA, 20 bp, Homo sapiens
ctgaaagacgtaacagtgca

SEQ ID NO: 7952816 - DNA, 22 bp, Homo sapiens
ctgaagattcgcctttgtttat

SEQ ID NO: 7952817 - DNA, 22 bp, Homo sapiens
ctgaagattataaacagacata

SEQ ID NO: 7952818 - DNA, 22 bp, Homo sapiens
ctgagaggtaagcagcgcagtg

SEQ ID NO: 7952819 - DNA, 22 bp, Homo sapiens
ctgagaggtaagcagcgcagtg

SEQ ID NO: 7952820 - DNA, 22 bp, Homo sapiens
ctgagaggtaagcagcgcagtg

SEQ ID NO: 7952821 - DNA, 22 bp, Homo sapiens
ctgagaggggaccagggtgttt

SEQ ID NO: 7952822 - DNA, 22 bp, Homo sapiens
ctgagaggggaccagggtgttt

SEQ ID NO: 7952823 - DNA, 22 bp, Homo sapiens
ctgagaggggaccagggtgttt

SEQ ID NO: 7952824 - DNA, 22 bp, Homo sapiens
ctgagaggtaagcagcgcagtg

SEQ ID NO: 7952825 - DNA, 22 bp, Homo sapiens
ctgagaggtaagcagcgcagtg

SEQ ID NO: 7952826 - DNA, 22 bp, Homo sapiens
ctgagaggtaagcagcgcagtg

SEQ ID NO: 7952827 - DNA, 22 bp, Homo sapiens
ctgagaggtgacagcgtgctgg

SEQ ID NO: 7952828 - DNA, 22 bp, Homo sapiens
ctgagaggtgacagcgtgctgg

SEQ ID NO: 7952829 - DNA, 22 bp, Homo sapiens
ctgagaggtgacagcgtgctgg

SEQ ID NO: 7952830 - DNA, 22 bp, Homo sapiens
ctgagaggtgacagcgtgctgg

SEQ ID NO: 7952831 - DNA, 22 bp, Homo sapiens
ctgagaggtgctggtggctgca

SEQ ID NO: 7952832 - DNA, 22 bp, Homo sapiens
ctgagagtaattttctacttga

SEQ ID NO: 7952833 - DNA, 22 bp, Homo sapiens
ctgagaggtgctggtggctgca

SEQ ID NO: 7952834 - DNA, 22 bp, Homo sapiens
ctgagaggtgctggtggctgca

SEQ ID NO: 7952835 - DNA, 22 bp, Homo sapiens
ctgagagtcagtggagtggtgt

SEQ ID NO: 7952836 - DNA, 22 bp, Homo sapiens
ctgagagtattggcaggcttgg

SEQ ID NO: 7952837 - DNA, 22 bp, Homo sapiens
ctgagagtattggcaggcttgg

SEQ ID NO: 7952838 - DNA, 22 bp, Homo sapiens
ctgagagtagctggagaacatt

SEQ ID NO: 7952839 - DNA, 22 bp, Homo sapiens
ctgagagatcaagccacaggat

SEQ ID NO: 7952840 - DNA, 19 bp, Homo sapiens
ctgagagatgcttcacaca

SEQ ID NO: 7952841 - DNA, 19 bp, Homo sapiens
ctgagagatgcttcacaca

SEQ ID NO: 7952842 - DNA, 19 bp, Homo sapiens
ctgagagatgcttcacaca

SEQ ID NO: 7952843 - DNA, 22 bp, Homo sapiens
ctgaataattttatagttgctg

SEQ ID NO: 7952844 - DNA, 22 bp, Homo sapiens
ctgagagatcaagccacaggat

SEQ ID NO: 7952845 - DNA, 22 bp, Homo sapiens
ctgaataatattccattatgag

SEQ ID NO: 7952846 - DNA, 22 bp, Homo sapiens
ctgaataatgttctcttgtatg

SEQ ID NO: 7952847 - DNA, 22 bp, Homo sapiens
ctgagatctttatacgaggcac

SEQ ID NO: 7952848 - DNA, 22 bp, Homo sapiens
ctgagatctttatacgaggcac

SEQ ID NO: 7952849 - DNA, 22 bp, Homo sapiens
ctgagatcccaggcagggtggc

SEQ ID NO: 7952850 - DNA, 22 bp, Homo sapiens
ctgagatcccaggcagggtggc

SEQ ID NO: 7952851 - DNA, 22 bp, Homo sapiens
ctgagatctttatacgaggcac

SEQ ID NO: 7952852 - DNA, 22 bp, Homo sapiens
ctgagatctttatacgaggcac

SEQ ID NO: 7952853 - DNA, 22 bp, Homo sapiens
ctgagatggtagatggatgtta

SEQ ID NO: 7952854 - DNA, 22 bp, Homo sapiens
ctgagatggccactgggtctca

SEQ ID NO: 7952855 - DNA, 22 bp, Homo sapiens
ctgagatggccactgggtctca

SEQ ID NO: 7952856 - DNA, 22 bp, Homo sapiens
ctgagatggagttttgctcttg

SEQ ID NO: 7952857 - DNA, 22 bp, Homo sapiens
ctgagatggagttttgctcttg

SEQ ID NO: 7952858 - DNA, 22 bp, Homo sapiens
ctgagatggagtttcgctcttc

SEQ ID NO: 7952859 - DNA, 22 bp, Homo sapiens
ctgagatggagtttcgctcttc

SEQ ID NO: 7952860 - DNA, 22 bp, Homo sapiens
ctgagagtgctctttgatgtca

SEQ ID NO: 7952861 - DNA, 22 bp, Homo sapiens
ctgagagtgcttgaaaggccag

SEQ ID NO: 7952862 - DNA, 22 bp, Homo sapiens
ctgagagtgtggcttccaggcc

SEQ ID NO: 7952863 - DNA, 22 bp, Homo sapiens
ctgagagtgtggcttccaggcc

SEQ ID NO: 7952864 - DNA, 22 bp, Homo sapiens
ctgagagttcgttccaccctcc

SEQ ID NO: 7952865 - DNA, 22 bp, Homo sapiens
ctgagagtgctctttgatgtca

SEQ ID NO: 7952866 - DNA, 22 bp, Homo sapiens
ctgagagtgctctttgatgtca

SEQ ID NO: 7952867 - DNA, 20 bp, Homo sapiens
ctgagagtctgtgcttagtc

SEQ ID NO: 7952868 - DNA, 20 bp, Homo sapiens
ctgagagtctgtgcttagtc

SEQ ID NO: 7952869 - DNA, 22 bp, Homo sapiens
ctgagagtcagtggagtggtgt

SEQ ID NO: 7952870 - DNA, 22 bp, Homo sapiens
ctgagagtctgcatttctaaca

SEQ ID NO: 7952871 - DNA, 22 bp, Homo sapiens
ctgagcaccccaggacctgcgc

SEQ ID NO: 7952872 - DNA, 23 bp, Homo sapiens
ctgagcacagctctgtgggcctc

SEQ ID NO: 7952873 - DNA, 22 bp, Homo sapiens
ctgagcaatttcagctctcact

SEQ ID NO: 7952874 - DNA, 22 bp, Homo sapiens
ctgagccttattcaccagccct

SEQ ID NO: 7952875 - DNA, 22 bp, Homo sapiens
ctgagcaccccaggacctgcgc

SEQ ID NO: 7952876 - DNA, 22 bp, Homo sapiens
ctgagcacctgctgtgtgccag

SEQ ID NO: 7952877 - DNA, 23 bp, Homo sapiens
ctgagcacagctctgtgggcctc

SEQ ID NO: 7952878 - DNA, 22 bp, Homo sapiens
ctgagccttattcaccagccct

SEQ ID NO: 7952879 - DNA, 22 bp, Homo sapiens
ctgagccttattcaccagccct

SEQ ID NO: 7952880 - DNA, 22 bp, Homo sapiens
ctgagcgcgggacctgaggctg

SEQ ID NO: 7952881 - DNA, 22 bp, Homo sapiens
ctgagcgcgggacctgaggctg

SEQ ID NO: 7952882 - DNA, 22 bp, Homo sapiens
ctgagcgcatggttgctgggga

SEQ ID NO: 7952883 - DNA, 22 bp, Homo sapiens
ctgagctgggctctcttgaggg

SEQ ID NO: 7952884 - DNA, 22 bp, Homo sapiens
ctgagctgggcaactcttagat

SEQ ID NO: 7952885 - DNA, 22 bp, Homo sapiens
ctgagctgggcaactcttagat

SEQ ID NO: 7952886 - DNA, 22 bp, Homo sapiens
ctgagctgggagtggatagtgg

SEQ ID NO: 7952887 - DNA, 22 bp, Homo sapiens
ctgagctgggagtagagactct

SEQ ID NO: 7952888 - DNA, 22 bp, Homo sapiens
ctgagctgggagtagagactct

SEQ ID NO: 7952889 - DNA, 22 bp, Homo sapiens
ctgagctgggagtagagactct

SEQ ID NO: 7952890 - DNA, 22 bp, Homo sapiens
ctgagctgggagtagagactct

SEQ ID NO: 7952891 - DNA, 22 bp, Homo sapiens
ctgagctgggagtagagactct

SEQ ID NO: 7952892 - DNA, 22 bp, Homo sapiens
ctgagctgggagtagagactct

SEQ ID NO: 7952893 - DNA, 22 bp, Homo sapiens
ctgagctgggagcctggcacca

SEQ ID NO: 7952894 - DNA, 22 bp, Homo sapiens
ctgagcgcgggacctgaggctg

SEQ ID NO: 7952895 - DNA, 22 bp, Homo sapiens
ctgaggctgggcatggggtcca

SEQ ID NO: 7952896 - DNA, 22 bp, Homo sapiens
ctgaggctgggcatggggtcca

SEQ ID NO: 7952897 - DNA, 18 bp, Homo sapiens
ctgaggctggcaggagcc

SEQ ID NO: 7952898 - DNA, 18 bp, Homo sapiens
ctgaggctggcaggagcc

SEQ ID NO: 7952899 - DNA, 22 bp, Homo sapiens
ctgaggaatgagtgaggagcca

SEQ ID NO: 7952900 - DNA, 18 bp, Homo sapiens
ctgaggctggcaggagcc

SEQ ID NO: 7952901 - DNA, 22 bp, Homo sapiens
ctgaggctgggcatggggtcca

SEQ ID NO: 7952902 - DNA, 22 bp, Homo sapiens
ctgagggaaggcagtcagttgg

SEQ ID NO: 7952903 - DNA, 22 bp, Homo sapiens
ctgagggaaggcagtcagttgg

SEQ ID NO: 7952904 - DNA, 22 bp, Homo sapiens
ctgaggctgggctgagggtata

SEQ ID NO: 7952905 - DNA, 22 bp, Homo sapiens
ctgagggaccctgtgagtacct

SEQ ID NO: 7952906 - DNA, 22 bp, Homo sapiens
ctgagggaccctgtgagtacct

SEQ ID NO: 7952907 - DNA, 22 bp, Homo sapiens
ctgagggagagaatggggcaaa

SEQ ID NO: 7952908 - DNA, 22 bp, Homo sapiens
ctgagggagctgctggccttgg

SEQ ID NO: 7952909 - DNA, 22 bp, Homo sapiens
ctgagggagagaatggggcaaa

SEQ ID NO: 7952910 - DNA, 22 bp, Homo sapiens
ctgagggagagaatggggcaaa

SEQ ID NO: 7952911 - DNA, 22 bp, Homo sapiens
ctgagggagagaatggggcaaa

SEQ ID NO: 7952912 - DNA, 22 bp, Homo sapiens
ctgagggaccctgtgagtacct

SEQ ID NO: 7952913 - DNA, 22 bp, Homo sapiens
ctgagggagaagtcacgggcag

SEQ ID NO: 7952914 - DNA, 22 bp, Homo sapiens
ctgagggagaagtcacgggcag

SEQ ID NO: 7952915 - DNA, 22 bp, Homo sapiens
ctgagggagaagtgatctctac

SEQ ID NO: 7952916 - DNA, 22 bp, Homo sapiens
ctgagggagacagtgcggacta

SEQ ID NO: 7952917 - DNA, 22 bp, Homo sapiens
ctgagggagacagtgcggacta

SEQ ID NO: 7952918 - DNA, 18 bp, Homo sapiens
ctgagggcaacagaggct

SEQ ID NO: 7952919 - DNA, 18 bp, Homo sapiens
ctgagggcaacagaggct

SEQ ID NO: 7952920 - DNA, 22 bp, Homo sapiens
ctgagggatgggctgggccgcc

SEQ ID NO: 7952921 - DNA, 22 bp, Homo sapiens
ctgagggatgggctgggccgcc

SEQ ID NO: 7952922 - DNA, 22 bp, Homo sapiens
ctgagggatgggctgggccgcc

SEQ ID NO: 7952923 - DNA, 22 bp, Homo sapiens
ctgagggagttcctgagcccac

SEQ ID NO: 7952924 - DNA, 22 bp, Homo sapiens
ctgagggatgggctgggccgcc

SEQ ID NO: 7952925 - DNA, 22 bp, Homo sapiens
ctgagggagttcctgagcccac

SEQ ID NO: 7952926 - DNA, 22 bp, Homo sapiens
ctgagggagggactttgagact

SEQ ID NO: 7952927 - DNA, 22 bp, Homo sapiens
ctgagggcaccgacagagtgga

SEQ ID NO: 7952928 - DNA, 22 bp, Homo sapiens
ctgagggcaccgacagagtgga

SEQ ID NO: 7952929 - DNA, 18 bp, Homo sapiens
ctgagggcaacagaggct

SEQ ID NO: 7952930 - DNA, 18 bp, Homo sapiens
ctgagggcaacagaggct

SEQ ID NO: 7952931 - DNA, 18 bp, Homo sapiens
ctgagggcaacagaggct

SEQ ID NO: 7952932 - DNA, 18 bp, Homo sapiens
ctgagggcagcccctggg

SEQ ID NO: 7952933 - DNA, 18 bp, Homo sapiens
ctgagggcagcccctggg

SEQ ID NO: 7952934 - DNA, 22 bp, Homo sapiens
ctgagggcagtgatgaaggtga

SEQ ID NO: 7952935 - DNA, 22 bp, Homo sapiens
ctgagggcagtgatgaaggtga

SEQ ID NO: 7952936 - DNA, 21 bp, Homo sapiens
ctgagggccgcagctgggctc

SEQ ID NO: 7952937 - DNA, 22 bp, Homo sapiens
ctgagggccctgaagcttggca

SEQ ID NO: 7952938 - DNA, 22 bp, Homo sapiens
ctgagggccctgaagcttggca

SEQ ID NO: 7952939 - DNA, 22 bp, Homo sapiens
ctgagctgtgtggtcctgggca

SEQ ID NO: 7952940 - DNA, 22 bp, Homo sapiens
ctgagctgtgtggtcctgggca

SEQ ID NO: 7952941 - DNA, 22 bp, Homo sapiens
ctgagctgtgtggtcctgggca

SEQ ID NO: 7952942 - DNA, 22 bp, Homo sapiens
ctgagctgtggccaccaattta

SEQ ID NO: 7952943 - DNA, 22 bp, Homo sapiens
ctgagctgtggccaccaattta

SEQ ID NO: 7952944 - DNA, 22 bp, Homo sapiens
ctgagctgtggaataaacactg

SEQ ID NO: 7952945 - DNA, 22 bp, Homo sapiens
ctgagctgtggaataaacactg

SEQ ID NO: 7952946 - DNA, 22 bp, Homo sapiens
ctgagctgttactctgtcctcg

SEQ ID NO: 7952947 - DNA, 22 bp, Homo sapiens
ctgagctgttactctgtcctcg

SEQ ID NO: 7952948 - DNA, 22 bp, Homo sapiens
ctgagctgttactctgtcctcg

SEQ ID NO: 7952949 - DNA, 22 bp, Homo sapiens
ctgagctgttactctgtcctcg

SEQ ID NO: 7952950 - DNA, 22 bp, Homo sapiens
ctgagctggttctcttgtgaaa

SEQ ID NO: 7952951 - DNA, 22 bp, Homo sapiens
ctgagctggttctcttgtgaaa

SEQ ID NO: 7952952 - DNA, 22 bp, Homo sapiens
ctgagctggtgtttcagggtca

SEQ ID NO: 7952953 - DNA, 22 bp, Homo sapiens
ctgagctgtcaggaatggaaag

SEQ ID NO: 7952954 - DNA, 22 bp, Homo sapiens
ctgagctggttctcttgtgaaa

SEQ ID NO: 7952955 - DNA, 22 bp, Homo sapiens
ctgagctgtggaataaacactg

SEQ ID NO: 7952956 - DNA, 22 bp, Homo sapiens
ctgagctgtgctaagtgaaatg

SEQ ID NO: 7952957 - DNA, 22 bp, Homo sapiens
ctgagctgtgctaagtgaaatg

SEQ ID NO: 7952958 - DNA, 22 bp, Homo sapiens
ctgagctgtgctaagtgaaatg

SEQ ID NO: 7952959 - DNA, 22 bp, Homo sapiens
ctgagctgtgctaagtgaaatg

SEQ ID NO: 7952960 - DNA, 22 bp, Homo sapiens
ctgagctgtcaggaatggaaag

SEQ ID NO: 7952961 - DNA, 22 bp, Homo sapiens
ctgagctgtcaggaatggaaag

SEQ ID NO: 7952962 - DNA, 21 bp, Homo sapiens
ctgagctggggtgaaggttgc

SEQ ID NO: 7952963 - DNA, 22 bp, Homo sapiens
ctgagctgggctctcttgaggg

SEQ ID NO: 7952964 - DNA, 22 bp, Homo sapiens
ctgagctgggcaactcttagat

SEQ ID NO: 7952965 - DNA, 22 bp, Homo sapiens
ctgagctgggctctcttgaggg

SEQ ID NO: 7952966 - DNA, 22 bp, Homo sapiens
ctgagctgggctctcttgaggg

SEQ ID NO: 7952967 - DNA, 21 bp, Homo sapiens
ctgagctggggtgaaggttgc

SEQ ID NO: 7952968 - DNA, 22 bp, Homo sapiens
ctgagctggtctatggacttgg

SEQ ID NO: 7952969 - DNA, 21 bp, Homo sapiens
ctgagctggggtgaaggttgc

SEQ ID NO: 7952970 - DNA, 22 bp, Homo sapiens
ctgagctggtggaagcatgcag

SEQ ID NO: 7952971 - DNA, 22 bp, Homo sapiens
ctgagctggtggaagcatgcag

SEQ ID NO: 7952972 - DNA, 22 bp, Homo sapiens
ctgagctggtggaagcatgcag

SEQ ID NO: 7952973 - DNA, 22 bp, Homo sapiens
ctgagctggtggaagcatgcag

SEQ ID NO: 7952974 - DNA, 22 bp, Homo sapiens
ctgagctggtgtttcagggtca

SEQ ID NO: 7952975 - DNA, 22 bp, Homo sapiens
ctgagctggtgtttcagggtca

SEQ ID NO: 7952976 - DNA, 22 bp, Homo sapiens
ctgagctggtggaagcatgcag

SEQ ID NO: 7952977 - DNA, 22 bp, Homo sapiens
ctgagctggtggaagcatgcag

SEQ ID NO: 7952978 - DNA, 22 bp, Homo sapiens
ctgagctggtgtttcagggtca

SEQ ID NO: 7952979 - DNA, 22 bp, Homo sapiens
ctgaggaaagctgcagcggtac

SEQ ID NO: 7952980 - DNA, 22 bp, Homo sapiens
ctgagcttggcttatctccagc

SEQ ID NO: 7952981 - DNA, 22 bp, Homo sapiens
ctgagcttggccaggaatgaat

SEQ ID NO: 7952982 - DNA, 22 bp, Homo sapiens
ctgagcttccagttcctccagg

SEQ ID NO: 7952983 - DNA, 22 bp, Homo sapiens
ctgagcttcagtgcactgggag

SEQ ID NO: 7952984 - DNA, 22 bp, Homo sapiens
ctgagcttccagttcctccagg

SEQ ID NO: 7952985 - DNA, 22 bp, Homo sapiens
ctgagcttaaccctgttagcaa

SEQ ID NO: 7952986 - DNA, 22 bp, Homo sapiens
ctgagctgtttaatcccagata

SEQ ID NO: 7952987 - DNA, 22 bp, Homo sapiens
ctgagctgttactctgtcctcg

SEQ ID NO: 7952988 - DNA, 22 bp, Homo sapiens
ctgagctgtttaatcccagata

SEQ ID NO: 7952989 - DNA, 22 bp, Homo sapiens
ctgagctgtttaatcccagata

SEQ ID NO: 7952990 - DNA, 22 bp, Homo sapiens
ctgaggaaagtattgcctggtg

SEQ ID NO: 7952991 - DNA, 22 bp, Homo sapiens
ctgaggaaagtattgcctggtg

SEQ ID NO: 7952992 - DNA, 22 bp, Homo sapiens
ctgaggaagacagcagctgtgt

SEQ ID NO: 7952993 - DNA, 22 bp, Homo sapiens
ctgaggaagacagcagctgtgt

SEQ ID NO: 7952994 - DNA, 22 bp, Homo sapiens
ctgaggaaagtattgcctggtg

SEQ ID NO: 7952995 - DNA, 22 bp, Homo sapiens
ctgaggaaagctgcagcggtac

SEQ ID NO: 7952996 - DNA, 22 bp, Homo sapiens
ctgaggaaggagttaggcagtt

SEQ ID NO: 7952997 - DNA, 22 bp, Homo sapiens
ctgaggacattgatgaggcaat

SEQ ID NO: 7952998 - DNA, 22 bp, Homo sapiens
ctgaggaatgagtgaggagcca

SEQ ID NO: 7952999 - DNA, 22 bp, Homo sapiens
ctgaggaaggctgggggcatcc

SEQ ID NO: 7953000 - DNA, 22 bp, Homo sapiens
ctgaggaatgagtgaggagcca

SEQ ID NO: 7953001 - DNA, 22 bp, Homo sapiens
ctgaggaaggagttaggcagtt

SEQ ID NO: 7953002 - DNA, 22 bp, Homo sapiens
ctgcctctggttttggtccctg

SEQ ID NO: 7953003 - DNA, 22 bp, Homo sapiens
ctgcctctggttttggtccctg

SEQ ID NO: 7953004 - DNA, 22 bp, Homo sapiens
ctgcctctggttttggtccctg

SEQ ID NO: 7953005 - DNA, 22 bp, Homo sapiens
ctgcctctgttgggcatggtct

SEQ ID NO: 7953006 - DNA, 22 bp, Homo sapiens
ctgcctctgttgggcatggtct

SEQ ID NO: 7953007 - DNA, 22 bp, Homo sapiens
ctgcctctggttttggtccctg

SEQ ID NO: 7953008 - DNA, 22 bp, Homo sapiens
ctgcctctggcctcaggcccag

SEQ ID NO: 7953009 - DNA, 22 bp, Homo sapiens
ctgcctctggcctcaggcccag

SEQ ID NO: 7953010 - DNA, 22 bp, Homo sapiens
ctgcctctggcctcaggcccag

SEQ ID NO: 7953011 - DNA, 22 bp, Homo sapiens
ctgcctctggcctcaggcccag

SEQ ID NO: 7953012 - DNA, 22 bp, Homo sapiens
ctgcctctggcctcaggcccag

SEQ ID NO: 7953013 - DNA, 22 bp, Homo sapiens
ctgcctctggttttggtccctg

SEQ ID NO: 7953014 - DNA, 22 bp, Homo sapiens
ctgccctgggccaggaagcggc

SEQ ID NO: 7953015 - DNA, 22 bp, Homo sapiens
ctgccctgggccaggaagcggc

SEQ ID NO: 7953016 - DNA, 22 bp, Homo sapiens
ctgcctctattcactgaggcag

SEQ ID NO: 7953017 - DNA, 22 bp, Homo sapiens
ctgcctctattcactgaggcag

SEQ ID NO: 7953018 - DNA, 22 bp, Homo sapiens
ctgcctctataggagtccacca

SEQ ID NO: 7953019 - DNA, 22 bp, Homo sapiens
ctgcctctattcactgaggcag

SEQ ID NO: 7953020 - DNA, 22 bp, Homo sapiens
ctgcctctattcactgaggcag

SEQ ID NO: 7953021 - DNA, 22 bp, Homo sapiens
ctgcctctattcactgaggcag

SEQ ID NO: 7953022 - DNA, 22 bp, Homo sapiens
ctgcctctattcactgaggcag

SEQ ID NO: 7953023 - DNA, 22 bp, Homo sapiens
ctgccctggccactgtgcccag

SEQ ID NO: 7953024 - DNA, 22 bp, Homo sapiens
ctgccctgggagtacctgtcct

SEQ ID NO: 7953025 - DNA, 22 bp, Homo sapiens
ctgccctgggagtacctgtcct

SEQ ID NO: 7953026 - DNA, 22 bp, Homo sapiens
ctgccctggccactgtgcccag

SEQ ID NO: 7953027 - DNA, 22 bp, Homo sapiens
ctgccctggcagcctaccatgg

SEQ ID NO: 7953028 - DNA, 22 bp, Homo sapiens
ctgccctggcagcctaccatgg

SEQ ID NO: 7953029 - DNA, 22 bp, Homo sapiens
ctgccctggccactgtgcccag

SEQ ID NO: 7953030 - DNA, 22 bp, Homo sapiens
ctgccctgggagtacctgtcct

SEQ ID NO: 7953031 - DNA, 22 bp, Homo sapiens
ctgccctgggagtacctgtcct

SEQ ID NO: 7953032 - DNA, 22 bp, Homo sapiens
ctgccctgggatggtctgtgcg

SEQ ID NO: 7953033 - DNA, 22 bp, Homo sapiens
ctgccctgggatggtctgtgcg

SEQ ID NO: 7953034 - DNA, 22 bp, Homo sapiens
ctgccctgggatggtctgtgcg

SEQ ID NO: 7953035 - DNA, 22 bp, Homo sapiens
ctgccctgggatggtctgtgcg

SEQ ID NO: 7953036 - DNA, 22 bp, Homo sapiens
ctgccctgggatggtctgtgcg

SEQ ID NO: 7953037 - DNA, 22 bp, Homo sapiens
ctgccctggaaaacgtatctta

SEQ ID NO: 7953038 - DNA, 22 bp, Homo sapiens
ctgccctggaaaacgtatctta

SEQ ID NO: 7953039 - DNA, 22 bp, Homo sapiens
ctgccctgcttgtttccagtgg

SEQ ID NO: 7953040 - DNA, 22 bp, Homo sapiens
ctgccctgcttgtttccagtgg

SEQ ID NO: 7953041 - DNA, 22 bp, Homo sapiens
ctgccctgcttgtttccagtgg

SEQ ID NO: 7953042 - DNA, 22 bp, Homo sapiens
ctgccctggcagcctaccatgg

SEQ ID NO: 7953043 - DNA, 22 bp, Homo sapiens
ctgccctggcagcctaccatgg

SEQ ID NO: 7953044 - DNA, 22 bp, Homo sapiens
ctgccctgcttgatgacagcga

SEQ ID NO: 7953045 - DNA, 22 bp, Homo sapiens
ctgccctgcttgatgacagcga

SEQ ID NO: 7953046 - DNA, 22 bp, Homo sapiens
ctgccctgcttgatgacagcga

SEQ ID NO: 7953047 - DNA, 22 bp, Homo sapiens
ctgccctgcttgatgacagcga

SEQ ID NO: 7953048 - DNA, 22 bp, Homo sapiens
ctgccctgcttgtttccagtgg

SEQ ID NO: 7953049 - DNA, 22 bp, Homo sapiens
ctgccctgcttgatgacagcga

SEQ ID NO: 7953050 - DNA, 22 bp, Homo sapiens
ctgccctgcagctccacggact

SEQ ID NO: 7953051 - DNA, 22 bp, Homo sapiens
ctgccctgcagctccacggact

SEQ ID NO: 7953052 - DNA, 22 bp, Homo sapiens
ctgccctgcagctccacggact

SEQ ID NO: 7953053 - DNA, 22 bp, Homo sapiens
ctgccctgcagctccacggact

SEQ ID NO: 7953054 - DNA, 23 bp, Homo sapiens
ctgccctgatcttgatctattgt

SEQ ID NO: 7953055 - DNA, 23 bp, Homo sapiens
ctgccctgatcttgatctattgt

SEQ ID NO: 7953056 - DNA, 22 bp, Homo sapiens
ctgccctgagtcatgccagatg

SEQ ID NO: 7953057 - DNA, 22 bp, Homo sapiens
ctgccctgatatgatttagaac

SEQ ID NO: 7953058 - DNA, 22 bp, Homo sapiens
ctgccctgagtcatgccagatg

SEQ ID NO: 7953059 - DNA, 22 bp, Homo sapiens
ctgccctgagtcatgccagatg

SEQ ID NO: 7953060 - DNA, 22 bp, Homo sapiens
ctgccctgagtcatgccagatg

SEQ ID NO: 7953061 - DNA, 22 bp, Homo sapiens
ctgccctgagtcatgccagatg

SEQ ID NO: 7953062 - DNA, 22 bp, Homo sapiens
ctgcccctggtgatggacgcca

SEQ ID NO: 7953063 - DNA, 18 bp, Homo sapiens
ctgccccttctctgagat

SEQ ID NO: 7953064 - DNA, 22 bp, Homo sapiens
ctgcccctggtgatggacgcca

SEQ ID NO: 7953065 - DNA, 22 bp, Homo sapiens
ctgcccctggtgatggacgcca

SEQ ID NO: 7953066 - DNA, 22 bp, Homo sapiens
ctgcccctggtgatggacgcca

SEQ ID NO: 7953067 - DNA, 22 bp, Homo sapiens
ctgcccctggctggtgaagcag

SEQ ID NO: 7953068 - DNA, 22 bp, Homo sapiens
ctgcccctggctggtgaagcag

SEQ ID NO: 7953069 - DNA, 22 bp, Homo sapiens
ctgccctgagggcctgtgtgtt

SEQ ID NO: 7953070 - DNA, 22 bp, Homo sapiens
ctgccctgagggcctgtgtgtt

SEQ ID NO: 7953071 - DNA, 22 bp, Homo sapiens
ctgccctgactgaccttttgaa

SEQ ID NO: 7953072 - DNA, 22 bp, Homo sapiens
ctgccctgagggcctgtgtgtt

SEQ ID NO: 7953073 - DNA, 22 bp, Homo sapiens
ctgccctgagggcctgtgtgtt

SEQ ID NO: 7953074 - DNA, 22 bp, Homo sapiens
ctgccctgagggcctgtgtgtt

SEQ ID NO: 7953075 - DNA, 22 bp, Homo sapiens
ctgccctgagggcctgtgtgtt

SEQ ID NO: 7953076 - DNA, 22 bp, Homo sapiens
ctgccctgcctggccagtgtgg

SEQ ID NO: 7953077 - DNA, 20 bp, Homo sapiens
ctgccctgccctgggtcctg

SEQ ID NO: 7953078 - DNA, 20 bp, Homo sapiens
ctgccctgccctgggtcctg

SEQ ID NO: 7953079 - DNA, 22 bp, Homo sapiens
ctgccctgcccaggccttgggc

SEQ ID NO: 7953080 - DNA, 22 bp, Homo sapiens
ctgccctgcccaggccttgggc

SEQ ID NO: 7953081 - DNA, 22 bp, Homo sapiens
ctgccctgcccaggccttgggc

SEQ ID NO: 7953082 - DNA, 22 bp, Homo sapiens
ctgccctgcccaggccttgggc

SEQ ID NO: 7953083 - DNA, 22 bp, Homo sapiens
ctgccctgcccaggccttgggc

SEQ ID NO: 7953084 - DNA, 22 bp, Homo sapiens
ctgccctgcagctccacggact

SEQ ID NO: 7953085 - DNA, 22 bp, Homo sapiens
ctgccctgcttgatgacagcga

SEQ ID NO: 7953086 - DNA, 22 bp, Homo sapiens
ctgccctgctggagatcacagt

SEQ ID NO: 7953087 - DNA, 22 bp, Homo sapiens
ctgccctgctaatgagttccaa

SEQ ID NO: 7953088 - DNA, 22 bp, Homo sapiens
ctgccctgctaatgagttccaa

SEQ ID NO: 7953089 - DNA, 22 bp, Homo sapiens
ctgccctgcctggccagtgtgg

SEQ ID NO: 7953090 - DNA, 22 bp, Homo sapiens
ctgccctgcctggccagtgtgg

SEQ ID NO: 7953091 - DNA, 22 bp, Homo sapiens
ctgccctgctctccgggatctt

SEQ ID NO: 7953092 - DNA, 22 bp, Homo sapiens
ctgccctgctggagatcacagt

SEQ ID NO: 7953093 - DNA, 22 bp, Homo sapiens
ctgcagtctgacatacgaggac

SEQ ID NO: 7953094 - DNA, 22 bp, Homo sapiens
ctgcagtcagtgctaatgggta

SEQ ID NO: 7953095 - DNA, 20 bp, Homo sapiens
ctgcagtcccctctgaatca

SEQ ID NO: 7953096 - DNA, 23 bp, Homo sapiens
ctgcagtcgccggcctgggtgcc

SEQ ID NO: 7953097 - DNA, 22 bp, Homo sapiens
ctgcagtcacattttctcacga

SEQ ID NO: 7953098 - DNA, 22 bp, Homo sapiens
ctgcagtcaagctcaccagttc

SEQ ID NO: 7953099 - DNA, 22 bp, Homo sapiens
ctgcagtcaagctcaccagttc

SEQ ID NO: 7953100 - DNA, 22 bp, Homo sapiens
ctgcagtatgagctacccaggt

SEQ ID NO: 7953101 - DNA, 22 bp, Homo sapiens
ctgcagtatgagctacccaggt

SEQ ID NO: 7953102 - DNA, 22 bp, Homo sapiens
ctgcagtagcagagctgagtag

SEQ ID NO: 7953103 - DNA, 22 bp, Homo sapiens
ctgcagtagcagagctgagtag

SEQ ID NO: 7953104 - DNA, 22 bp, Homo sapiens
ctgcagtgcaagcccagatgga

SEQ ID NO: 7953105 - DNA, 22 bp, Homo sapiens
ctgcagtgcctgccactgagcc

SEQ ID NO: 7953106 - DNA, 22 bp, Homo sapiens
ctgcagtgcaagcccagatgga

SEQ ID NO: 7953107 - DNA, 22 bp, Homo sapiens
ctgcagtgcctgccactgagcc

SEQ ID NO: 7953108 - DNA, 22 bp, Homo sapiens
ctgcagtgttctggaatgcatt

SEQ ID NO: 7953109 - DNA, 22 bp, Homo sapiens
ctgcagtgcctgccactgagcc

SEQ ID NO: 7953110 - DNA, 22 bp, Homo sapiens
ctgcagtgcctgccactgagcc

SEQ ID NO: 7953111 - DNA, 22 bp, Homo sapiens
ctgcagtgaaatcaggaagcaa

SEQ ID NO: 7953112 - DNA, 22 bp, Homo sapiens
ctgcagtcttccttccttaggc

SEQ ID NO: 7953113 - DNA, 22 bp, Homo sapiens
ctgcagtgcaagcccagatgga

SEQ ID NO: 7953114 - DNA, 22 bp, Homo sapiens
ctgcagtgcaagcccagatgga

SEQ ID NO: 7953115 - DNA, 22 bp, Homo sapiens
ctgcatcactcttactggcttt

SEQ ID NO: 7953116 - DNA, 22 bp, Homo sapiens
ctgcccctgctcatggctgtcc

SEQ ID NO: 7953117 - DNA, 20 bp, Homo sapiens
ctgcatcagcggccgcgtct

SEQ ID NO: 7953118 - DNA, 22 bp, Homo sapiens
ctgcatcacagcaggaggcaca

SEQ ID NO: 7953119 - DNA, 22 bp, Homo sapiens
ctgcatcactggccaagggtgt

SEQ ID NO: 7953120 - DNA, 22 bp, Homo sapiens
ctgcccctgctcatggctgtcc

SEQ ID NO: 7953121 - DNA, 22 bp, Homo sapiens
ctgcccctgctcatggctgtcc

SEQ ID NO: 7953122 - DNA, 22 bp, Homo sapiens
ctgcccctgctcatggctgtcc

SEQ ID NO: 7953123 - DNA, 22 bp, Homo sapiens
ctgcccctggctggtgaagcag

SEQ ID NO: 7953124 - DNA, 22 bp, Homo sapiens
ctgcccctggctggtgaagcag

SEQ ID NO: 7953125 - DNA, 22 bp, Homo sapiens
ctgcatatgagaataggagaaa

SEQ ID NO: 7953126 - DNA, 22 bp, Homo sapiens
ctgcatatcaaattactcctgg

SEQ ID NO: 7953127 - DNA, 22 bp, Homo sapiens
ctgcatatgatagatgccttgc

SEQ ID NO: 7953128 - DNA, 23 bp, Homo sapiens
ctgcatatggaggttagcaactc

SEQ ID NO: 7953129 - DNA, 22 bp, Homo sapiens
ctgcagtttcagcctttctggc

SEQ ID NO: 7953130 - DNA, 22 bp, Homo sapiens
ctgcagtttgaccttgttttct

SEQ ID NO: 7953131 - DNA, 22 bp, Homo sapiens
ctgcagtttgctaagagacaaa

SEQ ID NO: 7953132 - DNA, 22 bp, Homo sapiens
ctgcagtttgtaaacattttaa

SEQ ID NO: 7953133 - DNA, 22 bp, Homo sapiens
ctgcagttggataaagatactt

SEQ ID NO: 7953134 - DNA, 22 bp, Homo sapiens
ctgcagttggctgagacccccc

SEQ ID NO: 7953135 - DNA, 22 bp, Homo sapiens
ctgcagttgggtgacccaatat

SEQ ID NO: 7953136 - DNA, 22 bp, Homo sapiens
ctgcagttggtgggtcctcggt

SEQ ID NO: 7953137 - DNA, 22 bp, Homo sapiens
ctgcagtttcagcctttctggc

SEQ ID NO: 7953138 - DNA, 22 bp, Homo sapiens
ctgcagttctcaatttctattg

SEQ ID NO: 7953139 - DNA, 22 bp, Homo sapiens
ctgcagttcttctcctcaaggc

SEQ ID NO: 7953140 - DNA, 22 bp, Homo sapiens
ctgcagttctttggcttttaga

SEQ ID NO: 7953141 - DNA, 22 bp, Homo sapiens
ctgcagttgactccctgtttgc

SEQ ID NO: 7953142 - DNA, 22 bp, Homo sapiens
ctgcagtgttctggaatgcatt

SEQ ID NO: 7953143 - DNA, 22 bp, Homo sapiens
ctgcagtgttctggaatgcatt

SEQ ID NO: 7953144 - DNA, 22 bp, Homo sapiens
ctgcaggggctggagttggctt

SEQ ID NO: 7953145 - DNA, 22 bp, Homo sapiens
ctgcaggggctggagttggctt

SEQ ID NO: 7953146 - DNA, 22 bp, Homo sapiens
ctgcaggggctggagttggctt

SEQ ID NO: 7953147 - DNA, 22 bp, Homo sapiens
ctgcaggggctggagttggctt

SEQ ID NO: 7953148 - DNA, 22 bp, Homo sapiens
ctgcaggggctggagttggctt

SEQ ID NO: 7953149 - DNA, 22 bp, Homo sapiens
ctgcaggggcctcgagcacagg

SEQ ID NO: 7953150 - DNA, 23 bp, Homo sapiens
ctgaggggaaaagggcttcaggc

SEQ ID NO: 7953151 - DNA, 23 bp, Homo sapiens
ctgaggggaaaagggcttcaggc

SEQ ID NO: 7953152 - DNA, 23 bp, Homo sapiens
ctgaggggaaaagggcttcaggc

SEQ ID NO: 7953153 - DNA, 22 bp, Homo sapiens
ctgcagtaacgatcatggtgcc

SEQ ID NO: 7953154 - DNA, 22 bp, Homo sapiens
ctgcaggtttattttcttacct

SEQ ID NO: 7953155 - DNA, 22 bp, Homo sapiens
ctgcagtacaagaagcatctct

SEQ ID NO: 7953156 - DNA, 22 bp, Homo sapiens
ctgcagtaaccactgtaggtgt

SEQ ID NO: 7953157 - DNA, 22 bp, Homo sapiens
ctgcaggttgagcagccaggtt

SEQ ID NO: 7953158 - DNA, 22 bp, Homo sapiens
ctgcaggttgagcagccaggtt

SEQ ID NO: 7953159 - DNA, 22 bp, Homo sapiens
ctgcaggttgagcagccaggtt

SEQ ID NO: 7953160 - DNA, 22 bp, Homo sapiens
ctgcaggttgactgaagtttgg

SEQ ID NO: 7953161 - DNA, 22 bp, Homo sapiens
ctgcaggttaggagcactcctt

SEQ ID NO: 7953162 - DNA, 22 bp, Homo sapiens
ctgcaggtctctgtgtgcattc

SEQ ID NO: 7953163 - DNA, 21 bp, Homo sapiens
ctgcaggtgctgccatcaggg

SEQ ID NO: 7953164 - DNA, 22 bp, Homo sapiens
ctgcaggtctctgtgtgcattc

SEQ ID NO: 7953165 - DNA, 22 bp, Homo sapiens
ctgcaggttaggagcactcctt

SEQ ID NO: 7953166 - DNA, 21 bp, Homo sapiens
ctgcaggtgctgccatcaggg

SEQ ID NO: 7953167 - DNA, 22 bp, Homo sapiens
ctgcagggtttttcaaggacaa

SEQ ID NO: 7953168 - DNA, 22 bp, Homo sapiens
ctgcagggtttttcaaggacaa

SEQ ID NO: 7953169 - DNA, 22 bp, Homo sapiens
ctgagggcctgaggacctagat

SEQ ID NO: 7953170 - DNA, 22 bp, Homo sapiens
ctgagggccttggctcctgccc

SEQ ID NO: 7953171 - DNA, 22 bp, Homo sapiens
ctgagggccttctatgctgagc

SEQ ID NO: 7953172 - DNA, 21 bp, Homo sapiens
ctgagggccgcagctgggctc

SEQ ID NO: 7953173 - DNA, 21 bp, Homo sapiens
ctgagggccgcagctgggctc

SEQ ID NO: 7953174 - DNA, 22 bp, Homo sapiens
ctgagggctggagctgaggcct

SEQ ID NO: 7953175 - DNA, 22 bp, Homo sapiens
ctgagggctggagctgaggcct

SEQ ID NO: 7953176 - DNA, 23 bp, Homo sapiens
ctgagggctggtctgaagtctgc

SEQ ID NO: 7953177 - DNA, 22 bp, Homo sapiens
ctgagggctggagctgaggcct

SEQ ID NO: 7953178 - DNA, 22 bp, Homo sapiens
ctgagggccttggctcctgccc

SEQ ID NO: 7953179 - DNA, 22 bp, Homo sapiens
ctgagggccttggctcctgccc

SEQ ID NO: 7953180 - DNA, 22 bp, Homo sapiens
ctgagggctggagctgaggcct

SEQ ID NO: 7953181 - DNA, 22 bp, Homo sapiens
ctgagggctggagctgaggcct

SEQ ID NO: 7953182 - DNA, 22 bp, Homo sapiens
ctgctccccagcctgcgccttt

SEQ ID NO: 7953183 - DNA, 18 bp, Homo sapiens
ctgctccagtctggccag

SEQ ID NO: 7953184 - DNA, 18 bp, Homo sapiens
ctgctccagtctggccag

SEQ ID NO: 7953185 - DNA, 22 bp, Homo sapiens
ctgctccccagcctgcgccttt

SEQ ID NO: 7953186 - DNA, 19 bp, Homo sapiens
ctgctccctccttctggca

SEQ ID NO: 7953187 - DNA, 22 bp, Homo sapiens
ctgctccccagcctgcgccttt

SEQ ID NO: 7953188 - DNA, 22 bp, Homo sapiens
ctgctcctccccatcaggcagc

SEQ ID NO: 7953189 - DNA, 22 bp, Homo sapiens
ctgctcctccccatcaggcagc

SEQ ID NO: 7953190 - DNA, 22 bp, Homo sapiens
ctgctcctccccatcaggcagc

SEQ ID NO: 7953191 - DNA, 22 bp, Homo sapiens
ctgctcctccccatcaggcagc

SEQ ID NO: 7953192 - DNA, 22 bp, Homo sapiens
ctgctcctccccatcaggcagc

SEQ ID NO: 7953193 - DNA, 19 bp, Homo sapiens
ctgctccctccttctggca

SEQ ID NO: 7953194 - DNA, 22 bp, Homo sapiens
ctgctcctctgaggtagccaca

SEQ ID NO: 7953195 - DNA, 22 bp, Homo sapiens
ctgctcctctgaggtagccaca

SEQ ID NO: 7953196 - DNA, 22 bp, Homo sapiens
ctgctcctccccatcaggcagc

SEQ ID NO: 7953197 - DNA, 22 bp, Homo sapiens
ctgctcctctgaggtagccaca

SEQ ID NO: 7953198 - DNA, 22 bp, Homo sapiens
ctgctcctggtcatcctccact

SEQ ID NO: 7953199 - DNA, 22 bp, Homo sapiens
ctgctcctccccatcaggcagc

SEQ ID NO: 7953200 - DNA, 22 bp, Homo sapiens
ctgctcctctgaggtagccaca

SEQ ID NO: 7953201 - DNA, 22 bp, Homo sapiens
ctgctcctggtcatcctccact

SEQ ID NO: 7953202 - DNA, 22 bp, Homo sapiens
ctgctcctggtcatcctccact

SEQ ID NO: 7953203 - DNA, 22 bp, Homo sapiens
ctgctcctggtcatcctccact

SEQ ID NO: 7953204 - DNA, 22 bp, Homo sapiens
ctgctcctggtcatcctccact

SEQ ID NO: 7953205 - DNA, 22 bp, Homo sapiens
ctgctcctggtcatcctccact

SEQ ID NO: 7953206 - DNA, 22 bp, Homo sapiens
ctgctcctggtcatcctccact

SEQ ID NO: 7953207 - DNA, 22 bp, Homo sapiens
ctgctcctggtcatcctccact

SEQ ID NO: 7953208 - DNA, 22 bp, Homo sapiens
ctgctcctggtcatcctccact

SEQ ID NO: 7953209 - DNA, 22 bp, Homo sapiens
ctgctcctgtccagcagggcca

SEQ ID NO: 7953210 - DNA, 22 bp, Homo sapiens
ctgctcctgtccagcagggcca

SEQ ID NO: 7953211 - DNA, 22 bp, Homo sapiens
ctgctcctgtccagcagggcca

SEQ ID NO: 7953212 - DNA, 22 bp, Homo sapiens
ctgctcctgtccagcagggcca

SEQ ID NO: 7953213 - DNA, 22 bp, Homo sapiens
ctgctcctgtccagcagggcca

SEQ ID NO: 7953214 - DNA, 22 bp, Homo sapiens
ctgctcctgtccagcagggcca

SEQ ID NO: 7953215 - DNA, 22 bp, Homo sapiens
ctgctcctggtcatcctccact

SEQ ID NO: 7953216 - DNA, 20 bp, Homo sapiens
ctgctccacccggctctcag

SEQ ID NO: 7953217 - DNA, 22 bp, Homo sapiens
ctgctccacctccgggtcaggc

SEQ ID NO: 7953218 - DNA, 20 bp, Homo sapiens
ctgctccacccggctctcag

SEQ ID NO: 7953219 - DNA, 22 bp, Homo sapiens
ctgctccacaccgtccatactc

SEQ ID NO: 7953220 - DNA, 22 bp, Homo sapiens
ctgctccacaccgtccatactc

SEQ ID NO: 7953221 - DNA, 22 bp, Homo sapiens
ctgctccaagccagccctgcag

SEQ ID NO: 7953222 - DNA, 22 bp, Homo sapiens
ctgctccaagccagccctgcag

SEQ ID NO: 7953223 - DNA, 22 bp, Homo sapiens
ctgcgtgtttgcaccctgtctg

SEQ ID NO: 7953224 - DNA, 22 bp, Homo sapiens
ctgcgtgttcctgaagcgcgct

SEQ ID NO: 7953225 - DNA, 22 bp, Homo sapiens
ctgctccaggaacagagctgct

SEQ ID NO: 7953226 - DNA, 22 bp, Homo sapiens
ctgctccaggaacagagctgct

SEQ ID NO: 7953227 - DNA, 22 bp, Homo sapiens
ctgctccaggaacagagctgct

SEQ ID NO: 7953228 - DNA, 22 bp, Homo sapiens
ctgctccagacacctgcagggg

SEQ ID NO: 7953229 - DNA, 22 bp, Homo sapiens
ctgctccagacacctgcagggg

SEQ ID NO: 7953230 - DNA, 22 bp, Homo sapiens
ctgctccagacacctgcagggg

SEQ ID NO: 7953231 - DNA, 22 bp, Homo sapiens
ctgctccacctccgggtcaggc

SEQ ID NO: 7953232 - DNA, 19 bp, Homo sapiens
ctgctccaggagctgggga

SEQ ID NO: 7953233 - DNA, 19 bp, Homo sapiens
ctgctccaggagctgggga

SEQ ID NO: 7953234 - DNA, 23 bp, Homo sapiens
ctgctccaggacagcatggaggt

SEQ ID NO: 7953235 - DNA, 19 bp, Homo sapiens
ctgctccaggagctgggga

SEQ ID NO: 7953236 - DNA, 22 bp, Homo sapiens
ctgctccaggatttcaggccag

SEQ ID NO: 7953237 - DNA, 19 bp, Homo sapiens
ctgctccaggagctgggga

SEQ ID NO: 7953238 - DNA, 23 bp, Homo sapiens
ctgctccaggacagcatggaggt

SEQ ID NO: 7953239 - DNA, 23 bp, Homo sapiens
ctgctccaggacagcatggaggt

SEQ ID NO: 7953240 - DNA, 23 bp, Homo sapiens
ctgctccaggacagcatggaggt

SEQ ID NO: 7953241 - DNA, 19 bp, Homo sapiens
ctgctccaggagctgggga

SEQ ID NO: 7953242 - DNA, 22 bp, Homo sapiens
ctgcctgcctggagacagatgg

SEQ ID NO: 7953243 - DNA, 22 bp, Homo sapiens
ctgcctgccacgttcagctgta

SEQ ID NO: 7953244 - DNA, 22 bp, Homo sapiens
ctgcctgccttggcctccagga

SEQ ID NO: 7953245 - DNA, 22 bp, Homo sapiens
ctgcctgccttggcctccagga

SEQ ID NO: 7953246 - DNA, 22 bp, Homo sapiens
ctgcctgccttggcctccagga

SEQ ID NO: 7953247 - DNA, 22 bp, Homo sapiens
ctgcctgccttggcctccagga

SEQ ID NO: 7953248 - DNA, 22 bp, Homo sapiens
ctgcctgcctggagacagatgg

SEQ ID NO: 7953249 - DNA, 22 bp, Homo sapiens
ctgcctgcctggagacagatgg

SEQ ID NO: 7953250 - DNA, 22 bp, Homo sapiens
ctgcctgcatcccacagtgggg

SEQ ID NO: 7953251 - DNA, 22 bp, Homo sapiens
ctgcctgcatgctgccatagct

SEQ ID NO: 7953252 - DNA, 22 bp, Homo sapiens
ctgcctgcatcccacagtgggg

SEQ ID NO: 7953253 - DNA, 22 bp, Homo sapiens
ctgcctgcatgctgccatagct

SEQ ID NO: 7953254 - DNA, 22 bp, Homo sapiens
ctgcctgcatgctgccatagct

SEQ ID NO: 7953255 - DNA, 22 bp, Homo sapiens
ctgcctgccacgttcagctgta

SEQ ID NO: 7953256 - DNA, 22 bp, Homo sapiens
ctgcctgcatgctgccatagct

SEQ ID NO: 7953257 - DNA, 22 bp, Homo sapiens
ctgcctgccttggcctccagga

SEQ ID NO: 7953258 - DNA, 22 bp, Homo sapiens
ctgcctgccttggcctccagga

SEQ ID NO: 7953259 - DNA, 22 bp, Homo sapiens
ctgcctgccttggcctccagga

SEQ ID NO: 7953260 - DNA, 22 bp, Homo sapiens
ctgcctgcgccaccaccacgtc

SEQ ID NO: 7953261 - DNA, 22 bp, Homo sapiens
ctgcgtgtctctgtctcatggc

SEQ ID NO: 7953262 - DNA, 22 bp, Homo sapiens
ctgcgtgtctccttggggcaga

SEQ ID NO: 7953263 - DNA, 22 bp, Homo sapiens
ctgcgtgcattaatatttcctt

SEQ ID NO: 7953264 - DNA, 22 bp, Homo sapiens
ctgcgtgcatgtctgcgtgcat

SEQ ID NO: 7953265 - DNA, 22 bp, Homo sapiens
ctgcgtgagcgtgcccgtcttg

SEQ ID NO: 7953266 - DNA, 22 bp, Homo sapiens
ctgcctgcatcccacagtgggg

SEQ ID NO: 7953267 - DNA, 22 bp, Homo sapiens
ctgcctgcactgcctggctcca

SEQ ID NO: 7953268 - DNA, 22 bp, Homo sapiens
ctgcctgcaggacacctcgcta

SEQ ID NO: 7953269 - DNA, 22 bp, Homo sapiens
ctgcctgcaggacacctcgcta

SEQ ID NO: 7953270 - DNA, 22 bp, Homo sapiens
ctgcctgcactgcctggctcca

SEQ ID NO: 7953271 - DNA, 22 bp, Homo sapiens
ctgcctgagtacaagtcccaga

SEQ ID NO: 7953272 - DNA, 22 bp, Homo sapiens
ctgcctgagtggaggtcgaggg

SEQ ID NO: 7953273 - DNA, 22 bp, Homo sapiens
ctgcctgagtggaggtcgaggg

SEQ ID NO: 7953274 - DNA, 22 bp, Homo sapiens
ctgcctgcactgcctggctcca

SEQ ID NO: 7953275 - DNA, 22 bp, Homo sapiens
ctgcctgcactgcctggctcca

SEQ ID NO: 7953276 - DNA, 22 bp, Homo sapiens
ctgcctgcactgcctggctcca

SEQ ID NO: 7953277 - DNA, 22 bp, Homo sapiens
ctgcctgcactgcctggctcca

SEQ ID NO: 7953278 - DNA, 22 bp, Homo sapiens
ctgcctgcactgcctggctcca

SEQ ID NO: 7953279 - DNA, 22 bp, Homo sapiens
ctgcctcttgacagatcgtggc

SEQ ID NO: 7953280 - DNA, 22 bp, Homo sapiens
ctgcctcttgacagatcgtggc

SEQ ID NO: 7953281 - DNA, 22 bp, Homo sapiens
ctgcctgaactgggtgagcaag

SEQ ID NO: 7953282 - DNA, 22 bp, Homo sapiens
ctgcctgaactgggtgagcaag

SEQ ID NO: 7953283 - DNA, 22 bp, Homo sapiens
ctgcctgaactgggtgagcaag

SEQ ID NO: 7953284 - DNA, 22 bp, Homo sapiens
ctgcctgaactgggtgagcaag

SEQ ID NO: 7953285 - DNA, 22 bp, Homo sapiens
ctgcctgaagaattgtgttgca

SEQ ID NO: 7953286 - DNA, 22 bp, Homo sapiens
ctgcctcttgacagatcgtggc

SEQ ID NO: 7953287 - DNA, 22 bp, Homo sapiens
ctgcctcttaagtggatggagt

SEQ ID NO: 7953288 - DNA, 22 bp, Homo sapiens
ctgcctcttaagtggatggagt

SEQ ID NO: 7953289 - DNA, 22 bp, Homo sapiens
ctgcctcttaagtggatggagt

SEQ ID NO: 7953290 - DNA, 22 bp, Homo sapiens
ctgcctctgttgggcatggtct

SEQ ID NO: 7953291 - DNA, 22 bp, Homo sapiens
ctgctctgaagccaggattctg

SEQ ID NO: 7953292 - DNA, 22 bp, Homo sapiens
ctgctctgaagccaggattctg

SEQ ID NO: 7953293 - DNA, 21 bp, Homo sapiens
ctgctctgacagtgaggccag

SEQ ID NO: 7953294 - DNA, 22 bp, Homo sapiens
ctgctgagcatttgcagggaca

SEQ ID NO: 7953295 - DNA, 19 bp, Homo sapiens
ctgctctccttgacttgga

SEQ ID NO: 7953296 - DNA, 19 bp, Homo sapiens
ctgctctccttgacttgga

SEQ ID NO: 7953297 - DNA, 22 bp, Homo sapiens
ctgctctagagagcattagtca

SEQ ID NO: 7953298 - DNA, 22 bp, Homo sapiens
ctgctctaatatcagatagact

SEQ ID NO: 7953299 - DNA, 22 bp, Homo sapiens
ctgctcctgtgggccagtggcc

SEQ ID NO: 7953300 - DNA, 22 bp, Homo sapiens
ctgctcctgtgggccagtggcc

SEQ ID NO: 7953301 - DNA, 22 bp, Homo sapiens
ctgctcctgtgggccagtggcc

SEQ ID NO: 7953302 - DNA, 22 bp, Homo sapiens
ctgctcctgtgggccagtggcc

SEQ ID NO: 7953303 - DNA, 22 bp, Homo sapiens
ctgctcctgtgggccagtggcc

SEQ ID NO: 7953304 - DNA, 22 bp, Homo sapiens
ctgctcctgtgggccagtggcc

SEQ ID NO: 7953305 - DNA, 22 bp, Homo sapiens
ctgctcctgtgggccagtggcc

SEQ ID NO: 7953306 - DNA, 22 bp, Homo sapiens
ctgctcctgtgggccagtggcc

SEQ ID NO: 7953307 - DNA, 22 bp, Homo sapiens
ctgctctaatatcagatagact

SEQ ID NO: 7953308 - DNA, 22 bp, Homo sapiens
ctgctctaactgcattagtttt

SEQ ID NO: 7953309 - DNA, 22 bp, Homo sapiens
ctgctgagcctggtgcgggatg

SEQ ID NO: 7953310 - DNA, 22 bp, Homo sapiens
ctgctgagccgcacccaggagc

SEQ ID NO: 7953311 - DNA, 22 bp, Homo sapiens
ctgctgagccctggcacaggtg

SEQ ID NO: 7953312 - DNA, 22 bp, Homo sapiens
ctgctgagccctggcacaggtg

SEQ ID NO: 7953313 - DNA, 22 bp, Homo sapiens
ctgctgcccctgagctcagcct

SEQ ID NO: 7953314 - DNA, 22 bp, Homo sapiens
ctgctgcccctgagctcagcct

SEQ ID NO: 7953315 - DNA, 22 bp, Homo sapiens
ctgctgcccctgagctcagcct

SEQ ID NO: 7953316 - DNA, 22 bp, Homo sapiens
ctgctgcccctgagctcagcct

SEQ ID NO: 7953317 - DNA, 22 bp, Homo sapiens
ctgctgcccctgagctcagcct

SEQ ID NO: 7953318 - DNA, 20 bp, Homo sapiens
ctgctgccctgtcagcctct

SEQ ID NO: 7953319 - DNA, 22 bp, Homo sapiens
ctgctgccctagacccagtcct

SEQ ID NO: 7953320 - DNA, 22 bp, Homo sapiens
ctgctgcccctgagctcagcct

SEQ ID NO: 7953321 - DNA, 22 bp, Homo sapiens
ctgctgccggcgagcctccctt

SEQ ID NO: 7953322 - DNA, 22 bp, Homo sapiens
ctgctgccggcgagcctccctt

SEQ ID NO: 7953323 - DNA, 22 bp, Homo sapiens
ctgctgcctagtccaagacgtg

SEQ ID NO: 7953324 - DNA, 19 bp, Homo sapiens
ctgctgccggagactcgtc

SEQ ID NO: 7953325 - DNA, 20 bp, Homo sapiens
ctgctgccctgtcagcctct

SEQ ID NO: 7953326 - DNA, 20 bp, Homo sapiens
ctgctgccctgtcagcctct

SEQ ID NO: 7953327 - DNA, 20 bp, Homo sapiens
ctgctgccctgtcagcctct

SEQ ID NO: 7953328 - DNA, 20 bp, Homo sapiens
ctgctgccctgtcagcctct

SEQ ID NO: 7953329 - DNA, 22 bp, Homo sapiens
ctgctgctgagaatgcctcagg

SEQ ID NO: 7953330 - DNA, 22 bp, Homo sapiens
ctgctgctgagagctcagcctg

SEQ ID NO: 7953331 - DNA, 22 bp, Homo sapiens
ctgctgctgagagctcagcctg

SEQ ID NO: 7953332 - DNA, 22 bp, Homo sapiens
ctgctgctgagagctcagcctg

SEQ ID NO: 7953333 - DNA, 22 bp, Homo sapiens
ctgctgctgagagctcagcctg

SEQ ID NO: 7953334 - DNA, 22 bp, Homo sapiens
ctgctgctgagagctcagcctg

SEQ ID NO: 7953335 - DNA, 22 bp, Homo sapiens
ctgctgctgctatctacccagg

SEQ ID NO: 7953336 - DNA, 22 bp, Homo sapiens
ctgctgctgctatctacccagg

SEQ ID NO: 7953337 - DNA, 21 bp, Homo sapiens
ctgctgctggggtctgggcag

SEQ ID NO: 7953338 - DNA, 21 bp, Homo sapiens
ctgctgctggggtctgggcag

SEQ ID NO: 7953339 - DNA, 22 bp, Homo sapiens
ctgctgcttagcatagcagagg

SEQ ID NO: 7953340 - DNA, 22 bp, Homo sapiens
ctgctgctgtaaggcagaatta

SEQ ID NO: 7953341 - DNA, 22 bp, Homo sapiens
ctgctgctgtaaggcagaatta

SEQ ID NO: 7953342 - DNA, 22 bp, Homo sapiens
ctgctgcttagcatagcagagg

SEQ ID NO: 7953343 - DNA, 22 bp, Homo sapiens
ctgctgccttccaaaggccagg

SEQ ID NO: 7953344 - DNA, 22 bp, Homo sapiens
ctgctgcctgattgcagacctc

SEQ ID NO: 7953345 - DNA, 22 bp, Homo sapiens
ctgctgcctgattgcagacctc

SEQ ID NO: 7953346 - DNA, 22 bp, Homo sapiens
ctgctgcctgattgcagacctc

SEQ ID NO: 7953347 - DNA, 22 bp, Homo sapiens
ctgctgcctgattgcagacctc

SEQ ID NO: 7953348 - DNA, 22 bp, Homo sapiens
ctgctgcctcgacattgggaca

SEQ ID NO: 7953349 - DNA, 22 bp, Homo sapiens
ctgctgcctgacaatttaggtt

SEQ ID NO: 7953350 - DNA, 22 bp, Homo sapiens
ctgctgcctcgacattgggaca

SEQ ID NO: 7953351 - DNA, 22 bp, Homo sapiens
ctgctgcctcgacattgggaca

SEQ ID NO: 7953352 - DNA, 22 bp, Homo sapiens
ctgctgctgactcatcccagct

SEQ ID NO: 7953353 - DNA, 22 bp, Homo sapiens
ctgctgctcttgtgcattagtg

SEQ ID NO: 7953354 - DNA, 22 bp, Homo sapiens
ctgctgctgactcatcccagct

SEQ ID NO: 7953355 - DNA, 22 bp, Homo sapiens
ctgctgctgagaatgcctcagg

SEQ ID NO: 7953356 - DNA, 22 bp, Homo sapiens
ctgctgctcgaccagtcccagg

SEQ ID NO: 7953357 - DNA, 22 bp, Homo sapiens
ctgctgctcagtgtcatcatgt

SEQ ID NO: 7953358 - DNA, 22 bp, Homo sapiens
ctgctgctcgaccagtcccagg

SEQ ID NO: 7953359 - DNA, 22 bp, Homo sapiens
ctgctgctcagtgtcatcatgt

SEQ ID NO: 7953360 - DNA, 22 bp, Homo sapiens
ctgctgccttccaaaggccagg

SEQ ID NO: 7953361 - DNA, 22 bp, Homo sapiens
ctgctggaagtttgctgtggat

SEQ ID NO: 7953362 - DNA, 22 bp, Homo sapiens
ctgctggaagtttgctgtggat

SEQ ID NO: 7953363 - DNA, 22 bp, Homo sapiens
ctgctggaagtttgctgtggat

SEQ ID NO: 7953364 - DNA, 22 bp, Homo sapiens
ctgctggagggagctgatagtg

SEQ ID NO: 7953365 - DNA, 22 bp, Homo sapiens
ctgctggactacaggaagagtt

SEQ ID NO: 7953366 - DNA, 22 bp, Homo sapiens
ctgctggactacaggaagagtt

SEQ ID NO: 7953367 - DNA, 22 bp, Homo sapiens
ctgctggactacaggaagagtt

SEQ ID NO: 7953368 - DNA, 22 bp, Homo sapiens
ctgctggaatctttaagctgga

SEQ ID NO: 7953369 - DNA, 22 bp, Homo sapiens
ctgctggcaagcccagttggag

SEQ ID NO: 7953370 - DNA, 22 bp, Homo sapiens
ctgctggcaagcccagttggag

SEQ ID NO: 7953371 - DNA, 22 bp, Homo sapiens
ctgctggcaccgatgaaagaca

SEQ ID NO: 7953372 - DNA, 22 bp, Homo sapiens
ctgctggcaccgatgaaagaca

SEQ ID NO: 7953373 - DNA, 22 bp, Homo sapiens
ctgctggcaagcccagttggag

SEQ ID NO: 7953374 - DNA, 22 bp, Homo sapiens
ctgctggaggttggagcatgca

SEQ ID NO: 7953375 - DNA, 22 bp, Homo sapiens
ctgctggaggttggagcatgca

SEQ ID NO: 7953376 - DNA, 22 bp, Homo sapiens
ctgctggaggttggagcatgca

SEQ ID NO: 7953377 - DNA, 22 bp, Homo sapiens
ctgctggaggttggagcatgca

SEQ ID NO: 7953378 - DNA, 22 bp, Homo sapiens
ctgctggagggagctgatagtg

SEQ ID NO: 7953379 - DNA, 22 bp, Homo sapiens
ctgctgggaaggtctgctcagt

SEQ ID NO: 7953380 - DNA, 22 bp, Homo sapiens
ctgctggcttctagtcattcaa

SEQ ID NO: 7953381 - DNA, 20 bp, Homo sapiens
ctgctgtgattccctcctcc

SEQ ID NO: 7953382 - DNA, 22 bp, Homo sapiens
ctgctgtgagtttggaggtcta

SEQ ID NO: 7953383 - DNA, 17 bp, Homo sapiens
ctgctggctggggcttg

SEQ ID NO: 7953384 - DNA, 17 bp, Homo sapiens
ctgctggctggggcttg

SEQ ID NO: 7953385 - DNA, 22 bp, Homo sapiens
ctgctggcctcggccatgcctg

SEQ ID NO: 7953386 - DNA, 22 bp, Homo sapiens
ctgctggcctcggccatgcctg

SEQ ID NO: 7953387 - DNA, 22 bp, Homo sapiens
ctgctggcctcggccatgcctg

SEQ ID NO: 7953388 - DNA, 22 bp, Homo sapiens
ctgctggcctagcccatcctct

SEQ ID NO: 7953389 - DNA, 22 bp, Homo sapiens
ctgctggcaccgatgaaagaca

SEQ ID NO: 7953390 - DNA, 22 bp, Homo sapiens
ctgctggcccccatttcagggt

SEQ ID NO: 7953391 - DNA, 22 bp, Homo sapiens
ctgctggcccccatttcagggt

SEQ ID NO: 7953392 - DNA, 22 bp, Homo sapiens
ctccctgcttgtttcccttcag

SEQ ID NO: 7953393 - DNA, 22 bp, Homo sapiens
ctccctgcttgtttcccttcag

SEQ ID NO: 7953394 - DNA, 22 bp, Homo sapiens
ctccctgcttgtttcccttcag

SEQ ID NO: 7953395 - DNA, 22 bp, Homo sapiens
ctccctgcttgtttcccttcag

SEQ ID NO: 7953396 - DNA, 22 bp, Homo sapiens
ctccctggaggcccagacctgg

SEQ ID NO: 7953397 - DNA, 22 bp, Homo sapiens
ctccctggaggcccagacctgg

SEQ ID NO: 7953398 - DNA, 22 bp, Homo sapiens
ctccctggaggcccagacctgg

SEQ ID NO: 7953399 - DNA, 22 bp, Homo sapiens
ctccctggaggtgagctggcac

SEQ ID NO: 7953400 - DNA, 22 bp, Homo sapiens
ctccctggaggcccagacctgg

SEQ ID NO: 7953401 - DNA, 22 bp, Homo sapiens
ctccctggaggtgagctggcac

SEQ ID NO: 7953402 - DNA, 22 bp, Homo sapiens
ctccctggaggtgagctggcac

SEQ ID NO: 7953403 - DNA, 22 bp, Homo sapiens
ctccctggaggtgagctggcac

SEQ ID NO: 7953404 - DNA, 22 bp, Homo sapiens
ctccctctgtcttgtccagaaa

SEQ ID NO: 7953405 - DNA, 22 bp, Homo sapiens
ctccctcacacccttgcccaga

SEQ ID NO: 7953406 - DNA, 22 bp, Homo sapiens
ctccctctgtcttgtccagaaa

SEQ ID NO: 7953407 - DNA, 22 bp, Homo sapiens
ctccctgccctgtgagttggcc

SEQ ID NO: 7953408 - DNA, 22 bp, Homo sapiens
ctccctgccctgtgagttggcc

SEQ ID NO: 7953409 - DNA, 22 bp, Homo sapiens
ctccctgaggacaggccctgtc

SEQ ID NO: 7953410 - DNA, 22 bp, Homo sapiens
ctccctgggcagatgtggctct

SEQ ID NO: 7953411 - DNA, 22 bp, Homo sapiens
ctccctgggcagatgtggctct

SEQ ID NO: 7953412 - DNA, 22 bp, Homo sapiens
ctccctgggcagatgtggctct

SEQ ID NO: 7953413 - DNA, 23 bp, Homo sapiens
ctccctggcccttgggagacctg

SEQ ID NO: 7953414 - DNA, 22 bp, Homo sapiens
ctccctggctttgtcctgaggc

SEQ ID NO: 7953415 - DNA, 23 bp, Homo sapiens
ctccctggagtttctggaagatg

SEQ ID NO: 7953416 - DNA, 22 bp, Homo sapiens
ctccctggcacagcgagaggtt

SEQ ID NO: 7953417 - DNA, 22 bp, Homo sapiens
ctccctggcagccgcactcctg

SEQ ID NO: 7953418 - DNA, 22 bp, Homo sapiens
ctccctggcagccgcactcctg

SEQ ID NO: 7953419 - DNA, 22 bp, Homo sapiens
ctccctggcagccgcactcctg

SEQ ID NO: 7953420 - DNA, 22 bp, Homo sapiens
ctccctggcacagcgagaggtt

SEQ ID NO: 7953421 - DNA, 22 bp, Homo sapiens
ctccctggcacagcgagaggtt

SEQ ID NO: 7953422 - DNA, 22 bp, Homo sapiens
ctccctggcagccgcactcctg

SEQ ID NO: 7953423 - DNA, 22 bp, Homo sapiens
ctccgcttgtgtatacctccaa

SEQ ID NO: 7953424 - DNA, 22 bp, Homo sapiens
ctcctcagctgggaggagtccc

SEQ ID NO: 7953425 - DNA, 22 bp, Homo sapiens
ctcccttctgagccttttgtta

SEQ ID NO: 7953426 - DNA, 22 bp, Homo sapiens
ctcccttttggatatggggaga

SEQ ID NO: 7953427 - DNA, 22 bp, Homo sapiens
ctcccttttggatatggggaga

SEQ ID NO: 7953428 - DNA, 22 bp, Homo sapiens
ctcccttccaatgactatgctt

SEQ ID NO: 7953429 - DNA, 22 bp, Homo sapiens
ctcccttctgagccttttgtta

SEQ ID NO: 7953430 - DNA, 22 bp, Homo sapiens
ctcccttcaggagaggctcaca

SEQ ID NO: 7953431 - DNA, 22 bp, Homo sapiens
ctccctgtgtcttcacttggcc

SEQ ID NO: 7953432 - DNA, 22 bp, Homo sapiens
ctcccttcaggagaggctcaca

SEQ ID NO: 7953433 - DNA, 22 bp, Homo sapiens
ctccctggtgtcccctccagga

SEQ ID NO: 7953434 - DNA, 22 bp, Homo sapiens
ctccctggtgtcccctccagga

SEQ ID NO: 7953435 - DNA, 22 bp, Homo sapiens
ctccctggtgtcccctccagga

SEQ ID NO: 7953436 - DNA, 22 bp, Homo sapiens
ctccctggtctttcccatcatt

SEQ ID NO: 7953437 - DNA, 22 bp, Homo sapiens
ctccctggtctttcccatcatt

SEQ ID NO: 7953438 - DNA, 22 bp, Homo sapiens
ctcctcagtcaggtctagggtc

SEQ ID NO: 7953439 - DNA, 22 bp, Homo sapiens
ctcctcagtcaggtctagggtc

SEQ ID NO: 7953440 - DNA, 22 bp, Homo sapiens
ctcctcagtcaggtctagggtc

SEQ ID NO: 7953441 - DNA, 21 bp, Homo sapiens
ctcctcaggaccagccacagg

SEQ ID NO: 7953442 - DNA, 22 bp, Homo sapiens
ctcctcagggctggttacatgg

SEQ ID NO: 7953443 - DNA, 22 bp, Homo sapiens
ctcctcaggaagtagcatgtgt

SEQ ID NO: 7953444 - DNA, 21 bp, Homo sapiens
ctcctcaggaccagccacagg

SEQ ID NO: 7953445 - DNA, 22 bp, Homo sapiens
ctcctcaggaagtagcatgtgt

SEQ ID NO: 7953446 - DNA, 22 bp, Homo sapiens
ctcctcaggaagtagcatgtgt

SEQ ID NO: 7953447 - DNA, 22 bp, Homo sapiens
ctcctcaggaagtagcatgtgt

SEQ ID NO: 7953448 - DNA, 22 bp, Homo sapiens
ctcctcaggaagtagcatgtgt

SEQ ID NO: 7953449 - DNA, 21 bp, Homo sapiens
ctcctcaggaccagccacagg

SEQ ID NO: 7953450 - DNA, 21 bp, Homo sapiens
ctcctcaggaccagccacagg

SEQ ID NO: 7953451 - DNA, 21 bp, Homo sapiens
ctcctcaggaccagccacagg

SEQ ID NO: 7953452 - DNA, 21 bp, Homo sapiens
ctcctcaggaccagccacagg

SEQ ID NO: 7953453 - DNA, 20 bp, Homo sapiens
ctcctcagttccatgggagg

SEQ ID NO: 7953454 - DNA, 20 bp, Homo sapiens
ctcctcagttccatgggagg

SEQ ID NO: 7953455 - DNA, 20 bp, Homo sapiens
ctcctcagttccatgggagg

SEQ ID NO: 7953456 - DNA, 20 bp, Homo sapiens
ctcctcagttccatgggagg

SEQ ID NO: 7953457 - DNA, 19 bp, Homo sapiens
ctcctcagtcccagaggtc

SEQ ID NO: 7953458 - DNA, 20 bp, Homo sapiens
ctcctcagttccatgggagg

SEQ ID NO: 7953459 - DNA, 19 bp, Homo sapiens
ctcctcagtcccagaggtc

SEQ ID NO: 7953460 - DNA, 20 bp, Homo sapiens
ctcctcagttccatgggagg

SEQ ID NO: 7953461 - DNA, 19 bp, Homo sapiens
ctcctcagtcccagaggtc

SEQ ID NO: 7953462 - DNA, 19 bp, Homo sapiens
ctcctcagtcccagaggtc

SEQ ID NO: 7953463 - DNA, 19 bp, Homo sapiens
ctcctcagtcccagaggtc

SEQ ID NO: 7953464 - DNA, 22 bp, Homo sapiens
ctcctcagtcaggtctagggtc

SEQ ID NO: 7953465 - DNA, 22 bp, Homo sapiens
ctcctcagtcaggtctagggtc

SEQ ID NO: 7953466 - DNA, 22 bp, Homo sapiens
ctccccaagtcatggagccagg

SEQ ID NO: 7953467 - DNA, 22 bp, Homo sapiens
ctccccaagtcatggagccagg

SEQ ID NO: 7953468 - DNA, 22 bp, Homo sapiens
ctccccacacactaggcctgat

SEQ ID NO: 7953469 - DNA, 22 bp, Homo sapiens
ctccccaagccttggcttctcc

SEQ ID NO: 7953470 - DNA, 22 bp, Homo sapiens
ctccccaactcagccgaggctt

SEQ ID NO: 7953471 - DNA, 22 bp, Homo sapiens
ctcccatgctctctctgagaag

SEQ ID NO: 7953472 - DNA, 22 bp, Homo sapiens
ctcccagggccatcgagtcact

SEQ ID NO: 7953473 - DNA, 22 bp, Homo sapiens
ctcccagggccatcgagtcact

SEQ ID NO: 7953474 - DNA, 22 bp, Homo sapiens
ctcccagggccatcgagtcact

SEQ ID NO: 7953475 - DNA, 22 bp, Homo sapiens
ctcccataattctcatatgtca

SEQ ID NO: 7953476 - DNA, 22 bp, Homo sapiens
ctcccatagcattttaaatagt

SEQ ID NO: 7953477 - DNA, 22 bp, Homo sapiens
ctccccacgcctggactaagag

SEQ ID NO: 7953478 - DNA, 22 bp, Homo sapiens
ctccccacgcctggactaagag

SEQ ID NO: 7953479 - DNA, 22 bp, Homo sapiens
ctccccacgcctggactaagag

SEQ ID NO: 7953480 - DNA, 22 bp, Homo sapiens
ctccccacgcctggactaagag

SEQ ID NO: 7953481 - DNA, 22 bp, Homo sapiens
ctccccaccttcgcggtccctg

SEQ ID NO: 7953482 - DNA, 22 bp, Homo sapiens
ctccccaccttcgcggtccctg

SEQ ID NO: 7953483 - DNA, 22 bp, Homo sapiens
ctccccaccttcgcggtccctg

SEQ ID NO: 7953484 - DNA, 22 bp, Homo sapiens
ctccccacatttctccctgtct

SEQ ID NO: 7953485 - DNA, 22 bp, Homo sapiens
ctccccacatttctccctgtct

SEQ ID NO: 7953486 - DNA, 22 bp, Homo sapiens
ctccccacatttctccctgtct

SEQ ID NO: 7953487 - DNA, 22 bp, Homo sapiens
ctccccacatttctccctgtct

SEQ ID NO: 7953488 - DNA, 22 bp, Homo sapiens
ctccccacatttctccctgtct

SEQ ID NO: 7953489 - DNA, 22 bp, Homo sapiens
ctccccacatttctccctgtct

SEQ ID NO: 7953490 - DNA, 22 bp, Homo sapiens
ctccccacacactaggcctgat

SEQ ID NO: 7953491 - DNA, 22 bp, Homo sapiens
ctccccacacactaggcctgat

SEQ ID NO: 7953492 - DNA, 22 bp, Homo sapiens
ctcaggctgtgatgtgatggca

SEQ ID NO: 7953493 - DNA, 22 bp, Homo sapiens
ctcaggctgtgatgtgatggca

SEQ ID NO: 7953494 - DNA, 22 bp, Homo sapiens
ctcaggctggtccttagtgaca

SEQ ID NO: 7953495 - DNA, 22 bp, Homo sapiens
ctcagggaagctatggtgaggg

SEQ ID NO: 7953496 - DNA, 22 bp, Homo sapiens
ctcaggcttgggaggaggccca

SEQ ID NO: 7953497 - DNA, 22 bp, Homo sapiens
ctcaggctgtgccacctgtgtg

SEQ ID NO: 7953498 - DNA, 22 bp, Homo sapiens
ctcaggcttgggaggaggccca

SEQ ID NO: 7953499 - DNA, 22 bp, Homo sapiens
ctcaggctgtgccacctgtgtg

SEQ ID NO: 7953500 - DNA, 22 bp, Homo sapiens
ctcaggctgtgccacctgtgtg

SEQ ID NO: 7953501 - DNA, 21 bp, Homo sapiens
ctcaggctggcagcaggctag

SEQ ID NO: 7953502 - DNA, 21 bp, Homo sapiens
ctcaggctggcagcaggctag

SEQ ID NO: 7953503 - DNA, 21 bp, Homo sapiens
ctcaggctggcagcaggctag

SEQ ID NO: 7953504 - DNA, 22 bp, Homo sapiens
ctcaggctgccctgacagcccc

SEQ ID NO: 7953505 - DNA, 22 bp, Homo sapiens
ctcaggctgccctgacagcccc

SEQ ID NO: 7953506 - DNA, 21 bp, Homo sapiens
ctcaggctggcagcaggctag

SEQ ID NO: 7953507 - DNA, 21 bp, Homo sapiens
ctcaggctggcagcaggctag

SEQ ID NO: 7953508 - DNA, 22 bp, Homo sapiens
ctcaggctctggccatccaagg

SEQ ID NO: 7953509 - DNA, 22 bp, Homo sapiens
ctcaggctctggccatccaagg

SEQ ID NO: 7953510 - DNA, 22 bp, Homo sapiens
ctcaggctctgtactccctttg

SEQ ID NO: 7953511 - DNA, 22 bp, Homo sapiens
ctcaggctgccctgacagcccc

SEQ ID NO: 7953512 - DNA, 22 bp, Homo sapiens
ctcaggctgccctgacagcccc

SEQ ID NO: 7953513 - DNA, 22 bp, Homo sapiens
ctcaggctctgtactccctttg

SEQ ID NO: 7953514 - DNA, 22 bp, Homo sapiens
ttgtttcagctgtatgctatgt

SEQ ID NO: 7953515 - DNA, 22 bp, Homo sapiens
ttgtttcagctgtatgctatgt

SEQ ID NO: 7953516 - DNA, 22 bp, Homo sapiens
ctccctcacaaagcattctctt

SEQ ID NO: 7953517 - DNA, 22 bp, Homo sapiens
ttgtttcagcccagatctttac

SEQ ID NO: 7953518 - DNA, 22 bp, Homo sapiens
ttgtttcagcccagatctttac

SEQ ID NO: 7953519 - DNA, 22 bp, Homo sapiens
ttgtttcagctgtatgctatgt

SEQ ID NO: 7953520 - DNA, 22 bp, Homo sapiens
ttgtttcaaatatttcagaata

SEQ ID NO: 7953521 - DNA, 22 bp, Homo sapiens
ttgtttcaaatatttcagaata

SEQ ID NO: 7953522 - DNA, 22 bp, Homo sapiens
ttgtttcaaggaagaattagga

SEQ ID NO: 7953523 - DNA, 22 bp, Homo sapiens
ttgtttcaaggaagaattagga

SEQ ID NO: 7953524 - DNA, 22 bp, Homo sapiens
ttgtttcaaggaagaattagga

SEQ ID NO: 7953525 - DNA, 20 bp, Homo sapiens
ttgtttattatgttctgatc

SEQ ID NO: 7953526 - DNA, 22 bp, Homo sapiens
ttgtttattagcaattatcctg

SEQ ID NO: 7953527 - DNA, 22 bp, Homo sapiens
ttgtttattagcaattatcctg

SEQ ID NO: 7953528 - DNA, 20 bp, Homo sapiens
ttgtttattatgttctgatc

SEQ ID NO: 7953529 - DNA, 22 bp, Homo sapiens
ttgtttacactgcagaattggg

SEQ ID NO: 7953530 - DNA, 22 bp, Homo sapiens
ttgtttacactgcagaattggg

SEQ ID NO: 7953531 - DNA, 22 bp, Homo sapiens
ttgtttacaagttactcagtct

SEQ ID NO: 7953532 - DNA, 23 bp, Homo sapiens
ttgtttaccgtaggacttttaac

SEQ ID NO: 7953533 - DNA, 22 bp, Homo sapiens
ttgtttactaagaacctggtca

SEQ ID NO: 7953534 - DNA, 22 bp, Homo sapiens
ttgtttatcgcttgctcacata

SEQ ID NO: 7953535 - DNA, 22 bp, Homo sapiens
ttgtttatggattgtagaaact

SEQ ID NO: 7953536 - DNA, 22 bp, Homo sapiens
ttgtttattagcaattatcctg

SEQ ID NO: 7953537 - DNA, 22 bp, Homo sapiens
ttgtttattagcaattatcctg

SEQ ID NO: 7953538 - DNA, 20 bp, Homo sapiens
ttgtttattatgttctgatc

SEQ ID NO: 7953539 - DNA, 22 bp, Homo sapiens
ttgtttatgtgttgtctatggc

SEQ ID NO: 7953540 - DNA, 22 bp, Homo sapiens
ttgtttatgtgttgtctatggc

SEQ ID NO: 7953541 - DNA, 22 bp, Homo sapiens
ttgtttatgtgttgtctatggc

SEQ ID NO: 7953542 - DNA, 22 bp, Homo sapiens
ttgtttatggattgtagaaact

SEQ ID NO: 7953543 - DNA, 22 bp, Homo sapiens
ttgtttatggattgtagaaact

SEQ ID NO: 7953544 - DNA, 22 bp, Homo sapiens
ttgtttaatatcgtgaagtact

SEQ ID NO: 7953545 - DNA, 22 bp, Homo sapiens
ttgtttaatatcgtgaagtact

SEQ ID NO: 7953546 - DNA, 22 bp, Homo sapiens
ctccccaggttcaggaggtggg

SEQ ID NO: 7953547 - DNA, 22 bp, Homo sapiens
ctccccaggttcaggaggtggg

SEQ ID NO: 7953548 - DNA, 22 bp, Homo sapiens
ctccccaggttcaggaggtggg

SEQ ID NO: 7953549 - DNA, 22 bp, Homo sapiens
ttgtttaatgcctcatacatct

SEQ ID NO: 7953550 - DNA, 22 bp, Homo sapiens
ttgtttaatgcctcatacatct

SEQ ID NO: 7953551 - DNA, 22 bp, Homo sapiens
ttgtttaatgcctcatacatct

SEQ ID NO: 7953552 - DNA, 22 bp, Homo sapiens
ttgtttaatgcctcatacatct

SEQ ID NO: 7953553 - DNA, 22 bp, Homo sapiens
ctccccagctcgcgggtgacgg

SEQ ID NO: 7953554 - DNA, 22 bp, Homo sapiens
ctccccagctcgcgggtgacgg

SEQ ID NO: 7953555 - DNA, 18 bp, Homo sapiens
ctccccagctgcccccag

SEQ ID NO: 7953556 - DNA, 18 bp, Homo sapiens
ctccccagctgcccccag

SEQ ID NO: 7953557 - DNA, 18 bp, Homo sapiens
ctccccagctgcccccag

SEQ ID NO: 7953558 - DNA, 18 bp, Homo sapiens
ctccccagctgcccccag

SEQ ID NO: 7953559 - DNA, 18 bp, Homo sapiens
ctccccagctgcccccag

SEQ ID NO: 7953560 - DNA, 22 bp, Homo sapiens
ctccccagccctggtattctga

SEQ ID NO: 7953561 - DNA, 22 bp, Homo sapiens
ctccccagccctggtattctga

SEQ ID NO: 7953562 - DNA, 22 bp, Homo sapiens
ctccccagccctggtattctga

SEQ ID NO: 7953563 - DNA, 22 bp, Homo sapiens
ctccccagcattctgacttcct

SEQ ID NO: 7953564 - DNA, 22 bp, Homo sapiens
ctccccagcattctgacttcct

SEQ ID NO: 7953565 - DNA, 22 bp, Homo sapiens
ctccccagcattctgacttcct

SEQ ID NO: 7953566 - DNA, 22 bp, Homo sapiens
ctcctggttcctgtcttaaata

SEQ ID NO: 7953567 - DNA, 22 bp, Homo sapiens
ctcctgggcttcgaaggctccc

SEQ ID NO: 7953568 - DNA, 22 bp, Homo sapiens
ctcctggttcctgtcttaaata

SEQ ID NO: 7953569 - DNA, 22 bp, Homo sapiens
tttatattacctggaatagctt

SEQ ID NO: 7953570 - DNA, 22 bp, Homo sapiens
ctcctgggcttcgaaggctccc

SEQ ID NO: 7953571 - DNA, 22 bp, Homo sapiens
tttatattacctggaatagctt

SEQ ID NO: 7953572 - DNA, 22 bp, Homo sapiens
tttatattacctggaatagctt

SEQ ID NO: 7953573 - DNA, 22 bp, Homo sapiens
tttatatgtttgtacaattaag

SEQ ID NO: 7953574 - DNA, 22 bp, Homo sapiens
ctcctgtcaataggctcctggc

SEQ ID NO: 7953575 - DNA, 22 bp, Homo sapiens
ctcctgtcaataggctcctggc

SEQ ID NO: 7953576 - DNA, 22 bp, Homo sapiens
ctcctgtcaataggctcctggc

SEQ ID NO: 7953577 - DNA, 22 bp, Homo sapiens
ctcctgtatgttgggcttcaca

SEQ ID NO: 7953578 - DNA, 22 bp, Homo sapiens
ctcctggttcctgtcttaaata

SEQ ID NO: 7953579 - DNA, 22 bp, Homo sapiens
ctcctgtcaataggctcctggc

SEQ ID NO: 7953580 - DNA, 22 bp, Homo sapiens
ctcctgtcagaagcatcctgag

SEQ ID NO: 7953581 - DNA, 22 bp, Homo sapiens
ctcctgtcaataggctcctggc

SEQ ID NO: 7953582 - DNA, 22 bp, Homo sapiens
ctcctgtcagaagcatcctgag

SEQ ID NO: 7953583 - DNA, 22 bp, Homo sapiens
ctcctgtgcacctccagcggca

SEQ ID NO: 7953584 - DNA, 20 bp, Homo sapiens
ctcctgtgcctctctgggcc

SEQ ID NO: 7953585 - DNA, 20 bp, Homo sapiens
ctcctgtgcctctctgggcc

SEQ ID NO: 7953586 - DNA, 20 bp, Homo sapiens
ctcctgtgcctctctgggcc

SEQ ID NO: 7953587 - DNA, 22 bp, Homo sapiens
ctcctgtgggtcaccaataggc

SEQ ID NO: 7953588 - DNA, 22 bp, Homo sapiens
ctcctgtggctttctgatttca

SEQ ID NO: 7953589 - DNA, 22 bp, Homo sapiens
ctcctgtcccggggaccgccga

SEQ ID NO: 7953590 - DNA, 22 bp, Homo sapiens
ctcctgtgaggcttaagcccag

SEQ ID NO: 7953591 - DNA, 22 bp, Homo sapiens
ctcctgtcagaagcatcctgag

SEQ ID NO: 7953592 - DNA, 22 bp, Homo sapiens
ctcctgtgcacctccagcggca

SEQ ID NO: 7953593 - DNA, 22 bp, Homo sapiens
ctcctgtgcacctccagcggca

SEQ ID NO: 7953594 - DNA, 22 bp, Homo sapiens
ctcctgtgcatgcatctcccta

SEQ ID NO: 7953595 - DNA, 22 bp, Homo sapiens
ctcctgtgattcatttaacata

SEQ ID NO: 7953596 - DNA, 22 bp, Homo sapiens
ctcctgtggtcaagggtgggac

SEQ ID NO: 7953597 - DNA, 22 bp, Homo sapiens
ctcctgtggtcaagggtgggac

SEQ ID NO: 7953598 - DNA, 22 bp, Homo sapiens
ctcctgtggtactcccagggcc

SEQ ID NO: 7953599 - DNA, 22 bp, Homo sapiens
ctcctgtggtactcccagggcc

SEQ ID NO: 7953600 - DNA, 22 bp, Homo sapiens
ctcctgtggtactcccagggcc

SEQ ID NO: 7953601 - DNA, 22 bp, Homo sapiens
ctcctgtggtactcccagggcc

SEQ ID NO: 7953602 - DNA, 22 bp, Homo sapiens
tttcaaagtcaatatcattacc

SEQ ID NO: 7953603 - DNA, 22 bp, Homo sapiens
tttcaaataccataaacctaat

SEQ ID NO: 7953604 - DNA, 22 bp, Homo sapiens
tttcaaatagaatctttccaaa

SEQ ID NO: 7953605 - DNA, 22 bp, Homo sapiens
tttcaaatgcatgtctttcctc

SEQ ID NO: 7953606 - DNA, 22 bp, Homo sapiens
tttcaaatgcatgtctttcctc

SEQ ID NO: 7953607 - DNA, 22 bp, Homo sapiens
tttcaaatggagtcgtgaaatg

SEQ ID NO: 7953608 - DNA, 22 bp, Homo sapiens
tttcaaatgcatgtctttcctc

SEQ ID NO: 7953609 - DNA, 22 bp, Homo sapiens
tttcaaatagaatctttccaaa

SEQ ID NO: 7953610 - DNA, 22 bp, Homo sapiens
tttcaaatagaatctttccaaa

SEQ ID NO: 7953611 - DNA, 22 bp, Homo sapiens
tttcaaagtggagaattagaca

SEQ ID NO: 7953612 - DNA, 22 bp, Homo sapiens
tttcaaagtggagaattagaca

SEQ ID NO: 7953613 - DNA, 22 bp, Homo sapiens
tttcaaagtggagaattagaca

SEQ ID NO: 7953614 - DNA, 22 bp, Homo sapiens
tttcaaagtggagggatggtat

SEQ ID NO: 7953615 - DNA, 22 bp, Homo sapiens
tttcaaataccataaacctaat

SEQ ID NO: 7953616 - DNA, 22 bp, Homo sapiens
tttcaaataccataaacctaat

SEQ ID NO: 7953617 - DNA, 22 bp, Homo sapiens
tttcaaagttgggaattgtaat

SEQ ID NO: 7953618 - DNA, 22 bp, Homo sapiens
tttcaaagttgggaattgtaat

SEQ ID NO: 7953619 - DNA, 22 bp, Homo sapiens
ctctaacactgtaatgctttct

SEQ ID NO: 7953620 - DNA, 22 bp, Homo sapiens
ctctacagctgctgcccctggt

SEQ ID NO: 7953621 - DNA, 21 bp, Homo sapiens
ctctacattcccagcaactct

SEQ ID NO: 7953622 - DNA, 22 bp, Homo sapiens
ctctaattaatatttattaggt

SEQ ID NO: 7953623 - DNA, 22 bp, Homo sapiens
ctctaatactgaccaagtcacc

SEQ ID NO: 7953624 - DNA, 22 bp, Homo sapiens
ctctaaatccaaataagtgtcc

SEQ ID NO: 7953625 - DNA, 22 bp, Homo sapiens
ctctaaaggcttgttattgcat

SEQ ID NO: 7953626 - DNA, 22 bp, Homo sapiens
ctcgttgctgaagccaaagtca

SEQ ID NO: 7953627 - DNA, 22 bp, Homo sapiens
ctctaaatccacggtatagttg

SEQ ID NO: 7953628 - DNA, 22 bp, Homo sapiens
ctctaaatccaaataagtgtcc

SEQ ID NO: 7953629 - DNA, 22 bp, Homo sapiens
ctcgtttgcacacaaggctttt

SEQ ID NO: 7953630 - DNA, 22 bp, Homo sapiens
ctctaaatgtggtctgcagata

SEQ ID NO: 7953631 - DNA, 22 bp, Homo sapiens
ctccttctcctcgggaggccag

SEQ ID NO: 7953632 - DNA, 22 bp, Homo sapiens
ctccttctcctcgggaggccag

SEQ ID NO: 7953633 - DNA, 22 bp, Homo sapiens
ctcggggatccatccacgtggc

SEQ ID NO: 7953634 - DNA, 18 bp, Homo sapiens
ctcggggacaagggcggc

SEQ ID NO: 7953635 - DNA, 22 bp, Homo sapiens
ctccttcctggttagcacctta

SEQ ID NO: 7953636 - DNA, 22 bp, Homo sapiens
ctccttcctggttagcacctta

SEQ ID NO: 7953637 - DNA, 22 bp, Homo sapiens
ctccttcctggttagcacctta

SEQ ID NO: 7953638 - DNA, 22 bp, Homo sapiens
tttcaaatggagtcgtgaaatg

SEQ ID NO: 7953639 - DNA, 22 bp, Homo sapiens
ctccttcctggttagcacctta

SEQ ID NO: 7953640 - DNA, 22 bp, Homo sapiens
ctccttcctggttagcacctta

SEQ ID NO: 7953641 - DNA, 22 bp, Homo sapiens
ctccttcctggttagcacctta

SEQ ID NO: 7953642 - DNA, 22 bp, Homo sapiens
ctcgttgctgaagccaaagtca

SEQ ID NO: 7953643 - DNA, 22 bp, Homo sapiens
ctctaaaggcttgttattgcat

SEQ ID NO: 7953644 - DNA, 22 bp, Homo sapiens
ctcgttaagttctgcatatctg

SEQ ID NO: 7953645 - DNA, 22 bp, Homo sapiens
ctcgtgccaggacgcgcagttt

SEQ ID NO: 7953646 - DNA, 22 bp, Homo sapiens
ctcgtgatccgcccacctcagc

SEQ ID NO: 7953647 - DNA, 22 bp, Homo sapiens
ctcctgctgaatggccaggagc

SEQ ID NO: 7953648 - DNA, 22 bp, Homo sapiens
ctcctgctgaatggccaggagc

SEQ ID NO: 7953649 - DNA, 22 bp, Homo sapiens
ctcctgctgaatggccaggagc

SEQ ID NO: 7953650 - DNA, 22 bp, Homo sapiens
ctcctgctcctgcttgcaagga

SEQ ID NO: 7953651 - DNA, 22 bp, Homo sapiens
ctcctgagctgcagccttgtgt

SEQ ID NO: 7953652 - DNA, 22 bp, Homo sapiens
ctcctgagctgcagccttgtgt

SEQ ID NO: 7953653 - DNA, 22 bp, Homo sapiens
tttacacatacctctttaaagt

SEQ ID NO: 7953654 - DNA, 22 bp, Homo sapiens
ctcctgagctgcagccttgtgt

SEQ ID NO: 7953655 - DNA, 22 bp, Homo sapiens
ctcctgcggtactactgtgctt

SEQ ID NO: 7953656 - DNA, 22 bp, Homo sapiens
tttacacaaaagatagcacacc

SEQ ID NO: 7953657 - DNA, 22 bp, Homo sapiens
tttacacataaatgtgtagaca

SEQ ID NO: 7953658 - DNA, 22 bp, Homo sapiens
tttacacagaggacactgggct

SEQ ID NO: 7953659 - DNA, 22 bp, Homo sapiens
tttacacataaatgtgtagaca

SEQ ID NO: 7953660 - DNA, 22 bp, Homo sapiens
tttacaattggttttctctaat

SEQ ID NO: 7953661 - DNA, 22 bp, Homo sapiens
tttacaattggttttctctaat

SEQ ID NO: 7953662 - DNA, 22 bp, Homo sapiens
tttacaattggttttctctaat

SEQ ID NO: 7953663 - DNA, 22 bp, Homo sapiens
tttacaattctctaccagtgtt

SEQ ID NO: 7953664 - DNA, 22 bp, Homo sapiens
tttacaattggttttctctaat

SEQ ID NO: 7953665 - DNA, 22 bp, Homo sapiens
tttacaattggttttctctaat

SEQ ID NO: 7953666 - DNA, 22 bp, Homo sapiens
tttacacaaaagatagcacacc

SEQ ID NO: 7953667 - DNA, 22 bp, Homo sapiens
tttacacaaaagatagcacacc

SEQ ID NO: 7953668 - DNA, 22 bp, Homo sapiens
tttacacaaaagatagcacacc

SEQ ID NO: 7953669 - DNA, 22 bp, Homo sapiens
tttacacaaaagatagcacacc

SEQ ID NO: 7953670 - DNA, 22 bp, Homo sapiens
ctcctcagttgtcccatggaga

SEQ ID NO: 7953671 - DNA, 22 bp, Homo sapiens
ctcctcagttgtcccatggaga

SEQ ID NO: 7953672 - DNA, 20 bp, Homo sapiens
ctcctcagttccatgggagg

SEQ ID NO: 7953673 - DNA, 22 bp, Homo sapiens
ctcctcagttgtcccatggaga

SEQ ID NO: 7953674 - DNA, 20 bp, Homo sapiens
ctcctcagttccatgggagg

SEQ ID NO: 7953675 - DNA, 20 bp, Homo sapiens
ctcctcagttccatgggagg

SEQ ID NO: 7953676 - DNA, 22 bp, Homo sapiens
ctcctcagttgtcccatggaga

SEQ ID NO: 7953677 - DNA, 22 bp, Homo sapiens
tttacaagtttacagaatgatg

SEQ ID NO: 7953678 - DNA, 22 bp, Homo sapiens
tttacaatagggtctgaatgaa

SEQ ID NO: 7953679 - DNA, 22 bp, Homo sapiens
tttacaatagggtctgaatgaa

SEQ ID NO: 7953680 - DNA, 22 bp, Homo sapiens
tttacaatagggtctgaatgaa

SEQ ID NO: 7953681 - DNA, 22 bp, Homo sapiens
tttacaattctctaccagtgtt

SEQ ID NO: 7953682 - DNA, 22 bp, Homo sapiens
tttacaattctctaccagtgtt

SEQ ID NO: 7953683 - DNA, 22 bp, Homo sapiens
tttacaattctctaccagtgtt

SEQ ID NO: 7953684 - DNA, 22 bp, Homo sapiens
ctcctggatcttagccagattc

SEQ ID NO: 7953685 - DNA, 22 bp, Homo sapiens
ctcctggatcttagccagattc

SEQ ID NO: 7953686 - DNA, 22 bp, Homo sapiens
ctcctggatgcaggctgtctgc

SEQ ID NO: 7953687 - DNA, 23 bp, Homo sapiens
ctcctggagggtccggccctgcc

SEQ ID NO: 7953688 - DNA, 22 bp, Homo sapiens
ctcctggaggctccaagggaga

SEQ ID NO: 7953689 - DNA, 22 bp, Homo sapiens
ctcctggaggatagtgactggg

SEQ ID NO: 7953690 - DNA, 22 bp, Homo sapiens
ctcctggaggatagtgactggg

SEQ ID NO: 7953691 - DNA, 23 bp, Homo sapiens
ctcctggagggtccggccctgcc

SEQ ID NO: 7953692 - DNA, 22 bp, Homo sapiens
ctcctggaggctccaagggaga

SEQ ID NO: 7953693 - DNA, 22 bp, Homo sapiens
ctcctggaccaccttgtggcca

SEQ ID NO: 7953694 - DNA, 22 bp, Homo sapiens
ctcctggacatggagcggagga

SEQ ID NO: 7953695 - DNA, 22 bp, Homo sapiens
ctcctggacatggagcggagga

SEQ ID NO: 7953696 - DNA, 22 bp, Homo sapiens
ctcctggacatggagcggagga

SEQ ID NO: 7953697 - DNA, 22 bp, Homo sapiens
ctcctggacatggagcggagga

SEQ ID NO: 7953698 - DNA, 22 bp, Homo sapiens
ctcctggagcagcaggcgcagg

SEQ ID NO: 7953699 - DNA, 22 bp, Homo sapiens
ctcctggagcagcaggcgcagg

SEQ ID NO: 7953700 - DNA, 22 bp, Homo sapiens
ctcctggaggatagtgactggg

SEQ ID NO: 7953701 - DNA, 22 bp, Homo sapiens
tttatatatggctggtctggat

SEQ ID NO: 7953702 - DNA, 22 bp, Homo sapiens
tttatatctggagttgctagga

SEQ ID NO: 7953703 - DNA, 22 bp, Homo sapiens
tttatatcttatgtcatttcaa

SEQ ID NO: 7953704 - DNA, 22 bp, Homo sapiens
tttatatctggagttgctagga

SEQ ID NO: 7953705 - DNA, 18 bp, Homo sapiens
tttatatggatagagacc

SEQ ID NO: 7953706 - DNA, 18 bp, Homo sapiens
tttatatggatagagacc

SEQ ID NO: 7953707 - DNA, 18 bp, Homo sapiens
tttatatggatagagacc

SEQ ID NO: 7953708 - DNA, 18 bp, Homo sapiens
tttatatggatagagacc

SEQ ID NO: 7953709 - DNA, 18 bp, Homo sapiens
tttatatggatagagacc

SEQ ID NO: 7953710 - DNA, 22 bp, Homo sapiens
tttatatgaaagtgaccagtgg

SEQ ID NO: 7953711 - DNA, 22 bp, Homo sapiens
tttatatgaaagtgaccagtgg

SEQ ID NO: 7953712 - DNA, 22 bp, Homo sapiens
tttatatgtattgactttgatg

SEQ ID NO: 7953713 - DNA, 22 bp, Homo sapiens
tttatatgtattgactttgatg

SEQ ID NO: 7953714 - DNA, 22 bp, Homo sapiens
tttatatggttgactatgagtt

SEQ ID NO: 7953715 - DNA, 22 bp, Homo sapiens
tttatatgtttgtacaattaag

SEQ ID NO: 7953716 - DNA, 22 bp, Homo sapiens
tttatatgtttgtacaattaag

SEQ ID NO: 7953717 - DNA, 22 bp, Homo sapiens
tttatatgtttgtacaattaag

SEQ ID NO: 7953718 - DNA, 22 bp, Homo sapiens
tttatatgtttgtacaattaag

SEQ ID NO: 7953719 - DNA, 22 bp, Homo sapiens
tttatatgtttgtacaattaag

SEQ ID NO: 7953720 - DNA, 22 bp, Homo sapiens
tttatatgtttgtacaattaag

SEQ ID NO: 7953721 - DNA, 22 bp, Homo sapiens
ctctgctgtgccgccagggcct

SEQ ID NO: 7953722 - DNA, 22 bp, Homo sapiens
ctctgcttctgagatggaagct

SEQ ID NO: 7953723 - DNA, 22 bp, Homo sapiens
ctctgcttctgagatggaagct

SEQ ID NO: 7953724 - DNA, 22 bp, Homo sapiens
ctctgcttctgagatggaagct

SEQ ID NO: 7953725 - DNA, 22 bp, Homo sapiens
ctctgcttggaactggacagaa

SEQ ID NO: 7953726 - DNA, 19 bp, Homo sapiens
ctctgcttggtccatatgc

SEQ ID NO: 7953727 - DNA, 19 bp, Homo sapiens
ctctgcttggtccatatgc

SEQ ID NO: 7953728 - DNA, 22 bp, Homo sapiens
ctctgcttgtatcacatttgct

SEQ ID NO: 7953729 - DNA, 22 bp, Homo sapiens
ctctgctgtctccagggcagtc

SEQ ID NO: 7953730 - DNA, 22 bp, Homo sapiens
ctctgctgtgccgccagggcct

SEQ ID NO: 7953731 - DNA, 22 bp, Homo sapiens
ctctgctgtgccgccagggcct

SEQ ID NO: 7953732 - DNA, 22 bp, Homo sapiens
ctctgctgtctccagggcagtc

SEQ ID NO: 7953733 - DNA, 22 bp, Homo sapiens
ctctgctgtgccgccagggcct

SEQ ID NO: 7953734 - DNA, 22 bp, Homo sapiens
ctctgctgtgccgccagggcct

SEQ ID NO: 7953735 - DNA, 22 bp, Homo sapiens
ctctgctgtctcagatgggcca

SEQ ID NO: 7953736 - DNA, 22 bp, Homo sapiens
ctctgctggtagctcattccat

SEQ ID NO: 7953737 - DNA, 22 bp, Homo sapiens
ctctgctggtgaccactgggcc

SEQ ID NO: 7953738 - DNA, 22 bp, Homo sapiens
ctctgctggtgaccactgggcc

SEQ ID NO: 7953739 - DNA, 21 bp, Homo sapiens
ctctgctgtctaccagctgtt

SEQ ID NO: 7953740 - DNA, 21 bp, Homo sapiens
ctctgctgtctaccagctgtt

SEQ ID NO: 7953741 - DNA, 21 bp, Homo sapiens
ctctgctgtctaccagctgtt

SEQ ID NO: 7953742 - DNA, 21 bp, Homo sapiens
ctctgctgtctaccagctgtt

SEQ ID NO: 7953743 - DNA, 19 bp, Homo sapiens
ctctgcctctggctgtggc

SEQ ID NO: 7953744 - DNA, 22 bp, Homo sapiens
ctctgctgcccaggcctgctag

SEQ ID NO: 7953745 - DNA, 19 bp, Homo sapiens
ctctgcctctggctgtggc

SEQ ID NO: 7953746 - DNA, 19 bp, Homo sapiens
ctctgcctctggctgtggc

SEQ ID NO: 7953747 - DNA, 19 bp, Homo sapiens
ctctgcctctggctgtggc

SEQ ID NO: 7953748 - DNA, 19 bp, Homo sapiens
ctctgcctctggctgtggc

SEQ ID NO: 7953749 - DNA, 22 bp, Homo sapiens
tttcttgactgcttaggaatgc

SEQ ID NO: 7953750 - DNA, 22 bp, Homo sapiens
tttcttgactgcttaggaatgc

SEQ ID NO: 7953751 - DNA, 22 bp, Homo sapiens
tttcttgagcccaggaggtgga

SEQ ID NO: 7953752 - DNA, 22 bp, Homo sapiens
tttcttgactgcttaggaatgc

SEQ ID NO: 7953753 - DNA, 22 bp, Homo sapiens
tttcttgactgcttaggaatgc

SEQ ID NO: 7953754 - DNA, 20 bp, Homo sapiens
ctctgctgcccgccggctgc

SEQ ID NO: 7953755 - DNA, 20 bp, Homo sapiens
ctctgctgcgcatcccactt

SEQ ID NO: 7953756 - DNA, 20 bp, Homo sapiens
ctctgctgcgcatcccactt

SEQ ID NO: 7953757 - DNA, 22 bp, Homo sapiens
ctctgctgcttgccagtcattg

SEQ ID NO: 7953758 - DNA, 20 bp, Homo sapiens
ctctgctgcgcatcccactt

SEQ ID NO: 7953759 - DNA, 22 bp, Homo sapiens
ctctgctgcttgccagtcattg

SEQ ID NO: 7953760 - DNA, 22 bp, Homo sapiens
ctctgctgctttgccagtggaa

SEQ ID NO: 7953761 - DNA, 22 bp, Homo sapiens
ctctgctgctttgccagtggaa

SEQ ID NO: 7953762 - DNA, 22 bp, Homo sapiens
ctctgctgctttgccagtggaa

SEQ ID NO: 7953763 - DNA, 22 bp, Homo sapiens
ctctgctgctttgccagtggaa

SEQ ID NO: 7953764 - DNA, 22 bp, Homo sapiens
tttcttctgtttgtagttacac

SEQ ID NO: 7953765 - DNA, 22 bp, Homo sapiens
tttcttcttaatactggctgct

SEQ ID NO: 7953766 - DNA, 22 bp, Homo sapiens
tttcttctgtttgtagttacac

SEQ ID NO: 7953767 - DNA, 22 bp, Homo sapiens
tttcttcttaatactggctgct

SEQ ID NO: 7953768 - DNA, 22 bp, Homo sapiens
tttcttcttgagtaaccagatt

SEQ ID NO: 7953769 - DNA, 22 bp, Homo sapiens
tttcttcttgagtaaccagatt

SEQ ID NO: 7953770 - DNA, 22 bp, Homo sapiens
tttcttcttgagtaaccagatt

SEQ ID NO: 7953771 - DNA, 22 bp, Homo sapiens
tttcttcttgagtaaccagatt

SEQ ID NO: 7953772 - DNA, 22 bp, Homo sapiens
tttcttcttgagtaaccagatt

SEQ ID NO: 7953773 - DNA, 22 bp, Homo sapiens
tttcttcttgagtaaccagatt

SEQ ID NO: 7953774 - DNA, 22 bp, Homo sapiens
tttcttcttgatttaaacaggg

SEQ ID NO: 7953775 - DNA, 22 bp, Homo sapiens
tttcttcttgatttaaacaggg

SEQ ID NO: 7953776 - DNA, 22 bp, Homo sapiens
tttcttcttgatttaaacaggg

SEQ ID NO: 7953777 - DNA, 22 bp, Homo sapiens
tttcttcttgatttaaacaggg

SEQ ID NO: 7953778 - DNA, 22 bp, Homo sapiens
tttcttcttgatttaaacaggg

SEQ ID NO: 7953779 - DNA, 22 bp, Homo sapiens
tttcttcttgatttaaacaggg

SEQ ID NO: 7953780 - DNA, 22 bp, Homo sapiens
tttcttcttgatttaaacaggg

SEQ ID NO: 7953781 - DNA, 22 bp, Homo sapiens
tttcttcttgatttaaacaggg

SEQ ID NO: 7953782 - DNA, 22 bp, Homo sapiens
tttcttcttgatttaaacaggg

SEQ ID NO: 7953783 - DNA, 22 bp, Homo sapiens
tttcttctttcccagtgatggg

SEQ ID NO: 7953784 - DNA, 22 bp, Homo sapiens
tttcttctttcccagtgatggg

SEQ ID NO: 7953785 - DNA, 22 bp, Homo sapiens
tttcttctttcccagtgatggg

SEQ ID NO: 7953786 - DNA, 22 bp, Homo sapiens
tttcttgaagtcctaaccctca

SEQ ID NO: 7953787 - DNA, 22 bp, Homo sapiens
tttcttgaatatgggttaaact

SEQ ID NO: 7953788 - DNA, 22 bp, Homo sapiens
tttcttgaccactatgttgata

SEQ ID NO: 7953789 - DNA, 22 bp, Homo sapiens
tttcttgaccactatgttgata

SEQ ID NO: 7953790 - DNA, 22 bp, Homo sapiens
tttcttgaccactatgttgata

SEQ ID NO: 7953791 - DNA, 22 bp, Homo sapiens
tttcttaggctctaaaatgact

SEQ ID NO: 7953792 - DNA, 21 bp, Homo sapiens
tttcttaggctctaaaatgac

SEQ ID NO: 7953793 - DNA, 21 bp, Homo sapiens
tttcttaggctctaaaatgac

SEQ ID NO: 7953794 - DNA, 21 bp, Homo sapiens
tttcttaggctctaaaatgac

SEQ ID NO: 7953795 - DNA, 22 bp, Homo sapiens
tttcttaatttgagttccacta

SEQ ID NO: 7953796 - DNA, 19 bp, Homo sapiens
tttcttaggcctttggcct

SEQ ID NO: 7953797 - DNA, 22 bp, Homo sapiens
tttcttaatttgagttccacta

SEQ ID NO: 7953798 - DNA, 22 bp, Homo sapiens
tttcttaaatatttgcaggaca

SEQ ID NO: 7953799 - DNA, 22 bp, Homo sapiens
tttcttatactatattgtcatc

SEQ ID NO: 7953800 - DNA, 22 bp, Homo sapiens
tttcttatactatattgtcatc

SEQ ID NO: 7953801 - DNA, 22 bp, Homo sapiens
tttcttatactatattgtcatc

SEQ ID NO: 7953802 - DNA, 22 bp, Homo sapiens
tttcttatactatattgtcatc

SEQ ID NO: 7953803 - DNA, 22 bp, Homo sapiens
tttcttatactatattgtcatc

SEQ ID NO: 7953804 - DNA, 22 bp, Homo sapiens
tttcttagtcctagagtgattt

SEQ ID NO: 7953805 - DNA, 22 bp, Homo sapiens
tttcttatattctgtcattgtt

SEQ ID NO: 7953806 - DNA, 22 bp, Homo sapiens
tttcttatattctgtcattgtt

SEQ ID NO: 7953807 - DNA, 22 bp, Homo sapiens
tttcttatactatattgtcatc

SEQ ID NO: 7953808 - DNA, 22 bp, Homo sapiens
tttcttatattctgtcattgtt

SEQ ID NO: 7953809 - DNA, 22 bp, Homo sapiens
tttcttctgtttgtagttacac

SEQ ID NO: 7953810 - DNA, 22 bp, Homo sapiens
tttcttctgtttgtagttacac

SEQ ID NO: 7953811 - DNA, 22 bp, Homo sapiens
tttcttctgtttgtagttacac

SEQ ID NO: 7953812 - DNA, 22 bp, Homo sapiens
tttcttctgtttgtagttacac

SEQ ID NO: 7953813 - DNA, 22 bp, Homo sapiens
tttgaagtgttatttctatcac

SEQ ID NO: 7953814 - DNA, 23 bp, Homo sapiens
tttgaagttgactgccttccaga

SEQ ID NO: 7953815 - DNA, 22 bp, Homo sapiens
tttgaagttcccccatatcaga

SEQ ID NO: 7953816 - DNA, 22 bp, Homo sapiens
tttgaataaacggttaatgttc

SEQ ID NO: 7953817 - DNA, 22 bp, Homo sapiens
tttgaataaacggttaatgttc

SEQ ID NO: 7953818 - DNA, 22 bp, Homo sapiens
ctctggaattgacctgggaggg

SEQ ID NO: 7953819 - DNA, 22 bp, Homo sapiens
ctctggaattgacctgggaggg

SEQ ID NO: 7953820 - DNA, 22 bp, Homo sapiens
ctctggaattgacctgggaggg

SEQ ID NO: 7953821 - DNA, 22 bp, Homo sapiens
ctctggaattgacctgggaggg

SEQ ID NO: 7953822 - DNA, 22 bp, Homo sapiens
ctctggaattgacctgggaggg

SEQ ID NO: 7953823 - DNA, 19 bp, Homo sapiens
ctctggagcagacactgga

SEQ ID NO: 7953824 - DNA, 19 bp, Homo sapiens
ctctggagcagacactgga

SEQ ID NO: 7953825 - DNA, 22 bp, Homo sapiens
ctctggagcgctgcttcccgcg

SEQ ID NO: 7953826 - DNA, 22 bp, Homo sapiens
ctctggagcatttcacctacat

SEQ ID NO: 7953827 - DNA, 22 bp, Homo sapiens
ctctggagcatttcacctacat

SEQ ID NO: 7953828 - DNA, 22 bp, Homo sapiens
ctctggagcatttcacctacat

SEQ ID NO: 7953829 - DNA, 22 bp, Homo sapiens
ctctggagcatttcacctacat

SEQ ID NO: 7953830 - DNA, 22 bp, Homo sapiens
tttgaagggcacgacaatagtt

SEQ ID NO: 7953831 - DNA, 22 bp, Homo sapiens
ctctgcttgtgtcaggcatgct

SEQ ID NO: 7953832 - DNA, 22 bp, Homo sapiens
ctctgcttgtgtcaggcatgct

SEQ ID NO: 7953833 - DNA, 18 bp, Homo sapiens
tttgaaggatggcctgga

SEQ ID NO: 7953834 - DNA, 22 bp, Homo sapiens
tttgaagggcacgacaatagtt

SEQ ID NO: 7953835 - DNA, 22 bp, Homo sapiens
tttgaagggcacgacaatagtt

SEQ ID NO: 7953836 - DNA, 22 bp, Homo sapiens
tttgaagtcaaagattgattcc

SEQ ID NO: 7953837 - DNA, 22 bp, Homo sapiens
tttgaagtcaggctttctaccc

SEQ ID NO: 7953838 - DNA, 22 bp, Homo sapiens
tttgaagtcagacactgctttg

SEQ ID NO: 7953839 - DNA, 22 bp, Homo sapiens
tttgaagtggaaaaggatttaa

SEQ ID NO: 7953840 - DNA, 22 bp, Homo sapiens
tttgaagtgggcattagaacct

SEQ ID NO: 7953841 - DNA, 22 bp, Homo sapiens
tttgaagtgtatgaaaatacag

SEQ ID NO: 7953842 - DNA, 22 bp, Homo sapiens
tttgaagtgggcattagaacct

SEQ ID NO: 7953843 - DNA, 22 bp, Homo sapiens
ctctggagggaggctgagctgg

SEQ ID NO: 7953844 - DNA, 22 bp, Homo sapiens
ctctggagggaggctgagctgg

SEQ ID NO: 7953845 - DNA, 22 bp, Homo sapiens
ctctggagggaggctgagctgg

SEQ ID NO: 7953846 - DNA, 22 bp, Homo sapiens
ctctggagggaggctgagctgg

SEQ ID NO: 7953847 - DNA, 22 bp, Homo sapiens
ctctggagggaggctgagctgg

SEQ ID NO: 7953848 - DNA, 22 bp, Homo sapiens
ctctggagggaggctgagctgg

SEQ ID NO: 7953849 - DNA, 22 bp, Homo sapiens
ctctggagggaggctgagctgg

SEQ ID NO: 7953850 - DNA, 22 bp, Homo sapiens
ctctggagggaggctgagctgg

SEQ ID NO: 7953851 - DNA, 22 bp, Homo sapiens
ctctggagggaggctgagctgg

SEQ ID NO: 7953852 - DNA, 22 bp, Homo sapiens
ctctggaggcctaaggaagtgg

SEQ ID NO: 7953853 - DNA, 22 bp, Homo sapiens
ctctggaggcctaaggaagtgg

SEQ ID NO: 7953854 - DNA, 22 bp, Homo sapiens
ctctggaggcctaaggaagtgg

SEQ ID NO: 7953855 - DNA, 19 bp, Homo sapiens
ctctggagggaccgccgtt

SEQ ID NO: 7953856 - DNA, 22 bp, Homo sapiens
ctctggaggcctaaggaagtgg

SEQ ID NO: 7953857 - DNA, 22 bp, Homo sapiens
ctctggaggccgttggccctta

SEQ ID NO: 7953858 - DNA, 22 bp, Homo sapiens
ctctggaggcagcaccagccag

SEQ ID NO: 7953859 - DNA, 22 bp, Homo sapiens
ctctggaggccgttggccctta

SEQ ID NO: 7953860 - DNA, 22 bp, Homo sapiens
ctctggaggccgttggccctta

SEQ ID NO: 7953861 - DNA, 22 bp, Homo sapiens
ctctggaggccgttggccctta

SEQ ID NO: 7953862 - DNA, 22 bp, Homo sapiens
ctctggaggcagcaccagccag

SEQ ID NO: 7953863 - DNA, 21 bp, Homo sapiens
ctctggaggcaagggagagtg

SEQ ID NO: 7953864 - DNA, 21 bp, Homo sapiens
ctctggaggcaagggagagtg

SEQ ID NO: 7953865 - DNA, 21 bp, Homo sapiens
ctctggaggcaagggagagtg

SEQ ID NO: 7953866 - DNA, 22 bp, Homo sapiens
ctctggaggtggaggttgcagt

SEQ ID NO: 7953867 - DNA, 22 bp, Homo sapiens
ctctggaggtggaggttgcagt

SEQ ID NO: 7953868 - DNA, 22 bp, Homo sapiens
ctctggaggtggaggttgcagt

SEQ ID NO: 7953869 - DNA, 22 bp, Homo sapiens
ctctggaggtggaggttgcagt

SEQ ID NO: 7953870 - DNA, 22 bp, Homo sapiens
ctctggaggtcaggtgtggtgg

SEQ ID NO: 7953871 - DNA, 22 bp, Homo sapiens
ctctggaggtcaggtgtggtgg

SEQ ID NO: 7953872 - DNA, 22 bp, Homo sapiens
ctctggaggtcaggtgtggtgg

SEQ ID NO: 7953873 - DNA, 22 bp, Homo sapiens
ctctggaggtcaggtgtggtgg

SEQ ID NO: 7953874 - DNA, 22 bp, Homo sapiens
ctctggaggttgagcccagcaa

SEQ ID NO: 7953875 - DNA, 22 bp, Homo sapiens
ctctggaggttgagcccagcaa

SEQ ID NO: 7953876 - DNA, 22 bp, Homo sapiens
ctctggagtaagagctatgaaa

SEQ ID NO: 7953877 - DNA, 22 bp, Homo sapiens
ctctggagtaagagctatgaaa

SEQ ID NO: 7953878 - DNA, 22 bp, Homo sapiens
ctctggagtaagagctatgaaa

SEQ ID NO: 7953879 - DNA, 22 bp, Homo sapiens
ctctggagtaagagctatgaaa

SEQ ID NO: 7953880 - DNA, 21 bp, Homo sapiens
ctctggagtcaagagcttcca

SEQ ID NO: 7953881 - DNA, 21 bp, Homo sapiens
ctctggagtcaagagcttcca

SEQ ID NO: 7953882 - DNA, 22 bp, Homo sapiens
ctctggagtcaggcagccctgg

SEQ ID NO: 7953883 - DNA, 22 bp, Homo sapiens
ctctggagtcaggcagccctgg

SEQ ID NO: 7953884 - DNA, 21 bp, Homo sapiens
ctctggagtcaagagcttcca

SEQ ID NO: 7953885 - DNA, 22 bp, Homo sapiens
ctctggagtcaggcagccctgg

SEQ ID NO: 7953886 - DNA, 22 bp, Homo sapiens
ctctggagtcaggcagccctgg

SEQ ID NO: 7953887 - DNA, 22 bp, Homo sapiens
ctctggagtcaggcagccctgg

SEQ ID NO: 7953888 - DNA, 19 bp, Homo sapiens
ctctggagtcattgctccc

SEQ ID NO: 7953889 - DNA, 19 bp, Homo sapiens
ctctggagtcattgctccc

SEQ ID NO: 7953890 - DNA, 19 bp, Homo sapiens
ctctggagtcattgctccc

SEQ ID NO: 7953891 - DNA, 22 bp, Homo sapiens
ctctatttatggcatctttatg

SEQ ID NO: 7953892 - DNA, 22 bp, Homo sapiens
ctctcaaagaaattgcctgtca

SEQ ID NO: 7953893 - DNA, 22 bp, Homo sapiens
ctctatttatggcatctttatg

SEQ ID NO: 7953894 - DNA, 22 bp, Homo sapiens
ctctagggtgcaggccccagga

SEQ ID NO: 7953895 - DNA, 22 bp, Homo sapiens
ctctagggctctgtgaggttgg

SEQ ID NO: 7953896 - DNA, 22 bp, Homo sapiens
ctctaggggctggtcagcgtct

SEQ ID NO: 7953897 - DNA, 22 bp, Homo sapiens
ctctagggaagaatgagagccc

SEQ ID NO: 7953898 - DNA, 22 bp, Homo sapiens
ctctagggtgcaggccccagga

SEQ ID NO: 7953899 - DNA, 22 bp, Homo sapiens
ctctagtagctgagattacagg

SEQ ID NO: 7953900 - DNA, 19 bp, Homo sapiens
ctctagggtctaagggcag

SEQ ID NO: 7953901 - DNA, 22 bp, Homo sapiens
ctctagtgtagtgcaggaagga

SEQ ID NO: 7953902 - DNA, 22 bp, Homo sapiens
ctctcaaatgtaatttgaggtt

SEQ ID NO: 7953903 - DNA, 22 bp, Homo sapiens
ctctcaaatgtcattcctctat

SEQ ID NO: 7953904 - DNA, 22 bp, Homo sapiens
ctctcaaagtaaggtgtataca

SEQ ID NO: 7953905 - DNA, 22 bp, Homo sapiens
ctctcaaatgtcattcctctat

SEQ ID NO: 7953906 - DNA, 22 bp, Homo sapiens
ctctcaaatgtcattcctctat

SEQ ID NO: 7953907 - DNA, 21 bp, Homo sapiens
tttctcaccatggtatggaaa

SEQ ID NO: 7953908 - DNA, 22 bp, Homo sapiens
tttctcacccaagagttatttt

SEQ ID NO: 7953909 - DNA, 20 bp, Homo sapiens
ctctcacagctccctcagcc

SEQ ID NO: 7953910 - DNA, 22 bp, Homo sapiens
ctctcaaagtaaggtgtataca

SEQ ID NO: 7953911 - DNA, 22 bp, Homo sapiens
tttctctcagcctgtagaaact

SEQ ID NO: 7953912 - DNA, 22 bp, Homo sapiens
tttctctattaggggctagctt

SEQ ID NO: 7953913 - DNA, 22 bp, Homo sapiens
tttctctattaggggctagctt

SEQ ID NO: 7953914 - DNA, 18 bp, Homo sapiens
tttctcagactctctttc

SEQ ID NO: 7953915 - DNA, 18 bp, Homo sapiens
tttctcagactctctttc

SEQ ID NO: 7953916 - DNA, 20 bp, Homo sapiens
tttctcagaacagtggctgc

SEQ ID NO: 7953917 - DNA, 20 bp, Homo sapiens
tttctcagaacagtggctgc

SEQ ID NO: 7953918 - DNA, 22 bp, Homo sapiens
tttctcacccaagagttatttt

SEQ ID NO: 7953919 - DNA, 20 bp, Homo sapiens
tttctcagaacagtggctgc

SEQ ID NO: 7953920 - DNA, 22 bp, Homo sapiens
tttctcagaatataaaattctc

SEQ ID NO: 7953921 - DNA, 22 bp, Homo sapiens
ctctagggaagaatgagagccc

SEQ ID NO: 7953922 - DNA, 22 bp, Homo sapiens
ctctaggctgcccaggagctga

SEQ ID NO: 7953923 - DNA, 22 bp, Homo sapiens
ctctaggctgcccaggagctga

SEQ ID NO: 7953924 - DNA, 22 bp, Homo sapiens
ctctaggctgcccaggagctga

SEQ ID NO: 7953925 - DNA, 22 bp, Homo sapiens
ctctaggccatccagggccatt

SEQ ID NO: 7953926 - DNA, 22 bp, Homo sapiens
ctctaggccatccagggccatt

SEQ ID NO: 7953927 - DNA, 22 bp, Homo sapiens
ctctagctgaggtcactgctat

SEQ ID NO: 7953928 - DNA, 22 bp, Homo sapiens
ctctagcttttgataccagtgt

SEQ ID NO: 7953929 - DNA, 22 bp, Homo sapiens
ctctagagtacgggctggcatg

SEQ ID NO: 7953930 - DNA, 22 bp, Homo sapiens
ctctagacaacttgctgtgggt

SEQ ID NO: 7953931 - DNA, 22 bp, Homo sapiens
ctctagaggcttgaatgggcga

SEQ ID NO: 7953932 - DNA, 22 bp, Homo sapiens
ctctagaggcttgaatgggcga

SEQ ID NO: 7953933 - DNA, 22 bp, Homo sapiens
ctctagcagcagcccttcctta

SEQ ID NO: 7953934 - DNA, 22 bp, Homo sapiens
ctctagctgaggtcactgctat

SEQ ID NO: 7953935 - DNA, 22 bp, Homo sapiens
ctctactccaaaaggctacaat

SEQ ID NO: 7953936 - DNA, 22 bp, Homo sapiens
ctctactcttaacacagctagg

SEQ ID NO: 7953937 - DNA, 22 bp, Homo sapiens
ctctactcttaacacagctagg

SEQ ID NO: 7953938 - DNA, 22 bp, Homo sapiens
ctctaccaggagtctccaccgt

SEQ ID NO: 7953939 - DNA, 21 bp, Homo sapiens
ctctagaaatcgaataacctt

SEQ ID NO: 7953940 - DNA, 21 bp, Homo sapiens
ctctagaaatcgaataacctt

SEQ ID NO: 7953941 - DNA, 21 bp, Homo sapiens
ctctagaaatcgaataacctt

SEQ ID NO: 7953942 - DNA, 22 bp, Homo sapiens
ctctagaacagtgctgagcctt

SEQ ID NO: 7953943 - DNA, 22 bp, Homo sapiens
ctctagaacagtgctgagcctt

SEQ ID NO: 7953944 - DNA, 22 bp, Homo sapiens
ctctagaacagtgctgagcctt

SEQ ID NO: 7953945 - DNA, 22 bp, Homo sapiens
ctctagaaagattgttgaccaa

SEQ ID NO: 7953946 - DNA, 21 bp, Homo sapiens
ctctagaaatcgaataacctt

SEQ ID NO: 7953947 - DNA, 22 bp, Homo sapiens
ctctactgagagcagcagatat

SEQ ID NO: 7953948 - DNA, 22 bp, Homo sapiens
ctctagaaagattgttgaccaa

SEQ ID NO: 7953949 - DNA, 22 bp, Homo sapiens
ctctagaaagattgttgaccaa

SEQ ID NO: 7953950 - DNA, 22 bp, Homo sapiens
ctctagaactgattgggaagaa

SEQ ID NO: 7953951 - DNA, 22 bp, Homo sapiens
ctctagaactgattgggaagaa

SEQ ID NO: 7953952 - DNA, 22 bp, Homo sapiens
ctctagaacagtgctgagcctt

SEQ ID NO: 7953953 - DNA, 22 bp, Homo sapiens
ctctagaactgattgggaagaa

SEQ ID NO: 7953954 - DNA, 22 bp, Homo sapiens
ctctagaagctgaggggcccaa

SEQ ID NO: 7953955 - DNA, 22 bp, Homo sapiens
ctctagaagctgaggggcccaa

SEQ ID NO: 7953956 - DNA, 22 bp, Homo sapiens
ctctagaagctgaggggcccaa

SEQ ID NO: 7953957 - DNA, 22 bp, Homo sapiens
ctctagaaggtctccctgccag

SEQ ID NO: 7953958 - DNA, 22 bp, Homo sapiens
ctctagaaggtctccctgccag

SEQ ID NO: 7953959 - DNA, 22 bp, Homo sapiens
ctctagaaggtctccctgccag

SEQ ID NO: 7953960 - DNA, 22 bp, Homo sapiens
ctctagaatgaattagcgcagg

SEQ ID NO: 7953961 - DNA, 22 bp, Homo sapiens
ctctagaatgaattagcgcagg

SEQ ID NO: 7953962 - DNA, 22 bp, Homo sapiens
ctctagaatgaattagcgcagg

SEQ ID NO: 7953963 - DNA, 22 bp, Homo sapiens
ctctagaatgaattagcgcagg

SEQ ID NO: 7953964 - DNA, 18 bp, Homo sapiens
ctctagaatgggagattt

SEQ ID NO: 7953965 - DNA, 18 bp, Homo sapiens
ctctagaatgggagattt

SEQ ID NO: 7953966 - DNA, 18 bp, Homo sapiens
ctctagaatgggagattt

SEQ ID NO: 7953967 - DNA, 22 bp, Homo sapiens
ctctagacaacttgctgtgggt

SEQ ID NO: 7953968 - DNA, 23 bp, Homo sapiens
tttctctgagaagcagttctcta

SEQ ID NO: 7953969 - DNA, 23 bp, Homo sapiens
tttctctgagaagcagttctcta

SEQ ID NO: 7953970 - DNA, 23 bp, Homo sapiens
tttctctgagaagcagttctcta

SEQ ID NO: 7953971 - DNA, 22 bp, Homo sapiens
tttctctcttaaggagtttaaa

SEQ ID NO: 7953972 - DNA, 22 bp, Homo sapiens
tttctctctggccctgattgtc

SEQ ID NO: 7953973 - DNA, 22 bp, Homo sapiens
tttctctctggccctgattgtc

SEQ ID NO: 7953974 - DNA, 22 bp, Homo sapiens
tttctctctgactgggagctga

SEQ ID NO: 7953975 - DNA, 22 bp, Homo sapiens
tttctctctatttagacaggta

SEQ ID NO: 7953976 - DNA, 22 bp, Homo sapiens
tttctctctatttagacaggta

SEQ ID NO: 7953977 - DNA, 22 bp, Homo sapiens
tttctctctacagtactttcat

SEQ ID NO: 7953978 - DNA, 22 bp, Homo sapiens
tttctctctacagtactttcat

SEQ ID NO: 7953979 - DNA, 19 bp, Homo sapiens
tttctctccctcatcccga

SEQ ID NO: 7953980 - DNA, 19 bp, Homo sapiens
tttctctccctcatcccga

SEQ ID NO: 7953981 - DNA, 18 bp, Homo sapiens
tttctcagactctctttc

SEQ ID NO: 7953982 - DNA, 22 bp, Homo sapiens
tttctctccccaagtggaattg

SEQ ID NO: 7953983 - DNA, 22 bp, Homo sapiens
ctctctggaattaaagcccaat

SEQ ID NO: 7953984 - DNA, 22 bp, Homo sapiens
ctctctggaattaaagcccaat

SEQ ID NO: 7953985 - DNA, 20 bp, Homo sapiens
ctctctggaaggtgggagcc

SEQ ID NO: 7953986 - DNA, 20 bp, Homo sapiens
ctctctggaaggtgggagcc

SEQ ID NO: 7953987 - DNA, 20 bp, Homo sapiens
ctctctggaaggtgggagcc

SEQ ID NO: 7953988 - DNA, 22 bp, Homo sapiens
ctctctggacttgagtatcagc

SEQ ID NO: 7953989 - DNA, 22 bp, Homo sapiens
ctctctggacctcaactatttt

SEQ ID NO: 7953990 - DNA, 22 bp, Homo sapiens
ctctctggacttgagtatcagc

SEQ ID NO: 7953991 - DNA, 22 bp, Homo sapiens
ctctctggaattaaagcccaat

SEQ ID NO: 7953992 - DNA, 22 bp, Homo sapiens
tttctctggcattaggtataaa

SEQ ID NO: 7953993 - DNA, 22 bp, Homo sapiens
tttctctggcattaggtataaa

SEQ ID NO: 7953994 - DNA, 22 bp, Homo sapiens
tttctctggcctcagtttaaca

SEQ ID NO: 7953995 - DNA, 22 bp, Homo sapiens
tttctctggcctcagtttaaca

SEQ ID NO: 7953996 - DNA, 20 bp, Homo sapiens
ctctctggaaggtgggagcc

SEQ ID NO: 7953997 - DNA, 22 bp, Homo sapiens
tttctctggcctcagtttaaca

SEQ ID NO: 7953998 - DNA, 22 bp, Homo sapiens
tttctctgagttgttacaaaac

SEQ ID NO: 7953999 - DNA, 22 bp, Homo sapiens
tttctctgcagagccccaagga

SEQ ID NO: 7954000 - DNA, 23 bp, Homo sapiens
tttctctgagaagcagttctcta

SEQ ID NO: 7954001 - DNA, 22 bp, Homo sapiens
tttctctgaggctggcctccct

SEQ ID NO: 7954002 - DNA, 22 bp, Homo sapiens
tttctctgccagttattttcct

SEQ ID NO: 7954003 - DNA, 22 bp, Homo sapiens
tttctctgccagttattttcct

SEQ ID NO: 7954004 - DNA, 22 bp, Homo sapiens
tttctctgcagagccccaagga

SEQ ID NO: 7954005 - DNA, 22 bp, Homo sapiens
tttctctgctgtgttggcagct

SEQ ID NO: 7954006 - DNA, 22 bp, Homo sapiens
tttctctgctgcctgtgtcgat

SEQ ID NO: 7954007 - DNA, 22 bp, Homo sapiens
tttctctgctgcctgtgtcgat

SEQ ID NO: 7954008 - DNA, 22 bp, Homo sapiens
tttctgttgttggtgtctggct

SEQ ID NO: 7954009 - DNA, 22 bp, Homo sapiens
tttctgttgtatggcttctgca

SEQ ID NO: 7954010 - DNA, 19 bp, Homo sapiens
tttctgtttgcttctggtt

SEQ ID NO: 7954011 - DNA, 19 bp, Homo sapiens
tttctgtttgcttctggtt

SEQ ID NO: 7954012 - DNA, 22 bp, Homo sapiens
tttctgtttagcataaagtggc

SEQ ID NO: 7954013 - DNA, 22 bp, Homo sapiens
tttctgcaggtattgcataagt

SEQ ID NO: 7954014 - DNA, 19 bp, Homo sapiens
tttctgcagcccagcagca

SEQ ID NO: 7954015 - DNA, 20 bp, Homo sapiens
tttctgcagatgtttacatg

SEQ ID NO: 7954016 - DNA, 20 bp, Homo sapiens
tttctgcagatgtttacatg

SEQ ID NO: 7954017 - DNA, 22 bp, Homo sapiens
tttctgcaagtgtagataccca

SEQ ID NO: 7954018 - DNA, 22 bp, Homo sapiens
tttctgcaacgagtctttgact

SEQ ID NO: 7954019 - DNA, 22 bp, Homo sapiens
tttctgcaaaataaatagtgac

SEQ ID NO: 7954020 - DNA, 22 bp, Homo sapiens
tttctgcaaaatctaagttaga

SEQ ID NO: 7954021 - DNA, 22 bp, Homo sapiens
tttctgcaaaatctaagttaga

SEQ ID NO: 7954022 - DNA, 22 bp, Homo sapiens
tttctgatttgacttgaagtat

SEQ ID NO: 7954023 - DNA, 22 bp, Homo sapiens
tttctgattctcactttggcat

SEQ ID NO: 7954024 - DNA, 22 bp, Homo sapiens
ctctgaggtctaggaccatggc

SEQ ID NO: 7954025 - DNA, 22 bp, Homo sapiens
ctctgaggtccttcccagctct

SEQ ID NO: 7954026 - DNA, 22 bp, Homo sapiens
ctctgaggtccttcccagctct

SEQ ID NO: 7954027 - DNA, 22 bp, Homo sapiens
ctctgaggtccttcccagctct

SEQ ID NO: 7954028 - DNA, 22 bp, Homo sapiens
ctctgaggtcctacagtgaccc

SEQ ID NO: 7954029 - DNA, 22 bp, Homo sapiens
ctctgaggtcctacagtgaccc

SEQ ID NO: 7954030 - DNA, 22 bp, Homo sapiens
tttctgatattcatttagaaga

SEQ ID NO: 7954031 - DNA, 22 bp, Homo sapiens
tttctgatattcatttagaaga

SEQ ID NO: 7954032 - DNA, 22 bp, Homo sapiens
tttctgatattcatttagaaga

SEQ ID NO: 7954033 - DNA, 22 bp, Homo sapiens
tttctgatatactgtagaatcc

SEQ ID NO: 7954034 - DNA, 22 bp, Homo sapiens
tttctgatattcatttagaaga

SEQ ID NO: 7954035 - DNA, 22 bp, Homo sapiens
ctctctggcacttcattgctgt

SEQ ID NO: 7954036 - DNA, 22 bp, Homo sapiens
ctctctggcacttcattgctgt

SEQ ID NO: 7954037 - DNA, 22 bp, Homo sapiens
ctctctggcacttcattgctgt

SEQ ID NO: 7954038 - DNA, 22 bp, Homo sapiens
ctctctggatatttgtatgctg

SEQ ID NO: 7954039 - DNA, 22 bp, Homo sapiens
ctctctggatatttgtatgctg

SEQ ID NO: 7954040 - DNA, 22 bp, Homo sapiens
ctctctggatatttgtatgctg

SEQ ID NO: 7954041 - DNA, 22 bp, Homo sapiens
ctctctggcacttcattgctgt

SEQ ID NO: 7954042 - DNA, 22 bp, Homo sapiens
ctctgacagccttcattatgca

SEQ ID NO: 7954043 - DNA, 22 bp, Homo sapiens
ctctctggcccatcctgttgcc

SEQ ID NO: 7954044 - DNA, 22 bp, Homo sapiens
ctctctggcccatcctgttgcc

SEQ ID NO: 7954045 - DNA, 22 bp, Homo sapiens
ctctctggcccatcctgttgcc

SEQ ID NO: 7954046 - DNA, 22 bp, Homo sapiens
ctctctggcccatcctgttgcc

SEQ ID NO: 7954047 - DNA, 22 bp, Homo sapiens
ctctctggcacttcattgctgt

SEQ ID NO: 7954048 - DNA, 22 bp, Homo sapiens
ctctgacaggtggcattatctc

SEQ ID NO: 7954049 - DNA, 22 bp, Homo sapiens
ctctgacagccttcattatgca

SEQ ID NO: 7954050 - DNA, 22 bp, Homo sapiens
ctctgacagccttcattatgca

SEQ ID NO: 7954051 - DNA, 22 bp, Homo sapiens
ctctgagctcgtgcagtacttc

SEQ ID NO: 7954052 - DNA, 22 bp, Homo sapiens
ctctgagctgaaacatgagcat

SEQ ID NO: 7954053 - DNA, 22 bp, Homo sapiens
ctctgagctgaaacatgagcat

SEQ ID NO: 7954054 - DNA, 22 bp, Homo sapiens
ctctgagctgaaacatgagcat

SEQ ID NO: 7954055 - DNA, 22 bp, Homo sapiens
ctctgagctgaaacatgagcat

SEQ ID NO: 7954056 - DNA, 22 bp, Homo sapiens
ctctgagctgaaacatgagcat

SEQ ID NO: 7954057 - DNA, 22 bp, Homo sapiens
ctctgagctcgtgcagtacttc

SEQ ID NO: 7954058 - DNA, 22 bp, Homo sapiens
ctctgagctgaaacatgagcat

SEQ ID NO: 7954059 - DNA, 22 bp, Homo sapiens
ctctgaggctccatgcaggctt

SEQ ID NO: 7954060 - DNA, 22 bp, Homo sapiens
ctctgaggctccatgcaggctt

SEQ ID NO: 7954061 - DNA, 22 bp, Homo sapiens
ctctgaggctccatgcaggctt

SEQ ID NO: 7954062 - DNA, 20 bp, Homo sapiens
ctctgaggctgagaagggag

SEQ ID NO: 7954063 - DNA, 20 bp, Homo sapiens
ctctgaggctgagaagggag

SEQ ID NO: 7954064 - DNA, 20 bp, Homo sapiens
ctctgaggctgagaagggag

SEQ ID NO: 7954065 - DNA, 22 bp, Homo sapiens
ctctgagggctcgagggacgcg

SEQ ID NO: 7954066 - DNA, 22 bp, Homo sapiens
ctctgaggctccatgcaggctt

SEQ ID NO: 7954067 - DNA, 22 bp, Homo sapiens
ctctgaggctccatgcaggctt

SEQ ID NO: 7954068 - DNA, 22 bp, Homo sapiens
ctctgaggctccatgcaggctt

SEQ ID NO: 7954069 - DNA, 19 bp, Homo sapiens
ctctgaggattagctgtgg

SEQ ID NO: 7954070 - DNA, 22 bp, Homo sapiens
ctctgagctttgcagcccctgg

SEQ ID NO: 7954071 - DNA, 22 bp, Homo sapiens
ctctgaggaagtcaagtagcca

SEQ ID NO: 7954072 - DNA, 22 bp, Homo sapiens
ctctgagctgaaacatgagcat

SEQ ID NO: 7954073 - DNA, 22 bp, Homo sapiens
ctctgaggtcctacagtgaccc

SEQ ID NO: 7954074 - DNA, 22 bp, Homo sapiens
ctctgaggtcctacagtgaccc

SEQ ID NO: 7954075 - DNA, 22 bp, Homo sapiens
ctctgaggtcctacagtgaccc

SEQ ID NO: 7954076 - DNA, 22 bp, Homo sapiens
ctctgaggtcctacagtgaccc

SEQ ID NO: 7954077 - DNA, 22 bp, Homo sapiens
ctctgagggtctaaggagtcac

SEQ ID NO: 7954078 - DNA, 22 bp, Homo sapiens
ctctgagggtctaaggagtcac

SEQ ID NO: 7954079 - DNA, 22 bp, Homo sapiens
ctctgaggtcagggcccggcaa

SEQ ID NO: 7954080 - DNA, 20 bp, Homo sapiens
ctctgaggtatctgtaaagt

SEQ ID NO: 7954081 - DNA, 22 bp, Homo sapiens
ctctgagggctcgagggacgcg

SEQ ID NO: 7954082 - DNA, 22 bp, Homo sapiens
ctctgagggctcgagggacgcg

SEQ ID NO: 7954083 - DNA, 22 bp, Homo sapiens
ctctgagggctcgagggacgcg

SEQ ID NO: 7954084 - DNA, 22 bp, Homo sapiens
ctctgagggctcgagggacgcg

SEQ ID NO: 7954085 - DNA, 22 bp, Homo sapiens
ctctgagggctcgagggacgcg

SEQ ID NO: 7954086 - DNA, 22 bp, Homo sapiens
ctctgagggctgtcaggaaagg

SEQ ID NO: 7954087 - DNA, 22 bp, Homo sapiens
ctctgagggctgtcaggaaagg

SEQ ID NO: 7954088 - DNA, 22 bp, Homo sapiens
ctctgagggtctaaggagtcac

SEQ ID NO: 7954089 - DNA, 22 bp, Homo sapiens
ctctgagggtctaaggagtcac

SEQ ID NO: 7954090 - DNA, 22 bp, Homo sapiens
gaggaagaagcaaaccagctaa

SEQ ID NO: 7954091 - DNA, 22 bp, Homo sapiens
gaggaagaagcaaaccagctaa

SEQ ID NO: 7954092 - DNA, 22 bp, Homo sapiens
gaggaagaagggattagaactc

SEQ ID NO: 7954093 - DNA, 22 bp, Homo sapiens
gaggaagaagcaaaccagctaa

SEQ ID NO: 7954094 - DNA, 22 bp, Homo sapiens
gaggaagaagcaaaccagctaa

SEQ ID NO: 7954095 - DNA, 22 bp, Homo sapiens
gaggaagaagcaaaccagctaa

SEQ ID NO: 7954096 - DNA, 22 bp, Homo sapiens
gaggagagagggactgtctgca

SEQ ID NO: 7954097 - DNA, 22 bp, Homo sapiens
gaggagagagggactgtctgca

SEQ ID NO: 7954098 - DNA, 22 bp, Homo sapiens
gaggagagatggtagattgggt

SEQ ID NO: 7954099 - DNA, 22 bp, Homo sapiens
gaggagagagggactgtctgca

SEQ ID NO: 7954100 - DNA, 22 bp, Homo sapiens
gaggaagaatcagggtggtgag

SEQ ID NO: 7954101 - DNA, 22 bp, Homo sapiens
gaggaagaattggttattggag

SEQ ID NO: 7954102 - DNA, 22 bp, Homo sapiens
gaggaagaatcagggtggtgag

SEQ ID NO: 7954103 - DNA, 22 bp, Homo sapiens
gaggaagaatcagggtggtgag

SEQ ID NO: 7954104 - DNA, 22 bp, Homo sapiens
gaggaagaatcagggtggtgag

SEQ ID NO: 7954105 - DNA, 22 bp, Homo sapiens
gaggaaatggttgttcaggtgg

SEQ ID NO: 7954106 - DNA, 21 bp, Homo sapiens
gaggaaatgctctggtgttca

SEQ ID NO: 7954107 - DNA, 22 bp, Homo sapiens
gaggaacaagctgctttatctt

SEQ ID NO: 7954108 - DNA, 22 bp, Homo sapiens
gaggaacagagacgggatcgct

SEQ ID NO: 7954109 - DNA, 22 bp, Homo sapiens
gaggaacagagacgggatcgct

SEQ ID NO: 7954110 - DNA, 22 bp, Homo sapiens
gaggaacatgaggtgacctggg

SEQ ID NO: 7954111 - DNA, 22 bp, Homo sapiens
gaggaacagcagccacatgtcc

SEQ ID NO: 7954112 - DNA, 22 bp, Homo sapiens
gaggaacagagggcaaggccag

SEQ ID NO: 7954113 - DNA, 18 bp, Homo sapiens
gaggaacattcacctcct

SEQ ID NO: 7954114 - DNA, 18 bp, Homo sapiens
gaggaacattcacctcct

SEQ ID NO: 7954115 - DNA, 22 bp, Homo sapiens
gaggaagaaagcataggtgggg

SEQ ID NO: 7954116 - DNA, 22 bp, Homo sapiens
gaggaagaaagcataggtgggg

SEQ ID NO: 7954117 - DNA, 22 bp, Homo sapiens
gaggaacttgggttttggattg

SEQ ID NO: 7954118 - DNA, 22 bp, Homo sapiens
gaggaacttatgatattctact

SEQ ID NO: 7954119 - DNA, 19 bp, Homo sapiens
gaggaactggcttggttcc

SEQ ID NO: 7954120 - DNA, 20 bp, Homo sapiens
gaggaaccactgggaggaga

SEQ ID NO: 7954121 - DNA, 22 bp, Homo sapiens
gaggaactgagtaccatgattc

SEQ ID NO: 7954122 - DNA, 22 bp, Homo sapiens
gagctgcctgttgcatagcaac

SEQ ID NO: 7954123 - DNA, 22 bp, Homo sapiens
gagctgcctgttgcatagcaac

SEQ ID NO: 7954124 - DNA, 22 bp, Homo sapiens
gagctgcctgtgtgccatgatg

SEQ ID NO: 7954125 - DNA, 22 bp, Homo sapiens
gagctgcctgtgtgccatgatg

SEQ ID NO: 7954126 - DNA, 22 bp, Homo sapiens
gagctgcctgtgtgccatgatg

SEQ ID NO: 7954127 - DNA, 22 bp, Homo sapiens
gagctgctggaagtggagccct

SEQ ID NO: 7954128 - DNA, 22 bp, Homo sapiens
gagctgctggaagtggagccct

SEQ ID NO: 7954129 - DNA, 22 bp, Homo sapiens
gagctgctggcctcctgcggga

SEQ ID NO: 7954130 - DNA, 22 bp, Homo sapiens
gagctgctggatatgtggcctg

SEQ ID NO: 7954131 - DNA, 19 bp, Homo sapiens
gagctgccttttgaagacc

SEQ ID NO: 7954132 - DNA, 19 bp, Homo sapiens
gagctgccttttgaagacc

SEQ ID NO: 7954133 - DNA, 19 bp, Homo sapiens
gagctgccttttgaagacc

SEQ ID NO: 7954134 - DNA, 22 bp, Homo sapiens
gagctgctggttgctggtgcct

SEQ ID NO: 7954135 - DNA, 22 bp, Homo sapiens
gagctgctggttgctggtgcct

SEQ ID NO: 7954136 - DNA, 22 bp, Homo sapiens
gagctgcttctgtgtgccgggt

SEQ ID NO: 7954137 - DNA, 22 bp, Homo sapiens
gagctgcttccagagttgagtg

SEQ ID NO: 7954138 - DNA, 22 bp, Homo sapiens
gagctgctgtgaggggagcttc

SEQ ID NO: 7954139 - DNA, 22 bp, Homo sapiens
gaggaaaatgggacaggctgta

SEQ ID NO: 7954140 - DNA, 22 bp, Homo sapiens
gaggaaaatgggacaggctgta

SEQ ID NO: 7954141 - DNA, 22 bp, Homo sapiens
gaggaaaatgggacaggctgta

SEQ ID NO: 7954142 - DNA, 22 bp, Homo sapiens
gaggaaaatggagtgtaattaa

SEQ ID NO: 7954143 - DNA, 22 bp, Homo sapiens
gaggaaaatggagtgtaattaa

SEQ ID NO: 7954144 - DNA, 22 bp, Homo sapiens
gaggaaaatggagtgtaattaa

SEQ ID NO: 7954145 - DNA, 18 bp, Homo sapiens
gaggaaacaaggcagagg

SEQ ID NO: 7954146 - DNA, 18 bp, Homo sapiens
gaggaaacaaggcagagg

SEQ ID NO: 7954147 - DNA, 18 bp, Homo sapiens
gaggaaacaaggcagagg

SEQ ID NO: 7954148 - DNA, 18 bp, Homo sapiens
gaggaaacaggctctgtg

SEQ ID NO: 7954149 - DNA, 22 bp, Homo sapiens
gaggaaacattgtagaagcagt

SEQ ID NO: 7954150 - DNA, 22 bp, Homo sapiens
gaggaaagaaccccagtcaata

SEQ ID NO: 7954151 - DNA, 22 bp, Homo sapiens
gaggaaagaaccccagtcaata

SEQ ID NO: 7954152 - DNA, 22 bp, Homo sapiens
gaggaaacattgtagaagcagt

SEQ ID NO: 7954153 - DNA, 22 bp, Homo sapiens
gaggaaagaaccccagtcaata

SEQ ID NO: 7954154 - DNA, 22 bp, Homo sapiens
gaggaaagaaccccagtcaata

SEQ ID NO: 7954155 - DNA, 23 bp, Homo sapiens
gaggaaagaatatagatgcaatc

SEQ ID NO: 7954156 - DNA, 22 bp, Homo sapiens
gaggaaatcttaggccccaacc

SEQ ID NO: 7954157 - DNA, 22 bp, Homo sapiens
gaggaaatcttaggccccaacc

SEQ ID NO: 7954158 - DNA, 22 bp, Homo sapiens
gaggaaagctggtttaaagtat

SEQ ID NO: 7954159 - DNA, 22 bp, Homo sapiens
gaggaaatcattccagaaaagg

SEQ ID NO: 7954160 - DNA, 22 bp, Homo sapiens
gaggaaatcattccagaaaagg

SEQ ID NO: 7954161 - DNA, 22 bp, Homo sapiens
gaggaaagctggtttaaagtat

SEQ ID NO: 7954162 - DNA, 22 bp, Homo sapiens
gaggaaagagtcaaatctgaag

SEQ ID NO: 7954163 - DNA, 22 bp, Homo sapiens
gaggaaagctggtttaaagtat

SEQ ID NO: 7954164 - DNA, 23 bp, Homo sapiens
gaggaaagaatatagatgcaatc

SEQ ID NO: 7954165 - DNA, 23 bp, Homo sapiens
gaggaaagaatatagatgcaatc

SEQ ID NO: 7954166 - DNA, 23 bp, Homo sapiens
gaggaaagaatatagatgcaatc

SEQ ID NO: 7954167 - DNA, 22 bp, Homo sapiens
gaggaaagagtcaaatctgaag

SEQ ID NO: 7954168 - DNA, 22 bp, Homo sapiens
gaggaaagagtcaaatctgaag

SEQ ID NO: 7954169 - DNA, 23 bp, Homo sapiens
gagctgagtgtagggagactagg

SEQ ID NO: 7954170 - DNA, 22 bp, Homo sapiens
gagctgccggcccacagtacta

SEQ ID NO: 7954171 - DNA, 22 bp, Homo sapiens
gagctgagtctgcagtcgccat

SEQ ID NO: 7954172 - DNA, 22 bp, Homo sapiens
gagctgagtatgaaggatgtga

SEQ ID NO: 7954173 - DNA, 22 bp, Homo sapiens
gagctgcctacattgccaagag

SEQ ID NO: 7954174 - DNA, 22 bp, Homo sapiens
gagctgcctacattgccaagag

SEQ ID NO: 7954175 - DNA, 22 bp, Homo sapiens
gagctgcctgaacaagcagcag

SEQ ID NO: 7954176 - DNA, 22 bp, Homo sapiens
gagctgcctgaacaagcagcag

SEQ ID NO: 7954177 - DNA, 22 bp, Homo sapiens
gagctgcctgaacaagcagcag

SEQ ID NO: 7954178 - DNA, 22 bp, Homo sapiens
gagctgagtagaggctgctccc

SEQ ID NO: 7954179 - DNA, 22 bp, Homo sapiens
gagctgaggtgatgtggtcgtt

SEQ ID NO: 7954180 - DNA, 22 bp, Homo sapiens
gagctgagggtctaggagggtt

SEQ ID NO: 7954181 - DNA, 22 bp, Homo sapiens
gagctgagggtctaggagggtt

SEQ ID NO: 7954182 - DNA, 22 bp, Homo sapiens
gagctgagtatgaaggatgtga

SEQ ID NO: 7954183 - DNA, 22 bp, Homo sapiens
gagctgagtatcccactgaagt

SEQ ID NO: 7954184 - DNA, 22 bp, Homo sapiens
gagctgagtatcccactgaagt

SEQ ID NO: 7954185 - DNA, 22 bp, Homo sapiens
gagctgagtatcccactgaagt

SEQ ID NO: 7954186 - DNA, 22 bp, Homo sapiens
gagctgagtatcccactgaagt

SEQ ID NO: 7954187 - DNA, 22 bp, Homo sapiens
gagctgagtatcccactgaagt

SEQ ID NO: 7954188 - DNA, 22 bp, Homo sapiens
gagctgagtagaggctgctccc

SEQ ID NO: 7954189 - DNA, 22 bp, Homo sapiens
gagctgaggccagagtcttctg

SEQ ID NO: 7954190 - DNA, 22 bp, Homo sapiens
gagctgaggccagagtcttctg

SEQ ID NO: 7954191 - DNA, 22 bp, Homo sapiens
gagctgaggccagagtcttctg

SEQ ID NO: 7954192 - DNA, 22 bp, Homo sapiens
gagctgaggctcaggctggcgt

SEQ ID NO: 7954193 - DNA, 22 bp, Homo sapiens
gagctgaggctcaggctggcgt

SEQ ID NO: 7954194 - DNA, 22 bp, Homo sapiens
gagctgaggctcaggctggcgt

SEQ ID NO: 7954195 - DNA, 22 bp, Homo sapiens
gagctgaggctcaggctggcgt

SEQ ID NO: 7954196 - DNA, 22 bp, Homo sapiens
gagctgaggctcaggctggcgt

SEQ ID NO: 7954197 - DNA, 22 bp, Homo sapiens
gagctgagggtctaggagggtt

SEQ ID NO: 7954198 - DNA, 22 bp, Homo sapiens
gagctgagggtctaggagggtt

SEQ ID NO: 7954199 - DNA, 22 bp, Homo sapiens
gagctgagggtctaggagggtt

SEQ ID NO: 7954200 - DNA, 22 bp, Homo sapiens
gagctgagggtctaggagggtt

SEQ ID NO: 7954201 - DNA, 22 bp, Homo sapiens
gagctgaggctgaggcctcact

SEQ ID NO: 7954202 - DNA, 22 bp, Homo sapiens
gagctgaggctcaggctggcgt

SEQ ID NO: 7954203 - DNA, 22 bp, Homo sapiens
gagctgaggctcaggctggcgt

SEQ ID NO: 7954204 - DNA, 22 bp, Homo sapiens
gagctgaggatacatcagtgaa

SEQ ID NO: 7954205 - DNA, 22 bp, Homo sapiens
gagctgagcttaactccttgaa

SEQ ID NO: 7954206 - DNA, 22 bp, Homo sapiens
gagctgagcttaactccttgaa

SEQ ID NO: 7954207 - DNA, 22 bp, Homo sapiens
gagctgaggatacatcagtgaa

SEQ ID NO: 7954208 - DNA, 22 bp, Homo sapiens
gagctgagcttaactccttgaa

SEQ ID NO: 7954209 - DNA, 22 bp, Homo sapiens
gagctgagcttaactccttgaa

SEQ ID NO: 7954210 - DNA, 22 bp, Homo sapiens
gagctgagcttaactccttgaa

SEQ ID NO: 7954211 - DNA, 22 bp, Homo sapiens
gagctgagcttaactccttgaa

SEQ ID NO: 7954212 - DNA, 22 bp, Homo sapiens
gagctgagcctgggtggaccgc

SEQ ID NO: 7954213 - DNA, 22 bp, Homo sapiens
gagctgagcagggagcctcact

SEQ ID NO: 7954214 - DNA, 22 bp, Homo sapiens
gagctgagcagggagcctcact

SEQ ID NO: 7954215 - DNA, 22 bp, Homo sapiens
gagctgagatttgaagcaagtt

SEQ ID NO: 7954216 - DNA, 22 bp, Homo sapiens
gagctgagatttgaagcaagtt

SEQ ID NO: 7954217 - DNA, 22 bp, Homo sapiens
gagccctgttcaggcctcctca

SEQ ID NO: 7954218 - DNA, 22 bp, Homo sapiens
gagccctgttcaggcctcctca

SEQ ID NO: 7954219 - DNA, 22 bp, Homo sapiens
gagctgagatcatgtacactag

SEQ ID NO: 7954220 - DNA, 22 bp, Homo sapiens
gagccctgttcaggcctcctca

SEQ ID NO: 7954221 - DNA, 22 bp, Homo sapiens
gagctgagatcatgtacactag

SEQ ID NO: 7954222 - DNA, 22 bp, Homo sapiens
gagctgagatcgtgccattgca

SEQ ID NO: 7954223 - DNA, 22 bp, Homo sapiens
gagctgagatcatgtacactag

SEQ ID NO: 7954224 - DNA, 22 bp, Homo sapiens
gagccctgtgaggaaagagggt

SEQ ID NO: 7954225 - DNA, 22 bp, Homo sapiens
gagccctgtgattctgttgtgt

SEQ ID NO: 7954226 - DNA, 22 bp, Homo sapiens
gagccctgtgattctgttgtgt

SEQ ID NO: 7954227 - DNA, 22 bp, Homo sapiens
gagccctgtaggaatctctcaa

SEQ ID NO: 7954228 - DNA, 22 bp, Homo sapiens
gagccctgtagcaagtcatgtc

SEQ ID NO: 7954229 - DNA, 22 bp, Homo sapiens
gagccctgtagcaagtcatgtc

SEQ ID NO: 7954230 - DNA, 22 bp, Homo sapiens
gagccctgtagcaagtcatgtc

SEQ ID NO: 7954231 - DNA, 22 bp, Homo sapiens
gagccctgtagcaagtcatgtc

SEQ ID NO: 7954232 - DNA, 22 bp, Homo sapiens
gagccctgtagcaagtcatgtc

SEQ ID NO: 7954233 - DNA, 22 bp, Homo sapiens
gagccctgtagcaagtcatgtc

SEQ ID NO: 7954234 - DNA, 18 bp, Homo sapiens
gagccctgggagatctct

SEQ ID NO: 7954235 - DNA, 18 bp, Homo sapiens
gagccctgggagatctct

SEQ ID NO: 7954236 - DNA, 22 bp, Homo sapiens
gagccctgtagcaagtcatgtc

SEQ ID NO: 7954237 - DNA, 22 bp, Homo sapiens
gagccctggcagtctgggatgg

SEQ ID NO: 7954238 - DNA, 22 bp, Homo sapiens
gagccctgcttccaagggggca

SEQ ID NO: 7954239 - DNA, 22 bp, Homo sapiens
gagccctggcagtctgggatgg

SEQ ID NO: 7954240 - DNA, 22 bp, Homo sapiens
gagccctgatttgcagcatttg

SEQ ID NO: 7954241 - DNA, 22 bp, Homo sapiens
gagccctgcccacttgtctgag

SEQ ID NO: 7954242 - DNA, 22 bp, Homo sapiens
gagccctgcccacttgtctgag

SEQ ID NO: 7954243 - DNA, 22 bp, Homo sapiens
gagccctgcccacttgtctgag

SEQ ID NO: 7954244 - DNA, 22 bp, Homo sapiens
gagccctgcggagccccgaggc

SEQ ID NO: 7954245 - DNA, 22 bp, Homo sapiens
gagccctgcggagccccgaggc

SEQ ID NO: 7954246 - DNA, 18 bp, Homo sapiens
gagccctgagtctgcaca

SEQ ID NO: 7954247 - DNA, 18 bp, Homo sapiens
gagccctgagtctgcaca

SEQ ID NO: 7954248 - DNA, 18 bp, Homo sapiens
gagccctgagtctgcaca

SEQ ID NO: 7954249 - DNA, 18 bp, Homo sapiens
gagccctgagtctgcaca

SEQ ID NO: 7954250 - DNA, 22 bp, Homo sapiens
gagccctggcagtctgggatgg

SEQ ID NO: 7954251 - DNA, 22 bp, Homo sapiens
gagccctggcagtctgggatgg

SEQ ID NO: 7954252 - DNA, 22 bp, Homo sapiens
gagccctgcttccaagggggca

SEQ ID NO: 7954253 - DNA, 22 bp, Homo sapiens
gagccctgcttccaagggggca

SEQ ID NO: 7954254 - DNA, 22 bp, Homo sapiens
gagccctgcgtgtctgggggca

SEQ ID NO: 7954255 - DNA, 22 bp, Homo sapiens
gagccctgcgtgtctgggggca

SEQ ID NO: 7954256 - DNA, 22 bp, Homo sapiens
gagccctgcgtgtctgggggca

SEQ ID NO: 7954257 - DNA, 22 bp, Homo sapiens
gagccctgcggagccccgaggc

SEQ ID NO: 7954258 - DNA, 22 bp, Homo sapiens
gagccctgctgggccttgtctc

SEQ ID NO: 7954259 - DNA, 22 bp, Homo sapiens
gagcagggagacaactctggtg

SEQ ID NO: 7954260 - DNA, 22 bp, Homo sapiens
gagcaggcttgcagagaagggg

SEQ ID NO: 7954261 - DNA, 22 bp, Homo sapiens
gagcagtgagtgaatgttgcct

SEQ ID NO: 7954262 - DNA, 19 bp, Homo sapiens
gagcagtgaggaccaccag

SEQ ID NO: 7954263 - DNA, 19 bp, Homo sapiens
gagcagtgaggaccaccag

SEQ ID NO: 7954264 - DNA, 19 bp, Homo sapiens
gagcagtgaggaccaccag

SEQ ID NO: 7954265 - DNA, 20 bp, Homo sapiens
gagcagtgagccagggaaag

SEQ ID NO: 7954266 - DNA, 22 bp, Homo sapiens
gagcagtgagtgaatgttgcct

SEQ ID NO: 7954267 - DNA, 22 bp, Homo sapiens
gagcagtgatgggaggacgtca

SEQ ID NO: 7954268 - DNA, 22 bp, Homo sapiens
gagcagtgatgggaggacgtca

SEQ ID NO: 7954269 - DNA, 22 bp, Homo sapiens
gagcaggcttgcagagaagggg

SEQ ID NO: 7954270 - DNA, 22 bp, Homo sapiens
gagcaggcttgcagagaagggg

SEQ ID NO: 7954271 - DNA, 22 bp, Homo sapiens
gagcaggcttgcagagaagggg

SEQ ID NO: 7954272 - DNA, 22 bp, Homo sapiens
gagaggtaatttgaagtgcaaa

SEQ ID NO: 7954273 - DNA, 22 bp, Homo sapiens
gagcaggctctgcctgtgtgtc

SEQ ID NO: 7954274 - DNA, 22 bp, Homo sapiens
gagcaggcttgcagagaagggg

SEQ ID NO: 7954275 - DNA, 22 bp, Homo sapiens
gagaggggtttgccatcctatg

SEQ ID NO: 7954276 - DNA, 22 bp, Homo sapiens
gagaggggtttgccatcctatg

SEQ ID NO: 7954277 - DNA, 22 bp, Homo sapiens
gagaggggtttgccatcctatg

SEQ ID NO: 7954278 - DNA, 22 bp, Homo sapiens
gagagggtgcctggaagccagg

SEQ ID NO: 7954279 - DNA, 22 bp, Homo sapiens
gagagggtgcctggaagccagg

SEQ ID NO: 7954280 - DNA, 22 bp, Homo sapiens
gagagggctgcctggtgtgagg

SEQ ID NO: 7954281 - DNA, 22 bp, Homo sapiens
gagagggctgcctggtgtgagg

SEQ ID NO: 7954282 - DNA, 22 bp, Homo sapiens
gagagggctgcctggtgtgagg

SEQ ID NO: 7954283 - DNA, 22 bp, Homo sapiens
gagagggctgcctggtgtgagg

SEQ ID NO: 7954284 - DNA, 22 bp, Homo sapiens
gagagggctgcctggtgtgagg

SEQ ID NO: 7954285 - DNA, 22 bp, Homo sapiens
gagaggggcccaagccacatag

SEQ ID NO: 7954286 - DNA, 22 bp, Homo sapiens
gagaggggacctgtgtgtctag

SEQ ID NO: 7954287 - DNA, 22 bp, Homo sapiens
gagaggggacctgtgtgtctag

SEQ ID NO: 7954288 - DNA, 22 bp, Homo sapiens
gagaggggacctgtgtgtctag

SEQ ID NO: 7954289 - DNA, 22 bp, Homo sapiens
gagaggggacctgtgtgtctag

SEQ ID NO: 7954290 - DNA, 22 bp, Homo sapiens
gagaggggcgcgcagctcgcga

SEQ ID NO: 7954291 - DNA, 22 bp, Homo sapiens
gagaggggcgcgcagctcgcga

SEQ ID NO: 7954292 - DNA, 22 bp, Homo sapiens
gagaggggcgcgcagctcgcga

SEQ ID NO: 7954293 - DNA, 22 bp, Homo sapiens
gagaggggtttgccatcctatg

SEQ ID NO: 7954294 - DNA, 22 bp, Homo sapiens
gagaggggcccaagccacatag

SEQ ID NO: 7954295 - DNA, 22 bp, Homo sapiens
gagaggggcgcgcagctcgcga

SEQ ID NO: 7954296 - DNA, 22 bp, Homo sapiens
gagaggggcccaagccacatag

SEQ ID NO: 7954297 - DNA, 22 bp, Homo sapiens
gagaggggcgcgcagctcgcga

SEQ ID NO: 7954298 - DNA, 22 bp, Homo sapiens
gagaggggcgcgcagctcgcga

SEQ ID NO: 7954299 - DNA, 22 bp, Homo sapiens
gagcagtggtcacagggaggga

SEQ ID NO: 7954300 - DNA, 22 bp, Homo sapiens
gagcagtggtctgatcttctaa

SEQ ID NO: 7954301 - DNA, 22 bp, Homo sapiens
gagcagtggtcacagggaggga

SEQ ID NO: 7954302 - DNA, 22 bp, Homo sapiens
gagcagtgagtgaatgttgcct

SEQ ID NO: 7954303 - DNA, 22 bp, Homo sapiens
gagcagtgtttgtggacctgga

SEQ ID NO: 7954304 - DNA, 22 bp, Homo sapiens
gagcagtgtttgtggacctgga

SEQ ID NO: 7954305 - DNA, 22 bp, Homo sapiens
gagcagtgtttgtggacctgga

SEQ ID NO: 7954306 - DNA, 22 bp, Homo sapiens
gagcagtggttgaacagaggca

SEQ ID NO: 7954307 - DNA, 22 bp, Homo sapiens
gagcagtggttgaacagaggca

SEQ ID NO: 7954308 - DNA, 22 bp, Homo sapiens
gagcatcactgtcctctccccg

SEQ ID NO: 7954309 - DNA, 22 bp, Homo sapiens
gagcatcgctgagatcccagac

SEQ ID NO: 7954310 - DNA, 22 bp, Homo sapiens
gagcagttgggctctaggaagt

SEQ ID NO: 7954311 - DNA, 22 bp, Homo sapiens
gagcagttttatttcatgagac

SEQ ID NO: 7954312 - DNA, 22 bp, Homo sapiens
gagcagttttatttcatgagac

SEQ ID NO: 7954313 - DNA, 22 bp, Homo sapiens
gagcagtggtggtgtgttagag

SEQ ID NO: 7954314 - DNA, 22 bp, Homo sapiens
gagcagttttatttcatgagac

SEQ ID NO: 7954315 - DNA, 22 bp, Homo sapiens
gagcagttctccttggtagggg

SEQ ID NO: 7954316 - DNA, 22 bp, Homo sapiens
gagcagttctccttggtagggg

SEQ ID NO: 7954317 - DNA, 22 bp, Homo sapiens
gagcagttgggctctaggaagt

SEQ ID NO: 7954318 - DNA, 22 bp, Homo sapiens
gagcagttatttttagacatga

SEQ ID NO: 7954319 - DNA, 22 bp, Homo sapiens
gagcagttatttttagacatga

SEQ ID NO: 7954320 - DNA, 22 bp, Homo sapiens
gagcagtgtttgtggacctgga

SEQ ID NO: 7954321 - DNA, 22 bp, Homo sapiens
gagcatggatagaaggtgggat

SEQ ID NO: 7954322 - DNA, 22 bp, Homo sapiens
gagcatggatcatgtgctgggt

SEQ ID NO: 7954323 - DNA, 22 bp, Homo sapiens
gagcatggatcatgtgctgggt

SEQ ID NO: 7954324 - DNA, 22 bp, Homo sapiens
gagcatggatcatgtgctgggt

SEQ ID NO: 7954325 - DNA, 22 bp, Homo sapiens
gagcatggatagaaggtgggat

SEQ ID NO: 7954326 - DNA, 22 bp, Homo sapiens
gagcatggatagaaggtgggat

SEQ ID NO: 7954327 - DNA, 22 bp, Homo sapiens
gagcatggatagaaggtgggat

SEQ ID NO: 7954328 - DNA, 22 bp, Homo sapiens
gagcatcgctgagatcccagac

SEQ ID NO: 7954329 - DNA, 22 bp, Homo sapiens
gagcatctgtggtccatcagaa

SEQ ID NO: 7954330 - DNA, 19 bp, Homo sapiens
gagcatgactggccttgca

SEQ ID NO: 7954331 - DNA, 22 bp, Homo sapiens
gagcatgagggaaggcagcaga

SEQ ID NO: 7954332 - DNA, 22 bp, Homo sapiens
gagcatgagggaaggcagcaga

SEQ ID NO: 7954333 - DNA, 22 bp, Homo sapiens
gagcatggcagctgagggcagg

SEQ ID NO: 7954334 - DNA, 22 bp, Homo sapiens
gagcatggctgcctccctgtgc

SEQ ID NO: 7954335 - DNA, 21 bp, Homo sapiens
gagcatggcttacatcagcag

SEQ ID NO: 7954336 - DNA, 18 bp, Homo sapiens
gagcatgggcagtgggga

SEQ ID NO: 7954337 - DNA, 21 bp, Homo sapiens
gagcatggcttacatcagcag

SEQ ID NO: 7954338 - DNA, 18 bp, Homo sapiens
gagcatgggcagtgggga

SEQ ID NO: 7954339 - DNA, 18 bp, Homo sapiens
gagcatgggcagtgggga

SEQ ID NO: 7954340 - DNA, 21 bp, Homo sapiens
gagcccaggcatctcattaat

SEQ ID NO: 7954341 - DNA, 22 bp, Homo sapiens
gagcccaggctggggttcagag

SEQ ID NO: 7954342 - DNA, 22 bp, Homo sapiens
gagcccaggctggggttcagag

SEQ ID NO: 7954343 - DNA, 22 bp, Homo sapiens
gagcccaggctggggttcagag

SEQ ID NO: 7954344 - DNA, 21 bp, Homo sapiens
gagcccaggcatctcattaat

SEQ ID NO: 7954345 - DNA, 22 bp, Homo sapiens
gagcccaggcagaggttgcagt

SEQ ID NO: 7954346 - DNA, 22 bp, Homo sapiens
gagcccaggcagaggttgcagt

SEQ ID NO: 7954347 - DNA, 22 bp, Homo sapiens
gagcccaggcagaggttgcagt

SEQ ID NO: 7954348 - DNA, 22 bp, Homo sapiens
gagcccaggcagaggttgcagt

SEQ ID NO: 7954349 - DNA, 22 bp, Homo sapiens
gagcccaggcagaggttgcagt

SEQ ID NO: 7954350 - DNA, 22 bp, Homo sapiens
gagcccaggatggtgtatggct

SEQ ID NO: 7954351 - DNA, 22 bp, Homo sapiens
gagcccaggatggtgtatggct

SEQ ID NO: 7954352 - DNA, 22 bp, Homo sapiens
gagcccaggatggtgtatggct

SEQ ID NO: 7954353 - DNA, 22 bp, Homo sapiens
gagcccagggtgaaatagcagc

SEQ ID NO: 7954354 - DNA, 22 bp, Homo sapiens
gagcccagggtgaaatagcagc

SEQ ID NO: 7954355 - DNA, 22 bp, Homo sapiens
gagcccagggcaggcaaggcag

SEQ ID NO: 7954356 - DNA, 22 bp, Homo sapiens
gagcccagggcaggcaaggcag

SEQ ID NO: 7954357 - DNA, 22 bp, Homo sapiens
gagcccagggtgaaatagcagc

SEQ ID NO: 7954358 - DNA, 22 bp, Homo sapiens
gagcccagggtgaaatagcagc

SEQ ID NO: 7954359 - DNA, 22 bp, Homo sapiens
gagcccagggtgaaatagcagc

SEQ ID NO: 7954360 - DNA, 22 bp, Homo sapiens
gagcccagggcaggcaaggcag

SEQ ID NO: 7954361 - DNA, 22 bp, Homo sapiens
gagcccagggcaggcaaggcag

SEQ ID NO: 7954362 - DNA, 22 bp, Homo sapiens
gagcccagggcaggcaaggcag

SEQ ID NO: 7954363 - DNA, 22 bp, Homo sapiens
gagcccagggcaggcaaggcag

SEQ ID NO: 7954364 - DNA, 22 bp, Homo sapiens
gagcccaggctggggttcagag

SEQ ID NO: 7954365 - DNA, 22 bp, Homo sapiens
gagcccaggctggggttcagag

SEQ ID NO: 7954366 - DNA, 22 bp, Homo sapiens
gagcccaggttctgcttccagc

SEQ ID NO: 7954367 - DNA, 22 bp, Homo sapiens
gagcccaggttctgcttccagc

SEQ ID NO: 7954368 - DNA, 22 bp, Homo sapiens
gagcccaggttctgcttccagc

SEQ ID NO: 7954369 - DNA, 22 bp, Homo sapiens
gagcccaggttctgcttccagc

SEQ ID NO: 7954370 - DNA, 22 bp, Homo sapiens
gagcccaggttctgcttccagc

SEQ ID NO: 7954371 - DNA, 22 bp, Homo sapiens
gagcccagtaggcaaagctgca

SEQ ID NO: 7954372 - DNA, 22 bp, Homo sapiens
gagcccagtaggcaaagctgca

SEQ ID NO: 7954373 - DNA, 22 bp, Homo sapiens
gagcccagtaggcaaagctgca

SEQ ID NO: 7954374 - DNA, 22 bp, Homo sapiens
gagcccagtaggcaaagctgca

SEQ ID NO: 7954375 - DNA, 22 bp, Homo sapiens
gagcccagtctgctcctgcgcc

SEQ ID NO: 7954376 - DNA, 22 bp, Homo sapiens
gagcccagtctgctcctgcgcc

SEQ ID NO: 7954377 - DNA, 22 bp, Homo sapiens
gagcccagtctgctcctgcgcc

SEQ ID NO: 7954378 - DNA, 22 bp, Homo sapiens
gagcccagtaggcaaagctgca

SEQ ID NO: 7954379 - DNA, 22 bp, Homo sapiens
gagccctgacactgagggagtt

SEQ ID NO: 7954380 - DNA, 22 bp, Homo sapiens
gagccctgacactgagggagtt

SEQ ID NO: 7954381 - DNA, 22 bp, Homo sapiens
gagccctgacactgagggagtt

SEQ ID NO: 7954382 - DNA, 22 bp, Homo sapiens
gagccctgagagttgtgaggcc

SEQ ID NO: 7954383 - DNA, 22 bp, Homo sapiens
gagccctgaacaacagcaggaa

SEQ ID NO: 7954384 - DNA, 22 bp, Homo sapiens
gagccctgaacaacagcaggaa

SEQ ID NO: 7954385 - DNA, 22 bp, Homo sapiens
gagccctgaacaacagcaggaa

SEQ ID NO: 7954386 - DNA, 22 bp, Homo sapiens
gagccctgaacaacagcaggaa

SEQ ID NO: 7954387 - DNA, 22 bp, Homo sapiens
gagccctgaacaacagcaggaa

SEQ ID NO: 7954388 - DNA, 22 bp, Homo sapiens
gagccctgaacaacagcaggaa

SEQ ID NO: 7954389 - DNA, 22 bp, Homo sapiens
gagccctgaacaacagcaggaa

SEQ ID NO: 7954390 - DNA, 22 bp, Homo sapiens
gagccctgaacaacagcaggaa

SEQ ID NO: 7954391 - DNA, 22 bp, Homo sapiens
gagcccagctgcggccctcagc

SEQ ID NO: 7954392 - DNA, 22 bp, Homo sapiens
gagcccagctgcggccctcagc

SEQ ID NO: 7954393 - DNA, 22 bp, Homo sapiens
gagcccagctgtccttggcaaa

SEQ ID NO: 7954394 - DNA, 22 bp, Homo sapiens
gagcccagctgtccttggcaaa

SEQ ID NO: 7954395 - DNA, 22 bp, Homo sapiens
gagcccagctgtccttggcaaa

SEQ ID NO: 7954396 - DNA, 22 bp, Homo sapiens
gagcccagctgtccttggcaaa

SEQ ID NO: 7954397 - DNA, 22 bp, Homo sapiens
gagcccagcttgcacatggagc

SEQ ID NO: 7954398 - DNA, 22 bp, Homo sapiens
gagcccaggaagtggaggctga

SEQ ID NO: 7954399 - DNA, 22 bp, Homo sapiens
gagcccagcttgcacatggagc

SEQ ID NO: 7954400 - DNA, 22 bp, Homo sapiens
gagcccagcttgcacatggagc

SEQ ID NO: 7954401 - DNA, 22 bp, Homo sapiens
gagcccaggaagtggaggctga

SEQ ID NO: 7954402 - DNA, 22 bp, Homo sapiens
gagcccaggaagtggaggctga

SEQ ID NO: 7954403 - DNA, 22 bp, Homo sapiens
gagcccaggaagtggaggctga

SEQ ID NO: 7954404 - DNA, 22 bp, Homo sapiens
gagcccaggaagtggaggctga

SEQ ID NO: 7954405 - DNA, 22 bp, Homo sapiens
gagcccaggagtttgatgctgc

SEQ ID NO: 7954406 - DNA, 22 bp, Homo sapiens
gagcccaggagtttgatgctgc

SEQ ID NO: 7954407 - DNA, 22 bp, Homo sapiens
gagcccaggagtttgatgctgc

SEQ ID NO: 7954408 - DNA, 22 bp, Homo sapiens
gagcccaggagtttgatgctgc

SEQ ID NO: 7954409 - DNA, 22 bp, Homo sapiens
gagcccaggaagtggaggctga

SEQ ID NO: 7954410 - DNA, 20 bp, Homo sapiens
gagcccaagtagggagaaat

SEQ ID NO: 7954411 - DNA, 22 bp, Homo sapiens
gagccagtgatcagacagggag

SEQ ID NO: 7954412 - DNA, 22 bp, Homo sapiens
gagccagtgatcagacagggag

SEQ ID NO: 7954413 - DNA, 22 bp, Homo sapiens
gagccattgtccaagcctgttt

SEQ ID NO: 7954414 - DNA, 22 bp, Homo sapiens
gagcatttggttatagtaattt

SEQ ID NO: 7954415 - DNA, 22 bp, Homo sapiens
gagcatttttgtctgcatttta

SEQ ID NO: 7954416 - DNA, 22 bp, Homo sapiens
gagcccagctctacctcagact

SEQ ID NO: 7954417 - DNA, 22 bp, Homo sapiens
gagcccagctctacctcagact

SEQ ID NO: 7954418 - DNA, 22 bp, Homo sapiens
gagcccagcccagagccatatg

SEQ ID NO: 7954419 - DNA, 22 bp, Homo sapiens
gagcccagcccagagccatatg

SEQ ID NO: 7954420 - DNA, 22 bp, Homo sapiens
gagcccagcccagagccatatg

SEQ ID NO: 7954421 - DNA, 22 bp, Homo sapiens
gagcccagctgcggccctcagc

SEQ ID NO: 7954422 - DNA, 22 bp, Homo sapiens
gagcccagctctacctcagact

SEQ ID NO: 7954423 - DNA, 22 bp, Homo sapiens
gagcccagctgcggccctcagc

SEQ ID NO: 7954424 - DNA, 22 bp, Homo sapiens
gagcccagctgcggccctcagc

SEQ ID NO: 7954425 - DNA, 22 bp, Homo sapiens
gagcccagctgcggccctcagc

SEQ ID NO: 7954426 - DNA, 22 bp, Homo sapiens
gagcccagctctacctcagact

SEQ ID NO: 7954427 - DNA, 22 bp, Homo sapiens
gagggctgtggggcatgaccag

SEQ ID NO: 7954428 - DNA, 22 bp, Homo sapiens
gagggctgtggggcatgaccag

SEQ ID NO: 7954429 - DNA, 22 bp, Homo sapiens
gagggctgtgaaggagcgggtt

SEQ ID NO: 7954430 - DNA, 22 bp, Homo sapiens
gagggctgtgaaggagcgggtt

SEQ ID NO: 7954431 - DNA, 22 bp, Homo sapiens
gagggctgtgaaggagcgggtt

SEQ ID NO: 7954432 - DNA, 22 bp, Homo sapiens
gagggctgtgaaggagcgggtt

SEQ ID NO: 7954433 - DNA, 22 bp, Homo sapiens
gagggctgtgaaggagcgggtt

SEQ ID NO: 7954434 - DNA, 22 bp, Homo sapiens
gagggctgtggggcatgaccag

SEQ ID NO: 7954435 - DNA, 22 bp, Homo sapiens
gagggctgtggggcatgaccag

SEQ ID NO: 7954436 - DNA, 22 bp, Homo sapiens
gagggctgtggggcatgaccag

SEQ ID NO: 7954437 - DNA, 22 bp, Homo sapiens
gagggctgtggggcatgaccag

SEQ ID NO: 7954438 - DNA, 22 bp, Homo sapiens
gagggctgctggaaaaatgcag

SEQ ID NO: 7954439 - DNA, 22 bp, Homo sapiens
gagggctgctggaaaaatgcag

SEQ ID NO: 7954440 - DNA, 22 bp, Homo sapiens
gagggctgctgccagatatgcc

SEQ ID NO: 7954441 - DNA, 22 bp, Homo sapiens
gagggctgctggaaaaatgcag

SEQ ID NO: 7954442 - DNA, 22 bp, Homo sapiens
gagggctggggcttaggcttag

SEQ ID NO: 7954443 - DNA, 22 bp, Homo sapiens
gagggctggggcttaggcttag

SEQ ID NO: 7954444 - DNA, 22 bp, Homo sapiens
gagggctgctggaaaaatgcag

SEQ ID NO: 7954445 - DNA, 22 bp, Homo sapiens
gagggctgctggaaaaatgcag

SEQ ID NO: 7954446 - DNA, 22 bp, Homo sapiens
gagggctgctggaaaaatgcag

SEQ ID NO: 7954447 - DNA, 22 bp, Homo sapiens
gagggctggggcttaggcttag

SEQ ID NO: 7954448 - DNA, 22 bp, Homo sapiens
gagggctggggcttaggcttag

SEQ ID NO: 7954449 - DNA, 22 bp, Homo sapiens
gagggctgtgaaggagcgggtt

SEQ ID NO: 7954450 - DNA, 22 bp, Homo sapiens
gagggctgtgaaggagcgggtt

SEQ ID NO: 7954451 - DNA, 22 bp, Homo sapiens
gagggctgtgaaggagcgggtt

SEQ ID NO: 7954452 - DNA, 22 bp, Homo sapiens
gaggggctgccctggtgtcagg

SEQ ID NO: 7954453 - DNA, 22 bp, Homo sapiens
gaggggctggcacgatggctgc

SEQ ID NO: 7954454 - DNA, 22 bp, Homo sapiens
gaggggctggcacgatggctgc

SEQ ID NO: 7954455 - DNA, 19 bp, Homo sapiens
gagggcttgatggacccga

SEQ ID NO: 7954456 - DNA, 22 bp, Homo sapiens
gaggggaaagtgtgaggctgcg

SEQ ID NO: 7954457 - DNA, 22 bp, Homo sapiens
gaggggctggcacgatggctgc

SEQ ID NO: 7954458 - DNA, 22 bp, Homo sapiens
gaggggctggcacgatggctgc

SEQ ID NO: 7954459 - DNA, 22 bp, Homo sapiens
gaggggctggcacgatggctgc

SEQ ID NO: 7954460 - DNA, 22 bp, Homo sapiens
gaggggctggctgtggtcccat

SEQ ID NO: 7954461 - DNA, 22 bp, Homo sapiens
gaggggctggctgtggtcccat

SEQ ID NO: 7954462 - DNA, 22 bp, Homo sapiens
gagggaggtgatactgaacgta

SEQ ID NO: 7954463 - DNA, 22 bp, Homo sapiens
gagggaggtgatactgaacgta

SEQ ID NO: 7954464 - DNA, 22 bp, Homo sapiens
gagggaggtgatactgaacgta

SEQ ID NO: 7954465 - DNA, 22 bp, Homo sapiens
gagggaggtgatactgaacgta

SEQ ID NO: 7954466 - DNA, 22 bp, Homo sapiens
gagggagtaacgtactacagtg

SEQ ID NO: 7954467 - DNA, 22 bp, Homo sapiens
gagggagtaacgtactacagtg

SEQ ID NO: 7954468 - DNA, 22 bp, Homo sapiens
gagggagtaacgtactacagtg

SEQ ID NO: 7954469 - DNA, 22 bp, Homo sapiens
gagggaggtgatactgaacgta

SEQ ID NO: 7954470 - DNA, 18 bp, Homo sapiens
gagggagtagctgaggtt

SEQ ID NO: 7954471 - DNA, 22 bp, Homo sapiens
gagggagtaacgtactacagtg

SEQ ID NO: 7954472 - DNA, 22 bp, Homo sapiens
gagggagtgccagagggccagc

SEQ ID NO: 7954473 - DNA, 22 bp, Homo sapiens
gagggctgatgttgccacctca

SEQ ID NO: 7954474 - DNA, 22 bp, Homo sapiens
gagggctgatgttgccacctca

SEQ ID NO: 7954475 - DNA, 22 bp, Homo sapiens
gagggctgatgttgccacctca

SEQ ID NO: 7954476 - DNA, 22 bp, Homo sapiens
gagggctgatgttgccacctca

SEQ ID NO: 7954477 - DNA, 22 bp, Homo sapiens
gagggagtctgtgcaaagaatt

SEQ ID NO: 7954478 - DNA, 22 bp, Homo sapiens
gagggagtctgtgcaaagaatt

SEQ ID NO: 7954479 - DNA, 18 bp, Homo sapiens
gagggagtagctgaggtt

SEQ ID NO: 7954480 - DNA, 22 bp, Homo sapiens
gagggagtgagacacaaaagaa

SEQ ID NO: 7954481 - DNA, 22 bp, Homo sapiens
gagggagtgagacacaaaagaa

SEQ ID NO: 7954482 - DNA, 22 bp, Homo sapiens
gagggagtgccagagggccagc

SEQ ID NO: 7954483 - DNA, 22 bp, Homo sapiens
gagggctgccacgttgggcgag

SEQ ID NO: 7954484 - DNA, 22 bp, Homo sapiens
gagggctgccacgttgggcgag

SEQ ID NO: 7954485 - DNA, 22 bp, Homo sapiens
gagggctgccacgttgggcgag

SEQ ID NO: 7954486 - DNA, 22 bp, Homo sapiens
gagggctgccacgttgggcgag

SEQ ID NO: 7954487 - DNA, 22 bp, Homo sapiens
gagggctgccacgttgggcgag

SEQ ID NO: 7954488 - DNA, 22 bp, Homo sapiens
gagggctgctgccagatatgcc

SEQ ID NO: 7954489 - DNA, 22 bp, Homo sapiens
gagggctgccacgttgggcgag

SEQ ID NO: 7954490 - DNA, 22 bp, Homo sapiens
gagggctgctgccagatatgcc

SEQ ID NO: 7954491 - DNA, 22 bp, Homo sapiens
gagggctgctggaaaaatgcag

SEQ ID NO: 7954492 - DNA, 22 bp, Homo sapiens
gagggctgctgccagatatgcc

SEQ ID NO: 7954493 - DNA, 22 bp, Homo sapiens
gagggctgctgccagatatgcc

SEQ ID NO: 7954494 - DNA, 22 bp, Homo sapiens
gagggctgctgccagatatgcc

SEQ ID NO: 7954495 - DNA, 22 bp, Homo sapiens
gagggctgctgccagatatgcc

SEQ ID NO: 7954496 - DNA, 22 bp, Homo sapiens
gagggctgctgccagatatgcc

SEQ ID NO: 7954497 - DNA, 22 bp, Homo sapiens
gagggctgcaatgagacagaga

SEQ ID NO: 7954498 - DNA, 22 bp, Homo sapiens
gagggctgcaatgagacagaga

SEQ ID NO: 7954499 - DNA, 22 bp, Homo sapiens
gagggctgcaatgagacagaga

SEQ ID NO: 7954500 - DNA, 22 bp, Homo sapiens
gagggctgcaatgagacagaga

SEQ ID NO: 7954501 - DNA, 22 bp, Homo sapiens
gagggctgcaatgagacagaga

SEQ ID NO: 7954502 - DNA, 22 bp, Homo sapiens
gagggctgcaatgagacagaga

SEQ ID NO: 7954503 - DNA, 22 bp, Homo sapiens
gagggctgatgttgccacctca

SEQ ID NO: 7954504 - DNA, 22 bp, Homo sapiens
gagggctgatgttgccacctca

SEQ ID NO: 7954505 - DNA, 22 bp, Homo sapiens
gagggctgcaatgagacagaga

SEQ ID NO: 7954506 - DNA, 22 bp, Homo sapiens
gagggctgcaatgagacagaga

SEQ ID NO: 7954507 - DNA, 22 bp, Homo sapiens
gagggctgcaatgagacagaga

SEQ ID NO: 7954508 - DNA, 22 bp, Homo sapiens
gagggagccgccacagactggg

SEQ ID NO: 7954509 - DNA, 22 bp, Homo sapiens
gagggagccgccacagactggg

SEQ ID NO: 7954510 - DNA, 22 bp, Homo sapiens
gagggagagtgatggaccattg

SEQ ID NO: 7954511 - DNA, 22 bp, Homo sapiens
gagggagccgccacagactggg

SEQ ID NO: 7954512 - DNA, 22 bp, Homo sapiens
gagggagccgccacagactggg

SEQ ID NO: 7954513 - DNA, 22 bp, Homo sapiens
gagggagctatgaatagaagaa

SEQ ID NO: 7954514 - DNA, 22 bp, Homo sapiens
gagggagagtgatggaccattg

SEQ ID NO: 7954515 - DNA, 22 bp, Homo sapiens
gagggagagtgatggaccattg

SEQ ID NO: 7954516 - DNA, 22 bp, Homo sapiens
gagggagagtgatggaccattg

SEQ ID NO: 7954517 - DNA, 22 bp, Homo sapiens
gagggagagtgatggaccattg

SEQ ID NO: 7954518 - DNA, 22 bp, Homo sapiens
gagggagagtgatggaccattg

SEQ ID NO: 7954519 - DNA, 22 bp, Homo sapiens
gagggaggcatcatgaatccag

SEQ ID NO: 7954520 - DNA, 22 bp, Homo sapiens
gagggaggcatcatgaatccag

SEQ ID NO: 7954521 - DNA, 22 bp, Homo sapiens
gagggaggcatcatgaatccag

SEQ ID NO: 7954522 - DNA, 22 bp, Homo sapiens
gagggagctggagcagacgccg

SEQ ID NO: 7954523 - DNA, 22 bp, Homo sapiens
gagggaggcatcatgaatccag

SEQ ID NO: 7954524 - DNA, 22 bp, Homo sapiens
gagggagcttgatggatgtttg

SEQ ID NO: 7954525 - DNA, 22 bp, Homo sapiens
gagggagcttgatggatgtttg

SEQ ID NO: 7954526 - DNA, 22 bp, Homo sapiens
gagggagctggagcagacgccg

SEQ ID NO: 7954527 - DNA, 22 bp, Homo sapiens
gagggagctggagcagacgccg

SEQ ID NO: 7954528 - DNA, 22 bp, Homo sapiens
gagggagctggagcagacgccg

SEQ ID NO: 7954529 - DNA, 22 bp, Homo sapiens
gagggagctggagcagacgccg

SEQ ID NO: 7954530 - DNA, 22 bp, Homo sapiens
gagggagggactagcattctct

SEQ ID NO: 7954531 - DNA, 22 bp, Homo sapiens
gagggagggactagcattctct

SEQ ID NO: 7954532 - DNA, 22 bp, Homo sapiens
gagggagggactagcattctct

SEQ ID NO: 7954533 - DNA, 22 bp, Homo sapiens
gagggagggccaggtcccaacc

SEQ ID NO: 7954534 - DNA, 22 bp, Homo sapiens
gagggagggaaagtttaacact

SEQ ID NO: 7954535 - DNA, 22 bp, Homo sapiens
gagggagggaaagtttaacact

SEQ ID NO: 7954536 - DNA, 22 bp, Homo sapiens
gagggagggaaagtttaacact

SEQ ID NO: 7954537 - DNA, 22 bp, Homo sapiens
gagggagggactagcattctct

SEQ ID NO: 7954538 - DNA, 22 bp, Homo sapiens
gagggagggactagcattctct

SEQ ID NO: 7954539 - DNA, 22 bp, Homo sapiens
gagggagggactagcattctct

SEQ ID NO: 7954540 - DNA, 22 bp, Homo sapiens
gagggaggggagctccaccctc

SEQ ID NO: 7954541 - DNA, 22 bp, Homo sapiens
gagggaggggagctccaccctc

SEQ ID NO: 7954542 - DNA, 22 bp, Homo sapiens
gagggaggggagctccaccctc

SEQ ID NO: 7954543 - DNA, 22 bp, Homo sapiens
gagggaggggagctccaccctc

SEQ ID NO: 7954544 - DNA, 22 bp, Homo sapiens
gagggaggggagctccaccctc

SEQ ID NO: 7954545 - DNA, 22 bp, Homo sapiens
gagggagggccaggtcccaacc

SEQ ID NO: 7954546 - DNA, 22 bp, Homo sapiens
gagggagggccaggtcccaacc

SEQ ID NO: 7954547 - DNA, 22 bp, Homo sapiens
gagggagggccaggtcccaacc

SEQ ID NO: 7954548 - DNA, 22 bp, Homo sapiens
gaggctgcccaactggagtgga

SEQ ID NO: 7954549 - DNA, 22 bp, Homo sapiens
gagggagaattgcagccagcgt

SEQ ID NO: 7954550 - DNA, 22 bp, Homo sapiens
gaggctgcattcttcccactgc

SEQ ID NO: 7954551 - DNA, 22 bp, Homo sapiens
gaggctgcaggcaatgctgccc

SEQ ID NO: 7954552 - DNA, 22 bp, Homo sapiens
gaggctgattcggggaacagca

SEQ ID NO: 7954553 - DNA, 22 bp, Homo sapiens
gaggctgattcggggaacagca

SEQ ID NO: 7954554 - DNA, 22 bp, Homo sapiens
gaggctgattcggggaacagca

SEQ ID NO: 7954555 - DNA, 22 bp, Homo sapiens
gaggctgcactggctaaaggct

SEQ ID NO: 7954556 - DNA, 22 bp, Homo sapiens
gaggctgcactggctaaaggct

SEQ ID NO: 7954557 - DNA, 22 bp, Homo sapiens
gaggctgatgctgcctcacaga

SEQ ID NO: 7954558 - DNA, 22 bp, Homo sapiens
gaggctgatgctgcctcacaga

SEQ ID NO: 7954559 - DNA, 22 bp, Homo sapiens
gaggctgagtagctttgtgctc

SEQ ID NO: 7954560 - DNA, 22 bp, Homo sapiens
gaggctgagtagctttgtgctc

SEQ ID NO: 7954561 - DNA, 22 bp, Homo sapiens
gaggctgatgctgcctcacaga

SEQ ID NO: 7954562 - DNA, 22 bp, Homo sapiens
gaggctgagtagctttgtgctc

SEQ ID NO: 7954563 - DNA, 22 bp, Homo sapiens
gaggctgaggttgcagtgagcc

SEQ ID NO: 7954564 - DNA, 22 bp, Homo sapiens
gaggctgaggttgcagtgagcc

SEQ ID NO: 7954565 - DNA, 22 bp, Homo sapiens
gaggctgaggttgcagtgagcc

SEQ ID NO: 7954566 - DNA, 22 bp, Homo sapiens
gaggctgaggttgcagtgagct

SEQ ID NO: 7954567 - DNA, 22 bp, Homo sapiens
gaggctgaggttgcagtgagct

SEQ ID NO: 7954568 - DNA, 22 bp, Homo sapiens
gaggctgaggttgcagtgagct

SEQ ID NO: 7954569 - DNA, 22 bp, Homo sapiens
gaggctgagtagctttgtgctc

SEQ ID NO: 7954570 - DNA, 22 bp, Homo sapiens
gaggctgagggttagagagtca

SEQ ID NO: 7954571 - DNA, 22 bp, Homo sapiens
gaggctgagggttagagagtca

SEQ ID NO: 7954572 - DNA, 22 bp, Homo sapiens
gaggctgagggttagagagtca

SEQ ID NO: 7954573 - DNA, 22 bp, Homo sapiens
gaggctgagggttagagagtca

SEQ ID NO: 7954574 - DNA, 22 bp, Homo sapiens
gaggctgaggcggatggatcac

SEQ ID NO: 7954575 - DNA, 22 bp, Homo sapiens
gaggctgaggcggatggatcac

SEQ ID NO: 7954576 - DNA, 22 bp, Homo sapiens
gaggctgaggcggatggatcac

SEQ ID NO: 7954577 - DNA, 22 bp, Homo sapiens
gaggctgaggcaggaggatcac

SEQ ID NO: 7954578 - DNA, 22 bp, Homo sapiens
gaggctgaggcaggaggatcac

SEQ ID NO: 7954579 - DNA, 22 bp, Homo sapiens
gaggagaggctggacgcggtga

SEQ ID NO: 7954580 - DNA, 22 bp, Homo sapiens
gaggagagggctgcgggcccac

SEQ ID NO: 7954581 - DNA, 22 bp, Homo sapiens
gaggagagggctgcgggcccac

SEQ ID NO: 7954582 - DNA, 22 bp, Homo sapiens
gaggagaggctggacgcggtga

SEQ ID NO: 7954583 - DNA, 22 bp, Homo sapiens
gaggagaggccatcgttgttat

SEQ ID NO: 7954584 - DNA, 22 bp, Homo sapiens
gaggagaggccatcgttgttat

SEQ ID NO: 7954585 - DNA, 22 bp, Homo sapiens
gaggagaggctggacgcggtga

SEQ ID NO: 7954586 - DNA, 22 bp, Homo sapiens
gaggagaggctggacgcggtga

SEQ ID NO: 7954587 - DNA, 22 bp, Homo sapiens
gaggagaggggctcccaagagc

SEQ ID NO: 7954588 - DNA, 22 bp, Homo sapiens
gaggagaggggctcccaagagc

SEQ ID NO: 7954589 - DNA, 22 bp, Homo sapiens
gaggagaggggctcccaagagc

SEQ ID NO: 7954590 - DNA, 22 bp, Homo sapiens
gaggagaggggctcccaagagc

SEQ ID NO: 7954591 - DNA, 22 bp, Homo sapiens
gaggagaggggctcccaagagc

SEQ ID NO: 7954592 - DNA, 22 bp, Homo sapiens
gaggagaggggctcccaagagc

SEQ ID NO: 7954593 - DNA, 22 bp, Homo sapiens
gaggagagatggtagattgggt

SEQ ID NO: 7954594 - DNA, 22 bp, Homo sapiens
gaggagagatggtagattgggt

SEQ ID NO: 7954595 - DNA, 22 bp, Homo sapiens
gaggagagatggtagattgggt

SEQ ID NO: 7954596 - DNA, 22 bp, Homo sapiens
gaggagagatggtagattgggt

SEQ ID NO: 7954597 - DNA, 22 bp, Homo sapiens
gaggagagatggtagattgggt

SEQ ID NO: 7954598 - DNA, 22 bp, Homo sapiens
gaggagagatggtagattgggt

SEQ ID NO: 7954599 - DNA, 22 bp, Homo sapiens
gaggagagcctgcactttgacc

SEQ ID NO: 7954600 - DNA, 22 bp, Homo sapiens
gaggagagcctgcactttgacc

SEQ ID NO: 7954601 - DNA, 22 bp, Homo sapiens
gaggagcatgggaaggctctgg

SEQ ID NO: 7954602 - DNA, 22 bp, Homo sapiens
gaggagcatgggaaggctctgg

SEQ ID NO: 7954603 - DNA, 22 bp, Homo sapiens
gaggagcatgggaaggctctgg

SEQ ID NO: 7954604 - DNA, 22 bp, Homo sapiens
gaggagcatgggaaggctctgg

SEQ ID NO: 7954605 - DNA, 22 bp, Homo sapiens
gaggagcatgggaaggctctgg

SEQ ID NO: 7954606 - DNA, 22 bp, Homo sapiens
gaggagcatgggaaggctctgg

SEQ ID NO: 7954607 - DNA, 22 bp, Homo sapiens
gaggagccaaggtatgtgtgtt

SEQ ID NO: 7954608 - DNA, 22 bp, Homo sapiens
gaggagcatgggaaggctctgg

SEQ ID NO: 7954609 - DNA, 22 bp, Homo sapiens
gaggagcatgggaaggctctgg

SEQ ID NO: 7954610 - DNA, 20 bp, Homo sapiens
gaggagccaccttgagctgg

SEQ ID NO: 7954611 - DNA, 22 bp, Homo sapiens
gaggagccaaggtatgtgtgtt

SEQ ID NO: 7954612 - DNA, 22 bp, Homo sapiens
gaggagcacatgaggctgaggg

SEQ ID NO: 7954613 - DNA, 22 bp, Homo sapiens
gaggagcacatgaggctgaggg

SEQ ID NO: 7954614 - DNA, 22 bp, Homo sapiens
gaggagcacatgaggctgaggg

SEQ ID NO: 7954615 - DNA, 22 bp, Homo sapiens
gaggagcacatgaggctgaggg

SEQ ID NO: 7954616 - DNA, 22 bp, Homo sapiens
gaggagcacatgaggctgaggg

SEQ ID NO: 7954617 - DNA, 22 bp, Homo sapiens
gaggagcacatgaggctgaggg

SEQ ID NO: 7954618 - DNA, 22 bp, Homo sapiens
gaggagcacatgaggctgaggg

SEQ ID NO: 7954619 - DNA, 22 bp, Homo sapiens
gaggagcacatgaggctgaggg

SEQ ID NO: 7954620 - DNA, 22 bp, Homo sapiens
gaggagaggggctcccaagagc

SEQ ID NO: 7954621 - DNA, 22 bp, Homo sapiens
gaggagaggggctcccaagagc

SEQ ID NO: 7954622 - DNA, 22 bp, Homo sapiens
gaggagcacatgaggctgaggg

SEQ ID NO: 7954623 - DNA, 22 bp, Homo sapiens
gaggagcacatgaggctgaggg

SEQ ID NO: 7954624 - DNA, 22 bp, Homo sapiens
gaggagcaagaaatagtgccca

SEQ ID NO: 7954625 - DNA, 22 bp, Homo sapiens
gaggagcaagaaatagtgccca

SEQ ID NO: 7954626 - DNA, 22 bp, Homo sapiens
gaggcaggaggattgcttgagc

SEQ ID NO: 7954627 - DNA, 22 bp, Homo sapiens
gaggcaggaggattgcttgagc

SEQ ID NO: 7954628 - DNA, 22 bp, Homo sapiens
gaggcaggaggattgcttgagc

SEQ ID NO: 7954629 - DNA, 22 bp, Homo sapiens
gaggcagcttggggctgtgggt

SEQ ID NO: 7954630 - DNA, 22 bp, Homo sapiens
gaggcaggaggattgcttgagc

SEQ ID NO: 7954631 - DNA, 22 bp, Homo sapiens
gaggcagcttggggctgtgggt

SEQ ID NO: 7954632 - DNA, 22 bp, Homo sapiens
gaggcagcttggggctgtgggt

SEQ ID NO: 7954633 - DNA, 22 bp, Homo sapiens
gaggcagcttggggctgtgggt

SEQ ID NO: 7954634 - DNA, 22 bp, Homo sapiens
gaggcagcttggggctgtgggt

SEQ ID NO: 7954635 - DNA, 22 bp, Homo sapiens
gaggcagcttggggctgtgggt

SEQ ID NO: 7954636 - DNA, 22 bp, Homo sapiens
gaggcagcttggggctgtgggt

SEQ ID NO: 7954637 - DNA, 22 bp, Homo sapiens
gaggcagcttagggtactgact

SEQ ID NO: 7954638 - DNA, 22 bp, Homo sapiens
gaggagcccccactgggctcac

SEQ ID NO: 7954639 - DNA, 22 bp, Homo sapiens
gaggagcccccactgggctcac

SEQ ID NO: 7954640 - DNA, 22 bp, Homo sapiens
gaggcagctgggtccggtcggg

SEQ ID NO: 7954641 - DNA, 22 bp, Homo sapiens
gaggcagcttagggtactgact

SEQ ID NO: 7954642 - DNA, 22 bp, Homo sapiens
gaggcagcttagggtactgact

SEQ ID NO: 7954643 - DNA, 22 bp, Homo sapiens
gaggcaggcagattgcttgagg

SEQ ID NO: 7954644 - DNA, 22 bp, Homo sapiens
gaggcaggcagattgcttgagg

SEQ ID NO: 7954645 - DNA, 22 bp, Homo sapiens
gaggcaggcagattgcttgagg

SEQ ID NO: 7954646 - DNA, 22 bp, Homo sapiens
gaggcaggcagattgcttgagg

SEQ ID NO: 7954647 - DNA, 22 bp, Homo sapiens
gaggcaggcagattgcttgagg

SEQ ID NO: 7954648 - DNA, 22 bp, Homo sapiens
gaggcaggcagattgcttgagg

SEQ ID NO: 7954649 - DNA, 22 bp, Homo sapiens
gaggcaggccctgaatgagtca

SEQ ID NO: 7954650 - DNA, 22 bp, Homo sapiens
gaggcaggccctgaatgagtca

SEQ ID NO: 7954651 - DNA, 22 bp, Homo sapiens
gaggcaggcagattgcttgagg

SEQ ID NO: 7954652 - DNA, 22 bp, Homo sapiens
gaggcaggccctgaatgagtca

SEQ ID NO: 7954653 - DNA, 22 bp, Homo sapiens
gaggcaggaggattgcttgagc

SEQ ID NO: 7954654 - DNA, 22 bp, Homo sapiens
gaggcaggaggattgcttgagc

SEQ ID NO: 7954655 - DNA, 22 bp, Homo sapiens
gaggcaggaggattgcttgagc

SEQ ID NO: 7954656 - DNA, 22 bp, Homo sapiens
gaggcaggcactgttatcagca

SEQ ID NO: 7954657 - DNA, 22 bp, Homo sapiens
gaggcaggcactgttatcagca

SEQ ID NO: 7954658 - DNA, 22 bp, Homo sapiens
gaggcaggcactgttatcagca

SEQ ID NO: 7954659 - DNA, 22 bp, Homo sapiens
gaggcaggcactgttatcagca

SEQ ID NO: 7954660 - DNA, 22 bp, Homo sapiens
gaggcaggcactgttatcagca

SEQ ID NO: 7954661 - DNA, 22 bp, Homo sapiens
gaggcaggcactgttatcagca

SEQ ID NO: 7954662 - DNA, 22 bp, Homo sapiens
gaggcagggtgttgattacaga

SEQ ID NO: 7954663 - DNA, 22 bp, Homo sapiens
gaggcagggtgttgattacaga

SEQ ID NO: 7954664 - DNA, 22 bp, Homo sapiens
gaggcagggtgttgattacaga

SEQ ID NO: 7954665 - DNA, 22 bp, Homo sapiens
gaggcaggccctgaatgagtca

SEQ ID NO: 7954666 - DNA, 22 bp, Homo sapiens
gaggcagggtgttgattacaga

SEQ ID NO: 7954667 - DNA, 22 bp, Homo sapiens
gaggcagtaattgtgggcaata

SEQ ID NO: 7954668 - DNA, 22 bp, Homo sapiens
gaggcagggtgttgattacaga

SEQ ID NO: 7954669 - DNA, 22 bp, Homo sapiens
gaggcagggtgttgattacaga

SEQ ID NO: 7954670 - DNA, 22 bp, Homo sapiens
gaggcagggtgttgattacaga

SEQ ID NO: 7954671 - DNA, 22 bp, Homo sapiens
gaggcagggtgttgattacaga

SEQ ID NO: 7954672 - DNA, 22 bp, Homo sapiens
gaggcagtgtcggtggcaggat

SEQ ID NO: 7954673 - DNA, 22 bp, Homo sapiens
gaggcagtgtcggtggcaggat

SEQ ID NO: 7954674 - DNA, 22 bp, Homo sapiens
gaggcagtgcattgtctagggg

SEQ ID NO: 7954675 - DNA, 22 bp, Homo sapiens
gaggcagtgtcggtggcaggat

SEQ ID NO: 7954676 - DNA, 22 bp, Homo sapiens
gaggcagtgtcggtggcaggat

SEQ ID NO: 7954677 - DNA, 22 bp, Homo sapiens
gaggcagtggtctgatgcaagg

SEQ ID NO: 7954678 - DNA, 22 bp, Homo sapiens
gaggcagtatagtcattaagta

SEQ ID NO: 7954679 - DNA, 19 bp, Homo sapiens
gaggcagtagtcaaagctt

SEQ ID NO: 7954680 - DNA, 19 bp, Homo sapiens
gaggcagtagtcaaagctt

SEQ ID NO: 7954681 - DNA, 19 bp, Homo sapiens
gaggcagtagtcaaagctt

SEQ ID NO: 7954682 - DNA, 19 bp, Homo sapiens
gaggcagtagtcaaagctt

SEQ ID NO: 7954683 - DNA, 22 bp, Homo sapiens
gaggctcagagaagtcatggta

SEQ ID NO: 7954684 - DNA, 22 bp, Homo sapiens
gaggctcagagaagtcatggta

SEQ ID NO: 7954685 - DNA, 22 bp, Homo sapiens
gaggctcagagaagtcatggta

SEQ ID NO: 7954686 - DNA, 22 bp, Homo sapiens
gaggctcactgggcaaagactc

SEQ ID NO: 7954687 - DNA, 22 bp, Homo sapiens
gaggctcactttcatcctcttc

SEQ ID NO: 7954688 - DNA, 22 bp, Homo sapiens
gaggctcactttcatcctcttc

SEQ ID NO: 7954689 - DNA, 22 bp, Homo sapiens
gaggctcactttcatcctcttc

SEQ ID NO: 7954690 - DNA, 22 bp, Homo sapiens
gaggctcacctagggagcactg

SEQ ID NO: 7954691 - DNA, 22 bp, Homo sapiens
gaggctcacctagggagcactg

SEQ ID NO: 7954692 - DNA, 22 bp, Homo sapiens
gaggctcacgacgggacgaact

SEQ ID NO: 7954693 - DNA, 22 bp, Homo sapiens
gaggctcactgggcaaagactc

SEQ ID NO: 7954694 - DNA, 22 bp, Homo sapiens
gaggctcactaggcatcctggg

SEQ ID NO: 7954695 - DNA, 22 bp, Homo sapiens
gaggctcactaggcatcctggg

SEQ ID NO: 7954696 - DNA, 22 bp, Homo sapiens
gaggctcaacccacaggggttg

SEQ ID NO: 7954697 - DNA, 22 bp, Homo sapiens
gaggctcacctagggagcactg

SEQ ID NO: 7954698 - DNA, 22 bp, Homo sapiens
gaggctcacctagggagcactg

SEQ ID NO: 7954699 - DNA, 22 bp, Homo sapiens
gaggctcaacccacaggggttg

SEQ ID NO: 7954700 - DNA, 22 bp, Homo sapiens
gaggcatgcagagctggagcag

SEQ ID NO: 7954701 - DNA, 22 bp, Homo sapiens
gaggctcaacccacaggggttg

SEQ ID NO: 7954702 - DNA, 22 bp, Homo sapiens
gaggcataagtagaagagattg

SEQ ID NO: 7954703 - DNA, 22 bp, Homo sapiens
gaggcagttcctgagtgacaag

SEQ ID NO: 7954704 - DNA, 22 bp, Homo sapiens
gaggcagtgtttactgccctgt

SEQ ID NO: 7954705 - DNA, 22 bp, Homo sapiens
gaggctgaggcaggaggatcac

SEQ ID NO: 7954706 - DNA, 22 bp, Homo sapiens
gaggctgagagtttgttctact

SEQ ID NO: 7954707 - DNA, 22 bp, Homo sapiens
gaggctgagagtttgttctact

SEQ ID NO: 7954708 - DNA, 22 bp, Homo sapiens
gaggctgagagtttgttctact

SEQ ID NO: 7954709 - DNA, 22 bp, Homo sapiens
gaggctgagagtttgttctact

SEQ ID NO: 7954710 - DNA, 22 bp, Homo sapiens
gaggctgacggcaccatcttct

SEQ ID NO: 7954711 - DNA, 22 bp, Homo sapiens
gaggctgacggcaccatcttct

SEQ ID NO: 7954712 - DNA, 22 bp, Homo sapiens
gaggctgacggcaccatcttct

SEQ ID NO: 7954713 - DNA, 22 bp, Homo sapiens
gaggctgagactctgaattttt

SEQ ID NO: 7954714 - DNA, 22 bp, Homo sapiens
gaggctgacggcaccatcttct

SEQ ID NO: 7954715 - DNA, 22 bp, Homo sapiens
gaggctgagactctgaattttt

SEQ ID NO: 7954716 - DNA, 20 bp, Homo sapiens
gaggctgaagtgtttttgct

SEQ ID NO: 7954717 - DNA, 20 bp, Homo sapiens
gaggctgaagtgtttttgct

SEQ ID NO: 7954718 - DNA, 22 bp, Homo sapiens
gaggctgaagtgtacatgggtg

SEQ ID NO: 7954719 - DNA, 22 bp, Homo sapiens
gaggctgaagtgtacatgggtg

SEQ ID NO: 7954720 - DNA, 22 bp, Homo sapiens
gaggctgaagtgtacatgggtg

SEQ ID NO: 7954721 - DNA, 22 bp, Homo sapiens
gaggctgaagtgtacatgggtg

SEQ ID NO: 7954722 - DNA, 22 bp, Homo sapiens
gaggctgaatggccagaagcca

SEQ ID NO: 7954723 - DNA, 22 bp, Homo sapiens
gaggctgaatggccagaagcca

SEQ ID NO: 7954724 - DNA, 22 bp, Homo sapiens
gaggctgaatggccagaagcca

SEQ ID NO: 7954725 - DNA, 20 bp, Homo sapiens
gaggctgaagtgtttttgct

SEQ ID NO: 7954726 - DNA, 22 bp, Homo sapiens
gaggctgaatggccagaagcca

SEQ ID NO: 7954727 - DNA, 20 bp, Homo sapiens
gaggctgaagtgtttttgct

SEQ ID NO: 7954728 - DNA, 22 bp, Homo sapiens
gaggctcagagaggtccacata

SEQ ID NO: 7954729 - DNA, 22 bp, Homo sapiens
gaggctcagagactttaagttt

SEQ ID NO: 7954730 - DNA, 22 bp, Homo sapiens
gaggctcagagactttaagttt

SEQ ID NO: 7954731 - DNA, 22 bp, Homo sapiens
gaggctcagagggactttcaag

SEQ ID NO: 7954732 - DNA, 22 bp, Homo sapiens
gaggctcagagaggtccacata

SEQ ID NO: 7954733 - DNA, 22 bp, Homo sapiens
gaggctcagagggagcatggtc

SEQ ID NO: 7954734 - DNA, 22 bp, Homo sapiens
gaggctcagagggagcatggtc

SEQ ID NO: 7954735 - DNA, 22 bp, Homo sapiens
gaggctcagagggagcatggtc

SEQ ID NO: 7954736 - DNA, 22 bp, Homo sapiens
gaggctcagagggagcatggtc

SEQ ID NO: 7954737 - DNA, 22 bp, Homo sapiens
gaggctcagagggagcatggtc

SEQ ID NO: 7954738 - DNA, 22 bp, Homo sapiens
gaggctcagagtggttaaataa

SEQ ID NO: 7954739 - DNA, 22 bp, Homo sapiens
gaggctcagggaaacagcgcag

SEQ ID NO: 7954740 - DNA, 22 bp, Homo sapiens
gaggctcagagtggttaaataa

SEQ ID NO: 7954741 - DNA, 22 bp, Homo sapiens
gaggctcagggagtatatgaat

SEQ ID NO: 7954742 - DNA, 22 bp, Homo sapiens
gaggctcagggaaacagcgcag

SEQ ID NO: 7954743 - DNA, 22 bp, Homo sapiens
gaggctcagggagtatatgaat

SEQ ID NO: 7954744 - DNA, 22 bp, Homo sapiens
gaggctcagttatgtcatcagg

SEQ ID NO: 7954745 - DNA, 22 bp, Homo sapiens
gaggctcagttattttagcctg

SEQ ID NO: 7954746 - DNA, 22 bp, Homo sapiens
gaggctcagttattttagcctg

SEQ ID NO: 7954747 - DNA, 22 bp, Homo sapiens
gaggctcagttatgtcatcagg

SEQ ID NO: 7954748 - DNA, 22 bp, Homo sapiens
gaggctcattgcattgtgcatt

SEQ ID NO: 7954749 - DNA, 22 bp, Homo sapiens
gaggctcattgcattgtgcatt

SEQ ID NO: 7954750 - DNA, 22 bp, Homo sapiens
gaggctccagcgacacctaggc

SEQ ID NO: 7954751 - DNA, 22 bp, Homo sapiens
gaggctgaacaggttctcatga

SEQ ID NO: 7954752 - DNA, 22 bp, Homo sapiens
gaggctgaacaggttctcatga

SEQ ID NO: 7954753 - DNA, 22 bp, Homo sapiens
gaggctgaacaggttctcatga

SEQ ID NO: 7954754 - DNA, 22 bp, Homo sapiens
gaggctgaagtgtacatgggtg

SEQ ID NO: 7954755 - DNA, 22 bp, Homo sapiens
gagaaagatgtaggctgggagg

SEQ ID NO: 7954756 - DNA, 22 bp, Homo sapiens
gagaaagatgtaggctgggagg

SEQ ID NO: 7954757 - DNA, 22 bp, Homo sapiens
gagaaagatgtaggctgggagg

SEQ ID NO: 7954758 - DNA, 22 bp, Homo sapiens
gagaaagatgtaggctgggagg

SEQ ID NO: 7954759 - DNA, 22 bp, Homo sapiens
gagaaagatgtaggctgggagg

SEQ ID NO: 7954760 - DNA, 22 bp, Homo sapiens
gagaaagatgtaggctgggagg

SEQ ID NO: 7954761 - DNA, 22 bp, Homo sapiens
gagaaagatgtaggctgggagg

SEQ ID NO: 7954762 - DNA, 22 bp, Homo sapiens
gagaaagatggaatcttacagg

SEQ ID NO: 7954763 - DNA, 22 bp, Homo sapiens
gagaaagatggaatcttacagg

SEQ ID NO: 7954764 - DNA, 22 bp, Homo sapiens
gagaaagattgtccttcagggg

SEQ ID NO: 7954765 - DNA, 22 bp, Homo sapiens
gagaaagattgtccttcagggg

SEQ ID NO: 7954766 - DNA, 22 bp, Homo sapiens
gagaaagattgtccttcagggg

SEQ ID NO: 7954767 - DNA, 22 bp, Homo sapiens
gagaaagatgtaggctgggagg

SEQ ID NO: 7954768 - DNA, 22 bp, Homo sapiens
gagaaagcttcagaaatggcct

SEQ ID NO: 7954769 - DNA, 22 bp, Homo sapiens
gagaaagcttcagaaatggcct

SEQ ID NO: 7954770 - DNA, 22 bp, Homo sapiens
gagaaagcttcagaaatggcct

SEQ ID NO: 7954771 - DNA, 22 bp, Homo sapiens
gagaaagctaataggaatccta

SEQ ID NO: 7954772 - DNA, 23 bp, Homo sapiens
gagaaagccggctatgatcctgg

SEQ ID NO: 7954773 - DNA, 22 bp, Homo sapiens
gagaaagctaaataagttgatt

SEQ ID NO: 7954774 - DNA, 22 bp, Homo sapiens
gagaaagctaaataagttgatt

SEQ ID NO: 7954775 - DNA, 18 bp, Homo sapiens
gagaaagcagggaatgtt

SEQ ID NO: 7954776 - DNA, 18 bp, Homo sapiens
gagaaagcagggaatgtt

SEQ ID NO: 7954777 - DNA, 19 bp, Homo sapiens
gagaaagcaggcacagcac

SEQ ID NO: 7954778 - DNA, 19 bp, Homo sapiens
gagaaagcaggcacagcac

SEQ ID NO: 7954779 - DNA, 19 bp, Homo sapiens
gagaaagcaggcacagcac

SEQ ID NO: 7954780 - DNA, 19 bp, Homo sapiens
gagaaagcaggcacagcac

SEQ ID NO: 7954781 - DNA, 23 bp, Homo sapiens
gagaccagggccagctgtgtcat

SEQ ID NO: 7954782 - DNA, 22 bp, Homo sapiens
gagaccaggaagtacagcagcc

SEQ ID NO: 7954783 - DNA, 22 bp, Homo sapiens
gagaccaggaagtacagcagcc

SEQ ID NO: 7954784 - DNA, 19 bp, Homo sapiens
gagacatgtagatagaaga

SEQ ID NO: 7954785 - DNA, 20 bp, Homo sapiens
gagacagcaaaagcctctcc

SEQ ID NO: 7954786 - DNA, 22 bp, Homo sapiens
gagacagatgctgctggagcat

SEQ ID NO: 7954787 - DNA, 22 bp, Homo sapiens
gagaaagcttctttcccacagg

SEQ ID NO: 7954788 - DNA, 22 bp, Homo sapiens
gagaaaggcatccttggcttca

SEQ ID NO: 7954789 - DNA, 22 bp, Homo sapiens
gagaaaggcattcctatgcaaa

SEQ ID NO: 7954790 - DNA, 22 bp, Homo sapiens
gagaaaggcattcctatgcaaa

SEQ ID NO: 7954791 - DNA, 22 bp, Homo sapiens
gagaaaggcattcctatgcaaa

SEQ ID NO: 7954792 - DNA, 22 bp, Homo sapiens
gagaaaggcattcctatgcaaa

SEQ ID NO: 7954793 - DNA, 22 bp, Homo sapiens
gagacagatgctgctggagcat

SEQ ID NO: 7954794 - DNA, 22 bp, Homo sapiens
gagacagatgctgctggagcat

SEQ ID NO: 7954795 - DNA, 22 bp, Homo sapiens
gagacagatgctgctggagcat

SEQ ID NO: 7954796 - DNA, 22 bp, Homo sapiens
gagacagatgctgctggagcat

SEQ ID NO: 7954797 - DNA, 22 bp, Homo sapiens
gagacagatgctgctggagcat

SEQ ID NO: 7954798 - DNA, 22 bp, Homo sapiens
gagacagatgctgctggagcat

SEQ ID NO: 7954799 - DNA, 22 bp, Homo sapiens
gagaaaggcattcctatgcaaa

SEQ ID NO: 7954800 - DNA, 22 bp, Homo sapiens
gagacagatgctgctggagcat

SEQ ID NO: 7954801 - DNA, 22 bp, Homo sapiens
gagaaaggcattcctatgcaaa

SEQ ID NO: 7954802 - DNA, 22 bp, Homo sapiens
gagaaaggcattcctatgcaaa

SEQ ID NO: 7954803 - DNA, 22 bp, Homo sapiens
gagaaagatgaagagtggcgtt

SEQ ID NO: 7954804 - DNA, 22 bp, Homo sapiens
gagaaagacgtaggctgggagg

SEQ ID NO: 7954805 - DNA, 22 bp, Homo sapiens
gagaaagatgaagagtggcgtt

SEQ ID NO: 7954806 - DNA, 22 bp, Homo sapiens
gagaaagatggaatcttacagg

SEQ ID NO: 7954807 - DNA, 22 bp, Homo sapiens
gagaaagatggaatcttacagg

SEQ ID NO: 7954808 - DNA, 22 bp, Homo sapiens
gagaaagatggaatcttacagg

SEQ ID NO: 7954809 - DNA, 22 bp, Homo sapiens
gagaaagacgtaggctgggagg

SEQ ID NO: 7954810 - DNA, 22 bp, Homo sapiens
gagaaagacgtaggctgggagg

SEQ ID NO: 7954811 - DNA, 22 bp, Homo sapiens
gagaaagacgtaggctgggagg

SEQ ID NO: 7954812 - DNA, 22 bp, Homo sapiens
gagaaagacgtaggctgggagg

SEQ ID NO: 7954813 - DNA, 22 bp, Homo sapiens
gagaaagacgtaggctgggagg

SEQ ID NO: 7954814 - DNA, 22 bp, Homo sapiens
gagaaagacgtaggctgggagg

SEQ ID NO: 7954815 - DNA, 22 bp, Homo sapiens
gagaaacctgtaaggaaggaag

SEQ ID NO: 7954816 - DNA, 18 bp, Homo sapiens
gagaaacctgtgaatgct

SEQ ID NO: 7954817 - DNA, 22 bp, Homo sapiens
gagaaactgttggaattttaat

SEQ ID NO: 7954818 - DNA, 22 bp, Homo sapiens
gagaaactaacatctgaaggtg

SEQ ID NO: 7954819 - DNA, 22 bp, Homo sapiens
gagaaacttggagttattctgg

SEQ ID NO: 7954820 - DNA, 22 bp, Homo sapiens
gagaaagaaagggaagtttgtt

SEQ ID NO: 7954821 - DNA, 22 bp, Homo sapiens
gagaaacttggagttattctgg

SEQ ID NO: 7954822 - DNA, 22 bp, Homo sapiens
gagaaagacgtaggctgggagg

SEQ ID NO: 7954823 - DNA, 22 bp, Homo sapiens
gagaaagaaagggaagtttgtt

SEQ ID NO: 7954824 - DNA, 22 bp, Homo sapiens
gagaaagaaagggaagtttgtt

SEQ ID NO: 7954825 - DNA, 22 bp, Homo sapiens
gactgcattcatttggttggca

SEQ ID NO: 7954826 - DNA, 22 bp, Homo sapiens
gactgcagtaagcctcatgact

SEQ ID NO: 7954827 - DNA, 22 bp, Homo sapiens
gactgcagtgaaggcacatggg

SEQ ID NO: 7954828 - DNA, 22 bp, Homo sapiens
gactgaggtgacctaggactac

SEQ ID NO: 7954829 - DNA, 22 bp, Homo sapiens
gactgaggtgacctaggactac

SEQ ID NO: 7954830 - DNA, 22 bp, Homo sapiens
gactgaggtgcccagaggtgac

SEQ ID NO: 7954831 - DNA, 22 bp, Homo sapiens
gactgaggtgacctaggactac

SEQ ID NO: 7954832 - DNA, 22 bp, Homo sapiens
gactgaggtgcccagaggtgac

SEQ ID NO: 7954833 - DNA, 22 bp, Homo sapiens
gactgaggtgcccagaggtgac

SEQ ID NO: 7954834 - DNA, 22 bp, Homo sapiens
gactgattgcctggaacaggaa

SEQ ID NO: 7954835 - DNA, 23 bp, Homo sapiens
gagaaacctcggtaagcaggagg

SEQ ID NO: 7954836 - DNA, 19 bp, Homo sapiens
gagaaaccccgtctttagg

SEQ ID NO: 7954837 - DNA, 22 bp, Homo sapiens
gagaaaccgattctgcatgtca

SEQ ID NO: 7954838 - DNA, 22 bp, Homo sapiens
gagaaacaggaattgagtcgct

SEQ ID NO: 7954839 - DNA, 22 bp, Homo sapiens
gagaaacaggaattgagtcgct

SEQ ID NO: 7954840 - DNA, 22 bp, Homo sapiens
gagaaacaggaattgagtcgct

SEQ ID NO: 7954841 - DNA, 22 bp, Homo sapiens
gagaaacaggaattgagtcgct

SEQ ID NO: 7954842 - DNA, 22 bp, Homo sapiens
gagaaacaggaattgagtcgct

SEQ ID NO: 7954843 - DNA, 22 bp, Homo sapiens
gagaaacactgttagtttatta

SEQ ID NO: 7954844 - DNA, 22 bp, Homo sapiens
gagaaacactgttagtttatta

SEQ ID NO: 7954845 - DNA, 22 bp, Homo sapiens
gagaaacactgttagtttatta

SEQ ID NO: 7954846 - DNA, 22 bp, Homo sapiens
gagaaacactgttagtttatta

SEQ ID NO: 7954847 - DNA, 22 bp, Homo sapiens
gagaaacactgttagtttatta

SEQ ID NO: 7954848 - DNA, 22 bp, Homo sapiens
gagactgctggtaaagatggga

SEQ ID NO: 7954849 - DNA, 22 bp, Homo sapiens
gagactgcatagatggccacaa

SEQ ID NO: 7954850 - DNA, 22 bp, Homo sapiens
gagactgcattgtccaagggtt

SEQ ID NO: 7954851 - DNA, 22 bp, Homo sapiens
gagactgggggcttggcctttt

SEQ ID NO: 7954852 - DNA, 22 bp, Homo sapiens
gagactgggggcttggcctttt

SEQ ID NO: 7954853 - DNA, 22 bp, Homo sapiens
gagacgtggcctttgcctgagc

SEQ ID NO: 7954854 - DNA, 22 bp, Homo sapiens
gagacgtggcctttgcctgagc

SEQ ID NO: 7954855 - DNA, 22 bp, Homo sapiens
gagacgtggcctttgcctgagc

SEQ ID NO: 7954856 - DNA, 22 bp, Homo sapiens
gagactgatggggctcccagaa

SEQ ID NO: 7954857 - DNA, 22 bp, Homo sapiens
gagactcttgctttaatagccc

SEQ ID NO: 7954858 - DNA, 22 bp, Homo sapiens
gagacctcttggtatcgctagg

SEQ ID NO: 7954859 - DNA, 22 bp, Homo sapiens
gagacctcttggtatcgctagg

SEQ ID NO: 7954860 - DNA, 22 bp, Homo sapiens
gagacctgcagctgtagtctgc

SEQ ID NO: 7954861 - DNA, 22 bp, Homo sapiens
gagacctggaggatgtggatgg

SEQ ID NO: 7954862 - DNA, 22 bp, Homo sapiens
gagaccttaagagatgtcagct

SEQ ID NO: 7954863 - DNA, 22 bp, Homo sapiens
gagaccttaagagatgtcagct

SEQ ID NO: 7954864 - DNA, 22 bp, Homo sapiens
gagacctcttggtatcgctagg

SEQ ID NO: 7954865 - DNA, 22 bp, Homo sapiens
gagacctcttggtatcgctagg

SEQ ID NO: 7954866 - DNA, 17 bp, Homo sapiens
gagacccccactacacc

SEQ ID NO: 7954867 - DNA, 22 bp, Homo sapiens
gagacccaggggtctgctgccc

SEQ ID NO: 7954868 - DNA, 22 bp, Homo sapiens
gagagaaaagggggaattgatt

SEQ ID NO: 7954869 - DNA, 22 bp, Homo sapiens
gagagaaagcccctgcatccct

SEQ ID NO: 7954870 - DNA, 22 bp, Homo sapiens
gagagaaagcccctgcatccct

SEQ ID NO: 7954871 - DNA, 22 bp, Homo sapiens
gagagaaagcccctgcatccct

SEQ ID NO: 7954872 - DNA, 22 bp, Homo sapiens
gagagaaagcccctgcatccct

SEQ ID NO: 7954873 - DNA, 22 bp, Homo sapiens
gagagaaaagggggaattgatt

SEQ ID NO: 7954874 - DNA, 22 bp, Homo sapiens
gagagaaaacaagttctccatt

SEQ ID NO: 7954875 - DNA, 22 bp, Homo sapiens
gagagaaaagggggaattgatt

SEQ ID NO: 7954876 - DNA, 22 bp, Homo sapiens
gagagaaaggataacagctcaa

SEQ ID NO: 7954877 - DNA, 22 bp, Homo sapiens
gagagaaaggataacagctcaa

SEQ ID NO: 7954878 - DNA, 22 bp, Homo sapiens
gagagaaagcccctgcatccct

SEQ ID NO: 7954879 - DNA, 22 bp, Homo sapiens
gagagaaagcccctgcatccct

SEQ ID NO: 7954880 - DNA, 22 bp, Homo sapiens
gagagaaaggataacagctcaa

SEQ ID NO: 7954881 - DNA, 22 bp, Homo sapiens
gagagaaaggcttgcaggctgt

SEQ ID NO: 7954882 - DNA, 22 bp, Homo sapiens
gagagaaaaatgagcttcattg

SEQ ID NO: 7954883 - DNA, 22 bp, Homo sapiens
gagagaaaaatgagcttcattg

SEQ ID NO: 7954884 - DNA, 22 bp, Homo sapiens
gagagaaaaatgagcttcattg

SEQ ID NO: 7954885 - DNA, 22 bp, Homo sapiens
gagactttaaaaaacattaaga

SEQ ID NO: 7954886 - DNA, 22 bp, Homo sapiens
gagagaaaaatgagcttcattg

SEQ ID NO: 7954887 - DNA, 22 bp, Homo sapiens
gagagaaaacaagttctccatt

SEQ ID NO: 7954888 - DNA, 22 bp, Homo sapiens
gagactggtgtttgctgggctg

SEQ ID NO: 7954889 - DNA, 22 bp, Homo sapiens
gagactggtgtttgctgggctg

SEQ ID NO: 7954890 - DNA, 22 bp, Homo sapiens
gagactggtgtttgctgggctg

SEQ ID NO: 7954891 - DNA, 22 bp, Homo sapiens
gagactggtgtttgctgggctg

SEQ ID NO: 7954892 - DNA, 22 bp, Homo sapiens
gagactggtgtttgctgggctg

SEQ ID NO: 7954893 - DNA, 22 bp, Homo sapiens
gagactggtgtttgctgggctg

SEQ ID NO: 7954894 - DNA, 22 bp, Homo sapiens
gagactgtaagctccttgagga

SEQ ID NO: 7954895 - DNA, 22 bp, Homo sapiens
gagacttaggcaagtcacttag

SEQ ID NO: 7954896 - DNA, 22 bp, Homo sapiens
gagacttagagctccttgaggg

SEQ ID NO: 7954897 - DNA, 22 bp, Homo sapiens
gagagggcaaggtagatgctac

SEQ ID NO: 7954898 - DNA, 21 bp, Homo sapiens
gagagggcattataggaagtg

SEQ ID NO: 7954899 - DNA, 21 bp, Homo sapiens
gagagggcattataggaagtg

SEQ ID NO: 7954900 - DNA, 21 bp, Homo sapiens
gagagggcattataggaagtg

SEQ ID NO: 7954901 - DNA, 22 bp, Homo sapiens
gagagggcaaggtagatgctac

SEQ ID NO: 7954902 - DNA, 22 bp, Homo sapiens
gagagggcaaacttgtagctaa

SEQ ID NO: 7954903 - DNA, 22 bp, Homo sapiens
gagagggcaaggtagatgctac

SEQ ID NO: 7954904 - DNA, 22 bp, Homo sapiens
gagagggcaaggtagatgctac

SEQ ID NO: 7954905 - DNA, 21 bp, Homo sapiens
gagagggcattataggaagtg

SEQ ID NO: 7954906 - DNA, 21 bp, Homo sapiens
gagagggcattataggaagtg

SEQ ID NO: 7954907 - DNA, 21 bp, Homo sapiens
gagagggcattataggaagtg

SEQ ID NO: 7954908 - DNA, 21 bp, Homo sapiens
gagagggcattataggaagtg

SEQ ID NO: 7954909 - DNA, 21 bp, Homo sapiens
gagagggcattataggaagtg

SEQ ID NO: 7954910 - DNA, 21 bp, Homo sapiens
gagagggcattataggaagtg

SEQ ID NO: 7954911 - DNA, 22 bp, Homo sapiens
gagagggccagggtgagaacta

SEQ ID NO: 7954912 - DNA, 22 bp, Homo sapiens
gagagggccagggtgagaacta

SEQ ID NO: 7954913 - DNA, 22 bp, Homo sapiens
gagagggccagggtgagaacta

SEQ ID NO: 7954914 - DNA, 22 bp, Homo sapiens
gagagggccagggtgagaacta

SEQ ID NO: 7954915 - DNA, 22 bp, Homo sapiens
gagagggccgggggccagctcc

SEQ ID NO: 7954916 - DNA, 22 bp, Homo sapiens
gagagggccgggggccagctcc

SEQ ID NO: 7954917 - DNA, 22 bp, Homo sapiens
gagagggccagggtgagaacta

SEQ ID NO: 7954918 - DNA, 22 bp, Homo sapiens
gagagggccgggggccagctcc

SEQ ID NO: 7954919 - DNA, 22 bp, Homo sapiens
gagagggccgggggccagctcc

SEQ ID NO: 7954920 - DNA, 22 bp, Homo sapiens
gagagggccgggggccagctcc

SEQ ID NO: 7954921 - DNA, 22 bp, Homo sapiens
gagagggccgggggccagctcc

SEQ ID NO: 7954922 - DNA, 22 bp, Homo sapiens
gagagggccgggggccagctcc

SEQ ID NO: 7954923 - DNA, 22 bp, Homo sapiens
gagagggctctgtgtgggtact

SEQ ID NO: 7954924 - DNA, 22 bp, Homo sapiens
gagagggctctgtgtgggtact

SEQ ID NO: 7954925 - DNA, 22 bp, Homo sapiens
gagagggctctgtgtgggtact

SEQ ID NO: 7954926 - DNA, 22 bp, Homo sapiens
gagagggctctgtgtgggtact

SEQ ID NO: 7954927 - DNA, 22 bp, Homo sapiens
gagagggctctgtgtgggtact

SEQ ID NO: 7954928 - DNA, 22 bp, Homo sapiens
gagagggctgcctggtgtgagg

SEQ ID NO: 7954929 - DNA, 22 bp, Homo sapiens
gagagaaattagttggtttgct

SEQ ID NO: 7954930 - DNA, 22 bp, Homo sapiens
gagagaaattagttggtttgct

SEQ ID NO: 7954931 - DNA, 22 bp, Homo sapiens
gagagaaattagttggtttgct

SEQ ID NO: 7954932 - DNA, 22 bp, Homo sapiens
gagagaaattagttggtttgct

SEQ ID NO: 7954933 - DNA, 22 bp, Homo sapiens
gagagaaatgtgcagtttgggc

SEQ ID NO: 7954934 - DNA, 22 bp, Homo sapiens
gagagaaatgtgcagtttgggc

SEQ ID NO: 7954935 - DNA, 22 bp, Homo sapiens
gagagaaatgtgcagtttgggc

SEQ ID NO: 7954936 - DNA, 22 bp, Homo sapiens
gagagaaatgtgcagtttgggc

SEQ ID NO: 7954937 - DNA, 22 bp, Homo sapiens
gagagaaaggcttgcaggctgt

SEQ ID NO: 7954938 - DNA, 22 bp, Homo sapiens
gagagaaaggcttgcaggctgt

SEQ ID NO: 7954939 - DNA, 22 bp, Homo sapiens
gagagaaaggcttgcaggctgt

SEQ ID NO: 7954940 - DNA, 22 bp, Homo sapiens
gagagaacacaaagggccagct

SEQ ID NO: 7954941 - DNA, 22 bp, Homo sapiens
gagagaacacaaagggccagct

SEQ ID NO: 7954942 - DNA, 22 bp, Homo sapiens
gagagaacacaaagggccagct

SEQ ID NO: 7954943 - DNA, 22 bp, Homo sapiens
gagagaaccctaaatgagatat

SEQ ID NO: 7954944 - DNA, 22 bp, Homo sapiens
gagagaagaaagccatggtcct

SEQ ID NO: 7954945 - DNA, 18 bp, Homo sapiens
gagagggatccctcagga

SEQ ID NO: 7954946 - DNA, 18 bp, Homo sapiens
gagagggatccctcagga

SEQ ID NO: 7954947 - DNA, 18 bp, Homo sapiens
gagagggatccctcagga

SEQ ID NO: 7954948 - DNA, 22 bp, Homo sapiens
gagagggcaaacttgtagctaa

SEQ ID NO: 7954949 - DNA, 22 bp, Homo sapiens
gagagggcaaacttgtagctaa

SEQ ID NO: 7954950 - DNA, 22 bp, Homo sapiens
gagagggcaaacttgtagctaa

SEQ ID NO: 7954951 - DNA, 22 bp, Homo sapiens
gacagcagacaaaccatgtttt

SEQ ID NO: 7954952 - DNA, 22 bp, Homo sapiens
gacagcagacaaaccatgtttt

SEQ ID NO: 7954953 - DNA, 22 bp, Homo sapiens
gacagcagacaaaccatgtttt

SEQ ID NO: 7954954 - DNA, 22 bp, Homo sapiens
gacagcagacaaaccatgtttt

SEQ ID NO: 7954955 - DNA, 22 bp, Homo sapiens
gacagcagaaaacttttgtgct

SEQ ID NO: 7954956 - DNA, 22 bp, Homo sapiens
gacagcagaaaacttttgtgct

SEQ ID NO: 7954957 - DNA, 22 bp, Homo sapiens
gacagcaatgacggggcagctg

SEQ ID NO: 7954958 - DNA, 22 bp, Homo sapiens
gacagcagaaaacttttgtgct

SEQ ID NO: 7954959 - DNA, 22 bp, Homo sapiens
gacagcagacagaactacctgc

SEQ ID NO: 7954960 - DNA, 22 bp, Homo sapiens
gacagcagacagaactacctgc

SEQ ID NO: 7954961 - DNA, 22 bp, Homo sapiens
gacagcagacagaactacctgc

SEQ ID NO: 7954962 - DNA, 22 bp, Homo sapiens
gacagcagacagcctggcccct

SEQ ID NO: 7954963 - DNA, 22 bp, Homo sapiens
gacagcagacagcctggcccct

SEQ ID NO: 7954964 - DNA, 22 bp, Homo sapiens
gacagcagacagcctggcccct

SEQ ID NO: 7954965 - DNA, 22 bp, Homo sapiens
gacagcagacagcctggcccct

SEQ ID NO: 7954966 - DNA, 22 bp, Homo sapiens
gacagcagagcagactaatgga

SEQ ID NO: 7954967 - DNA, 22 bp, Homo sapiens
gacagcagacagcctggcccct

SEQ ID NO: 7954968 - DNA, 22 bp, Homo sapiens
gacagaggagaagatgctgtgg

SEQ ID NO: 7954969 - DNA, 22 bp, Homo sapiens
gacagaggagaagatgctgtgg

SEQ ID NO: 7954970 - DNA, 22 bp, Homo sapiens
gacagaggagaagatgctgtgg

SEQ ID NO: 7954971 - DNA, 22 bp, Homo sapiens
gacagaggcaagaccagaagcc

SEQ ID NO: 7954972 - DNA, 22 bp, Homo sapiens
gacagaggcaagaccagaagcc

SEQ ID NO: 7954973 - DNA, 22 bp, Homo sapiens
gacagaggcaagaccagaagcc

SEQ ID NO: 7954974 - DNA, 22 bp, Homo sapiens
gacagcaagagacagagcatcc

SEQ ID NO: 7954975 - DNA, 22 bp, Homo sapiens
gacagcaagagacagagcatcc

SEQ ID NO: 7954976 - DNA, 22 bp, Homo sapiens
gacagagctgctctagattctg

SEQ ID NO: 7954977 - DNA, 22 bp, Homo sapiens
gacagagctgctctagattctg

SEQ ID NO: 7954978 - DNA, 22 bp, Homo sapiens
gacagaggagaagatgctgtgg

SEQ ID NO: 7954979 - DNA, 22 bp, Homo sapiens
gacagagccagttggaggtagg

SEQ ID NO: 7954980 - DNA, 22 bp, Homo sapiens
gacagagcagcacccagcccct

SEQ ID NO: 7954981 - DNA, 22 bp, Homo sapiens
gacagagattgaatcaggaaat

SEQ ID NO: 7954982 - DNA, 22 bp, Homo sapiens
gacagagattgaatcaggaaat

SEQ ID NO: 7954983 - DNA, 22 bp, Homo sapiens
gacagacatgggacttcatact

SEQ ID NO: 7954984 - DNA, 22 bp, Homo sapiens
gacagacatgggacttcatact

SEQ ID NO: 7954985 - DNA, 22 bp, Homo sapiens
gacagacatgggacttcatact

SEQ ID NO: 7954986 - DNA, 22 bp, Homo sapiens
gacagacatgggacttcatact

SEQ ID NO: 7954987 - DNA, 22 bp, Homo sapiens
gacagacatttcctgatccaat

SEQ ID NO: 7954988 - DNA, 22 bp, Homo sapiens
gacagacatttcctgatccaat

SEQ ID NO: 7954989 - DNA, 22 bp, Homo sapiens
gacagacatttcctgatccaat

SEQ ID NO: 7954990 - DNA, 22 bp, Homo sapiens
gacagactgcgtagtccccaaa

SEQ ID NO: 7954991 - DNA, 22 bp, Homo sapiens
gacagagaggctgagcagtaca

SEQ ID NO: 7954992 - DNA, 22 bp, Homo sapiens
gacagagaggctgagcagtaca

SEQ ID NO: 7954993 - DNA, 22 bp, Homo sapiens
gacagagaggctgagcagtaca

SEQ ID NO: 7954994 - DNA, 22 bp, Homo sapiens
gacagagaggctgagcagtaca

SEQ ID NO: 7954995 - DNA, 22 bp, Homo sapiens
gacagagaggctgagcagtaca

SEQ ID NO: 7954996 - DNA, 22 bp, Homo sapiens
gacatttactgaatactgatta

SEQ ID NO: 7954997 - DNA, 22 bp, Homo sapiens
gacatttagaagtctaatggcc

SEQ ID NO: 7954998 - DNA, 22 bp, Homo sapiens
gacatttactgaatactgatta

SEQ ID NO: 7954999 - DNA, 22 bp, Homo sapiens
gacatttactgaatactgatta

SEQ ID NO: 7955000 - DNA, 22 bp, Homo sapiens
gacatttaaggcagtcacttaa

SEQ ID NO: 7955001 - DNA, 22 bp, Homo sapiens
gacatttaaggcagtcacttaa

SEQ ID NO: 7955002 - DNA, 22 bp, Homo sapiens
gacatttaaggcagtcacttaa

SEQ ID NO: 7955003 - DNA, 22 bp, Homo sapiens
gacatttaaattgcaggcagcc

SEQ ID NO: 7955004 - DNA, 20 bp, Homo sapiens
gacattgtaattaatgatga

SEQ ID NO: 7955005 - DNA, 22 bp, Homo sapiens
gacattgctcggaaattagtgt

SEQ ID NO: 7955006 - DNA, 15 bp, Homo sapiens
gacattgctttgcag

SEQ ID NO: 7955007 - DNA, 22 bp, Homo sapiens
gacattgaagtatttttgtcga

SEQ ID NO: 7955008 - DNA, 22 bp, Homo sapiens
gacattctgtcaatgttgactc

SEQ ID NO: 7955009 - DNA, 22 bp, Homo sapiens
gacattctgtgactctgaacag

SEQ ID NO: 7955010 - DNA, 21 bp, Homo sapiens
gacattgcatggtggcctctt

SEQ ID NO: 7955011 - DNA, 22 bp, Homo sapiens
gacagcagatgaagcctgcaga

SEQ ID NO: 7955012 - DNA, 22 bp, Homo sapiens
gacagcagatgaagcctgcaga

SEQ ID NO: 7955013 - DNA, 22 bp, Homo sapiens
gacagcagatgaagcctgcaga

SEQ ID NO: 7955014 - DNA, 22 bp, Homo sapiens
gacagcagatgaagcctgcaga

SEQ ID NO: 7955015 - DNA, 22 bp, Homo sapiens
gacagcagatgaagcctgcaga

SEQ ID NO: 7955016 - DNA, 22 bp, Homo sapiens
gacagcagataagacctcatca

SEQ ID NO: 7955017 - DNA, 22 bp, Homo sapiens
gacagcagataagacctcatca

SEQ ID NO: 7955018 - DNA, 22 bp, Homo sapiens
gacagcagatactttcattgaa

SEQ ID NO: 7955019 - DNA, 22 bp, Homo sapiens
gacagcagatactttcattgaa

SEQ ID NO: 7955020 - DNA, 22 bp, Homo sapiens
gacagcagatgaagcctgcaga

SEQ ID NO: 7955021 - DNA, 22 bp, Homo sapiens
gacagcagatgaagcctgcaga

SEQ ID NO: 7955022 - DNA, 22 bp, Homo sapiens
gacagcagcataatacatgaac

SEQ ID NO: 7955023 - DNA, 22 bp, Homo sapiens
gacagcagcataatacatgaac

SEQ ID NO: 7955024 - DNA, 22 bp, Homo sapiens
gacagcagcatgtttacaggcc

SEQ ID NO: 7955025 - DNA, 22 bp, Homo sapiens
gacagcagcatgtttacaggcc

SEQ ID NO: 7955026 - DNA, 22 bp, Homo sapiens
gacattctaaaaaatatggaag

SEQ ID NO: 7955027 - DNA, 22 bp, Homo sapiens
gacattctaaaaaatatggaag

SEQ ID NO: 7955028 - DNA, 19 bp, Homo sapiens
gacattcctgacactggct

SEQ ID NO: 7955029 - DNA, 22 bp, Homo sapiens
gacagcagcatgtttacaggcc

SEQ ID NO: 7955030 - DNA, 22 bp, Homo sapiens
gacattcagactcacatggagg

SEQ ID NO: 7955031 - DNA, 22 bp, Homo sapiens
gacatttagaagttagattcaa

SEQ ID NO: 7955032 - DNA, 22 bp, Homo sapiens
gacatttagaagttagattcaa

SEQ ID NO: 7955033 - DNA, 22 bp, Homo sapiens
gacatttagctgttttgcattt

SEQ ID NO: 7955034 - DNA, 22 bp, Homo sapiens
gacatttagctgttttgcattt

SEQ ID NO: 7955035 - DNA, 22 bp, Homo sapiens
gaccacagctacaagggcaagg

SEQ ID NO: 7955036 - DNA, 22 bp, Homo sapiens
gaccacagctacaagggcaagg

SEQ ID NO: 7955037 - DNA, 22 bp, Homo sapiens
gaccacagctacaagggcaagg

SEQ ID NO: 7955038 - DNA, 22 bp, Homo sapiens
gaccacagcagtgcaagaggag

SEQ ID NO: 7955039 - DNA, 22 bp, Homo sapiens
gaccacagctacaagggcaagg

SEQ ID NO: 7955040 - DNA, 22 bp, Homo sapiens
gaccacaggtatgggcttggca

SEQ ID NO: 7955041 - DNA, 22 bp, Homo sapiens
gaccacaggtatgggcttggca

SEQ ID NO: 7955042 - DNA, 21 bp, Homo sapiens
gaccacagggaaggtcttgca

SEQ ID NO: 7955043 - DNA, 21 bp, Homo sapiens
gaccacagggaaggtcttgca

SEQ ID NO: 7955044 - DNA, 21 bp, Homo sapiens
gaccacagggaaggtcttgca

SEQ ID NO: 7955045 - DNA, 22 bp, Homo sapiens
gaccacaggtatgggcttggca

SEQ ID NO: 7955046 - DNA, 22 bp, Homo sapiens
gaccactggcgctgcgagaccc

SEQ ID NO: 7955047 - DNA, 22 bp, Homo sapiens
gaccactggggtgagggccatc

SEQ ID NO: 7955048 - DNA, 22 bp, Homo sapiens
gaccacagtccagtcatcatgg

SEQ ID NO: 7955049 - DNA, 22 bp, Homo sapiens
gaccactgaatgcacttctaat

SEQ ID NO: 7955050 - DNA, 22 bp, Homo sapiens
gaccactgatgacatgaggaga

SEQ ID NO: 7955051 - DNA, 22 bp, Homo sapiens
gaccagaaggaaatgtgagcag

SEQ ID NO: 7955052 - DNA, 22 bp, Homo sapiens
gaccagaatctggactctgatt

SEQ ID NO: 7955053 - DNA, 22 bp, Homo sapiens
gaccagaaggaaatgtgagcag

SEQ ID NO: 7955054 - DNA, 22 bp, Homo sapiens
gaccagaaagtcatgagtcagt

SEQ ID NO: 7955055 - DNA, 22 bp, Homo sapiens
gaccactggggtgagggccatc

SEQ ID NO: 7955056 - DNA, 22 bp, Homo sapiens
gaccactggggtgagggccatc

SEQ ID NO: 7955057 - DNA, 22 bp, Homo sapiens
gaccagagaaaggcactggaag

SEQ ID NO: 7955058 - DNA, 22 bp, Homo sapiens
gaccagagaaaggcactggaag

SEQ ID NO: 7955059 - DNA, 22 bp, Homo sapiens
gaccagagaaaggcactggaag

SEQ ID NO: 7955060 - DNA, 22 bp, Homo sapiens
gaccagagaaaggcactggaag

SEQ ID NO: 7955061 - DNA, 22 bp, Homo sapiens
gaccaggacacagtggcaaggt

SEQ ID NO: 7955062 - DNA, 22 bp, Homo sapiens
gaccaggaagggtttctgggat

SEQ ID NO: 7955063 - DNA, 22 bp, Homo sapiens
gaccaggacacagtggcaaggt

SEQ ID NO: 7955064 - DNA, 22 bp, Homo sapiens
gaccaggagatttgagctaggc

SEQ ID NO: 7955065 - DNA, 17 bp, Homo sapiens
gaccaggagaaaccagg

SEQ ID NO: 7955066 - DNA, 22 bp, Homo sapiens
gaccaggagatttgagctaggc

SEQ ID NO: 7955067 - DNA, 22 bp, Homo sapiens
gaccaggagatttgagctaggc

SEQ ID NO: 7955068 - DNA, 22 bp, Homo sapiens
gaccaggcccaggtgcaaggga

SEQ ID NO: 7955069 - DNA, 22 bp, Homo sapiens
gaccaggctagttcagagcttc

SEQ ID NO: 7955070 - DNA, 22 bp, Homo sapiens
gaccaggctagttcagagcttc

SEQ ID NO: 7955071 - DNA, 22 bp, Homo sapiens
gaccagctctctgaagaaagag

SEQ ID NO: 7955072 - DNA, 22 bp, Homo sapiens
gaccagatgcaacaacttatcc

SEQ ID NO: 7955073 - DNA, 22 bp, Homo sapiens
gaccagctggtcctgtcctggg

SEQ ID NO: 7955074 - DNA, 22 bp, Homo sapiens
gaccaggaaagagtgtgactaa

SEQ ID NO: 7955075 - DNA, 22 bp, Homo sapiens
gaccaggaaagagtgtgactaa

SEQ ID NO: 7955076 - DNA, 22 bp, Homo sapiens
gactccaggtgcaggaggagcc

SEQ ID NO: 7955077 - DNA, 22 bp, Homo sapiens
gactccagggattggaagatgt

SEQ ID NO: 7955078 - DNA, 22 bp, Homo sapiens
gactccaggtgtccaggcctcc

SEQ ID NO: 7955079 - DNA, 22 bp, Homo sapiens
gaccaggctgttccagtctaac

SEQ ID NO: 7955080 - DNA, 22 bp, Homo sapiens
gactccagggattggaagatgt

SEQ ID NO: 7955081 - DNA, 22 bp, Homo sapiens
gactcccctgggccccatccag

SEQ ID NO: 7955082 - DNA, 22 bp, Homo sapiens
gactcctcagtcaccctcagct

SEQ ID NO: 7955083 - DNA, 22 bp, Homo sapiens
gactccagtgattgtcctgtct

SEQ ID NO: 7955084 - DNA, 22 bp, Homo sapiens
gaccaggctagttcagagcttc

SEQ ID NO: 7955085 - DNA, 22 bp, Homo sapiens
gactgaggaggtaaggtttgaa

SEQ ID NO: 7955086 - DNA, 22 bp, Homo sapiens
gactgaggcctttattgagaca

SEQ ID NO: 7955087 - DNA, 22 bp, Homo sapiens
gactgagaatcatagaaggcaa

SEQ ID NO: 7955088 - DNA, 22 bp, Homo sapiens
gactgagaatcatagaaggcaa

SEQ ID NO: 7955089 - DNA, 22 bp, Homo sapiens
gactgagaatcatagaaggcaa

SEQ ID NO: 7955090 - DNA, 22 bp, Homo sapiens
gactgagaatcatagaaggcaa

SEQ ID NO: 7955091 - DNA, 22 bp, Homo sapiens
gactgaaggtctcagcatgtga

SEQ ID NO: 7955092 - DNA, 22 bp, Homo sapiens
gactgagaaacagtacattacc

SEQ ID NO: 7955093 - DNA, 22 bp, Homo sapiens
gactgagaatcatagaaggcaa

SEQ ID NO: 7955094 - DNA, 22 bp, Homo sapiens
gactctttcaaacagaaagcca

SEQ ID NO: 7955095 - DNA, 22 bp, Homo sapiens
gactgaaggtctcagcatgtga

SEQ ID NO: 7955096 - DNA, 22 bp, Homo sapiens
gactgagaaacagtacattacc

SEQ ID NO: 7955097 - DNA, 22 bp, Homo sapiens
gactgaaggtctcagcatgtga

SEQ ID NO: 7955098 - DNA, 22 bp, Homo sapiens
gactgaggtattaagatggctt

SEQ ID NO: 7955099 - DNA, 22 bp, Homo sapiens
gactgaggtattaagatggctt

SEQ ID NO: 7955100 - DNA, 17 bp, Homo sapiens
gactgaggtaaggtgag

SEQ ID NO: 7955101 - DNA, 22 bp, Homo sapiens
gactgaggctcccctaggctca

SEQ ID NO: 7955102 - DNA, 22 bp, Homo sapiens
gactgagggacagggcagtgga

SEQ ID NO: 7955103 - DNA, 22 bp, Homo sapiens
gactgagggatagaggtgcttc

SEQ ID NO: 7955104 - DNA, 22 bp, Homo sapiens
gactgagggatagaggtgcttc

SEQ ID NO: 7955105 - DNA, 22 bp, Homo sapiens
gactcctctctaacccactgga

SEQ ID NO: 7955106 - DNA, 22 bp, Homo sapiens
gactcctgggcctctgagaggc

SEQ ID NO: 7955107 - DNA, 22 bp, Homo sapiens
gactcccctgggccccatccag

SEQ ID NO: 7955108 - DNA, 22 bp, Homo sapiens
gactcgctcccttttgtcttat

SEQ ID NO: 7955109 - DNA, 22 bp, Homo sapiens
gactctgctacaggccgaggtt

SEQ ID NO: 7955110 - DNA, 22 bp, Homo sapiens
gactctcaagcacaagtccacc

SEQ ID NO: 7955111 - DNA, 22 bp, Homo sapiens
gactctccattagtctttggta

SEQ ID NO: 7955112 - DNA, 22 bp, Homo sapiens
gactctgggctgagccagggcc

SEQ ID NO: 7955113 - DNA, 22 bp, Homo sapiens
gactctgggctgagccagggcc

SEQ ID NO: 7955114 - DNA, 22 bp, Homo sapiens
gactctgggctgagccagggcc

SEQ ID NO: 7955115 - DNA, 22 bp, Homo sapiens
gactctgggagtttatgtgatt

SEQ ID NO: 7955116 - DNA, 22 bp, Homo sapiens
gactctgggaggtggactgagg

SEQ ID NO: 7955117 - DNA, 22 bp, Homo sapiens
gactctggcctcatccctgagg

SEQ ID NO: 7955118 - DNA, 21 bp, Homo sapiens
gactctggggtcagctcaacc

SEQ ID NO: 7955119 - DNA, 22 bp, Homo sapiens
gactctggtgacttgacctgta

SEQ ID NO: 7955120 - DNA, 22 bp, Homo sapiens
gactctggtgacttgacctgta

SEQ ID NO: 7955121 - DNA, 22 bp, Homo sapiens
gactctggttgcgggttctgct

SEQ ID NO: 7955122 - DNA, 22 bp, Homo sapiens
gactctggtgtcagaagtgccc

SEQ ID NO: 7955123 - DNA, 22 bp, Homo sapiens
gaatattttcagtacagatggt

SEQ ID NO: 7955124 - DNA, 22 bp, Homo sapiens
gaatatttgtaattactgttga

SEQ ID NO: 7955125 - DNA, 22 bp, Homo sapiens
gaatatttgtaattactgttga

SEQ ID NO: 7955126 - DNA, 22 bp, Homo sapiens
gaatccagggttgtttgagcta

SEQ ID NO: 7955127 - DNA, 22 bp, Homo sapiens
gaatccagggttgtttgagcta

SEQ ID NO: 7955128 - DNA, 22 bp, Homo sapiens
gaatccagggtgtttgctgagg

SEQ ID NO: 7955129 - DNA, 22 bp, Homo sapiens
gaatccagggtgtttgctgagg

SEQ ID NO: 7955130 - DNA, 22 bp, Homo sapiens
gaatccagatttttctcttatt

SEQ ID NO: 7955131 - DNA, 22 bp, Homo sapiens
gaatccagatttttctcttatt

SEQ ID NO: 7955132 - DNA, 22 bp, Homo sapiens
gaatccaggacggtcgtgggtt

SEQ ID NO: 7955133 - DNA, 22 bp, Homo sapiens
gaatccaggacggtcgtgggtt

SEQ ID NO: 7955134 - DNA, 22 bp, Homo sapiens
gaatcatttatttttgacagca

SEQ ID NO: 7955135 - DNA, 22 bp, Homo sapiens
gaatatttgtaattactgttga

SEQ ID NO: 7955136 - DNA, 22 bp, Homo sapiens
gaatatttgtaattactgttga

SEQ ID NO: 7955137 - DNA, 22 bp, Homo sapiens
gaatatttgtaattactgttga

SEQ ID NO: 7955138 - DNA, 22 bp, Homo sapiens
gaatatttgtaattactgttga

SEQ ID NO: 7955139 - DNA, 22 bp, Homo sapiens
gaatatttgtaattactgttga

SEQ ID NO: 7955140 - DNA, 22 bp, Homo sapiens
gaatatttgtaattactgttga

SEQ ID NO: 7955141 - DNA, 22 bp, Homo sapiens
gaaggtttgaaataggtataga

SEQ ID NO: 7955142 - DNA, 22 bp, Homo sapiens
gaaggtgtctggcccagagtct

SEQ ID NO: 7955143 - DNA, 22 bp, Homo sapiens
gaatctatgcctcatatagacc

SEQ ID NO: 7955144 - DNA, 22 bp, Homo sapiens
gaatctatgcctcatatagacc

SEQ ID NO: 7955145 - DNA, 22 bp, Homo sapiens
gaatctcaaattaagaatttta

SEQ ID NO: 7955146 - DNA, 22 bp, Homo sapiens
gaatctcaaattaagaatttta

SEQ ID NO: 7955147 - DNA, 22 bp, Homo sapiens
gaatctcaggaagatctctgca

SEQ ID NO: 7955148 - DNA, 22 bp, Homo sapiens
gaatctcaggaagatctctgca

SEQ ID NO: 7955149 - DNA, 22 bp, Homo sapiens
gaatctcaggggagttactgga

SEQ ID NO: 7955150 - DNA, 22 bp, Homo sapiens
gaatctcaaggcttgtgaggat

SEQ ID NO: 7955151 - DNA, 22 bp, Homo sapiens
gaatctcaaattaagaatttta

SEQ ID NO: 7955152 - DNA, 22 bp, Homo sapiens
gaatctcaggaagatctctgca

SEQ ID NO: 7955153 - DNA, 22 bp, Homo sapiens
gaatctcaggaagatctctgca

SEQ ID NO: 7955154 - DNA, 22 bp, Homo sapiens
gaatctaaaaacgggcttggtt

SEQ ID NO: 7955155 - DNA, 22 bp, Homo sapiens
gaatctagggcctagatcacag

SEQ ID NO: 7955156 - DNA, 22 bp, Homo sapiens
gaatcccttgcattatcccttt

SEQ ID NO: 7955157 - DNA, 22 bp, Homo sapiens
gaatcccttgcaagttgttgta

SEQ ID NO: 7955158 - DNA, 22 bp, Homo sapiens
gaatcccttgcaagttgttgta

SEQ ID NO: 7955159 - DNA, 22 bp, Homo sapiens
gaatccctaagatttttataaa

SEQ ID NO: 7955160 - DNA, 22 bp, Homo sapiens
gaatccatcatgcagaacaatg

SEQ ID NO: 7955161 - DNA, 22 bp, Homo sapiens
gaatctgtcacttggccactct

SEQ ID NO: 7955162 - DNA, 22 bp, Homo sapiens
gaatcttaaatcggaatcttaa

SEQ ID NO: 7955163 - DNA, 22 bp, Homo sapiens
gaatctgcattttaacaagatc

SEQ ID NO: 7955164 - DNA, 22 bp, Homo sapiens
gaatctgcattttaacaagatc

SEQ ID NO: 7955165 - DNA, 22 bp, Homo sapiens
gaatctggaagtgggcagtagg

SEQ ID NO: 7955166 - DNA, 22 bp, Homo sapiens
gaatctcattctaactagtagg

SEQ ID NO: 7955167 - DNA, 22 bp, Homo sapiens
gaatctcattctaactagtagg

SEQ ID NO: 7955168 - DNA, 22 bp, Homo sapiens
gaatctcattctaactagtagg

SEQ ID NO: 7955169 - DNA, 22 bp, Homo sapiens
gaatctcattctaactagtagg

SEQ ID NO: 7955170 - DNA, 22 bp, Homo sapiens
gaatctcagtggaagcaggaag

SEQ ID NO: 7955171 - DNA, 22 bp, Homo sapiens
gaatctcagtggaagcaggaag

SEQ ID NO: 7955172 - DNA, 22 bp, Homo sapiens
gaatctcagtggaagcaggaag

SEQ ID NO: 7955173 - DNA, 20 bp, Homo sapiens
gaatctttccccatgcaatg

SEQ ID NO: 7955174 - DNA, 20 bp, Homo sapiens
gaatctttccccatgcaatg

SEQ ID NO: 7955175 - DNA, 22 bp, Homo sapiens
gaatcttatccccagtccttaa

SEQ ID NO: 7955176 - DNA, 22 bp, Homo sapiens
gaatcttatttttaaatcttcc

SEQ ID NO: 7955177 - DNA, 20 bp, Homo sapiens
gaatcttactacattctctc

SEQ ID NO: 7955178 - DNA, 22 bp, Homo sapiens
gaatcttaaatcggaatcttaa

SEQ ID NO: 7955179 - DNA, 22 bp, Homo sapiens
gaagggtgtgtgtgagggacac

SEQ ID NO: 7955180 - DNA, 22 bp, Homo sapiens
gaagggtgtgatttgcctgaga

SEQ ID NO: 7955181 - DNA, 22 bp, Homo sapiens
gaagggtgtgatttgcctgaga

SEQ ID NO: 7955182 - DNA, 22 bp, Homo sapiens
gaagggtgcatggagggaagtc

SEQ ID NO: 7955183 - DNA, 22 bp, Homo sapiens
gaagggtgcatggagggaagtc

SEQ ID NO: 7955184 - DNA, 22 bp, Homo sapiens
gaagggtgcatggagggaagtc

SEQ ID NO: 7955185 - DNA, 22 bp, Homo sapiens
gaagggggttgcagtctagggt

SEQ ID NO: 7955186 - DNA, 22 bp, Homo sapiens
gaagggggttgcagtctagggt

SEQ ID NO: 7955187 - DNA, 22 bp, Homo sapiens
gaagggtgcatggagggaagtc

SEQ ID NO: 7955188 - DNA, 22 bp, Homo sapiens
gaagggtgcatggagggaagtc

SEQ ID NO: 7955189 - DNA, 22 bp, Homo sapiens
gaagggtgcatggagggaagtc

SEQ ID NO: 7955190 - DNA, 22 bp, Homo sapiens
gaagggtgcatggagggaagtc

SEQ ID NO: 7955191 - DNA, 22 bp, Homo sapiens
gaaggtgcagtggctggaggct

SEQ ID NO: 7955192 - DNA, 22 bp, Homo sapiens
gaaggtggcgagcggattgctg

SEQ ID NO: 7955193 - DNA, 22 bp, Homo sapiens
gaaggtccagcgtggccaagtc

SEQ ID NO: 7955194 - DNA, 22 bp, Homo sapiens
gaaggtgcaggcaaggttggtt

SEQ ID NO: 7955195 - DNA, 22 bp, Homo sapiens
gaaggtagctgctgagatgaca

SEQ ID NO: 7955196 - DNA, 22 bp, Homo sapiens
gaaggtagctgctgagatgaca

SEQ ID NO: 7955197 - DNA, 22 bp, Homo sapiens
gaagggtgtgtgtgagggacac

SEQ ID NO: 7955198 - DNA, 22 bp, Homo sapiens
gaagggtgtgtgtgagggacac

SEQ ID NO: 7955199 - DNA, 22 bp, Homo sapiens
gaagggtgtgtgtgagggacac

SEQ ID NO: 7955200 - DNA, 22 bp, Homo sapiens
gaagggtgtgtgtgagggacac

SEQ ID NO: 7955201 - DNA, 22 bp, Homo sapiens
gaagggtgtgtgtgagggacac

SEQ ID NO: 7955202 - DNA, 22 bp, Homo sapiens
gaaggggactggcagctgcaga

SEQ ID NO: 7955203 - DNA, 22 bp, Homo sapiens
gaaggggactggcagctgcaga

SEQ ID NO: 7955204 - DNA, 22 bp, Homo sapiens
gaaggggactggcagctgcaga

SEQ ID NO: 7955205 - DNA, 22 bp, Homo sapiens
gaaggggactggcagctgcaga

SEQ ID NO: 7955206 - DNA, 22 bp, Homo sapiens
gaaggggagtggctagtgtgtg

SEQ ID NO: 7955207 - DNA, 22 bp, Homo sapiens
gaaggggactggcagctgcaga

SEQ ID NO: 7955208 - DNA, 22 bp, Homo sapiens
gaagggggaaaatgacaacaga

SEQ ID NO: 7955209 - DNA, 22 bp, Homo sapiens
gaagggggaaaatgacaacaga

SEQ ID NO: 7955210 - DNA, 19 bp, Homo sapiens
gaaggggaaggtgggtacc

SEQ ID NO: 7955211 - DNA, 22 bp, Homo sapiens
gaaggggactggcagctgcaga

SEQ ID NO: 7955212 - DNA, 22 bp, Homo sapiens
gaaggggactggcagctgcaga

SEQ ID NO: 7955213 - DNA, 22 bp, Homo sapiens
gaaggggaaagttgagcaaata

SEQ ID NO: 7955214 - DNA, 22 bp, Homo sapiens
gaaggggaaagttgagcaaata

SEQ ID NO: 7955215 - DNA, 18 bp, Homo sapiens
gaagggctttgaagtaga

SEQ ID NO: 7955216 - DNA, 22 bp, Homo sapiens
gaaggggaaagttgagcaaata

SEQ ID NO: 7955217 - DNA, 18 bp, Homo sapiens
gaagggagctggaatgca

SEQ ID NO: 7955218 - DNA, 20 bp, Homo sapiens
gaagggatcactgcatactt

SEQ ID NO: 7955219 - DNA, 22 bp, Homo sapiens
gaagggctcatcaggtggccgc

SEQ ID NO: 7955220 - DNA, 22 bp, Homo sapiens
gaagggctgcaggtctgggccc

SEQ ID NO: 7955221 - DNA, 22 bp, Homo sapiens
gaagggctttctgggagaagag

SEQ ID NO: 7955222 - DNA, 22 bp, Homo sapiens
gaagggcttggctgggaggcca

SEQ ID NO: 7955223 - DNA, 22 bp, Homo sapiens
gaagggctgcaggtctgggccc

SEQ ID NO: 7955224 - DNA, 22 bp, Homo sapiens
gaagggctgcaggtctgggccc

SEQ ID NO: 7955225 - DNA, 22 bp, Homo sapiens
gaagggctttctgggagaagag

SEQ ID NO: 7955226 - DNA, 22 bp, Homo sapiens
gaatgaacaaggatgttcatcc

SEQ ID NO: 7955227 - DNA, 22 bp, Homo sapiens
gaatgaattcagcacatggaat

SEQ ID NO: 7955228 - DNA, 22 bp, Homo sapiens
gaatgaatctgtaagtgacaag

SEQ ID NO: 7955229 - DNA, 22 bp, Homo sapiens
gaatgaatctgtaagtgacaag

SEQ ID NO: 7955230 - DNA, 22 bp, Homo sapiens
gaatgaatctgtaagtgacaag

SEQ ID NO: 7955231 - DNA, 22 bp, Homo sapiens
gaatgaaaaccttggctcaaat

SEQ ID NO: 7955232 - DNA, 22 bp, Homo sapiens
gaatcttttgtctcgtgaataa

SEQ ID NO: 7955233 - DNA, 21 bp, Homo sapiens
gaatctttgatttacatggga

SEQ ID NO: 7955234 - DNA, 22 bp, Homo sapiens
gaatcttttttcttgccaggca

SEQ ID NO: 7955235 - DNA, 22 bp, Homo sapiens
gaatgaaagatttgcattctat

SEQ ID NO: 7955236 - DNA, 22 bp, Homo sapiens
gaatgaaagatttgcattctat

SEQ ID NO: 7955237 - DNA, 22 bp, Homo sapiens
gaatgagttaatatttgcttgg

SEQ ID NO: 7955238 - DNA, 22 bp, Homo sapiens
gaatgagtagagtataaacaaa

SEQ ID NO: 7955239 - DNA, 22 bp, Homo sapiens
gaatgaggtcatcttgtaatct

SEQ ID NO: 7955240 - DNA, 22 bp, Homo sapiens
gaatgagactatgcgagtgtga

SEQ ID NO: 7955241 - DNA, 22 bp, Homo sapiens
gaatgacattgaaaagacattg

SEQ ID NO: 7955242 - DNA, 22 bp, Homo sapiens
gacactgtgctagctgggctta

SEQ ID NO: 7955243 - DNA, 22 bp, Homo sapiens
gacactgtgctagctgggctta

SEQ ID NO: 7955244 - DNA, 22 bp, Homo sapiens
gacactgtcccacagaattcga

SEQ ID NO: 7955245 - DNA, 22 bp, Homo sapiens
gacactgtcccacagaattcga

SEQ ID NO: 7955246 - DNA, 22 bp, Homo sapiens
gacactggcttgtcccgccatc

SEQ ID NO: 7955247 - DNA, 22 bp, Homo sapiens
gacactggatttctagaaatgt

SEQ ID NO: 7955248 - DNA, 21 bp, Homo sapiens
gacactgcttactctgaccta

SEQ ID NO: 7955249 - DNA, 22 bp, Homo sapiens
gacactgcacttggggcccaca

SEQ ID NO: 7955250 - DNA, 22 bp, Homo sapiens
gacactggaaatattgaattgg

SEQ ID NO: 7955251 - DNA, 22 bp, Homo sapiens
gacactgttatggtgaggtaag

SEQ ID NO: 7955252 - DNA, 22 bp, Homo sapiens
gacactgttatggtgaggtaag

SEQ ID NO: 7955253 - DNA, 22 bp, Homo sapiens
gacacttcacctttcccagcct

SEQ ID NO: 7955254 - DNA, 22 bp, Homo sapiens
gacactgtgctagctgggctta

SEQ ID NO: 7955255 - DNA, 22 bp, Homo sapiens
gacacttgacatccagcagcaa

SEQ ID NO: 7955256 - DNA, 22 bp, Homo sapiens
gacacagtggttctgtgagtaa

SEQ ID NO: 7955257 - DNA, 22 bp, Homo sapiens
gacacagtcaagagtggaggaa

SEQ ID NO: 7955258 - DNA, 22 bp, Homo sapiens
gacacagtcaagagtggaggaa

SEQ ID NO: 7955259 - DNA, 21 bp, Homo sapiens
gacacagtaatcttggggctt

SEQ ID NO: 7955260 - DNA, 22 bp, Homo sapiens
gacactttggtgctttgtggtt

SEQ ID NO: 7955261 - DNA, 22 bp, Homo sapiens
gacagaagaggaacttggacag

SEQ ID NO: 7955262 - DNA, 22 bp, Homo sapiens
gacactttggtgctttgtggtt

SEQ ID NO: 7955263 - DNA, 22 bp, Homo sapiens
gacactttattaagctgttgtt

SEQ ID NO: 7955264 - DNA, 22 bp, Homo sapiens
gacactttattaagctgttgtt

SEQ ID NO: 7955265 - DNA, 22 bp, Homo sapiens
gacactttctcaggtaaagcat

SEQ ID NO: 7955266 - DNA, 22 bp, Homo sapiens
gacagaactcaaacatgagaag

SEQ ID NO: 7955267 - DNA, 22 bp, Homo sapiens
gacagaaggcatctagggcacg

SEQ ID NO: 7955268 - DNA, 22 bp, Homo sapiens
gacagaaggcatctagggcacg

SEQ ID NO: 7955269 - DNA, 22 bp, Homo sapiens
gacagaaggcatctagggcacg

SEQ ID NO: 7955270 - DNA, 22 bp, Homo sapiens
gacagaatcatctcctgggact

SEQ ID NO: 7955271 - DNA, 22 bp, Homo sapiens
gacagaattttccatcatgtgg

SEQ ID NO: 7955272 - DNA, 22 bp, Homo sapiens
gacagacacaattgatccatga

SEQ ID NO: 7955273 - DNA, 22 bp, Homo sapiens
gacagacacagggccatgattg

SEQ ID NO: 7955274 - DNA, 22 bp, Homo sapiens
gacagacacagggccatgattg

SEQ ID NO: 7955275 - DNA, 22 bp, Homo sapiens
gacagacacctggggggttgct

SEQ ID NO: 7955276 - DNA, 22 bp, Homo sapiens
gacagacacctggggggttgct

SEQ ID NO: 7955277 - DNA, 22 bp, Homo sapiens
gacagacacctggggggttgct

SEQ ID NO: 7955278 - DNA, 22 bp, Homo sapiens
gacagacacagggccatgattg

SEQ ID NO: 7955279 - DNA, 22 bp, Homo sapiens
gacagacactattggtatgcct

SEQ ID NO: 7955280 - DNA, 22 bp, Homo sapiens
gacagacaaatgtttttaactt

SEQ ID NO: 7955281 - DNA, 22 bp, Homo sapiens
gacagacaaatgtttttaactt

SEQ ID NO: 7955282 - DNA, 22 bp, Homo sapiens
gacagacacaattgatccatga

SEQ ID NO: 7955283 - DNA, 22 bp, Homo sapiens
gacagacacaattgatccatga

SEQ ID NO: 7955284 - DNA, 22 bp, Homo sapiens
gacagacacaattgatccatga

SEQ ID NO: 7955285 - DNA, 22 bp, Homo sapiens
gacagacacaattgatccatga

SEQ ID NO: 7955286 - DNA, 22 bp, Homo sapiens
gacagacacaattgatccatga

SEQ ID NO: 7955287 - DNA, 22 bp, Homo sapiens
gacagacacaattgatccatga

SEQ ID NO: 7955288 - DNA, 22 bp, Homo sapiens
gacagacaggaggccacctgct

SEQ ID NO: 7955289 - DNA, 22 bp, Homo sapiens
gacagacaggaggcattcaggg

SEQ ID NO: 7955290 - DNA, 22 bp, Homo sapiens
gacagacaggaggcattcaggg

SEQ ID NO: 7955291 - DNA, 22 bp, Homo sapiens
gacagacaggaggccacctgct

SEQ ID NO: 7955292 - DNA, 22 bp, Homo sapiens
gacagacaggaggccacctgct

SEQ ID NO: 7955293 - DNA, 22 bp, Homo sapiens
gacagacaggtgtggtaggcac

SEQ ID NO: 7955294 - DNA, 22 bp, Homo sapiens
gacagacaggtgtggtaggcac

SEQ ID NO: 7955295 - DNA, 22 bp, Homo sapiens
gacagacaggggttctcctgga

SEQ ID NO: 7955296 - DNA, 22 bp, Homo sapiens
gacagacaggtgtggtaggcac

SEQ ID NO: 7955297 - DNA, 22 bp, Homo sapiens
gacagacaggtgtggtaggcac

SEQ ID NO: 7955298 - DNA, 22 bp, Homo sapiens
gacagacaggggttctcctgga

SEQ ID NO: 7955299 - DNA, 22 bp, Homo sapiens
gacagacaggggttctcctgga

SEQ ID NO: 7955300 - DNA, 22 bp, Homo sapiens
gacagacaggggttctcctgga

SEQ ID NO: 7955301 - DNA, 22 bp, Homo sapiens
gacagacaggaggccacctgct

SEQ ID NO: 7955302 - DNA, 22 bp, Homo sapiens
gacagacaggagctcacaggca

SEQ ID NO: 7955303 - DNA, 22 bp, Homo sapiens
gacagacactgtgtcctcactt

SEQ ID NO: 7955304 - DNA, 22 bp, Homo sapiens
gacagacaggagctcacaggca

SEQ ID NO: 7955305 - DNA, 22 bp, Homo sapiens
gacagacaggaggcattcaggg

SEQ ID NO: 7955306 - DNA, 22 bp, Homo sapiens
gacagacaggaggcattcaggg

SEQ ID NO: 7955307 - DNA, 22 bp, Homo sapiens
gacagacagagaatgggcttga

SEQ ID NO: 7955308 - DNA, 22 bp, Homo sapiens
gacagacagagaatgggcttga

SEQ ID NO: 7955309 - DNA, 22 bp, Homo sapiens
gacagacactgtgtcctcactt

SEQ ID NO: 7955310 - DNA, 22 bp, Homo sapiens
gacagacactgtgtcctcactt

SEQ ID NO: 7955311 - DNA, 22 bp, Homo sapiens
gacagacactgtgtcctcactt

SEQ ID NO: 7955312 - DNA, 22 bp, Homo sapiens
gacagacactattggtatgcct

SEQ ID NO: 7955313 - DNA, 22 bp, Homo sapiens
gacagacactattggtatgcct

SEQ ID NO: 7955314 - DNA, 22 bp, Homo sapiens
gacagacactattggtatgcct

SEQ ID NO: 7955315 - DNA, 22 bp, Homo sapiens
gacagacactgtgtcctcactt

SEQ ID NO: 7955316 - DNA, 22 bp, Homo sapiens
gacagacactgtgtcctcactt

SEQ ID NO: 7955317 - DNA, 22 bp, Homo sapiens
gacagacacagggccatgattg

SEQ ID NO: 7955318 - DNA, 22 bp, Homo sapiens
gacagacactattggtatgcct

SEQ ID NO: 7955319 - DNA, 22 bp, Homo sapiens
gaaggccacggaatggagctgg

SEQ ID NO: 7955320 - DNA, 22 bp, Homo sapiens
gaaggccacggaatggagctgg

SEQ ID NO: 7955321 - DNA, 22 bp, Homo sapiens
gaaggccagttttgagataggt

SEQ ID NO: 7955322 - DNA, 22 bp, Homo sapiens
gaaggccaagaggctccaagat

SEQ ID NO: 7955323 - DNA, 22 bp, Homo sapiens
gaaggcatttcagagatctctg

SEQ ID NO: 7955324 - DNA, 22 bp, Homo sapiens
gaaggcatttaggaactgcaat

SEQ ID NO: 7955325 - DNA, 22 bp, Homo sapiens
gaaggcatttaggaactgcaat

SEQ ID NO: 7955326 - DNA, 18 bp, Homo sapiens
gaaggcattcagtggctt

SEQ ID NO: 7955327 - DNA, 18 bp, Homo sapiens
gaaggcattcagtggctt

SEQ ID NO: 7955328 - DNA, 22 bp, Homo sapiens
gaaggcatctatgtgacctgga

SEQ ID NO: 7955329 - DNA, 22 bp, Homo sapiens
gaaggcatcagcaggcaccgat

SEQ ID NO: 7955330 - DNA, 22 bp, Homo sapiens
gaaggcatcacagaggctgtga

SEQ ID NO: 7955331 - DNA, 22 bp, Homo sapiens
gaaggcatcacagaggctgtgg

SEQ ID NO: 7955332 - DNA, 22 bp, Homo sapiens
gaaggcatcaccaacattgaaa

SEQ ID NO: 7955333 - DNA, 22 bp, Homo sapiens
gaaggcagtaaatggctgtttt

SEQ ID NO: 7955334 - DNA, 22 bp, Homo sapiens
gaaggcagtaaatggctgtttt

SEQ ID NO: 7955335 - DNA, 22 bp, Homo sapiens
gaaggcaggtttttcaaaactg

SEQ ID NO: 7955336 - DNA, 22 bp, Homo sapiens
gaaggcaggtttttcaaaactg

SEQ ID NO: 7955337 - DNA, 22 bp, Homo sapiens
gaaggcagtaaatggctgtttt

SEQ ID NO: 7955338 - DNA, 22 bp, Homo sapiens
gaaggcagtaaatggctgtttt

SEQ ID NO: 7955339 - DNA, 22 bp, Homo sapiens
gaaggcagtaaatggctgtttt

SEQ ID NO: 7955340 - DNA, 22 bp, Homo sapiens
gaaggcagtaaatggctgtttt

SEQ ID NO: 7955341 - DNA, 22 bp, Homo sapiens
gaagggagaaggttgggtgacg

SEQ ID NO: 7955342 - DNA, 22 bp, Homo sapiens
gaagggagaaggttgggtgacg

SEQ ID NO: 7955343 - DNA, 22 bp, Homo sapiens
gaagggaatttggagggtttca

SEQ ID NO: 7955344 - DNA, 22 bp, Homo sapiens
gaagggaatttggagggtttca

SEQ ID NO: 7955345 - DNA, 22 bp, Homo sapiens
gaagggaaggaaagaaccagca

SEQ ID NO: 7955346 - DNA, 22 bp, Homo sapiens
gaaggcccagtcaaggggctag

SEQ ID NO: 7955347 - DNA, 22 bp, Homo sapiens
gaagggagaaggttgggtgacg

SEQ ID NO: 7955348 - DNA, 18 bp, Homo sapiens
gaagggagctggaatgca

SEQ ID NO: 7955349 - DNA, 18 bp, Homo sapiens
gaagggagctggaatgca

SEQ ID NO: 7955350 - DNA, 18 bp, Homo sapiens
gaagggagctggaatgca

SEQ ID NO: 7955351 - DNA, 22 bp, Homo sapiens
gaaggccagttttgagataggt

SEQ ID NO: 7955352 - DNA, 22 bp, Homo sapiens
gaaggccattagagcctgtgcc

SEQ ID NO: 7955353 - DNA, 22 bp, Homo sapiens
gaaggcccagtcaaggggctag

SEQ ID NO: 7955354 - DNA, 22 bp, Homo sapiens
gaaggcccagcttgaatgctgc

SEQ ID NO: 7955355 - DNA, 22 bp, Homo sapiens
gaaggcccagcttgaatgctgc

SEQ ID NO: 7955356 - DNA, 22 bp, Homo sapiens
gaaggcaccctccatcactcac

SEQ ID NO: 7955357 - DNA, 22 bp, Homo sapiens
gaaggcaccctccatcactcac

SEQ ID NO: 7955358 - DNA, 22 bp, Homo sapiens
gaaggcactgaactccttctgg

SEQ ID NO: 7955359 - DNA, 22 bp, Homo sapiens
gaaggcactgaactccttctgg

SEQ ID NO: 7955360 - DNA, 22 bp, Homo sapiens
gaaggcacagatggcagtccac

SEQ ID NO: 7955361 - DNA, 22 bp, Homo sapiens
gaaggcacccggcgtgcggcgg

SEQ ID NO: 7955362 - DNA, 22 bp, Homo sapiens
gaaggcacccggcgtgcggcgg

SEQ ID NO: 7955363 - DNA, 22 bp, Homo sapiens
gaaggagctaccaagactgaat

SEQ ID NO: 7955364 - DNA, 22 bp, Homo sapiens
gaaggcaagctttggatatgag

SEQ ID NO: 7955365 - DNA, 22 bp, Homo sapiens
gaaggcaagctttggatatgag

SEQ ID NO: 7955366 - DNA, 22 bp, Homo sapiens
gaaggcaagctttggatatgag

SEQ ID NO: 7955367 - DNA, 22 bp, Homo sapiens
gaaggcaaggagggaagccacc

SEQ ID NO: 7955368 - DNA, 22 bp, Homo sapiens
gaaggcaaggagggaagccacc

SEQ ID NO: 7955369 - DNA, 22 bp, Homo sapiens
gaaggcaagtgagccaagagaa

SEQ ID NO: 7955370 - DNA, 20 bp, Homo sapiens
gaaggcaatggtttggcaca

SEQ ID NO: 7955371 - DNA, 20 bp, Homo sapiens
gaaggcaatggtttggcaca

SEQ ID NO: 7955372 - DNA, 22 bp, Homo sapiens
gaaggcacagatggcagtccac

SEQ ID NO: 7955373 - DNA, 22 bp, Homo sapiens
gaaggcacagatggcagtccac

SEQ ID NO: 7955374 - DNA, 22 bp, Homo sapiens
gaaggcacagatggcagtccac

SEQ ID NO: 7955375 - DNA, 22 bp, Homo sapiens
gaaggcaggcttctgattaggt

SEQ ID NO: 7955376 - DNA, 22 bp, Homo sapiens
gaaggcactgaactccttctgg

SEQ ID NO: 7955377 - DNA, 22 bp, Homo sapiens
gaaggcaggcttctgattaggt

SEQ ID NO: 7955378 - DNA, 22 bp, Homo sapiens
gaaggcagggaatgtggtgcta

SEQ ID NO: 7955379 - DNA, 22 bp, Homo sapiens
gaaggcagggaatgtggtgcta

SEQ ID NO: 7955380 - DNA, 22 bp, Homo sapiens
gaaggcagggaatgtggtgcta

SEQ ID NO: 7955381 - DNA, 22 bp, Homo sapiens
gaaggcaggtttttcaaaactg

SEQ ID NO: 7955382 - DNA, 22 bp, Homo sapiens
gaaggcaggtttttcaaaactg

SEQ ID NO: 7955383 - DNA, 22 bp, Homo sapiens
gaaggcagggaatgtggtgcta

SEQ ID NO: 7955384 - DNA, 22 bp, Homo sapiens
gaaggcagggaatgtggtgcta

SEQ ID NO: 7955385 - DNA, 22 bp, Homo sapiens
gaaggcagggaatgtggtgcta

SEQ ID NO: 7955386 - DNA, 22 bp, Homo sapiens
gaagccacagagattgtggggg

SEQ ID NO: 7955387 - DNA, 22 bp, Homo sapiens
gaagccacagagattgtggggg

SEQ ID NO: 7955388 - DNA, 22 bp, Homo sapiens
gaagccacaactttttcttagc

SEQ ID NO: 7955389 - DNA, 22 bp, Homo sapiens
gaagccaagtcctcgagtttca

SEQ ID NO: 7955390 - DNA, 22 bp, Homo sapiens
gaagccaagtgcaaatgcctta

SEQ ID NO: 7955391 - DNA, 23 bp, Homo sapiens
gaagccacacaaaggtcgccaag

SEQ ID NO: 7955392 - DNA, 22 bp, Homo sapiens
gaagccacgttaaattggctgt

SEQ ID NO: 7955393 - DNA, 22 bp, Homo sapiens
gaagccacgttaaattggctgt

SEQ ID NO: 7955394 - DNA, 22 bp, Homo sapiens
gaagccacgttaaattggctgt

SEQ ID NO: 7955395 - DNA, 22 bp, Homo sapiens
gaagccactatagatattctaa

SEQ ID NO: 7955396 - DNA, 22 bp, Homo sapiens
gaagccaccctccttccagccc

SEQ ID NO: 7955397 - DNA, 22 bp, Homo sapiens
gaagccaccctccttccagccc

SEQ ID NO: 7955398 - DNA, 20 bp, Homo sapiens
gaagccagaggggaaaggag

SEQ ID NO: 7955399 - DNA, 22 bp, Homo sapiens
gaaggagagggtcaaggataat

SEQ ID NO: 7955400 - DNA, 16 bp, Homo sapiens
gaaggagattcagaaa

SEQ ID NO: 7955401 - DNA, 16 bp, Homo sapiens
gaaggagattcagaaa

SEQ ID NO: 7955402 - DNA, 20 bp, Homo sapiens
gaagccagaggggaaaggag

SEQ ID NO: 7955403 - DNA, 20 bp, Homo sapiens
gaagccagaggggaaaggag

SEQ ID NO: 7955404 - DNA, 16 bp, Homo sapiens
gaaggagattcagaaa

SEQ ID NO: 7955405 - DNA, 22 bp, Homo sapiens
gaaggagccgagctcttcccca

SEQ ID NO: 7955406 - DNA, 22 bp, Homo sapiens
gaaggagctaaagggagccctg

SEQ ID NO: 7955407 - DNA, 22 bp, Homo sapiens
gaaggagctaccaagactgaat

SEQ ID NO: 7955408 - DNA, 22 bp, Homo sapiens
gaaggagctaccaagactgaat

SEQ ID NO: 7955409 - DNA, 18 bp, Homo sapiens
gaaaggagagacagtagg

SEQ ID NO: 7955410 - DNA, 18 bp, Homo sapiens
gaaaggagagacagtagg

SEQ ID NO: 7955411 - DNA, 22 bp, Homo sapiens
gaaaggaagaaaggtcatttta

SEQ ID NO: 7955412 - DNA, 18 bp, Homo sapiens
gaaaggagagacagtagg

SEQ ID NO: 7955413 - DNA, 22 bp, Homo sapiens
gaaaggaagaaaggtcatttta

SEQ ID NO: 7955414 - DNA, 22 bp, Homo sapiens
gaaaggaacttgtgagtgggag

SEQ ID NO: 7955415 - DNA, 22 bp, Homo sapiens
gaaaggaaattgagggacgcat

SEQ ID NO: 7955416 - DNA, 22 bp, Homo sapiens
gaaagctgggaaataaatatta

SEQ ID NO: 7955417 - DNA, 22 bp, Homo sapiens
gaaagctgtgaaatagtgctct

SEQ ID NO: 7955418 - DNA, 22 bp, Homo sapiens
gaaagctgtgaaatagtgctct

SEQ ID NO: 7955419 - DNA, 22 bp, Homo sapiens
gaaagctgtgaaatagtgctct

SEQ ID NO: 7955420 - DNA, 22 bp, Homo sapiens
gaaagctgtgaaatagtgctct

SEQ ID NO: 7955421 - DNA, 22 bp, Homo sapiens
gaaagctgtgaaatagtgctct

SEQ ID NO: 7955422 - DNA, 22 bp, Homo sapiens
gaaagctgggaaataaatatta

SEQ ID NO: 7955423 - DNA, 22 bp, Homo sapiens
gaaagctgaaccaggaaccatg

SEQ ID NO: 7955424 - DNA, 22 bp, Homo sapiens
gaaagctgaaccaggaaccatg

SEQ ID NO: 7955425 - DNA, 22 bp, Homo sapiens
gaaagctgaaccaggaaccatg

SEQ ID NO: 7955426 - DNA, 22 bp, Homo sapiens
gaaagctctgcttcagcctgca

SEQ ID NO: 7955427 - DNA, 22 bp, Homo sapiens
gaaaggaaatattctaagcact

SEQ ID NO: 7955428 - DNA, 22 bp, Homo sapiens
gaaaggaaatattctaagcact

SEQ ID NO: 7955429 - DNA, 22 bp, Homo sapiens
gaaagcttccattttgtacatt

SEQ ID NO: 7955430 - DNA, 22 bp, Homo sapiens
gaaagcttccattttgtacatt

SEQ ID NO: 7955431 - DNA, 22 bp, Homo sapiens
gaaaggaaatattctaagcact

SEQ ID NO: 7955432 - DNA, 22 bp, Homo sapiens
gaaagcttccattttgtacatt

SEQ ID NO: 7955433 - DNA, 22 bp, Homo sapiens
gaaaggagggaaacagagcggt

SEQ ID NO: 7955434 - DNA, 22 bp, Homo sapiens
gaaaggagggctcacaaaagtg

SEQ ID NO: 7955435 - DNA, 22 bp, Homo sapiens
gaaaggagggaaacagagcggt

SEQ ID NO: 7955436 - DNA, 22 bp, Homo sapiens
gaaaggagggctcacaaaagtg

SEQ ID NO: 7955437 - DNA, 20 bp, Homo sapiens
gaaaggagtgtccctgtgag

SEQ ID NO: 7955438 - DNA, 22 bp, Homo sapiens
gaaaggagtcagtcttactgaa

SEQ ID NO: 7955439 - DNA, 22 bp, Homo sapiens
gaaaggagagggttaaggagct

SEQ ID NO: 7955440 - DNA, 22 bp, Homo sapiens
gaaaggagggaaacagagcggt

SEQ ID NO: 7955441 - DNA, 22 bp, Homo sapiens
gaaaggagggaaacagagcggt

SEQ ID NO: 7955442 - DNA, 17 bp, Homo sapiens
gaaaggaggcaacactg

SEQ ID NO: 7955443 - DNA, 17 bp, Homo sapiens
gaaaggaggcaacactg

SEQ ID NO: 7955444 - DNA, 17 bp, Homo sapiens
gaaaggaggcaacactg

SEQ ID NO: 7955445 - DNA, 22 bp, Homo sapiens
gaagcagtgtgaacccatgtaa

SEQ ID NO: 7955446 - DNA, 22 bp, Homo sapiens
gaagcagtgtgaacccatgtaa

SEQ ID NO: 7955447 - DNA, 22 bp, Homo sapiens
gaagcagtgtgaacccatgtaa

SEQ ID NO: 7955448 - DNA, 22 bp, Homo sapiens
gaagcagtatcctgacagcacc

SEQ ID NO: 7955449 - DNA, 22 bp, Homo sapiens
gaagcagtatcctgacagcacc

SEQ ID NO: 7955450 - DNA, 22 bp, Homo sapiens
gaagcagtatcctgacagcacc

SEQ ID NO: 7955451 - DNA, 22 bp, Homo sapiens
gaagcagtagattcctactcat

SEQ ID NO: 7955452 - DNA, 22 bp, Homo sapiens
gaagcagggagcagtctttgca

SEQ ID NO: 7955453 - DNA, 22 bp, Homo sapiens
gaagcagctttctggtgaggag

SEQ ID NO: 7955454 - DNA, 22 bp, Homo sapiens
gaagcagctttctggtgaggag

SEQ ID NO: 7955455 - DNA, 22 bp, Homo sapiens
gaagcagctttctggtgaggag

SEQ ID NO: 7955456 - DNA, 20 bp, Homo sapiens
gaagcagcttcatgtagaca

SEQ ID NO: 7955457 - DNA, 20 bp, Homo sapiens
gaagcagcttcatgtagaca

SEQ ID NO: 7955458 - DNA, 20 bp, Homo sapiens
gaagcagcttcatgtagaca

SEQ ID NO: 7955459 - DNA, 22 bp, Homo sapiens
gaagcagctggtgagatggagc

SEQ ID NO: 7955460 - DNA, 22 bp, Homo sapiens
gaagcagctggtgagatggagc

SEQ ID NO: 7955461 - DNA, 22 bp, Homo sapiens
gaagccaacattccaagtagaa

SEQ ID NO: 7955462 - DNA, 21 bp, Homo sapiens
gaagccaagacaggatcaagg

SEQ ID NO: 7955463 - DNA, 21 bp, Homo sapiens
gaagccaagacaggatcaagg

SEQ ID NO: 7955464 - DNA, 22 bp, Homo sapiens
gaagccaagggctgcttttcct

SEQ ID NO: 7955465 - DNA, 22 bp, Homo sapiens
gaagccaagccagctgatggag

SEQ ID NO: 7955466 - DNA, 22 bp, Homo sapiens
gaagccaagtcctcgagtttca

SEQ ID NO: 7955467 - DNA, 22 bp, Homo sapiens
gaagcatactttctatactgct

SEQ ID NO: 7955468 - DNA, 22 bp, Homo sapiens
gaagcatactttctatactgct

SEQ ID NO: 7955469 - DNA, 22 bp, Homo sapiens
gaagcagttcgaaagcagttgg

SEQ ID NO: 7955470 - DNA, 22 bp, Homo sapiens
gaagcatataggtactgaacta

SEQ ID NO: 7955471 - DNA, 22 bp, Homo sapiens
gaagcatgctaaggattctcag

SEQ ID NO: 7955472 - DNA, 22 bp, Homo sapiens
gaagcaagtgcaaggaagaggc

SEQ ID NO: 7955473 - DNA, 22 bp, Homo sapiens
gaagcaagtgcaaggaagaggc

SEQ ID NO: 7955474 - DNA, 22 bp, Homo sapiens
gaagcaagtgcaaggaagaggc

SEQ ID NO: 7955475 - DNA, 22 bp, Homo sapiens
gaagcaagtgcaaggaagaggc

SEQ ID NO: 7955476 - DNA, 22 bp, Homo sapiens
gaagcaagtgcaaggaagaggc

SEQ ID NO: 7955477 - DNA, 22 bp, Homo sapiens
gaagcaagtggcctgattcaga

SEQ ID NO: 7955478 - DNA, 22 bp, Homo sapiens
gaagcaagtggcctgattcaga

SEQ ID NO: 7955479 - DNA, 22 bp, Homo sapiens
gaagcaagtggcctgattcaga

SEQ ID NO: 7955480 - DNA, 22 bp, Homo sapiens
gaagcagcagctggggacagtt

SEQ ID NO: 7955481 - DNA, 22 bp, Homo sapiens
gaagcaaagagctagtgccgct

SEQ ID NO: 7955482 - DNA, 22 bp, Homo sapiens
gaagcaaagagctagtgccgct

SEQ ID NO: 7955483 - DNA, 22 bp, Homo sapiens
gaaaggcaggcagggtgtccat

SEQ ID NO: 7955484 - DNA, 22 bp, Homo sapiens
gaaaggcaggcagggtgtccat

SEQ ID NO: 7955485 - DNA, 22 bp, Homo sapiens
gaaaggcaggcagggtgtccat

SEQ ID NO: 7955486 - DNA, 22 bp, Homo sapiens
gaagcagctaggatcttcattt

SEQ ID NO: 7955487 - DNA, 22 bp, Homo sapiens
gaagcagctaggatcttcattt

SEQ ID NO: 7955488 - DNA, 22 bp, Homo sapiens
gaagcagctaggatcttcattt

SEQ ID NO: 7955489 - DNA, 22 bp, Homo sapiens
gaagcagctaggatcttcattt

SEQ ID NO: 7955490 - DNA, 22 bp, Homo sapiens
gaagcagctaggatcttcattt

SEQ ID NO: 7955491 - DNA, 22 bp, Homo sapiens
gaagcagctggtgagatggagc

SEQ ID NO: 7955492 - DNA, 22 bp, Homo sapiens
gaagcagctcagattgactgaa

SEQ ID NO: 7955493 - DNA, 22 bp, Homo sapiens
gaagcagctcagattgactgaa

SEQ ID NO: 7955494 - DNA, 22 bp, Homo sapiens
gaagcagctagcccactagtca

SEQ ID NO: 7955495 - DNA, 22 bp, Homo sapiens
gaagcagcgaagtggaagggac

SEQ ID NO: 7955496 - DNA, 22 bp, Homo sapiens
gaagcagcgaagtggaagggac

SEQ ID NO: 7955497 - DNA, 22 bp, Homo sapiens
gaagcagccacggggagacaga

SEQ ID NO: 7955498 - DNA, 22 bp, Homo sapiens
gaagcagccacggggagacaga

SEQ ID NO: 7955499 - DNA, 22 bp, Homo sapiens
gaagcagccacggggagacaga

SEQ ID NO: 7955500 - DNA, 22 bp, Homo sapiens
gaagcagcagctggggacagtt

SEQ ID NO: 7955501 - DNA, 22 bp, Homo sapiens
ctgtgcttagccatcacattca

SEQ ID NO: 7955502 - DNA, 22 bp, Homo sapiens
ctgtgcttagccatcacattca

SEQ ID NO: 7955503 - DNA, 22 bp, Homo sapiens
ctgtgctgtcttgggagcctta

SEQ ID NO: 7955504 - DNA, 22 bp, Homo sapiens
ctgtgctgtcttgggagcctta

SEQ ID NO: 7955505 - DNA, 22 bp, Homo sapiens
ctgtgctgtcttgggagcctta

SEQ ID NO: 7955506 - DNA, 22 bp, Homo sapiens
ctgtgctgtcttgggagcctta

SEQ ID NO: 7955507 - DNA, 22 bp, Homo sapiens
ctgtgctggtccagggagctgg

SEQ ID NO: 7955508 - DNA, 22 bp, Homo sapiens
ctgtgctggtccagggagctgg

SEQ ID NO: 7955509 - DNA, 22 bp, Homo sapiens
ctgtgctgggtccttcttttga

SEQ ID NO: 7955510 - DNA, 22 bp, Homo sapiens
ctgtgctggtccagggagctgg

SEQ ID NO: 7955511 - DNA, 22 bp, Homo sapiens
ctgtgctggtgaaacccacaga

SEQ ID NO: 7955512 - DNA, 22 bp, Homo sapiens
ctgtgctgggtccttcttttga

SEQ ID NO: 7955513 - DNA, 22 bp, Homo sapiens
ctgtgctgggtgtgcttatgat

SEQ ID NO: 7955514 - DNA, 23 bp, Homo sapiens
ctgtgctgggtcccatcttgggc

SEQ ID NO: 7955515 - DNA, 22 bp, Homo sapiens
ctgtgctggcagcaatcaagga

SEQ ID NO: 7955516 - DNA, 22 bp, Homo sapiens
ctgtgctggcagcaatcaagga

SEQ ID NO: 7955517 - DNA, 22 bp, Homo sapiens
ctgtgctggattctgaggctac

SEQ ID NO: 7955518 - DNA, 22 bp, Homo sapiens
ctgtgctggattctgaggctac

SEQ ID NO: 7955519 - DNA, 22 bp, Homo sapiens
ctgtgctggattctgaggctac

SEQ ID NO: 7955520 - DNA, 22 bp, Homo sapiens
ctgtgctggattctgaggctac

SEQ ID NO: 7955521 - DNA, 22 bp, Homo sapiens
ctgtgctggagatgggccagag

SEQ ID NO: 7955522 - DNA, 22 bp, Homo sapiens
ctgtgctggagatgggccagag

SEQ ID NO: 7955523 - DNA, 22 bp, Homo sapiens
ctgtgctggattctgaggctac

SEQ ID NO: 7955524 - DNA, 22 bp, Homo sapiens
ctgtgctggcagacctggagtt

SEQ ID NO: 7955525 - DNA, 22 bp, Homo sapiens
ctgtgctggcagacctggagtt

SEQ ID NO: 7955526 - DNA, 22 bp, Homo sapiens
ctgtgctggcagacctggagtt

SEQ ID NO: 7955527 - DNA, 22 bp, Homo sapiens
ctgtgctgctagacctggattc

SEQ ID NO: 7955528 - DNA, 22 bp, Homo sapiens
ctgtgctggagatgggccagag

SEQ ID NO: 7955529 - DNA, 22 bp, Homo sapiens
ctgtgctgctagacctggattc

SEQ ID NO: 7955530 - DNA, 22 bp, Homo sapiens
ctgtgctggagatgggccagag

SEQ ID NO: 7955531 - DNA, 22 bp, Homo sapiens
ctgtgctggagatgggccagag

SEQ ID NO: 7955532 - DNA, 22 bp, Homo sapiens
ctgtgctgcagacgcagtagct

SEQ ID NO: 7955533 - DNA, 22 bp, Homo sapiens
ctgtgctgcagacgcagtagct

SEQ ID NO: 7955534 - DNA, 22 bp, Homo sapiens
ctgtgctgcagacgcagtagct

SEQ ID NO: 7955535 - DNA, 22 bp, Homo sapiens
ctgtgctgctagacctggattc

SEQ ID NO: 7955536 - DNA, 22 bp, Homo sapiens
ctgtgctgattcagcacaggcc

SEQ ID NO: 7955537 - DNA, 22 bp, Homo sapiens
ctgtgctgattcagcacaggcc

SEQ ID NO: 7955538 - DNA, 22 bp, Homo sapiens
ctgtgctgattcagcacaggcc

SEQ ID NO: 7955539 - DNA, 22 bp, Homo sapiens
ctgtgctgattcagcacaggcc

SEQ ID NO: 7955540 - DNA, 22 bp, Homo sapiens
ctgtgctgattcagcacaggcc

SEQ ID NO: 7955541 - DNA, 22 bp, Homo sapiens
ctgtgctgagtgatgtgactta

SEQ ID NO: 7955542 - DNA, 22 bp, Homo sapiens
ctgtgctgagtgatgtgactta

SEQ ID NO: 7955543 - DNA, 22 bp, Homo sapiens
ctgtgctgattcagcacaggcc

SEQ ID NO: 7955544 - DNA, 22 bp, Homo sapiens
ctgtgctgattcagcacaggcc

SEQ ID NO: 7955545 - DNA, 22 bp, Homo sapiens
ctgtgctgattcagcacaggcc

SEQ ID NO: 7955546 - DNA, 22 bp, Homo sapiens
ctgtgctgaacaattctgcatt

SEQ ID NO: 7955547 - DNA, 22 bp, Homo sapiens
ctgtgctctggcatcgctgcaa

SEQ ID NO: 7955548 - DNA, 17 bp, Homo sapiens
ctgtgctcgagtgatgg

SEQ ID NO: 7955549 - DNA, 22 bp, Homo sapiens
ctgtgctgaggatgcagtttct

SEQ ID NO: 7955550 - DNA, 22 bp, Homo sapiens
ctgtgctgaggatgcagtttct

SEQ ID NO: 7955551 - DNA, 22 bp, Homo sapiens
ctgtgctgagtgatgtgactta

SEQ ID NO: 7955552 - DNA, 22 bp, Homo sapiens
ctgtgctgaacaattctgcatt

SEQ ID NO: 7955553 - DNA, 22 bp, Homo sapiens
ctgtgccctgtggctggcacct

SEQ ID NO: 7955554 - DNA, 17 bp, Homo sapiens
ctgtgctcgagtgatgg

SEQ ID NO: 7955555 - DNA, 22 bp, Homo sapiens
ctgtgccctttcgctgcactgt

SEQ ID NO: 7955556 - DNA, 22 bp, Homo sapiens
ctgtgccctttcgctgcactgt

SEQ ID NO: 7955557 - DNA, 22 bp, Homo sapiens
ctgtgccctgtggctggcacct

SEQ ID NO: 7955558 - DNA, 22 bp, Homo sapiens
ctgtgccctggccaggcctctc

SEQ ID NO: 7955559 - DNA, 22 bp, Homo sapiens
ctgtgccctggccaggcctctc

SEQ ID NO: 7955560 - DNA, 22 bp, Homo sapiens
ctgtgccctggccaggcctctc

SEQ ID NO: 7955561 - DNA, 22 bp, Homo sapiens
ctgtgccctggccaggcctctc

SEQ ID NO: 7955562 - DNA, 18 bp, Homo sapiens
ctgtgccctgctcctact

SEQ ID NO: 7955563 - DNA, 22 bp, Homo sapiens
ctgtgccctggccaggcctctc

SEQ ID NO: 7955564 - DNA, 22 bp, Homo sapiens
ctgtctgtggagcttctgatgt

SEQ ID NO: 7955565 - DNA, 22 bp, Homo sapiens
ctgtgccctctttgctggcctt

SEQ ID NO: 7955566 - DNA, 22 bp, Homo sapiens
ctgtctgtggagcttctgatgt

SEQ ID NO: 7955567 - DNA, 22 bp, Homo sapiens
ctgtctgtcaagttcatctcca

SEQ ID NO: 7955568 - DNA, 22 bp, Homo sapiens
ctgtctgtcaccaaaacagact

SEQ ID NO: 7955569 - DNA, 22 bp, Homo sapiens
ctgtctgtcaccaaaacagact

SEQ ID NO: 7955570 - DNA, 22 bp, Homo sapiens
ctgtctgtcccgtcaccgcccc

SEQ ID NO: 7955571 - DNA, 22 bp, Homo sapiens
ctgtctgtcctgagttcaacca

SEQ ID NO: 7955572 - DNA, 22 bp, Homo sapiens
ctgtctgtgcctcttctcccag

SEQ ID NO: 7955573 - DNA, 19 bp, Homo sapiens
ctgtctgtgcagagatgtg

SEQ ID NO: 7955574 - DNA, 19 bp, Homo sapiens
ctgtctgtgcagagatgtg

SEQ ID NO: 7955575 - DNA, 22 bp, Homo sapiens
ctgtctgtgacctctgcatgtc

SEQ ID NO: 7955576 - DNA, 22 bp, Homo sapiens
ctgtctgtgacctctgcatgtc

SEQ ID NO: 7955577 - DNA, 19 bp, Homo sapiens
ctgtctgtgcagagatgtg

SEQ ID NO: 7955578 - DNA, 22 bp, Homo sapiens
ctgtctgtgacctctgcatgtc

SEQ ID NO: 7955579 - DNA, 22 bp, Homo sapiens
ctgtctgtcaagttcatctcca

SEQ ID NO: 7955580 - DNA, 22 bp, Homo sapiens
ctgtctgtatccctgttggtaa

SEQ ID NO: 7955581 - DNA, 22 bp, Homo sapiens
ctgtctgtatccctgttggtaa

SEQ ID NO: 7955582 - DNA, 22 bp, Homo sapiens
ctgtctgtagacatttttggtt

SEQ ID NO: 7955583 - DNA, 22 bp, Homo sapiens
ctgtctgtagacatttttggtt

SEQ ID NO: 7955584 - DNA, 22 bp, Homo sapiens
ctgtctgtactgagagttctgt

SEQ ID NO: 7955585 - DNA, 22 bp, Homo sapiens
ctgtctgtactgagagttctgt

SEQ ID NO: 7955586 - DNA, 22 bp, Homo sapiens
ctgtctgtactgagagttctgt

SEQ ID NO: 7955587 - DNA, 22 bp, Homo sapiens
ctgtctggtgtccctgtctaca

SEQ ID NO: 7955588 - DNA, 19 bp, Homo sapiens
ctgtctggttcatgtgttc

SEQ ID NO: 7955589 - DNA, 22 bp, Homo sapiens
ctgtctgtacaaatgtggggcc

SEQ ID NO: 7955590 - DNA, 22 bp, Homo sapiens
ctgtctgtacaaatgtggggcc

SEQ ID NO: 7955591 - DNA, 19 bp, Homo sapiens
ctgtctggttcatgtgttc

SEQ ID NO: 7955592 - DNA, 19 bp, Homo sapiens
ctgtctggttcatgtgttc

SEQ ID NO: 7955593 - DNA, 17 bp, Homo sapiens
ctgtctgcgcatgaggt

SEQ ID NO: 7955594 - DNA, 17 bp, Homo sapiens
ctgtctgcgcatgaggt

SEQ ID NO: 7955595 - DNA, 17 bp, Homo sapiens
ctgtctgcgcatgaggt

SEQ ID NO: 7955596 - DNA, 22 bp, Homo sapiens
ctgtctgctatgcttgttgtca

SEQ ID NO: 7955597 - DNA, 22 bp, Homo sapiens
ctgtctgctagaacatctatac

SEQ ID NO: 7955598 - DNA, 22 bp, Homo sapiens
ctgtctgctagaacatctatac

SEQ ID NO: 7955599 - DNA, 22 bp, Homo sapiens
ctgtctggaatgcagtacatag

SEQ ID NO: 7955600 - DNA, 22 bp, Homo sapiens
ctgtctggagttatgtaaatag

SEQ ID NO: 7955601 - DNA, 22 bp, Homo sapiens
ctgtctggaatgcagtacatag

SEQ ID NO: 7955602 - DNA, 22 bp, Homo sapiens
ctgtctggaatgcagtacatag

SEQ ID NO: 7955603 - DNA, 22 bp, Homo sapiens
ctgtctggatgtgagtcaccta

SEQ ID NO: 7955604 - DNA, 22 bp, Homo sapiens
ctgtctggatataccttggcca

SEQ ID NO: 7955605 - DNA, 21 bp, Homo sapiens
ctgtctggccgcgggctccgc

SEQ ID NO: 7955606 - DNA, 22 bp, Homo sapiens
ctgtctggccggcccagcttcc

SEQ ID NO: 7955607 - DNA, 22 bp, Homo sapiens
ctgtctgggtctacatcctctg

SEQ ID NO: 7955608 - DNA, 22 bp, Homo sapiens
ctgtctgggtctacatcctctg

SEQ ID NO: 7955609 - DNA, 22 bp, Homo sapiens
ctgtctgggtctacatcctctg

SEQ ID NO: 7955610 - DNA, 22 bp, Homo sapiens
ctgtctgggtctacatcctctg

SEQ ID NO: 7955611 - DNA, 22 bp, Homo sapiens
ctgtattttcatgcctacgtac

SEQ ID NO: 7955612 - DNA, 22 bp, Homo sapiens
ctgtattttttaagaatatctc

SEQ ID NO: 7955613 - DNA, 22 bp, Homo sapiens
ctgtattttcatgcctacgtac

SEQ ID NO: 7955614 - DNA, 22 bp, Homo sapiens
ctgtattttttaagaatatctc

SEQ ID NO: 7955615 - DNA, 22 bp, Homo sapiens
ctgtattttttaagaatatctc

SEQ ID NO: 7955616 - DNA, 22 bp, Homo sapiens
ctgtattttttaagaatatctc

SEQ ID NO: 7955617 - DNA, 22 bp, Homo sapiens
ctgtattttttaagaatatctc

SEQ ID NO: 7955618 - DNA, 22 bp, Homo sapiens
ctgtatttgtcctctatttatt

SEQ ID NO: 7955619 - DNA, 22 bp, Homo sapiens
ctgtcaaagactaaggttctta

SEQ ID NO: 7955620 - DNA, 22 bp, Homo sapiens
ctgtattttttaagtgatctgg

SEQ ID NO: 7955621 - DNA, 22 bp, Homo sapiens
ctgtattttttaagtgatctgg

SEQ ID NO: 7955622 - DNA, 22 bp, Homo sapiens
ctgtattttttaagtgatctgg

SEQ ID NO: 7955623 - DNA, 22 bp, Homo sapiens
ctgtcaaatggaaacttatcct

SEQ ID NO: 7955624 - DNA, 22 bp, Homo sapiens
ctgtcaacattggtgtctgtca

SEQ ID NO: 7955625 - DNA, 22 bp, Homo sapiens
ctgtcaaattcataacacttat

SEQ ID NO: 7955626 - DNA, 22 bp, Homo sapiens
ctgtcacactaaaacaagaagt

SEQ ID NO: 7955627 - DNA, 22 bp, Homo sapiens
ctgtcaatgacagttatttggg

SEQ ID NO: 7955628 - DNA, 22 bp, Homo sapiens
ctgtcaatttatgttgacatgc

SEQ ID NO: 7955629 - DNA, 20 bp, Homo sapiens
ctgtcacaaaggatgtgtca

SEQ ID NO: 7955630 - DNA, 22 bp, Homo sapiens
ctgtcacactgatatcaggctt

SEQ ID NO: 7955631 - DNA, 22 bp, Homo sapiens
ctgtcacccacccagcctgtca

SEQ ID NO: 7955632 - DNA, 22 bp, Homo sapiens
ctgtcaccatttgagccctgga

SEQ ID NO: 7955633 - DNA, 22 bp, Homo sapiens
ctgtcacccacccagcctgtca

SEQ ID NO: 7955634 - DNA, 22 bp, Homo sapiens
ctgtatttgtcctctatttatt

SEQ ID NO: 7955635 - DNA, 23 bp, Homo sapiens
ctgtatttgacttgagcggaaat

SEQ ID NO: 7955636 - DNA, 23 bp, Homo sapiens
ctgtatttgacttgagcggaaat

SEQ ID NO: 7955637 - DNA, 23 bp, Homo sapiens
ctgtatttgacttgagcggaaat

SEQ ID NO: 7955638 - DNA, 23 bp, Homo sapiens
ctgtatttgacttgagcggaaat

SEQ ID NO: 7955639 - DNA, 22 bp, Homo sapiens
ctgtatttgaaagaaaagattt

SEQ ID NO: 7955640 - DNA, 22 bp, Homo sapiens
ctgtatttgaaagaaaagattt

SEQ ID NO: 7955641 - DNA, 22 bp, Homo sapiens
ctgtatatggcttactttatat

SEQ ID NO: 7955642 - DNA, 22 bp, Homo sapiens
ctgtatttgaaagaaaagattt

SEQ ID NO: 7955643 - DNA, 22 bp, Homo sapiens
ctgtatatcatggttttgcagt

SEQ ID NO: 7955644 - DNA, 22 bp, Homo sapiens
ctgtatatcatggttttgcagt

SEQ ID NO: 7955645 - DNA, 22 bp, Homo sapiens
ctgtatatcatggttttgcagt

SEQ ID NO: 7955646 - DNA, 22 bp, Homo sapiens
ctgtatatggcttactttatat

SEQ ID NO: 7955647 - DNA, 22 bp, Homo sapiens
ctgtatatggcttactttatat

SEQ ID NO: 7955648 - DNA, 22 bp, Homo sapiens
ctgtataaacatattttcaagt

SEQ ID NO: 7955649 - DNA, 20 bp, Homo sapiens
ctgtagggtgcagcaggctc

SEQ ID NO: 7955650 - DNA, 22 bp, Homo sapiens
ctgtaggcttagctagaagtga

SEQ ID NO: 7955651 - DNA, 22 bp, Homo sapiens
ctgtagttgatgatttctgata

SEQ ID NO: 7955652 - DNA, 20 bp, Homo sapiens
ctgtagggtgcagcaggctc

SEQ ID NO: 7955653 - DNA, 22 bp, Homo sapiens
ctgtccttactgcttctggctt

SEQ ID NO: 7955654 - DNA, 22 bp, Homo sapiens
ctgtcctgtgtcagcctgaaat

SEQ ID NO: 7955655 - DNA, 22 bp, Homo sapiens
ctgtcaggtttcccggctcacg

SEQ ID NO: 7955656 - DNA, 22 bp, Homo sapiens
ctgtcctgtggtgacaggtaca

SEQ ID NO: 7955657 - DNA, 22 bp, Homo sapiens
ctgtcctgtggtgacaggtaca

SEQ ID NO: 7955658 - DNA, 22 bp, Homo sapiens
ctgtcaggttggtctcagagct

SEQ ID NO: 7955659 - DNA, 22 bp, Homo sapiens
ctgtcaggttggtctcagagct

SEQ ID NO: 7955660 - DNA, 22 bp, Homo sapiens
ctgtcaggtttcccatctgcaa

SEQ ID NO: 7955661 - DNA, 22 bp, Homo sapiens
ctgtcaggtttcccggctcacg

SEQ ID NO: 7955662 - DNA, 22 bp, Homo sapiens
ctgtctgccctggccagagccc

SEQ ID NO: 7955663 - DNA, 22 bp, Homo sapiens
ctgtctgccctggccagagccc

SEQ ID NO: 7955664 - DNA, 22 bp, Homo sapiens
ctgtctgccctggccagagccc

SEQ ID NO: 7955665 - DNA, 22 bp, Homo sapiens
ctgtctgcaggatagtaccctc

SEQ ID NO: 7955666 - DNA, 22 bp, Homo sapiens
ctgtctgccaataatctatggc

SEQ ID NO: 7955667 - DNA, 22 bp, Homo sapiens
ctgtctgccaataatctatggc

SEQ ID NO: 7955668 - DNA, 22 bp, Homo sapiens
ctgtctgcaggatagtaccctc

SEQ ID NO: 7955669 - DNA, 22 bp, Homo sapiens
ctgtctgcaggatagtaccctc

SEQ ID NO: 7955670 - DNA, 22 bp, Homo sapiens
ctgtccttccagccgaaatcta

SEQ ID NO: 7955671 - DNA, 22 bp, Homo sapiens
ctgtctgaatcctaagcttcct

SEQ ID NO: 7955672 - DNA, 22 bp, Homo sapiens
ctgtctctgttgcctgtaggtg

SEQ ID NO: 7955673 - DNA, 22 bp, Homo sapiens
ctgtctctgttgcctgtaggtg

SEQ ID NO: 7955674 - DNA, 22 bp, Homo sapiens
ctgtctctgttgcctgtaggtg

SEQ ID NO: 7955675 - DNA, 19 bp, Homo sapiens
ctgtccttggctgcactgt

SEQ ID NO: 7955676 - DNA, 19 bp, Homo sapiens
ctgtccttggctgcactgt

SEQ ID NO: 7955677 - DNA, 22 bp, Homo sapiens
ctgtctctgttgcctgtaggtg

SEQ ID NO: 7955678 - DNA, 19 bp, Homo sapiens
ctgtccttggctgcactgt

SEQ ID NO: 7955679 - DNA, 19 bp, Homo sapiens
ctgtcaggggctggatgtt

SEQ ID NO: 7955680 - DNA, 19 bp, Homo sapiens
ctgtcaggggctggatgtt

SEQ ID NO: 7955681 - DNA, 22 bp, Homo sapiens
ctgtcaggttggtctcagagct

SEQ ID NO: 7955682 - DNA, 22 bp, Homo sapiens
ctgtcaggggcgggtggagcgg

SEQ ID NO: 7955683 - DNA, 22 bp, Homo sapiens
ctgtcagcttctcctggccaga

SEQ ID NO: 7955684 - DNA, 22 bp, Homo sapiens
ctgtcagcactctactacagat

SEQ ID NO: 7955685 - DNA, 22 bp, Homo sapiens
ctgtcagcactctactacagat

SEQ ID NO: 7955686 - DNA, 22 bp, Homo sapiens
ctgtcacctctgccctttgccc

SEQ ID NO: 7955687 - DNA, 21 bp, Homo sapiens
ctgtcacctgctcagagaggg

SEQ ID NO: 7955688 - DNA, 22 bp, Homo sapiens
ctgtcacctgttcactgcagca

SEQ ID NO: 7955689 - DNA, 22 bp, Homo sapiens
ctgggcttttgagtcacaaggg

SEQ ID NO: 7955690 - DNA, 22 bp, Homo sapiens
ctgggctttggtactgtgatta

SEQ ID NO: 7955691 - DNA, 22 bp, Homo sapiens
ctggggaacgcagcgagcagcg

SEQ ID NO: 7955692 - DNA, 22 bp, Homo sapiens
ctggggaacaatttgccacact

SEQ ID NO: 7955693 - DNA, 22 bp, Homo sapiens
ctggggaaggcggtgactgcgc

SEQ ID NO: 7955694 - DNA, 22 bp, Homo sapiens
ctggggaacgcagcgagcagcg

SEQ ID NO: 7955695 - DNA, 22 bp, Homo sapiens
ctggggaacgcagcgagcagcg

SEQ ID NO: 7955696 - DNA, 22 bp, Homo sapiens
ctggggaacgcagcgagcagcg

SEQ ID NO: 7955697 - DNA, 22 bp, Homo sapiens
ctgggcttgtgttagctgacaa

SEQ ID NO: 7955698 - DNA, 22 bp, Homo sapiens
ctgggctttcaggccctaaggc

SEQ ID NO: 7955699 - DNA, 22 bp, Homo sapiens
ctgggcttgcactgcagcgaga

SEQ ID NO: 7955700 - DNA, 19 bp, Homo sapiens
ctgggcttgatgttgagtt

SEQ ID NO: 7955701 - DNA, 22 bp, Homo sapiens
ctgggcttaggacctggtgcgg

SEQ ID NO: 7955702 - DNA, 22 bp, Homo sapiens
ctgggcttctccccctggcaga

SEQ ID NO: 7955703 - DNA, 22 bp, Homo sapiens
ctgggcttctccccctggcaga

SEQ ID NO: 7955704 - DNA, 19 bp, Homo sapiens
ctgggcttgatgttgagtt

SEQ ID NO: 7955705 - DNA, 22 bp, Homo sapiens
ctgggcttgagttcctgctcgt

SEQ ID NO: 7955706 - DNA, 20 bp, Homo sapiens
ctggggacagcaatggctgt

SEQ ID NO: 7955707 - DNA, 22 bp, Homo sapiens
ctggggaatagagctggagacc

SEQ ID NO: 7955708 - DNA, 20 bp, Homo sapiens
ctggggacagcaatggctgt

SEQ ID NO: 7955709 - DNA, 22 bp, Homo sapiens
ctggggaatagagctggagacc

SEQ ID NO: 7955710 - DNA, 22 bp, Homo sapiens
ctggggaatagagctggagacc

SEQ ID NO: 7955711 - DNA, 22 bp, Homo sapiens
ctggggaaggcggtgactgcgc

SEQ ID NO: 7955712 - DNA, 22 bp, Homo sapiens
ctggggaccgagcaagctctgg

SEQ ID NO: 7955713 - DNA, 22 bp, Homo sapiens
ctggggaccgagcaagctctgg

SEQ ID NO: 7955714 - DNA, 20 bp, Homo sapiens
ctggggacagcaatggctgt

SEQ ID NO: 7955715 - DNA, 22 bp, Homo sapiens
ctggggacgtcgggcagtgttc

SEQ ID NO: 7955716 - DNA, 22 bp, Homo sapiens
ctggggaccgagcaagctctgg

SEQ ID NO: 7955717 - DNA, 22 bp, Homo sapiens
ctggggacgtcgggcagtgttc

SEQ ID NO: 7955718 - DNA, 22 bp, Homo sapiens
ctggggacgtcgggcagtgttc

SEQ ID NO: 7955719 - DNA, 22 bp, Homo sapiens
ctggggactcattcagagcata

SEQ ID NO: 7955720 - DNA, 22 bp, Homo sapiens
ctggggacgtcgggcagtgttc

SEQ ID NO: 7955721 - DNA, 22 bp, Homo sapiens
ctggggacgtcgggcagtgttc

SEQ ID NO: 7955722 - DNA, 22 bp, Homo sapiens
ctggggagacgatcgatgttct

SEQ ID NO: 7955723 - DNA, 22 bp, Homo sapiens
ctggggagaagcgactcggctg

SEQ ID NO: 7955724 - DNA, 22 bp, Homo sapiens
ctggggagacgatcgatgttct

SEQ ID NO: 7955725 - DNA, 22 bp, Homo sapiens
ctggggagacgatcgatgttct

SEQ ID NO: 7955726 - DNA, 22 bp, Homo sapiens
ctggggagaagcgactcggctg

SEQ ID NO: 7955727 - DNA, 22 bp, Homo sapiens
ctggggagaagcgactcggctg

SEQ ID NO: 7955728 - DNA, 22 bp, Homo sapiens
ctggggagaagcgactcggctg

SEQ ID NO: 7955729 - DNA, 22 bp, Homo sapiens
ctggggagaagcgactcggctg

SEQ ID NO: 7955730 - DNA, 22 bp, Homo sapiens
ctggggagaagcgactcggctg

SEQ ID NO: 7955731 - DNA, 22 bp, Homo sapiens
ctggggagaagcgactcggctg

SEQ ID NO: 7955732 - DNA, 22 bp, Homo sapiens
ctggggactttggttctccatg

SEQ ID NO: 7955733 - DNA, 22 bp, Homo sapiens
ctggggactgaaggatgttgct

SEQ ID NO: 7955734 - DNA, 22 bp, Homo sapiens
ctggggactgaaggatgttgct

SEQ ID NO: 7955735 - DNA, 22 bp, Homo sapiens
ctggggactcattcagagcata

SEQ ID NO: 7955736 - DNA, 18 bp, Homo sapiens
ctggtctcccttcgcttt

SEQ ID NO: 7955737 - DNA, 18 bp, Homo sapiens
ctggtctcccttcgcttt

SEQ ID NO: 7955738 - DNA, 22 bp, Homo sapiens
ctggtctgaaaaggaggcatgc

SEQ ID NO: 7955739 - DNA, 22 bp, Homo sapiens
ctggtccttgctacccagcaag

SEQ ID NO: 7955740 - DNA, 22 bp, Homo sapiens
ctggtcagctgaagccccacac

SEQ ID NO: 7955741 - DNA, 23 bp, Homo sapiens
ctggtcagaggctgctggaaggg

SEQ ID NO: 7955742 - DNA, 22 bp, Homo sapiens
ctggtcagctgaagccccacac

SEQ ID NO: 7955743 - DNA, 22 bp, Homo sapiens
ctggtcagctgaagccccacac

SEQ ID NO: 7955744 - DNA, 23 bp, Homo sapiens
ctggtcagaggctgctggaaggg

SEQ ID NO: 7955745 - DNA, 22 bp, Homo sapiens
ctggtcagagcaactgctcaca

SEQ ID NO: 7955746 - DNA, 22 bp, Homo sapiens
ctggtcactggtctcatccagc

SEQ ID NO: 7955747 - DNA, 22 bp, Homo sapiens
ctggtcactcctccacctgctt

SEQ ID NO: 7955748 - DNA, 22 bp, Homo sapiens
ctggtcactggtctcatccagc

SEQ ID NO: 7955749 - DNA, 22 bp, Homo sapiens
ctggtcactcctccacctgctt

SEQ ID NO: 7955750 - DNA, 22 bp, Homo sapiens
ctggtcacgtgccatatttcct

SEQ ID NO: 7955751 - DNA, 20 bp, Homo sapiens
ctggggagctgctcccacga

SEQ ID NO: 7955752 - DNA, 20 bp, Homo sapiens
ctggggagctgctcccacga

SEQ ID NO: 7955753 - DNA, 20 bp, Homo sapiens
ctggggagctgctcccacga

SEQ ID NO: 7955754 - DNA, 20 bp, Homo sapiens
ctggggagcctcgcggtggc

SEQ ID NO: 7955755 - DNA, 20 bp, Homo sapiens
ctggggagcctcgcggtggc

SEQ ID NO: 7955756 - DNA, 20 bp, Homo sapiens
ctggggagcctcgcggtggc

SEQ ID NO: 7955757 - DNA, 20 bp, Homo sapiens
ctggggagcctcgcggtggc

SEQ ID NO: 7955758 - DNA, 20 bp, Homo sapiens
ctggggagcctcgcggtggc

SEQ ID NO: 7955759 - DNA, 20 bp, Homo sapiens
ctggggagcctcgcggtggc

SEQ ID NO: 7955760 - DNA, 20 bp, Homo sapiens
ctggtctgccactcacagtt

SEQ ID NO: 7955761 - DNA, 22 bp, Homo sapiens
ctggtctgcgggaaggcgtggg

SEQ ID NO: 7955762 - DNA, 19 bp, Homo sapiens
ctggtctgctgcttccagg

SEQ ID NO: 7955763 - DNA, 19 bp, Homo sapiens
ctggtctgctgcttccagg

SEQ ID NO: 7955764 - DNA, 19 bp, Homo sapiens
ctggtctgctgcttccagg

SEQ ID NO: 7955765 - DNA, 19 bp, Homo sapiens
ctggtctgctgcttccagg

SEQ ID NO: 7955766 - DNA, 19 bp, Homo sapiens
ctggtctgctgcttccagg

SEQ ID NO: 7955767 - DNA, 19 bp, Homo sapiens
ctggtctgctgcttccagg

SEQ ID NO: 7955768 - DNA, 22 bp, Homo sapiens
ctggtctgctagaaagatgcat

SEQ ID NO: 7955769 - DNA, 22 bp, Homo sapiens
ctggtctgaggttgcccttgaa

SEQ ID NO: 7955770 - DNA, 22 bp, Homo sapiens
ctggtctgcaaggccatataga

SEQ ID NO: 7955771 - DNA, 20 bp, Homo sapiens
ctggtctgccactcacagtt

SEQ ID NO: 7955772 - DNA, 20 bp, Homo sapiens
ctggtctgccactcacagtt

SEQ ID NO: 7955773 - DNA, 20 bp, Homo sapiens
ctggtctgccactcacagtt

SEQ ID NO: 7955774 - DNA, 21 bp, Homo sapiens
ctggtctggccaataaggtcc

SEQ ID NO: 7955775 - DNA, 22 bp, Homo sapiens
ctggtctggctacccagcgaat

SEQ ID NO: 7955776 - DNA, 22 bp, Homo sapiens
ctggtctgggatgagggatgta

SEQ ID NO: 7955777 - DNA, 22 bp, Homo sapiens
ctggtctggctacccagcgaat

SEQ ID NO: 7955778 - DNA, 22 bp, Homo sapiens
ctggtctgggatgagggatgta

SEQ ID NO: 7955779 - DNA, 22 bp, Homo sapiens
ctggtgaatattggaggcattg

SEQ ID NO: 7955780 - DNA, 22 bp, Homo sapiens
ctggtgaatattggaggcattg

SEQ ID NO: 7955781 - DNA, 22 bp, Homo sapiens
ctggtgacatttccggctgcca

SEQ ID NO: 7955782 - DNA, 19 bp, Homo sapiens
ctggtctgtcatgctcccc

SEQ ID NO: 7955783 - DNA, 19 bp, Homo sapiens
ctggtctgtcatgctcccc

SEQ ID NO: 7955784 - DNA, 22 bp, Homo sapiens
ctggtctgtccgcaggtcacct

SEQ ID NO: 7955785 - DNA, 22 bp, Homo sapiens
ctggtctgtccgcaggtcacct

SEQ ID NO: 7955786 - DNA, 22 bp, Homo sapiens
ctggtgcaaaagtaattgtggt

SEQ ID NO: 7955787 - DNA, 22 bp, Homo sapiens
ctggtgagactcagggatgctt

SEQ ID NO: 7955788 - DNA, 22 bp, Homo sapiens
ctggtgagactcagggatgctt

SEQ ID NO: 7955789 - DNA, 22 bp, Homo sapiens
ctggtgcaagattccctgcttc

SEQ ID NO: 7955790 - DNA, 22 bp, Homo sapiens
ctggtgcaagattccctgcttc

SEQ ID NO: 7955791 - DNA, 22 bp, Homo sapiens
ctggtgcaagattccctgcttc

SEQ ID NO: 7955792 - DNA, 22 bp, Homo sapiens
ctggtgcacatgaaagagaagg

SEQ ID NO: 7955793 - DNA, 22 bp, Homo sapiens
ctggtgcaaggctttggaatcc

SEQ ID NO: 7955794 - DNA, 22 bp, Homo sapiens
ctggtgaccggacctcagtttt

SEQ ID NO: 7955795 - DNA, 22 bp, Homo sapiens
ctggtgaccttgccccaggtca

SEQ ID NO: 7955796 - DNA, 22 bp, Homo sapiens
ctggtgaccttgccccaggtca

SEQ ID NO: 7955797 - DNA, 22 bp, Homo sapiens
ctggtgacttcatctcctcccc

SEQ ID NO: 7955798 - DNA, 22 bp, Homo sapiens
ctggtgacttcatctcctcccc

SEQ ID NO: 7955799 - DNA, 22 bp, Homo sapiens
ctggtgagacggttgacaggag

SEQ ID NO: 7955800 - DNA, 22 bp, Homo sapiens
ctggtgagacggttgacaggag

SEQ ID NO: 7955801 - DNA, 22 bp, Homo sapiens
ctggtgagactcagggatgctt

SEQ ID NO: 7955802 - DNA, 22 bp, Homo sapiens
ctggtgagactcagggatgctt

SEQ ID NO: 7955803 - DNA, 22 bp, Homo sapiens
ctggtgagactcagggatgctt

SEQ ID NO: 7955804 - DNA, 22 bp, Homo sapiens
ctggtgcacattcgctctcata

SEQ ID NO: 7955805 - DNA, 22 bp, Homo sapiens
ctggtgcacgtggctgcagtcg

SEQ ID NO: 7955806 - DNA, 22 bp, Homo sapiens
ctggtgcactacagcctggaac

SEQ ID NO: 7955807 - DNA, 22 bp, Homo sapiens
ctggtgcaggaaggagctggca

SEQ ID NO: 7955808 - DNA, 22 bp, Homo sapiens
ctggtgcacgtggctgcagtcg

SEQ ID NO: 7955809 - DNA, 22 bp, Homo sapiens
ctggtgcactacagcctggaac

SEQ ID NO: 7955810 - DNA, 22 bp, Homo sapiens
ctggtgcacgtggctgcagtcg

SEQ ID NO: 7955811 - DNA, 22 bp, Homo sapiens
ctggtgcaggaaggagctggca

SEQ ID NO: 7955812 - DNA, 22 bp, Homo sapiens
ctggtgcaggaaggagctggca

SEQ ID NO: 7955813 - DNA, 22 bp, Homo sapiens
ctggtgccattctgtggcctag

SEQ ID NO: 7955814 - DNA, 22 bp, Homo sapiens
ctggtgccattctgtggcctag

SEQ ID NO: 7955815 - DNA, 22 bp, Homo sapiens
ctggtgccattctgtggcctag

SEQ ID NO: 7955816 - DNA, 22 bp, Homo sapiens
ctggtgcatgtggccttgctct

SEQ ID NO: 7955817 - DNA, 22 bp, Homo sapiens
ctggtgcatgtggccttgctct

SEQ ID NO: 7955818 - DNA, 22 bp, Homo sapiens
ctggtgcaggaaggagctggca

SEQ ID NO: 7955819 - DNA, 22 bp, Homo sapiens
ctgtaattttccagccaatatg

SEQ ID NO: 7955820 - DNA, 22 bp, Homo sapiens
ctgtacaaaagaaagttcctat

SEQ ID NO: 7955821 - DNA, 22 bp, Homo sapiens
ctgtaattgttctatgtgttca

SEQ ID NO: 7955822 - DNA, 22 bp, Homo sapiens
ctgtaattctctagttcggagt

SEQ ID NO: 7955823 - DNA, 20 bp, Homo sapiens
ctgtaaaccaggcttcttgg

SEQ ID NO: 7955824 - DNA, 22 bp, Homo sapiens
ctgtaaaatgaacctagtcatc

SEQ ID NO: 7955825 - DNA, 22 bp, Homo sapiens
ctgtacaaagtagctgctggga

SEQ ID NO: 7955826 - DNA, 22 bp, Homo sapiens
ctgtacaaaagaaagttcctat

SEQ ID NO: 7955827 - DNA, 22 bp, Homo sapiens
ctgtacaaaagaaagttcctat

SEQ ID NO: 7955828 - DNA, 22 bp, Homo sapiens
ctgtacaaaagaaagttcctat

SEQ ID NO: 7955829 - DNA, 22 bp, Homo sapiens
ctgtacaaagtagctgctggga

SEQ ID NO: 7955830 - DNA, 22 bp, Homo sapiens
ctgtacaaagtagctgctggga

SEQ ID NO: 7955831 - DNA, 22 bp, Homo sapiens
ctgtacaaatggcagttgagtt

SEQ ID NO: 7955832 - DNA, 22 bp, Homo sapiens
ctgtacaaatggcagttgagtt

SEQ ID NO: 7955833 - DNA, 22 bp, Homo sapiens
ctggtgccctgtgtggcaggag

SEQ ID NO: 7955834 - DNA, 22 bp, Homo sapiens
ctggtgccctgtgtggcaggag

SEQ ID NO: 7955835 - DNA, 22 bp, Homo sapiens
ctggtgccctgtgtggcaggag

SEQ ID NO: 7955836 - DNA, 22 bp, Homo sapiens
ctggtgccctgtgtggcaggag

SEQ ID NO: 7955837 - DNA, 22 bp, Homo sapiens
ctggtgccctgtgtggcaggag

SEQ ID NO: 7955838 - DNA, 22 bp, Homo sapiens
ctggtgccattctgtggcctag

SEQ ID NO: 7955839 - DNA, 22 bp, Homo sapiens
ctggtgccctgtgtggcaggag

SEQ ID NO: 7955840 - DNA, 22 bp, Homo sapiens
ctgtaaaactgcttaagtatgc

SEQ ID NO: 7955841 - DNA, 22 bp, Homo sapiens
ctgtagcaagttattcaataaa

SEQ ID NO: 7955842 - DNA, 20 bp, Homo sapiens
ctgtagagcacaagtggagg

SEQ ID NO: 7955843 - DNA, 22 bp, Homo sapiens
ctgtacttctttcagagcaccc

SEQ ID NO: 7955844 - DNA, 22 bp, Homo sapiens
ctgtagagaaagcatggaagct

SEQ ID NO: 7955845 - DNA, 22 bp, Homo sapiens
ctgtagagaaagcatggaagct

SEQ ID NO: 7955846 - DNA, 22 bp, Homo sapiens
ctgtagccagaagcagaaggcc

SEQ ID NO: 7955847 - DNA, 22 bp, Homo sapiens
ctgtagccagtttggcctcacc

SEQ ID NO: 7955848 - DNA, 22 bp, Homo sapiens
ctgtagccagaagcagaaggcc

SEQ ID NO: 7955849 - DNA, 22 bp, Homo sapiens
ctgtagcagtgttccagcattg

SEQ ID NO: 7955850 - DNA, 22 bp, Homo sapiens
ctgtagcatttgttatggcaat

SEQ ID NO: 7955851 - DNA, 18 bp, Homo sapiens
ctgtaccaccctgagggc

SEQ ID NO: 7955852 - DNA, 22 bp, Homo sapiens
ctgtacatcttaaatggaaaaa

SEQ ID NO: 7955853 - DNA, 22 bp, Homo sapiens
ctgtacatcttaaatggaaaaa

SEQ ID NO: 7955854 - DNA, 22 bp, Homo sapiens
ctgtacctcagctttgctccca

SEQ ID NO: 7955855 - DNA, 18 bp, Homo sapiens
ctgtacttcagcctgggt

SEQ ID NO: 7955856 - DNA, 22 bp, Homo sapiens
ctgtacatcccgagagccagta

SEQ ID NO: 7955857 - DNA, 22 bp, Homo sapiens
ctgtacatatacatttttttcc

SEQ ID NO: 7955858 - DNA, 22 bp, Homo sapiens
ctgtacatatgtctccagagtg

SEQ ID NO: 7955859 - DNA, 22 bp, Homo sapiens
ctgtacatcccaagatatttct

SEQ ID NO: 7955860 - DNA, 23 bp, Homo sapiens
ctgtacacaaactgcctgcctgt

SEQ ID NO: 7955861 - DNA, 23 bp, Homo sapiens
ctgtacacaaactgcctgcctgt

SEQ ID NO: 7955862 - DNA, 22 bp, Homo sapiens
ctgtacacttcagtgagttttg

SEQ ID NO: 7955863 - DNA, 22 bp, Homo sapiens
ctgtacacttcagtgagttttg

SEQ ID NO: 7955864 - DNA, 22 bp, Homo sapiens
ctgtacagaagctagagcaaat

SEQ ID NO: 7955865 - DNA, 22 bp, Homo sapiens
ctgtacaatgttacctatttat

SEQ ID NO: 7955866 - DNA, 22 bp, Homo sapiens
ctgtacaatgttacctatttat

SEQ ID NO: 7955867 - DNA, 22 bp, Homo sapiens
ctgtacaatgttacctatttat

SEQ ID NO: 7955868 - DNA, 22 bp, Homo sapiens
ctgtacaagtccttcatcaggg

SEQ ID NO: 7955869 - DNA, 22 bp, Homo sapiens
ctgtacaagtccttcatcaggg

SEQ ID NO: 7955870 - DNA, 22 bp, Homo sapiens
ctgtacaagtccttcatcaggg

SEQ ID NO: 7955871 - DNA, 22 bp, Homo sapiens
ctgtacagaagctagagcaaat

SEQ ID NO: 7955872 - DNA, 22 bp, Homo sapiens
ctgtacaggtcaatgataagat

SEQ ID NO: 7955873 - DNA, 22 bp, Homo sapiens
ctgtacagagttctgagtgtac

SEQ ID NO: 7955874 - DNA, 22 bp, Homo sapiens
ctgtacataaaggaataggtgt

SEQ ID NO: 7955875 - DNA, 22 bp, Homo sapiens
ctgcttatggagatgagtaaga

SEQ ID NO: 7955876 - DNA, 22 bp, Homo sapiens
ctgcttatggagatgagtaaga

SEQ ID NO: 7955877 - DNA, 22 bp, Homo sapiens
ctgcttatggaattgtatactg

SEQ ID NO: 7955878 - DNA, 22 bp, Homo sapiens
ctgcttaatttaatagttgcaa

SEQ ID NO: 7955879 - DNA, 22 bp, Homo sapiens
ctgcttaagcaagaaagcagca

SEQ ID NO: 7955880 - DNA, 18 bp, Homo sapiens
ctgcttacaaaaataccc

SEQ ID NO: 7955881 - DNA, 22 bp, Homo sapiens
ctgcttcaaggaaatgaatcgg

SEQ ID NO: 7955882 - DNA, 22 bp, Homo sapiens
ctgcttcaaggaaatgaatcgg

SEQ ID NO: 7955883 - DNA, 22 bp, Homo sapiens
ctgcttatggagatgagtaaga

SEQ ID NO: 7955884 - DNA, 22 bp, Homo sapiens
ctgcttcacccaactttgggat

SEQ ID NO: 7955885 - DNA, 22 bp, Homo sapiens
ctgcttcacccaactttgggat

SEQ ID NO: 7955886 - DNA, 22 bp, Homo sapiens
ctgctgtttggtgagtgagaaa

SEQ ID NO: 7955887 - DNA, 23 bp, Homo sapiens
ctgctgttttctgtacctgaagc

SEQ ID NO: 7955888 - DNA, 20 bp, Homo sapiens
ctgcttaagtaagtgacaca

SEQ ID NO: 7955889 - DNA, 20 bp, Homo sapiens
ctgcttaagtaagtgacaca

SEQ ID NO: 7955890 - DNA, 22 bp, Homo sapiens
ctgcttaaaatgcagattctgt

SEQ ID NO: 7955891 - DNA, 22 bp, Homo sapiens
ctgctgtgtttctgctagaaaa

SEQ ID NO: 7955892 - DNA, 22 bp, Homo sapiens
ctgctgtgtttctgctagaaaa

SEQ ID NO: 7955893 - DNA, 22 bp, Homo sapiens
ctgctgtgtttctgctagaaaa

SEQ ID NO: 7955894 - DNA, 22 bp, Homo sapiens
ctgctgtgtttcacacctctgg

SEQ ID NO: 7955895 - DNA, 22 bp, Homo sapiens
ctgctgtgtttcacacctctgg

SEQ ID NO: 7955896 - DNA, 22 bp, Homo sapiens
ctgctgttccacctctgaatgc

SEQ ID NO: 7955897 - DNA, 22 bp, Homo sapiens
ctgctgttctgaagcaacaagc

SEQ ID NO: 7955898 - DNA, 22 bp, Homo sapiens
ctgctgtgttggcattggatag

SEQ ID NO: 7955899 - DNA, 22 bp, Homo sapiens
ctgctgtgttggcattggatag

SEQ ID NO: 7955900 - DNA, 23 bp, Homo sapiens
ctgctgtgttggtctcgatggga

SEQ ID NO: 7955901 - DNA, 23 bp, Homo sapiens
ctgctgtgttggtctcgatggga

SEQ ID NO: 7955902 - DNA, 23 bp, Homo sapiens
ctgctgtgttggtctcgatggga

SEQ ID NO: 7955903 - DNA, 20 bp, Homo sapiens
ctgctgtgttattgtagaac

SEQ ID NO: 7955904 - DNA, 20 bp, Homo sapiens
ctgctgtgttattgtagaac

SEQ ID NO: 7955905 - DNA, 22 bp, Homo sapiens
ctgctgtgttcctcctgcatct

SEQ ID NO: 7955906 - DNA, 22 bp, Homo sapiens
ctgctgtgttcctcctgcatct

SEQ ID NO: 7955907 - DNA, 22 bp, Homo sapiens
ctgctgtgttgccagtgtcacc

SEQ ID NO: 7955908 - DNA, 22 bp, Homo sapiens
ctgctgtgttagcaggtttagt

SEQ ID NO: 7955909 - DNA, 20 bp, Homo sapiens
ctgctgtgttattgtagaac

SEQ ID NO: 7955910 - DNA, 20 bp, Homo sapiens
ctgctgtgtgtgcctcagcc

SEQ ID NO: 7955911 - DNA, 20 bp, Homo sapiens
ctgctgtgtgtgcctcagcc

SEQ ID NO: 7955912 - DNA, 22 bp, Homo sapiens
ctgctgtgtggattcaatggct

SEQ ID NO: 7955913 - DNA, 22 bp, Homo sapiens
ctgctgtgtggattcaatggct

SEQ ID NO: 7955914 - DNA, 22 bp, Homo sapiens
ctgctgtgcagacagactctct

SEQ ID NO: 7955915 - DNA, 22 bp, Homo sapiens
ctgctgtgcagacagactctct

SEQ ID NO: 7955916 - DNA, 22 bp, Homo sapiens
ctgctgtgtggattcaatggct

SEQ ID NO: 7955917 - DNA, 22 bp, Homo sapiens
ctgctgtgtggattcaatggct

SEQ ID NO: 7955918 - DNA, 22 bp, Homo sapiens
ctgctgtgtggtgaaactcagt

SEQ ID NO: 7955919 - DNA, 22 bp, Homo sapiens
ctgctgtgtggtgaaactcagt

SEQ ID NO: 7955920 - DNA, 22 bp, Homo sapiens
ctgctgtgattgggagaaaccg

SEQ ID NO: 7955921 - DNA, 22 bp, Homo sapiens
ctgctgtgattgggagaaaccg

SEQ ID NO: 7955922 - DNA, 22 bp, Homo sapiens
ctgctgtgcacccaggaaggct

SEQ ID NO: 7955923 - DNA, 22 bp, Homo sapiens
ctgctgtgcaacattgcaccta

SEQ ID NO: 7955924 - DNA, 22 bp, Homo sapiens
ctgggacagagcagcagtgggg

SEQ ID NO: 7955925 - DNA, 22 bp, Homo sapiens
ctgggacagagcagcagtgggg

SEQ ID NO: 7955926 - DNA, 22 bp, Homo sapiens
ctgggacagagcagcagtgggg

SEQ ID NO: 7955927 - DNA, 22 bp, Homo sapiens
ctgggacagagcagcagtgggg

SEQ ID NO: 7955928 - DNA, 22 bp, Homo sapiens
ctgggacacccagagctgcaga

SEQ ID NO: 7955929 - DNA, 22 bp, Homo sapiens
ctgggacacccagagctgcaga

SEQ ID NO: 7955930 - DNA, 22 bp, Homo sapiens
ctgggacacccagagctgcaga

SEQ ID NO: 7955931 - DNA, 22 bp, Homo sapiens
ctgggacacccagagctgcaga

SEQ ID NO: 7955932 - DNA, 22 bp, Homo sapiens
ctgggaagaagtgggctacatt

SEQ ID NO: 7955933 - DNA, 22 bp, Homo sapiens
ctgggaagaagtgggctacatt

SEQ ID NO: 7955934 - DNA, 22 bp, Homo sapiens
ctgggaagaagtgggctacatt

SEQ ID NO: 7955935 - DNA, 22 bp, Homo sapiens
ctgggaagaagggacaacagcg

SEQ ID NO: 7955936 - DNA, 22 bp, Homo sapiens
ctgggaagaagggacaacagcg

SEQ ID NO: 7955937 - DNA, 22 bp, Homo sapiens
ctgggaagatggtgacagaatt

SEQ ID NO: 7955938 - DNA, 22 bp, Homo sapiens
ctgggaagatggtgacagaatt

SEQ ID NO: 7955939 - DNA, 22 bp, Homo sapiens
ctgggaagaatccaagggccct

SEQ ID NO: 7955940 - DNA, 22 bp, Homo sapiens
ctgggaagaagtgggctacatt

SEQ ID NO: 7955941 - DNA, 22 bp, Homo sapiens
ctgcttcacgttgtgccttgtt

SEQ ID NO: 7955942 - DNA, 22 bp, Homo sapiens
ctgcttcacttcggttgcatag

SEQ ID NO: 7955943 - DNA, 19 bp, Homo sapiens
ctgcttcaggcgccttgcc

SEQ ID NO: 7955944 - DNA, 22 bp, Homo sapiens
ctgcttcaccctgcctgagaac

SEQ ID NO: 7955945 - DNA, 22 bp, Homo sapiens
ctgcttcaccctgcctgagaac

SEQ ID NO: 7955946 - DNA, 22 bp, Homo sapiens
ctgcttcacgttgtgccttgtt

SEQ ID NO: 7955947 - DNA, 22 bp, Homo sapiens
ctgcttcaccctgcctgagaac

SEQ ID NO: 7955948 - DNA, 22 bp, Homo sapiens
ctgcttcatagccctggtctct

SEQ ID NO: 7955949 - DNA, 19 bp, Homo sapiens
ctgcttcaggcgccttgcc

SEQ ID NO: 7955950 - DNA, 22 bp, Homo sapiens
ctgcttcatatttcatagtgat

SEQ ID NO: 7955951 - DNA, 22 bp, Homo sapiens
ctgcttcatatttcatagtgat

SEQ ID NO: 7955952 - DNA, 22 bp, Homo sapiens
ctgcttccatggtctggagact

SEQ ID NO: 7955953 - DNA, 21 bp, Homo sapiens
ctgcttcctctcttcatggca

SEQ ID NO: 7955954 - DNA, 21 bp, Homo sapiens
ctgcttcctctcttcatggca

SEQ ID NO: 7955955 - DNA, 22 bp, Homo sapiens
ctgcttccatggtctggagact

SEQ ID NO: 7955956 - DNA, 20 bp, Homo sapiens
ctgcttccaggctcaccccc

SEQ ID NO: 7955957 - DNA, 20 bp, Homo sapiens
ctgcttccaggctcaccccc

SEQ ID NO: 7955958 - DNA, 22 bp, Homo sapiens
ctgcttccataaataatgtgct

SEQ ID NO: 7955959 - DNA, 22 bp, Homo sapiens
ctgggacatattgctagtgttg

SEQ ID NO: 7955960 - DNA, 22 bp, Homo sapiens
ctgggacatattgctagtgttg

SEQ ID NO: 7955961 - DNA, 22 bp, Homo sapiens
ctgggacatattgctagtgttg

SEQ ID NO: 7955962 - DNA, 22 bp, Homo sapiens
ctgggacatagatcagcctttt

SEQ ID NO: 7955963 - DNA, 22 bp, Homo sapiens
ctgggacagctgagacaggaga

SEQ ID NO: 7955964 - DNA, 22 bp, Homo sapiens
ctgggacagagcagcagtgggg

SEQ ID NO: 7955965 - DNA, 22 bp, Homo sapiens
ctgggacagctgagacaggaga

SEQ ID NO: 7955966 - DNA, 22 bp, Homo sapiens
ctgggacatgatagaaacagat

SEQ ID NO: 7955967 - DNA, 22 bp, Homo sapiens
ctgggacatgatagaaacagat

SEQ ID NO: 7955968 - DNA, 22 bp, Homo sapiens
ctgggacatgatagaaacagat

SEQ ID NO: 7955969 - DNA, 23 bp, Homo sapiens
ctgggacatggtaggggcacaac

SEQ ID NO: 7955970 - DNA, 23 bp, Homo sapiens
ctgggacatggtaggggcacaac

SEQ ID NO: 7955971 - DNA, 22 bp, Homo sapiens
ctgggacatgatagaaacagat

SEQ ID NO: 7955972 - DNA, 22 bp, Homo sapiens
ctgggacatgatagaaacagat

SEQ ID NO: 7955973 - DNA, 22 bp, Homo sapiens
ctgggacattataagaaacatt

SEQ ID NO: 7955974 - DNA, 22 bp, Homo sapiens
ctgggacatggtgctgtcttta

SEQ ID NO: 7955975 - DNA, 22 bp, Homo sapiens
ctgggacattataagaaacatt

SEQ ID NO: 7955976 - DNA, 22 bp, Homo sapiens
ctgggacatggtgctgtcttta

SEQ ID NO: 7955977 - DNA, 22 bp, Homo sapiens
ctgggacatggtgctgtcttta

SEQ ID NO: 7955978 - DNA, 22 bp, Homo sapiens
ctgggaccctgccctgtggcct

SEQ ID NO: 7955979 - DNA, 22 bp, Homo sapiens
ctgggacccccactgcgtagct

SEQ ID NO: 7955980 - DNA, 22 bp, Homo sapiens
ctgggaccagtgaagcaactca

SEQ ID NO: 7955981 - DNA, 22 bp, Homo sapiens
ctgggaccatctgtgtctactt

SEQ ID NO: 7955982 - DNA, 22 bp, Homo sapiens
ctgggaccctgccctgtggcct

SEQ ID NO: 7955983 - DNA, 22 bp, Homo sapiens
ctgggaccctgccctgtggcct

SEQ ID NO: 7955984 - DNA, 22 bp, Homo sapiens
ctgggacctcctcactgttcta

SEQ ID NO: 7955985 - DNA, 22 bp, Homo sapiens
ctgggacctcctgaggtggagc

SEQ ID NO: 7955986 - DNA, 22 bp, Homo sapiens
ctgggacctcggggtgatcaaa

SEQ ID NO: 7955987 - DNA, 22 bp, Homo sapiens
ctgggacctgtgtgcctgggcc

SEQ ID NO: 7955988 - DNA, 22 bp, Homo sapiens
ctgggacctgtgtgcctgggcc

SEQ ID NO: 7955989 - DNA, 22 bp, Homo sapiens
ctgggacctgtgtgcctgggcc

SEQ ID NO: 7955990 - DNA, 22 bp, Homo sapiens
ctgggacctgtgtgcctgggcc

SEQ ID NO: 7955991 - DNA, 18 bp, Homo sapiens
ctgggactcaatgctact

SEQ ID NO: 7955992 - DNA, 18 bp, Homo sapiens
ctgggactcaatgctact

SEQ ID NO: 7955993 - DNA, 22 bp, Homo sapiens
ctgggactcagaccagttctgt

SEQ ID NO: 7955994 - DNA, 22 bp, Homo sapiens
ctgggactcagaccagttctgt

SEQ ID NO: 7955995 - DNA, 22 bp, Homo sapiens
ctgggactcagaccagttctgt

SEQ ID NO: 7955996 - DNA, 19 bp, Homo sapiens
ctgggactcctgatacctt

SEQ ID NO: 7955997 - DNA, 22 bp, Homo sapiens
ctgggactcagaccagttctgt

SEQ ID NO: 7955998 - DNA, 22 bp, Homo sapiens
ctgggactgccattcacagcca

SEQ ID NO: 7955999 - DNA, 22 bp, Homo sapiens
ctgggactggacctctgcctgg

SEQ ID NO: 7956000 - DNA, 22 bp, Homo sapiens
ctgggactgccattcacagcca

SEQ ID NO: 7956001 - DNA, 22 bp, Homo sapiens
ctgggactgccattcacagcca

SEQ ID NO: 7956002 - DNA, 19 bp, Homo sapiens
ctgggactcctgatacctt

SEQ ID NO: 7956003 - DNA, 19 bp, Homo sapiens
ctgggactcctgatacctt

SEQ ID NO: 7956004 - DNA, 19 bp, Homo sapiens
ctgggactcctgatacctt

SEQ ID NO: 7956005 - DNA, 22 bp, Homo sapiens
ctgggagatctcctgagggcag

SEQ ID NO: 7956006 - DNA, 22 bp, Homo sapiens
ctgggagatctcctgagggcag

SEQ ID NO: 7956007 - DNA, 22 bp, Homo sapiens
ctgggagatctcctgagggcag

SEQ ID NO: 7956008 - DNA, 22 bp, Homo sapiens
ctgggagatctcctgagggcag

SEQ ID NO: 7956009 - DNA, 22 bp, Homo sapiens
ctgggagatctcctgagggcag

SEQ ID NO: 7956010 - DNA, 22 bp, Homo sapiens
ctgggagatatgaggatctgga

SEQ ID NO: 7956011 - DNA, 22 bp, Homo sapiens
ctgggagatatgaggatctgga

SEQ ID NO: 7956012 - DNA, 22 bp, Homo sapiens
ctgggagaggtggtgggaagta

SEQ ID NO: 7956013 - DNA, 22 bp, Homo sapiens
ctgggagaggtggtgggaagta

SEQ ID NO: 7956014 - DNA, 22 bp, Homo sapiens
ctgggagaggtggtgggaagta

SEQ ID NO: 7956015 - DNA, 22 bp, Homo sapiens
ctgggagaggtggtgggaagta

SEQ ID NO: 7956016 - DNA, 22 bp, Homo sapiens
ctgggagaggtggtgggaagta

SEQ ID NO: 7956017 - DNA, 22 bp, Homo sapiens
ctgggagatatgaggatctgga

SEQ ID NO: 7956018 - DNA, 22 bp, Homo sapiens
ctgggagatatgaggatctgga

SEQ ID NO: 7956019 - DNA, 22 bp, Homo sapiens
ctgggagatatgaggatctgga

SEQ ID NO: 7956020 - DNA, 22 bp, Homo sapiens
ctgggagaggtggtgggaagta

SEQ ID NO: 7956021 - DNA, 22 bp, Homo sapiens
ctgggactggacctctgcctgg

SEQ ID NO: 7956022 - DNA, 22 bp, Homo sapiens
ctgggactgggtcctcaggaca

SEQ ID NO: 7956023 - DNA, 22 bp, Homo sapiens
ctgggactgggtcctcaggaca

SEQ ID NO: 7956024 - DNA, 22 bp, Homo sapiens
ctgggacttgcagagcaggagg

SEQ ID NO: 7956025 - DNA, 22 bp, Homo sapiens
ctgggacttgcagagcaggagg

SEQ ID NO: 7956026 - DNA, 22 bp, Homo sapiens
ctgggacttgatgaaatgactg

SEQ ID NO: 7956027 - DNA, 22 bp, Homo sapiens
ctgggacttgcagagcaggagg

SEQ ID NO: 7956028 - DNA, 22 bp, Homo sapiens
ctgggacttgcagagcaggagg

SEQ ID NO: 7956029 - DNA, 22 bp, Homo sapiens
ctgggacttgggctatgctctg

SEQ ID NO: 7956030 - DNA, 22 bp, Homo sapiens
ctgggacttgcagagcaggagg

SEQ ID NO: 7956031 - DNA, 22 bp, Homo sapiens
ctgggacttgtagtctcggcgc

SEQ ID NO: 7956032 - DNA, 22 bp, Homo sapiens
ctgggagaggctgctccgctct

SEQ ID NO: 7956033 - DNA, 22 bp, Homo sapiens
ctgggagattgaggccatggtg

SEQ ID NO: 7956034 - DNA, 22 bp, Homo sapiens
ctgggagattgaggccatggtg

SEQ ID NO: 7956035 - DNA, 22 bp, Homo sapiens
ctgggagattcaggtgaagttt

SEQ ID NO: 7956036 - DNA, 22 bp, Homo sapiens
ctgggagattcaggtgaagttt

SEQ ID NO: 7956037 - DNA, 22 bp, Homo sapiens
ctgggagattcaggtgaagttt

SEQ ID NO: 7956038 - DNA, 22 bp, Homo sapiens
ctgggagattcaggtgaagttt

SEQ ID NO: 7956039 - DNA, 22 bp, Homo sapiens
ctgggagattgctagagatgca

SEQ ID NO: 7956040 - DNA, 22 bp, Homo sapiens
ctgggagattgctagagatgca

SEQ ID NO: 7956041 - DNA, 22 bp, Homo sapiens
ctgggagattgctagagatgca

SEQ ID NO: 7956042 - DNA, 22 bp, Homo sapiens
ctgggagattgaggccatggtg

SEQ ID NO: 7956043 - DNA, 22 bp, Homo sapiens
ctgggagattgaggccatggtg

SEQ ID NO: 7956044 - DNA, 22 bp, Homo sapiens
ctgggagattgaggccatggtg

SEQ ID NO: 7956045 - DNA, 22 bp, Homo sapiens
ctgggagatctgttgggactgg

SEQ ID NO: 7956046 - DNA, 22 bp, Homo sapiens
ctgggagatctgttgggactgg

SEQ ID NO: 7956047 - DNA, 22 bp, Homo sapiens
ctgggagatctgttgggactgg

SEQ ID NO: 7956048 - DNA, 22 bp, Homo sapiens
ctgggagatctgttgggactgg

SEQ ID NO: 7956049 - DNA, 22 bp, Homo sapiens
ctgggagatctcctgagggcag

SEQ ID NO: 7956050 - DNA, 22 bp, Homo sapiens
ctgggagatctcctgagggcag

SEQ ID NO: 7956051 - DNA, 22 bp, Homo sapiens
ctgggagatctcctgagggcag

SEQ ID NO: 7956052 - DNA, 22 bp, Homo sapiens
ctgggagatctcctgagggcag

SEQ ID NO: 7956053 - DNA, 22 bp, Homo sapiens
ctgggagatctcctgagggcag

SEQ ID NO: 7956054 - DNA, 22 bp, Homo sapiens
ctgggagatctcctgagggcag

SEQ ID NO: 7956055 - DNA, 22 bp, Homo sapiens
ctgggagatgactcagagcagg

SEQ ID NO: 7956056 - DNA, 22 bp, Homo sapiens
ctgggagatgactcagagcagg

SEQ ID NO: 7956057 - DNA, 22 bp, Homo sapiens
ctgggagatctgttgggactgg

SEQ ID NO: 7956058 - DNA, 22 bp, Homo sapiens
ctgggagatctgttgggactgg

SEQ ID NO: 7956059 - DNA, 22 bp, Homo sapiens
ctgggcactgcagggtgttgag

SEQ ID NO: 7956060 - DNA, 22 bp, Homo sapiens
ctgggcactgcagcaggcatca

SEQ ID NO: 7956061 - DNA, 22 bp, Homo sapiens
ctgggcacttgctcacagctct

SEQ ID NO: 7956062 - DNA, 22 bp, Homo sapiens
ctgggcacttgctcacagctct

SEQ ID NO: 7956063 - DNA, 22 bp, Homo sapiens
ctgggcacttgctcacagctct

SEQ ID NO: 7956064 - DNA, 22 bp, Homo sapiens
ctgggcacttgctcacagctct

SEQ ID NO: 7956065 - DNA, 22 bp, Homo sapiens
ctgggcactgcagcaggcatca

SEQ ID NO: 7956066 - DNA, 22 bp, Homo sapiens
ctgggcactgcagcaggcatca

SEQ ID NO: 7956067 - DNA, 22 bp, Homo sapiens
ctgggcactgcagcaggcatca

SEQ ID NO: 7956068 - DNA, 22 bp, Homo sapiens
ctgggcactgcagcaggcatca

SEQ ID NO: 7956069 - DNA, 22 bp, Homo sapiens
ctgggcacctttgcagcaggct

SEQ ID NO: 7956070 - DNA, 22 bp, Homo sapiens
ctgggcaaattgtgccagctat

SEQ ID NO: 7956071 - DNA, 22 bp, Homo sapiens
ctgggagcggctgtcactggtt

SEQ ID NO: 7956072 - DNA, 22 bp, Homo sapiens
ctgggagcggctgtcactggtt

SEQ ID NO: 7956073 - DNA, 22 bp, Homo sapiens
ctgggagcggctgtcactggtt

SEQ ID NO: 7956074 - DNA, 22 bp, Homo sapiens
ctgggagcggctgtcactggtt

SEQ ID NO: 7956075 - DNA, 22 bp, Homo sapiens
ctgggagcggctgtcactggtt

SEQ ID NO: 7956076 - DNA, 17 bp, Homo sapiens
ctgggatgtggactctt

SEQ ID NO: 7956077 - DNA, 17 bp, Homo sapiens
ctgggatgtggactctt

SEQ ID NO: 7956078 - DNA, 22 bp, Homo sapiens
ctgggatgtgaggagcgcctct

SEQ ID NO: 7956079 - DNA, 17 bp, Homo sapiens
ctgggatgtggactctt

SEQ ID NO: 7956080 - DNA, 22 bp, Homo sapiens
ctgggcaaattgtgccagctat

SEQ ID NO: 7956081 - DNA, 22 bp, Homo sapiens
ctgggcaatatgctgggcctgg

SEQ ID NO: 7956082 - DNA, 22 bp, Homo sapiens
ctgggagcgcagcaggcacaac

SEQ ID NO: 7956083 - DNA, 22 bp, Homo sapiens
ctgggagcgcagcaggcacaac

SEQ ID NO: 7956084 - DNA, 22 bp, Homo sapiens
ctgggagcctggcagttgctga

SEQ ID NO: 7956085 - DNA, 22 bp, Homo sapiens
ctgggagcgcagcaggcacaac

SEQ ID NO: 7956086 - DNA, 22 bp, Homo sapiens
ctgggagcgcagcaggcacaac

SEQ ID NO: 7956087 - DNA, 22 bp, Homo sapiens
ctgggagcgcagcaggcacaac

SEQ ID NO: 7956088 - DNA, 22 bp, Homo sapiens
ctgggagcgcagcaggcacaac

SEQ ID NO: 7956089 - DNA, 22 bp, Homo sapiens
ctgggagcgcagcaggcacaac

SEQ ID NO: 7956090 - DNA, 22 bp, Homo sapiens
ctgggagcgcagcaggcacaac

SEQ ID NO: 7956091 - DNA, 22 bp, Homo sapiens
ctgggagcgcagcaggcacaac

SEQ ID NO: 7956092 - DNA, 22 bp, Homo sapiens
ctgggagccctgactagcctgg

SEQ ID NO: 7956093 - DNA, 22 bp, Homo sapiens
ctgggagccctgactagcctgg

SEQ ID NO: 7956094 - DNA, 22 bp, Homo sapiens
ctgggagcctggcagttgctga

SEQ ID NO: 7956095 - DNA, 22 bp, Homo sapiens
ctgggagcctggcagttgctga

SEQ ID NO: 7956096 - DNA, 22 bp, Homo sapiens
ctgggagcctggcagttgctga

SEQ ID NO: 7956097 - DNA, 22 bp, Homo sapiens
ctgggagcctggcagttgctga

SEQ ID NO: 7956098 - DNA, 22 bp, Homo sapiens
ctgggagcaagaggctgcaaat

SEQ ID NO: 7956099 - DNA, 22 bp, Homo sapiens
ctgggagcaagaggctgcaaat

SEQ ID NO: 7956100 - DNA, 22 bp, Homo sapiens
ctgggagattgctagagatgca

SEQ ID NO: 7956101 - DNA, 22 bp, Homo sapiens
ctgggagattgctagagatgca

SEQ ID NO: 7956102 - DNA, 22 bp, Homo sapiens
ctgggagattgctagagatgca

SEQ ID NO: 7956103 - DNA, 22 bp, Homo sapiens
ctgggagattgctagagatgca

SEQ ID NO: 7956104 - DNA, 22 bp, Homo sapiens
ctgggagattgctagagatgca

SEQ ID NO: 7956105 - DNA, 22 bp, Homo sapiens
ctgggagcaagtcaggaaaggt

SEQ ID NO: 7956106 - DNA, 22 bp, Homo sapiens
ctgggagcaagtcaggaaaggt

SEQ ID NO: 7956107 - DNA, 22 bp, Homo sapiens
ctgggagcaagtcaggaaaggt

SEQ ID NO: 7956108 - DNA, 22 bp, Homo sapiens
ctgggagcaccatacttgtttc

SEQ ID NO: 7956109 - DNA, 22 bp, Homo sapiens
ctgggagcccgcgtcctggtgg

SEQ ID NO: 7956110 - DNA, 22 bp, Homo sapiens
ctgggagcccgcgtcctggtgg

SEQ ID NO: 7956111 - DNA, 22 bp, Homo sapiens
ctgggagcccgcgtcctggtgg

SEQ ID NO: 7956112 - DNA, 22 bp, Homo sapiens
ctgggcagctaccaccactgct

SEQ ID NO: 7956113 - DNA, 22 bp, Homo sapiens
ctgggcagctaccaccactgct

SEQ ID NO: 7956114 - DNA, 22 bp, Homo sapiens
ctgggcagcctcacacaatgtt

SEQ ID NO: 7956115 - DNA, 22 bp, Homo sapiens
ctgggcagctccataccaccca

SEQ ID NO: 7956116 - DNA, 22 bp, Homo sapiens
ctgggcagctccataccaccca

SEQ ID NO: 7956117 - DNA, 22 bp, Homo sapiens
ctgggcagctccataccaccca

SEQ ID NO: 7956118 - DNA, 22 bp, Homo sapiens
ctgggcagctgtatcagggagt

SEQ ID NO: 7956119 - DNA, 22 bp, Homo sapiens
ctgggcagctgtatcagggagt

SEQ ID NO: 7956120 - DNA, 22 bp, Homo sapiens
ctgggcagctgtatcagggagt

SEQ ID NO: 7956121 - DNA, 22 bp, Homo sapiens
ctgggcagctgtatcagggagt

SEQ ID NO: 7956122 - DNA, 22 bp, Homo sapiens
ctgggcagctgtatcagggagt

SEQ ID NO: 7956123 - DNA, 22 bp, Homo sapiens
ctgggcagctgtatcagggagt

SEQ ID NO: 7956124 - DNA, 22 bp, Homo sapiens
ctgggcagctgtatcagggagt

SEQ ID NO: 7956125 - DNA, 22 bp, Homo sapiens
ctgggcagctgtatcagggagt

SEQ ID NO: 7956126 - DNA, 22 bp, Homo sapiens
ctgggcagctgtatcagggagt

SEQ ID NO: 7956127 - DNA, 22 bp, Homo sapiens
ctgggcagctgtgcaaacaata

SEQ ID NO: 7956128 - DNA, 22 bp, Homo sapiens
ctgggcctccagctctgccagc

SEQ ID NO: 7956129 - DNA, 22 bp, Homo sapiens
ctgggcagctgtgcaaacaata

SEQ ID NO: 7956130 - DNA, 22 bp, Homo sapiens
ctgggcagctgtgcaaacaata

SEQ ID NO: 7956131 - DNA, 22 bp, Homo sapiens
ctgggcagagtccggaagatgg

SEQ ID NO: 7956132 - DNA, 22 bp, Homo sapiens
ctgggcagcctcacacaatgtt

SEQ ID NO: 7956133 - DNA, 22 bp, Homo sapiens
ctgggcagcacatcatcgtatc

SEQ ID NO: 7956134 - DNA, 22 bp, Homo sapiens
ctgggcagcacatcatcgtatc

SEQ ID NO: 7956135 - DNA, 22 bp, Homo sapiens
ctgggcagagctaacacctgag

SEQ ID NO: 7956136 - DNA, 22 bp, Homo sapiens
ctgggcagagtccggaagatgg

SEQ ID NO: 7956137 - DNA, 22 bp, Homo sapiens
ctgggcagagctaacacctgag

SEQ ID NO: 7956138 - DNA, 22 bp, Homo sapiens
ctgggcagagctaacacctgag

SEQ ID NO: 7956139 - DNA, 22 bp, Homo sapiens
ctgggcagagctaacacctgag

SEQ ID NO: 7956140 - DNA, 22 bp, Homo sapiens
ctgggcagaattttaggatggc

SEQ ID NO: 7956141 - DNA, 22 bp, Homo sapiens
ctgggcagaattttaggatggc

SEQ ID NO: 7956142 - DNA, 22 bp, Homo sapiens
ctgggcagaattttaggatggc

SEQ ID NO: 7956143 - DNA, 22 bp, Homo sapiens
ctgggcagaattttaggatggc

SEQ ID NO: 7956144 - DNA, 22 bp, Homo sapiens
ctgggcagaattttaggatggc

SEQ ID NO: 7956145 - DNA, 22 bp, Homo sapiens
ctgggcagaattttaggatggc

SEQ ID NO: 7956146 - DNA, 22 bp, Homo sapiens
ctgggcactttggggagcctac

SEQ ID NO: 7956147 - DNA, 22 bp, Homo sapiens
ctgggcactttggggagcctac

SEQ ID NO: 7956148 - DNA, 22 bp, Homo sapiens
ctgggcactttggggagcctac

SEQ ID NO: 7956149 - DNA, 22 bp, Homo sapiens
ctgggcactttggggagcctac

SEQ ID NO: 7956150 - DNA, 22 bp, Homo sapiens
ctgggcactttggggagcctac

SEQ ID NO: 7956151 - DNA, 22 bp, Homo sapiens
ctgggcacttgctcacagctct

SEQ ID NO: 7956152 - DNA, 22 bp, Homo sapiens
ctgggcacttgctcacagctct

SEQ ID NO: 7956153 - DNA, 22 bp, Homo sapiens
ctgggcctccagctctgccagc

SEQ ID NO: 7956154 - DNA, 17 bp, Homo sapiens
ctgggcctcccctgtcc

SEQ ID NO: 7956155 - DNA, 17 bp, Homo sapiens
ctgggcctcccctgtcc

SEQ ID NO: 7956156 - DNA, 22 bp, Homo sapiens
ctgggcctccagctctgccagc

SEQ ID NO: 7956157 - DNA, 22 bp, Homo sapiens
ctgggcctccagctctgccagc

SEQ ID NO: 7956158 - DNA, 22 bp, Homo sapiens
ctgggcctcctctgcccaagct

SEQ ID NO: 7956159 - DNA, 22 bp, Homo sapiens
ctgggcctcctctgcccaagct

SEQ ID NO: 7956160 - DNA, 17 bp, Homo sapiens
ctgggcctcccctgtcc

SEQ ID NO: 7956161 - DNA, 17 bp, Homo sapiens
ctgggcctcccctgtcc

SEQ ID NO: 7956162 - DNA, 22 bp, Homo sapiens
ctgggcctcctctgcccaagct

SEQ ID NO: 7956163 - DNA, 22 bp, Homo sapiens
ctgggcctcctctgcccaagct

SEQ ID NO: 7956164 - DNA, 22 bp, Homo sapiens
ctgggcctggtgtggcacctgc

SEQ ID NO: 7956165 - DNA, 22 bp, Homo sapiens
ctgggcctggtgtggcacctgc

SEQ ID NO: 7956166 - DNA, 22 bp, Homo sapiens
ctgggcctggtgtggcacctgc

SEQ ID NO: 7956167 - DNA, 22 bp, Homo sapiens
ctgggccttagggcactccctt

SEQ ID NO: 7956168 - DNA, 22 bp, Homo sapiens
ctgggccttagggcactccctt

SEQ ID NO: 7956169 - DNA, 22 bp, Homo sapiens
ctgggcctgtgggcacacggac

SEQ ID NO: 7956170 - DNA, 22 bp, Homo sapiens
ctgggcctgtgactcccatcct

SEQ ID NO: 7956171 - DNA, 22 bp, Homo sapiens
ctgggcctgtgactcccatcct

SEQ ID NO: 7956172 - DNA, 22 bp, Homo sapiens
ctgggcctgtgactcccatcct

SEQ ID NO: 7956173 - DNA, 22 bp, Homo sapiens
ctgggcctgtgggcacacggac

SEQ ID NO: 7956174 - DNA, 22 bp, Homo sapiens
ctgggcctgtgactcccatcct

SEQ ID NO: 7956175 - DNA, 22 bp, Homo sapiens
ctgggcctgtccctgattgagg

SEQ ID NO: 7956176 - DNA, 22 bp, Homo sapiens
ctgggcctgtccctgattgagg

SEQ ID NO: 7956177 - DNA, 22 bp, Homo sapiens
ctgggcctgtccctgattgagg

SEQ ID NO: 7956178 - DNA, 22 bp, Homo sapiens
ctgggcctgtcagggctttttg

SEQ ID NO: 7956179 - DNA, 22 bp, Homo sapiens
ctgggcctgtcagggctttttg

SEQ ID NO: 7956180 - DNA, 22 bp, Homo sapiens
ctgggccttatgagtacctgga

SEQ ID NO: 7956181 - DNA, 22 bp, Homo sapiens
ctgggccttatgagtacctgga

SEQ ID NO: 7956182 - DNA, 22 bp, Homo sapiens
ctgggccttatgagtacctgga

SEQ ID NO: 7956183 - DNA, 22 bp, Homo sapiens
ctgggccttatgagtacctgga

SEQ ID NO: 7956184 - DNA, 22 bp, Homo sapiens
ctgggccttagggcactccctt

SEQ ID NO: 7956185 - DNA, 22 bp, Homo sapiens
ctgggccttatgagtacctgga

SEQ ID NO: 7956186 - DNA, 22 bp, Homo sapiens
ctgggccttatgagtacctgga

SEQ ID NO: 7956187 - DNA, 22 bp, Homo sapiens
ctgggccttcattgctctccca

SEQ ID NO: 7956188 - DNA, 22 bp, Homo sapiens
ctgggccttcattgctctccca

SEQ ID NO: 7956189 - DNA, 22 bp, Homo sapiens
ctgggccttcattgctctccca

SEQ ID NO: 7956190 - DNA, 22 bp, Homo sapiens
ctgggccttcattgctctccca

SEQ ID NO: 7956191 - DNA, 22 bp, Homo sapiens
ctgggccttcattgctctccca

SEQ ID NO: 7956192 - DNA, 22 bp, Homo sapiens
ctgggccttgagaatcatgttt

SEQ ID NO: 7956193 - DNA, 22 bp, Homo sapiens
ctgggccttgagaatcatgttt

SEQ ID NO: 7956194 - DNA, 22 bp, Homo sapiens
ctgggccttgagaatcatgttt

SEQ ID NO: 7956195 - DNA, 22 bp, Homo sapiens
ctgggccttgccttgcccacag

SEQ ID NO: 7956196 - DNA, 22 bp, Homo sapiens
ctgggccttgccttgcccacag

SEQ ID NO: 7956197 - DNA, 22 bp, Homo sapiens
ctgggccttgccttgcccacag

SEQ ID NO: 7956198 - DNA, 22 bp, Homo sapiens
ctgggccttgccaggggtgtct

SEQ ID NO: 7956199 - DNA, 22 bp, Homo sapiens
ctgggccttgccaggggtgtct

SEQ ID NO: 7956200 - DNA, 22 bp, Homo sapiens
ctgggccttgcatcccagagcc

SEQ ID NO: 7956201 - DNA, 22 bp, Homo sapiens
ctgggccttgcatcccagagcc

SEQ ID NO: 7956202 - DNA, 22 bp, Homo sapiens
ctgggccttgcatcccagagcc

SEQ ID NO: 7956203 - DNA, 22 bp, Homo sapiens
ctgggccttgcatcccagagcc

SEQ ID NO: 7956204 - DNA, 22 bp, Homo sapiens
ctgggccttgatcacacaggtg

SEQ ID NO: 7956205 - DNA, 22 bp, Homo sapiens
ctgggccttgatcacacaggtg

SEQ ID NO: 7956206 - DNA, 22 bp, Homo sapiens
ctgggccttgatcacacaggtg

SEQ ID NO: 7956207 - DNA, 22 bp, Homo sapiens
ctgggccttgcatcccagagcc

SEQ ID NO: 7956208 - DNA, 22 bp, Homo sapiens
ctgggctggagtgcaatggcgc

SEQ ID NO: 7956209 - DNA, 22 bp, Homo sapiens
ctgggctggagtgcaatggcgc

SEQ ID NO: 7956210 - DNA, 22 bp, Homo sapiens
ctgggctggagtgcaatggcgc

SEQ ID NO: 7956211 - DNA, 22 bp, Homo sapiens
ctgggctggagtgcaatggcgc

SEQ ID NO: 7956212 - DNA, 22 bp, Homo sapiens
ctgggctggataattctttgct

SEQ ID NO: 7956213 - DNA, 21 bp, Homo sapiens
ctgggctggcaggcattacct

SEQ ID NO: 7956214 - DNA, 21 bp, Homo sapiens
ctgggctggcaggcattacct

SEQ ID NO: 7956215 - DNA, 22 bp, Homo sapiens
ctgggctggcgcatccgacacg

SEQ ID NO: 7956216 - DNA, 22 bp, Homo sapiens
ctgggctggataattctttgct

SEQ ID NO: 7956217 - DNA, 21 bp, Homo sapiens
ctgggctggcaggcattacct

SEQ ID NO: 7956218 - DNA, 22 bp, Homo sapiens
ctgggctcaaatcctatctcca

SEQ ID NO: 7956219 - DNA, 22 bp, Homo sapiens
ctgggctcaaatcctatctcca

SEQ ID NO: 7956220 - DNA, 22 bp, Homo sapiens
ctgggctggagtgcaatggcgc

SEQ ID NO: 7956221 - DNA, 22 bp, Homo sapiens
ctgggctcaaatcctatctcca

SEQ ID NO: 7956222 - DNA, 22 bp, Homo sapiens
ctgggctcaaatcctatctcca

SEQ ID NO: 7956223 - DNA, 22 bp, Homo sapiens
ctgggctcaaatcctatctcca

SEQ ID NO: 7956224 - DNA, 22 bp, Homo sapiens
ctgggctagaaggaccaggatg

SEQ ID NO: 7956225 - DNA, 22 bp, Homo sapiens
ctgggctgtttgttctggtctc

SEQ ID NO: 7956226 - DNA, 22 bp, Homo sapiens
ctgggctgtttgttctggtctc

SEQ ID NO: 7956227 - DNA, 22 bp, Homo sapiens
ctgggctgtttgttctggtctc

SEQ ID NO: 7956228 - DNA, 22 bp, Homo sapiens
ctgggctgtttgttctggtctc

SEQ ID NO: 7956229 - DNA, 22 bp, Homo sapiens
ctgggctgtttgttctggtctc

SEQ ID NO: 7956230 - DNA, 22 bp, Homo sapiens
ctgggctgtttgttctggtctc

SEQ ID NO: 7956231 - DNA, 22 bp, Homo sapiens
ctgggctgttctgcccctgggt

SEQ ID NO: 7956232 - DNA, 22 bp, Homo sapiens
ctgggcttagcagctcctggtc

SEQ ID NO: 7956233 - DNA, 22 bp, Homo sapiens
ctgggcttaggacctggtgcgg

SEQ ID NO: 7956234 - DNA, 22 bp, Homo sapiens
ctgggctgtttgttctggtctc

SEQ ID NO: 7956235 - DNA, 22 bp, Homo sapiens
ctgggctgtttgtttagaatgg

SEQ ID NO: 7956236 - DNA, 22 bp, Homo sapiens
ctgggcttagcagctcctggtc

SEQ ID NO: 7956237 - DNA, 22 bp, Homo sapiens
ctgggcttagcagctcctggtc

SEQ ID NO: 7956238 - DNA, 22 bp, Homo sapiens
ctgggcttagcagctcctggtc

SEQ ID NO: 7956239 - DNA, 22 bp, Homo sapiens
ctgggccttggattgacactgt

SEQ ID NO: 7956240 - DNA, 22 bp, Homo sapiens
ctgggccttggattgacactgt

SEQ ID NO: 7956241 - DNA, 22 bp, Homo sapiens
ctgggccttggattgacactgt

SEQ ID NO: 7956242 - DNA, 22 bp, Homo sapiens
ctgggccttggattgacactgt

SEQ ID NO: 7956243 - DNA, 22 bp, Homo sapiens
ctgggccttggattgacactgt

SEQ ID NO: 7956244 - DNA, 22 bp, Homo sapiens
ctgggcctttacctacggagtt

SEQ ID NO: 7956245 - DNA, 18 bp, Homo sapiens
ctgggcctttgtattttt

SEQ ID NO: 7956246 - DNA, 22 bp, Homo sapiens
ctgggcctttgggagttcggtg

SEQ ID NO: 7956247 - DNA, 22 bp, Homo sapiens
ctgggcctttgggagttcggtg

SEQ ID NO: 7956248 - DNA, 22 bp, Homo sapiens
ctgggcctttacctacggagtt

SEQ ID NO: 7956249 - DNA, 22 bp, Homo sapiens
ctgggcctttgcttattaattt

SEQ ID NO: 7956250 - DNA, 22 bp, Homo sapiens
ctgggcctttgcttattaattt

SEQ ID NO: 7956251 - DNA, 22 bp, Homo sapiens
ctgggcgcgtcccctgaggcgg

SEQ ID NO: 7956252 - DNA, 18 bp, Homo sapiens
ctgggcctttgtattttt

SEQ ID NO: 7956253 - DNA, 22 bp, Homo sapiens
ctgggcgcgtcccctgaggcgg

SEQ ID NO: 7956254 - DNA, 22 bp, Homo sapiens
ctgggcgcgtcccctgaggcgg

SEQ ID NO: 7956255 - DNA, 22 bp, Homo sapiens
ctgggctaattaagcacagctg

SEQ ID NO: 7956256 - DNA, 22 bp, Homo sapiens
ctgggcgtgtcttccagctggc

SEQ ID NO: 7956257 - DNA, 22 bp, Homo sapiens
ctgggcgtgtcttccagctggc

SEQ ID NO: 7956258 - DNA, 22 bp, Homo sapiens
ctgggctagaaggaccaggatg

SEQ ID NO: 7956259 - DNA, 22 bp, Homo sapiens
ctgggctagaaggaccaggatg

SEQ ID NO: 7956260 - DNA, 22 bp, Homo sapiens
ctgggctagaaggaccaggatg

SEQ ID NO: 7956261 - DNA, 22 bp, Homo sapiens
ctgggctaattaagcacagctg

SEQ ID NO: 7956262 - DNA, 22 bp, Homo sapiens
ctgggctagaaggaccaggatg

SEQ ID NO: 7956263 - DNA, 21 bp, Homo sapiens
cttttctctccgcaggacatt

SEQ ID NO: 7956264 - DNA, 21 bp, Homo sapiens
cttttctagtcccagccccgc

SEQ ID NO: 7956265 - DNA, 22 bp, Homo sapiens
cttttctctgcaccatgtgtga

SEQ ID NO: 7956266 - DNA, 22 bp, Homo sapiens
cttttctctgcaccatgtgtga

SEQ ID NO: 7956267 - DNA, 22 bp, Homo sapiens
cttttctctgcgggtctttcat

SEQ ID NO: 7956268 - DNA, 22 bp, Homo sapiens
cttttctctgcaccatgtgtga

SEQ ID NO: 7956269 - DNA, 22 bp, Homo sapiens
cttttctctgcaccatgtgtga

SEQ ID NO: 7956270 - DNA, 22 bp, Homo sapiens
cttttctctgcgggtctttcat

SEQ ID NO: 7956271 - DNA, 21 bp, Homo sapiens
cttttctagtcccagccccgc

SEQ ID NO: 7956272 - DNA, 22 bp, Homo sapiens
cttttctactaatgagtagcta

SEQ ID NO: 7956273 - DNA, 22 bp, Homo sapiens
cttttctactaatgagtagcta

SEQ ID NO: 7956274 - DNA, 22 bp, Homo sapiens
cttttcctcaggaggagacgcg

SEQ ID NO: 7956275 - DNA, 22 bp, Homo sapiens
cttttcctcaggaggagacgcg

SEQ ID NO: 7956276 - DNA, 22 bp, Homo sapiens
cttttcctcaggaggagacgcg

SEQ ID NO: 7956277 - DNA, 22 bp, Homo sapiens
cttttcctattgattctgttac

SEQ ID NO: 7956278 - DNA, 22 bp, Homo sapiens
cttttcctattgattctgttac

SEQ ID NO: 7956279 - DNA, 22 bp, Homo sapiens
cttttctcttacattccactgg

SEQ ID NO: 7956280 - DNA, 22 bp, Homo sapiens
cttttctcttacattccactgg

SEQ ID NO: 7956281 - DNA, 22 bp, Homo sapiens
cttttctctgcgggtctttcat

SEQ ID NO: 7956282 - DNA, 22 bp, Homo sapiens
cttttctcttacattccactgg

SEQ ID NO: 7956283 - DNA, 22 bp, Homo sapiens
cttttctcttacattccactgg

SEQ ID NO: 7956284 - DNA, 22 bp, Homo sapiens
cttttctcttacattccactgg

SEQ ID NO: 7956285 - DNA, 22 bp, Homo sapiens
cttttctggaatcatctctaac

SEQ ID NO: 7956286 - DNA, 22 bp, Homo sapiens
cttttctcttacattccactgg

SEQ ID NO: 7956287 - DNA, 22 bp, Homo sapiens
cttttctgagagggccaagatt

SEQ ID NO: 7956288 - DNA, 22 bp, Homo sapiens
cttttctgtgatgctgacagtc

SEQ ID NO: 7956289 - DNA, 22 bp, Homo sapiens
cttttctgtatcaaaaggatta

SEQ ID NO: 7956290 - DNA, 22 bp, Homo sapiens
cttttctgtatcaaaaggatta

SEQ ID NO: 7956291 - DNA, 22 bp, Homo sapiens
cttttctgtatcaaaaggatta

SEQ ID NO: 7956292 - DNA, 22 bp, Homo sapiens
cttttcttgtattggatgcccc

SEQ ID NO: 7956293 - DNA, 22 bp, Homo sapiens
cttttcttgtattggatgcccc

SEQ ID NO: 7956294 - DNA, 22 bp, Homo sapiens
cttttcttgtattggatgcccc

SEQ ID NO: 7956295 - DNA, 22 bp, Homo sapiens
cttttcttgtattggatgcccc

SEQ ID NO: 7956296 - DNA, 22 bp, Homo sapiens
cttttcttctcacggctgtcag

SEQ ID NO: 7956297 - DNA, 22 bp, Homo sapiens
cttttcttctcacggctgtcag

SEQ ID NO: 7956298 - DNA, 22 bp, Homo sapiens
cttttcttctcacggctgtcag

SEQ ID NO: 7956299 - DNA, 22 bp, Homo sapiens
cttttgattgagcagtttcaaa

SEQ ID NO: 7956300 - DNA, 22 bp, Homo sapiens
cttttgattgagcagtttcaaa

SEQ ID NO: 7956301 - DNA, 22 bp, Homo sapiens
cttttgatggagttcaagaagc

SEQ ID NO: 7956302 - DNA, 22 bp, Homo sapiens
cttttcttgtattggatgcccc

SEQ ID NO: 7956303 - DNA, 22 bp, Homo sapiens
cttttcttgtattggatgcccc

SEQ ID NO: 7956304 - DNA, 21 bp, Homo sapiens
cttttctgtgttcctccctgt

SEQ ID NO: 7956305 - DNA, 22 bp, Homo sapiens
cttttctgtgatgctgacagtc

SEQ ID NO: 7956306 - DNA, 22 bp, Homo sapiens
cttttcttactcccgcaaggca

SEQ ID NO: 7956307 - DNA, 22 bp, Homo sapiens
cttttcttactcccgcaaggca

SEQ ID NO: 7956308 - DNA, 22 bp, Homo sapiens
cttttcttactcccgcaaggca

SEQ ID NO: 7956309 - DNA, 22 bp, Homo sapiens
cttttcttatgtggacgtacct

SEQ ID NO: 7956310 - DNA, 22 bp, Homo sapiens
cttttcttatgtggacgtacct

SEQ ID NO: 7956311 - DNA, 22 bp, Homo sapiens
cttttcttatgtggacgtacct

SEQ ID NO: 7956312 - DNA, 22 bp, Homo sapiens
cttttcttatgtggacgtacct

SEQ ID NO: 7956313 - DNA, 22 bp, Homo sapiens
cttttacatttgttgaagagta

SEQ ID NO: 7956314 - DNA, 22 bp, Homo sapiens
cttttacatttgttgaagagta

SEQ ID NO: 7956315 - DNA, 22 bp, Homo sapiens
cttttacatttgttgaagagta

SEQ ID NO: 7956316 - DNA, 22 bp, Homo sapiens
cttttcattgtttgtacatgca

SEQ ID NO: 7956317 - DNA, 22 bp, Homo sapiens
cttttcattgtttgtacatgca

SEQ ID NO: 7956318 - DNA, 22 bp, Homo sapiens
cttttcattgtttgtacatgca

SEQ ID NO: 7956319 - DNA, 22 bp, Homo sapiens
cttttcattgtttgtacatgca

SEQ ID NO: 7956320 - DNA, 22 bp, Homo sapiens
cttttacatttgttgaagagta

SEQ ID NO: 7956321 - DNA, 22 bp, Homo sapiens
cttttcctattgattctgttac

SEQ ID NO: 7956322 - DNA, 22 bp, Homo sapiens
cttttcctattgattctgttac

SEQ ID NO: 7956323 - DNA, 22 bp, Homo sapiens
cttttcctattgattctgttac

SEQ ID NO: 7956324 - DNA, 22 bp, Homo sapiens
cttttccactgagcctcacaaa

SEQ ID NO: 7956325 - DNA, 22 bp, Homo sapiens
cttttccaaagtccatctggtc

SEQ ID NO: 7956326 - DNA, 22 bp, Homo sapiens
cttttccaaagtccatctggtc

SEQ ID NO: 7956327 - DNA, 22 bp, Homo sapiens
cttttccaaagtccatctggtc

SEQ ID NO: 7956328 - DNA, 22 bp, Homo sapiens
cttttccactgagcctcacaaa

SEQ ID NO: 7956329 - DNA, 21 bp, Homo sapiens
cttttacattcagtcatgatg

SEQ ID NO: 7956330 - DNA, 21 bp, Homo sapiens
cttttacattcagtcatgatg

SEQ ID NO: 7956331 - DNA, 21 bp, Homo sapiens
cttttacattcagtcatgatg

SEQ ID NO: 7956332 - DNA, 22 bp, Homo sapiens
cttttacagtggacctgccatt

SEQ ID NO: 7956333 - DNA, 22 bp, Homo sapiens
cttttacagtggacctgccatt

SEQ ID NO: 7956334 - DNA, 19 bp, Homo sapiens
ctttgcaggggatgggtga

SEQ ID NO: 7956335 - DNA, 17 bp, Homo sapiens
ctttgcagcagacatgt

SEQ ID NO: 7956336 - DNA, 22 bp, Homo sapiens
ctttgcagagggggtgggagct

SEQ ID NO: 7956337 - DNA, 22 bp, Homo sapiens
ctttgcagaagaaacctacaaa

SEQ ID NO: 7956338 - DNA, 22 bp, Homo sapiens
ctttgcaatagaggcacacatg

SEQ ID NO: 7956339 - DNA, 22 bp, Homo sapiens
ctttgcaatagaggcacacatg

SEQ ID NO: 7956340 - DNA, 22 bp, Homo sapiens
ctttgcaagggatttcatgtct

SEQ ID NO: 7956341 - DNA, 22 bp, Homo sapiens
ctttgcaagggatttcatgtct

SEQ ID NO: 7956342 - DNA, 22 bp, Homo sapiens
ctttgcaagggatttcatgtct

SEQ ID NO: 7956343 - DNA, 22 bp, Homo sapiens
ctttgattcagagagaattagc

SEQ ID NO: 7956344 - DNA, 22 bp, Homo sapiens
ctttgattcagagagaattagc

SEQ ID NO: 7956345 - DNA, 22 bp, Homo sapiens
ctttgattcagagagaattagc

SEQ ID NO: 7956346 - DNA, 22 bp, Homo sapiens
ctttgattcagactttgtcggc

SEQ ID NO: 7956347 - DNA, 22 bp, Homo sapiens
ctttgattcagagagaattagc

SEQ ID NO: 7956348 - DNA, 23 bp, Homo sapiens
ctttgcaaaaacattagtcagtg

SEQ ID NO: 7956349 - DNA, 22 bp, Homo sapiens
ctttgatttctctggtccaatc

SEQ ID NO: 7956350 - DNA, 22 bp, Homo sapiens
ctttgattccaggcacatgttt

SEQ ID NO: 7956351 - DNA, 22 bp, Homo sapiens
ctttgattccaggcacatgttt

SEQ ID NO: 7956352 - DNA, 22 bp, Homo sapiens
ctttgcaaacgattaccacatg

SEQ ID NO: 7956353 - DNA, 22 bp, Homo sapiens
ctttgcaaactgtcacactttc

SEQ ID NO: 7956354 - DNA, 22 bp, Homo sapiens
ctttgcaaactgtcacactttc

SEQ ID NO: 7956355 - DNA, 23 bp, Homo sapiens
ctttgcaaaaacattagtcagtg

SEQ ID NO: 7956356 - DNA, 22 bp, Homo sapiens
ctttgcaaaagttaattgttga

SEQ ID NO: 7956357 - DNA, 22 bp, Homo sapiens
ctttgatataagtatacatagt

SEQ ID NO: 7956358 - DNA, 22 bp, Homo sapiens
ctttgcaaagtctttggcaaga

SEQ ID NO: 7956359 - DNA, 21 bp, Homo sapiens
ctttgcaagatgtctatgaaa

SEQ ID NO: 7956360 - DNA, 21 bp, Homo sapiens
ctttgcaagatgtctatgaaa

SEQ ID NO: 7956361 - DNA, 21 bp, Homo sapiens
ctttgcaagatgtctatgaaa

SEQ ID NO: 7956362 - DNA, 22 bp, Homo sapiens
gaaaattattgaaaatggctct

SEQ ID NO: 7956363 - DNA, 22 bp, Homo sapiens
gaaaattattgaaaatggctct

SEQ ID NO: 7956364 - DNA, 22 bp, Homo sapiens
gaaaattattgaaaatggctct

SEQ ID NO: 7956365 - DNA, 22 bp, Homo sapiens
gaaaatttaattctcttctgtg

SEQ ID NO: 7956366 - DNA, 22 bp, Homo sapiens
gaaaatttaattctcttctgtg

SEQ ID NO: 7956367 - DNA, 22 bp, Homo sapiens
gaaaatttaattctcttctgtg

SEQ ID NO: 7956368 - DNA, 22 bp, Homo sapiens
gaaaatttaattctcttctgtg

SEQ ID NO: 7956369 - DNA, 22 bp, Homo sapiens
gaaaatttagaactgaacttct

SEQ ID NO: 7956370 - DNA, 22 bp, Homo sapiens
gaaaatttagaactgaacttct

SEQ ID NO: 7956371 - DNA, 22 bp, Homo sapiens
gaaaatttctgccacatgtgtg

SEQ ID NO: 7956372 - DNA, 22 bp, Homo sapiens
gaaaatttagaactgaacttct

SEQ ID NO: 7956373 - DNA, 22 bp, Homo sapiens
gaaaatttagaactgaacttct

SEQ ID NO: 7956374 - DNA, 22 bp, Homo sapiens
gaaaatttagaactgaacttct

SEQ ID NO: 7956375 - DNA, 22 bp, Homo sapiens
gaaacaatcatcatgtgatttg

SEQ ID NO: 7956376 - DNA, 19 bp, Homo sapiens
gaaacaagtcattccagag

SEQ ID NO: 7956377 - DNA, 22 bp, Homo sapiens
gaaacaatacttgtcctcacta

SEQ ID NO: 7956378 - DNA, 22 bp, Homo sapiens
gaaaatttctgccacatgtgtg

SEQ ID NO: 7956379 - DNA, 22 bp, Homo sapiens
gaaaatttctgccacatgtgtg

SEQ ID NO: 7956380 - DNA, 22 bp, Homo sapiens
gaaaatttctgccacatgtgtg

SEQ ID NO: 7956381 - DNA, 22 bp, Homo sapiens
gaaacaactactattgatttct

SEQ ID NO: 7956382 - DNA, 22 bp, Homo sapiens
gaaacaactactattgatttct

SEQ ID NO: 7956383 - DNA, 22 bp, Homo sapiens
gaaaatgttagcttcatagtca

SEQ ID NO: 7956384 - DNA, 22 bp, Homo sapiens
gaaaatgtttcctgttatttgc

SEQ ID NO: 7956385 - DNA, 22 bp, Homo sapiens
gaaaatgtttcctgttatttgc

SEQ ID NO: 7956386 - DNA, 22 bp, Homo sapiens
gaaaatgtttcctgttatttgc

SEQ ID NO: 7956387 - DNA, 22 bp, Homo sapiens
gaaaattattgaaaatggctct

SEQ ID NO: 7956388 - DNA, 22 bp, Homo sapiens
gaaaattattgaaaatggctct

SEQ ID NO: 7956389 - DNA, 22 bp, Homo sapiens
gaaaatgtttgtccggagctga

SEQ ID NO: 7956390 - DNA, 22 bp, Homo sapiens
gaaaatgtttgtccggagctga

SEQ ID NO: 7956391 - DNA, 22 bp, Homo sapiens
gaaaattattgaaaatggctct

SEQ ID NO: 7956392 - DNA, 22 bp, Homo sapiens
gaaaatacttcagtgttctggc

SEQ ID NO: 7956393 - DNA, 22 bp, Homo sapiens
gaaaatacttcagtgttctggc

SEQ ID NO: 7956394 - DNA, 22 bp, Homo sapiens
gaaaatacttcagtgttctggc

SEQ ID NO: 7956395 - DNA, 22 bp, Homo sapiens
gaaaatacttcagtgttctggc

SEQ ID NO: 7956396 - DNA, 22 bp, Homo sapiens
gaaaatacttcagtgttctggc

SEQ ID NO: 7956397 - DNA, 22 bp, Homo sapiens
gaaaatacttcagtgttctggc

SEQ ID NO: 7956398 - DNA, 22 bp, Homo sapiens
gaaaatacttcagtgttctggc

SEQ ID NO: 7956399 - DNA, 22 bp, Homo sapiens
gaaaatacttcagtgttctggc

SEQ ID NO: 7956400 - DNA, 22 bp, Homo sapiens
cttttgcagccattattgctgc

SEQ ID NO: 7956401 - DNA, 22 bp, Homo sapiens
cttttgcaccttttaagtaatg

SEQ ID NO: 7956402 - DNA, 22 bp, Homo sapiens
cttttgcagccattattgctgc

SEQ ID NO: 7956403 - DNA, 22 bp, Homo sapiens
cttttgcaccttttaagtaatg

SEQ ID NO: 7956404 - DNA, 22 bp, Homo sapiens
cttttgcaccttttaagtaatg

SEQ ID NO: 7956405 - DNA, 22 bp, Homo sapiens
cttttgcaccttttaagtaatg

SEQ ID NO: 7956406 - DNA, 22 bp, Homo sapiens
cttttgcacccagagttatttg

SEQ ID NO: 7956407 - DNA, 22 bp, Homo sapiens
cttttgcacccagagttatttg

SEQ ID NO: 7956408 - DNA, 22 bp, Homo sapiens
gaaagagaggggctgagatgca

SEQ ID NO: 7956409 - DNA, 22 bp, Homo sapiens
gaaagagaggggctgagatgca

SEQ ID NO: 7956410 - DNA, 22 bp, Homo sapiens
gaaagagaggggctgagatgca

SEQ ID NO: 7956411 - DNA, 22 bp, Homo sapiens
gaaacagcacgtttggagagat

SEQ ID NO: 7956412 - DNA, 22 bp, Homo sapiens
gaaagagaggggctgagatgca

SEQ ID NO: 7956413 - DNA, 22 bp, Homo sapiens
gaaagagaggggctgagatgca

SEQ ID NO: 7956414 - DNA, 22 bp, Homo sapiens
gaaagatatttattggcaacag

SEQ ID NO: 7956415 - DNA, 22 bp, Homo sapiens
gaaagcatccgcctggaggtgg

SEQ ID NO: 7956416 - DNA, 22 bp, Homo sapiens
gaaagatatttattggcaacag

SEQ ID NO: 7956417 - DNA, 17 bp, Homo sapiens
gaaagcatcacatgctc

SEQ ID NO: 7956418 - DNA, 22 bp, Homo sapiens
gaaagataatcaattactcctt

SEQ ID NO: 7956419 - DNA, 22 bp, Homo sapiens
gaaagatatttattggcaacag

SEQ ID NO: 7956420 - DNA, 22 bp, Homo sapiens
gaaagataatcaattactcctt

SEQ ID NO: 7956421 - DNA, 22 bp, Homo sapiens
gaaagagtatgggagctttact

SEQ ID NO: 7956422 - DNA, 22 bp, Homo sapiens
gaaagaggaaggagatgtatta

SEQ ID NO: 7956423 - DNA, 22 bp, Homo sapiens
gaaagctaaatgaggtcttaca

SEQ ID NO: 7956424 - DNA, 22 bp, Homo sapiens
gaaagcccattgacaaagaagt

SEQ ID NO: 7956425 - DNA, 22 bp, Homo sapiens
gaaagctaaatgaggtcttaca

SEQ ID NO: 7956426 - DNA, 23 bp, Homo sapiens
gaaagctctctcctcaggacctt

SEQ ID NO: 7956427 - DNA, 18 bp, Homo sapiens
gaaagccatgcagcagtg

SEQ ID NO: 7956428 - DNA, 18 bp, Homo sapiens
gaaagccatgcagcagtg

SEQ ID NO: 7956429 - DNA, 22 bp, Homo sapiens
gaaagccatctggctgctggga

SEQ ID NO: 7956430 - DNA, 22 bp, Homo sapiens
gaaagccatctggctgctggga

SEQ ID NO: 7956431 - DNA, 22 bp, Homo sapiens
gaaagagaggggctgagatgca

SEQ ID NO: 7956432 - DNA, 22 bp, Homo sapiens
gaaagccatagcccagctttac

SEQ ID NO: 7956433 - DNA, 22 bp, Homo sapiens
gaaagccagagagaaagggctc

SEQ ID NO: 7956434 - DNA, 22 bp, Homo sapiens
gaaagccagagagaaagggctc

SEQ ID NO: 7956435 - DNA, 22 bp, Homo sapiens
gaaagccagagagaaagggctc

SEQ ID NO: 7956436 - DNA, 22 bp, Homo sapiens
gaaacagcacgtttggagagat

SEQ ID NO: 7956437 - DNA, 22 bp, Homo sapiens
gaaacagcacgtttggagagat

SEQ ID NO: 7956438 - DNA, 22 bp, Homo sapiens
gaaacagattaacagcatattt

SEQ ID NO: 7956439 - DNA, 22 bp, Homo sapiens
gaaacagattaacagcatattt

SEQ ID NO: 7956440 - DNA, 22 bp, Homo sapiens
gaaacagattaacagcatattt

SEQ ID NO: 7956441 - DNA, 22 bp, Homo sapiens
gaaacagattaacagcatattt

SEQ ID NO: 7956442 - DNA, 22 bp, Homo sapiens
gaaacactggtaaagactgccg

SEQ ID NO: 7956443 - DNA, 22 bp, Homo sapiens
gaaacagattaacagcatattt

SEQ ID NO: 7956444 - DNA, 22 bp, Homo sapiens
gaaacactatgccaagacaggg

SEQ ID NO: 7956445 - DNA, 22 bp, Homo sapiens
gaaacacatgcagctccataga

SEQ ID NO: 7956446 - DNA, 22 bp, Homo sapiens
gaaacacatgcagctccataga

SEQ ID NO: 7956447 - DNA, 22 bp, Homo sapiens
gaaacacatgcagctccataga

SEQ ID NO: 7956448 - DNA, 22 bp, Homo sapiens
gaaacactatgccaagacaggg

SEQ ID NO: 7956449 - DNA, 22 bp, Homo sapiens
gaaacactatgccaagacaggg

SEQ ID NO: 7956450 - DNA, 22 bp, Homo sapiens
gaaacactcaatttagtaattc

SEQ ID NO: 7956451 - DNA, 22 bp, Homo sapiens
gaaacaatttttgttgtctaag

SEQ ID NO: 7956452 - DNA, 22 bp, Homo sapiens
gaaacaatttttgttgtctaag

SEQ ID NO: 7956453 - DNA, 22 bp, Homo sapiens
gaaacaatttttgttgtctaag

SEQ ID NO: 7956454 - DNA, 22 bp, Homo sapiens
gaaacaatttttgttgtctaag

SEQ ID NO: 7956455 - DNA, 22 bp, Homo sapiens
gaaacaatttttgttgtctaag

SEQ ID NO: 7956456 - DNA, 22 bp, Homo sapiens
gaaacaatttttgttgtctaag

SEQ ID NO: 7956457 - DNA, 22 bp, Homo sapiens
gaaacacatatgaacagttgat

SEQ ID NO: 7956458 - DNA, 22 bp, Homo sapiens
gaaacacatgcagctccataga

SEQ ID NO: 7956459 - DNA, 22 bp, Homo sapiens
gaaacacatgcagctccataga

SEQ ID NO: 7956460 - DNA, 22 bp, Homo sapiens
gaaacacatatgaacagttgat

SEQ ID NO: 7956461 - DNA, 22 bp, Homo sapiens
gaaacacatatgaacagttgat

SEQ ID NO: 7956462 - DNA, 22 bp, Homo sapiens
gaaacacatatgaacagttgat

SEQ ID NO: 7956463 - DNA, 22 bp, Homo sapiens
gaaacacatgcagctccataga

SEQ ID NO: 7956464 - DNA, 22 bp, Homo sapiens
gaaacacatgcagctccataga

SEQ ID NO: 7956465 - DNA, 22 bp, Homo sapiens
ctttctcttcagcacccagccc

SEQ ID NO: 7956466 - DNA, 22 bp, Homo sapiens
ctttctcttcagcacccagccc

SEQ ID NO: 7956467 - DNA, 22 bp, Homo sapiens
ctttctcttcactgtcatgatc

SEQ ID NO: 7956468 - DNA, 22 bp, Homo sapiens
ctttctcttcactgtcatgatc

SEQ ID NO: 7956469 - DNA, 22 bp, Homo sapiens
ctttacaaatagggagggagtg

SEQ ID NO: 7956470 - DNA, 22 bp, Homo sapiens
ctttaattgtagctcccataat

SEQ ID NO: 7956471 - DNA, 22 bp, Homo sapiens
ctttacaaactataaagtgcgg

SEQ ID NO: 7956472 - DNA, 22 bp, Homo sapiens
ctttaaataatacaaggtccag

SEQ ID NO: 7956473 - DNA, 22 bp, Homo sapiens
ctttaacagttccattcaattt

SEQ ID NO: 7956474 - DNA, 22 bp, Homo sapiens
ctttaacaaatgactcttgtct

SEQ ID NO: 7956475 - DNA, 22 bp, Homo sapiens
ctttaaataatacaaggtccag

SEQ ID NO: 7956476 - DNA, 22 bp, Homo sapiens
ctttaaataatacaaggtccag

SEQ ID NO: 7956477 - DNA, 22 bp, Homo sapiens
ctttaaataatacaaggtccag

SEQ ID NO: 7956478 - DNA, 22 bp, Homo sapiens
ctttaaataatacaaggtccag

SEQ ID NO: 7956479 - DNA, 22 bp, Homo sapiens
ctttaacctgtgcattttatat

SEQ ID NO: 7956480 - DNA, 22 bp, Homo sapiens
ctttaacagttccattcaattt

SEQ ID NO: 7956481 - DNA, 22 bp, Homo sapiens
ctttaagactaaattagagttt

SEQ ID NO: 7956482 - DNA, 22 bp, Homo sapiens
ctttaagactaaattagagttt

SEQ ID NO: 7956483 - DNA, 22 bp, Homo sapiens
ctttaattctcaggtgcacata

SEQ ID NO: 7956484 - DNA, 22 bp, Homo sapiens
ctttaattaggaagtataatga

SEQ ID NO: 7956485 - DNA, 22 bp, Homo sapiens
ctttaattcagatttgaaggga

SEQ ID NO: 7956486 - DNA, 22 bp, Homo sapiens
ctttaattcagatttgaaggga

SEQ ID NO: 7956487 - DNA, 22 bp, Homo sapiens
ctttaattaggaagtataatga

SEQ ID NO: 7956488 - DNA, 22 bp, Homo sapiens
ctttaatgagtctttctgctgt

SEQ ID NO: 7956489 - DNA, 22 bp, Homo sapiens
ctttaagagatcaccaatcaca

SEQ ID NO: 7956490 - DNA, 22 bp, Homo sapiens
ctttaatcaagataagtatact

SEQ ID NO: 7956491 - DNA, 23 bp, Homo sapiens
ctttaatgaaattctctgtgaag

SEQ ID NO: 7956492 - DNA, 22 bp, Homo sapiens
ctttctttgtccaccaacaatg

SEQ ID NO: 7956493 - DNA, 22 bp, Homo sapiens
ctttctttgtccaccaacaatg

SEQ ID NO: 7956494 - DNA, 22 bp, Homo sapiens
ctttctttgtccaccaacaatg

SEQ ID NO: 7956495 - DNA, 22 bp, Homo sapiens
ctttctttgcagtgagccagag

SEQ ID NO: 7956496 - DNA, 22 bp, Homo sapiens
ctttctttgcagtgagccagag

SEQ ID NO: 7956497 - DNA, 22 bp, Homo sapiens
ctttctcttcgaaaacctgccc

SEQ ID NO: 7956498 - DNA, 22 bp, Homo sapiens
ctttacaaactataaagtgcgg

SEQ ID NO: 7956499 - DNA, 22 bp, Homo sapiens
ctttctcttcagcacccagccc

SEQ ID NO: 7956500 - DNA, 22 bp, Homo sapiens
ctttctcttcagcacccagccc

SEQ ID NO: 7956501 - DNA, 22 bp, Homo sapiens
ctttctcttcagcacccagccc

SEQ ID NO: 7956502 - DNA, 22 bp, Homo sapiens
ctttctcttcgaaaacctgccc

SEQ ID NO: 7956503 - DNA, 22 bp, Homo sapiens
ctttgaaaacttaaataacagc

SEQ ID NO: 7956504 - DNA, 22 bp, Homo sapiens
ctttgaaaacttaaataacagc

SEQ ID NO: 7956505 - DNA, 22 bp, Homo sapiens
ctttgaaaacttaaataacagc

SEQ ID NO: 7956506 - DNA, 22 bp, Homo sapiens
ctttgaaaacttaaataacagc

SEQ ID NO: 7956507 - DNA, 22 bp, Homo sapiens
ctttgaaaacttaaataacagc

SEQ ID NO: 7956508 - DNA, 22 bp, Homo sapiens
ctttgaaaacttaaataacagc

SEQ ID NO: 7956509 - DNA, 22 bp, Homo sapiens
ctttgaaaacttaaataacagc

SEQ ID NO: 7956510 - DNA, 22 bp, Homo sapiens
ctttgaaaacacacgaatagac

SEQ ID NO: 7956511 - DNA, 22 bp, Homo sapiens
ctttgaaaacacacgaatagac

SEQ ID NO: 7956512 - DNA, 22 bp, Homo sapiens
ctttgaaaaatggtttcctaga

SEQ ID NO: 7956513 - DNA, 22 bp, Homo sapiens
ctttgaaaaatggtttcctaga

SEQ ID NO: 7956514 - DNA, 22 bp, Homo sapiens
ctttgaaaaatggtttcctaga

SEQ ID NO: 7956515 - DNA, 22 bp, Homo sapiens
ctttgattatcggtgtgaatgt

SEQ ID NO: 7956516 - DNA, 22 bp, Homo sapiens
ctttgattatcggtgtgaatgt

SEQ ID NO: 7956517 - DNA, 22 bp, Homo sapiens
ctttgatataagtatacatagt

SEQ ID NO: 7956518 - DNA, 22 bp, Homo sapiens
ctttgatataagtatacatagt

SEQ ID NO: 7956519 - DNA, 22 bp, Homo sapiens
ctttgaattgccgtttcatctg

SEQ ID NO: 7956520 - DNA, 22 bp, Homo sapiens
ctttgactttgtcctcaggaaa

SEQ ID NO: 7956521 - DNA, 22 bp, Homo sapiens
ctttgacctcatatgacacatt

SEQ ID NO: 7956522 - DNA, 22 bp, Homo sapiens
ctttgacctctctgtgcccctc

SEQ ID NO: 7956523 - DNA, 22 bp, Homo sapiens
ctttgaattccagtacaataac

SEQ ID NO: 7956524 - DNA, 22 bp, Homo sapiens
ctttgaattccagtacaataac

SEQ ID NO: 7956525 - DNA, 22 bp, Homo sapiens
ctttgaattccagtacaataac

SEQ ID NO: 7956526 - DNA, 22 bp, Homo sapiens
ctttgaattccagtacaataac

SEQ ID NO: 7956527 - DNA, 22 bp, Homo sapiens
ctttgaattccagtacaataac

SEQ ID NO: 7956528 - DNA, 22 bp, Homo sapiens
ctttgaaattcttcagctgaag

SEQ ID NO: 7956529 - DNA, 22 bp, Homo sapiens
ctttgaaattcttcagctgaag

SEQ ID NO: 7956530 - DNA, 22 bp, Homo sapiens
ctttgaaaggaagccacacagc

SEQ ID NO: 7956531 - DNA, 22 bp, Homo sapiens
ctttgaagagattactgtgctc

SEQ ID NO: 7956532 - DNA, 22 bp, Homo sapiens
ctttgaagatcacatgttgctc

SEQ ID NO: 7956533 - DNA, 22 bp, Homo sapiens
ctttgaagatggcaaatttaga

SEQ ID NO: 7956534 - DNA, 22 bp, Homo sapiens
ctttgaaagctcccaggactta

SEQ ID NO: 7956535 - DNA, 22 bp, Homo sapiens
ctttgaaacctgctctgcagaa

SEQ ID NO: 7956536 - DNA, 22 bp, Homo sapiens
ctttgaaagctcccaggactta

SEQ ID NO: 7956537 - DNA, 22 bp, Homo sapiens
ctttgaaaggaagccacacagc

SEQ ID NO: 7956538 - DNA, 22 bp, Homo sapiens
ctttgaaacctgctctgcagaa

SEQ ID NO: 7956539 - DNA, 22 bp, Homo sapiens
ctttgaaacctgctctgcagaa

SEQ ID NO: 7956540 - DNA, 22 bp, Homo sapiens
ctttgaaacctgctctgcagaa

SEQ ID NO: 7956541 - DNA, 22 bp, Homo sapiens
ctttgaaacctgctctgcagaa

SEQ ID NO: 7956542 - DNA, 22 bp, Homo sapiens
cttgttttggaacagagtgaat

SEQ ID NO: 7956543 - DNA, 22 bp, Homo sapiens
cttgttttggaacagagtgaat

SEQ ID NO: 7956544 - DNA, 22 bp, Homo sapiens
cttgttttggaacagagtgaat

SEQ ID NO: 7956545 - DNA, 22 bp, Homo sapiens
cttgttttggaacagagtgaat

SEQ ID NO: 7956546 - DNA, 22 bp, Homo sapiens
cttgttttggaacagagtgaat

SEQ ID NO: 7956547 - DNA, 22 bp, Homo sapiens
cttgttttgaaagcagtggcca

SEQ ID NO: 7956548 - DNA, 22 bp, Homo sapiens
cttgttttgaaagcagtggcca

SEQ ID NO: 7956549 - DNA, 22 bp, Homo sapiens
cttgttttgaaagcagtggcca

SEQ ID NO: 7956550 - DNA, 22 bp, Homo sapiens
cttgttttcttctgcagtctat

SEQ ID NO: 7956551 - DNA, 21 bp, Homo sapiens
cttgttttgaaaggactggcc

SEQ ID NO: 7956552 - DNA, 21 bp, Homo sapiens
cttgttttgaaaggactggcc

SEQ ID NO: 7956553 - DNA, 22 bp, Homo sapiens
cttgttttctaaaacatcattt

SEQ ID NO: 7956554 - DNA, 22 bp, Homo sapiens
cttgttttcttctgcagtctat

SEQ ID NO: 7956555 - DNA, 22 bp, Homo sapiens
cttgttttcttctgcagtctat

SEQ ID NO: 7956556 - DNA, 22 bp, Homo sapiens
cttgttttctaaaacatcattt

SEQ ID NO: 7956557 - DNA, 22 bp, Homo sapiens
cttgttttggctagtatgatgt

SEQ ID NO: 7956558 - DNA, 22 bp, Homo sapiens
cttgttttggctagtatgatgt

SEQ ID NO: 7956559 - DNA, 22 bp, Homo sapiens
cttgttttggctagtatgatgt

SEQ ID NO: 7956560 - DNA, 22 bp, Homo sapiens
cttgttttggctagtatgatgt

SEQ ID NO: 7956561 - DNA, 22 bp, Homo sapiens
cttgttttggctagtatgatgt

SEQ ID NO: 7956562 - DNA, 22 bp, Homo sapiens
cttgtttttaagagatgtttac

SEQ ID NO: 7956563 - DNA, 22 bp, Homo sapiens
cttgtttttaagagatgtttac

SEQ ID NO: 7956564 - DNA, 22 bp, Homo sapiens
cttgtttttaagagatgtttac

SEQ ID NO: 7956565 - DNA, 22 bp, Homo sapiens
ctttaaataatacaaggtccag

SEQ ID NO: 7956566 - DNA, 22 bp, Homo sapiens
ctttaaataatacaaggtccag

SEQ ID NO: 7956567 - DNA, 22 bp, Homo sapiens
cttctgggtgtggagtgaggac

SEQ ID NO: 7956568 - DNA, 22 bp, Homo sapiens
cttctgggtgtggagtgaggac

SEQ ID NO: 7956569 - DNA, 22 bp, Homo sapiens
cttctgggtgtggagtgaggac

SEQ ID NO: 7956570 - DNA, 22 bp, Homo sapiens
cttctgggtgtggagtgaggac

SEQ ID NO: 7956571 - DNA, 22 bp, Homo sapiens
cttctgggtgtggagtgaggac

SEQ ID NO: 7956572 - DNA, 22 bp, Homo sapiens
cttctgggttgcaggtcttggc

SEQ ID NO: 7956573 - DNA, 22 bp, Homo sapiens
cttctgggtgcctgtgagtgtt

SEQ ID NO: 7956574 - DNA, 22 bp, Homo sapiens
cttctgggtgcctgtgagtgtt

SEQ ID NO: 7956575 - DNA, 22 bp, Homo sapiens
cttctgggtgcctgtgagtgtt

SEQ ID NO: 7956576 - DNA, 22 bp, Homo sapiens
cttctgggtattccagatacct

SEQ ID NO: 7956577 - DNA, 22 bp, Homo sapiens
cttctgggtgcctgtgagtgtt

SEQ ID NO: 7956578 - DNA, 22 bp, Homo sapiens
cttctgggtaattcttcttcat

SEQ ID NO: 7956579 - DNA, 22 bp, Homo sapiens
cttctgggtaattcttcttcat

SEQ ID NO: 7956580 - DNA, 22 bp, Homo sapiens
cttgtgcaaatcctcgagcaca

SEQ ID NO: 7956581 - DNA, 23 bp, Homo sapiens
cttgtgagtttgctagggctgcc

SEQ ID NO: 7956582 - DNA, 23 bp, Homo sapiens
cttgtgagtttgctagggctgcc

SEQ ID NO: 7956583 - DNA, 22 bp, Homo sapiens
cttctggttccagcttctgttg

SEQ ID NO: 7956584 - DNA, 19 bp, Homo sapiens
cttgtgcagttcacgctca

SEQ ID NO: 7956585 - DNA, 23 bp, Homo sapiens
cttctggctctatatcagaattc

SEQ ID NO: 7956586 - DNA, 22 bp, Homo sapiens
cttctgggagagcttttgcttc

SEQ ID NO: 7956587 - DNA, 22 bp, Homo sapiens
cttctgggatttttgaagactc

SEQ ID NO: 7956588 - DNA, 22 bp, Homo sapiens
cttctgggagagcttttgcttc

SEQ ID NO: 7956589 - DNA, 22 bp, Homo sapiens
cttctgggattaatttttcctg

SEQ ID NO: 7956590 - DNA, 22 bp, Homo sapiens
cttctggcaaaacaggcagaaa

SEQ ID NO: 7956591 - DNA, 19 bp, Homo sapiens
cttctggccctgagccacc

SEQ ID NO: 7956592 - DNA, 22 bp, Homo sapiens
cttctggcaatcccagggtctt

SEQ ID NO: 7956593 - DNA, 22 bp, Homo sapiens
cttctggcaatcccagggtctt

SEQ ID NO: 7956594 - DNA, 22 bp, Homo sapiens
cttctggcgttggaggtctgag

SEQ ID NO: 7956595 - DNA, 19 bp, Homo sapiens
cttctggccctgagccacc

SEQ ID NO: 7956596 - DNA, 22 bp, Homo sapiens
cttctggcgttggaggtctgag

SEQ ID NO: 7956597 - DNA, 22 bp, Homo sapiens
cttctggcgttggaggtctgag

SEQ ID NO: 7956598 - DNA, 22 bp, Homo sapiens
cttctgggcattcagctgcaca

SEQ ID NO: 7956599 - DNA, 22 bp, Homo sapiens
cttctgggcatggcagagcctg

SEQ ID NO: 7956600 - DNA, 22 bp, Homo sapiens
cttctgggcattcagctgcaca

SEQ ID NO: 7956601 - DNA, 22 bp, Homo sapiens
cttctgggcatggcagagcctg

SEQ ID NO: 7956602 - DNA, 22 bp, Homo sapiens
cttctgggcatggcagagcctg

SEQ ID NO: 7956603 - DNA, 22 bp, Homo sapiens
cttctgggccatggccttcctc

SEQ ID NO: 7956604 - DNA, 22 bp, Homo sapiens
cttctggggatggagcccagaa

SEQ ID NO: 7956605 - DNA, 22 bp, Homo sapiens
cttctggggatggagcccagaa

SEQ ID NO: 7956606 - DNA, 22 bp, Homo sapiens
cttctgggcattcagctgcaca

SEQ ID NO: 7956607 - DNA, 22 bp, Homo sapiens
cttctgaagtgtttgatgattg

SEQ ID NO: 7956608 - DNA, 22 bp, Homo sapiens
cttctgaagtgtttgatgattg

SEQ ID NO: 7956609 - DNA, 22 bp, Homo sapiens
cttctgaagtgtttgatgattg

SEQ ID NO: 7956610 - DNA, 22 bp, Homo sapiens
cttctgaagaggttatcataga

SEQ ID NO: 7956611 - DNA, 22 bp, Homo sapiens
cttctgctgctgttcatggttg

SEQ ID NO: 7956612 - DNA, 22 bp, Homo sapiens
cttctgaatggctgtgtatgct

SEQ ID NO: 7956613 - DNA, 22 bp, Homo sapiens
cttctgaagtgtttgatgattg

SEQ ID NO: 7956614 - DNA, 22 bp, Homo sapiens
cttctgaatggctgtgtatgct

SEQ ID NO: 7956615 - DNA, 22 bp, Homo sapiens
cttctgaaacccccagtgtggg

SEQ ID NO: 7956616 - DNA, 22 bp, Homo sapiens
cttctcttggtagttcttgttg

SEQ ID NO: 7956617 - DNA, 22 bp, Homo sapiens
cttctgaagaggttatcataga

SEQ ID NO: 7956618 - DNA, 22 bp, Homo sapiens
cttctgaaacccccagtgtggg

SEQ ID NO: 7956619 - DNA, 22 bp, Homo sapiens
cttctgaaacccccagtgtggg

SEQ ID NO: 7956620 - DNA, 22 bp, Homo sapiens
cttctgaaatgtgagcaaaatc

SEQ ID NO: 7956621 - DNA, 22 bp, Homo sapiens
cttctgaagaggttatcataga

SEQ ID NO: 7956622 - DNA, 22 bp, Homo sapiens
cttctgaagaggttatcataga

SEQ ID NO: 7956623 - DNA, 22 bp, Homo sapiens
cttctgaagaggttatcataga

SEQ ID NO: 7956624 - DNA, 22 bp, Homo sapiens
cttctggaggacactggcccca

SEQ ID NO: 7956625 - DNA, 22 bp, Homo sapiens
cttctggagctcaccaacttcc

SEQ ID NO: 7956626 - DNA, 22 bp, Homo sapiens
cttctggagctcaccaacttcc

SEQ ID NO: 7956627 - DNA, 22 bp, Homo sapiens
cttctggaggctccagggaggt

SEQ ID NO: 7956628 - DNA, 22 bp, Homo sapiens
cttctggaggctccagggaggt

SEQ ID NO: 7956629 - DNA, 22 bp, Homo sapiens
cttctggaggctccagggaggt

SEQ ID NO: 7956630 - DNA, 22 bp, Homo sapiens
cttctggaggctccagggaggt

SEQ ID NO: 7956631 - DNA, 22 bp, Homo sapiens
cttctggaggctccagggaggt

SEQ ID NO: 7956632 - DNA, 19 bp, Homo sapiens
cttctggatccgcagggcc

SEQ ID NO: 7956633 - DNA, 22 bp, Homo sapiens
cttctggataattgtgtgatta

SEQ ID NO: 7956634 - DNA, 22 bp, Homo sapiens
cttctggatttattcattcctt

SEQ ID NO: 7956635 - DNA, 22 bp, Homo sapiens
cttctggatttattcattcctt

SEQ ID NO: 7956636 - DNA, 19 bp, Homo sapiens
cttctggatccgcagggcc

SEQ ID NO: 7956637 - DNA, 22 bp, Homo sapiens
cttctggcaaaacaggcagaaa

SEQ ID NO: 7956638 - DNA, 22 bp, Homo sapiens
ctgtgcttgcgggtgtggagcc

SEQ ID NO: 7956639 - DNA, 19 bp, Homo sapiens
ctgtgctttaaactcctat

SEQ ID NO: 7956640 - DNA, 22 bp, Homo sapiens
ctgtgcttgtgttcattgttaa

SEQ ID NO: 7956641 - DNA, 22 bp, Homo sapiens
ctgtgcttcgcaactccaaggt

SEQ ID NO: 7956642 - DNA, 22 bp, Homo sapiens
ctgtgcttgacagtgggaagca

SEQ ID NO: 7956643 - DNA, 22 bp, Homo sapiens
ctgtgcttgacagtgggaagca

SEQ ID NO: 7956644 - DNA, 21 bp, Homo sapiens
ctgtgcttcttcctaagccag

SEQ ID NO: 7956645 - DNA, 22 bp, Homo sapiens
ctgtggaacttagtgggagaca

SEQ ID NO: 7956646 - DNA, 22 bp, Homo sapiens
ctgtggaaaatgctttacatat

SEQ ID NO: 7956647 - DNA, 22 bp, Homo sapiens
ctgtggaaagagcctttggagg

SEQ ID NO: 7956648 - DNA, 21 bp, Homo sapiens
ctgtgctttttaagtgtgatg

SEQ ID NO: 7956649 - DNA, 20 bp, Homo sapiens
ctgtgctttggaacctggaa

SEQ ID NO: 7956650 - DNA, 21 bp, Homo sapiens
ctgtgctttttaagtgtgatg

SEQ ID NO: 7956651 - DNA, 22 bp, Homo sapiens
ctgtgctttcaggccgctgtgt

SEQ ID NO: 7956652 - DNA, 22 bp, Homo sapiens
ctgtgctttcaggccgctgtgt

SEQ ID NO: 7956653 - DNA, 22 bp, Homo sapiens
ctgtttaatgcaatgaaatgag

SEQ ID NO: 7956654 - DNA, 22 bp, Homo sapiens
ctgtttaatgcaatgaaatgag

SEQ ID NO: 7956655 - DNA, 22 bp, Homo sapiens
ctgtttataaaccaccagttta

SEQ ID NO: 7956656 - DNA, 22 bp, Homo sapiens
ctgtttataaaccaccagttta

SEQ ID NO: 7956657 - DNA, 22 bp, Homo sapiens
ctgtttataaatagaggggagt

SEQ ID NO: 7956658 - DNA, 22 bp, Homo sapiens
ctgtttaatgaggtgtaacaac

SEQ ID NO: 7956659 - DNA, 22 bp, Homo sapiens
ctgtttaatgaggtgtaacaac

SEQ ID NO: 7956660 - DNA, 22 bp, Homo sapiens
ctgtttaatgaggtgtaacaac

SEQ ID NO: 7956661 - DNA, 21 bp, Homo sapiens
ctgtggaagggaactagaggg

SEQ ID NO: 7956662 - DNA, 22 bp, Homo sapiens
ctgtggaaggacttagcgatac

SEQ ID NO: 7956663 - DNA, 19 bp, Homo sapiens
ctgtttctgagcttgcttt

SEQ ID NO: 7956664 - DNA, 19 bp, Homo sapiens
ctgtttctgagcttgcttt

SEQ ID NO: 7956665 - DNA, 21 bp, Homo sapiens
ctgtttcttgtgaagtgacac

SEQ ID NO: 7956666 - DNA, 22 bp, Homo sapiens
ctgtttatacgacaggtggagg

SEQ ID NO: 7956667 - DNA, 22 bp, Homo sapiens
ctgtttatacgacaggtggagg

SEQ ID NO: 7956668 - DNA, 22 bp, Homo sapiens
ctgtttataaatagaggggagt

SEQ ID NO: 7956669 - DNA, 22 bp, Homo sapiens
ctgtttatactcaaaagataca

SEQ ID NO: 7956670 - DNA, 22 bp, Homo sapiens
ctgtttatccctttggtcagca

SEQ ID NO: 7956671 - DNA, 22 bp, Homo sapiens
ctgtttatccctttggtcagca

SEQ ID NO: 7956672 - DNA, 22 bp, Homo sapiens
ctgtttatcatgtacatttcca

SEQ ID NO: 7956673 - DNA, 22 bp, Homo sapiens
ctgtttatcatgtacatttcca

SEQ ID NO: 7956674 - DNA, 22 bp, Homo sapiens
ctgtttatagcagagcaagcct

SEQ ID NO: 7956675 - DNA, 20 bp, Homo sapiens
cttaaacacagagatagatt

SEQ ID NO: 7956676 - DNA, 20 bp, Homo sapiens
cttaaacacagagatagatt

SEQ ID NO: 7956677 - DNA, 22 bp, Homo sapiens
cttaaacaggaaagagccaggt

SEQ ID NO: 7956678 - DNA, 22 bp, Homo sapiens
cttaaaatctggcagttagcta

SEQ ID NO: 7956679 - DNA, 20 bp, Homo sapiens
cttaaacacagagatagatt

SEQ ID NO: 7956680 - DNA, 20 bp, Homo sapiens
cttaaacacagagatagatt

SEQ ID NO: 7956681 - DNA, 22 bp, Homo sapiens
cttaaacaggaaagagccaggt

SEQ ID NO: 7956682 - DNA, 22 bp, Homo sapiens
cttaaagaaattgaggagagga

SEQ ID NO: 7956683 - DNA, 22 bp, Homo sapiens
cttaaagaaattgaggagagga

SEQ ID NO: 7956684 - DNA, 22 bp, Homo sapiens
cttaaactgggcattcagagaa

SEQ ID NO: 7956685 - DNA, 22 bp, Homo sapiens
cttaaaatctggcagttagcta

SEQ ID NO: 7956686 - DNA, 22 bp, Homo sapiens
cttaaaatctggcagttagcta

SEQ ID NO: 7956687 - DNA, 22 bp, Homo sapiens
cttaaaatctggcagttagcta

SEQ ID NO: 7956688 - DNA, 22 bp, Homo sapiens
cttaaaagttgcttccctaact

SEQ ID NO: 7956689 - DNA, 22 bp, Homo sapiens
ctgtttttgtgctgtgtctccc

SEQ ID NO: 7956690 - DNA, 22 bp, Homo sapiens
ctgttttctagggctgaggtga

SEQ ID NO: 7956691 - DNA, 22 bp, Homo sapiens
ctgtttttcagaaggtaaggga

SEQ ID NO: 7956692 - DNA, 22 bp, Homo sapiens
ctgtttttgtgctgtgtctccc

SEQ ID NO: 7956693 - DNA, 22 bp, Homo sapiens
ctgtttttcagaaggtaaggga

SEQ ID NO: 7956694 - DNA, 20 bp, Homo sapiens
ctgtttgctatcatgagctg

SEQ ID NO: 7956695 - DNA, 22 bp, Homo sapiens
ctgtttgctggctatgaactcc

SEQ ID NO: 7956696 - DNA, 22 bp, Homo sapiens
ctgtttgcattaaagtatatga

SEQ ID NO: 7956697 - DNA, 22 bp, Homo sapiens
ctgtttctttgctgtcagagag

SEQ ID NO: 7956698 - DNA, 22 bp, Homo sapiens
ctgtttctttgctgtcagagag

SEQ ID NO: 7956699 - DNA, 22 bp, Homo sapiens
ctgtttgttggctattgacagt

SEQ ID NO: 7956700 - DNA, 22 bp, Homo sapiens
ctgtttgttggctattgacagt

SEQ ID NO: 7956701 - DNA, 17 bp, Homo sapiens
ctgtttgttctgggagc

SEQ ID NO: 7956702 - DNA, 22 bp, Homo sapiens
ctgtttgtgatttctacgattt

SEQ ID NO: 7956703 - DNA, 22 bp, Homo sapiens
ctgttttccctggagttcagca

SEQ ID NO: 7956704 - DNA, 22 bp, Homo sapiens
ctgttttctagggctgaggtga

SEQ ID NO: 7956705 - DNA, 22 bp, Homo sapiens
ctgttttatgaagggaatgaga

SEQ ID NO: 7956706 - DNA, 22 bp, Homo sapiens
ctgttttatgaagggaatgaga

SEQ ID NO: 7956707 - DNA, 22 bp, Homo sapiens
ctgttttatgaagggaatgaga

SEQ ID NO: 7956708 - DNA, 22 bp, Homo sapiens
ctgttttatgaagggaatgaga

SEQ ID NO: 7956709 - DNA, 22 bp, Homo sapiens
ctgttttcaaagagagagaatg

SEQ ID NO: 7956710 - DNA, 22 bp, Homo sapiens
ctgttttccctggagttcagca

SEQ ID NO: 7956711 - DNA, 22 bp, Homo sapiens
ctgttttaatggagactgatgt

SEQ ID NO: 7956712 - DNA, 22 bp, Homo sapiens
ctgttttaatggagactgatgt

SEQ ID NO: 7956713 - DNA, 22 bp, Homo sapiens
ctgttttaagtggcgtgtggta

SEQ ID NO: 7956714 - DNA, 22 bp, Homo sapiens
ctgttttaagtggcgtgtggta

SEQ ID NO: 7956715 - DNA, 22 bp, Homo sapiens
ctgttttaatggagactgatgt

SEQ ID NO: 7956716 - DNA, 22 bp, Homo sapiens
ctgttttaagtggcgtgtggta

SEQ ID NO: 7956717 - DNA, 22 bp, Homo sapiens
ctgttttataaagtccaaaagt

SEQ ID NO: 7956718 - DNA, 22 bp, Homo sapiens
ctgttttataaagtccaaaagt

SEQ ID NO: 7956719 - DNA, 22 bp, Homo sapiens
ctgttttataaagtccaaaagt

SEQ ID NO: 7956720 - DNA, 22 bp, Homo sapiens
ctgttttatctcaagagttcaa

SEQ ID NO: 7956721 - DNA, 22 bp, Homo sapiens
ctgttttatctcaagagttcaa

SEQ ID NO: 7956722 - DNA, 22 bp, Homo sapiens
ctgttttatctcaagagttcaa

SEQ ID NO: 7956723 - DNA, 22 bp, Homo sapiens
ctgttttatctcaagagttcaa

SEQ ID NO: 7956724 - DNA, 22 bp, Homo sapiens
cttagaaataatggtttcagtt

SEQ ID NO: 7956725 - DNA, 22 bp, Homo sapiens
cttagaaataatggtttcagtt

SEQ ID NO: 7956726 - DNA, 22 bp, Homo sapiens
cttagaaataatggtttcagtt

SEQ ID NO: 7956727 - DNA, 22 bp, Homo sapiens
cttagaaagagttttctcccct

SEQ ID NO: 7956728 - DNA, 22 bp, Homo sapiens
cttactgcagcagcccatggac

SEQ ID NO: 7956729 - DNA, 22 bp, Homo sapiens
cttagaaagagttttctcccct

SEQ ID NO: 7956730 - DNA, 22 bp, Homo sapiens
cttagaaataatggtttcagtt

SEQ ID NO: 7956731 - DNA, 22 bp, Homo sapiens
cttagaaatcgaactcaggtta

SEQ ID NO: 7956732 - DNA, 22 bp, Homo sapiens
cttagaaatcgaactcaggtta

SEQ ID NO: 7956733 - DNA, 22 bp, Homo sapiens
cttagaaatcgaactcaggtta

SEQ ID NO: 7956734 - DNA, 22 bp, Homo sapiens
cttacccttcatcagattttgg

SEQ ID NO: 7956735 - DNA, 22 bp, Homo sapiens
cttacccaaattagagttacca

SEQ ID NO: 7956736 - DNA, 22 bp, Homo sapiens
cttacatttaatcatgtgtcat

SEQ ID NO: 7956737 - DNA, 22 bp, Homo sapiens
cttacattgtgtgcatgagggg

SEQ ID NO: 7956738 - DNA, 22 bp, Homo sapiens
cttagaaatgcagattctcagg

SEQ ID NO: 7956739 - DNA, 22 bp, Homo sapiens
cttagaaatgcagattctcagg

SEQ ID NO: 7956740 - DNA, 22 bp, Homo sapiens
cttagaaatgcagattctcagg

SEQ ID NO: 7956741 - DNA, 22 bp, Homo sapiens
cttagaaatgcagattctcagg

SEQ ID NO: 7956742 - DNA, 22 bp, Homo sapiens
cttagaaatcgaactcaggtta

SEQ ID NO: 7956743 - DNA, 22 bp, Homo sapiens
cttagaaatgcagattctcagg

SEQ ID NO: 7956744 - DNA, 22 bp, Homo sapiens
cttagaaatgcagattctcagg

SEQ ID NO: 7956745 - DNA, 20 bp, Homo sapiens
cttagcaccagcaggacagg

SEQ ID NO: 7956746 - DNA, 22 bp, Homo sapiens
cttagcaataagagggaatata

SEQ ID NO: 7956747 - DNA, 22 bp, Homo sapiens
cttagcacatatcagaaaatag

SEQ ID NO: 7956748 - DNA, 22 bp, Homo sapiens
cttagcaaggctgcctggagaa

SEQ ID NO: 7956749 - DNA, 22 bp, Homo sapiens
cttagcaaggctgcctggagaa

SEQ ID NO: 7956750 - DNA, 22 bp, Homo sapiens
cttacatactgagaaaatatcc

SEQ ID NO: 7956751 - DNA, 22 bp, Homo sapiens
cttacatactgagaaaatatcc

SEQ ID NO: 7956752 - DNA, 22 bp, Homo sapiens
cttacatatgcaagacaaaggg

SEQ ID NO: 7956753 - DNA, 22 bp, Homo sapiens
cttacatatgcaagacaaaggg

SEQ ID NO: 7956754 - DNA, 22 bp, Homo sapiens
cttacatatgcaagacaaaggg

SEQ ID NO: 7956755 - DNA, 22 bp, Homo sapiens
cttacattgtcttagttttcaa

SEQ ID NO: 7956756 - DNA, 22 bp, Homo sapiens
cttacattaagtaagagattga

SEQ ID NO: 7956757 - DNA, 22 bp, Homo sapiens
cttacagtgatcaacacaaaga

SEQ ID NO: 7956758 - DNA, 22 bp, Homo sapiens
cttacaacttgtatgtgattgt

SEQ ID NO: 7956759 - DNA, 22 bp, Homo sapiens
cttacaagcaaaacaactgtag

SEQ ID NO: 7956760 - DNA, 22 bp, Homo sapiens
cttacaagaccaaagaaaggat

SEQ ID NO: 7956761 - DNA, 22 bp, Homo sapiens
cttacaagaccaaagaaaggat

SEQ ID NO: 7956762 - DNA, 22 bp, Homo sapiens
cttacacagtctggcacttctt

SEQ ID NO: 7956763 - DNA, 22 bp, Homo sapiens
cttacacagtctggcacttctt

SEQ ID NO: 7956764 - DNA, 22 bp, Homo sapiens
cttacaagcaaaacaactgtag

SEQ ID NO: 7956765 - DNA, 22 bp, Homo sapiens
cttacagtacttctaatatgat

SEQ ID NO: 7956766 - DNA, 22 bp, Homo sapiens
cttacaggaaagaagaaagcat

SEQ ID NO: 7956767 - DNA, 22 bp, Homo sapiens
cttacagagaagaaaatgtagt

SEQ ID NO: 7956768 - DNA, 22 bp, Homo sapiens
cttacagagaagaaaatgtagt

SEQ ID NO: 7956769 - DNA, 22 bp, Homo sapiens
cttacagcattgttcagaggct

SEQ ID NO: 7956770 - DNA, 22 bp, Homo sapiens
cttacagagaagaaaatgtagt

SEQ ID NO: 7956771 - DNA, 22 bp, Homo sapiens
cttacactttccgaaagcttgt

SEQ ID NO: 7956772 - DNA, 22 bp, Homo sapiens
cttaaagtctatcctttctaga

SEQ ID NO: 7956773 - DNA, 22 bp, Homo sapiens
cttaaagttgacacagtccctg

SEQ ID NO: 7956774 - DNA, 22 bp, Homo sapiens
cttaaatccatcatttctaatc

SEQ ID NO: 7956775 - DNA, 22 bp, Homo sapiens
cttaaattcttaatgccctcat

SEQ ID NO: 7956776 - DNA, 22 bp, Homo sapiens
cttaaattcttaatgccctcat

SEQ ID NO: 7956777 - DNA, 22 bp, Homo sapiens
cttaaatccatcatttctaatc

SEQ ID NO: 7956778 - DNA, 22 bp, Homo sapiens
cttaaagagtatttaatataat

SEQ ID NO: 7956779 - DNA, 22 bp, Homo sapiens
cttaaagatgtcaaggctgttt

SEQ ID NO: 7956780 - DNA, 22 bp, Homo sapiens
cttaaagtagaatacaagacct

SEQ ID NO: 7956781 - DNA, 22 bp, Homo sapiens
cttaaagtagaatacaagacct

SEQ ID NO: 7956782 - DNA, 22 bp, Homo sapiens
cttaaagtagaatacaagacct

SEQ ID NO: 7956783 - DNA, 22 bp, Homo sapiens
cttaaattttcatctacaagaa

SEQ ID NO: 7956784 - DNA, 22 bp, Homo sapiens
cttaaattggatgagttaagtt

SEQ ID NO: 7956785 - DNA, 22 bp, Homo sapiens
cttaaattggatgagttaagtt

SEQ ID NO: 7956786 - DNA, 22 bp, Homo sapiens
cttaaattggatgagttaagtt

SEQ ID NO: 7956787 - DNA, 22 bp, Homo sapiens
cttaattacccaatgtggtagg

SEQ ID NO: 7956788 - DNA, 22 bp, Homo sapiens
cttaattactgtccaatatgca

SEQ ID NO: 7956789 - DNA, 22 bp, Homo sapiens
cttaattactgtccaatatgca

SEQ ID NO: 7956790 - DNA, 22 bp, Homo sapiens
cttaattacccaatgtggtagg

SEQ ID NO: 7956791 - DNA, 22 bp, Homo sapiens
cttacaaaggagaggagatagg

SEQ ID NO: 7956792 - DNA, 22 bp, Homo sapiens
cttacaaaggagaggagatagg

SEQ ID NO: 7956793 - DNA, 22 bp, Homo sapiens
cttacaaatacacttaggagag

SEQ ID NO: 7956794 - DNA, 22 bp, Homo sapiens
cttacaaatacacttaggagag

SEQ ID NO: 7956795 - DNA, 22 bp, Homo sapiens
cttacaaatacacttaggagag

SEQ ID NO: 7956796 - DNA, 22 bp, Homo sapiens
cttacaaatacacttaggagag

SEQ ID NO: 7956797 - DNA, 22 bp, Homo sapiens
cttaatttaaaatagttcaggc

SEQ ID NO: 7956798 - DNA, 22 bp, Homo sapiens
cttaatttaaaatagttcaggc

SEQ ID NO: 7956799 - DNA, 22 bp, Homo sapiens
cttaatttaagcctagaatgca

SEQ ID NO: 7956800 - DNA, 22 bp, Homo sapiens
cttaatttcaaactgctagtga

SEQ ID NO: 7956801 - DNA, 22 bp, Homo sapiens
cttaatttcaaactgctagtga

SEQ ID NO: 7956802 - DNA, 22 bp, Homo sapiens
cttaatttttgtagtagatgga

SEQ ID NO: 7956803 - DNA, 22 bp, Homo sapiens
cttacaaaggagaggagatagg

SEQ ID NO: 7956804 - DNA, 22 bp, Homo sapiens
cttacaaaggagaggagatagg

SEQ ID NO: 7956805 - DNA, 22 bp, Homo sapiens
cttacaaaggagaggagatagg

SEQ ID NO: 7956806 - DNA, 22 bp, Homo sapiens
cttctcagatctcagctttgag

SEQ ID NO: 7956807 - DNA, 22 bp, Homo sapiens
cttctcagcatggttactgtga

SEQ ID NO: 7956808 - DNA, 22 bp, Homo sapiens
cttctcagatctcagctttgag

SEQ ID NO: 7956809 - DNA, 22 bp, Homo sapiens
cttctcagaggccagaagctat

SEQ ID NO: 7956810 - DNA, 22 bp, Homo sapiens
cttctcagaggccagaagctat

SEQ ID NO: 7956811 - DNA, 22 bp, Homo sapiens
cttctcagcattttgtcagtct

SEQ ID NO: 7956812 - DNA, 22 bp, Homo sapiens
cttctcagcattttgtcagtct

SEQ ID NO: 7956813 - DNA, 23 bp, Homo sapiens
cttctcagtagtacacacactat

SEQ ID NO: 7956814 - DNA, 21 bp, Homo sapiens
cttctcaggaccacactagga

SEQ ID NO: 7956815 - DNA, 21 bp, Homo sapiens
cttctcaggaccacactagga

SEQ ID NO: 7956816 - DNA, 21 bp, Homo sapiens
cttctcaggaccacactagga

SEQ ID NO: 7956817 - DNA, 22 bp, Homo sapiens
cttctcagtcacctgtgagtct

SEQ ID NO: 7956818 - DNA, 23 bp, Homo sapiens
cttctcagtagtacacacactat

SEQ ID NO: 7956819 - DNA, 22 bp, Homo sapiens
cttctcagtcacctgtgagtct

SEQ ID NO: 7956820 - DNA, 22 bp, Homo sapiens
cttctattttcatgcctgggtc

SEQ ID NO: 7956821 - DNA, 22 bp, Homo sapiens
cttctcaaacctgaaaggacaa

SEQ ID NO: 7956822 - DNA, 22 bp, Homo sapiens
cttctattttcatgcctgggtc

SEQ ID NO: 7956823 - DNA, 22 bp, Homo sapiens
cttctcaaacctgaaaggacaa

SEQ ID NO: 7956824 - DNA, 22 bp, Homo sapiens
cttctcaaactgagactgtcta

SEQ ID NO: 7956825 - DNA, 22 bp, Homo sapiens
cttctcaaactgagactgtcta

SEQ ID NO: 7956826 - DNA, 22 bp, Homo sapiens
cttctattcactggtcacagtt

SEQ ID NO: 7956827 - DNA, 22 bp, Homo sapiens
cttctattcactggtcacagtt

SEQ ID NO: 7956828 - DNA, 22 bp, Homo sapiens
cttctagatttttgtaattgtt

SEQ ID NO: 7956829 - DNA, 22 bp, Homo sapiens
cttctattcactggtcacagtt

SEQ ID NO: 7956830 - DNA, 22 bp, Homo sapiens
cttctattcactggtcacagtt

SEQ ID NO: 7956831 - DNA, 22 bp, Homo sapiens
cttctattcactggtcacagtt

SEQ ID NO: 7956832 - DNA, 22 bp, Homo sapiens
cttctattcactggtcacagtt

SEQ ID NO: 7956833 - DNA, 22 bp, Homo sapiens
cttctcagagcttccagaaaac

SEQ ID NO: 7956834 - DNA, 23 bp, Homo sapiens
cttctcagaagtctgtgccagga

SEQ ID NO: 7956835 - DNA, 22 bp, Homo sapiens
cttctcagagcttccagaaaac

SEQ ID NO: 7956836 - DNA, 22 bp, Homo sapiens
cttctcagagcttccagaaaac

SEQ ID NO: 7956837 - DNA, 22 bp, Homo sapiens
cttctcaactgcacttgccagg

SEQ ID NO: 7956838 - DNA, 23 bp, Homo sapiens
cttctcagaagtctgtgccagga

SEQ ID NO: 7956839 - DNA, 22 bp, Homo sapiens
cttctagccttgatgactggga

SEQ ID NO: 7956840 - DNA, 23 bp, Homo sapiens
cttctagagtcagctccaagttt

SEQ ID NO: 7956841 - DNA, 22 bp, Homo sapiens
cttctagagtttctgatgcaac

SEQ ID NO: 7956842 - DNA, 22 bp, Homo sapiens
cttctaggcttgacatctccct

SEQ ID NO: 7956843 - DNA, 22 bp, Homo sapiens
cttctaggcttctcagggggca

SEQ ID NO: 7956844 - DNA, 22 bp, Homo sapiens
cttctaggtcttgattgaatgt

SEQ ID NO: 7956845 - DNA, 22 bp, Homo sapiens
cttctagggcatcatgacaaat

SEQ ID NO: 7956846 - DNA, 22 bp, Homo sapiens
cttctagggcatcatgacaaat

SEQ ID NO: 7956847 - DNA, 22 bp, Homo sapiens
cttctaggtcttgattgaatgt

SEQ ID NO: 7956848 - DNA, 22 bp, Homo sapiens
cttctataaactgtgatctttc

SEQ ID NO: 7956849 - DNA, 22 bp, Homo sapiens
cttctataaactgtgatctttc

SEQ ID NO: 7956850 - DNA, 22 bp, Homo sapiens
cttctagagtaaggaacaaatg

SEQ ID NO: 7956851 - DNA, 22 bp, Homo sapiens
cttctagagtaaggaacaaatg

SEQ ID NO: 7956852 - DNA, 22 bp, Homo sapiens
cttctagagtaaggaacaaatg

SEQ ID NO: 7956853 - DNA, 17 bp, Homo sapiens
cttctagaggtcaccca

SEQ ID NO: 7956854 - DNA, 17 bp, Homo sapiens
cttctagaggtcaccca

SEQ ID NO: 7956855 - DNA, 22 bp, Homo sapiens
cttctagaggtgcaagggaaga

SEQ ID NO: 7956856 - DNA, 19 bp, Homo sapiens
cttctagaccttataccac

SEQ ID NO: 7956857 - DNA, 22 bp, Homo sapiens
cttctagagctggagcaaatgt

SEQ ID NO: 7956858 - DNA, 22 bp, Homo sapiens
cttctagagctggagcaaatgt

SEQ ID NO: 7956859 - DNA, 22 bp, Homo sapiens
cttctagagctggagcaaatgt

SEQ ID NO: 7956860 - DNA, 22 bp, Homo sapiens
cttctagagctggagcaaatgt

SEQ ID NO: 7956861 - DNA, 22 bp, Homo sapiens
cttctagactatgggaatttcc

SEQ ID NO: 7956862 - DNA, 22 bp, Homo sapiens
cttctagagaggtgagctggag

SEQ ID NO: 7956863 - DNA, 22 bp, Homo sapiens
cttctagagctggagcaaatgt

SEQ ID NO: 7956864 - DNA, 22 bp, Homo sapiens
cttctaattcttatgtaagctt

SEQ ID NO: 7956865 - DNA, 22 bp, Homo sapiens
cttctaattcttatgtaagctt

SEQ ID NO: 7956866 - DNA, 22 bp, Homo sapiens
cttctaattcttatgtaagctt

SEQ ID NO: 7956867 - DNA, 22 bp, Homo sapiens
cttctaatataaagtctttgca

SEQ ID NO: 7956868 - DNA, 22 bp, Homo sapiens
cttctaagctgagaatgccttt

SEQ ID NO: 7956869 - DNA, 19 bp, Homo sapiens
cttctaagtcatttggaat

SEQ ID NO: 7956870 - DNA, 22 bp, Homo sapiens
cttctaattcttatgtaagctt

SEQ ID NO: 7956871 - DNA, 22 bp, Homo sapiens
cttctacaaggttgtcctctat

SEQ ID NO: 7956872 - DNA, 22 bp, Homo sapiens
cttctacacatccctcttgctt

SEQ ID NO: 7956873 - DNA, 22 bp, Homo sapiens
cttctacaaggttgtcctctat

SEQ ID NO: 7956874 - DNA, 22 bp, Homo sapiens
cttctacacatccctcttgctt

SEQ ID NO: 7956875 - DNA, 22 bp, Homo sapiens
cttctacacatccctcttgctt

SEQ ID NO: 7956876 - DNA, 22 bp, Homo sapiens
cttctacacgtggctgtgccaa

SEQ ID NO: 7956877 - DNA, 22 bp, Homo sapiens
cttctacaggcccagcgagtgt

SEQ ID NO: 7956878 - DNA, 17 bp, Homo sapiens
cttctagaaggcaaact

SEQ ID NO: 7956879 - DNA, 22 bp, Homo sapiens
cttctagaaccctctattcttt

SEQ ID NO: 7956880 - DNA, 17 bp, Homo sapiens
cttctagaaggcaaact

SEQ ID NO: 7956881 - DNA, 22 bp, Homo sapiens
cttctagaaccctctattcttt

SEQ ID NO: 7956882 - DNA, 22 bp, Homo sapiens
cttctagaaatgtgggtgatag

SEQ ID NO: 7956883 - DNA, 17 bp, Homo sapiens
cttctagaaggcaaact

SEQ ID NO: 7956884 - DNA, 22 bp, Homo sapiens
cttccaagttgctctgctgacc

SEQ ID NO: 7956885 - DNA, 22 bp, Homo sapiens
cttccaagtggggcacgtgcca

SEQ ID NO: 7956886 - DNA, 22 bp, Homo sapiens
cttccaagatgaacagcaagcg

SEQ ID NO: 7956887 - DNA, 22 bp, Homo sapiens
cttccaagatgaacagcaagcg

SEQ ID NO: 7956888 - DNA, 22 bp, Homo sapiens
cttccaagatgaacagcaagcg

SEQ ID NO: 7956889 - DNA, 22 bp, Homo sapiens
cttccaagatgaacagcaagcg

SEQ ID NO: 7956890 - DNA, 22 bp, Homo sapiens
cttccaagcccaggagccattt

SEQ ID NO: 7956891 - DNA, 22 bp, Homo sapiens
cttccaagcccaggagccattt

SEQ ID NO: 7956892 - DNA, 22 bp, Homo sapiens
cttccacattatttaggaatcc

SEQ ID NO: 7956893 - DNA, 20 bp, Homo sapiens
cttccacacaagaagcacag

SEQ ID NO: 7956894 - DNA, 20 bp, Homo sapiens
cttccacacaagaagcacag

SEQ ID NO: 7956895 - DNA, 22 bp, Homo sapiens
cttccacattatttaggaatcc

SEQ ID NO: 7956896 - DNA, 20 bp, Homo sapiens
cttccacacaagaagcacag

SEQ ID NO: 7956897 - DNA, 20 bp, Homo sapiens
cttccacacaagaagcacag

SEQ ID NO: 7956898 - DNA, 20 bp, Homo sapiens
cttccacacaagaagcacag

SEQ ID NO: 7956899 - DNA, 20 bp, Homo sapiens
cttccacacaagaagcacag

SEQ ID NO: 7956900 - DNA, 20 bp, Homo sapiens
cttccacacaagaagcacag

SEQ ID NO: 7956901 - DNA, 22 bp, Homo sapiens
cttccaatagcaacaaagatta

SEQ ID NO: 7956902 - DNA, 22 bp, Homo sapiens
cttccagctgattacaggctat

SEQ ID NO: 7956903 - DNA, 22 bp, Homo sapiens
cttccagctgattacaggctat

SEQ ID NO: 7956904 - DNA, 22 bp, Homo sapiens
cttccagagttgcgttctcggt

SEQ ID NO: 7956905 - DNA, 22 bp, Homo sapiens
cttccagctgattacaggctat

SEQ ID NO: 7956906 - DNA, 22 bp, Homo sapiens
cttccagaggaactctgcagtg

SEQ ID NO: 7956907 - DNA, 22 bp, Homo sapiens
cttccagaggaactctgcagtg

SEQ ID NO: 7956908 - DNA, 22 bp, Homo sapiens
cttccagaggaactctgcagtg

SEQ ID NO: 7956909 - DNA, 22 bp, Homo sapiens
cttccactactcttagatctgc

SEQ ID NO: 7956910 - DNA, 22 bp, Homo sapiens
cttccactctgagtccaccctg

SEQ ID NO: 7956911 - DNA, 22 bp, Homo sapiens
cttccagagaagcactacgggt

SEQ ID NO: 7956912 - DNA, 20 bp, Homo sapiens
cttccaccagggccgctgat

SEQ ID NO: 7956913 - DNA, 22 bp, Homo sapiens
cttccagagatccatgaatacc

SEQ ID NO: 7956914 - DNA, 22 bp, Homo sapiens
cttccagagatagggcctcaag

SEQ ID NO: 7956915 - DNA, 22 bp, Homo sapiens
cttccagagctgggctgacctt

SEQ ID NO: 7956916 - DNA, 22 bp, Homo sapiens
cttccagagctgggctgacctt

SEQ ID NO: 7956917 - DNA, 22 bp, Homo sapiens
cttccagagatccatgaatacc

SEQ ID NO: 7956918 - DNA, 22 bp, Homo sapiens
cttccttccacaccttcagaat

SEQ ID NO: 7956919 - DNA, 22 bp, Homo sapiens
cttccttccacaccttcagaat

SEQ ID NO: 7956920 - DNA, 22 bp, Homo sapiens
cttcctttccccaatcatatcg

SEQ ID NO: 7956921 - DNA, 22 bp, Homo sapiens
cttcctttccccaatcatatcg

SEQ ID NO: 7956922 - DNA, 22 bp, Homo sapiens
cttcctttccccaatcatatcg

SEQ ID NO: 7956923 - DNA, 22 bp, Homo sapiens
cttcctttgctgttcggaggtt

SEQ ID NO: 7956924 - DNA, 22 bp, Homo sapiens
cttcctttgctgttcggaggtt

SEQ ID NO: 7956925 - DNA, 22 bp, Homo sapiens
cttcctttgctgttcggaggtt

SEQ ID NO: 7956926 - DNA, 22 bp, Homo sapiens
cttcctttccccaatcatatcg

SEQ ID NO: 7956927 - DNA, 22 bp, Homo sapiens
cttcctttccccaatcatatcg

SEQ ID NO: 7956928 - DNA, 20 bp, Homo sapiens
cttccttttccttcgtcaaa

SEQ ID NO: 7956929 - DNA, 20 bp, Homo sapiens
cttccttttccttcgtcaaa

SEQ ID NO: 7956930 - DNA, 20 bp, Homo sapiens
cttccttttccttcgtcaaa

SEQ ID NO: 7956931 - DNA, 20 bp, Homo sapiens
cttccttttccttcgtcaaa

SEQ ID NO: 7956932 - DNA, 20 bp, Homo sapiens
cttccttttccttcgtcaaa

SEQ ID NO: 7956933 - DNA, 22 bp, Homo sapiens
cttcctttggttggagcgccgt

SEQ ID NO: 7956934 - DNA, 22 bp, Homo sapiens
cttcctttgctgttcggaggtt

SEQ ID NO: 7956935 - DNA, 22 bp, Homo sapiens
cttcctttgctgttcggaggtt

SEQ ID NO: 7956936 - DNA, 22 bp, Homo sapiens
cttcctttggttggagcgccgt

SEQ ID NO: 7956937 - DNA, 22 bp, Homo sapiens
cttcctttggttggagcgccgt

SEQ ID NO: 7956938 - DNA, 22 bp, Homo sapiens
cttcctttgctgttcggaggtt

SEQ ID NO: 7956939 - DNA, 22 bp, Homo sapiens
cttcctttggttggagcgccgt

SEQ ID NO: 7956940 - DNA, 22 bp, Homo sapiens
cttcctgttgtcacagtctgcg

SEQ ID NO: 7956941 - DNA, 22 bp, Homo sapiens
cttccttcaatataatttttac

SEQ ID NO: 7956942 - DNA, 22 bp, Homo sapiens
cttcctgttgtatttgtgagcc

SEQ ID NO: 7956943 - DNA, 22 bp, Homo sapiens
cttccagctgattggcatccag

SEQ ID NO: 7956944 - DNA, 22 bp, Homo sapiens
cttccagctgattggcatccag

SEQ ID NO: 7956945 - DNA, 22 bp, Homo sapiens
cttccaggacaccagggtagta

SEQ ID NO: 7956946 - DNA, 22 bp, Homo sapiens
cttccaggacaccagggtagta

SEQ ID NO: 7956947 - DNA, 22 bp, Homo sapiens
cttccaggacaccagggtagta

SEQ ID NO: 7956948 - DNA, 22 bp, Homo sapiens
cttccaggacaccagggtagta

SEQ ID NO: 7956949 - DNA, 22 bp, Homo sapiens
cttcctgggtctggagactgga

SEQ ID NO: 7956950 - DNA, 22 bp, Homo sapiens
cttagcagataaaaaccttcag

SEQ ID NO: 7956951 - DNA, 22 bp, Homo sapiens
cttagcatgtggtgtccttgta

SEQ ID NO: 7956952 - DNA, 22 bp, Homo sapiens
cttagctttaaaagtgagatct

SEQ ID NO: 7956953 - DNA, 22 bp, Homo sapiens
cttagcttctctgcatctgtgt

SEQ ID NO: 7956954 - DNA, 22 bp, Homo sapiens
cttagcttctctgcatctgtgt

SEQ ID NO: 7956955 - DNA, 22 bp, Homo sapiens
cttagctgcgggccctcctcgc

SEQ ID NO: 7956956 - DNA, 22 bp, Homo sapiens
cttagctccagacccacatgac

SEQ ID NO: 7956957 - DNA, 22 bp, Homo sapiens
cttaggaagcttttgaggacaa

SEQ ID NO: 7956958 - DNA, 22 bp, Homo sapiens
cttaggaacgctctgcctagtg

SEQ ID NO: 7956959 - DNA, 22 bp, Homo sapiens
cttaggaagcgggacctgtgca

SEQ ID NO: 7956960 - DNA, 22 bp, Homo sapiens
cttaggaagcttttgaggacaa

SEQ ID NO: 7956961 - DNA, 22 bp, Homo sapiens
cttaggaatgcgtttcctgggt

SEQ ID NO: 7956962 - DNA, 22 bp, Homo sapiens
cttaggaatgtcccttcccaca

SEQ ID NO: 7956963 - DNA, 22 bp, Homo sapiens
cttaggaatatccacagcaggt

SEQ ID NO: 7956964 - DNA, 22 bp, Homo sapiens
cttaggaatatccacagcaggt

SEQ ID NO: 7956965 - DNA, 22 bp, Homo sapiens
cttaggaaagttggctgatttc

SEQ ID NO: 7956966 - DNA, 22 bp, Homo sapiens
cttaggaaagtttctgcttatg

SEQ ID NO: 7956967 - DNA, 22 bp, Homo sapiens
cttaggaaatatatactaaact

SEQ ID NO: 7956968 - DNA, 22 bp, Homo sapiens
cttagggaattgggaggatgcc

SEQ ID NO: 7956969 - DNA, 22 bp, Homo sapiens
cttagggaatcttagagctgga

SEQ ID NO: 7956970 - DNA, 22 bp, Homo sapiens
cttagggagaatgcctctgcag

SEQ ID NO: 7956971 - DNA, 22 bp, Homo sapiens
cttagtttctgtttctgattaa

SEQ ID NO: 7956972 - DNA, 22 bp, Homo sapiens
cttagtttctctgtatgtttac

SEQ ID NO: 7956973 - DNA, 22 bp, Homo sapiens
cttagtttctctgtatgtttac

SEQ ID NO: 7956974 - DNA, 22 bp, Homo sapiens
cttagtttctctgtatgtttac

SEQ ID NO: 7956975 - DNA, 22 bp, Homo sapiens
cttagtgagaaggagcccatgc

SEQ ID NO: 7956976 - DNA, 22 bp, Homo sapiens
cttaggatttaatttcagactc

SEQ ID NO: 7956977 - DNA, 22 bp, Homo sapiens
cttaggcaagcagagcccatcc

SEQ ID NO: 7956978 - DNA, 22 bp, Homo sapiens
cttaggagttcacttgaatagt

SEQ ID NO: 7956979 - DNA, 22 bp, Homo sapiens
cttataaagtccatctgaacaa

SEQ ID NO: 7956980 - DNA, 22 bp, Homo sapiens
cttataaagtccatctgaacaa

SEQ ID NO: 7956981 - DNA, 22 bp, Homo sapiens
cttataaagtccatctgaacaa

SEQ ID NO: 7956982 - DNA, 22 bp, Homo sapiens
cttataaagtccatctgaacaa

SEQ ID NO: 7956983 - DNA, 22 bp, Homo sapiens
cttataaagtccatctgaacaa

SEQ ID NO: 7956984 - DNA, 22 bp, Homo sapiens
cttataaagtccatctgaacaa

SEQ ID NO: 7956985 - DNA, 22 bp, Homo sapiens
cttagtttgcatgattatggag

SEQ ID NO: 7956986 - DNA, 22 bp, Homo sapiens
cttatacaccctcttcccaggc

SEQ ID NO: 7956987 - DNA, 22 bp, Homo sapiens
cttatacaccctcttcccaggc

SEQ ID NO: 7956988 - DNA, 22 bp, Homo sapiens
cttataaagtccatctgaacaa

SEQ ID NO: 7956989 - DNA, 22 bp, Homo sapiens
cttatacacgaacacaaggtgt

SEQ ID NO: 7956990 - DNA, 22 bp, Homo sapiens
cttatacacgaacacaaggtgt

SEQ ID NO: 7956991 - DNA, 22 bp, Homo sapiens
cttatacagatcaagggaaaag

SEQ ID NO: 7956992 - DNA, 22 bp, Homo sapiens
cttatacacgaacacaaggtgt

SEQ ID NO: 7956993 - DNA, 22 bp, Homo sapiens
cttcagttagccaattcaggtc

SEQ ID NO: 7956994 - DNA, 22 bp, Homo sapiens
cttcagttagagtttacaaagt

SEQ ID NO: 7956995 - DNA, 22 bp, Homo sapiens
cttcagtgttggttcattacga

SEQ ID NO: 7956996 - DNA, 22 bp, Homo sapiens
cttcagttagtttcatgtgagc

SEQ ID NO: 7956997 - DNA, 22 bp, Homo sapiens
cttcagttagccaattcaggtc

SEQ ID NO: 7956998 - DNA, 22 bp, Homo sapiens
cttcagttagtttcatgtgagc

SEQ ID NO: 7956999 - DNA, 22 bp, Homo sapiens
cttcatttcaggctgaagaata

SEQ ID NO: 7957000 - DNA, 22 bp, Homo sapiens
cttcatttcaggctgaagaata

SEQ ID NO: 7957001 - DNA, 23 bp, Homo sapiens
cttcattgtagtgttggggagat

SEQ ID NO: 7957002 - DNA, 23 bp, Homo sapiens
cttcattgtagtgttggggagat

SEQ ID NO: 7957003 - DNA, 19 bp, Homo sapiens
cttcattcttcagcttttg

SEQ ID NO: 7957004 - DNA, 22 bp, Homo sapiens
cttcattacttgctcgtagcac

SEQ ID NO: 7957005 - DNA, 22 bp, Homo sapiens
cttcattggcttccatagatgc

SEQ ID NO: 7957006 - DNA, 22 bp, Homo sapiens
cttcagtgttggttcattacga

SEQ ID NO: 7957007 - DNA, 22 bp, Homo sapiens
cttcagtgttgccagggcctag

SEQ ID NO: 7957008 - DNA, 22 bp, Homo sapiens
cttcagtgttgccagggcctag

SEQ ID NO: 7957009 - DNA, 22 bp, Homo sapiens
cttatagtatgatgttgagaat

SEQ ID NO: 7957010 - DNA, 22 bp, Homo sapiens
cttatagtatgatgttgagaat

SEQ ID NO: 7957011 - DNA, 22 bp, Homo sapiens
cttatagtatgatgttgagaat

SEQ ID NO: 7957012 - DNA, 22 bp, Homo sapiens
cttatatttgtcaactttacaa

SEQ ID NO: 7957013 - DNA, 22 bp, Homo sapiens
cttatatttgtcaactttacaa

SEQ ID NO: 7957014 - DNA, 19 bp, Homo sapiens
cttatacagattttctcat

SEQ ID NO: 7957015 - DNA, 22 bp, Homo sapiens
cttatacagatcaagggaaaag

SEQ ID NO: 7957016 - DNA, 22 bp, Homo sapiens
cttatacataaaatgggtgtag

SEQ ID NO: 7957017 - DNA, 22 bp, Homo sapiens
cttatactgaaaaattatttgt

SEQ ID NO: 7957018 - DNA, 22 bp, Homo sapiens
cttatagatggcgatcttcttg

SEQ ID NO: 7957019 - DNA, 22 bp, Homo sapiens
cttatagatggcgatcttcttg

SEQ ID NO: 7957020 - DNA, 22 bp, Homo sapiens
cttatagaattagagagatttt

SEQ ID NO: 7957021 - DNA, 22 bp, Homo sapiens
cttatacataaaatgggtgtag

SEQ ID NO: 7957022 - DNA, 22 bp, Homo sapiens
cttcatttcaggctgaagaata

SEQ ID NO: 7957023 - DNA, 22 bp, Homo sapiens
cttcatttcaggctgaagaata

SEQ ID NO: 7957024 - DNA, 22 bp, Homo sapiens
cttcatttcaggctgaagaata

SEQ ID NO: 7957025 - DNA, 22 bp, Homo sapiens
cttcatttcaggctgaagaata

SEQ ID NO: 7957026 - DNA, 22 bp, Homo sapiens
cttcatttccatccaactggga

SEQ ID NO: 7957027 - DNA, 22 bp, Homo sapiens
cttcatttcaggctgaagaata

SEQ ID NO: 7957028 - DNA, 18 bp, Homo sapiens
cttcatttgtagagttcc

SEQ ID NO: 7957029 - DNA, 18 bp, Homo sapiens
cttcatttgtagagttcc

SEQ ID NO: 7957030 - DNA, 22 bp, Homo sapiens
cttcatttggcaggctggcctc

SEQ ID NO: 7957031 - DNA, 22 bp, Homo sapiens
cttcatttggagaactgtgctt

SEQ ID NO: 7957032 - DNA, 22 bp, Homo sapiens
cttcatttggagaactgtgctt

SEQ ID NO: 7957033 - DNA, 22 bp, Homo sapiens
cttcatttggagaactgtgctt

SEQ ID NO: 7957034 - DNA, 22 bp, Homo sapiens
cttcatttggagaactgtgctt

SEQ ID NO: 7957035 - DNA, 22 bp, Homo sapiens
cttccaaacccagggtatgggc

SEQ ID NO: 7957036 - DNA, 22 bp, Homo sapiens
cttccaaaatttatatgttgaa

SEQ ID NO: 7957037 - DNA, 22 bp, Homo sapiens
cttccaaaatttatatgttgaa

SEQ ID NO: 7957038 - DNA, 22 bp, Homo sapiens
cttccaaaatttatatgttgaa

SEQ ID NO: 7957039 - DNA, 22 bp, Homo sapiens
cttccaaaatttatatgttgaa

SEQ ID NO: 7957040 - DNA, 18 bp, Homo sapiens
cttcatttgtagagttcc

SEQ ID NO: 7957041 - DNA, 18 bp, Homo sapiens
cttcatttgtagagttcc

SEQ ID NO: 7957042 - DNA, 18 bp, Homo sapiens
cttcatttgtagagttcc

SEQ ID NO: 7957043 - DNA, 22 bp, Homo sapiens
cttccaaacccagggtatgggc

SEQ ID NO: 7957044 - DNA, 22 bp, Homo sapiens
cttccaaacccagggtatgggc

SEQ ID NO: 7957045 - DNA, 22 bp, Homo sapiens
cttccaaagcactttatggacc

SEQ ID NO: 7957046 - DNA, 22 bp, Homo sapiens
cttccaaagcactttatggacc

SEQ ID NO: 7957047 - DNA, 22 bp, Homo sapiens
cttccaaagcactttatggacc

SEQ ID NO: 7957048 - DNA, 22 bp, Homo sapiens
cttccaaatgtaaataagtttc

SEQ ID NO: 7957049 - DNA, 19 bp, Homo sapiens
cttccaactgtgatctaga

SEQ ID NO: 7957050 - DNA, 19 bp, Homo sapiens
cttccaactgtgatctaga

SEQ ID NO: 7957051 - DNA, 22 bp, Homo sapiens
cttccaaatgtaaataagtttc

SEQ ID NO: 7957052 - DNA, 22 bp, Homo sapiens
cttccaaatgtaaataagtttc

SEQ ID NO: 7957053 - DNA, 22 bp, Homo sapiens
ccctggctggaaattaagtagt

SEQ ID NO: 7957054 - DNA, 22 bp, Homo sapiens
ccctggctgcttgtagtctggc

SEQ ID NO: 7957055 - DNA, 22 bp, Homo sapiens
ccctggctggaaattaagtagt

SEQ ID NO: 7957056 - DNA, 22 bp, Homo sapiens
ccctggcttaaaaacctcatat

SEQ ID NO: 7957057 - DNA, 22 bp, Homo sapiens
ccctggcttggcactctccact

SEQ ID NO: 7957058 - DNA, 22 bp, Homo sapiens
ccctggcttggcactctccact

SEQ ID NO: 7957059 - DNA, 22 bp, Homo sapiens
ccctggcttggcactctccact

SEQ ID NO: 7957060 - DNA, 22 bp, Homo sapiens
ccctggcttggcactctccact

SEQ ID NO: 7957061 - DNA, 22 bp, Homo sapiens
ccctgggaagtattccagctat

SEQ ID NO: 7957062 - DNA, 22 bp, Homo sapiens
ccctgggaagtattccagctat

SEQ ID NO: 7957063 - DNA, 22 bp, Homo sapiens
ccctgggaagtattccagctat

SEQ ID NO: 7957064 - DNA, 22 bp, Homo sapiens
ccctgggacccgctgcagaggc

SEQ ID NO: 7957065 - DNA, 22 bp, Homo sapiens
ccctgggacccgctgcagaggc

SEQ ID NO: 7957066 - DNA, 22 bp, Homo sapiens
ccctgggacccgctgcagaggc

SEQ ID NO: 7957067 - DNA, 22 bp, Homo sapiens
ccctgggagaagttgagggctg

SEQ ID NO: 7957068 - DNA, 22 bp, Homo sapiens
ccctgggagaagttgagggctg

SEQ ID NO: 7957069 - DNA, 22 bp, Homo sapiens
ccctgggacccgctgcagaggc

SEQ ID NO: 7957070 - DNA, 22 bp, Homo sapiens
ccctgggagctgcctggctgac

SEQ ID NO: 7957071 - DNA, 22 bp, Homo sapiens
ccctgggagaagttgagggctg

SEQ ID NO: 7957072 - DNA, 22 bp, Homo sapiens
ccctgggagaagttgagggctg

SEQ ID NO: 7957073 - DNA, 22 bp, Homo sapiens
ccctgggagctgcctggctgac

SEQ ID NO: 7957074 - DNA, 22 bp, Homo sapiens
tggcaggctgagttggcctggt

SEQ ID NO: 7957075 - DNA, 22 bp, Homo sapiens
tggcaggctgagttggcctggt

SEQ ID NO: 7957076 - DNA, 22 bp, Homo sapiens
tggcaggctgagttggcctggt

SEQ ID NO: 7957077 - DNA, 22 bp, Homo sapiens
tggcagggaatacagatgttta

SEQ ID NO: 7957078 - DNA, 22 bp, Homo sapiens
tggcaggctctgagtagcacct

SEQ ID NO: 7957079 - DNA, 22 bp, Homo sapiens
tggcaggctgagttggcctggt

SEQ ID NO: 7957080 - DNA, 22 bp, Homo sapiens
tggcaggcggaggttgcagtga

SEQ ID NO: 7957081 - DNA, 22 bp, Homo sapiens
tggcaggcgggagccatagagg

SEQ ID NO: 7957082 - DNA, 22 bp, Homo sapiens
ccctgggaggcttccaggcaga

SEQ ID NO: 7957083 - DNA, 22 bp, Homo sapiens
ccctgggaggcttccaggcaga

SEQ ID NO: 7957084 - DNA, 22 bp, Homo sapiens
ccctgggaggcttccaggcaga

SEQ ID NO: 7957085 - DNA, 22 bp, Homo sapiens
ccctgggaggcttccaggcaga

SEQ ID NO: 7957086 - DNA, 22 bp, Homo sapiens
ccctgggagtccactgatgtca

SEQ ID NO: 7957087 - DNA, 22 bp, Homo sapiens
ccctgggagtccactgatgtca

SEQ ID NO: 7957088 - DNA, 22 bp, Homo sapiens
tggcaggaaaaacattggagat

SEQ ID NO: 7957089 - DNA, 22 bp, Homo sapiens
tggcaggaaaaacattggagat

SEQ ID NO: 7957090 - DNA, 22 bp, Homo sapiens
tggcaggaaaaacattggagat

SEQ ID NO: 7957091 - DNA, 19 bp, Homo sapiens
tggcaggcccaggatggac

SEQ ID NO: 7957092 - DNA, 19 bp, Homo sapiens
tggcaggcccaggatggac

SEQ ID NO: 7957093 - DNA, 22 bp, Homo sapiens
tggcaggaaaaacattggagat

SEQ ID NO: 7957094 - DNA, 22 bp, Homo sapiens
tggcaggaaaaacattggagat

SEQ ID NO: 7957095 - DNA, 19 bp, Homo sapiens
tggcaggcccaggatggac

SEQ ID NO: 7957096 - DNA, 22 bp, Homo sapiens
tggcagggaatacagatgttta

SEQ ID NO: 7957097 - DNA, 19 bp, Homo sapiens
tggcagggagagtttgaag

SEQ ID NO: 7957098 - DNA, 22 bp, Homo sapiens
tggcagggaatacagatgttta

SEQ ID NO: 7957099 - DNA, 22 bp, Homo sapiens
tggcagggaatacagatgttta

SEQ ID NO: 7957100 - DNA, 22 bp, Homo sapiens
tggcagggaatacagatgttta

SEQ ID NO: 7957101 - DNA, 19 bp, Homo sapiens
tggcagggagagtttgaag

SEQ ID NO: 7957102 - DNA, 19 bp, Homo sapiens
tggcagggagagtttgaag

SEQ ID NO: 7957103 - DNA, 19 bp, Homo sapiens
tggcagggagagtttgaag

SEQ ID NO: 7957104 - DNA, 19 bp, Homo sapiens
tggcagggagagtttgaag

SEQ ID NO: 7957105 - DNA, 22 bp, Homo sapiens
tggcagggagccaccggtcatg

SEQ ID NO: 7957106 - DNA, 19 bp, Homo sapiens
tggcagggagagtttgaag

SEQ ID NO: 7957107 - DNA, 22 bp, Homo sapiens
cccttgctgccacagctgccca

SEQ ID NO: 7957108 - DNA, 22 bp, Homo sapiens
cccttgctgccacagctgccca

SEQ ID NO: 7957109 - DNA, 22 bp, Homo sapiens
cccttgctgccacagctgccca

SEQ ID NO: 7957110 - DNA, 22 bp, Homo sapiens
cccttgcatcccatgtgtggcc

SEQ ID NO: 7957111 - DNA, 22 bp, Homo sapiens
cccttgcacatttgtctttaat

SEQ ID NO: 7957112 - DNA, 22 bp, Homo sapiens
tggcagggagccaccggtcatg

SEQ ID NO: 7957113 - DNA, 22 bp, Homo sapiens
cccttgaagactagaatgagga

SEQ ID NO: 7957114 - DNA, 22 bp, Homo sapiens
ccctttaaggtctgattttcag

SEQ ID NO: 7957115 - DNA, 22 bp, Homo sapiens
ccctttaaggaaaggaaggatg

SEQ ID NO: 7957116 - DNA, 22 bp, Homo sapiens
ccctttaaggtctgattttcag

SEQ ID NO: 7957117 - DNA, 23 bp, Homo sapiens
ccctttaagatttgaatagtcag

SEQ ID NO: 7957118 - DNA, 20 bp, Homo sapiens
ccctttaagctttagtatgc

SEQ ID NO: 7957119 - DNA, 22 bp, Homo sapiens
ccctttaagtagaatatattat

SEQ ID NO: 7957120 - DNA, 22 bp, Homo sapiens
ccctttaacacacagaggctgc

SEQ ID NO: 7957121 - DNA, 22 bp, Homo sapiens
ccctttaaagttttaccagcag

SEQ ID NO: 7957122 - DNA, 22 bp, Homo sapiens
ccctttcaacattctgccttgt

SEQ ID NO: 7957123 - DNA, 22 bp, Homo sapiens
tggcaggtagtcagaggcgaca

SEQ ID NO: 7957124 - DNA, 22 bp, Homo sapiens
ccctttagcccctgcagagact

SEQ ID NO: 7957125 - DNA, 22 bp, Homo sapiens
ccctttaattccaacacaggaa

SEQ ID NO: 7957126 - DNA, 22 bp, Homo sapiens
ccctttaagtcctggaacaaag

SEQ ID NO: 7957127 - DNA, 22 bp, Homo sapiens
ccctttagcccctgcagagact

SEQ ID NO: 7957128 - DNA, 22 bp, Homo sapiens
cccttggctttagtttctaaag

SEQ ID NO: 7957129 - DNA, 22 bp, Homo sapiens
cccttgggccccagctcagggc

SEQ ID NO: 7957130 - DNA, 22 bp, Homo sapiens
cccttggggtggaggttgcagt

SEQ ID NO: 7957131 - DNA, 22 bp, Homo sapiens
cccttggggtggaggttgcagt

SEQ ID NO: 7957132 - DNA, 22 bp, Homo sapiens
cccttggggtggaggttgcagt

SEQ ID NO: 7957133 - DNA, 22 bp, Homo sapiens
cccttgggccccagctcagggc

SEQ ID NO: 7957134 - DNA, 22 bp, Homo sapiens
cccttggaaggtagctggcagt

SEQ ID NO: 7957135 - DNA, 22 bp, Homo sapiens
cccttgcttgcccagtcacagg

SEQ ID NO: 7957136 - DNA, 22 bp, Homo sapiens
cccttggaggaagctctaggct

SEQ ID NO: 7957137 - DNA, 22 bp, Homo sapiens
ccctggctgcgtgatggatgaa

SEQ ID NO: 7957138 - DNA, 22 bp, Homo sapiens
tggcagagaacacacatgattc

SEQ ID NO: 7957139 - DNA, 22 bp, Homo sapiens
tggcagagaacacacatgattc

SEQ ID NO: 7957140 - DNA, 22 bp, Homo sapiens
tggcagagaacacacatgattc

SEQ ID NO: 7957141 - DNA, 22 bp, Homo sapiens
tggcagagaacacacatgattc

SEQ ID NO: 7957142 - DNA, 22 bp, Homo sapiens
tggcagagaacacacatgattc

SEQ ID NO: 7957143 - DNA, 22 bp, Homo sapiens
ccctggctgcttgtagtctggc

SEQ ID NO: 7957144 - DNA, 22 bp, Homo sapiens
ccctggctgcttgtagtctggc

SEQ ID NO: 7957145 - DNA, 22 bp, Homo sapiens
ccctggctgcttgtagtctggc

SEQ ID NO: 7957146 - DNA, 22 bp, Homo sapiens
ccctggctgctaccaggtagct

SEQ ID NO: 7957147 - DNA, 22 bp, Homo sapiens
ccctggctgctaccaggtagct

SEQ ID NO: 7957148 - DNA, 22 bp, Homo sapiens
ccctggctgctaccaggtagct

SEQ ID NO: 7957149 - DNA, 22 bp, Homo sapiens
ccctggctgctaccaggtagct

SEQ ID NO: 7957150 - DNA, 22 bp, Homo sapiens
ccctggctgctaccaggtagct

SEQ ID NO: 7957151 - DNA, 22 bp, Homo sapiens
tggcagaatttctagcagattc

SEQ ID NO: 7957152 - DNA, 22 bp, Homo sapiens
tggcagaattttaaagacagat

SEQ ID NO: 7957153 - DNA, 22 bp, Homo sapiens
tggcagaattttaaagacagat

SEQ ID NO: 7957154 - DNA, 22 bp, Homo sapiens
tggcagaattttaaagacagat

SEQ ID NO: 7957155 - DNA, 22 bp, Homo sapiens
tggcagaattttaaagacagat

SEQ ID NO: 7957156 - DNA, 22 bp, Homo sapiens
tggcagaatttctagcagattc

SEQ ID NO: 7957157 - DNA, 22 bp, Homo sapiens
tggcagaagttcactagtagct

SEQ ID NO: 7957158 - DNA, 22 bp, Homo sapiens
tggcagaatttctagcagattc

SEQ ID NO: 7957159 - DNA, 22 bp, Homo sapiens
tggcagagaacacacatgattc

SEQ ID NO: 7957160 - DNA, 22 bp, Homo sapiens
tggcagactttagggtctacat

SEQ ID NO: 7957161 - DNA, 22 bp, Homo sapiens
tggcagagaacacacatgattc

SEQ ID NO: 7957162 - DNA, 22 bp, Homo sapiens
tggcagacctgaaggttcggcg

SEQ ID NO: 7957163 - DNA, 22 bp, Homo sapiens
tggcagactttagggtctacat

SEQ ID NO: 7957164 - DNA, 19 bp, Homo sapiens
tggcagacacaccttcttc

SEQ ID NO: 7957165 - DNA, 21 bp, Homo sapiens
tggcagacaggaggagctcac

SEQ ID NO: 7957166 - DNA, 21 bp, Homo sapiens
tggcagacaggaggagctcac

SEQ ID NO: 7957167 - DNA, 22 bp, Homo sapiens
tggcagaatgaagactggggcc

SEQ ID NO: 7957168 - DNA, 22 bp, Homo sapiens
tggcagaagttcactagtagct

SEQ ID NO: 7957169 - DNA, 22 bp, Homo sapiens
tggcagaagtacacaagcatgc

SEQ ID NO: 7957170 - DNA, 22 bp, Homo sapiens
tggcagaaagaaccatgtgcaa

SEQ ID NO: 7957171 - DNA, 22 bp, Homo sapiens
tggcagaagtacacaagcatgc

SEQ ID NO: 7957172 - DNA, 22 bp, Homo sapiens
tggcagaagtacacaagcatgc

SEQ ID NO: 7957173 - DNA, 22 bp, Homo sapiens
tggcacttgtcacctgctttca

SEQ ID NO: 7957174 - DNA, 22 bp, Homo sapiens
tggcacttggtaaatatgtgtt

SEQ ID NO: 7957175 - DNA, 22 bp, Homo sapiens
tggcacttttcccagttttggt

SEQ ID NO: 7957176 - DNA, 22 bp, Homo sapiens
tggcacttttcccagttttggt

SEQ ID NO: 7957177 - DNA, 22 bp, Homo sapiens
tggcactttacttcctcaggag

SEQ ID NO: 7957178 - DNA, 22 bp, Homo sapiens
tggcactttacacccatttggc

SEQ ID NO: 7957179 - DNA, 22 bp, Homo sapiens
ccctggagtgtgacgaggcatt

SEQ ID NO: 7957180 - DNA, 22 bp, Homo sapiens
tggcacagtgctggatggtgct

SEQ ID NO: 7957181 - DNA, 22 bp, Homo sapiens
ccctggatttacatcattctga

SEQ ID NO: 7957182 - DNA, 22 bp, Homo sapiens
tggcacagtgctggatggtgct

SEQ ID NO: 7957183 - DNA, 22 bp, Homo sapiens
tggcacagtgctggatggtgct

SEQ ID NO: 7957184 - DNA, 22 bp, Homo sapiens
tggcacagtgctggatggtgct

SEQ ID NO: 7957185 - DNA, 22 bp, Homo sapiens
tggcacttgatatttgatttgc

SEQ ID NO: 7957186 - DNA, 22 bp, Homo sapiens
tggcacttgcttcagatgatgt

SEQ ID NO: 7957187 - DNA, 22 bp, Homo sapiens
tggcacttggctgagaggttct

SEQ ID NO: 7957188 - DNA, 22 bp, Homo sapiens
tggcacttgggagtcgtggcga

SEQ ID NO: 7957189 - DNA, 22 bp, Homo sapiens
ccctggagtgtgacgaggcatt

SEQ ID NO: 7957190 - DNA, 22 bp, Homo sapiens
ccctggagtgtgacgaggcatt

SEQ ID NO: 7957191 - DNA, 22 bp, Homo sapiens
ccctggagtgtgacgaggcatt

SEQ ID NO: 7957192 - DNA, 22 bp, Homo sapiens
ccctggagtgtgacgaggcatt

SEQ ID NO: 7957193 - DNA, 22 bp, Homo sapiens
tggcacagtcctgggtgcctgc

SEQ ID NO: 7957194 - DNA, 22 bp, Homo sapiens
ccctggagtccggagctcacct

SEQ ID NO: 7957195 - DNA, 22 bp, Homo sapiens
ccctggagtcctggcagttgat

SEQ ID NO: 7957196 - DNA, 22 bp, Homo sapiens
ccctggagtcctggcagttgat

SEQ ID NO: 7957197 - DNA, 22 bp, Homo sapiens
ccctggagtcctggcagttgat

SEQ ID NO: 7957198 - DNA, 22 bp, Homo sapiens
ccctggagtccggagctcacct

SEQ ID NO: 7957199 - DNA, 22 bp, Homo sapiens
ccctggagtccggagctcacct

SEQ ID NO: 7957200 - DNA, 22 bp, Homo sapiens
ccctggagtccggagctcacct

SEQ ID NO: 7957201 - DNA, 22 bp, Homo sapiens
ccctggagtccggagctcacct

SEQ ID NO: 7957202 - DNA, 22 bp, Homo sapiens
ccctggagtgccggaatcaaga

SEQ ID NO: 7957203 - DNA, 22 bp, Homo sapiens
ccctggagtgtgacgaggcatt

SEQ ID NO: 7957204 - DNA, 22 bp, Homo sapiens
ccctggagtcctggcagttgat

SEQ ID NO: 7957205 - DNA, 22 bp, Homo sapiens
ccctggagtcctggcagttgat

SEQ ID NO: 7957206 - DNA, 22 bp, Homo sapiens
ccctggagtccggagctcacct

SEQ ID NO: 7957207 - DNA, 22 bp, Homo sapiens
ccctggagtcaggttggcctgg

SEQ ID NO: 7957208 - DNA, 22 bp, Homo sapiens
ccctggagtagcactgggtcgc

SEQ ID NO: 7957209 - DNA, 22 bp, Homo sapiens
ccctggagtagcactgggtcgc

SEQ ID NO: 7957210 - DNA, 22 bp, Homo sapiens
ccctggagtagcactgggtcgc

SEQ ID NO: 7957211 - DNA, 22 bp, Homo sapiens
ccctggagtagcactgggtcgc

SEQ ID NO: 7957212 - DNA, 22 bp, Homo sapiens
ccctggaggtggaggttgcagg

SEQ ID NO: 7957213 - DNA, 22 bp, Homo sapiens
ccctggaggtggaggttgcagg

SEQ ID NO: 7957214 - DNA, 22 bp, Homo sapiens
ccctggaggtggaggttgcagg

SEQ ID NO: 7957215 - DNA, 22 bp, Homo sapiens
ccctggaggtggaggttgcagg

SEQ ID NO: 7957216 - DNA, 22 bp, Homo sapiens
ccctggaggtggaggttgcagg

SEQ ID NO: 7957217 - DNA, 22 bp, Homo sapiens
ccctggaggttgaggctgcagt

SEQ ID NO: 7957218 - DNA, 22 bp, Homo sapiens
ccctggaggttgaggctgcagt

SEQ ID NO: 7957219 - DNA, 22 bp, Homo sapiens
ccctggaggttgaggctgcagt

SEQ ID NO: 7957220 - DNA, 22 bp, Homo sapiens
ccctggaggttgaggctgcagt

SEQ ID NO: 7957221 - DNA, 22 bp, Homo sapiens
ccctggaggttgaggctgcagt

SEQ ID NO: 7957222 - DNA, 22 bp, Homo sapiens
ccctggagggcagacagatgcc

SEQ ID NO: 7957223 - DNA, 22 bp, Homo sapiens
ccctggagggcagacagatgcc

SEQ ID NO: 7957224 - DNA, 22 bp, Homo sapiens
ccctggagggcagacagatgcc

SEQ ID NO: 7957225 - DNA, 22 bp, Homo sapiens
ccctggagggcagacagatgcc

SEQ ID NO: 7957226 - DNA, 22 bp, Homo sapiens
ccctggagggcagacagatgcc

SEQ ID NO: 7957227 - DNA, 22 bp, Homo sapiens
ccctggagggcagacagatgcc

SEQ ID NO: 7957228 - DNA, 22 bp, Homo sapiens
ccctggaggtcagaggcctggg

SEQ ID NO: 7957229 - DNA, 22 bp, Homo sapiens
ccctggaggtcagaggcctggg

SEQ ID NO: 7957230 - DNA, 22 bp, Homo sapiens
ccctggaggtggaggttgcagg

SEQ ID NO: 7957231 - DNA, 22 bp, Homo sapiens
ccctggaggtcagaggcctggg

SEQ ID NO: 7957232 - DNA, 22 bp, Homo sapiens
ccctggaggtcagaggcctggg

SEQ ID NO: 7957233 - DNA, 22 bp, Homo sapiens
ccctggaggtcagaggcctggg

SEQ ID NO: 7957234 - DNA, 22 bp, Homo sapiens
ccctggaggtcagaggcctggg

SEQ ID NO: 7957235 - DNA, 22 bp, Homo sapiens
ccctggaggtcagaggcctggg

SEQ ID NO: 7957236 - DNA, 22 bp, Homo sapiens
tggaggagaactccctggctac

SEQ ID NO: 7957237 - DNA, 22 bp, Homo sapiens
tggaggagaactccctggctac

SEQ ID NO: 7957238 - DNA, 22 bp, Homo sapiens
tggaggcagtcacctgaagtca

SEQ ID NO: 7957239 - DNA, 22 bp, Homo sapiens
tggaggacgtgtccaccatgaa

SEQ ID NO: 7957240 - DNA, 22 bp, Homo sapiens
tggaggagaactccctggctac

SEQ ID NO: 7957241 - DNA, 22 bp, Homo sapiens
tggaggagaactccctggctac

SEQ ID NO: 7957242 - DNA, 22 bp, Homo sapiens
tggaggcagtttaagtctgaga

SEQ ID NO: 7957243 - DNA, 22 bp, Homo sapiens
tggaggcagtttaagtctgaga

SEQ ID NO: 7957244 - DNA, 22 bp, Homo sapiens
tggaggcagtttaagtctgaga

SEQ ID NO: 7957245 - DNA, 22 bp, Homo sapiens
tggaggcataggcctgggccct

SEQ ID NO: 7957246 - DNA, 22 bp, Homo sapiens
tggaggcataggcctgggccct

SEQ ID NO: 7957247 - DNA, 22 bp, Homo sapiens
tggaggcagtttaagtctgaga

SEQ ID NO: 7957248 - DNA, 16 bp, Homo sapiens
tggaggcatctggccc

SEQ ID NO: 7957249 - DNA, 22 bp, Homo sapiens
tggaggcatgacagtgtctgga

SEQ ID NO: 7957250 - DNA, 22 bp, Homo sapiens
tggaggcatcagagtgcttggc

SEQ ID NO: 7957251 - DNA, 22 bp, Homo sapiens
tggaggcataggcctgggccct

SEQ ID NO: 7957252 - DNA, 22 bp, Homo sapiens
tggaggcataggcctgggccct

SEQ ID NO: 7957253 - DNA, 22 bp, Homo sapiens
tggaggcatcagagtgcttggc

SEQ ID NO: 7957254 - DNA, 22 bp, Homo sapiens
tggaggcatcagagtgcttggc

SEQ ID NO: 7957255 - DNA, 22 bp, Homo sapiens
tggaggcatcagagtgcttggc

SEQ ID NO: 7957256 - DNA, 22 bp, Homo sapiens
tggaggcataggcctgggccct

SEQ ID NO: 7957257 - DNA, 22 bp, Homo sapiens
ccctggaggaagaaacaatggc

SEQ ID NO: 7957258 - DNA, 22 bp, Homo sapiens
ccctggaggaccccaatgtggc

SEQ ID NO: 7957259 - DNA, 22 bp, Homo sapiens
ccctggaggaccccaatgtggc

SEQ ID NO: 7957260 - DNA, 22 bp, Homo sapiens
tggaggccaactttcctcatct

SEQ ID NO: 7957261 - DNA, 22 bp, Homo sapiens
tggaggccaactttcctcatct

SEQ ID NO: 7957262 - DNA, 22 bp, Homo sapiens
tggaggccaaggcaggcggatc

SEQ ID NO: 7957263 - DNA, 22 bp, Homo sapiens
tggaggccaaggcaggcggatc

SEQ ID NO: 7957264 - DNA, 22 bp, Homo sapiens
tggaggccaaggcaggcggatc

SEQ ID NO: 7957265 - DNA, 22 bp, Homo sapiens
tggaggccacatgaacgctgcg

SEQ ID NO: 7957266 - DNA, 22 bp, Homo sapiens
tggaggccacatgaacgctgcg

SEQ ID NO: 7957267 - DNA, 22 bp, Homo sapiens
tggaggccaaggcaggcggatc

SEQ ID NO: 7957268 - DNA, 22 bp, Homo sapiens
ccctggagggatttctcaatca

SEQ ID NO: 7957269 - DNA, 22 bp, Homo sapiens
ccctggagggatttctcaatca

SEQ ID NO: 7957270 - DNA, 22 bp, Homo sapiens
ccctggagggatttctcaatca

SEQ ID NO: 7957271 - DNA, 22 bp, Homo sapiens
ccctggagggacagctgctcta

SEQ ID NO: 7957272 - DNA, 22 bp, Homo sapiens
ccctggagggacagctgctcta

SEQ ID NO: 7957273 - DNA, 22 bp, Homo sapiens
tggaggcatgacagtgtctgga

SEQ ID NO: 7957274 - DNA, 22 bp, Homo sapiens
tggaggcatgacagtgtctgga

SEQ ID NO: 7957275 - DNA, 22 bp, Homo sapiens
tggaggcatgacagtgtctgga

SEQ ID NO: 7957276 - DNA, 22 bp, Homo sapiens
tggaggcattgtgactgctgaa

SEQ ID NO: 7957277 - DNA, 22 bp, Homo sapiens
tggaggcattgtgactgctgaa

SEQ ID NO: 7957278 - DNA, 22 bp, Homo sapiens
tggaggcattgtgactgctgaa

SEQ ID NO: 7957279 - DNA, 22 bp, Homo sapiens
tggaggcattgtgactgctgaa

SEQ ID NO: 7957280 - DNA, 22 bp, Homo sapiens
tggaggcattgtgactgctgaa

SEQ ID NO: 7957281 - DNA, 22 bp, Homo sapiens
tggaggaatcagggcttaggct

SEQ ID NO: 7957282 - DNA, 22 bp, Homo sapiens
tggaggacaggactggacagcc

SEQ ID NO: 7957283 - DNA, 22 bp, Homo sapiens
tggaggacaggactggacagcc

SEQ ID NO: 7957284 - DNA, 22 bp, Homo sapiens
tggaggacaggactggacagcc

SEQ ID NO: 7957285 - DNA, 22 bp, Homo sapiens
tggaggacaggactggacagcc

SEQ ID NO: 7957286 - DNA, 22 bp, Homo sapiens
tggaggacgtgtccaccatgaa

SEQ ID NO: 7957287 - DNA, 18 bp, Homo sapiens
tggaggaatcacaatggc

SEQ ID NO: 7957288 - DNA, 18 bp, Homo sapiens
tggaggaatcacaatggc

SEQ ID NO: 7957289 - DNA, 18 bp, Homo sapiens
tggaggaatcacaatggc

SEQ ID NO: 7957290 - DNA, 18 bp, Homo sapiens
tggaggaatcacaatggc

SEQ ID NO: 7957291 - DNA, 21 bp, Homo sapiens
tggaggaataaagcacagaag

SEQ ID NO: 7957292 - DNA, 21 bp, Homo sapiens
tggaggaataaagcacagaag

SEQ ID NO: 7957293 - DNA, 22 bp, Homo sapiens
tggaggaagttgctggaagtca

SEQ ID NO: 7957294 - DNA, 22 bp, Homo sapiens
tggaggaataacagcaacctta

SEQ ID NO: 7957295 - DNA, 22 bp, Homo sapiens
tggaggaataacagcaacctta

SEQ ID NO: 7957296 - DNA, 23 bp, Homo sapiens
tggaggaaacacatcagaagacc

SEQ ID NO: 7957297 - DNA, 19 bp, Homo sapiens
tggaggaagtatatttcat

SEQ ID NO: 7957298 - DNA, 22 bp, Homo sapiens
tggaggaagtggacagttgtgt

SEQ ID NO: 7957299 - DNA, 22 bp, Homo sapiens
tggaggaagtggacagttgtgt

SEQ ID NO: 7957300 - DNA, 19 bp, Homo sapiens
tggaggaagtatatttcat

SEQ ID NO: 7957301 - DNA, 19 bp, Homo sapiens
tggaggaagtatatttcat

SEQ ID NO: 7957302 - DNA, 22 bp, Homo sapiens
tggaggaagttgctggaagtca

SEQ ID NO: 7957303 - DNA, 22 bp, Homo sapiens
tggaggaagttgctggaagtca

SEQ ID NO: 7957304 - DNA, 22 bp, Homo sapiens
tggaggaagtggctggccagaa

SEQ ID NO: 7957305 - DNA, 22 bp, Homo sapiens
tggaggaagtggctggccagaa

SEQ ID NO: 7957306 - DNA, 22 bp, Homo sapiens
tggaggaagtggctggccagaa

SEQ ID NO: 7957307 - DNA, 22 bp, Homo sapiens
tggaggaagtggctggccagaa

SEQ ID NO: 7957308 - DNA, 23 bp, Homo sapiens
tggaggaaacacatcagaagacc

SEQ ID NO: 7957309 - DNA, 23 bp, Homo sapiens
tggaggaaacacatcagaagacc

SEQ ID NO: 7957310 - DNA, 22 bp, Homo sapiens
tggagctgaggggaatgctgag

SEQ ID NO: 7957311 - DNA, 22 bp, Homo sapiens
tggagctgaggggaatgctgag

SEQ ID NO: 7957312 - DNA, 22 bp, Homo sapiens
tggaggaaaattactggggtct

SEQ ID NO: 7957313 - DNA, 22 bp, Homo sapiens
tggagctgaggggaatgctgag

SEQ ID NO: 7957314 - DNA, 22 bp, Homo sapiens
tggagatgtaaagcaaggctta

SEQ ID NO: 7957315 - DNA, 22 bp, Homo sapiens
tggagatgtaaagcaaggctta

SEQ ID NO: 7957316 - DNA, 22 bp, Homo sapiens
tggagatgggttaatggagaga

SEQ ID NO: 7957317 - DNA, 22 bp, Homo sapiens
tggagatgtaaagcaaggctta

SEQ ID NO: 7957318 - DNA, 22 bp, Homo sapiens
tggagatggcctcaggccctca

SEQ ID NO: 7957319 - DNA, 22 bp, Homo sapiens
tggagatggcctcaggccctca

SEQ ID NO: 7957320 - DNA, 22 bp, Homo sapiens
tggagatggcctcaggccctca

SEQ ID NO: 7957321 - DNA, 22 bp, Homo sapiens
tggagatgggaaaaaggaggta

SEQ ID NO: 7957322 - DNA, 22 bp, Homo sapiens
tggagatgggttaatggagaga

SEQ ID NO: 7957323 - DNA, 22 bp, Homo sapiens
tggagatgggttaatggagaga

SEQ ID NO: 7957324 - DNA, 22 bp, Homo sapiens
tggagatgggaaaaaggaggta

SEQ ID NO: 7957325 - DNA, 22 bp, Homo sapiens
tggagatgggaaaaaggaggta

SEQ ID NO: 7957326 - DNA, 22 bp, Homo sapiens
tggagatgcacgagcaggtgga

SEQ ID NO: 7957327 - DNA, 22 bp, Homo sapiens
tggagatgcacgagcaggtgga

SEQ ID NO: 7957328 - DNA, 22 bp, Homo sapiens
tggagatgcacgagcaggtgga

SEQ ID NO: 7957329 - DNA, 22 bp, Homo sapiens
tggagatgcacgagcaggtgga

SEQ ID NO: 7957330 - DNA, 23 bp, Homo sapiens
tggagatgccccactccctgtct

SEQ ID NO: 7957331 - DNA, 22 bp, Homo sapiens
tggagatgcacgagcaggtgga

SEQ ID NO: 7957332 - DNA, 23 bp, Homo sapiens
tggagatgccccactccctgtct

SEQ ID NO: 7957333 - DNA, 23 bp, Homo sapiens
tggagatgccccactccctgtct

SEQ ID NO: 7957334 - DNA, 22 bp, Homo sapiens
tggagatgcacgagcaggtgga

SEQ ID NO: 7957335 - DNA, 22 bp, Homo sapiens
ccctcctcaactctggcttcca

SEQ ID NO: 7957336 - DNA, 23 bp, Homo sapiens
tggaaacattctgaatgtccatc

SEQ ID NO: 7957337 - DNA, 23 bp, Homo sapiens
tggaaacattctgaatgtccatc

SEQ ID NO: 7957338 - DNA, 22 bp, Homo sapiens
ccctcctcaactctggcttcca

SEQ ID NO: 7957339 - DNA, 22 bp, Homo sapiens
ccctcctcaactctggcttcca

SEQ ID NO: 7957340 - DNA, 22 bp, Homo sapiens
ccctcctcaactctggcttcca

SEQ ID NO: 7957341 - DNA, 22 bp, Homo sapiens
ccctcctcaactctggcttcca

SEQ ID NO: 7957342 - DNA, 22 bp, Homo sapiens
ccctccctttgcagcagtgcat

SEQ ID NO: 7957343 - DNA, 22 bp, Homo sapiens
ccctccctttgtctttatgaac

SEQ ID NO: 7957344 - DNA, 22 bp, Homo sapiens
ccctccctttgcagcagtgcat

SEQ ID NO: 7957345 - DNA, 22 bp, Homo sapiens
ccctccctgtgtgcctcatttg

SEQ ID NO: 7957346 - DNA, 22 bp, Homo sapiens
ccctccctgtgtgcctcatttg

SEQ ID NO: 7957347 - DNA, 22 bp, Homo sapiens
ccctccctgaagaagttactct

SEQ ID NO: 7957348 - DNA, 22 bp, Homo sapiens
ccctccctgaagaagttactct

SEQ ID NO: 7957349 - DNA, 22 bp, Homo sapiens
ccctccctgaagaagttactct

SEQ ID NO: 7957350 - DNA, 22 bp, Homo sapiens
ccctccctgaagaagttactct

SEQ ID NO: 7957351 - DNA, 22 bp, Homo sapiens
ccctccctgaagaagttactct

SEQ ID NO: 7957352 - DNA, 22 bp, Homo sapiens
ccctccctgtgtgcctcatttg

SEQ ID NO: 7957353 - DNA, 22 bp, Homo sapiens
ccctccctgtgtgcctcatttg

SEQ ID NO: 7957354 - DNA, 22 bp, Homo sapiens
ccctccctgtgtgcctcatttg

SEQ ID NO: 7957355 - DNA, 22 bp, Homo sapiens
ccctccctgtgtgcctcatttg

SEQ ID NO: 7957356 - DNA, 23 bp, Homo sapiens
tggaaacattctgaatgtccatc

SEQ ID NO: 7957357 - DNA, 22 bp, Homo sapiens
tggaaactaacaacagagcaga

SEQ ID NO: 7957358 - DNA, 22 bp, Homo sapiens
tggaaactaagactagagagac

SEQ ID NO: 7957359 - DNA, 22 bp, Homo sapiens
tggaaactaacaacagagcaga

SEQ ID NO: 7957360 - DNA, 22 bp, Homo sapiens
tggaaactagagtgtgggaagc

SEQ ID NO: 7957361 - DNA, 22 bp, Homo sapiens
tggaaactagccttttaggttg

SEQ ID NO: 7957362 - DNA, 22 bp, Homo sapiens
tggaaactagagagtttgtatt

SEQ ID NO: 7957363 - DNA, 22 bp, Homo sapiens
tggaaactagagagtttgtatt

SEQ ID NO: 7957364 - DNA, 22 bp, Homo sapiens
tggaaactcagggccagaagga

SEQ ID NO: 7957365 - DNA, 22 bp, Homo sapiens
tggaaactatcctcacaactag

SEQ ID NO: 7957366 - DNA, 22 bp, Homo sapiens
tggaaactatcctcacaactag

SEQ ID NO: 7957367 - DNA, 22 bp, Homo sapiens
tggaaactatagtcacaataga

SEQ ID NO: 7957368 - DNA, 22 bp, Homo sapiens
tggaaactaggatggaagaaat

SEQ ID NO: 7957369 - DNA, 22 bp, Homo sapiens
tggaaactagccttttaggttg

SEQ ID NO: 7957370 - DNA, 22 bp, Homo sapiens
tggaaactataaaagcaccttc

SEQ ID NO: 7957371 - DNA, 22 bp, Homo sapiens
tggaaactgtggtatttcttta

SEQ ID NO: 7957372 - DNA, 23 bp, Homo sapiens
tggaaacttaagggggagatgtc

SEQ ID NO: 7957373 - DNA, 23 bp, Homo sapiens
tggaaacttaagggggagatgtc

SEQ ID NO: 7957374 - DNA, 22 bp, Homo sapiens
tggaaacttatctgacacgaac

SEQ ID NO: 7957375 - DNA, 22 bp, Homo sapiens
tggaaacttaccgtttggggaa

SEQ ID NO: 7957376 - DNA, 22 bp, Homo sapiens
tggaaagaaaaacaggccatga

SEQ ID NO: 7957377 - DNA, 22 bp, Homo sapiens
tggaaacttggaacgtcttcag

SEQ ID NO: 7957378 - DNA, 21 bp, Homo sapiens
tggaaacttctagcttacgta

SEQ ID NO: 7957379 - DNA, 21 bp, Homo sapiens
tggaaacttctagcttacgta

SEQ ID NO: 7957380 - DNA, 22 bp, Homo sapiens
tggaaagaaaaacaggccatga

SEQ ID NO: 7957381 - DNA, 19 bp, Homo sapiens
tggaaactcctgatattag

SEQ ID NO: 7957382 - DNA, 19 bp, Homo sapiens
tggaaactcctgatattag

SEQ ID NO: 7957383 - DNA, 22 bp, Homo sapiens
tggaaactctacctctctaaga

SEQ ID NO: 7957384 - DNA, 22 bp, Homo sapiens
tggaaactctacctctctaaga

SEQ ID NO: 7957385 - DNA, 22 bp, Homo sapiens
tggaaactctacctctctaaga

SEQ ID NO: 7957386 - DNA, 22 bp, Homo sapiens
tggaaactgtggtatttcttta

SEQ ID NO: 7957387 - DNA, 22 bp, Homo sapiens
tggaaactgggagttaaatgta

SEQ ID NO: 7957388 - DNA, 22 bp, Homo sapiens
tggaaactgggagttaaatgta

SEQ ID NO: 7957389 - DNA, 22 bp, Homo sapiens
tggaaactgcagttcccgggga

SEQ ID NO: 7957390 - DNA, 22 bp, Homo sapiens
tggagaattctatgttgagggg

SEQ ID NO: 7957391 - DNA, 23 bp, Homo sapiens
tggagaattcagtctttgttttg

SEQ ID NO: 7957392 - DNA, 20 bp, Homo sapiens
tggagacaattgcccttttt

SEQ ID NO: 7957393 - DNA, 20 bp, Homo sapiens
tggagacaattgcccttttt

SEQ ID NO: 7957394 - DNA, 22 bp, Homo sapiens
tggagacacaggaccagactgc

SEQ ID NO: 7957395 - DNA, 22 bp, Homo sapiens
tggagacatgggcgaatctaag

SEQ ID NO: 7957396 - DNA, 22 bp, Homo sapiens
tggagaattaggccaaatctcc

SEQ ID NO: 7957397 - DNA, 22 bp, Homo sapiens
tggagaattctatgttgagggg

SEQ ID NO: 7957398 - DNA, 22 bp, Homo sapiens
tggagaattctatgttgagggg

SEQ ID NO: 7957399 - DNA, 22 bp, Homo sapiens
tggaaagaaagtaaaggcgtat

SEQ ID NO: 7957400 - DNA, 22 bp, Homo sapiens
tggaaagaaagtaaaggcgtat

SEQ ID NO: 7957401 - DNA, 22 bp, Homo sapiens
tggaaagaattcctatggttca

SEQ ID NO: 7957402 - DNA, 22 bp, Homo sapiens
tggaaagaattcctatggttca

SEQ ID NO: 7957403 - DNA, 22 bp, Homo sapiens
tggagacatttctcattaaaaa

SEQ ID NO: 7957404 - DNA, 22 bp, Homo sapiens
tggagactcagaaggggaagca

SEQ ID NO: 7957405 - DNA, 22 bp, Homo sapiens
tggagactctgcatctgtgaca

SEQ ID NO: 7957406 - DNA, 21 bp, Homo sapiens
tggagactctggttctttgtg

SEQ ID NO: 7957407 - DNA, 22 bp, Homo sapiens
tggagactctgcatctgtgaca

SEQ ID NO: 7957408 - DNA, 19 bp, Homo sapiens
tggagactgagagtgagca

SEQ ID NO: 7957409 - DNA, 22 bp, Homo sapiens
tggagactgataaaggctattg

SEQ ID NO: 7957410 - DNA, 22 bp, Homo sapiens
tggagactgataaaggctattg

SEQ ID NO: 7957411 - DNA, 22 bp, Homo sapiens
tggagactgataaaggctattg

SEQ ID NO: 7957412 - DNA, 22 bp, Homo sapiens
tggagactgtgctaagggagtt

SEQ ID NO: 7957413 - DNA, 22 bp, Homo sapiens
tggagactgactgcctgtattt

SEQ ID NO: 7957414 - DNA, 22 bp, Homo sapiens
tggagactgactgcctgtattt

SEQ ID NO: 7957415 - DNA, 21 bp, Homo sapiens
tggagactctggttctttgtg

SEQ ID NO: 7957416 - DNA, 21 bp, Homo sapiens
tggagactctggttctttgtg

SEQ ID NO: 7957417 - DNA, 22 bp, Homo sapiens
tggagactctgcatctgtgaca

SEQ ID NO: 7957418 - DNA, 22 bp, Homo sapiens
tggagactctgcatctgtgaca

SEQ ID NO: 7957419 - DNA, 22 bp, Homo sapiens
tggagatgaatatgtgtacctg

SEQ ID NO: 7957420 - DNA, 22 bp, Homo sapiens
tggagatgaggacatggacgtc

SEQ ID NO: 7957421 - DNA, 22 bp, Homo sapiens
tggagatgaggacatggacgtc

SEQ ID NO: 7957422 - DNA, 22 bp, Homo sapiens
tggagatgaacatggtgatgtt

SEQ ID NO: 7957423 - DNA, 22 bp, Homo sapiens
tggagatgaatatgtgtacctg

SEQ ID NO: 7957424 - DNA, 22 bp, Homo sapiens
tggagatgaacatggtgatgtt

SEQ ID NO: 7957425 - DNA, 22 bp, Homo sapiens
tggagagtttagcctactggaa

SEQ ID NO: 7957426 - DNA, 22 bp, Homo sapiens
tggagagaaaaaagacagttct

SEQ ID NO: 7957427 - DNA, 22 bp, Homo sapiens
tggagagaaaaaagacagttct

SEQ ID NO: 7957428 - DNA, 22 bp, Homo sapiens
tggagagaaaaaagacagttct

SEQ ID NO: 7957429 - DNA, 22 bp, Homo sapiens
tggagatgaacatggtgatgtt

SEQ ID NO: 7957430 - DNA, 22 bp, Homo sapiens
tggagatgaacatggtgatgtt

SEQ ID NO: 7957431 - DNA, 22 bp, Homo sapiens
tggagagtttagcctactggaa

SEQ ID NO: 7957432 - DNA, 22 bp, Homo sapiens
ccctccctatgtagatgatgtt

SEQ ID NO: 7957433 - DNA, 22 bp, Homo sapiens
ccctccctatgtagatgatgtt

SEQ ID NO: 7957434 - DNA, 22 bp, Homo sapiens
ccctccctctgctgggtgtaga

SEQ ID NO: 7957435 - DNA, 22 bp, Homo sapiens
ccctccccacaaagcttcacac

SEQ ID NO: 7957436 - DNA, 22 bp, Homo sapiens
ccctccccagggtcatattgaa

SEQ ID NO: 7957437 - DNA, 22 bp, Homo sapiens
ccctccccacaaagcttcacac

SEQ ID NO: 7957438 - DNA, 22 bp, Homo sapiens
ccctccccagggtcatattgaa

SEQ ID NO: 7957439 - DNA, 22 bp, Homo sapiens
ccctccccagggtcatattgaa

SEQ ID NO: 7957440 - DNA, 22 bp, Homo sapiens
ccctccccagggtcatattgaa

SEQ ID NO: 7957441 - DNA, 22 bp, Homo sapiens
ccctccccagggtcatattgaa

SEQ ID NO: 7957442 - DNA, 22 bp, Homo sapiens
tgcttgtccctctttatgatgg

SEQ ID NO: 7957443 - DNA, 22 bp, Homo sapiens
ccctccagtgtcccagtgggga

SEQ ID NO: 7957444 - DNA, 22 bp, Homo sapiens
ccctccagtgtcccagtgggga

SEQ ID NO: 7957445 - DNA, 22 bp, Homo sapiens
tgcttgtccgaggtgagtactt

SEQ ID NO: 7957446 - DNA, 20 bp, Homo sapiens
tgcttgtcatgcactcaggc

SEQ ID NO: 7957447 - DNA, 22 bp, Homo sapiens
tgcttgtcaggataagctctgg

SEQ ID NO: 7957448 - DNA, 22 bp, Homo sapiens
tgcttgtcacatacaggagcat

SEQ ID NO: 7957449 - DNA, 22 bp, Homo sapiens
tgcttgtcaggataagctctgg

SEQ ID NO: 7957450 - DNA, 20 bp, Homo sapiens
tgcttgtcatgcactcaggc

SEQ ID NO: 7957451 - DNA, 20 bp, Homo sapiens
tgcttgtcatgcactcaggc

SEQ ID NO: 7957452 - DNA, 23 bp, Homo sapiens
tgcttgtcatgacatcaccaagc

SEQ ID NO: 7957453 - DNA, 23 bp, Homo sapiens
tgcttgtcatgacatcaccaagc

SEQ ID NO: 7957454 - DNA, 21 bp, Homo sapiens
tgcttgtcatgaatgggccag

SEQ ID NO: 7957455 - DNA, 21 bp, Homo sapiens
tgcttgtcatgaatgggccag

SEQ ID NO: 7957456 - DNA, 22 bp, Homo sapiens
tgcttgtcagtgtgctagaaac

SEQ ID NO: 7957457 - DNA, 22 bp, Homo sapiens
ccctccccacaaagcttcacac

SEQ ID NO: 7957458 - DNA, 22 bp, Homo sapiens
ccctccccacaaagcttcacac

SEQ ID NO: 7957459 - DNA, 22 bp, Homo sapiens
ccctccccacaaagcttcacac

SEQ ID NO: 7957460 - DNA, 22 bp, Homo sapiens
ccctccccacaaagcttcacac

SEQ ID NO: 7957461 - DNA, 22 bp, Homo sapiens
ccctccccacaaagcttcacac

SEQ ID NO: 7957462 - DNA, 22 bp, Homo sapiens
ccctccagtgtcccagtgggga

SEQ ID NO: 7957463 - DNA, 22 bp, Homo sapiens
ccctccagtgtcccagtgggga

SEQ ID NO: 7957464 - DNA, 22 bp, Homo sapiens
ccctccagtgtcccagtgggga

SEQ ID NO: 7957465 - DNA, 22 bp, Homo sapiens
ccctccagtgtcccagtgggga

SEQ ID NO: 7957466 - DNA, 22 bp, Homo sapiens
tgcttggcctacttgtcctttg

SEQ ID NO: 7957467 - DNA, 22 bp, Homo sapiens
tgcttggcctacttgtcctttg

SEQ ID NO: 7957468 - DNA, 22 bp, Homo sapiens
tgcttggctagcttggcagctc

SEQ ID NO: 7957469 - DNA, 22 bp, Homo sapiens
tgcttggctagcttggcagctc

SEQ ID NO: 7957470 - DNA, 22 bp, Homo sapiens
tgcttggctagcttggcagctc

SEQ ID NO: 7957471 - DNA, 22 bp, Homo sapiens
tgcttggctttctgagcttctg

SEQ ID NO: 7957472 - DNA, 22 bp, Homo sapiens
tgcttgctggaggcagacagaa

SEQ ID NO: 7957473 - DNA, 22 bp, Homo sapiens
tgcttgctgaaaggcatttaga

SEQ ID NO: 7957474 - DNA, 22 bp, Homo sapiens
tgcttccttgatcattcccaaa

SEQ ID NO: 7957475 - DNA, 22 bp, Homo sapiens
tgcttgctgggccaatggcaat

SEQ ID NO: 7957476 - DNA, 22 bp, Homo sapiens
tgcttgctggaggcagacagaa

SEQ ID NO: 7957477 - DNA, 22 bp, Homo sapiens
tgcttgctgggccaatggcaat

SEQ ID NO: 7957478 - DNA, 22 bp, Homo sapiens
tgcttgctgggtcttgcatctg

SEQ ID NO: 7957479 - DNA, 22 bp, Homo sapiens
tgcttgcttcagccctcatctt

SEQ ID NO: 7957480 - DNA, 22 bp, Homo sapiens
tgcttgcttgaggcgagacatt

SEQ ID NO: 7957481 - DNA, 22 bp, Homo sapiens
tgcttgggcggccagcatggcg

SEQ ID NO: 7957482 - DNA, 22 bp, Homo sapiens
tgcttgggcggccagcatggcg

SEQ ID NO: 7957483 - DNA, 22 bp, Homo sapiens
tgcttgggcggccagcatggcg

SEQ ID NO: 7957484 - DNA, 22 bp, Homo sapiens
tgcttggctttctgagcttctg

SEQ ID NO: 7957485 - DNA, 21 bp, Homo sapiens
tgcttgggggcttcaggagct

SEQ ID NO: 7957486 - DNA, 20 bp, Homo sapiens
tgcttgtaatacctgcttca

SEQ ID NO: 7957487 - DNA, 22 bp, Homo sapiens
tgcttgtagcaatacacaagtt

SEQ ID NO: 7957488 - DNA, 22 bp, Homo sapiens
tgcttgtagcaatacacaagtt

SEQ ID NO: 7957489 - DNA, 22 bp, Homo sapiens
tgcttgtcaccctgcctgagtg

SEQ ID NO: 7957490 - DNA, 22 bp, Homo sapiens
tgcttgtcacatacaggagcat

SEQ ID NO: 7957491 - DNA, 22 bp, Homo sapiens
tgcttgtcaccctgcctgagtg

SEQ ID NO: 7957492 - DNA, 22 bp, Homo sapiens
tgcttgtcacatacaggagcat

SEQ ID NO: 7957493 - DNA, 22 bp, Homo sapiens
tgcttgtattcatatcacagct

SEQ ID NO: 7957494 - DNA, 22 bp, Homo sapiens
ccccaggcagggcctaacagag

SEQ ID NO: 7957495 - DNA, 22 bp, Homo sapiens
tgctgttgacggactggctgct

SEQ ID NO: 7957496 - DNA, 22 bp, Homo sapiens
tgctgttgacggactggctgct

SEQ ID NO: 7957497 - DNA, 22 bp, Homo sapiens
tgctgtttcattttcctcatcc

SEQ ID NO: 7957498 - DNA, 22 bp, Homo sapiens
tgctgtttcacctcccagcgat

SEQ ID NO: 7957499 - DNA, 22 bp, Homo sapiens
tgctgtttcattttcctcatcc

SEQ ID NO: 7957500 - DNA, 22 bp, Homo sapiens
ccccaggagcttgttttagaga

SEQ ID NO: 7957501 - DNA, 22 bp, Homo sapiens
ccccaggagcttgttttagaga

SEQ ID NO: 7957502 - DNA, 22 bp, Homo sapiens
ccccaggcagggcctaacagag

SEQ ID NO: 7957503 - DNA, 22 bp, Homo sapiens
tgctgtttgagcttattttcag

SEQ ID NO: 7957504 - DNA, 22 bp, Homo sapiens
tgctgtttgagcttattttcag

SEQ ID NO: 7957505 - DNA, 22 bp, Homo sapiens
tgctgtttgagcttattttcag

SEQ ID NO: 7957506 - DNA, 22 bp, Homo sapiens
tgctgtttgagcttattttcag

SEQ ID NO: 7957507 - DNA, 22 bp, Homo sapiens
tgctgtttgccaagatcacttt

SEQ ID NO: 7957508 - DNA, 21 bp, Homo sapiens
tgcttccctgggccacactga

SEQ ID NO: 7957509 - DNA, 22 bp, Homo sapiens
ccccaggagatttgggagcaca

SEQ ID NO: 7957510 - DNA, 22 bp, Homo sapiens
ccccaggagatttgggagcaca

SEQ ID NO: 7957511 - DNA, 22 bp, Homo sapiens
ccccaggagatttgggagcaca

SEQ ID NO: 7957512 - DNA, 22 bp, Homo sapiens
ccccaggagaaatcttaaacta

SEQ ID NO: 7957513 - DNA, 22 bp, Homo sapiens
ccccaggagatttgggagcaca

SEQ ID NO: 7957514 - DNA, 22 bp, Homo sapiens
ccccaggagaaatcttaaacta

SEQ ID NO: 7957515 - DNA, 22 bp, Homo sapiens
ccccaggagaaatcttaaacta

SEQ ID NO: 7957516 - DNA, 22 bp, Homo sapiens
ccccaggacacatggaccaagt

SEQ ID NO: 7957517 - DNA, 22 bp, Homo sapiens
ccccaggacacatggaccaagt

SEQ ID NO: 7957518 - DNA, 22 bp, Homo sapiens
ccccaggacgtggccctcatag

SEQ ID NO: 7957519 - DNA, 16 bp, Homo sapiens
ccccaggacttggcac

SEQ ID NO: 7957520 - DNA, 16 bp, Homo sapiens
ccccaggacttggcac

SEQ ID NO: 7957521 - DNA, 22 bp, Homo sapiens
ccccaggacgtggccctcatag

SEQ ID NO: 7957522 - DNA, 22 bp, Homo sapiens
ccccaggacgtggccctcatag

SEQ ID NO: 7957523 - DNA, 19 bp, Homo sapiens
tgcttcctcaccatctccc

SEQ ID NO: 7957524 - DNA, 22 bp, Homo sapiens
tgcttccctgctctgcacacct

SEQ ID NO: 7957525 - DNA, 21 bp, Homo sapiens
tgcttccctgggccacactga

SEQ ID NO: 7957526 - DNA, 22 bp, Homo sapiens
tgcttccgctaaaaattaatcc

SEQ ID NO: 7957527 - DNA, 22 bp, Homo sapiens
tgcttcctatccacacaatgcc

SEQ ID NO: 7957528 - DNA, 22 bp, Homo sapiens
tgcttcctatccacacaatgcc

SEQ ID NO: 7957529 - DNA, 22 bp, Homo sapiens
tgcttccttgatcattcccaaa

SEQ ID NO: 7957530 - DNA, 22 bp, Homo sapiens
tgcttccttgagctctccaatc

SEQ ID NO: 7957531 - DNA, 22 bp, Homo sapiens
tgcttccttcccgttcttctcc

SEQ ID NO: 7957532 - DNA, 22 bp, Homo sapiens
tgcttccttcccgttcttctcc

SEQ ID NO: 7957533 - DNA, 20 bp, Homo sapiens
tgcttcctggccactgcggg

SEQ ID NO: 7957534 - DNA, 20 bp, Homo sapiens
tgcttcctggccactgcggg

SEQ ID NO: 7957535 - DNA, 20 bp, Homo sapiens
tgcttcctggccactgcggg

SEQ ID NO: 7957536 - DNA, 22 bp, Homo sapiens
tgctgggggtagctctgcgtag

SEQ ID NO: 7957537 - DNA, 22 bp, Homo sapiens
tgctgggggtagctctgcgtag

SEQ ID NO: 7957538 - DNA, 22 bp, Homo sapiens
tgctgggggtagctctgcgtag

SEQ ID NO: 7957539 - DNA, 22 bp, Homo sapiens
tgctgggggtgtctcaccaggc

SEQ ID NO: 7957540 - DNA, 22 bp, Homo sapiens
tgctgggggtgtctcaccaggc

SEQ ID NO: 7957541 - DNA, 22 bp, Homo sapiens
tgctgggggtgtctcaccaggc

SEQ ID NO: 7957542 - DNA, 22 bp, Homo sapiens
tgctgggggttcagatgagtaa

SEQ ID NO: 7957543 - DNA, 22 bp, Homo sapiens
tgctgggggtgtctcaccaggc

SEQ ID NO: 7957544 - DNA, 22 bp, Homo sapiens
tgctgggggtgtctcaccaggc

SEQ ID NO: 7957545 - DNA, 22 bp, Homo sapiens
tgctgggggtgtctcaccaggc

SEQ ID NO: 7957546 - DNA, 22 bp, Homo sapiens
tgctgggggctttctggatacc

SEQ ID NO: 7957547 - DNA, 22 bp, Homo sapiens
tgctgggggctttctggatacc

SEQ ID NO: 7957548 - DNA, 22 bp, Homo sapiens
tgctgggggtagctctgcgtag

SEQ ID NO: 7957549 - DNA, 22 bp, Homo sapiens
tgctgggggctttctggatacc

SEQ ID NO: 7957550 - DNA, 22 bp, Homo sapiens
tgctggggctctgaccactcca

SEQ ID NO: 7957551 - DNA, 22 bp, Homo sapiens
tgctggggctctgaccactcca

SEQ ID NO: 7957552 - DNA, 22 bp, Homo sapiens
tgctgggggctttctggatacc

SEQ ID NO: 7957553 - DNA, 22 bp, Homo sapiens
tgctgggggctttctggatacc

SEQ ID NO: 7957554 - DNA, 22 bp, Homo sapiens
tgctgggggctttctggatacc

SEQ ID NO: 7957555 - DNA, 22 bp, Homo sapiens
ccccagctcagtgcagggacat

SEQ ID NO: 7957556 - DNA, 22 bp, Homo sapiens
ccccagctcagtgcagggacat

SEQ ID NO: 7957557 - DNA, 22 bp, Homo sapiens
ccccagctgagatttgaggaga

SEQ ID NO: 7957558 - DNA, 22 bp, Homo sapiens
ccccagctgagatttgaggaga

SEQ ID NO: 7957559 - DNA, 22 bp, Homo sapiens
ccccagctgcatacttgccaag

SEQ ID NO: 7957560 - DNA, 22 bp, Homo sapiens
ccccagctgcatacttgccaag

SEQ ID NO: 7957561 - DNA, 22 bp, Homo sapiens
ccccagctgcatacttgccaag

SEQ ID NO: 7957562 - DNA, 22 bp, Homo sapiens
ccccaggaagcctcagatttgc

SEQ ID NO: 7957563 - DNA, 22 bp, Homo sapiens
ccccagctgcatacttgccaag

SEQ ID NO: 7957564 - DNA, 22 bp, Homo sapiens
ccccaggacacatggaccaagt

SEQ ID NO: 7957565 - DNA, 22 bp, Homo sapiens
ccccaggaagcctcagatttgc

SEQ ID NO: 7957566 - DNA, 22 bp, Homo sapiens
tgctgggggttcagatgagtaa

SEQ ID NO: 7957567 - DNA, 18 bp, Homo sapiens
tgctggggtagaatccac

SEQ ID NO: 7957568 - DNA, 18 bp, Homo sapiens
tgctggggtagaatccac

SEQ ID NO: 7957569 - DNA, 22 bp, Homo sapiens
tgctgggggttcagatgagtaa

SEQ ID NO: 7957570 - DNA, 22 bp, Homo sapiens
tgctgggggttcagatgagtaa

SEQ ID NO: 7957571 - DNA, 22 bp, Homo sapiens
tgctgggggttcagatgagtaa

SEQ ID NO: 7957572 - DNA, 18 bp, Homo sapiens
tgctggggtagaatccac

SEQ ID NO: 7957573 - DNA, 18 bp, Homo sapiens
tgctggggtagaatccac

SEQ ID NO: 7957574 - DNA, 18 bp, Homo sapiens
tgctggggtagaatccac

SEQ ID NO: 7957575 - DNA, 23 bp, Homo sapiens
tgctggggtagtttgtggcacag

SEQ ID NO: 7957576 - DNA, 23 bp, Homo sapiens
tgctggggtagtttgtggcacag

SEQ ID NO: 7957577 - DNA, 22 bp, Homo sapiens
cccagtgtgcccctcctgcagc

SEQ ID NO: 7957578 - DNA, 22 bp, Homo sapiens
cccagtgtgatgaggttgctaa

SEQ ID NO: 7957579 - DNA, 22 bp, Homo sapiens
cccagtgtggttctttggagaa

SEQ ID NO: 7957580 - DNA, 22 bp, Homo sapiens
cccagtgtctgggcctgcaggg

SEQ ID NO: 7957581 - DNA, 22 bp, Homo sapiens
cccagtgtctgggcctgcaggg

SEQ ID NO: 7957582 - DNA, 22 bp, Homo sapiens
cccagtgtctgggcctgcaggg

SEQ ID NO: 7957583 - DNA, 22 bp, Homo sapiens
cccagtgtcattctaagggagg

SEQ ID NO: 7957584 - DNA, 20 bp, Homo sapiens
cccagtgtccagccttgcca

SEQ ID NO: 7957585 - DNA, 22 bp, Homo sapiens
cccagtgtctccaacatcagat

SEQ ID NO: 7957586 - DNA, 22 bp, Homo sapiens
cccagtgtctccaacatcagat

SEQ ID NO: 7957587 - DNA, 22 bp, Homo sapiens
cccagtgtctcttgtgcctttc

SEQ ID NO: 7957588 - DNA, 22 bp, Homo sapiens
cccagtgtctcttgtgcctttc

SEQ ID NO: 7957589 - DNA, 22 bp, Homo sapiens
tgctgggcaccagtgcctgcag

SEQ ID NO: 7957590 - DNA, 22 bp, Homo sapiens
tgctgggcaccagtgcctgcag

SEQ ID NO: 7957591 - DNA, 22 bp, Homo sapiens
tgctgggcaccagtgcctgcag

SEQ ID NO: 7957592 - DNA, 22 bp, Homo sapiens
tgctgggcactgtctaggtact

SEQ ID NO: 7957593 - DNA, 22 bp, Homo sapiens
tgctggggctctgaccactcca

SEQ ID NO: 7957594 - DNA, 22 bp, Homo sapiens
tgctgggcaccagtgcctgcag

SEQ ID NO: 7957595 - DNA, 22 bp, Homo sapiens
tgctgggcaccagtgcctgcag

SEQ ID NO: 7957596 - DNA, 22 bp, Homo sapiens
tgctgggcactgtctaggtact

SEQ ID NO: 7957597 - DNA, 22 bp, Homo sapiens
tgctgggcactgtctaggtact

SEQ ID NO: 7957598 - DNA, 22 bp, Homo sapiens
tgctgggcactgtctaggtact

SEQ ID NO: 7957599 - DNA, 22 bp, Homo sapiens
cccagtgttccttgaggggctg

SEQ ID NO: 7957600 - DNA, 22 bp, Homo sapiens
cccagtgtggttgtgaattctg

SEQ ID NO: 7957601 - DNA, 22 bp, Homo sapiens
cccagtgttacgtgacagcctg

SEQ ID NO: 7957602 - DNA, 22 bp, Homo sapiens
cccagtgttacgtgacagcctg

SEQ ID NO: 7957603 - DNA, 22 bp, Homo sapiens
cccagtgttacgtgacagcctg

SEQ ID NO: 7957604 - DNA, 22 bp, Homo sapiens
cccagtgtttaggtcccatctc

SEQ ID NO: 7957605 - DNA, 22 bp, Homo sapiens
cccagttagttgcttccacatc

SEQ ID NO: 7957606 - DNA, 22 bp, Homo sapiens
cccagttagttgcttccacatc

SEQ ID NO: 7957607 - DNA, 22 bp, Homo sapiens
cccagttgttgccggctctgga

SEQ ID NO: 7957608 - DNA, 22 bp, Homo sapiens
cccagttgttgccggctctgga

SEQ ID NO: 7957609 - DNA, 22 bp, Homo sapiens
cccagttgttgccggctctgga

SEQ ID NO: 7957610 - DNA, 22 bp, Homo sapiens
cccagttgttgccggctctgga

SEQ ID NO: 7957611 - DNA, 22 bp, Homo sapiens
cccagtggtgctggcatctgtg

SEQ ID NO: 7957612 - DNA, 22 bp, Homo sapiens
cccagtggtgctggcatctgtg

SEQ ID NO: 7957613 - DNA, 22 bp, Homo sapiens
cccagtggtgctggcatctgtg

SEQ ID NO: 7957614 - DNA, 22 bp, Homo sapiens
cccagtggtttgcagaaccaag

SEQ ID NO: 7957615 - DNA, 22 bp, Homo sapiens
cccagtggggagctgaggttca

SEQ ID NO: 7957616 - DNA, 22 bp, Homo sapiens
cccagtggggaaatagctagct

SEQ ID NO: 7957617 - DNA, 22 bp, Homo sapiens
cccagtgggtcactgcatctca

SEQ ID NO: 7957618 - DNA, 22 bp, Homo sapiens
cccagtgggtcactgcatctca

SEQ ID NO: 7957619 - DNA, 22 bp, Homo sapiens
tgctgctcaagctgcagcaaaa

SEQ ID NO: 7957620 - DNA, 22 bp, Homo sapiens
tgctgctcaagctgcagcaaaa

SEQ ID NO: 7957621 - DNA, 22 bp, Homo sapiens
tgctgctcaagctgcagcaaaa

SEQ ID NO: 7957622 - DNA, 19 bp, Homo sapiens
tgctgctacttctctctgt

SEQ ID NO: 7957623 - DNA, 17 bp, Homo sapiens
tgctgctaattaaaata

SEQ ID NO: 7957624 - DNA, 22 bp, Homo sapiens
tgctgcgggacccactgtgggc

SEQ ID NO: 7957625 - DNA, 22 bp, Homo sapiens
tgctgcctttgggacctggcct

SEQ ID NO: 7957626 - DNA, 22 bp, Homo sapiens
tgctgcctttgtggggtcactg

SEQ ID NO: 7957627 - DNA, 22 bp, Homo sapiens
tgctgcctttgtggggtcactg

SEQ ID NO: 7957628 - DNA, 22 bp, Homo sapiens
tgctgcctttgggacctggcct

SEQ ID NO: 7957629 - DNA, 22 bp, Homo sapiens
tgctgctcaatgagatgccatc

SEQ ID NO: 7957630 - DNA, 22 bp, Homo sapiens
tgctgctcaatgagatgccatc

SEQ ID NO: 7957631 - DNA, 22 bp, Homo sapiens
tgctgctcacacacagtgaatg

SEQ ID NO: 7957632 - DNA, 22 bp, Homo sapiens
tgctgctcagaacccctgggct

SEQ ID NO: 7957633 - DNA, 22 bp, Homo sapiens
tgctgctccatctgaccattcc

SEQ ID NO: 7957634 - DNA, 22 bp, Homo sapiens
tgctgctccccagcacacagca

SEQ ID NO: 7957635 - DNA, 22 bp, Homo sapiens
tgctcaggaaataatgtctgtg

SEQ ID NO: 7957636 - DNA, 22 bp, Homo sapiens
tgctagtgtgtgagatgttcaa

SEQ ID NO: 7957637 - DNA, 22 bp, Homo sapiens
tgctcaggacagtggaacctaa

SEQ ID NO: 7957638 - DNA, 22 bp, Homo sapiens
tgctcaggaaataatgtctgtg

SEQ ID NO: 7957639 - DNA, 20 bp, Homo sapiens
tgctcaggatggagaggtgt

SEQ ID NO: 7957640 - DNA, 20 bp, Homo sapiens
tgctcaggatggagaggtgt

SEQ ID NO: 7957641 - DNA, 19 bp, Homo sapiens
tgctcaggccaaggagccc

SEQ ID NO: 7957642 - DNA, 22 bp, Homo sapiens
tgctcaggaggaggctgtgagg

SEQ ID NO: 7957643 - DNA, 22 bp, Homo sapiens
tgctcaggaggaggctgtgagg

SEQ ID NO: 7957644 - DNA, 22 bp, Homo sapiens
tgctcaggccctgggccatcct

SEQ ID NO: 7957645 - DNA, 22 bp, Homo sapiens
tgctcaggccctgggccatcct

SEQ ID NO: 7957646 - DNA, 22 bp, Homo sapiens
tgctcaggccctgggccatcct

SEQ ID NO: 7957647 - DNA, 22 bp, Homo sapiens
tgctcagggagcatagtgaatt

SEQ ID NO: 7957648 - DNA, 22 bp, Homo sapiens
tgctcagggacaatggagaggg

SEQ ID NO: 7957649 - DNA, 22 bp, Homo sapiens
tgctcagggacaatggagaggg

SEQ ID NO: 7957650 - DNA, 22 bp, Homo sapiens
tgctagcactgtgcagtctacg

SEQ ID NO: 7957651 - DNA, 22 bp, Homo sapiens
tgctagatgagttttgagaagt

SEQ ID NO: 7957652 - DNA, 22 bp, Homo sapiens
tgctagaatttgcagaagcata

SEQ ID NO: 7957653 - DNA, 22 bp, Homo sapiens
tgctagaatttgcagaagcata

SEQ ID NO: 7957654 - DNA, 22 bp, Homo sapiens
tgctagaattaggttaaacaaa

SEQ ID NO: 7957655 - DNA, 22 bp, Homo sapiens
tgctagaattaggttaaacaaa

SEQ ID NO: 7957656 - DNA, 22 bp, Homo sapiens
tgctagaatttgcagaagcata

SEQ ID NO: 7957657 - DNA, 22 bp, Homo sapiens
tgctagaagatagctagaagat

SEQ ID NO: 7957658 - DNA, 22 bp, Homo sapiens
tgctagaatacctacctggagg

SEQ ID NO: 7957659 - DNA, 22 bp, Homo sapiens
tgctagaagatagctagaagat

SEQ ID NO: 7957660 - DNA, 22 bp, Homo sapiens
tgctagaagatagctagaagat

SEQ ID NO: 7957661 - DNA, 22 bp, Homo sapiens
tgctagaagatagctagaagat

SEQ ID NO: 7957662 - DNA, 22 bp, Homo sapiens
tgctacttttgaaatcttcctt

SEQ ID NO: 7957663 - DNA, 22 bp, Homo sapiens
tgctagaaatctgaaactagca

SEQ ID NO: 7957664 - DNA, 19 bp, Homo sapiens
tgctagaaattctgtgact

SEQ ID NO: 7957665 - DNA, 19 bp, Homo sapiens
tgctagaaattctgtgact

SEQ ID NO: 7957666 - DNA, 19 bp, Homo sapiens
tgctagaaattctgtgact

SEQ ID NO: 7957667 - DNA, 22 bp, Homo sapiens
tgctactcaattcacctgccac

SEQ ID NO: 7957668 - DNA, 22 bp, Homo sapiens
tgctaggggcactaaaagctga

SEQ ID NO: 7957669 - DNA, 22 bp, Homo sapiens
tgctagggatatagtggcgagt

SEQ ID NO: 7957670 - DNA, 22 bp, Homo sapiens
tgctaggggtcagcaccatatc

SEQ ID NO: 7957671 - DNA, 22 bp, Homo sapiens
tgctaggtgctcctccctaatt

SEQ ID NO: 7957672 - DNA, 22 bp, Homo sapiens
tgctaggggtcagcaccatatc

SEQ ID NO: 7957673 - DNA, 22 bp, Homo sapiens
tgctagtgcagggttttcagtt

SEQ ID NO: 7957674 - DNA, 22 bp, Homo sapiens
tgctaggcattgtctgggagta

SEQ ID NO: 7957675 - DNA, 22 bp, Homo sapiens
tgctaggcagtgcttccctgac

SEQ ID NO: 7957676 - DNA, 22 bp, Homo sapiens
tgcagggctaagtcagagcctg

SEQ ID NO: 7957677 - DNA, 22 bp, Homo sapiens
tgcagggctaagtcagagcctg

SEQ ID NO: 7957678 - DNA, 22 bp, Homo sapiens
tgcagggctaagtcagagcctg

SEQ ID NO: 7957679 - DNA, 22 bp, Homo sapiens
tgcaggtgccatcgctgctcat

SEQ ID NO: 7957680 - DNA, 22 bp, Homo sapiens
tgcaggtgccatcgctgctcat

SEQ ID NO: 7957681 - DNA, 22 bp, Homo sapiens
tgcaggtgccatcgctgctcat

SEQ ID NO: 7957682 - DNA, 22 bp, Homo sapiens
tgcaggtgccatcgctgctcat

SEQ ID NO: 7957683 - DNA, 22 bp, Homo sapiens
tgcaggtgctccgggggtgccc

SEQ ID NO: 7957684 - DNA, 22 bp, Homo sapiens
tgcaggtgctccgggggtgccc

SEQ ID NO: 7957685 - DNA, 22 bp, Homo sapiens
tgcaggtgctacaagaactcac

SEQ ID NO: 7957686 - DNA, 22 bp, Homo sapiens
tgcaggtgctccgggggtgccc

SEQ ID NO: 7957687 - DNA, 22 bp, Homo sapiens
tgcaggtgctccgggggtgccc

SEQ ID NO: 7957688 - DNA, 22 bp, Homo sapiens
tgcaggtgctgatacctactcc

SEQ ID NO: 7957689 - DNA, 22 bp, Homo sapiens
tgcaggtgctgatacctactcc

SEQ ID NO: 7957690 - DNA, 22 bp, Homo sapiens
tgcaggtgctccgggggtgccc

SEQ ID NO: 7957691 - DNA, 22 bp, Homo sapiens
tgcaggtgctccgggggtgccc

SEQ ID NO: 7957692 - DNA, 22 bp, Homo sapiens
tgcaggtgcgttttcaagcctc

SEQ ID NO: 7957693 - DNA, 22 bp, Homo sapiens
tgcaggtgcgttttcaagcctc

SEQ ID NO: 7957694 - DNA, 22 bp, Homo sapiens
tgcaggtgcgttttcaagcctc

SEQ ID NO: 7957695 - DNA, 22 bp, Homo sapiens
tgcaggtgcgttttcaagcctc

SEQ ID NO: 7957696 - DNA, 22 bp, Homo sapiens
tgcaggtgcctcttgagcttgt

SEQ ID NO: 7957697 - DNA, 22 bp, Homo sapiens
tgccttctcttccctgggagct

SEQ ID NO: 7957698 - DNA, 22 bp, Homo sapiens
tgccttctcccttggaccctga

SEQ ID NO: 7957699 - DNA, 22 bp, Homo sapiens
tgccttctcttccctgggagct

SEQ ID NO: 7957700 - DNA, 22 bp, Homo sapiens
tgccttctcttccctgggagct

SEQ ID NO: 7957701 - DNA, 22 bp, Homo sapiens
tgcaggtgctgtgtcaagagag

SEQ ID NO: 7957702 - DNA, 22 bp, Homo sapiens
tgcaggtgctgtgtcaagagag

SEQ ID NO: 7957703 - DNA, 22 bp, Homo sapiens
tgccttcttctccctggctcag

SEQ ID NO: 7957704 - DNA, 22 bp, Homo sapiens
tgccttcttctccctggctcag

SEQ ID NO: 7957705 - DNA, 22 bp, Homo sapiens
tgctaactgtgagtacttcagg

SEQ ID NO: 7957706 - DNA, 22 bp, Homo sapiens
tgctaagctgaggaagatgaga

SEQ ID NO: 7957707 - DNA, 23 bp, Homo sapiens
tgctaattggacttgattctgca

SEQ ID NO: 7957708 - DNA, 22 bp, Homo sapiens
tgctaattcaaagggtagttag

SEQ ID NO: 7957709 - DNA, 22 bp, Homo sapiens
tgctacaattcacatctggata

SEQ ID NO: 7957710 - DNA, 22 bp, Homo sapiens
tgctacactcaatcagtgctat

SEQ ID NO: 7957711 - DNA, 22 bp, Homo sapiens
tgctacactcaatcagtgctat

SEQ ID NO: 7957712 - DNA, 22 bp, Homo sapiens
tgctacactcaatcagtgctat

SEQ ID NO: 7957713 - DNA, 19 bp, Homo sapiens
tgctaccgtgggatgctta

SEQ ID NO: 7957714 - DNA, 22 bp, Homo sapiens
tgctacattatatggcaaagga

SEQ ID NO: 7957715 - DNA, 22 bp, Homo sapiens
tgctacataggatagctcaaat

SEQ ID NO: 7957716 - DNA, 22 bp, Homo sapiens
tgctacataggatagctcaaat

SEQ ID NO: 7957717 - DNA, 22 bp, Homo sapiens
tgctctggaatagtcctaggca

SEQ ID NO: 7957718 - DNA, 22 bp, Homo sapiens
tgctctggaatagtcctaggca

SEQ ID NO: 7957719 - DNA, 22 bp, Homo sapiens
tgctctggaatagtcctaggca

SEQ ID NO: 7957720 - DNA, 22 bp, Homo sapiens
tgctctggaatagtcctaggca

SEQ ID NO: 7957721 - DNA, 22 bp, Homo sapiens
tgctctggaatagtcctaggca

SEQ ID NO: 7957722 - DNA, 22 bp, Homo sapiens
tgctctggaccatgactatgtg

SEQ ID NO: 7957723 - DNA, 22 bp, Homo sapiens
tgctctggaccatgactatgtg

SEQ ID NO: 7957724 - DNA, 22 bp, Homo sapiens
tgctctggacgctgagtggttt

SEQ ID NO: 7957725 - DNA, 22 bp, Homo sapiens
tgctctggacgctgagtggttt

SEQ ID NO: 7957726 - DNA, 22 bp, Homo sapiens
tgctctggaaataaatgattta

SEQ ID NO: 7957727 - DNA, 22 bp, Homo sapiens
tgctctggaaataaatgattta

SEQ ID NO: 7957728 - DNA, 22 bp, Homo sapiens
tgctctggaaataaatgattta

SEQ ID NO: 7957729 - DNA, 20 bp, Homo sapiens
tgctctggaaatggtctgag

SEQ ID NO: 7957730 - DNA, 20 bp, Homo sapiens
tgctctggaaatggtctgag

SEQ ID NO: 7957731 - DNA, 20 bp, Homo sapiens
tgctctggaaatggtctgag

SEQ ID NO: 7957732 - DNA, 20 bp, Homo sapiens
tgctctggaaatggtctgag

SEQ ID NO: 7957733 - DNA, 20 bp, Homo sapiens
tgctctggaaatggtctgag

SEQ ID NO: 7957734 - DNA, 20 bp, Homo sapiens
tgctctggaaatggtctgag

SEQ ID NO: 7957735 - DNA, 22 bp, Homo sapiens
tgctctggacgctgagtggttt

SEQ ID NO: 7957736 - DNA, 22 bp, Homo sapiens
tgctctggacgctgagtggttt

SEQ ID NO: 7957737 - DNA, 22 bp, Homo sapiens
tgctctggacgctgagtggttt

SEQ ID NO: 7957738 - DNA, 22 bp, Homo sapiens
tgctctggacgctgagtggttt

SEQ ID NO: 7957739 - DNA, 19 bp, Homo sapiens
tgctctggagccagctctc

SEQ ID NO: 7957740 - DNA, 19 bp, Homo sapiens
tgctctggagccagctctc

SEQ ID NO: 7957741 - DNA, 19 bp, Homo sapiens
tgctctggagccagctctc

SEQ ID NO: 7957742 - DNA, 22 bp, Homo sapiens
tgctctggacgctgagtggttt

SEQ ID NO: 7957743 - DNA, 19 bp, Homo sapiens
tgctctggagccagctctc

SEQ ID NO: 7957744 - DNA, 19 bp, Homo sapiens
tgctctggagccagctctc

SEQ ID NO: 7957745 - DNA, 19 bp, Homo sapiens
tgctgcaggatgctgctgg

SEQ ID NO: 7957746 - DNA, 22 bp, Homo sapiens
tgctgcaggcaatagaaaacct

SEQ ID NO: 7957747 - DNA, 22 bp, Homo sapiens
tgctctggagggtgaagctttt

SEQ ID NO: 7957748 - DNA, 22 bp, Homo sapiens
tgctctggagggtgaagctttt

SEQ ID NO: 7957749 - DNA, 22 bp, Homo sapiens
tgctctggagggtgaagctttt

SEQ ID NO: 7957750 - DNA, 22 bp, Homo sapiens
tgctctggagtgaatttgacaa

SEQ ID NO: 7957751 - DNA, 22 bp, Homo sapiens
tgctctggagtgaatttgacaa

SEQ ID NO: 7957752 - DNA, 22 bp, Homo sapiens
tgctctggagtggcttgtgcac

SEQ ID NO: 7957753 - DNA, 22 bp, Homo sapiens
tgctctggagtggcttgtgcac

SEQ ID NO: 7957754 - DNA, 22 bp, Homo sapiens
tgctgccttgacctcctgggct

SEQ ID NO: 7957755 - DNA, 22 bp, Homo sapiens
tgctgccttgacctcctgggct

SEQ ID NO: 7957756 - DNA, 22 bp, Homo sapiens
tgctgccttgtgctgcctttca

SEQ ID NO: 7957757 - DNA, 22 bp, Homo sapiens
tgctgccttgacctcctgggct

SEQ ID NO: 7957758 - DNA, 22 bp, Homo sapiens
tgctgcctttactgggatttaa

SEQ ID NO: 7957759 - DNA, 22 bp, Homo sapiens
tgctgcctttcaatgttgtcat

SEQ ID NO: 7957760 - DNA, 22 bp, Homo sapiens
tgctgccttgtgctgcctttca

SEQ ID NO: 7957761 - DNA, 22 bp, Homo sapiens
tgctgcctttctgaatggtgga

SEQ ID NO: 7957762 - DNA, 22 bp, Homo sapiens
tgctgcctttgcttagcgaata

SEQ ID NO: 7957763 - DNA, 22 bp, Homo sapiens
tgctgcctttcaatgttgtcat

SEQ ID NO: 7957764 - DNA, 22 bp, Homo sapiens
tgctgcctttctgaatggtgga

SEQ ID NO: 7957765 - DNA, 22 bp, Homo sapiens
tgctgccttctaggcgtgccct

SEQ ID NO: 7957766 - DNA, 22 bp, Homo sapiens
tgctgccttctaggcgtgccct

SEQ ID NO: 7957767 - DNA, 22 bp, Homo sapiens
tgctgccttagaaatggctata

SEQ ID NO: 7957768 - DNA, 22 bp, Homo sapiens
tgctgccttagcagccaggcaa

SEQ ID NO: 7957769 - DNA, 22 bp, Homo sapiens
tgctgccttagaaatggctata

SEQ ID NO: 7957770 - DNA, 20 bp, Homo sapiens
tgctgcctgtttttgtgaat

SEQ ID NO: 7957771 - DNA, 22 bp, Homo sapiens
tgctgccttagcagccaggcaa

SEQ ID NO: 7957772 - DNA, 22 bp, Homo sapiens
tgctgccttagaaatggctata

SEQ ID NO: 7957773 - DNA, 22 bp, Homo sapiens
tgctgcctgtgccaggagggtc

SEQ ID NO: 7957774 - DNA, 22 bp, Homo sapiens
tgctgcctggtttcttcttgct

SEQ ID NO: 7957775 - DNA, 22 bp, Homo sapiens
tgctgcctgtgccaggagggtc

SEQ ID NO: 7957776 - DNA, 22 bp, Homo sapiens
tgctgcctgtgccaggagggtc

SEQ ID NO: 7957777 - DNA, 22 bp, Homo sapiens
tgctgcctgttgtggggccacg

SEQ ID NO: 7957778 - DNA, 22 bp, Homo sapiens
tgctgcctgttgtggggccacg

SEQ ID NO: 7957779 - DNA, 20 bp, Homo sapiens
tgctgcctgtttttgtgaat

SEQ ID NO: 7957780 - DNA, 22 bp, Homo sapiens
tgctgcctgttgtggggccacg

SEQ ID NO: 7957781 - DNA, 21 bp, Homo sapiens
tgctgcctgtgggtgtttacc

SEQ ID NO: 7957782 - DNA, 22 bp, Homo sapiens
tgctgcctggagccttttgttt

SEQ ID NO: 7957783 - DNA, 22 bp, Homo sapiens
tgctgcctgctacgagggaaga

SEQ ID NO: 7957784 - DNA, 22 bp, Homo sapiens
tgctgcctgctacgagggaaga

SEQ ID NO: 7957785 - DNA, 22 bp, Homo sapiens
tgctgcaggcaatagaaaacct

SEQ ID NO: 7957786 - DNA, 22 bp, Homo sapiens
tgctgcctgatgctttctggac

SEQ ID NO: 7957787 - DNA, 22 bp, Homo sapiens
tgctgcctgatgctttctggac

SEQ ID NO: 7957788 - DNA, 22 bp, Homo sapiens
cccagtggcccagcatgtggtg

SEQ ID NO: 7957789 - DNA, 22 bp, Homo sapiens
cccagtggcccagcatgtggtg

SEQ ID NO: 7957790 - DNA, 22 bp, Homo sapiens
cccagtggcaaagcagcttaga

SEQ ID NO: 7957791 - DNA, 22 bp, Homo sapiens
cccagtggagataggagtgtgg

SEQ ID NO: 7957792 - DNA, 22 bp, Homo sapiens
cccagtggaaggagtagaagac

SEQ ID NO: 7957793 - DNA, 18 bp, Homo sapiens
cccagtgctcactgcctc

SEQ ID NO: 7957794 - DNA, 22 bp, Homo sapiens
cccagtgccaggcacaggcagc

SEQ ID NO: 7957795 - DNA, 22 bp, Homo sapiens
cccagtgctatgcctattacat

SEQ ID NO: 7957796 - DNA, 18 bp, Homo sapiens
cccagtgctcactgcctc

SEQ ID NO: 7957797 - DNA, 22 bp, Homo sapiens
cccagtggagataggagtgtgg

SEQ ID NO: 7957798 - DNA, 22 bp, Homo sapiens
cccagtggaaggagtagaagac

SEQ ID NO: 7957799 - DNA, 22 bp, Homo sapiens
cccagtggaaggagtagaagac

SEQ ID NO: 7957800 - DNA, 22 bp, Homo sapiens
cccagtggaaggagtagaagac

SEQ ID NO: 7957801 - DNA, 22 bp, Homo sapiens
tgctctgcacatccctcacaaa

SEQ ID NO: 7957802 - DNA, 22 bp, Homo sapiens
tgctctgcacatccctcacaaa

SEQ ID NO: 7957803 - DNA, 22 bp, Homo sapiens
tgctctgcaagcaggagcaaga

SEQ ID NO: 7957804 - DNA, 22 bp, Homo sapiens
tgctctgcaagcaggagcaaga

SEQ ID NO: 7957805 - DNA, 22 bp, Homo sapiens
tgctctgattggagtctgttgc

SEQ ID NO: 7957806 - DNA, 22 bp, Homo sapiens
tgctctgaggcacatgccatcg

SEQ ID NO: 7957807 - DNA, 22 bp, Homo sapiens
tgctctgaaggggaagggatgg

SEQ ID NO: 7957808 - DNA, 22 bp, Homo sapiens
tgctctgaaggggaagggatgg

SEQ ID NO: 7957809 - DNA, 19 bp, Homo sapiens
cccagtctaggtcctagga

SEQ ID NO: 7957810 - DNA, 19 bp, Homo sapiens
cccagtccttgtcctgggc

SEQ ID NO: 7957811 - DNA, 19 bp, Homo sapiens
cccagtctaggtcctagga

SEQ ID NO: 7957812 - DNA, 19 bp, Homo sapiens
cccagtctaggtcctagga

SEQ ID NO: 7957813 - DNA, 22 bp, Homo sapiens
cccagtgccaggcacaggcagc

SEQ ID NO: 7957814 - DNA, 22 bp, Homo sapiens
cccagtgccaggcacaggcagc

SEQ ID NO: 7957815 - DNA, 20 bp, Homo sapiens
cccagtgaagcatggaagag

SEQ ID NO: 7957816 - DNA, 22 bp, Homo sapiens
cccagtgccaggcacaggcagc

SEQ ID NO: 7957817 - DNA, 22 bp, Homo sapiens
cccagtgccaggcacaggcagc

SEQ ID NO: 7957818 - DNA, 19 bp, Homo sapiens
cccagtccttgtcctgggc

SEQ ID NO: 7957819 - DNA, 19 bp, Homo sapiens
cccagtccttgtcctgggc

SEQ ID NO: 7957820 - DNA, 22 bp, Homo sapiens
cccagtccagaccatgacctca

SEQ ID NO: 7957821 - DNA, 22 bp, Homo sapiens
tgctcaggtgccttggctgctg

SEQ ID NO: 7957822 - DNA, 21 bp, Homo sapiens
tgctcagtaaatgctgagtga

SEQ ID NO: 7957823 - DNA, 22 bp, Homo sapiens
tgctcaggtgccttggctgctg

SEQ ID NO: 7957824 - DNA, 22 bp, Homo sapiens
tgctcaggtgccttggctgctg

SEQ ID NO: 7957825 - DNA, 22 bp, Homo sapiens
tgctcagggagcttcctggtgg

SEQ ID NO: 7957826 - DNA, 22 bp, Homo sapiens
cccaggtctcctgcttcccagg

SEQ ID NO: 7957827 - DNA, 22 bp, Homo sapiens
cccaggtctcctgcttcccagg

SEQ ID NO: 7957828 - DNA, 22 bp, Homo sapiens
cccaggtctgtgccagctctga

SEQ ID NO: 7957829 - DNA, 22 bp, Homo sapiens
cccaggtctgtgccagctctga

SEQ ID NO: 7957830 - DNA, 22 bp, Homo sapiens
cccagtccaaaagtaggttcta

SEQ ID NO: 7957831 - DNA, 22 bp, Homo sapiens
cctgcctcaggactctgcatat

SEQ ID NO: 7957832 - DNA, 22 bp, Homo sapiens
cctgcctcaggactctgcatat

SEQ ID NO: 7957833 - DNA, 22 bp, Homo sapiens
cctgcctcaggactctgcatat

SEQ ID NO: 7957834 - DNA, 22 bp, Homo sapiens
cctgcctcaggactctgcatat

SEQ ID NO: 7957835 - DNA, 22 bp, Homo sapiens
cctgcctcaggactctgcatat

SEQ ID NO: 7957836 - DNA, 22 bp, Homo sapiens
cctgcctcaggactctgcatat

SEQ ID NO: 7957837 - DNA, 22 bp, Homo sapiens
cctgcctcatcaacttgtcgtg

SEQ ID NO: 7957838 - DNA, 22 bp, Homo sapiens
cctgcctcatcaacttgtcgtg

SEQ ID NO: 7957839 - DNA, 22 bp, Homo sapiens
cctgcctatgagacgttttgcc

SEQ ID NO: 7957840 - DNA, 22 bp, Homo sapiens
cctgcctcaggactctgcatat

SEQ ID NO: 7957841 - DNA, 22 bp, Homo sapiens
cctgcctatgagacgttttgcc

SEQ ID NO: 7957842 - DNA, 22 bp, Homo sapiens
cctgcctatgagacgttttgcc

SEQ ID NO: 7957843 - DNA, 22 bp, Homo sapiens
cctgcctactgagttttatatt

SEQ ID NO: 7957844 - DNA, 22 bp, Homo sapiens
cctgcctactgagttttatatt

SEQ ID NO: 7957845 - DNA, 22 bp, Homo sapiens
cctgcccttctttccccagcat

SEQ ID NO: 7957846 - DNA, 22 bp, Homo sapiens
cctgcccttctttccccagcat

SEQ ID NO: 7957847 - DNA, 22 bp, Homo sapiens
cctgcccttctttccccagcat

SEQ ID NO: 7957848 - DNA, 22 bp, Homo sapiens
cctgcccttctttccccagcat

SEQ ID NO: 7957849 - DNA, 22 bp, Homo sapiens
cctgcccttctttccccagcat

SEQ ID NO: 7957850 - DNA, 22 bp, Homo sapiens
cctgcccttctttccccagcat

SEQ ID NO: 7957851 - DNA, 22 bp, Homo sapiens
cctgcccttctttccccagcat

SEQ ID NO: 7957852 - DNA, 22 bp, Homo sapiens
cctgcccttctttccccagcat

SEQ ID NO: 7957853 - DNA, 22 bp, Homo sapiens
cctgccctgtgtttggggacta

SEQ ID NO: 7957854 - DNA, 22 bp, Homo sapiens
cctgccctgtcactggctaggg

SEQ ID NO: 7957855 - DNA, 22 bp, Homo sapiens
cctgccctgtgtttggggacta

SEQ ID NO: 7957856 - DNA, 22 bp, Homo sapiens
cctgccctgtgtttggggacta

SEQ ID NO: 7957857 - DNA, 22 bp, Homo sapiens
cctgccctgtgtttggggacta

SEQ ID NO: 7957858 - DNA, 22 bp, Homo sapiens
cctgccctgtcactggctaggg

SEQ ID NO: 7957859 - DNA, 22 bp, Homo sapiens
cctgccctgtcactggctaggg

SEQ ID NO: 7957860 - DNA, 22 bp, Homo sapiens
cctgccctgtcactggctaggg

SEQ ID NO: 7957861 - DNA, 22 bp, Homo sapiens
cctgccctgtcactggctaggg

SEQ ID NO: 7957862 - DNA, 22 bp, Homo sapiens
cctgccctgtcactggctaggg

SEQ ID NO: 7957863 - DNA, 22 bp, Homo sapiens
cctgcccagcttcacctcaggc

SEQ ID NO: 7957864 - DNA, 22 bp, Homo sapiens
cctgccctgtcactggctaggg

SEQ ID NO: 7957865 - DNA, 22 bp, Homo sapiens
cctgccctgtcactggctaggg

SEQ ID NO: 7957866 - DNA, 22 bp, Homo sapiens
cctgcccagcttcacctcaggc

SEQ ID NO: 7957867 - DNA, 22 bp, Homo sapiens
cctgcccagagcccctttcact

SEQ ID NO: 7957868 - DNA, 22 bp, Homo sapiens
cctgcccagagcccctttcact

SEQ ID NO: 7957869 - DNA, 22 bp, Homo sapiens
tggtagcaggtgtgatagaaat

SEQ ID NO: 7957870 - DNA, 22 bp, Homo sapiens
tggtagcaacatctcagtggct

SEQ ID NO: 7957871 - DNA, 22 bp, Homo sapiens
tggtagcaacatctcagtggct

SEQ ID NO: 7957872 - DNA, 22 bp, Homo sapiens
tggtagcaacatctcagtggct

SEQ ID NO: 7957873 - DNA, 22 bp, Homo sapiens
tggtacatgggtaggtatctct

SEQ ID NO: 7957874 - DNA, 22 bp, Homo sapiens
tggtaccatttcccaggagtgt

SEQ ID NO: 7957875 - DNA, 22 bp, Homo sapiens
tggtaccatttcccaggagtgt

SEQ ID NO: 7957876 - DNA, 22 bp, Homo sapiens
tggtagcaacatctcagtggct

SEQ ID NO: 7957877 - DNA, 17 bp, Homo sapiens
tggtagaatgacaggcc

SEQ ID NO: 7957878 - DNA, 17 bp, Homo sapiens
tggtagaatgacaggcc

SEQ ID NO: 7957879 - DNA, 22 bp, Homo sapiens
tggtacctgccaccttttccct

SEQ ID NO: 7957880 - DNA, 22 bp, Homo sapiens
tggtacacatgtccaaggtcag

SEQ ID NO: 7957881 - DNA, 22 bp, Homo sapiens
tggtacacatgtccaaggtcag

SEQ ID NO: 7957882 - DNA, 21 bp, Homo sapiens
tggtacaccttgcctgtcaga

SEQ ID NO: 7957883 - DNA, 21 bp, Homo sapiens
tggtacagaggaggtgaagtg

SEQ ID NO: 7957884 - DNA, 17 bp, Homo sapiens
tggtacaggctgaggga

SEQ ID NO: 7957885 - DNA, 21 bp, Homo sapiens
tggtacagaggaggtgaagtg

SEQ ID NO: 7957886 - DNA, 23 bp, Homo sapiens
cctgcctccccatcagttataca

SEQ ID NO: 7957887 - DNA, 23 bp, Homo sapiens
cctgcctccccatcagttataca

SEQ ID NO: 7957888 - DNA, 22 bp, Homo sapiens
cctgcctcccagaggtcctcta

SEQ ID NO: 7957889 - DNA, 22 bp, Homo sapiens
cctgcctgaaggtcagccaccc

SEQ ID NO: 7957890 - DNA, 22 bp, Homo sapiens
cctgcctgaaggtcagccaccc

SEQ ID NO: 7957891 - DNA, 22 bp, Homo sapiens
cctgcctgaaggtcagccaccc

SEQ ID NO: 7957892 - DNA, 23 bp, Homo sapiens
cctgcctccccatcagttataca

SEQ ID NO: 7957893 - DNA, 22 bp, Homo sapiens
cctgcctcccagaggtcctcta

SEQ ID NO: 7957894 - DNA, 22 bp, Homo sapiens
cctgcctcccagaggtcctcta

SEQ ID NO: 7957895 - DNA, 22 bp, Homo sapiens
cctgcctcatcaacttgtcgtg

SEQ ID NO: 7957896 - DNA, 22 bp, Homo sapiens
cctgcctcccagaggtcctcta

SEQ ID NO: 7957897 - DNA, 22 bp, Homo sapiens
cctgcctcccagaggtcctcta

SEQ ID NO: 7957898 - DNA, 22 bp, Homo sapiens
cctgcctcccagaggtcctcta

SEQ ID NO: 7957899 - DNA, 22 bp, Homo sapiens
cctgcctcccagaggtcctcta

SEQ ID NO: 7957900 - DNA, 19 bp, Homo sapiens
cctgcctgaccccggctac

SEQ ID NO: 7957901 - DNA, 19 bp, Homo sapiens
cctgcctgagctgtccctc

SEQ ID NO: 7957902 - DNA, 17 bp, Homo sapiens
cctgcctgagccatagc

SEQ ID NO: 7957903 - DNA, 17 bp, Homo sapiens
cctgcctgagccatagc

SEQ ID NO: 7957904 - DNA, 17 bp, Homo sapiens
cctgcctgagccatagc

SEQ ID NO: 7957905 - DNA, 22 bp, Homo sapiens
cctgcctgattccaggatggct

SEQ ID NO: 7957906 - DNA, 22 bp, Homo sapiens
cctgcctgattccaggatggct

SEQ ID NO: 7957907 - DNA, 22 bp, Homo sapiens
cctgcctgattccaggatggct

SEQ ID NO: 7957908 - DNA, 22 bp, Homo sapiens
cctgcctgcaaaatgggacaag

SEQ ID NO: 7957909 - DNA, 22 bp, Homo sapiens
cctgcctgcaaaatgggacaag

SEQ ID NO: 7957910 - DNA, 22 bp, Homo sapiens
cctgcctgcaaaatgggacaag

SEQ ID NO: 7957911 - DNA, 22 bp, Homo sapiens
cctgcctgcaccttctctgggg

SEQ ID NO: 7957912 - DNA, 22 bp, Homo sapiens
cctgcctgcaccttctctgggg

SEQ ID NO: 7957913 - DNA, 22 bp, Homo sapiens
cctgcctgcaccttctctgggg

SEQ ID NO: 7957914 - DNA, 22 bp, Homo sapiens
cctgcctgcaccttctctgggg

SEQ ID NO: 7957915 - DNA, 22 bp, Homo sapiens
cctgcctgcaccttctctgggg

SEQ ID NO: 7957916 - DNA, 22 bp, Homo sapiens
tggtgggagtccgctgtgctgc

SEQ ID NO: 7957917 - DNA, 22 bp, Homo sapiens
tggtgggagtccgctgtgctgc

SEQ ID NO: 7957918 - DNA, 22 bp, Homo sapiens
tggtgggacatctgaggagagg

SEQ ID NO: 7957919 - DNA, 22 bp, Homo sapiens
cctgcctgcagaaagtatctcc

SEQ ID NO: 7957920 - DNA, 22 bp, Homo sapiens
tggtgggacatctgaggagagg

SEQ ID NO: 7957921 - DNA, 22 bp, Homo sapiens
cctgcctgcagaaagtatctcc

SEQ ID NO: 7957922 - DNA, 22 bp, Homo sapiens
cctgcctgcagaaagtatctcc

SEQ ID NO: 7957923 - DNA, 22 bp, Homo sapiens
tggttagacacatgcatgtcat

SEQ ID NO: 7957924 - DNA, 22 bp, Homo sapiens
tggttacccagtcgctggagtt

SEQ ID NO: 7957925 - DNA, 22 bp, Homo sapiens
tggttacctattcatgaacatt

SEQ ID NO: 7957926 - DNA, 22 bp, Homo sapiens
tggttacccagtcgctggagtt

SEQ ID NO: 7957927 - DNA, 22 bp, Homo sapiens
tggttacatatcctttggagcc

SEQ ID NO: 7957928 - DNA, 22 bp, Homo sapiens
tggttacataagaatagcactg

SEQ ID NO: 7957929 - DNA, 22 bp, Homo sapiens
cctgcagggtgctgccacagat

SEQ ID NO: 7957930 - DNA, 22 bp, Homo sapiens
cctgcagggtgctgccacagat

SEQ ID NO: 7957931 - DNA, 22 bp, Homo sapiens
cctgcagggtgctgccacagat

SEQ ID NO: 7957932 - DNA, 22 bp, Homo sapiens
cctgcagggtgctgccacagat

SEQ ID NO: 7957933 - DNA, 22 bp, Homo sapiens
cctgcaggtccccggatgcgca

SEQ ID NO: 7957934 - DNA, 22 bp, Homo sapiens
cctgcaggtccccggatgcgca

SEQ ID NO: 7957935 - DNA, 22 bp, Homo sapiens
cctgcaggtccccggatgcgca

SEQ ID NO: 7957936 - DNA, 22 bp, Homo sapiens
cctgcaggtaaggctaactgcc

SEQ ID NO: 7957937 - DNA, 19 bp, Homo sapiens
cctgcagggatgagaggtt

SEQ ID NO: 7957938 - DNA, 19 bp, Homo sapiens
cctgcagggatgagaggtt

SEQ ID NO: 7957939 - DNA, 19 bp, Homo sapiens
cctgcagggatgagaggtt

SEQ ID NO: 7957940 - DNA, 19 bp, Homo sapiens
cctgcagggatgagaggtt

SEQ ID NO: 7957941 - DNA, 22 bp, Homo sapiens
cctgcaggggagagacttctag

SEQ ID NO: 7957942 - DNA, 22 bp, Homo sapiens
cctgcaggggagagacttctag

SEQ ID NO: 7957943 - DNA, 22 bp, Homo sapiens
cctgcaggggagagacttctag

SEQ ID NO: 7957944 - DNA, 22 bp, Homo sapiens
cctgcagggtgctgccacagat

SEQ ID NO: 7957945 - DNA, 22 bp, Homo sapiens
cctgcaggggagagacttctag

SEQ ID NO: 7957946 - DNA, 22 bp, Homo sapiens
cctgcaggggagagacttctag

SEQ ID NO: 7957947 - DNA, 22 bp, Homo sapiens
cctgcagtctacccaatgtgtg

SEQ ID NO: 7957948 - DNA, 17 bp, Homo sapiens
cctgcagtgcctgtcgg

SEQ ID NO: 7957949 - DNA, 22 bp, Homo sapiens
cctgcaggttgcagaggcggaa

SEQ ID NO: 7957950 - DNA, 22 bp, Homo sapiens
cctgcaggttgcagaggcggaa

SEQ ID NO: 7957951 - DNA, 22 bp, Homo sapiens
cctgcaggttgcagaggcggaa

SEQ ID NO: 7957952 - DNA, 22 bp, Homo sapiens
cctgcaggttgcagaggcggaa

SEQ ID NO: 7957953 - DNA, 22 bp, Homo sapiens
cctgcaggtccccggatgcgca

SEQ ID NO: 7957954 - DNA, 22 bp, Homo sapiens
cctgcaggttgcagaggcggaa

SEQ ID NO: 7957955 - DNA, 22 bp, Homo sapiens
tgggtcagtttgggggccagcc

SEQ ID NO: 7957956 - DNA, 22 bp, Homo sapiens
cctgccagacgcaccagggggc

SEQ ID NO: 7957957 - DNA, 22 bp, Homo sapiens
cctgccagaaaagagggagttc

SEQ ID NO: 7957958 - DNA, 22 bp, Homo sapiens
cctgccacttcttgctatggag

SEQ ID NO: 7957959 - DNA, 22 bp, Homo sapiens
cctgccactgtaggtgacagtt

SEQ ID NO: 7957960 - DNA, 22 bp, Homo sapiens
cctgccactgtaggtgacagtt

SEQ ID NO: 7957961 - DNA, 22 bp, Homo sapiens
cctgcatgtggtcagcactcct

SEQ ID NO: 7957962 - DNA, 22 bp, Homo sapiens
tggtacacatgtccaaggtcag

SEQ ID NO: 7957963 - DNA, 22 bp, Homo sapiens
tggtaatgtaagcagcaaatgt

SEQ ID NO: 7957964 - DNA, 22 bp, Homo sapiens
tggtaatatatgccagataaaa

SEQ ID NO: 7957965 - DNA, 22 bp, Homo sapiens
tggtaattaatttgataggttc

SEQ ID NO: 7957966 - DNA, 22 bp, Homo sapiens
tggtaatttattttgagagatt

SEQ ID NO: 7957967 - DNA, 22 bp, Homo sapiens
tggtaatttgagtggacttagt

SEQ ID NO: 7957968 - DNA, 22 bp, Homo sapiens
tggtaagtaagtgaaacatcca

SEQ ID NO: 7957969 - DNA, 23 bp, Homo sapiens
tggtaatagggagcagaaggtag

SEQ ID NO: 7957970 - DNA, 22 bp, Homo sapiens
tggtaatactcatggcctgtca

SEQ ID NO: 7957971 - DNA, 23 bp, Homo sapiens
tggtaatagggagcagaaggtag

SEQ ID NO: 7957972 - DNA, 22 bp, Homo sapiens
tgggtgggagcaccctgtctgg

SEQ ID NO: 7957973 - DNA, 22 bp, Homo sapiens
tgggtgggagcaccctgtctgg

SEQ ID NO: 7957974 - DNA, 22 bp, Homo sapiens
tgggtgggagcaccctgtctgg

SEQ ID NO: 7957975 - DNA, 22 bp, Homo sapiens
tgggtgggagcgccctgtctgg

SEQ ID NO: 7957976 - DNA, 22 bp, Homo sapiens
tgggtgggagcaccctgtctgg

SEQ ID NO: 7957977 - DNA, 22 bp, Homo sapiens
tgggtgggagcaccctgtctgg

SEQ ID NO: 7957978 - DNA, 22 bp, Homo sapiens
tgggtgggagcaccctgtctgg

SEQ ID NO: 7957979 - DNA, 22 bp, Homo sapiens
tgggtgggagcaccctgtctgg

SEQ ID NO: 7957980 - DNA, 22 bp, Homo sapiens
tgggtgggagcaccctgtctgg

SEQ ID NO: 7957981 - DNA, 22 bp, Homo sapiens
tgggtgggagcaccctgtctgg

SEQ ID NO: 7957982 - DNA, 22 bp, Homo sapiens
tgggtggattaggatagggtat

SEQ ID NO: 7957983 - DNA, 22 bp, Homo sapiens
tgggtggcaaaggcccattgtc

SEQ ID NO: 7957984 - DNA, 22 bp, Homo sapiens
tgggtggaataaatcagttctg

SEQ ID NO: 7957985 - DNA, 22 bp, Homo sapiens
tgggtggagaagtggacctgct

SEQ ID NO: 7957986 - DNA, 22 bp, Homo sapiens
tgggtggagaagtggacctgct

SEQ ID NO: 7957987 - DNA, 22 bp, Homo sapiens
tgggtggagaagtggacctgct

SEQ ID NO: 7957988 - DNA, 22 bp, Homo sapiens
tgggtccacaaacatcagatat

SEQ ID NO: 7957989 - DNA, 22 bp, Homo sapiens
tgggtccacaaacatcagatat

SEQ ID NO: 7957990 - DNA, 22 bp, Homo sapiens
tgggtggaataaatcagttctg

SEQ ID NO: 7957991 - DNA, 22 bp, Homo sapiens
tgggtccacaaacatcagatat

SEQ ID NO: 7957992 - DNA, 18 bp, Homo sapiens
tgggtggctagggagttt

SEQ ID NO: 7957993 - DNA, 18 bp, Homo sapiens
tgggtggctagggagttt

SEQ ID NO: 7957994 - DNA, 22 bp, Homo sapiens
tgggtggcggcctggttctgag

SEQ ID NO: 7957995 - DNA, 22 bp, Homo sapiens
tgggtggcggcctggttctgag

SEQ ID NO: 7957996 - DNA, 18 bp, Homo sapiens
tgggtggctagggagttt

SEQ ID NO: 7957997 - DNA, 18 bp, Homo sapiens
tgggtggctagggagttt

SEQ ID NO: 7957998 - DNA, 18 bp, Homo sapiens
tgggtggctagggagttt

SEQ ID NO: 7957999 - DNA, 22 bp, Homo sapiens
tgggtggcacttctggggtcca

SEQ ID NO: 7958000 - DNA, 22 bp, Homo sapiens
tgggtggcacttctggggtcca

SEQ ID NO: 7958001 - DNA, 22 bp, Homo sapiens
tgggtggcacttctggggtcca

SEQ ID NO: 7958002 - DNA, 22 bp, Homo sapiens
tgggtggcacttctggggtcca

SEQ ID NO: 7958003 - DNA, 22 bp, Homo sapiens
tgggtggcagcttcagcatgtt

SEQ ID NO: 7958004 - DNA, 22 bp, Homo sapiens
tgggtggcagcttcagcatgtt

SEQ ID NO: 7958005 - DNA, 22 bp, Homo sapiens
tgggtggcagcttcagcatgtt

SEQ ID NO: 7958006 - DNA, 22 bp, Homo sapiens
tggggagcacggtagggaaatg

SEQ ID NO: 7958007 - DNA, 22 bp, Homo sapiens
tggggagcacggtagggaaatg

SEQ ID NO: 7958008 - DNA, 22 bp, Homo sapiens
cctgcagacacttgtccagcaa

SEQ ID NO: 7958009 - DNA, 22 bp, Homo sapiens
tggggagcacggtagggaaatg

SEQ ID NO: 7958010 - DNA, 22 bp, Homo sapiens
cctgcagacacttgtccagcaa

SEQ ID NO: 7958011 - DNA, 22 bp, Homo sapiens
cctgcagaccacactcagtcct

SEQ ID NO: 7958012 - DNA, 23 bp, Homo sapiens
tggggagagttaccctggaagcg

SEQ ID NO: 7958013 - DNA, 23 bp, Homo sapiens
tggggagagttaccctggaagcg

SEQ ID NO: 7958014 - DNA, 23 bp, Homo sapiens
tggggagagttaccctggaagcg

SEQ ID NO: 7958015 - DNA, 22 bp, Homo sapiens
tggggagagttacaaggaatct

SEQ ID NO: 7958016 - DNA, 22 bp, Homo sapiens
tggggagagttacaaggaatct

SEQ ID NO: 7958017 - DNA, 22 bp, Homo sapiens
tggggagagttacaaggaatct

SEQ ID NO: 7958018 - DNA, 23 bp, Homo sapiens
tggggagagttaccctggaagcg

SEQ ID NO: 7958019 - DNA, 22 bp, Homo sapiens
tggggagaggtatcattgagat

SEQ ID NO: 7958020 - DNA, 22 bp, Homo sapiens
tggggagaggtatcattgagat

SEQ ID NO: 7958021 - DNA, 22 bp, Homo sapiens
tggggagaggaatttgaatgat

SEQ ID NO: 7958022 - DNA, 22 bp, Homo sapiens
tggggagagttacaaggaatct

SEQ ID NO: 7958023 - DNA, 22 bp, Homo sapiens
tggggagaggtatcattgagat

SEQ ID NO: 7958024 - DNA, 22 bp, Homo sapiens
tggggagagattgaggagtttt

SEQ ID NO: 7958025 - DNA, 22 bp, Homo sapiens
tggggagagattgaggagtttt

SEQ ID NO: 7958026 - DNA, 22 bp, Homo sapiens
tggggagagattgaggagtttt

SEQ ID NO: 7958027 - DNA, 22 bp, Homo sapiens
tggggagagattgaggagtttt

SEQ ID NO: 7958028 - DNA, 22 bp, Homo sapiens
tggggagagaccggaatgtttc

SEQ ID NO: 7958029 - DNA, 22 bp, Homo sapiens
tggggagagaccggaatgtttc

SEQ ID NO: 7958030 - DNA, 22 bp, Homo sapiens
cctgcaggctgcaggccagttc

SEQ ID NO: 7958031 - DNA, 22 bp, Homo sapiens
cctgcaggctgcaggccagttc

SEQ ID NO: 7958032 - DNA, 22 bp, Homo sapiens
cctgcagggaatcgaggcagaa

SEQ ID NO: 7958033 - DNA, 22 bp, Homo sapiens
cctgcagggaatcgaggcagaa

SEQ ID NO: 7958034 - DNA, 22 bp, Homo sapiens
cctgcagggaatcgaggcagaa

SEQ ID NO: 7958035 - DNA, 22 bp, Homo sapiens
cctgcagggaatcgaggcagaa

SEQ ID NO: 7958036 - DNA, 22 bp, Homo sapiens
cctgcagggaatcgaggcagaa

SEQ ID NO: 7958037 - DNA, 22 bp, Homo sapiens
cctgcagctgtaggagaaggcg

SEQ ID NO: 7958038 - DNA, 22 bp, Homo sapiens
cctgcagctgtaggagaaggcg

SEQ ID NO: 7958039 - DNA, 22 bp, Homo sapiens
cctgcagaccacactcagtcct

SEQ ID NO: 7958040 - DNA, 22 bp, Homo sapiens
cctgcagctttgcctcctgaac

SEQ ID NO: 7958041 - DNA, 22 bp, Homo sapiens
cctgcagctttgcctcctgaac

SEQ ID NO: 7958042 - DNA, 22 bp, Homo sapiens
cctgcagctttgcctcctgaac

SEQ ID NO: 7958043 - DNA, 22 bp, Homo sapiens
cctgcagctttgcctcctgaac

SEQ ID NO: 7958044 - DNA, 22 bp, Homo sapiens
cctgcagctttgcctcctgaac

SEQ ID NO: 7958045 - DNA, 22 bp, Homo sapiens
cctgcagctttgcctcctgaac

SEQ ID NO: 7958046 - DNA, 22 bp, Homo sapiens
cctgcaggctgcaggccagttc

SEQ ID NO: 7958047 - DNA, 22 bp, Homo sapiens
cctgcaggctgcaggccagttc

SEQ ID NO: 7958048 - DNA, 22 bp, Homo sapiens
cctgcaggctgcaggccagttc

SEQ ID NO: 7958049 - DNA, 22 bp, Homo sapiens
cctgcaggctgcaggccagttc

SEQ ID NO: 7958050 - DNA, 22 bp, Homo sapiens
cctgcaggctgcaggccagttc

SEQ ID NO: 7958051 - DNA, 22 bp, Homo sapiens
cctgagttgtcagttgctgtag

SEQ ID NO: 7958052 - DNA, 22 bp, Homo sapiens
cctgagttagttgctgtgtctc

SEQ ID NO: 7958053 - DNA, 22 bp, Homo sapiens
cctgagttcttatttccagtca

SEQ ID NO: 7958054 - DNA, 19 bp, Homo sapiens
cctgagtgtttcagagaca

SEQ ID NO: 7958055 - DNA, 22 bp, Homo sapiens
cctgatggagccctgctgcatg

SEQ ID NO: 7958056 - DNA, 22 bp, Homo sapiens
tggggagaagcaatagactcta

SEQ ID NO: 7958057 - DNA, 22 bp, Homo sapiens
tggggagaaatgtctttgttcc

SEQ ID NO: 7958058 - DNA, 22 bp, Homo sapiens
tggggacttgccttgttgctca

SEQ ID NO: 7958059 - DNA, 22 bp, Homo sapiens
tggggacttgccttgttgctca

SEQ ID NO: 7958060 - DNA, 22 bp, Homo sapiens
cctgatggagccctgctgcatg

SEQ ID NO: 7958061 - DNA, 22 bp, Homo sapiens
cctgatggagccctgctgcatg

SEQ ID NO: 7958062 - DNA, 19 bp, Homo sapiens
cctgatggagctggtgcaa

SEQ ID NO: 7958063 - DNA, 19 bp, Homo sapiens
cctgatggagctggtgcaa

SEQ ID NO: 7958064 - DNA, 22 bp, Homo sapiens
tggggagactggccgagatcct

SEQ ID NO: 7958065 - DNA, 22 bp, Homo sapiens
tggggagaagcaatagactcta

SEQ ID NO: 7958066 - DNA, 22 bp, Homo sapiens
tggggagaagcaatagactcta

SEQ ID NO: 7958067 - DNA, 22 bp, Homo sapiens
tggggagagaccggaatgtttc

SEQ ID NO: 7958068 - DNA, 22 bp, Homo sapiens
tggggagagaccggaatgtttc

SEQ ID NO: 7958069 - DNA, 22 bp, Homo sapiens
tggggagagaccggaatgtttc

SEQ ID NO: 7958070 - DNA, 22 bp, Homo sapiens
tggggagactggccgagatcct

SEQ ID NO: 7958071 - DNA, 22 bp, Homo sapiens
tggggagactggccgagatcct

SEQ ID NO: 7958072 - DNA, 22 bp, Homo sapiens
cctgagtgtaataatgaaggca

SEQ ID NO: 7958073 - DNA, 22 bp, Homo sapiens
cctgagtggtgctaagcagata

SEQ ID NO: 7958074 - DNA, 17 bp, Homo sapiens
cctgagtgggagaggaa

SEQ ID NO: 7958075 - DNA, 17 bp, Homo sapiens
cctgagtgggagaggaa

SEQ ID NO: 7958076 - DNA, 22 bp, Homo sapiens
cctgagtggggagctaagtgag

SEQ ID NO: 7958077 - DNA, 22 bp, Homo sapiens
cctgagtggggagctaagtgag

SEQ ID NO: 7958078 - DNA, 22 bp, Homo sapiens
cctgagtgcttccagagtcatg

SEQ ID NO: 7958079 - DNA, 22 bp, Homo sapiens
cctgagtgcttccagagtcatg

SEQ ID NO: 7958080 - DNA, 22 bp, Homo sapiens
cctgagtgccatgagagcaccc

SEQ ID NO: 7958081 - DNA, 22 bp, Homo sapiens
cctgagtggccaggcagctgtg

SEQ ID NO: 7958082 - DNA, 22 bp, Homo sapiens
cctgagtggccaggcagctgtg

SEQ ID NO: 7958083 - DNA, 22 bp, Homo sapiens
cctgagtggccaggcagctgtg

SEQ ID NO: 7958084 - DNA, 21 bp, Homo sapiens
cctgagtgagacctggcccgt

SEQ ID NO: 7958085 - DNA, 22 bp, Homo sapiens
cctgagtgacctgaggtctagt

SEQ ID NO: 7958086 - DNA, 22 bp, Homo sapiens
cctgagtgacctgaggtctagt

SEQ ID NO: 7958087 - DNA, 21 bp, Homo sapiens
cctgagtgagacctggcccgt

SEQ ID NO: 7958088 - DNA, 22 bp, Homo sapiens
cctgagtctttcccattgcgct

SEQ ID NO: 7958089 - DNA, 22 bp, Homo sapiens
cctgagtgaattccctcactgt

SEQ ID NO: 7958090 - DNA, 22 bp, Homo sapiens
cctgaggtcatggtccagtgtt

SEQ ID NO: 7958091 - DNA, 22 bp, Homo sapiens
cctgaggtctagagtcagggtg

SEQ ID NO: 7958092 - DNA, 22 bp, Homo sapiens
cctgaggtcatggtccagtgtt

SEQ ID NO: 7958093 - DNA, 22 bp, Homo sapiens
tgggcaggagagaagctaaaga

SEQ ID NO: 7958094 - DNA, 22 bp, Homo sapiens
tgggcaggagagaagctaaaga

SEQ ID NO: 7958095 - DNA, 22 bp, Homo sapiens
tgggcaggataatatctcatgt

SEQ ID NO: 7958096 - DNA, 22 bp, Homo sapiens
tgggcaggataatatctcatgt

SEQ ID NO: 7958097 - DNA, 22 bp, Homo sapiens
tgggcaggatgcgttgattctt

SEQ ID NO: 7958098 - DNA, 22 bp, Homo sapiens
tgggcaggataatatctcatgt

SEQ ID NO: 7958099 - DNA, 22 bp, Homo sapiens
tgggcaggataatatctcatgt

SEQ ID NO: 7958100 - DNA, 22 bp, Homo sapiens
tgggcaggataatatctcatgt

SEQ ID NO: 7958101 - DNA, 22 bp, Homo sapiens
tgggcaggataatatctcatgt

SEQ ID NO: 7958102 - DNA, 22 bp, Homo sapiens
tgggcaggcaagtgaatacctt

SEQ ID NO: 7958103 - DNA, 22 bp, Homo sapiens
tgggcaggcaagtgaatacctt

SEQ ID NO: 7958104 - DNA, 22 bp, Homo sapiens
tgggcaggcaagtgaatacctt

SEQ ID NO: 7958105 - DNA, 22 bp, Homo sapiens
tgggcaggcaagtgaatacctt

SEQ ID NO: 7958106 - DNA, 22 bp, Homo sapiens
tgggcaggcaagtgaatacctt

SEQ ID NO: 7958107 - DNA, 22 bp, Homo sapiens
tgggcaggcaagtgaatacctt

SEQ ID NO: 7958108 - DNA, 22 bp, Homo sapiens
tgggcaggcaagtgaatacctt

SEQ ID NO: 7958109 - DNA, 22 bp, Homo sapiens
tgggcaggatgcgttgattctt

SEQ ID NO: 7958110 - DNA, 22 bp, Homo sapiens
tgggcaggatgcgttgattctt

SEQ ID NO: 7958111 - DNA, 22 bp, Homo sapiens
tgggcaggatgcgttgattctt

SEQ ID NO: 7958112 - DNA, 22 bp, Homo sapiens
tgggcaggatgcgttgattctt

SEQ ID NO: 7958113 - DNA, 22 bp, Homo sapiens
tgggcaggatgcgttgattctt

SEQ ID NO: 7958114 - DNA, 22 bp, Homo sapiens
tgggcctggagccctggagagt

SEQ ID NO: 7958115 - DNA, 22 bp, Homo sapiens
tgggcctggagccctggagagt

SEQ ID NO: 7958116 - DNA, 22 bp, Homo sapiens
tgggcctggagccctggagagt

SEQ ID NO: 7958117 - DNA, 22 bp, Homo sapiens
tgggcctggagccctggagagt

SEQ ID NO: 7958118 - DNA, 22 bp, Homo sapiens
tgggcctggagccctggagagt

SEQ ID NO: 7958119 - DNA, 22 bp, Homo sapiens
tgggcctggagccctggagagt

SEQ ID NO: 7958120 - DNA, 22 bp, Homo sapiens
tgggcctggagccctggagagt

SEQ ID NO: 7958121 - DNA, 22 bp, Homo sapiens
tgggcctggagccctggagagt

SEQ ID NO: 7958122 - DNA, 22 bp, Homo sapiens
tgggcctggagccctggagagt

SEQ ID NO: 7958123 - DNA, 22 bp, Homo sapiens
tgggcctggagtttgtccagag

SEQ ID NO: 7958124 - DNA, 22 bp, Homo sapiens
tgggcctggagtttgtccagag

SEQ ID NO: 7958125 - DNA, 22 bp, Homo sapiens
tgggcctggagtttgtccagag

SEQ ID NO: 7958126 - DNA, 22 bp, Homo sapiens
tgggcctggagtttgtccagag

SEQ ID NO: 7958127 - DNA, 22 bp, Homo sapiens
tgggcctggagtttgtccagag

SEQ ID NO: 7958128 - DNA, 21 bp, Homo sapiens
tgggcctcaagtgggtggcag

SEQ ID NO: 7958129 - DNA, 22 bp, Homo sapiens
tgggcctggacaaggccactag

SEQ ID NO: 7958130 - DNA, 22 bp, Homo sapiens
tgggcctggacaaggccactag

SEQ ID NO: 7958131 - DNA, 22 bp, Homo sapiens
tgggcctggacatctgtatttt

SEQ ID NO: 7958132 - DNA, 22 bp, Homo sapiens
tgggcctggacatctgtatttt

SEQ ID NO: 7958133 - DNA, 21 bp, Homo sapiens
tgggcctcaagtgggtggcag

SEQ ID NO: 7958134 - DNA, 22 bp, Homo sapiens
tgggcctacgtgacagaaacat

SEQ ID NO: 7958135 - DNA, 23 bp, Homo sapiens
tgggcccttggaatctctatttt

SEQ ID NO: 7958136 - DNA, 23 bp, Homo sapiens
tgggcccttggaatctctatttt

SEQ ID NO: 7958137 - DNA, 23 bp, Homo sapiens
tgggccggattgtgaaggacgtg

SEQ ID NO: 7958138 - DNA, 22 bp, Homo sapiens
tgggccgggcactgtactgggc

SEQ ID NO: 7958139 - DNA, 22 bp, Homo sapiens
tgggctccggcggcctcaggct

SEQ ID NO: 7958140 - DNA, 22 bp, Homo sapiens
tgggctccggcggcctcaggct

SEQ ID NO: 7958141 - DNA, 22 bp, Homo sapiens
tgggctccagcacctgtgctct

SEQ ID NO: 7958142 - DNA, 22 bp, Homo sapiens
tgggctccggcggcctcaggct

SEQ ID NO: 7958143 - DNA, 22 bp, Homo sapiens
tgggctccggcggcctcaggct

SEQ ID NO: 7958144 - DNA, 22 bp, Homo sapiens
tgggctccggcggcctcaggct

SEQ ID NO: 7958145 - DNA, 22 bp, Homo sapiens
tgggctcctcgtcactcgctgt

SEQ ID NO: 7958146 - DNA, 22 bp, Homo sapiens
tgggctcctcgtcactcgctgt

SEQ ID NO: 7958147 - DNA, 22 bp, Homo sapiens
tgggctccaatttgtcctttca

SEQ ID NO: 7958148 - DNA, 22 bp, Homo sapiens
tgggctccaatttgtcctttca

SEQ ID NO: 7958149 - DNA, 19 bp, Homo sapiens
tgggctcattcaggtggtt

SEQ ID NO: 7958150 - DNA, 22 bp, Homo sapiens
tgggctccagcacctgtgctct

SEQ ID NO: 7958151 - DNA, 22 bp, Homo sapiens
tgggctccagcacctgtgctct

SEQ ID NO: 7958152 - DNA, 22 bp, Homo sapiens
tgggctccagcacctgtgctct

SEQ ID NO: 7958153 - DNA, 22 bp, Homo sapiens
tgggctccagcacctgtgctct

SEQ ID NO: 7958154 - DNA, 22 bp, Homo sapiens
tgggctccagcacctgtgctct

SEQ ID NO: 7958155 - DNA, 22 bp, Homo sapiens
tgggctcatgtttctttgagga

SEQ ID NO: 7958156 - DNA, 19 bp, Homo sapiens
tgggctcattcaggtggtt

SEQ ID NO: 7958157 - DNA, 19 bp, Homo sapiens
tgggctcattcaggtggtt

SEQ ID NO: 7958158 - DNA, 22 bp, Homo sapiens
tgggctcatgtttctttgagga

SEQ ID NO: 7958159 - DNA, 22 bp, Homo sapiens
tgggcctgggagggcagacgct

SEQ ID NO: 7958160 - DNA, 22 bp, Homo sapiens
tgggcctgggagggcagacgct

SEQ ID NO: 7958161 - DNA, 22 bp, Homo sapiens
tgggcctgggagggcagacgct

SEQ ID NO: 7958162 - DNA, 22 bp, Homo sapiens
tgggcctgggagggcagacgct

SEQ ID NO: 7958163 - DNA, 22 bp, Homo sapiens
tgggcctgggagggcagacgct

SEQ ID NO: 7958164 - DNA, 22 bp, Homo sapiens
tgggcctgggagggcagacgct

SEQ ID NO: 7958165 - DNA, 22 bp, Homo sapiens
tgggctcatgctggagatgaga

SEQ ID NO: 7958166 - DNA, 22 bp, Homo sapiens
tgggctcatggcccagcactgg

SEQ ID NO: 7958167 - DNA, 22 bp, Homo sapiens
tgggctcagtgggagaaagggc

SEQ ID NO: 7958168 - DNA, 22 bp, Homo sapiens
tgggcctggccctgtggaggag

SEQ ID NO: 7958169 - DNA, 22 bp, Homo sapiens
tgggcctggccctgtggaggag

SEQ ID NO: 7958170 - DNA, 22 bp, Homo sapiens
tgggcctggagtttgtccagag

SEQ ID NO: 7958171 - DNA, 22 bp, Homo sapiens
tgggcctggccctgtggaggag

SEQ ID NO: 7958172 - DNA, 22 bp, Homo sapiens
tgggcctggccctgtggaggag

SEQ ID NO: 7958173 - DNA, 22 bp, Homo sapiens
tgggcctggccctgtggaggag

SEQ ID NO: 7958174 - DNA, 22 bp, Homo sapiens
tgggcctggccctgtggaggag

SEQ ID NO: 7958175 - DNA, 23 bp, Homo sapiens
tgggcctggcctcccagtccagc

SEQ ID NO: 7958176 - DNA, 23 bp, Homo sapiens
tgggcctggcctcccagtccagc

SEQ ID NO: 7958177 - DNA, 23 bp, Homo sapiens
tgggcctggcctcccagtccagc

SEQ ID NO: 7958178 - DNA, 23 bp, Homo sapiens
tgggcctggcctcccagtccagc

SEQ ID NO: 7958179 - DNA, 22 bp, Homo sapiens
tgggcctggccctgtggaggag

SEQ ID NO: 7958180 - DNA, 22 bp, Homo sapiens
tggcagtgtataggtggctcct

SEQ ID NO: 7958181 - DNA, 22 bp, Homo sapiens
tggcagtgtataggtggctcct

SEQ ID NO: 7958182 - DNA, 22 bp, Homo sapiens
tggcagtggtgtctgcacaggc

SEQ ID NO: 7958183 - DNA, 22 bp, Homo sapiens
tggcagtggtaccggctctcag

SEQ ID NO: 7958184 - DNA, 22 bp, Homo sapiens
tggcagtggtgtctgcacaggc

SEQ ID NO: 7958185 - DNA, 22 bp, Homo sapiens
tggcagtggtgtctgcacaggc

SEQ ID NO: 7958186 - DNA, 22 bp, Homo sapiens
tggcagtgggaatggacaaaca

SEQ ID NO: 7958187 - DNA, 22 bp, Homo sapiens
tggcagtgggaatggacaaaca

SEQ ID NO: 7958188 - DNA, 22 bp, Homo sapiens
tggcagtggtaccggctctcag

SEQ ID NO: 7958189 - DNA, 22 bp, Homo sapiens
tggcagtgggaatggacaaaca

SEQ ID NO: 7958190 - DNA, 22 bp, Homo sapiens
tggcagtgggaagctggaagtc

SEQ ID NO: 7958191 - DNA, 22 bp, Homo sapiens
tggcagtgggaagctggaagtc

SEQ ID NO: 7958192 - DNA, 22 bp, Homo sapiens
tggcagtgggaagctggaagtc

SEQ ID NO: 7958193 - DNA, 22 bp, Homo sapiens
tggcagtgggaagctggaagtc

SEQ ID NO: 7958194 - DNA, 22 bp, Homo sapiens
tggcagtggctttgctggtgga

SEQ ID NO: 7958195 - DNA, 22 bp, Homo sapiens
tggcagtggctttgctggtgga

SEQ ID NO: 7958196 - DNA, 19 bp, Homo sapiens
tggcaggtagtgagcagtc

SEQ ID NO: 7958197 - DNA, 19 bp, Homo sapiens
tggcaggtagtgagcagtc

SEQ ID NO: 7958198 - DNA, 22 bp, Homo sapiens
tggcaggtagtcagaggcgaca

SEQ ID NO: 7958199 - DNA, 19 bp, Homo sapiens
tggcaggtagtgagcagtc

SEQ ID NO: 7958200 - DNA, 22 bp, Homo sapiens
tggcagtgtgggaggaaggtac

SEQ ID NO: 7958201 - DNA, 22 bp, Homo sapiens
tggcagtgtgggaggaaggtac

SEQ ID NO: 7958202 - DNA, 22 bp, Homo sapiens
tggcatttctgttagactctca

SEQ ID NO: 7958203 - DNA, 19 bp, Homo sapiens
tggcagtgtggcttccaga

SEQ ID NO: 7958204 - DNA, 22 bp, Homo sapiens
tggcagtgtgggaggaaggtac

SEQ ID NO: 7958205 - DNA, 22 bp, Homo sapiens
tggcagtgtgggaggaaggtac

SEQ ID NO: 7958206 - DNA, 22 bp, Homo sapiens
tggcatttgagctggaaggatg

SEQ ID NO: 7958207 - DNA, 19 bp, Homo sapiens
tggcatttggaggcaacct

SEQ ID NO: 7958208 - DNA, 22 bp, Homo sapiens
tggcatttggcttacttatgtt

SEQ ID NO: 7958209 - DNA, 19 bp, Homo sapiens
tggcatttggaggcaacct

SEQ ID NO: 7958210 - DNA, 22 bp, Homo sapiens
tggcagtgtcttatcaggagtg

SEQ ID NO: 7958211 - DNA, 22 bp, Homo sapiens
tggcagtgtcttatcaggagtg

SEQ ID NO: 7958212 - DNA, 22 bp, Homo sapiens
tggcagtgtcttatcaggagtg

SEQ ID NO: 7958213 - DNA, 22 bp, Homo sapiens
tggcagtgtcttatcaggagtg

SEQ ID NO: 7958214 - DNA, 22 bp, Homo sapiens
tggcagtgtcttgctggggcag

SEQ ID NO: 7958215 - DNA, 22 bp, Homo sapiens
tggcagtgtcttgctggggcag

SEQ ID NO: 7958216 - DNA, 22 bp, Homo sapiens
tggcagtgtcttgctggggcag

SEQ ID NO: 7958217 - DNA, 22 bp, Homo sapiens
tggcagtgtcttgctggggcag

SEQ ID NO: 7958218 - DNA, 22 bp, Homo sapiens
tggcagtgtataggtggctcct

SEQ ID NO: 7958219 - DNA, 22 bp, Homo sapiens
tggcagtgtataggtggctcct

SEQ ID NO: 7958220 - DNA, 22 bp, Homo sapiens
tggcagtgtcttatcaggagtg

SEQ ID NO: 7958221 - DNA, 22 bp, Homo sapiens
tggcagtgtcctactggttggt

SEQ ID NO: 7958222 - DNA, 22 bp, Homo sapiens
tggcagtgtataggtggctcct

SEQ ID NO: 7958223 - DNA, 22 bp, Homo sapiens
tggcagtgtcctactggttggt

SEQ ID NO: 7958224 - DNA, 22 bp, Homo sapiens
tggcatttggcttacttatgtt

SEQ ID NO: 7958225 - DNA, 22 bp, Homo sapiens
tggcatttgggctggcttttct

SEQ ID NO: 7958226 - DNA, 22 bp, Homo sapiens
tggcattttagacatgatggtg

SEQ ID NO: 7958227 - DNA, 22 bp, Homo sapiens
tggcattttgtagctgtgtatc

SEQ ID NO: 7958228 - DNA, 22 bp, Homo sapiens
tggccaagccactgctgggtct

SEQ ID NO: 7958229 - DNA, 22 bp, Homo sapiens
tggccaagccactgctgggtct

SEQ ID NO: 7958230 - DNA, 21 bp, Homo sapiens
tggccaaggaatagaagctct

SEQ ID NO: 7958231 - DNA, 22 bp, Homo sapiens
tggccaagatgcgacctctcag

SEQ ID NO: 7958232 - DNA, 22 bp, Homo sapiens
tggccaagccactgctgggtct

SEQ ID NO: 7958233 - DNA, 22 bp, Homo sapiens
tggccaagccactgctgggtct

SEQ ID NO: 7958234 - DNA, 22 bp, Homo sapiens
tggccaagatgcgacctctcag

SEQ ID NO: 7958235 - DNA, 21 bp, Homo sapiens
tggccaaactggagcatttga

SEQ ID NO: 7958236 - DNA, 22 bp, Homo sapiens
tggccaagaatgatatgtgaag

SEQ ID NO: 7958237 - DNA, 22 bp, Homo sapiens
tggccaaatttggtgtaacttg

SEQ ID NO: 7958238 - DNA, 22 bp, Homo sapiens
tggcattttgttcagtatatgg

SEQ ID NO: 7958239 - DNA, 22 bp, Homo sapiens
tggcattttgttcagtatatgg

SEQ ID NO: 7958240 - DNA, 22 bp, Homo sapiens
cctccagggcccctctcactgg

SEQ ID NO: 7958241 - DNA, 21 bp, Homo sapiens
cctccaggtgattccgtgctc

SEQ ID NO: 7958242 - DNA, 22 bp, Homo sapiens
cctccagggcccctctcactgg

SEQ ID NO: 7958243 - DNA, 21 bp, Homo sapiens
cctccaggtgattccgtgctc

SEQ ID NO: 7958244 - DNA, 21 bp, Homo sapiens
cctccaggtgattccgtgctc

SEQ ID NO: 7958245 - DNA, 21 bp, Homo sapiens
cctccaggtgattccgtgctc

SEQ ID NO: 7958246 - DNA, 22 bp, Homo sapiens
cctccaggctggttatcagctg

SEQ ID NO: 7958247 - DNA, 22 bp, Homo sapiens
cctccagggcagacggggagca

SEQ ID NO: 7958248 - DNA, 22 bp, Homo sapiens
cctccagggcagacggggagca

SEQ ID NO: 7958249 - DNA, 22 bp, Homo sapiens
cctccagggcccctctcactgg

SEQ ID NO: 7958250 - DNA, 22 bp, Homo sapiens
cctccagggcccctctcactgg

SEQ ID NO: 7958251 - DNA, 22 bp, Homo sapiens
cctccagggcccctctcactgg

SEQ ID NO: 7958252 - DNA, 20 bp, Homo sapiens
tggccaagtatccaactgga

SEQ ID NO: 7958253 - DNA, 21 bp, Homo sapiens
tggccaaggaatagaagctct

SEQ ID NO: 7958254 - DNA, 20 bp, Homo sapiens
tggccaagtatccaactgga

SEQ ID NO: 7958255 - DNA, 20 bp, Homo sapiens
tggccaagtatccaactgga

SEQ ID NO: 7958256 - DNA, 21 bp, Homo sapiens
tggccaaggaatagaagctct

SEQ ID NO: 7958257 - DNA, 22 bp, Homo sapiens
cctccagcgcgatccactccgg

SEQ ID NO: 7958258 - DNA, 22 bp, Homo sapiens
cctccagcgcgatccactccgg

SEQ ID NO: 7958259 - DNA, 22 bp, Homo sapiens
tggccacaaagagaacgaggtc

SEQ ID NO: 7958260 - DNA, 22 bp, Homo sapiens
cctccaggctggttatcagctg

SEQ ID NO: 7958261 - DNA, 22 bp, Homo sapiens
cctccaggctggttatcagctg

SEQ ID NO: 7958262 - DNA, 22 bp, Homo sapiens
tggccaagccactgctgggtct

SEQ ID NO: 7958263 - DNA, 22 bp, Homo sapiens
cctccagggcagacggggagca

SEQ ID NO: 7958264 - DNA, 22 bp, Homo sapiens
cctccagctgcctcagtctctt

SEQ ID NO: 7958265 - DNA, 22 bp, Homo sapiens
cctccagctgcctcagtctctt

SEQ ID NO: 7958266 - DNA, 22 bp, Homo sapiens
cctccagctgcctcagtctctt

SEQ ID NO: 7958267 - DNA, 22 bp, Homo sapiens
cctccaggctggttatcagctg

SEQ ID NO: 7958268 - DNA, 17 bp, Homo sapiens
cctcccacaccgccctg

SEQ ID NO: 7958269 - DNA, 17 bp, Homo sapiens
cctcccacaccgccctg

SEQ ID NO: 7958270 - DNA, 17 bp, Homo sapiens
cctcccacaccgccctg

SEQ ID NO: 7958271 - DNA, 22 bp, Homo sapiens
cctccatgtaaaggtcccctca

SEQ ID NO: 7958272 - DNA, 22 bp, Homo sapiens
cctcccacatcctagctctgct

SEQ ID NO: 7958273 - DNA, 17 bp, Homo sapiens
cctcccacaccgccctg

SEQ ID NO: 7958274 - DNA, 22 bp, Homo sapiens
cctcccacatcctagctctgct

SEQ ID NO: 7958275 - DNA, 22 bp, Homo sapiens
cctcccacatcctagctctgct

SEQ ID NO: 7958276 - DNA, 22 bp, Homo sapiens
cctccagtcacctggatgagaa

SEQ ID NO: 7958277 - DNA, 22 bp, Homo sapiens
cctccagtcacctggatgagaa

SEQ ID NO: 7958278 - DNA, 22 bp, Homo sapiens
cctccatcaccatctgccctca

SEQ ID NO: 7958279 - DNA, 22 bp, Homo sapiens
cctccatcaccatctgccctca

SEQ ID NO: 7958280 - DNA, 22 bp, Homo sapiens
cctccagtcacctggatgagaa

SEQ ID NO: 7958281 - DNA, 22 bp, Homo sapiens
cctccatctccagcttctgcct

SEQ ID NO: 7958282 - DNA, 22 bp, Homo sapiens
cctccatctccagcttctgcct

SEQ ID NO: 7958283 - DNA, 22 bp, Homo sapiens
cctccatctccagcttctgcct

SEQ ID NO: 7958284 - DNA, 22 bp, Homo sapiens
cctccatctccagcttctgcct

SEQ ID NO: 7958285 - DNA, 22 bp, Homo sapiens
cctccagtactccagtccagcg

SEQ ID NO: 7958286 - DNA, 22 bp, Homo sapiens
cctccagtactccagtccagcg

SEQ ID NO: 7958287 - DNA, 22 bp, Homo sapiens
cctccaggtgttacatatgact

SEQ ID NO: 7958288 - DNA, 22 bp, Homo sapiens
cctccaggtgttacatatgact

SEQ ID NO: 7958289 - DNA, 22 bp, Homo sapiens
cctccaggtgttacatatgact

SEQ ID NO: 7958290 - DNA, 22 bp, Homo sapiens
cctccaggtgttacatatgact

SEQ ID NO: 7958291 - DNA, 22 bp, Homo sapiens
cctcccacttcttgctgaggtc

SEQ ID NO: 7958292 - DNA, 22 bp, Homo sapiens
cctcccacttcttgctgaggtc

SEQ ID NO: 7958293 - DNA, 22 bp, Homo sapiens
cctcccacttcttgctgaggtc

SEQ ID NO: 7958294 - DNA, 22 bp, Homo sapiens
cctcctctggtgctgccaaccc

SEQ ID NO: 7958295 - DNA, 22 bp, Homo sapiens
cctcctctggtgctgccaaccc

SEQ ID NO: 7958296 - DNA, 22 bp, Homo sapiens
cctcccacttcttgctgaggtc

SEQ ID NO: 7958297 - DNA, 22 bp, Homo sapiens
cctcctctggtgctgccaaccc

SEQ ID NO: 7958298 - DNA, 22 bp, Homo sapiens
cctcccaccgtatctcagtggc

SEQ ID NO: 7958299 - DNA, 23 bp, Homo sapiens
cctcccacctatttcactttctt

SEQ ID NO: 7958300 - DNA, 23 bp, Homo sapiens
cctcccacctatttcactttctt

SEQ ID NO: 7958301 - DNA, 22 bp, Homo sapiens
cctcccacattgaggacatgct

SEQ ID NO: 7958302 - DNA, 22 bp, Homo sapiens
cctcccacattgaggacatgct

SEQ ID NO: 7958303 - DNA, 22 bp, Homo sapiens
cctcccacattgaggacatgct

SEQ ID NO: 7958304 - DNA, 22 bp, Homo sapiens
cctcccaccatttagagagagc

SEQ ID NO: 7958305 - DNA, 22 bp, Homo sapiens
cctcccaccgtatctcagtggc

SEQ ID NO: 7958306 - DNA, 22 bp, Homo sapiens
cctcccaccgtatctcagtggc

SEQ ID NO: 7958307 - DNA, 22 bp, Homo sapiens
cctcccaccgtatctcagtggc

SEQ ID NO: 7958308 - DNA, 22 bp, Homo sapiens
cctcctgggacaggctggcaca

SEQ ID NO: 7958309 - DNA, 22 bp, Homo sapiens
cctcctgggacaggctggcaca

SEQ ID NO: 7958310 - DNA, 22 bp, Homo sapiens
cctcctgggacaggctggcaca

SEQ ID NO: 7958311 - DNA, 22 bp, Homo sapiens
cctcctggcttttcccattgaa

SEQ ID NO: 7958312 - DNA, 22 bp, Homo sapiens
cctcctggcttttcccattgaa

SEQ ID NO: 7958313 - DNA, 22 bp, Homo sapiens
cctcctggcctgtgcagagccc

SEQ ID NO: 7958314 - DNA, 22 bp, Homo sapiens
cctcctggcttttcccattgaa

SEQ ID NO: 7958315 - DNA, 22 bp, Homo sapiens
cctcctggcttttcccattgaa

SEQ ID NO: 7958316 - DNA, 22 bp, Homo sapiens
cctcctgggactcattagcacc

SEQ ID NO: 7958317 - DNA, 22 bp, Homo sapiens
cctcctgggactcattagcacc

SEQ ID NO: 7958318 - DNA, 22 bp, Homo sapiens
cctcctgggacaggctggcaca

SEQ ID NO: 7958319 - DNA, 22 bp, Homo sapiens
cctcctgggacaggctggcaca

SEQ ID NO: 7958320 - DNA, 22 bp, Homo sapiens
cctcctgggacaggctggcaca

SEQ ID NO: 7958321 - DNA, 22 bp, Homo sapiens
cctcctggcctgtgcagagccc

SEQ ID NO: 7958322 - DNA, 22 bp, Homo sapiens
cctcctggcctgtgcagagccc

SEQ ID NO: 7958323 - DNA, 22 bp, Homo sapiens
cctcctggcctgtgcagagccc

SEQ ID NO: 7958324 - DNA, 22 bp, Homo sapiens
cctcctggcctgtgcagagccc

SEQ ID NO: 7958325 - DNA, 22 bp, Homo sapiens
cctcctggcctgtgcagagccc

SEQ ID NO: 7958326 - DNA, 22 bp, Homo sapiens
cctcctggcctgtgcagagccc

SEQ ID NO: 7958327 - DNA, 22 bp, Homo sapiens
cctcctggccctgggcctggaa

SEQ ID NO: 7958328 - DNA, 22 bp, Homo sapiens
cctcctggccctgggcctggaa

SEQ ID NO: 7958329 - DNA, 22 bp, Homo sapiens
cctcctctgtgcagctgtgggt

SEQ ID NO: 7958330 - DNA, 22 bp, Homo sapiens
cctcctctgtgcagctgtgggt

SEQ ID NO: 7958331 - DNA, 22 bp, Homo sapiens
cctcctctgtgcagctgtgggt

SEQ ID NO: 7958332 - DNA, 22 bp, Homo sapiens
cctcctctgtgcagctgtgggt

SEQ ID NO: 7958333 - DNA, 22 bp, Homo sapiens
cctcctgggctcctgtctgcac

SEQ ID NO: 7958334 - DNA, 22 bp, Homo sapiens
cctcctgggctcctgtctgcac

SEQ ID NO: 7958335 - DNA, 22 bp, Homo sapiens
cctcctgggctcctgtctgcac

SEQ ID NO: 7958336 - DNA, 22 bp, Homo sapiens
cctcctgggccttgctctgtga

SEQ ID NO: 7958337 - DNA, 22 bp, Homo sapiens
cctcctgggctcctgtctgcac

SEQ ID NO: 7958338 - DNA, 22 bp, Homo sapiens
cctcctggggtgaaggatggga

SEQ ID NO: 7958339 - DNA, 22 bp, Homo sapiens
cctcctgggccttgctctgtga

SEQ ID NO: 7958340 - DNA, 22 bp, Homo sapiens
cctcctgggccttgctctgtga

SEQ ID NO: 7958341 - DNA, 22 bp, Homo sapiens
cctcctgggccttgctctgtga

SEQ ID NO: 7958342 - DNA, 22 bp, Homo sapiens
cctcctgggccttgctctgtga

SEQ ID NO: 7958343 - DNA, 22 bp, Homo sapiens
cctcctgggccttgctctgtga

SEQ ID NO: 7958344 - DNA, 22 bp, Homo sapiens
cctcctgggagagcacggaggg

SEQ ID NO: 7958345 - DNA, 22 bp, Homo sapiens
cctcctgggagagcacggaggg

SEQ ID NO: 7958346 - DNA, 22 bp, Homo sapiens
cctcctgggagagcacggaggg

SEQ ID NO: 7958347 - DNA, 22 bp, Homo sapiens
cctcctgggagagcacggaggg

SEQ ID NO: 7958348 - DNA, 22 bp, Homo sapiens
cctcctgggactcattagcacc

SEQ ID NO: 7958349 - DNA, 22 bp, Homo sapiens
cctcctgggagagcacggaggg

SEQ ID NO: 7958350 - DNA, 22 bp, Homo sapiens
cctcctgggagagcacggaggg

SEQ ID NO: 7958351 - DNA, 23 bp, Homo sapiens
cctcctgggcacaggcctgatgg

SEQ ID NO: 7958352 - DNA, 23 bp, Homo sapiens
cctcctgggcacaggcctgatgg

SEQ ID NO: 7958353 - DNA, 23 bp, Homo sapiens
cctcctgggcacaggcctgatgg

SEQ ID NO: 7958354 - DNA, 22 bp, Homo sapiens
cctcctgggagagcacggaggg

SEQ ID NO: 7958355 - DNA, 23 bp, Homo sapiens
cctcctgggcacaggcctgatgg

SEQ ID NO: 7958356 - DNA, 23 bp, Homo sapiens
cctcctgggcacaggcctgatgg

SEQ ID NO: 7958357 - DNA, 22 bp, Homo sapiens
cctcctggtccagcatctcttt

SEQ ID NO: 7958358 - DNA, 22 bp, Homo sapiens
cctcctggtccagcatctcttt

SEQ ID NO: 7958359 - DNA, 22 bp, Homo sapiens
cctcctggtccagcatctcttt

SEQ ID NO: 7958360 - DNA, 22 bp, Homo sapiens
cctcctggtccagcatctcttt

SEQ ID NO: 7958361 - DNA, 22 bp, Homo sapiens
tggcttcccatagcttgctagt

SEQ ID NO: 7958362 - DNA, 22 bp, Homo sapiens
tggcttcccaggaaaggagaag

SEQ ID NO: 7958363 - DNA, 22 bp, Homo sapiens
cctcctggtccagcatctcttt

SEQ ID NO: 7958364 - DNA, 22 bp, Homo sapiens
tggcttccccggagtgacatgt

SEQ ID NO: 7958365 - DNA, 22 bp, Homo sapiens
tggcttcccctaccttccaatt

SEQ ID NO: 7958366 - DNA, 22 bp, Homo sapiens
tggcttctttccactgtcctgt

SEQ ID NO: 7958367 - DNA, 22 bp, Homo sapiens
tggcttctttccactgtcctgt

SEQ ID NO: 7958368 - DNA, 22 bp, Homo sapiens
tggcttctttccactgtcctgt

SEQ ID NO: 7958369 - DNA, 22 bp, Homo sapiens
cctcctgggttcaagcgattct

SEQ ID NO: 7958370 - DNA, 22 bp, Homo sapiens
cctcctggtaattagcgaaagg

SEQ ID NO: 7958371 - DNA, 22 bp, Homo sapiens
cctcctgggttcaagcgattct

SEQ ID NO: 7958372 - DNA, 22 bp, Homo sapiens
cctcctggggtgaaggatggga

SEQ ID NO: 7958373 - DNA, 22 bp, Homo sapiens
cctcctggggtgaaggatggga

SEQ ID NO: 7958374 - DNA, 20 bp, Homo sapiens
cctcctggtcaggtgtgcag

SEQ ID NO: 7958375 - DNA, 20 bp, Homo sapiens
cctcctggtcaggtgtgcag

SEQ ID NO: 7958376 - DNA, 22 bp, Homo sapiens
cctcctggtaattagcgaaagg

SEQ ID NO: 7958377 - DNA, 20 bp, Homo sapiens
cctcctggtcaggtgtgcag

SEQ ID NO: 7958378 - DNA, 22 bp, Homo sapiens
tggcttggtaaggaccagcagg

SEQ ID NO: 7958379 - DNA, 22 bp, Homo sapiens
tggcttggtcctggcccttccc

SEQ ID NO: 7958380 - DNA, 22 bp, Homo sapiens
tggcttggtaaggaccagcagg

SEQ ID NO: 7958381 - DNA, 22 bp, Homo sapiens
tggcttgggtgtctcagctctt

SEQ ID NO: 7958382 - DNA, 22 bp, Homo sapiens
tggcttgggagattctcgaact

SEQ ID NO: 7958383 - DNA, 22 bp, Homo sapiens
tggcttggtgagcagagtgtag

SEQ ID NO: 7958384 - DNA, 22 bp, Homo sapiens
tggcttgtcatgtatctgaggc

SEQ ID NO: 7958385 - DNA, 22 bp, Homo sapiens
tggctttacagtttgcaaacta

SEQ ID NO: 7958386 - DNA, 22 bp, Homo sapiens
tggctttacacatccactgcct

SEQ ID NO: 7958387 - DNA, 20 bp, Homo sapiens
tggctttaagttttttgcta

SEQ ID NO: 7958388 - DNA, 22 bp, Homo sapiens
tggctttaagaagactgacagc

SEQ ID NO: 7958389 - DNA, 22 bp, Homo sapiens
tggctttaagaagactgacagc

SEQ ID NO: 7958390 - DNA, 22 bp, Homo sapiens
tggctttaagaagactgacagc

SEQ ID NO: 7958391 - DNA, 22 bp, Homo sapiens
tggctttaagaagactgacagc

SEQ ID NO: 7958392 - DNA, 22 bp, Homo sapiens
tggctttaaatctgtattcata

SEQ ID NO: 7958393 - DNA, 22 bp, Homo sapiens
tggctttaaaatggtttggtat

SEQ ID NO: 7958394 - DNA, 22 bp, Homo sapiens
tggcttgtcatgtatctgaggc

SEQ ID NO: 7958395 - DNA, 22 bp, Homo sapiens
tggcttgcttcttctgctgtcg

SEQ ID NO: 7958396 - DNA, 22 bp, Homo sapiens
tggcttgcttccccattctcat

SEQ ID NO: 7958397 - DNA, 22 bp, Homo sapiens
tggcttgcttccccattctcat

SEQ ID NO: 7958398 - DNA, 23 bp, Homo sapiens
tggcttgctaatgttccaaataa

SEQ ID NO: 7958399 - DNA, 22 bp, Homo sapiens
tggcttgcaaaattatttttct

SEQ ID NO: 7958400 - DNA, 22 bp, Homo sapiens
tggcttggactaaatggaccgt

SEQ ID NO: 7958401 - DNA, 19 bp, Homo sapiens
tggcttggctgcagatgct

SEQ ID NO: 7958402 - DNA, 19 bp, Homo sapiens
tggcttggctgcagatgct

SEQ ID NO: 7958403 - DNA, 22 bp, Homo sapiens
tggcttctttgtagaaattgaa

SEQ ID NO: 7958404 - DNA, 22 bp, Homo sapiens
tggcttctttccactgtcctgt

SEQ ID NO: 7958405 - DNA, 22 bp, Homo sapiens
tggcttctttgtagaaattgaa

SEQ ID NO: 7958406 - DNA, 22 bp, Homo sapiens
tggcttctttgtagaaattgaa

SEQ ID NO: 7958407 - DNA, 22 bp, Homo sapiens
tggcttctttgtgacagctctt

SEQ ID NO: 7958408 - DNA, 22 bp, Homo sapiens
tggcttctttgtgacagctctt

SEQ ID NO: 7958409 - DNA, 22 bp, Homo sapiens
cctctcccgggtgccgctgggc

SEQ ID NO: 7958410 - DNA, 22 bp, Homo sapiens
tgggaaggcagtcactgtccta

SEQ ID NO: 7958411 - DNA, 22 bp, Homo sapiens
tgggaaggcagtcactgtccta

SEQ ID NO: 7958412 - DNA, 22 bp, Homo sapiens
cctctcccgggtgccgctgggc

SEQ ID NO: 7958413 - DNA, 22 bp, Homo sapiens
cctctcccgggtgccgctgggc

SEQ ID NO: 7958414 - DNA, 22 bp, Homo sapiens
cctctcccgggtgccgctgggc

SEQ ID NO: 7958415 - DNA, 22 bp, Homo sapiens
cctctcccgggtgccgctgggc

SEQ ID NO: 7958416 - DNA, 22 bp, Homo sapiens
tgggaaggcgtggaagtagaag

SEQ ID NO: 7958417 - DNA, 22 bp, Homo sapiens
tgggaaggcagtcactgtccta

SEQ ID NO: 7958418 - DNA, 22 bp, Homo sapiens
tgggaaggcgtggaagtagaag

SEQ ID NO: 7958419 - DNA, 22 bp, Homo sapiens
tgggaaggcgtggaagtagaag

SEQ ID NO: 7958420 - DNA, 22 bp, Homo sapiens
tgggacacctcagatagtgtct

SEQ ID NO: 7958421 - DNA, 22 bp, Homo sapiens
tgggacagagtgagctttggcc

SEQ ID NO: 7958422 - DNA, 22 bp, Homo sapiens
tgggacagagtgagctttggcc

SEQ ID NO: 7958423 - DNA, 22 bp, Homo sapiens
tgggacagagtgagctttggcc

SEQ ID NO: 7958424 - DNA, 19 bp, Homo sapiens
cctctcccatgcttacctc

SEQ ID NO: 7958425 - DNA, 19 bp, Homo sapiens
cctctcccatgcttacctc

SEQ ID NO: 7958426 - DNA, 19 bp, Homo sapiens
cctctcccatgcttacctc

SEQ ID NO: 7958427 - DNA, 22 bp, Homo sapiens
cctctcccagggagagcctgag

SEQ ID NO: 7958428 - DNA, 22 bp, Homo sapiens
cctctcccagggagagcctgag

SEQ ID NO: 7958429 - DNA, 22 bp, Homo sapiens
cctctcccagggagagcctgag

SEQ ID NO: 7958430 - DNA, 22 bp, Homo sapiens
cctctcccctcccaaggcggga

SEQ ID NO: 7958431 - DNA, 19 bp, Homo sapiens
cctctcccatgcttacctc

SEQ ID NO: 7958432 - DNA, 22 bp, Homo sapiens
cctctcccctcccaaggcggga

SEQ ID NO: 7958433 - DNA, 22 bp, Homo sapiens
cctctcccctcccaaggcggga

SEQ ID NO: 7958434 - DNA, 19 bp, Homo sapiens
cctctcccatgcttacctc

SEQ ID NO: 7958435 - DNA, 19 bp, Homo sapiens
cctctcccatgcttacctc

SEQ ID NO: 7958436 - DNA, 22 bp, Homo sapiens
tggctttaggagctatatacct

SEQ ID NO: 7958437 - DNA, 22 bp, Homo sapiens
tggctttaggagctatatacct

SEQ ID NO: 7958438 - DNA, 22 bp, Homo sapiens
tggctttaggagctatatacct

SEQ ID NO: 7958439 - DNA, 22 bp, Homo sapiens
tggctttaggccaaagcctaac

SEQ ID NO: 7958440 - DNA, 22 bp, Homo sapiens
tggctttaggagctatatacct

SEQ ID NO: 7958441 - DNA, 22 bp, Homo sapiens
tggctttacagtttgcaaacta

SEQ ID NO: 7958442 - DNA, 20 bp, Homo sapiens
tggctttactagtggcactc

SEQ ID NO: 7958443 - DNA, 22 bp, Homo sapiens
tggctttactgtcattcttatg

SEQ ID NO: 7958444 - DNA, 20 bp, Homo sapiens
tggctttactagtggcactc

SEQ ID NO: 7958445 - DNA, 22 bp, Homo sapiens
cctctccagttttaacgtgacc

SEQ ID NO: 7958446 - DNA, 22 bp, Homo sapiens
cctctccagcggcctcagggcc

SEQ ID NO: 7958447 - DNA, 22 bp, Homo sapiens
cctctccagcggcctcagggcc

SEQ ID NO: 7958448 - DNA, 22 bp, Homo sapiens
cctctccagcggcctcagggcc

SEQ ID NO: 7958449 - DNA, 22 bp, Homo sapiens
cctctcccagggagagcctgag

SEQ ID NO: 7958450 - DNA, 22 bp, Homo sapiens
cctctcccagggagagcctgag

SEQ ID NO: 7958451 - DNA, 22 bp, Homo sapiens
cctctcccaggcgcggcggcag

SEQ ID NO: 7958452 - DNA, 22 bp, Homo sapiens
cctctcccaggcgcggcggcag

SEQ ID NO: 7958453 - DNA, 22 bp, Homo sapiens
cctctcccaggcgcggcggcag

SEQ ID NO: 7958454 - DNA, 22 bp, Homo sapiens
cctctcccacgtggcagaggct

SEQ ID NO: 7958455 - DNA, 22 bp, Homo sapiens
cctctcccacgtggcagaggct

SEQ ID NO: 7958456 - DNA, 22 bp, Homo sapiens
cctctcccacgtggcagaggct

SEQ ID NO: 7958457 - DNA, 22 bp, Homo sapiens
cctctcccacgtggcagaggct

SEQ ID NO: 7958458 - DNA, 22 bp, Homo sapiens
tgggagagcactgcagccccgg

SEQ ID NO: 7958459 - DNA, 22 bp, Homo sapiens
tgggagagataggcttctggac

SEQ ID NO: 7958460 - DNA, 22 bp, Homo sapiens
tgggagagcactgcagccccgg

SEQ ID NO: 7958461 - DNA, 22 bp, Homo sapiens
tgggagagataggcttctggac

SEQ ID NO: 7958462 - DNA, 22 bp, Homo sapiens
tgggagagataggcttctggac

SEQ ID NO: 7958463 - DNA, 22 bp, Homo sapiens
tgggagagagaattcccagtgg

SEQ ID NO: 7958464 - DNA, 22 bp, Homo sapiens
tgggagagagaattcccagtgg

SEQ ID NO: 7958465 - DNA, 22 bp, Homo sapiens
tgggagagagaattcccagtgg

SEQ ID NO: 7958466 - DNA, 22 bp, Homo sapiens
tgggagagagaattcccagtgg

SEQ ID NO: 7958467 - DNA, 22 bp, Homo sapiens
tgggagagaattctggtgactg

SEQ ID NO: 7958468 - DNA, 22 bp, Homo sapiens
tgggagagaattctggtgactg

SEQ ID NO: 7958469 - DNA, 22 bp, Homo sapiens
tgggagagaattctggtgactg

SEQ ID NO: 7958470 - DNA, 22 bp, Homo sapiens
tgggagagaattctggtgactg

SEQ ID NO: 7958471 - DNA, 22 bp, Homo sapiens
tgggagagaataatcaataggt

SEQ ID NO: 7958472 - DNA, 22 bp, Homo sapiens
tgggagagaataatcaataggt

SEQ ID NO: 7958473 - DNA, 22 bp, Homo sapiens
tgggagagaattctggtgactg

SEQ ID NO: 7958474 - DNA, 22 bp, Homo sapiens
tgggagagaattctggtgactg

SEQ ID NO: 7958475 - DNA, 22 bp, Homo sapiens
tgggagagaattctggtgactg

SEQ ID NO: 7958476 - DNA, 22 bp, Homo sapiens
tgggagagaattctggtgactg

SEQ ID NO: 7958477 - DNA, 22 bp, Homo sapiens
tgggagagaattctggtgactg

SEQ ID NO: 7958478 - DNA, 22 bp, Homo sapiens
tgggacagggaatctgatcccc

SEQ ID NO: 7958479 - DNA, 22 bp, Homo sapiens
tgggacagggaatctgatcccc

SEQ ID NO: 7958480 - DNA, 22 bp, Homo sapiens
tgggacagggaatctgatcccc

SEQ ID NO: 7958481 - DNA, 22 bp, Homo sapiens
tgggacagggaatctgatcccc

SEQ ID NO: 7958482 - DNA, 22 bp, Homo sapiens
tgggacaggatgaccagaaggt

SEQ ID NO: 7958483 - DNA, 22 bp, Homo sapiens
tgggacaggatgaccagaaggt

SEQ ID NO: 7958484 - DNA, 22 bp, Homo sapiens
tgggacaggaggcctctggaga

SEQ ID NO: 7958485 - DNA, 22 bp, Homo sapiens
tgggacaggaggcctctggaga

SEQ ID NO: 7958486 - DNA, 22 bp, Homo sapiens
tgggacaggaggcctctggaga

SEQ ID NO: 7958487 - DNA, 22 bp, Homo sapiens
tgggacaggaggcctctggaga

SEQ ID NO: 7958488 - DNA, 22 bp, Homo sapiens
tgggacaggaggcctctggaga

SEQ ID NO: 7958489 - DNA, 22 bp, Homo sapiens
tgggacagattataagtctgca

SEQ ID NO: 7958490 - DNA, 22 bp, Homo sapiens
tgggacagattataagtctgca

SEQ ID NO: 7958491 - DNA, 22 bp, Homo sapiens
tgggacaggaggcctctggaga

SEQ ID NO: 7958492 - DNA, 22 bp, Homo sapiens
tgggacaggaggcctctggaga

SEQ ID NO: 7958493 - DNA, 22 bp, Homo sapiens
tgggacagattataagtctgca

SEQ ID NO: 7958494 - DNA, 22 bp, Homo sapiens
tgggacagattataagtctgca

SEQ ID NO: 7958495 - DNA, 22 bp, Homo sapiens
tgggacagattataagtctgca

SEQ ID NO: 7958496 - DNA, 22 bp, Homo sapiens
tgggacagattataagtctgca

SEQ ID NO: 7958497 - DNA, 22 bp, Homo sapiens
tgggacagagtgagctttggcc

SEQ ID NO: 7958498 - DNA, 22 bp, Homo sapiens
tgggacagagtgagctttggcc

SEQ ID NO: 7958499 - DNA, 22 bp, Homo sapiens
tgggacagattataagtctgca

SEQ ID NO: 7958500 - DNA, 22 bp, Homo sapiens
tgggacagattataagtctgca

SEQ ID NO: 7958501 - DNA, 22 bp, Homo sapiens
tgggacagagtgagctttggcc

SEQ ID NO: 7958502 - DNA, 22 bp, Homo sapiens
tgggcagactaaggtcaaagct

SEQ ID NO: 7958503 - DNA, 22 bp, Homo sapiens
tgggcagacgggagcttgcctt

SEQ ID NO: 7958504 - DNA, 22 bp, Homo sapiens
tgggcaggagagaagctaaaga

SEQ ID NO: 7958505 - DNA, 22 bp, Homo sapiens
tgggcaggagagaagctaaaga

SEQ ID NO: 7958506 - DNA, 22 bp, Homo sapiens
tgggcagactaaggtcaaagct

SEQ ID NO: 7958507 - DNA, 22 bp, Homo sapiens
tgggcagacattgagtttgttc

SEQ ID NO: 7958508 - DNA, 22 bp, Homo sapiens
tgggcagacattgagtttgttc

SEQ ID NO: 7958509 - DNA, 22 bp, Homo sapiens
tgggcagacgctgttggaaggc

SEQ ID NO: 7958510 - DNA, 22 bp, Homo sapiens
tgggcagacgctgttggaaggc

SEQ ID NO: 7958511 - DNA, 22 bp, Homo sapiens
tgggcagaatgtgggatccaga

SEQ ID NO: 7958512 - DNA, 22 bp, Homo sapiens
tgggcagaattgtggtagttaa

SEQ ID NO: 7958513 - DNA, 22 bp, Homo sapiens
tgggcagaatgtgggatccaga

SEQ ID NO: 7958514 - DNA, 22 bp, Homo sapiens
tgggcagaatgtgggatccaga

SEQ ID NO: 7958515 - DNA, 22 bp, Homo sapiens
tgggcagaaggaagagccacct

SEQ ID NO: 7958516 - DNA, 22 bp, Homo sapiens
tgggcagaaggaagagccacct

SEQ ID NO: 7958517 - DNA, 22 bp, Homo sapiens
tgggcagaaggaagagccacct

SEQ ID NO: 7958518 - DNA, 22 bp, Homo sapiens
tgggcagaaggaagagccacct

SEQ ID NO: 7958519 - DNA, 22 bp, Homo sapiens
tgggcagaaatcagtatcagat

SEQ ID NO: 7958520 - DNA, 22 bp, Homo sapiens
tgggcagaaatcagtatcagat

SEQ ID NO: 7958521 - DNA, 22 bp, Homo sapiens
tgggcacttatcgaaattgagg

SEQ ID NO: 7958522 - DNA, 22 bp, Homo sapiens
tgggcagaaatcagtatcagat

SEQ ID NO: 7958523 - DNA, 21 bp, Homo sapiens
tgggatagaaatatggctgct

SEQ ID NO: 7958524 - DNA, 21 bp, Homo sapiens
tgggagagcgttgctgtcctc

SEQ ID NO: 7958525 - DNA, 21 bp, Homo sapiens
tgggagagcgttgctgtcctc

SEQ ID NO: 7958526 - DNA, 21 bp, Homo sapiens
tgggagagcgttgctgtcctc

SEQ ID NO: 7958527 - DNA, 21 bp, Homo sapiens
tgggagagcgttgctgtcctc

SEQ ID NO: 7958528 - DNA, 21 bp, Homo sapiens
tgggagagcgttgctgtcctc

SEQ ID NO: 7958529 - DNA, 22 bp, Homo sapiens
tgggataataaatagaggcaga

SEQ ID NO: 7958530 - DNA, 22 bp, Homo sapiens
tgggagagcagagaaccctctt

SEQ ID NO: 7958531 - DNA, 22 bp, Homo sapiens
tgggagagcagagaaccctctt

SEQ ID NO: 7958532 - DNA, 22 bp, Homo sapiens
tgggagagcagagaaccctctt

SEQ ID NO: 7958533 - DNA, 22 bp, Homo sapiens
tgggagagcactgcagccccgg

SEQ ID NO: 7958534 - DNA, 22 bp, Homo sapiens
tgggagagcactgcagccccgg

SEQ ID NO: 7958535 - DNA, 22 bp, Homo sapiens
tgggagagcactgcagccccgg

SEQ ID NO: 7958536 - DNA, 22 bp, Homo sapiens
tgggcactgaagctttgagcag

SEQ ID NO: 7958537 - DNA, 22 bp, Homo sapiens
tgggcactgactgttagtgatg

SEQ ID NO: 7958538 - DNA, 22 bp, Homo sapiens
tgggcactgaagctttgagcag

SEQ ID NO: 7958539 - DNA, 22 bp, Homo sapiens
tgggcactgaagctttgagcag

SEQ ID NO: 7958540 - DNA, 22 bp, Homo sapiens
tgggcactcttctgtgcaaaca

SEQ ID NO: 7958541 - DNA, 22 bp, Homo sapiens
tgggcactcttctgtgcaaaca

SEQ ID NO: 7958542 - DNA, 21 bp, Homo sapiens
tgggcactgagggtgctgctc

SEQ ID NO: 7958543 - DNA, 21 bp, Homo sapiens
tgggcactgagggtgctgctc

SEQ ID NO: 7958544 - DNA, 22 bp, Homo sapiens
tgggcactgactgttagtgatg

SEQ ID NO: 7958545 - DNA, 22 bp, Homo sapiens
tgggcactggaagcctgctgtg

SEQ ID NO: 7958546 - DNA, 22 bp, Homo sapiens
tgggcactggaagcctgctgtg

SEQ ID NO: 7958547 - DNA, 21 bp, Homo sapiens
tgggcactgagggtgctgctc

SEQ ID NO: 7958548 - DNA, 21 bp, Homo sapiens
tgggcactgagggtgctgctc

SEQ ID NO: 7958549 - DNA, 22 bp, Homo sapiens
tgggcactggaagcctgctgtg

SEQ ID NO: 7958550 - DNA, 22 bp, Homo sapiens
tgggcactggaagcctgctgtg

SEQ ID NO: 7958551 - DNA, 22 bp, Homo sapiens
tgggcactggggctccagaggt

SEQ ID NO: 7958552 - DNA, 22 bp, Homo sapiens
tgggcactgtagctggtgctgg

SEQ ID NO: 7958553 - DNA, 22 bp, Homo sapiens
tgggcactgtgtgtggtaaaat

SEQ ID NO: 7958554 - DNA, 22 bp, Homo sapiens
tgggcactgtgtgtggtaaaat

SEQ ID NO: 7958555 - DNA, 22 bp, Homo sapiens
tgggcactgtagctggtgctgg

SEQ ID NO: 7958556 - DNA, 22 bp, Homo sapiens
tgggcactgtagctggtgctgg

SEQ ID NO: 7958557 - DNA, 22 bp, Homo sapiens
tgggcactgtagctggtgctgg

SEQ ID NO: 7958558 - DNA, 22 bp, Homo sapiens
tgcaatatgttgcattgtatgg

SEQ ID NO: 7958559 - DNA, 22 bp, Homo sapiens
tgcaataatgtatgtcactccc

SEQ ID NO: 7958560 - DNA, 22 bp, Homo sapiens
tgcaatcagaaagttcagcggt

SEQ ID NO: 7958561 - DNA, 22 bp, Homo sapiens
tgcaatcaggtaccatttgatt

SEQ ID NO: 7958562 - DNA, 22 bp, Homo sapiens
tgcaatatttggcactgagatg

SEQ ID NO: 7958563 - DNA, 22 bp, Homo sapiens
tgcaatatgttgcattgtatgg

SEQ ID NO: 7958564 - DNA, 22 bp, Homo sapiens
tgcaataaggagtaatagtaaa

SEQ ID NO: 7958565 - DNA, 22 bp, Homo sapiens
tgcaataaggagtaatagtaaa

SEQ ID NO: 7958566 - DNA, 22 bp, Homo sapiens
tgcaataagttgtgttatcact

SEQ ID NO: 7958567 - DNA, 22 bp, Homo sapiens
tgcaataagtattgcttacatg

SEQ ID NO: 7958568 - DNA, 22 bp, Homo sapiens
tgcaataagttgtgttatcact

SEQ ID NO: 7958569 - DNA, 22 bp, Homo sapiens
tgcaataagttgtgttatcact

SEQ ID NO: 7958570 - DNA, 22 bp, Homo sapiens
tgcaataagttgtgttatcact

SEQ ID NO: 7958571 - DNA, 22 bp, Homo sapiens
tgcaataaggagtaatagtaaa

SEQ ID NO: 7958572 - DNA, 22 bp, Homo sapiens
tgcaataactactttaatgttg

SEQ ID NO: 7958573 - DNA, 22 bp, Homo sapiens
tgcaataaggagtaatagtaaa

SEQ ID NO: 7958574 - DNA, 22 bp, Homo sapiens
tgcaataacccatgagatagaa

SEQ ID NO: 7958575 - DNA, 22 bp, Homo sapiens
tgcaataacccatgagatagaa

SEQ ID NO: 7958576 - DNA, 22 bp, Homo sapiens
tgatacagaattgatatctgag

SEQ ID NO: 7958577 - DNA, 22 bp, Homo sapiens
tgatacacagatttacatcaat

SEQ ID NO: 7958578 - DNA, 22 bp, Homo sapiens
tgatacacagatttacatcaat

SEQ ID NO: 7958579 - DNA, 22 bp, Homo sapiens
tgataatgttcgagaatgaaga

SEQ ID NO: 7958580 - DNA, 22 bp, Homo sapiens
tgataatattttgaatcataag

SEQ ID NO: 7958581 - DNA, 22 bp, Homo sapiens
tgataatattttgaatcataag

SEQ ID NO: 7958582 - DNA, 22 bp, Homo sapiens
tgataaatccatgtaaatggta

SEQ ID NO: 7958583 - DNA, 22 bp, Homo sapiens
tgataaatccatgtaaatggta

SEQ ID NO: 7958584 - DNA, 22 bp, Homo sapiens
tgcaataacccagtatctgtga

SEQ ID NO: 7958585 - DNA, 22 bp, Homo sapiens
tgcaataacccagtatctgtga

SEQ ID NO: 7958586 - DNA, 22 bp, Homo sapiens
tgcaataaagtgctataaatcc

SEQ ID NO: 7958587 - DNA, 22 bp, Homo sapiens
tgcaataacccagtatctgtga

SEQ ID NO: 7958588 - DNA, 22 bp, Homo sapiens
tgcaataaagtgctataaatcc

SEQ ID NO: 7958589 - DNA, 22 bp, Homo sapiens
tgcaataaagtgctataaatcc

SEQ ID NO: 7958590 - DNA, 22 bp, Homo sapiens
tgcaataaagtgctataaatcc

SEQ ID NO: 7958591 - DNA, 22 bp, Homo sapiens
tgcaagtgccatgtgcacagtg

SEQ ID NO: 7958592 - DNA, 19 bp, Homo sapiens
tgcaagtgtcttggacaag

SEQ ID NO: 7958593 - DNA, 22 bp, Homo sapiens
tgcaaatattgggacagtctag

SEQ ID NO: 7958594 - DNA, 22 bp, Homo sapiens
tgcaaatattgggacagtctag

SEQ ID NO: 7958595 - DNA, 22 bp, Homo sapiens
cccaaggcctctccttggcttg

SEQ ID NO: 7958596 - DNA, 19 bp, Homo sapiens
cccaaggccctgggcaggc

SEQ ID NO: 7958597 - DNA, 22 bp, Homo sapiens
cccaaggcctctccttggcttg

SEQ ID NO: 7958598 - DNA, 19 bp, Homo sapiens
cccaaggccctgggcaggc

SEQ ID NO: 7958599 - DNA, 19 bp, Homo sapiens
cccaaggccctgggcaggc

SEQ ID NO: 7958600 - DNA, 22 bp, Homo sapiens
cccaaggccttcaagccagctc

SEQ ID NO: 7958601 - DNA, 22 bp, Homo sapiens
cccaaggctgcagtgagcatga

SEQ ID NO: 7958602 - DNA, 21 bp, Homo sapiens
cccaagggaggcaggataagg

SEQ ID NO: 7958603 - DNA, 21 bp, Homo sapiens
cccaagggaggcaggataagg

SEQ ID NO: 7958604 - DNA, 21 bp, Homo sapiens
cccaagggaggcaggataagg

SEQ ID NO: 7958605 - DNA, 22 bp, Homo sapiens
cccaaggacacgggcagggaca

SEQ ID NO: 7958606 - DNA, 22 bp, Homo sapiens
cccaaggacacgggcagggaca

SEQ ID NO: 7958607 - DNA, 22 bp, Homo sapiens
cccaaggaataggatcccagga

SEQ ID NO: 7958608 - DNA, 23 bp, Homo sapiens
cccaagcctgtgccctctgactc

SEQ ID NO: 7958609 - DNA, 22 bp, Homo sapiens
cccaagcctttcaaaactcaga

SEQ ID NO: 7958610 - DNA, 22 bp, Homo sapiens
cccaaggaagacgcttgtgata

SEQ ID NO: 7958611 - DNA, 22 bp, Homo sapiens
cccaaggaagacgcttgtgata

SEQ ID NO: 7958612 - DNA, 23 bp, Homo sapiens
cccaagcctgtgccctctgactc

SEQ ID NO: 7958613 - DNA, 23 bp, Homo sapiens
cccaagcctgtgccctctgactc

SEQ ID NO: 7958614 - DNA, 23 bp, Homo sapiens
cccaagcctgtgccctctgactc

SEQ ID NO: 7958615 - DNA, 22 bp, Homo sapiens
tgcaatcaggtaccatttgatt

SEQ ID NO: 7958616 - DNA, 22 bp, Homo sapiens
tgcaatccactattctaaagcc

SEQ ID NO: 7958617 - DNA, 22 bp, Homo sapiens
cccaaggggtgttgatggagga

SEQ ID NO: 7958618 - DNA, 22 bp, Homo sapiens
cccaaggggtgttgatggagga

SEQ ID NO: 7958619 - DNA, 22 bp, Homo sapiens
cccaagggatgcttgagtagtt

SEQ ID NO: 7958620 - DNA, 22 bp, Homo sapiens
cccaagggatgcttgagtagtt

SEQ ID NO: 7958621 - DNA, 22 bp, Homo sapiens
cccaagggatgcttgagtagtt

SEQ ID NO: 7958622 - DNA, 22 bp, Homo sapiens
cccaagggatgcttgagtagtt

SEQ ID NO: 7958623 - DNA, 22 bp, Homo sapiens
tgcacagatgctaggaggtgaa

SEQ ID NO: 7958624 - DNA, 22 bp, Homo sapiens
tgcacagatctggtggcaagga

SEQ ID NO: 7958625 - DNA, 22 bp, Homo sapiens
cccaagggtgcccagcagagga

SEQ ID NO: 7958626 - DNA, 22 bp, Homo sapiens
cccaagggtgcccagcagagga

SEQ ID NO: 7958627 - DNA, 22 bp, Homo sapiens
cccaaggggtgttgatggagga

SEQ ID NO: 7958628 - DNA, 22 bp, Homo sapiens
cccaaggggtgttgatggagga

SEQ ID NO: 7958629 - DNA, 22 bp, Homo sapiens
cccaaggggtgttgatggagga

SEQ ID NO: 7958630 - DNA, 22 bp, Homo sapiens
tgcactccaggctgggtgacag

SEQ ID NO: 7958631 - DNA, 22 bp, Homo sapiens
tgcactccaggctgggtgacag

SEQ ID NO: 7958632 - DNA, 22 bp, Homo sapiens
tgcactccaggctgggtgacag

SEQ ID NO: 7958633 - DNA, 22 bp, Homo sapiens
tgcactccaggctgggtgacag

SEQ ID NO: 7958634 - DNA, 22 bp, Homo sapiens
tgcactccaggctgggtgacag

SEQ ID NO: 7958635 - DNA, 22 bp, Homo sapiens
tgcactccaggctgggtgacag

SEQ ID NO: 7958636 - DNA, 22 bp, Homo sapiens
tgcactccaggctgggtgacag

SEQ ID NO: 7958637 - DNA, 22 bp, Homo sapiens
tgcacagatgggcttgttcata

SEQ ID NO: 7958638 - DNA, 18 bp, Homo sapiens
tgcactagatgctggcag

SEQ ID NO: 7958639 - DNA, 22 bp, Homo sapiens
tgcacagatgggcttgttcata

SEQ ID NO: 7958640 - DNA, 18 bp, Homo sapiens
tgcactagatgctggcag

SEQ ID NO: 7958641 - DNA, 22 bp, Homo sapiens
tgcactattgtgttcactatta

SEQ ID NO: 7958642 - DNA, 19 bp, Homo sapiens
tgcactagtcatttctgta

SEQ ID NO: 7958643 - DNA, 22 bp, Homo sapiens
tgcactatttcgccatggttgt

SEQ ID NO: 7958644 - DNA, 22 bp, Homo sapiens
tgcactattttcaggctttgtg

SEQ ID NO: 7958645 - DNA, 22 bp, Homo sapiens
tgcacttcaaaaatgtcactga

SEQ ID NO: 7958646 - DNA, 22 bp, Homo sapiens
tgcacttcattgtaaattgtac

SEQ ID NO: 7958647 - DNA, 21 bp, Homo sapiens
tgcacttcagtggctaaattc

SEQ ID NO: 7958648 - DNA, 22 bp, Homo sapiens
tgcactggtggtgagtgaggga

SEQ ID NO: 7958649 - DNA, 22 bp, Homo sapiens
tgcactggtggtgagtgaggga

SEQ ID NO: 7958650 - DNA, 22 bp, Homo sapiens
tgcactggtggtgagtgaggga

SEQ ID NO: 7958651 - DNA, 22 bp, Homo sapiens
tgcactgttgctttatatgatt

SEQ ID NO: 7958652 - DNA, 22 bp, Homo sapiens
tgcacttattgacatagaaaaa

SEQ ID NO: 7958653 - DNA, 22 bp, Homo sapiens
tgcactttaaaaaatggtgatg

SEQ ID NO: 7958654 - DNA, 19 bp, Homo sapiens
tgcacttgagatgtttgta

SEQ ID NO: 7958655 - DNA, 22 bp, Homo sapiens
tgcactttaaaaaatggtgatg

SEQ ID NO: 7958656 - DNA, 22 bp, Homo sapiens
tgcactgggaaagaaggaggga

SEQ ID NO: 7958657 - DNA, 22 bp, Homo sapiens
tgcactgggaaagaaggaggga

SEQ ID NO: 7958658 - DNA, 22 bp, Homo sapiens
tgcactggggtcccagcgcacg

SEQ ID NO: 7958659 - DNA, 22 bp, Homo sapiens
tgcactggggtcccagcgcacg

SEQ ID NO: 7958660 - DNA, 22 bp, Homo sapiens
tgcactgatgttttgccaagga

SEQ ID NO: 7958661 - DNA, 22 bp, Homo sapiens
tgcactgctttgcaaagctgag

SEQ ID NO: 7958662 - DNA, 22 bp, Homo sapiens
tgcactgatcctgaccagtgaa

SEQ ID NO: 7958663 - DNA, 22 bp, Homo sapiens
tgcactgatgttttgccaagga

SEQ ID NO: 7958664 - DNA, 22 bp, Homo sapiens
tgcactccaggctgggtgacag

SEQ ID NO: 7958665 - DNA, 22 bp, Homo sapiens
tgcactccaggctgggtgacag

SEQ ID NO: 7958666 - DNA, 22 bp, Homo sapiens
tgcactccaggctgggtgacag

SEQ ID NO: 7958667 - DNA, 22 bp, Homo sapiens
tgcactccaggctgggtgacag

SEQ ID NO: 7958668 - DNA, 22 bp, Homo sapiens
tgcactgaatagtagactgtac

SEQ ID NO: 7958669 - DNA, 22 bp, Homo sapiens
tgcactgatcctgaccagtgaa

SEQ ID NO: 7958670 - DNA, 22 bp, Homo sapiens
tgcagagagatcctcagggttt

SEQ ID NO: 7958671 - DNA, 22 bp, Homo sapiens
tgcagagagatcctcagggttt

SEQ ID NO: 7958672 - DNA, 22 bp, Homo sapiens
tgcagagagatcctcagggttt

SEQ ID NO: 7958673 - DNA, 22 bp, Homo sapiens
tgcagagagatatggcaagagg

SEQ ID NO: 7958674 - DNA, 22 bp, Homo sapiens
tgcagagagacccctgggccag

SEQ ID NO: 7958675 - DNA, 19 bp, Homo sapiens
tgcagagagaggcaaagaa

SEQ ID NO: 7958676 - DNA, 22 bp, Homo sapiens
tgcagagagacccctgggccag

SEQ ID NO: 7958677 - DNA, 22 bp, Homo sapiens
tgcagagaagaggacagttcta

SEQ ID NO: 7958678 - DNA, 22 bp, Homo sapiens
tgcagagaagaggacagttcta

SEQ ID NO: 7958679 - DNA, 22 bp, Homo sapiens
tgcagagaagaggacagttcta

SEQ ID NO: 7958680 - DNA, 22 bp, Homo sapiens
tgcagagaccactgtgccttcc

SEQ ID NO: 7958681 - DNA, 22 bp, Homo sapiens
tgcagagaagaggacagttcta

SEQ ID NO: 7958682 - DNA, 22 bp, Homo sapiens
tgcagagaaaccagtggaggac

SEQ ID NO: 7958683 - DNA, 22 bp, Homo sapiens
tgcagagaaagtgtagacaggc

SEQ ID NO: 7958684 - DNA, 22 bp, Homo sapiens
cccagagatgtcctgagtgata

SEQ ID NO: 7958685 - DNA, 22 bp, Homo sapiens
cccagagatgggaggtgatcgg

SEQ ID NO: 7958686 - DNA, 22 bp, Homo sapiens
cccagagatgggaggtgatcgg

SEQ ID NO: 7958687 - DNA, 22 bp, Homo sapiens
cccagagatgggaggtgatcgg

SEQ ID NO: 7958688 - DNA, 17 bp, Homo sapiens
cccagagatgctgcctt

SEQ ID NO: 7958689 - DNA, 22 bp, Homo sapiens
tgcagagagttagggcccgtat

SEQ ID NO: 7958690 - DNA, 22 bp, Homo sapiens
tgcagagagccctgccttcctc

SEQ ID NO: 7958691 - DNA, 22 bp, Homo sapiens
tgcagagagccctgccttcctc

SEQ ID NO: 7958692 - DNA, 22 bp, Homo sapiens
tgcagagagccagctctctcgg

SEQ ID NO: 7958693 - DNA, 16 bp, Homo sapiens
tgcagagagcatggtg

SEQ ID NO: 7958694 - DNA, 16 bp, Homo sapiens
tgcagagagcatggtg

SEQ ID NO: 7958695 - DNA, 22 bp, Homo sapiens
cccagagcctcattctgttggg

SEQ ID NO: 7958696 - DNA, 22 bp, Homo sapiens
cccagagctgagggggcacgtt

SEQ ID NO: 7958697 - DNA, 22 bp, Homo sapiens
cccagagctgagggggcacgtt

SEQ ID NO: 7958698 - DNA, 22 bp, Homo sapiens
cccagagctgagggggcacgtt

SEQ ID NO: 7958699 - DNA, 22 bp, Homo sapiens
cccagagctccggtcctgccca

SEQ ID NO: 7958700 - DNA, 22 bp, Homo sapiens
cccagagctccggtcctgccca

SEQ ID NO: 7958701 - DNA, 22 bp, Homo sapiens
cccagagctgggtgggcagcgg

SEQ ID NO: 7958702 - DNA, 22 bp, Homo sapiens
cccagagctgggtgggcagcgg

SEQ ID NO: 7958703 - DNA, 22 bp, Homo sapiens
cccagagctgggtgggcagcgg

SEQ ID NO: 7958704 - DNA, 22 bp, Homo sapiens
cccagagctgggtgggcagcgg

SEQ ID NO: 7958705 - DNA, 22 bp, Homo sapiens
cccagagctgagtctgatatat

SEQ ID NO: 7958706 - DNA, 22 bp, Homo sapiens
cccagagctgattgttggagcc

SEQ ID NO: 7958707 - DNA, 22 bp, Homo sapiens
cccagagctgattgttggagcc

SEQ ID NO: 7958708 - DNA, 18 bp, Homo sapiens
cccagaggaatgcctgga

SEQ ID NO: 7958709 - DNA, 18 bp, Homo sapiens
cccagaggaatgcctgga

SEQ ID NO: 7958710 - DNA, 18 bp, Homo sapiens
cccagaggaatgcctgga

SEQ ID NO: 7958711 - DNA, 19 bp, Homo sapiens
cccagaggaatgcctggaa

SEQ ID NO: 7958712 - DNA, 19 bp, Homo sapiens
cccagaggaatgcctggaa

SEQ ID NO: 7958713 - DNA, 23 bp, Homo sapiens
cccagaggagcagggcgtgagat

SEQ ID NO: 7958714 - DNA, 22 bp, Homo sapiens
cccagaggaggatctcggcccg

SEQ ID NO: 7958715 - DNA, 23 bp, Homo sapiens
cccagaggagcagggcgtgagat

SEQ ID NO: 7958716 - DNA, 23 bp, Homo sapiens
cccagaggagcagggcgtgagat

SEQ ID NO: 7958717 - DNA, 23 bp, Homo sapiens
cccagaggagcagggcgtgagat

SEQ ID NO: 7958718 - DNA, 23 bp, Homo sapiens
cccagaggagcagggcgtgagat

SEQ ID NO: 7958719 - DNA, 23 bp, Homo sapiens
cccagaggagcagggcgtgagat

SEQ ID NO: 7958720 - DNA, 23 bp, Homo sapiens
cccagaggagcagggcgtgagat

SEQ ID NO: 7958721 - DNA, 22 bp, Homo sapiens
tgcagggccttctagaccatgg

SEQ ID NO: 7958722 - DNA, 22 bp, Homo sapiens
tgcagggccttctagaccatgg

SEQ ID NO: 7958723 - DNA, 22 bp, Homo sapiens
tgcagggatcctagctgaagag

SEQ ID NO: 7958724 - DNA, 22 bp, Homo sapiens
tgcagggatcctagctgaagag

SEQ ID NO: 7958725 - DNA, 22 bp, Homo sapiens
tgcagggatcctagctgaagag

SEQ ID NO: 7958726 - DNA, 22 bp, Homo sapiens
tgcagggatcctagctgaagag

SEQ ID NO: 7958727 - DNA, 20 bp, Homo sapiens
tgcagggcctaaaaagggaa

SEQ ID NO: 7958728 - DNA, 22 bp, Homo sapiens
tgcagggccttgttgatgtgct

SEQ ID NO: 7958729 - DNA, 22 bp, Homo sapiens
tgcagggccttgttgatgtgct

SEQ ID NO: 7958730 - DNA, 22 bp, Homo sapiens
tgcagggctaagtcagagcctg

SEQ ID NO: 7958731 - DNA, 22 bp, Homo sapiens
tgcagggccttgttgatgtgct

SEQ ID NO: 7958732 - DNA, 22 bp, Homo sapiens
tgcagggctaagtcagagcctg

SEQ ID NO: 7958733 - DNA, 22 bp, Homo sapiens
tgcagggccttgttgatgtgct

SEQ ID NO: 7958734 - DNA, 22 bp, Homo sapiens
tgcagggccttgggatgtgtcc

SEQ ID NO: 7958735 - DNA, 22 bp, Homo sapiens
tgcagggccttgggatgtgtcc

SEQ ID NO: 7958736 - DNA, 22 bp, Homo sapiens
tgcagggccttgggatgtgtcc

SEQ ID NO: 7958737 - DNA, 22 bp, Homo sapiens
tgcagggccttgggatgtgtcc

SEQ ID NO: 7958738 - DNA, 22 bp, Homo sapiens
cccagcaggcatgttgggagga

SEQ ID NO: 7958739 - DNA, 22 bp, Homo sapiens
cccagcaggcatgttgggagga

SEQ ID NO: 7958740 - DNA, 22 bp, Homo sapiens
cccagcaggcatgttgggagga

SEQ ID NO: 7958741 - DNA, 22 bp, Homo sapiens
cccagcaggcatgttgggagga

SEQ ID NO: 7958742 - DNA, 22 bp, Homo sapiens
cccagcaggcatgttgggagga

SEQ ID NO: 7958743 - DNA, 22 bp, Homo sapiens
cccagcaggcatgttgggagga

SEQ ID NO: 7958744 - DNA, 22 bp, Homo sapiens
cccagcaggcatgttgggagga

SEQ ID NO: 7958745 - DNA, 22 bp, Homo sapiens
cccagcaggcatgttgggagga

SEQ ID NO: 7958746 - DNA, 22 bp, Homo sapiens
cccagcaggcatgttgggagga

SEQ ID NO: 7958747 - DNA, 22 bp, Homo sapiens
cccagcaggcatgttgggagga

SEQ ID NO: 7958748 - DNA, 22 bp, Homo sapiens
cccagcaggaggaggttgcagt

SEQ ID NO: 7958749 - DNA, 22 bp, Homo sapiens
cccagcaggaggaggttgcagt

SEQ ID NO: 7958750 - DNA, 22 bp, Homo sapiens
cccagcaggaggaggttgcagt

SEQ ID NO: 7958751 - DNA, 22 bp, Homo sapiens
cccagcaggaggaggttgcagt

SEQ ID NO: 7958752 - DNA, 22 bp, Homo sapiens
cccagcagcttgcacagtgctg

SEQ ID NO: 7958753 - DNA, 22 bp, Homo sapiens
cccagcaggaggaggttgcagt

SEQ ID NO: 7958754 - DNA, 22 bp, Homo sapiens
cccagcagcttgcacagtgctg

SEQ ID NO: 7958755 - DNA, 22 bp, Homo sapiens
cccagcagggtctctgtgtcta

SEQ ID NO: 7958756 - DNA, 22 bp, Homo sapiens
cccagcagggtctctgtgtcta

SEQ ID NO: 7958757 - DNA, 22 bp, Homo sapiens
cccagcagggtctctgtgtcta

SEQ ID NO: 7958758 - DNA, 22 bp, Homo sapiens
cccagcagggtctctgtgtcta

SEQ ID NO: 7958759 - DNA, 22 bp, Homo sapiens
cccagcagggtctctgtgtcta

SEQ ID NO: 7958760 - DNA, 22 bp, Homo sapiens
cccagcagggtctctgtgtcta

SEQ ID NO: 7958761 - DNA, 22 bp, Homo sapiens
cccagcagggtctctgtgtcta

SEQ ID NO: 7958762 - DNA, 22 bp, Homo sapiens
cccagcagggtctctgtgtcta

SEQ ID NO: 7958763 - DNA, 22 bp, Homo sapiens
cccagcaggtcggtgctgcctg

SEQ ID NO: 7958764 - DNA, 22 bp, Homo sapiens
cccagcaggtcggtgctgcctg

SEQ ID NO: 7958765 - DNA, 22 bp, Homo sapiens
cccagcaggtcggtgctgcctg

SEQ ID NO: 7958766 - DNA, 22 bp, Homo sapiens
cccagcaggtcggtgctgcctg

SEQ ID NO: 7958767 - DNA, 22 bp, Homo sapiens
cccagcaggtcggtgctgcctg

SEQ ID NO: 7958768 - DNA, 22 bp, Homo sapiens
cccagcaggtcggtgctgcctg

SEQ ID NO: 7958769 - DNA, 22 bp, Homo sapiens
cccagcaggtcggtgctgcctg

SEQ ID NO: 7958770 - DNA, 22 bp, Homo sapiens
tgcagggatcctagctgaagag

SEQ ID NO: 7958771 - DNA, 22 bp, Homo sapiens
tgcagggatcctagctgaagag

SEQ ID NO: 7958772 - DNA, 22 bp, Homo sapiens
cccagcaggtcggtgctgcctg

SEQ ID NO: 7958773 - DNA, 22 bp, Homo sapiens
cccagcagccttgtcccttctc

SEQ ID NO: 7958774 - DNA, 22 bp, Homo sapiens
cccagcagccttgtcccttctc

SEQ ID NO: 7958775 - DNA, 22 bp, Homo sapiens
cccagcagccttgtcccttctc

SEQ ID NO: 7958776 - DNA, 22 bp, Homo sapiens
cccagcagcctggatgttcttt

SEQ ID NO: 7958777 - DNA, 22 bp, Homo sapiens
cccagcagcctggatgttcttt

SEQ ID NO: 7958778 - DNA, 22 bp, Homo sapiens
cccagcagcctggatgttcttt

SEQ ID NO: 7958779 - DNA, 22 bp, Homo sapiens
cccagcagcctggatgttcttt

SEQ ID NO: 7958780 - DNA, 22 bp, Homo sapiens
cccagcagcctggatgttcttt

SEQ ID NO: 7958781 - DNA, 22 bp, Homo sapiens
cccagcagcctggatgttcttt

SEQ ID NO: 7958782 - DNA, 22 bp, Homo sapiens
cccagcagcttgcacagtgctg

SEQ ID NO: 7958783 - DNA, 22 bp, Homo sapiens
cccagcagcttgcacagtgctg

SEQ ID NO: 7958784 - DNA, 22 bp, Homo sapiens
cccagcagcttgcacagtgctg

SEQ ID NO: 7958785 - DNA, 22 bp, Homo sapiens
cccagcagcttgcacagtgctg

SEQ ID NO: 7958786 - DNA, 22 bp, Homo sapiens
cccagcagccttgtcccttctc

SEQ ID NO: 7958787 - DNA, 22 bp, Homo sapiens
cccagcagccttgtcccttctc

SEQ ID NO: 7958788 - DNA, 22 bp, Homo sapiens
cccagcagcttgcacagtgctg

SEQ ID NO: 7958789 - DNA, 22 bp, Homo sapiens
cccagcagcttgcacagtgctg

SEQ ID NO: 7958790 - DNA, 22 bp, Homo sapiens
cccagcagcttgcacagtgctg

SEQ ID NO: 7958791 - DNA, 22 bp, Homo sapiens
tgcaggccagggtagggactag

SEQ ID NO: 7958792 - DNA, 22 bp, Homo sapiens
tgcaggcccagtgtagaggctc

SEQ ID NO: 7958793 - DNA, 22 bp, Homo sapiens
tgcaggcccagtgtagaggctc

SEQ ID NO: 7958794 - DNA, 22 bp, Homo sapiens
tgcaggcccagtgtagaggctc

SEQ ID NO: 7958795 - DNA, 22 bp, Homo sapiens
tgcaggccggccctaggcctca

SEQ ID NO: 7958796 - DNA, 22 bp, Homo sapiens
tgcaggccggccctaggcctca

SEQ ID NO: 7958797 - DNA, 22 bp, Homo sapiens
tgcaggccggccctaggcctca

SEQ ID NO: 7958798 - DNA, 22 bp, Homo sapiens
tgcaggccggccctaggcctca

SEQ ID NO: 7958799 - DNA, 22 bp, Homo sapiens
tgcaggcccagtgtagaggctc

SEQ ID NO: 7958800 - DNA, 22 bp, Homo sapiens
tgcaggcccagtgtagaggctc

SEQ ID NO: 7958801 - DNA, 22 bp, Homo sapiens
tgcaggcctatggtggggcccc

SEQ ID NO: 7958802 - DNA, 22 bp, Homo sapiens
tgcaggcctatggtggggcccc

SEQ ID NO: 7958803 - DNA, 22 bp, Homo sapiens
tgcaggcctatggtggggcccc

SEQ ID NO: 7958804 - DNA, 22 bp, Homo sapiens
tgcaggccggccctaggcctca

SEQ ID NO: 7958805 - DNA, 22 bp, Homo sapiens
tgcaggcctcacacctggcacc

SEQ ID NO: 7958806 - DNA, 22 bp, Homo sapiens
tgcaggcctatggtggggcccc

SEQ ID NO: 7958807 - DNA, 22 bp, Homo sapiens
tgcaggcctcacacctggcacc

SEQ ID NO: 7958808 - DNA, 22 bp, Homo sapiens
tgcaggcaggggatgagcagcc

SEQ ID NO: 7958809 - DNA, 22 bp, Homo sapiens
tgcaggcaggggatgagcagcc

SEQ ID NO: 7958810 - DNA, 22 bp, Homo sapiens
tgcaggcagggccagcgtgagg

SEQ ID NO: 7958811 - DNA, 21 bp, Homo sapiens
tgcaggcaggcagagatgctg

SEQ ID NO: 7958812 - DNA, 22 bp, Homo sapiens
tgcaggagaaagtacggagcgt

SEQ ID NO: 7958813 - DNA, 22 bp, Homo sapiens
tgcaggagaaagtacggagcgt

SEQ ID NO: 7958814 - DNA, 22 bp, Homo sapiens
tgcaggagaaagtacggagcgt

SEQ ID NO: 7958815 - DNA, 21 bp, Homo sapiens
tgcaggcaggcagagatgctg

SEQ ID NO: 7958816 - DNA, 21 bp, Homo sapiens
tgcaggcaggcagagatgctg

SEQ ID NO: 7958817 - DNA, 21 bp, Homo sapiens
tgcaggcaggcagagatgctg

SEQ ID NO: 7958818 - DNA, 22 bp, Homo sapiens
tgcaggcataaccgatgttgat

SEQ ID NO: 7958819 - DNA, 22 bp, Homo sapiens
tgcaggcataaccgatgttgat

SEQ ID NO: 7958820 - DNA, 22 bp, Homo sapiens
tgcaggcattggtgagagaagc

SEQ ID NO: 7958821 - DNA, 22 bp, Homo sapiens
tgcaggcattggtgagagaagc

SEQ ID NO: 7958822 - DNA, 22 bp, Homo sapiens
tgcaggcagtaggccagctcca

SEQ ID NO: 7958823 - DNA, 22 bp, Homo sapiens
tgcaggcagtaggccagctcca

SEQ ID NO: 7958824 - DNA, 22 bp, Homo sapiens
tgcaggcagtaggccagctcca

SEQ ID NO: 7958825 - DNA, 22 bp, Homo sapiens
tgcaggcaggggatgagcagcc

SEQ ID NO: 7958826 - DNA, 22 bp, Homo sapiens
tgcaggcagtaggccagctcca

SEQ ID NO: 7958827 - DNA, 22 bp, Homo sapiens
tgcaggcaggggatgagcagcc

SEQ ID NO: 7958828 - DNA, 22 bp, Homo sapiens
tgcaggcaggggatgagcagcc

SEQ ID NO: 7958829 - DNA, 22 bp, Homo sapiens
tgcaggcaggggatgagcagcc

SEQ ID NO: 7958830 - DNA, 22 bp, Homo sapiens
tgcaggaatattgatgaactta

SEQ ID NO: 7958831 - DNA, 22 bp, Homo sapiens
tgcaggaatattgatgaactta

SEQ ID NO: 7958832 - DNA, 22 bp, Homo sapiens
tgcaggaatattgatgaactta

SEQ ID NO: 7958833 - DNA, 22 bp, Homo sapiens
tgcaggaatattgatgaactta

SEQ ID NO: 7958834 - DNA, 22 bp, Homo sapiens
tgcaggaatagctacagagctg

SEQ ID NO: 7958835 - DNA, 22 bp, Homo sapiens
tgcaggaatagctacagagctg

SEQ ID NO: 7958836 - DNA, 22 bp, Homo sapiens
tgcaggaatagctacagagctg

SEQ ID NO: 7958837 - DNA, 22 bp, Homo sapiens
tgcaggaagtttcctgaacttt

SEQ ID NO: 7958838 - DNA, 22 bp, Homo sapiens
tgcaggaatagctacagagctg

SEQ ID NO: 7958839 - DNA, 22 bp, Homo sapiens
tgcaggaagtttcctgaacttt

SEQ ID NO: 7958840 - DNA, 22 bp, Homo sapiens
tgcaggaatagctacagagctg

SEQ ID NO: 7958841 - DNA, 22 bp, Homo sapiens
tgcagctgctcattctctcagt

SEQ ID NO: 7958842 - DNA, 22 bp, Homo sapiens
tgcagctgctcattctctcagt

SEQ ID NO: 7958843 - DNA, 22 bp, Homo sapiens
tgcagctgctcattctctcagt

SEQ ID NO: 7958844 - DNA, 22 bp, Homo sapiens
tgcagctgctcattctctcagt

SEQ ID NO: 7958845 - DNA, 22 bp, Homo sapiens
tgcagctgcaggagggtgggag

SEQ ID NO: 7958846 - DNA, 22 bp, Homo sapiens
tgcagctgcaggagggtgggag

SEQ ID NO: 7958847 - DNA, 22 bp, Homo sapiens
tgcagctgcaggagggtgggag

SEQ ID NO: 7958848 - DNA, 22 bp, Homo sapiens
tgcagctgcaggagggtgggag

SEQ ID NO: 7958849 - DNA, 22 bp, Homo sapiens
tgcagctgcaggagggtgggag

SEQ ID NO: 7958850 - DNA, 22 bp, Homo sapiens
tgcagctgcaggagggtgggag

SEQ ID NO: 7958851 - DNA, 22 bp, Homo sapiens
tgcagctgcctagggctggctt

SEQ ID NO: 7958852 - DNA, 22 bp, Homo sapiens
tgcagctgcctagggctggctt

SEQ ID NO: 7958853 - DNA, 22 bp, Homo sapiens
tgcagctgcctagggctggctt

SEQ ID NO: 7958854 - DNA, 22 bp, Homo sapiens
tgcagctgcctagggctggctt

SEQ ID NO: 7958855 - DNA, 22 bp, Homo sapiens
tgcagctgcctagggctggctt

SEQ ID NO: 7958856 - DNA, 22 bp, Homo sapiens
tgcagctgcctccttcccttgt

SEQ ID NO: 7958857 - DNA, 22 bp, Homo sapiens
tgcagctgcctccttcccttgt

SEQ ID NO: 7958858 - DNA, 23 bp, Homo sapiens
tgcagctgcctctggcgggccgg

SEQ ID NO: 7958859 - DNA, 22 bp, Homo sapiens
tgcagctgcctagggctggctt

SEQ ID NO: 7958860 - DNA, 22 bp, Homo sapiens
tgcagctgcctagggctggctt

SEQ ID NO: 7958861 - DNA, 22 bp, Homo sapiens
tgcagctgcctagggctggctt

SEQ ID NO: 7958862 - DNA, 23 bp, Homo sapiens
tgcagctgcctctggcgggccgg

SEQ ID NO: 7958863 - DNA, 23 bp, Homo sapiens
tgcagctgcctctggcgggccgg

SEQ ID NO: 7958864 - DNA, 23 bp, Homo sapiens
tgcagctgcctctggcgggccgg

SEQ ID NO: 7958865 - DNA, 23 bp, Homo sapiens
tgcagctgcctctggcgggccgg

SEQ ID NO: 7958866 - DNA, 23 bp, Homo sapiens
tgcagctgcctctggcgggccgg

SEQ ID NO: 7958867 - DNA, 23 bp, Homo sapiens
tgcaggactactcgagcactgct

SEQ ID NO: 7958868 - DNA, 22 bp, Homo sapiens
tgcaggactcaagggtagcagg

SEQ ID NO: 7958869 - DNA, 22 bp, Homo sapiens
tgcaggactcaagggtagcagg

SEQ ID NO: 7958870 - DNA, 22 bp, Homo sapiens
tgcaggactgaaggagggctgg

SEQ ID NO: 7958871 - DNA, 22 bp, Homo sapiens
tgcaggactgaaggagggctgg

SEQ ID NO: 7958872 - DNA, 22 bp, Homo sapiens
tgcaggactggggagcggaagg

SEQ ID NO: 7958873 - DNA, 22 bp, Homo sapiens
tgcaggacttcaggactctgag

SEQ ID NO: 7958874 - DNA, 22 bp, Homo sapiens
tgcaggacttcaggactctgag

SEQ ID NO: 7958875 - DNA, 22 bp, Homo sapiens
tgcaggaccggaaccatgggat

SEQ ID NO: 7958876 - DNA, 22 bp, Homo sapiens
tgcaggacagtttggaagagag

SEQ ID NO: 7958877 - DNA, 22 bp, Homo sapiens
tgcaggacattagttatgaatt

SEQ ID NO: 7958878 - DNA, 23 bp, Homo sapiens
tgcaggactactcgagcactgct

SEQ ID NO: 7958879 - DNA, 23 bp, Homo sapiens
tgcaggactactcgagcactgct

SEQ ID NO: 7958880 - DNA, 23 bp, Homo sapiens
tgcaggactactcgagcactgct

SEQ ID NO: 7958881 - DNA, 22 bp, Homo sapiens
tgcaggaccttgatcctggact

SEQ ID NO: 7958882 - DNA, 22 bp, Homo sapiens
tgcaggaccttgatcctggact

SEQ ID NO: 7958883 - DNA, 20 bp, Homo sapiens
tgcaggacagagcctgtgtg

SEQ ID NO: 7958884 - DNA, 20 bp, Homo sapiens
tgcaggacagagcctgtgtg

SEQ ID NO: 7958885 - DNA, 22 bp, Homo sapiens
tgcaggaattttttgcagaaag

SEQ ID NO: 7958886 - DNA, 22 bp, Homo sapiens
tgcaggaattttttgcagaaag

SEQ ID NO: 7958887 - DNA, 22 bp, Homo sapiens
tgcaggaattttttgcagaaag

SEQ ID NO: 7958888 - DNA, 22 bp, Homo sapiens
tgcaggaattttttgcagaaag

SEQ ID NO: 7958889 - DNA, 22 bp, Homo sapiens
tgcaggaattttttgcagaaag

SEQ ID NO: 7958890 - DNA, 20 bp, Homo sapiens
tgcaggaatttgcattcctt

SEQ ID NO: 7958891 - DNA, 22 bp, Homo sapiens
tgcaggaatcagaggggaagcg

SEQ ID NO: 7958892 - DNA, 22 bp, Homo sapiens
tgcaggaatcagaggggaagcg

SEQ ID NO: 7958893 - DNA, 22 bp, Homo sapiens
tgcaggaatattgatgaactta

SEQ ID NO: 7958894 - DNA, 22 bp, Homo sapiens
tgcaggaatattgatgaactta

SEQ ID NO: 7958895 - DNA, 22 bp, Homo sapiens
tgcaggaatattgatgaactta

SEQ ID NO: 7958896 - DNA, 22 bp, Homo sapiens
tgcaggaatcagaggggaagcg

SEQ ID NO: 7958897 - DNA, 22 bp, Homo sapiens
tgcaggaatgaggttctcagtt

SEQ ID NO: 7958898 - DNA, 20 bp, Homo sapiens
tgcaggaatttgcattcctt

SEQ ID NO: 7958899 - DNA, 22 bp, Homo sapiens
tgcaggaatgaggttctcagtt

SEQ ID NO: 7958900 - DNA, 22 bp, Homo sapiens
cccagagggaagggaatgaggt

SEQ ID NO: 7958901 - DNA, 22 bp, Homo sapiens
cccagagggaagggaatgaggt

SEQ ID NO: 7958902 - DNA, 22 bp, Homo sapiens
cccagagggaagggaatgaggt

SEQ ID NO: 7958903 - DNA, 22 bp, Homo sapiens
cccagaggctgagttgggagca

SEQ ID NO: 7958904 - DNA, 22 bp, Homo sapiens
cccagaggctgagttgggagca

SEQ ID NO: 7958905 - DNA, 22 bp, Homo sapiens
cccagaggctgagttgggagca

SEQ ID NO: 7958906 - DNA, 22 bp, Homo sapiens
cccagaggctgagttgggagca

SEQ ID NO: 7958907 - DNA, 22 bp, Homo sapiens
cccagaggaggcaaagctctgt

SEQ ID NO: 7958908 - DNA, 22 bp, Homo sapiens
cccagaggaggcaaagctctgt

SEQ ID NO: 7958909 - DNA, 22 bp, Homo sapiens
cccagaggaggatctcggcccg

SEQ ID NO: 7958910 - DNA, 22 bp, Homo sapiens
cccagaggggtcgtctgagggg

SEQ ID NO: 7958911 - DNA, 22 bp, Homo sapiens
cccagagggctgaggatatgaa

SEQ ID NO: 7958912 - DNA, 22 bp, Homo sapiens
cccagaggggtcgtctgagggg

SEQ ID NO: 7958913 - DNA, 22 bp, Homo sapiens
cccagaggggtcgtctgagggg

SEQ ID NO: 7958914 - DNA, 22 bp, Homo sapiens
cccagaggggtcgtctgagggg

SEQ ID NO: 7958915 - DNA, 22 bp, Homo sapiens
cccagaggggtcgtctgagggg

SEQ ID NO: 7958916 - DNA, 22 bp, Homo sapiens
cccagaggggtcgtctgagggg

SEQ ID NO: 7958917 - DNA, 22 bp, Homo sapiens
cccagaggggtcgtctgagggg

SEQ ID NO: 7958918 - DNA, 22 bp, Homo sapiens
cccagaggggtcgtctgagggg

SEQ ID NO: 7958919 - DNA, 22 bp, Homo sapiens
cccagagggctgaggatatgaa

SEQ ID NO: 7958920 - DNA, 22 bp, Homo sapiens
cccagagggctgaggatatgaa

SEQ ID NO: 7958921 - DNA, 22 bp, Homo sapiens
cccagagggctgaggatatgaa

SEQ ID NO: 7958922 - DNA, 22 bp, Homo sapiens
cccagagggctgaggatatgaa

SEQ ID NO: 7958923 - DNA, 22 bp, Homo sapiens
cccagagggctgaggatatgaa

SEQ ID NO: 7958924 - DNA, 22 bp, Homo sapiens
cccagagggaagggaatgaggt

SEQ ID NO: 7958925 - DNA, 22 bp, Homo sapiens
cccagagggaagggaatgaggt

SEQ ID NO: 7958926 - DNA, 20 bp, Homo sapiens
tgcagctgcaggagggtggg

SEQ ID NO: 7958927 - DNA, 20 bp, Homo sapiens
tgcagctgcaggagggtggg

SEQ ID NO: 7958928 - DNA, 20 bp, Homo sapiens
tgcagctgcaggagggtggg

SEQ ID NO: 7958929 - DNA, 20 bp, Homo sapiens
tgcagctgcaggagggtggg

SEQ ID NO: 7958930 - DNA, 22 bp, Homo sapiens
tgcagctgcaggagggtgggag

SEQ ID NO: 7958931 - DNA, 20 bp, Homo sapiens
tgcagctgcaggagggtggg

SEQ ID NO: 7958932 - DNA, 20 bp, Homo sapiens
tgcagctgcaggagggtggg

SEQ ID NO: 7958933 - DNA, 20 bp, Homo sapiens
tgcagctgcaggagggtggg

SEQ ID NO: 7958934 - DNA, 22 bp, Homo sapiens
tgcagctgcaagtccaggtcag

SEQ ID NO: 7958935 - DNA, 22 bp, Homo sapiens
tgcagctgcaagtccaggtcag

SEQ ID NO: 7958936 - DNA, 22 bp, Homo sapiens
tgcagctgattaaagggcagac

SEQ ID NO: 7958937 - DNA, 22 bp, Homo sapiens
tgcagctgattaaagggcagac

SEQ ID NO: 7958938 - DNA, 22 bp, Homo sapiens
tgcagctgattaaagggcagac

SEQ ID NO: 7958939 - DNA, 22 bp, Homo sapiens
tgcagctgattaaagggcagac

SEQ ID NO: 7958940 - DNA, 22 bp, Homo sapiens
tgcagctgattaaagggcagac

SEQ ID NO: 7958941 - DNA, 22 bp, Homo sapiens
tgcagctgcaagtccaggtcag

SEQ ID NO: 7958942 - DNA, 22 bp, Homo sapiens
tgcagctgattaaagggcagac

SEQ ID NO: 7958943 - DNA, 22 bp, Homo sapiens
tgcagctgcaagtccaggtcag

SEQ ID NO: 7958944 - DNA, 22 bp, Homo sapiens
tgcagctgcaagtccaggtcag

SEQ ID NO: 7958945 - DNA, 22 bp, Homo sapiens
tgcagctgcaagtccaggtcag

SEQ ID NO: 7958946 - DNA, 22 bp, Homo sapiens
tgcagctgattaaagggcagac

SEQ ID NO: 7958947 - DNA, 22 bp, Homo sapiens
tgcagctgattaaagggcagac

SEQ ID NO: 7958948 - DNA, 19 bp, Homo sapiens
tgcagccacgtgagagact

SEQ ID NO: 7958949 - DNA, 22 bp, Homo sapiens
tgcagccaccacctctgctgaa

SEQ ID NO: 7958950 - DNA, 22 bp, Homo sapiens
tgcagccaccacctctgctgaa

SEQ ID NO: 7958951 - DNA, 22 bp, Homo sapiens
tgcagctgattaaagggcagac

SEQ ID NO: 7958952 - DNA, 22 bp, Homo sapiens
tgcagctgattaaagggcagac

SEQ ID NO: 7958953 - DNA, 22 bp, Homo sapiens
tgcagctgattaaagggcagac

SEQ ID NO: 7958954 - DNA, 22 bp, Homo sapiens
tgcagctgattaaagggcagac

SEQ ID NO: 7958955 - DNA, 22 bp, Homo sapiens
tgcagctgattaaagggcagac

SEQ ID NO: 7958956 - DNA, 22 bp, Homo sapiens
cccagagggtggaggttgcagt

SEQ ID NO: 7958957 - DNA, 22 bp, Homo sapiens
tgcagcattttataccatcatt

SEQ ID NO: 7958958 - DNA, 22 bp, Homo sapiens
tgcagccaattcattcattctt

SEQ ID NO: 7958959 - DNA, 22 bp, Homo sapiens
tgcagccacatgacctgggtct

SEQ ID NO: 7958960 - DNA, 22 bp, Homo sapiens
ccagtctgaggcctggtgaggg

SEQ ID NO: 7958961 - DNA, 22 bp, Homo sapiens
ccagtctgcagcccctggggac

SEQ ID NO: 7958962 - DNA, 22 bp, Homo sapiens
ccagtctgcagcccctggggac

SEQ ID NO: 7958963 - DNA, 22 bp, Homo sapiens
ccagtgcaggtgagcaccaggt

SEQ ID NO: 7958964 - DNA, 22 bp, Homo sapiens
ccagtgcaggtgagcaccaggt

SEQ ID NO: 7958965 - DNA, 22 bp, Homo sapiens
ccagtgcagtccccctgaactg

SEQ ID NO: 7958966 - DNA, 22 bp, Homo sapiens
ccagtgcaggtgagcaccaggt

SEQ ID NO: 7958967 - DNA, 22 bp, Homo sapiens
ccagtgcaggtgagcaccaggt

SEQ ID NO: 7958968 - DNA, 22 bp, Homo sapiens
ccagtgcaggtgagcaccaggt

SEQ ID NO: 7958969 - DNA, 22 bp, Homo sapiens
ccagtgcaggtgagcaccaggt

SEQ ID NO: 7958970 - DNA, 22 bp, Homo sapiens
tgagcccaggagtatgaggctg

SEQ ID NO: 7958971 - DNA, 22 bp, Homo sapiens
tgagcccaggagttggagaccg

SEQ ID NO: 7958972 - DNA, 22 bp, Homo sapiens
tgagcccaggagttggagaccg

SEQ ID NO: 7958973 - DNA, 22 bp, Homo sapiens
ccagtctgaggcctggtgaggg

SEQ ID NO: 7958974 - DNA, 22 bp, Homo sapiens
ccagtctgaggcctggtgaggg

SEQ ID NO: 7958975 - DNA, 23 bp, Homo sapiens
tgagcccaggaggtcaaggctgc

SEQ ID NO: 7958976 - DNA, 22 bp, Homo sapiens
tgagcccaggagtatgaggctg

SEQ ID NO: 7958977 - DNA, 22 bp, Homo sapiens
tgagcccaggaggcagaggttg

SEQ ID NO: 7958978 - DNA, 23 bp, Homo sapiens
tgagcccaggaggtcaaggctgc

SEQ ID NO: 7958979 - DNA, 22 bp, Homo sapiens
tgagcccaggaggcagaggttg

SEQ ID NO: 7958980 - DNA, 22 bp, Homo sapiens
tgagcccagcgtcccgttctgt

SEQ ID NO: 7958981 - DNA, 22 bp, Homo sapiens
tgagcccagaagcccactcggc

SEQ ID NO: 7958982 - DNA, 22 bp, Homo sapiens
tgagcccagaagcccactcggc

SEQ ID NO: 7958983 - DNA, 22 bp, Homo sapiens
tgagcccagagatctgagctat

SEQ ID NO: 7958984 - DNA, 22 bp, Homo sapiens
tgagcccagagcccttgtaggg

SEQ ID NO: 7958985 - DNA, 22 bp, Homo sapiens
tgagccagttcttcagatccat

SEQ ID NO: 7958986 - DNA, 22 bp, Homo sapiens
tgagccagtgtggtaaagctga

SEQ ID NO: 7958987 - DNA, 22 bp, Homo sapiens
tgagccagtggaagatggcagt

SEQ ID NO: 7958988 - DNA, 22 bp, Homo sapiens
tgagccagttcttcagatccat

SEQ ID NO: 7958989 - DNA, 22 bp, Homo sapiens
tgagccagttcttcagatccat

SEQ ID NO: 7958990 - DNA, 22 bp, Homo sapiens
tgagccagtgtggtaaagctga

SEQ ID NO: 7958991 - DNA, 22 bp, Homo sapiens
tgagccatgggactccaaggga

SEQ ID NO: 7958992 - DNA, 22 bp, Homo sapiens
tgagccatgggactccaaggga

SEQ ID NO: 7958993 - DNA, 22 bp, Homo sapiens
tgagccatgggactccaaggga

SEQ ID NO: 7958994 - DNA, 22 bp, Homo sapiens
tgagccatgggactccaaggga

SEQ ID NO: 7958995 - DNA, 22 bp, Homo sapiens
tgagccatgggactccaaggga

SEQ ID NO: 7958996 - DNA, 19 bp, Homo sapiens
ccagtcccatacaggagat

SEQ ID NO: 7958997 - DNA, 19 bp, Homo sapiens
ccagtcccatacaggagat

SEQ ID NO: 7958998 - DNA, 22 bp, Homo sapiens
tgagccagtggaagatggcagt

SEQ ID NO: 7958999 - DNA, 22 bp, Homo sapiens
ccagtcccatctctgtcgctta

SEQ ID NO: 7959000 - DNA, 22 bp, Homo sapiens
ccagtccatggattcccaaggt

SEQ ID NO: 7959001 - DNA, 22 bp, Homo sapiens
ccagtcccagctctgccatgct

SEQ ID NO: 7959002 - DNA, 22 bp, Homo sapiens
ccagtcccagctctgccatgct

SEQ ID NO: 7959003 - DNA, 22 bp, Homo sapiens
ccagtccatggattcccaaggt

SEQ ID NO: 7959004 - DNA, 22 bp, Homo sapiens
ccagtcccagctctgccatgct

SEQ ID NO: 7959005 - DNA, 22 bp, Homo sapiens
ccagtcccagctctgccatgct

SEQ ID NO: 7959006 - DNA, 22 bp, Homo sapiens
ccagtcccaggcagaaatccag

SEQ ID NO: 7959007 - DNA, 21 bp, Homo sapiens
ccagtgctacagctgcctgac

SEQ ID NO: 7959008 - DNA, 21 bp, Homo sapiens
ccagtgctacagctgcctgac

SEQ ID NO: 7959009 - DNA, 21 bp, Homo sapiens
ccagtgctacagctgcctgac

SEQ ID NO: 7959010 - DNA, 21 bp, Homo sapiens
ccagtgctacagctgcctgac

SEQ ID NO: 7959011 - DNA, 22 bp, Homo sapiens
ccagtgctaaggtagcctctgc

SEQ ID NO: 7959012 - DNA, 22 bp, Homo sapiens
ccagtgctaaggtagcctctgc

SEQ ID NO: 7959013 - DNA, 22 bp, Homo sapiens
ccagtgctaaggtagcctctgc

SEQ ID NO: 7959014 - DNA, 22 bp, Homo sapiens
ccagtgcttccaggaatacggt

SEQ ID NO: 7959015 - DNA, 22 bp, Homo sapiens
ccagtgctgaatgaggaggtct

SEQ ID NO: 7959016 - DNA, 22 bp, Homo sapiens
ccagtgctcttaaaggtcataa

SEQ ID NO: 7959017 - DNA, 22 bp, Homo sapiens
ccagtgctcattcaagtcctta

SEQ ID NO: 7959018 - DNA, 22 bp, Homo sapiens
ccagtgctcattcaagtcctta

SEQ ID NO: 7959019 - DNA, 22 bp, Homo sapiens
ccagtgctcttaaaggtcataa

SEQ ID NO: 7959020 - DNA, 22 bp, Homo sapiens
ccagtggacttctccctgtggt

SEQ ID NO: 7959021 - DNA, 22 bp, Homo sapiens
ccagtggacttctccctgtggt

SEQ ID NO: 7959022 - DNA, 22 bp, Homo sapiens
ccagtggacttctccctgtggt

SEQ ID NO: 7959023 - DNA, 22 bp, Homo sapiens
ccagtggaaatgtggtcaggat

SEQ ID NO: 7959024 - DNA, 22 bp, Homo sapiens
ccagtggacaatttctgaggaa

SEQ ID NO: 7959025 - DNA, 22 bp, Homo sapiens
ccagtggacaatttctgaggaa

SEQ ID NO: 7959026 - DNA, 22 bp, Homo sapiens
ccagtggaaatgtggtcaggat

SEQ ID NO: 7959027 - DNA, 22 bp, Homo sapiens
ccagtgcttctttgctagctgg

SEQ ID NO: 7959028 - DNA, 22 bp, Homo sapiens
ccagtggaattaaaaataagtg

SEQ ID NO: 7959029 - DNA, 22 bp, Homo sapiens
ccagtggacaatttctgaggaa

SEQ ID NO: 7959030 - DNA, 22 bp, Homo sapiens
tgaggcagtgctgggaagcctg

SEQ ID NO: 7959031 - DNA, 22 bp, Homo sapiens
ccagtggccatgcacgagcagc

SEQ ID NO: 7959032 - DNA, 22 bp, Homo sapiens
ccagtggagtttttatacccag

SEQ ID NO: 7959033 - DNA, 22 bp, Homo sapiens
ccagtggagtttttatacccag

SEQ ID NO: 7959034 - DNA, 22 bp, Homo sapiens
ccagtggccatgcacgagcagc

SEQ ID NO: 7959035 - DNA, 22 bp, Homo sapiens
tgaggcagtgctgggaagcctg

SEQ ID NO: 7959036 - DNA, 22 bp, Homo sapiens
ccagtgcataatcaatacagcc

SEQ ID NO: 7959037 - DNA, 22 bp, Homo sapiens
ccagtgcagtccccctgaactg

SEQ ID NO: 7959038 - DNA, 22 bp, Homo sapiens
ccagtgcagtccccctgaactg

SEQ ID NO: 7959039 - DNA, 22 bp, Homo sapiens
ccagtgcattgccgtgtctagg

SEQ ID NO: 7959040 - DNA, 22 bp, Homo sapiens
ccagtgcattgccgtgtctagg

SEQ ID NO: 7959041 - DNA, 22 bp, Homo sapiens
ccagtgcccagctgcccaggca

SEQ ID NO: 7959042 - DNA, 22 bp, Homo sapiens
ccagtgcccagtctccctggtc

SEQ ID NO: 7959043 - DNA, 22 bp, Homo sapiens
ccagtgcccagtctccctggtc

SEQ ID NO: 7959044 - DNA, 18 bp, Homo sapiens
ccagtgccaagagtggca

SEQ ID NO: 7959045 - DNA, 22 bp, Homo sapiens
ccagtgcccagctgcccaggca

SEQ ID NO: 7959046 - DNA, 22 bp, Homo sapiens
ccagtgcccagctgcccaggca

SEQ ID NO: 7959047 - DNA, 19 bp, Homo sapiens
ccagtgccggcgctgggga

SEQ ID NO: 7959048 - DNA, 22 bp, Homo sapiens
ccagtgcctatctcctctggga

SEQ ID NO: 7959049 - DNA, 22 bp, Homo sapiens
ccagtgcccagtctccctggtc

SEQ ID NO: 7959050 - DNA, 22 bp, Homo sapiens
ccagtgcccagtctccctggtc

SEQ ID NO: 7959051 - DNA, 22 bp, Homo sapiens
ccagtgcccagctgcccaggca

SEQ ID NO: 7959052 - DNA, 22 bp, Homo sapiens
ccagtgcccagtctccctggtc

SEQ ID NO: 7959053 - DNA, 19 bp, Homo sapiens
ccagtgccggcgctgggga

SEQ ID NO: 7959054 - DNA, 19 bp, Homo sapiens
ccagtgccggcgctgggga

SEQ ID NO: 7959055 - DNA, 17 bp, Homo sapiens
ccagtgcctgtggcaac

SEQ ID NO: 7959056 - DNA, 17 bp, Homo sapiens
ccagtgcctgtggcaac

SEQ ID NO: 7959057 - DNA, 22 bp, Homo sapiens
ccagtgcctatctcctctggga

SEQ ID NO: 7959058 - DNA, 22 bp, Homo sapiens
ccagtgcctatctcctctggga

SEQ ID NO: 7959059 - DNA, 17 bp, Homo sapiens
ccagtgcctgtggcaac

SEQ ID NO: 7959060 - DNA, 22 bp, Homo sapiens
ccagtgcctgtgggcatggtgc

SEQ ID NO: 7959061 - DNA, 22 bp, Homo sapiens
ccagtgcctgtgggcatggtgc

SEQ ID NO: 7959062 - DNA, 22 bp, Homo sapiens
ccagtgcctgtgggcatggtgc

SEQ ID NO: 7959063 - DNA, 22 bp, Homo sapiens
ccaggtggcttctgcccgatgt

SEQ ID NO: 7959064 - DNA, 22 bp, Homo sapiens
ccaggtgggaggaaagcagaga

SEQ ID NO: 7959065 - DNA, 22 bp, Homo sapiens
ccaggtgggaggaaagcagaga

SEQ ID NO: 7959066 - DNA, 17 bp, Homo sapiens
ccaggtgggaggtgggg

SEQ ID NO: 7959067 - DNA, 17 bp, Homo sapiens
ccaggtgggaggtgggg

SEQ ID NO: 7959068 - DNA, 22 bp, Homo sapiens
ccaggtgtgtcaccattgccca

SEQ ID NO: 7959069 - DNA, 17 bp, Homo sapiens
ccaggtgggaggtgggg

SEQ ID NO: 7959070 - DNA, 17 bp, Homo sapiens
ccaggtgggaggtgggg

SEQ ID NO: 7959071 - DNA, 22 bp, Homo sapiens
ccaggtggaggtgtgaggtcct

SEQ ID NO: 7959072 - DNA, 22 bp, Homo sapiens
tgagcagtcatccatttctcct

SEQ ID NO: 7959073 - DNA, 22 bp, Homo sapiens
tgagcagtcagacaagcatcac

SEQ ID NO: 7959074 - DNA, 22 bp, Homo sapiens
ccaggtggaggtgtgaggtcct

SEQ ID NO: 7959075 - DNA, 22 bp, Homo sapiens
ccagtcagttctgattatgtgg

SEQ ID NO: 7959076 - DNA, 20 bp, Homo sapiens
ccagtccaaattccttatga

SEQ ID NO: 7959077 - DNA, 22 bp, Homo sapiens
ccagtcattaagaacccttact

SEQ ID NO: 7959078 - DNA, 22 bp, Homo sapiens
ccagtcattaagaacccttact

SEQ ID NO: 7959079 - DNA, 20 bp, Homo sapiens
ccagtccacctgagacatgt

SEQ ID NO: 7959080 - DNA, 20 bp, Homo sapiens
ccagtccacctgagacatgt

SEQ ID NO: 7959081 - DNA, 20 bp, Homo sapiens
ccagtccaaattccttatga

SEQ ID NO: 7959082 - DNA, 20 bp, Homo sapiens
ccagtccacctgagacatgt

SEQ ID NO: 7959083 - DNA, 22 bp, Homo sapiens
ccagtccacgtcaagaagaggt

SEQ ID NO: 7959084 - DNA, 22 bp, Homo sapiens
ccagtccacgtcaagaagaggt

SEQ ID NO: 7959085 - DNA, 22 bp, Homo sapiens
ccagtccacgtcaagaagaggt

SEQ ID NO: 7959086 - DNA, 22 bp, Homo sapiens
ccagtccacgtcaagaagaggt

SEQ ID NO: 7959087 - DNA, 22 bp, Homo sapiens
ccagtccacgtcaagaagaggt

SEQ ID NO: 7959088 - DNA, 22 bp, Homo sapiens
ccagtccagtgccatgcatggc

SEQ ID NO: 7959089 - DNA, 22 bp, Homo sapiens
ccagtccatatttatactgccg

SEQ ID NO: 7959090 - DNA, 22 bp, Homo sapiens
ccagtcagagcagcgctcgcat

SEQ ID NO: 7959091 - DNA, 22 bp, Homo sapiens
ccagtcagccaagctgcagcgg

SEQ ID NO: 7959092 - DNA, 22 bp, Homo sapiens
ccagtcagccaagctgcagcgg

SEQ ID NO: 7959093 - DNA, 22 bp, Homo sapiens
ccagtcagccaagctgcagcgg

SEQ ID NO: 7959094 - DNA, 22 bp, Homo sapiens
ccagtcagagaaaatgtccact

SEQ ID NO: 7959095 - DNA, 22 bp, Homo sapiens
ccaggtgtgtcaccattgccca

SEQ ID NO: 7959096 - DNA, 22 bp, Homo sapiens
ccagtcactggaaaatgggaat

SEQ ID NO: 7959097 - DNA, 22 bp, Homo sapiens
ccagtcagggcaggagcctggt

SEQ ID NO: 7959098 - DNA, 22 bp, Homo sapiens
ccagtcagggcaggagcctggt

SEQ ID NO: 7959099 - DNA, 22 bp, Homo sapiens
ccagtcagggcaggagcctggt

SEQ ID NO: 7959100 - DNA, 22 bp, Homo sapiens
ccagtcagtcagttgctggcat

SEQ ID NO: 7959101 - DNA, 22 bp, Homo sapiens
ccagtcagtcagttgctggcat

SEQ ID NO: 7959102 - DNA, 22 bp, Homo sapiens
ccagtcagtcagttgctggcat

SEQ ID NO: 7959103 - DNA, 22 bp, Homo sapiens
ccagtcagtcagttgctggcat

SEQ ID NO: 7959104 - DNA, 22 bp, Homo sapiens
ccagtcagtcagttgctggcat

SEQ ID NO: 7959105 - DNA, 22 bp, Homo sapiens
ccagtcagggcaggagcctggt

SEQ ID NO: 7959106 - DNA, 22 bp, Homo sapiens
ccagtcagggcaggagcctggt

SEQ ID NO: 7959107 - DNA, 22 bp, Homo sapiens
ccagtcagccaagctgcagcgg

SEQ ID NO: 7959108 - DNA, 22 bp, Homo sapiens
ccagtcagggcaggagcctggt

SEQ ID NO: 7959109 - DNA, 22 bp, Homo sapiens
tgagcaggtcaggaagtacatt

SEQ ID NO: 7959110 - DNA, 22 bp, Homo sapiens
tgagcaggtcaggaagtacatt

SEQ ID NO: 7959111 - DNA, 22 bp, Homo sapiens
tgagcaggtcaggaagtacatt

SEQ ID NO: 7959112 - DNA, 22 bp, Homo sapiens
tgagcaggtcaggaagtacatt

SEQ ID NO: 7959113 - DNA, 22 bp, Homo sapiens
tgagcaggtgagtctagggcag

SEQ ID NO: 7959114 - DNA, 22 bp, Homo sapiens
tgagcaggtgagtctagggcag

SEQ ID NO: 7959115 - DNA, 22 bp, Homo sapiens
tgagcaggtgagtctagggcag

SEQ ID NO: 7959116 - DNA, 22 bp, Homo sapiens
tgagcaggtgagtctagggcag

SEQ ID NO: 7959117 - DNA, 22 bp, Homo sapiens
tgagcaggtgagtctagggcag

SEQ ID NO: 7959118 - DNA, 22 bp, Homo sapiens
tgagcaggtcaagactccagct

SEQ ID NO: 7959119 - DNA, 18 bp, Homo sapiens
tgagcaggggctgacctt

SEQ ID NO: 7959120 - DNA, 22 bp, Homo sapiens
tgagcaggtcaagactccagct

SEQ ID NO: 7959121 - DNA, 22 bp, Homo sapiens
tgagcaggtcaagactccagct

SEQ ID NO: 7959122 - DNA, 18 bp, Homo sapiens
tgagcaggggctgacctt

SEQ ID NO: 7959123 - DNA, 18 bp, Homo sapiens
tgagcaggggctgacctt

SEQ ID NO: 7959124 - DNA, 18 bp, Homo sapiens
tgagcaggggctgacctt

SEQ ID NO: 7959125 - DNA, 18 bp, Homo sapiens
tgagcaggggctgacctt

SEQ ID NO: 7959126 - DNA, 21 bp, Homo sapiens
tgagcaggtgcagggaagtgg

SEQ ID NO: 7959127 - DNA, 21 bp, Homo sapiens
tgagcaggtgcagggaagtgg

SEQ ID NO: 7959128 - DNA, 21 bp, Homo sapiens
tgagcaggtgctgcttttatg

SEQ ID NO: 7959129 - DNA, 21 bp, Homo sapiens
tgagcaggtgcagggaagtgg

SEQ ID NO: 7959130 - DNA, 21 bp, Homo sapiens
tgagcaggtgcagggaagtgg

SEQ ID NO: 7959131 - DNA, 21 bp, Homo sapiens
tgagcaggtgcagggaagtgg

SEQ ID NO: 7959132 - DNA, 22 bp, Homo sapiens
tgagcaggtgagtctagggcag

SEQ ID NO: 7959133 - DNA, 22 bp, Homo sapiens
tgagcagtaacagctcacaggg

SEQ ID NO: 7959134 - DNA, 22 bp, Homo sapiens
tgagcagtaacagctcacaggg

SEQ ID NO: 7959135 - DNA, 22 bp, Homo sapiens
tgagcagtaacagctcacaggg

SEQ ID NO: 7959136 - DNA, 21 bp, Homo sapiens
tgagcaggtgctgcttttatg

SEQ ID NO: 7959137 - DNA, 17 bp, Homo sapiens
tgagcagtagaagatgc

SEQ ID NO: 7959138 - DNA, 22 bp, Homo sapiens
tgagcagtaggtctgaatagtg

SEQ ID NO: 7959139 - DNA, 17 bp, Homo sapiens
tgagcagtagaagatgc

SEQ ID NO: 7959140 - DNA, 22 bp, Homo sapiens
tgagcagagacttcaagggcag

SEQ ID NO: 7959141 - DNA, 22 bp, Homo sapiens
tgagcagggagctgggctgagc

SEQ ID NO: 7959142 - DNA, 22 bp, Homo sapiens
tgagcagggagctgggctgagc

SEQ ID NO: 7959143 - DNA, 22 bp, Homo sapiens
tgagcaggggagagcgaatgtg

SEQ ID NO: 7959144 - DNA, 22 bp, Homo sapiens
tgagcaggggagagcgaatgtg

SEQ ID NO: 7959145 - DNA, 22 bp, Homo sapiens
ccagggctgctgtgggactcca

SEQ ID NO: 7959146 - DNA, 22 bp, Homo sapiens
ccagggctgctgtgggactcca

SEQ ID NO: 7959147 - DNA, 22 bp, Homo sapiens
tgagcagagacgggggcctcca

SEQ ID NO: 7959148 - DNA, 22 bp, Homo sapiens
ccagggctgctgtgggactcca

SEQ ID NO: 7959149 - DNA, 22 bp, Homo sapiens
ccagggctgctgtgggactcca

SEQ ID NO: 7959150 - DNA, 22 bp, Homo sapiens
ccagggctgctgtgggactcca

SEQ ID NO: 7959151 - DNA, 22 bp, Homo sapiens
ccagggctgctgggggagttga

SEQ ID NO: 7959152 - DNA, 22 bp, Homo sapiens
ccagggctgctgtgggactcca

SEQ ID NO: 7959153 - DNA, 22 bp, Homo sapiens
ccagggctgctcattggctggt

SEQ ID NO: 7959154 - DNA, 22 bp, Homo sapiens
ccagggctgctcattggctggt

SEQ ID NO: 7959155 - DNA, 22 bp, Homo sapiens
ccagggctgcctggccgtgtgt

SEQ ID NO: 7959156 - DNA, 22 bp, Homo sapiens
ccagggctgcctggccgtgtgt

SEQ ID NO: 7959157 - DNA, 22 bp, Homo sapiens
ccagggctgcctggccgtgtgt

SEQ ID NO: 7959158 - DNA, 22 bp, Homo sapiens
ccagggctgcctggccgtgtgt

SEQ ID NO: 7959159 - DNA, 22 bp, Homo sapiens
ccagggctgctcattggctggt

SEQ ID NO: 7959160 - DNA, 22 bp, Homo sapiens
ccagggctgctcattggctggt

SEQ ID NO: 7959161 - DNA, 22 bp, Homo sapiens
ccagggctgctcattggctggt

SEQ ID NO: 7959162 - DNA, 22 bp, Homo sapiens
ccagggctgctcattggctggt

SEQ ID NO: 7959163 - DNA, 22 bp, Homo sapiens
ccagggctgctgggggagttga

SEQ ID NO: 7959164 - DNA, 22 bp, Homo sapiens
ccagggctgctgggggagttga

SEQ ID NO: 7959165 - DNA, 22 bp, Homo sapiens
ccagggctgctgggggagttga

SEQ ID NO: 7959166 - DNA, 22 bp, Homo sapiens
ccagggctgctgggggagttga

SEQ ID NO: 7959167 - DNA, 22 bp, Homo sapiens
ccagggctgctgggggagttga

SEQ ID NO: 7959168 - DNA, 22 bp, Homo sapiens
tgagtccattctgttttcctgg

SEQ ID NO: 7959169 - DNA, 22 bp, Homo sapiens
tgagtccattgatggatagtga

SEQ ID NO: 7959170 - DNA, 22 bp, Homo sapiens
tgagtccatcgcagggaagtgg

SEQ ID NO: 7959171 - DNA, 22 bp, Homo sapiens
tgagtccatgtggaggggaggt

SEQ ID NO: 7959172 - DNA, 22 bp, Homo sapiens
tgagtccatagtggatccttca

SEQ ID NO: 7959173 - DNA, 22 bp, Homo sapiens
tgagtccatagtggatccttca

SEQ ID NO: 7959174 - DNA, 22 bp, Homo sapiens
tgagtccatagtggatccttca

SEQ ID NO: 7959175 - DNA, 22 bp, Homo sapiens
tgagtctaggtagagaaatgca

SEQ ID NO: 7959176 - DNA, 23 bp, Homo sapiens
tgagtctactcaccacaactggg

SEQ ID NO: 7959177 - DNA, 22 bp, Homo sapiens
tgagtctaggacaagttcagga

SEQ ID NO: 7959178 - DNA, 22 bp, Homo sapiens
tgagtctgctcctggtagcaga

SEQ ID NO: 7959179 - DNA, 22 bp, Homo sapiens
tgagtctgctcctggtagcaga

SEQ ID NO: 7959180 - DNA, 22 bp, Homo sapiens
tgagtctgatttttctagcatt

SEQ ID NO: 7959181 - DNA, 21 bp, Homo sapiens
tgagtctctcagcttcaggta

SEQ ID NO: 7959182 - DNA, 21 bp, Homo sapiens
tgagtctcccttagcccacgc

SEQ ID NO: 7959183 - DNA, 22 bp, Homo sapiens
tgagtttaattggagcctgaat

SEQ ID NO: 7959184 - DNA, 22 bp, Homo sapiens
tgagttgctatctagatccaga

SEQ ID NO: 7959185 - DNA, 19 bp, Homo sapiens
tgagttctgtggttctcaa

SEQ ID NO: 7959186 - DNA, 22 bp, Homo sapiens
tgagttgaaagactgacttctg

SEQ ID NO: 7959187 - DNA, 22 bp, Homo sapiens
tgagttctttccgttaggtatg

SEQ ID NO: 7959188 - DNA, 22 bp, Homo sapiens
tgagttcttcacattacctacg

SEQ ID NO: 7959189 - DNA, 22 bp, Homo sapiens
tgataaatccatgtaaatggta

SEQ ID NO: 7959190 - DNA, 22 bp, Homo sapiens
tgataaatccatgtaaatggta

SEQ ID NO: 7959191 - DNA, 22 bp, Homo sapiens
tgataaacttagaaagaatgtt

SEQ ID NO: 7959192 - DNA, 22 bp, Homo sapiens
tgagttttttcaacatatgaag

SEQ ID NO: 7959193 - DNA, 22 bp, Homo sapiens
tgagttttttcaacatatgaag

SEQ ID NO: 7959194 - DNA, 22 bp, Homo sapiens
tgagttttgtcttgctagaagt

SEQ ID NO: 7959195 - DNA, 22 bp, Homo sapiens
tgagtccaccttagtatatggg

SEQ ID NO: 7959196 - DNA, 22 bp, Homo sapiens
tgagtccaccttagtatatggg

SEQ ID NO: 7959197 - DNA, 22 bp, Homo sapiens
tgagtccactttaaaatgtcag

SEQ ID NO: 7959198 - DNA, 22 bp, Homo sapiens
tgagtccagatgggccagcagg

SEQ ID NO: 7959199 - DNA, 20 bp, Homo sapiens
tgagtccagattttgcttta

SEQ ID NO: 7959200 - DNA, 22 bp, Homo sapiens
tgagtccagatgggccagcagg

SEQ ID NO: 7959201 - DNA, 22 bp, Homo sapiens
tgagtcagtgacatgaacttgt

SEQ ID NO: 7959202 - DNA, 22 bp, Homo sapiens
tgagtcagtgacatgaacttgt

SEQ ID NO: 7959203 - DNA, 22 bp, Homo sapiens
tgagtccaaatcccttctctga

SEQ ID NO: 7959204 - DNA, 22 bp, Homo sapiens
tgagtccaagagccagtgggaa

SEQ ID NO: 7959205 - DNA, 22 bp, Homo sapiens
tgagtccaagagccagtgggaa

SEQ ID NO: 7959206 - DNA, 22 bp, Homo sapiens
ccatcctgcaggacctccatat

SEQ ID NO: 7959207 - DNA, 22 bp, Homo sapiens
ccatcctgcattgctattcaga

SEQ ID NO: 7959208 - DNA, 22 bp, Homo sapiens
tgaggtcatggctgatatttcc

SEQ ID NO: 7959209 - DNA, 22 bp, Homo sapiens
tgaggtcctgcatgttgaggtc

SEQ ID NO: 7959210 - DNA, 19 bp, Homo sapiens
tgaggtctacatgggcatc

SEQ ID NO: 7959211 - DNA, 19 bp, Homo sapiens
tgaggtctacatgggcatc

SEQ ID NO: 7959212 - DNA, 22 bp, Homo sapiens
tgagtcagccagagctgccatg

SEQ ID NO: 7959213 - DNA, 20 bp, Homo sapiens
tgagtcagctgcatgggtgg

SEQ ID NO: 7959214 - DNA, 22 bp, Homo sapiens
tgagtcagtctgccctggcttc

SEQ ID NO: 7959215 - DNA, 22 bp, Homo sapiens
ccatccaggctgtgggtgagct

SEQ ID NO: 7959216 - DNA, 22 bp, Homo sapiens
ccatccagaccagtccatgggt

SEQ ID NO: 7959217 - DNA, 22 bp, Homo sapiens
ccatccatgaacgaggaagtgg

SEQ ID NO: 7959218 - DNA, 21 bp, Homo sapiens
ccatccatctccctttgctgg

SEQ ID NO: 7959219 - DNA, 22 bp, Homo sapiens
ccatccatatggtgacaaggtg

SEQ ID NO: 7959220 - DNA, 22 bp, Homo sapiens
ccatccatgtggcagggctggc

SEQ ID NO: 7959221 - DNA, 22 bp, Homo sapiens
ccatccatggtgttggttgtat

SEQ ID NO: 7959222 - DNA, 22 bp, Homo sapiens
ccatccatgcgccagacagatt

SEQ ID NO: 7959223 - DNA, 19 bp, Homo sapiens
ccatccatggggccagagg

SEQ ID NO: 7959224 - DNA, 22 bp, Homo sapiens
ccatccattttcttgcttgcct

SEQ ID NO: 7959225 - DNA, 22 bp, Homo sapiens
ccatccatgtggcagggctggc

SEQ ID NO: 7959226 - DNA, 22 bp, Homo sapiens
ccatccctcctccaccagctag

SEQ ID NO: 7959227 - DNA, 22 bp, Homo sapiens
ccatccctcctactcacagtca

SEQ ID NO: 7959228 - DNA, 22 bp, Homo sapiens
ccatcccttctctggccagcag

SEQ ID NO: 7959229 - DNA, 22 bp, Homo sapiens
ccatcccttctctggccagcag

SEQ ID NO: 7959230 - DNA, 22 bp, Homo sapiens
ccatcccttcaccacagcagta

SEQ ID NO: 7959231 - DNA, 22 bp, Homo sapiens
ccatcccttctctggccagcag

SEQ ID NO: 7959232 - DNA, 22 bp, Homo sapiens
ccatcccttctctggccagcag

SEQ ID NO: 7959233 - DNA, 22 bp, Homo sapiens
ccatcctgaatggtctcagcca

SEQ ID NO: 7959234 - DNA, 22 bp, Homo sapiens
ccatcctgaatggtctcagcca

SEQ ID NO: 7959235 - DNA, 22 bp, Homo sapiens
ccatcctgaatggtctcagcca

SEQ ID NO: 7959236 - DNA, 22 bp, Homo sapiens
ccatcccttctctggccagcag

SEQ ID NO: 7959237 - DNA, 22 bp, Homo sapiens
ccatccctgggccatgtcccct

SEQ ID NO: 7959238 - DNA, 22 bp, Homo sapiens
ccatccctgggccatgtcccct

SEQ ID NO: 7959239 - DNA, 22 bp, Homo sapiens
ccatccctgccattatagccca

SEQ ID NO: 7959240 - DNA, 22 bp, Homo sapiens
ccatccctgggccatgtcccct

SEQ ID NO: 7959241 - DNA, 22 bp, Homo sapiens
ccatccctcctccaccagctag

SEQ ID NO: 7959242 - DNA, 22 bp, Homo sapiens
ccatccctgccattatagccca

SEQ ID NO: 7959243 - DNA, 22 bp, Homo sapiens
ccatccctgagtcacaggaggg

SEQ ID NO: 7959244 - DNA, 22 bp, Homo sapiens
ccatccctgagtcacaggaggg

SEQ ID NO: 7959245 - DNA, 22 bp, Homo sapiens
tgaggccatggaactagcttgg

SEQ ID NO: 7959246 - DNA, 22 bp, Homo sapiens
tgaggccatggaactagcttgg

SEQ ID NO: 7959247 - DNA, 17 bp, Homo sapiens
tgaggccatggcaccat

SEQ ID NO: 7959248 - DNA, 17 bp, Homo sapiens
tgaggccatggcaccat

SEQ ID NO: 7959249 - DNA, 22 bp, Homo sapiens
tgaggccatggaactagcttgg

SEQ ID NO: 7959250 - DNA, 22 bp, Homo sapiens
tgaggccatgcccgtgccggcc

SEQ ID NO: 7959251 - DNA, 22 bp, Homo sapiens
tgaggccatgcccgtgccggcc

SEQ ID NO: 7959252 - DNA, 17 bp, Homo sapiens
tgaggccatggcaccat

SEQ ID NO: 7959253 - DNA, 17 bp, Homo sapiens
tgaggccatggcaccat

SEQ ID NO: 7959254 - DNA, 17 bp, Homo sapiens
tgaggccatggcaccat

SEQ ID NO: 7959255 - DNA, 22 bp, Homo sapiens
tgaggccatggtcttcccagtc

SEQ ID NO: 7959256 - DNA, 22 bp, Homo sapiens
tgaggccatggtcttcccagtc

SEQ ID NO: 7959257 - DNA, 20 bp, Homo sapiens
tgaggcccagcagagtcggg

SEQ ID NO: 7959258 - DNA, 22 bp, Homo sapiens
tgaggccaggcaaaggcgatct

SEQ ID NO: 7959259 - DNA, 22 bp, Homo sapiens
tgaggccaggcaaaggcgatct

SEQ ID NO: 7959260 - DNA, 22 bp, Homo sapiens
tgaggcagtgtgagataataaa

SEQ ID NO: 7959261 - DNA, 22 bp, Homo sapiens
tgaggccaggcaaaggcgatct

SEQ ID NO: 7959262 - DNA, 22 bp, Homo sapiens
tgaggccagggattccatcatt

SEQ ID NO: 7959263 - DNA, 22 bp, Homo sapiens
tgaggccagggattccatcatt

SEQ ID NO: 7959264 - DNA, 22 bp, Homo sapiens
tgaggccagggattccatcatt

SEQ ID NO: 7959265 - DNA, 22 bp, Homo sapiens
tgaggccagggattccatcatt

SEQ ID NO: 7959266 - DNA, 22 bp, Homo sapiens
tgaggccagtgacatatattaa

SEQ ID NO: 7959267 - DNA, 22 bp, Homo sapiens
tgaggccatgcccgtgccggcc

SEQ ID NO: 7959268 - DNA, 22 bp, Homo sapiens
tgaggccagtctcatcacaggc

SEQ ID NO: 7959269 - DNA, 22 bp, Homo sapiens
tgaggccagtgacatatattaa

SEQ ID NO: 7959270 - DNA, 22 bp, Homo sapiens
tgaggccagtctcatcacaggc

SEQ ID NO: 7959271 - DNA, 22 bp, Homo sapiens
tgaggccagtctcatcacaggc

SEQ ID NO: 7959272 - DNA, 22 bp, Homo sapiens
tgaggctgacaaaagatgaggt

SEQ ID NO: 7959273 - DNA, 22 bp, Homo sapiens
tgaggctgacaaaagatgaggt

SEQ ID NO: 7959274 - DNA, 22 bp, Homo sapiens
tgaggctgacaaaagatgaggt

SEQ ID NO: 7959275 - DNA, 22 bp, Homo sapiens
tgaggctgacaaaagatgaggt

SEQ ID NO: 7959276 - DNA, 22 bp, Homo sapiens
tgaggctgacaaaagatgaggt

SEQ ID NO: 7959277 - DNA, 18 bp, Homo sapiens
tgaggctgaatatggggc

SEQ ID NO: 7959278 - DNA, 18 bp, Homo sapiens
tgaggctgaatatggggc

SEQ ID NO: 7959279 - DNA, 18 bp, Homo sapiens
tgaggctgaatatggggc

SEQ ID NO: 7959280 - DNA, 22 bp, Homo sapiens
tgaggctgacaaaagatgaggt

SEQ ID NO: 7959281 - DNA, 22 bp, Homo sapiens
tgaggctgacaaaagatgaggt

SEQ ID NO: 7959282 - DNA, 22 bp, Homo sapiens
tgaggctgagatatcagggagg

SEQ ID NO: 7959283 - DNA, 22 bp, Homo sapiens
tgaggctgagatatcagggagg

SEQ ID NO: 7959284 - DNA, 22 bp, Homo sapiens
tgaggctgagatatcagggagg

SEQ ID NO: 7959285 - DNA, 22 bp, Homo sapiens
tgaggctgaaactggcgataga

SEQ ID NO: 7959286 - DNA, 22 bp, Homo sapiens
tgaggctgaaactggcgataga

SEQ ID NO: 7959287 - DNA, 22 bp, Homo sapiens
tgaggctgaaactggcgataga

SEQ ID NO: 7959288 - DNA, 22 bp, Homo sapiens
tgaggccccgaagctgaggttt

SEQ ID NO: 7959289 - DNA, 22 bp, Homo sapiens
tgaggccccgaagctgaggttt

SEQ ID NO: 7959290 - DNA, 22 bp, Homo sapiens
tgaggcccaccttggccccggc

SEQ ID NO: 7959291 - DNA, 20 bp, Homo sapiens
tgaggcccagcagagtcggg

SEQ ID NO: 7959292 - DNA, 22 bp, Homo sapiens
tgaggcccagccgccctgagag

SEQ ID NO: 7959293 - DNA, 22 bp, Homo sapiens
tgaggcccagccgccctgagag

SEQ ID NO: 7959294 - DNA, 22 bp, Homo sapiens
tgaggcccatctgagattttga

SEQ ID NO: 7959295 - DNA, 22 bp, Homo sapiens
tgaggcccagccgccctgagag

SEQ ID NO: 7959296 - DNA, 18 bp, Homo sapiens
tgaggcccatctctctga

SEQ ID NO: 7959297 - DNA, 22 bp, Homo sapiens
ccatcagctccagtatcttctg

SEQ ID NO: 7959298 - DNA, 22 bp, Homo sapiens
ccatcagcatgggagcatgggc

SEQ ID NO: 7959299 - DNA, 22 bp, Homo sapiens
ccatcagctccagtatcttctg

SEQ ID NO: 7959300 - DNA, 22 bp, Homo sapiens
ccatcagtggcaaataaacacc

SEQ ID NO: 7959301 - DNA, 22 bp, Homo sapiens
ccatcagttctcagaccacact

SEQ ID NO: 7959302 - DNA, 23 bp, Homo sapiens
ccatcaggcctccgtgtccagcc

SEQ ID NO: 7959303 - DNA, 22 bp, Homo sapiens
ccatcagtgaaggagacagatt

SEQ ID NO: 7959304 - DNA, 23 bp, Homo sapiens
ccatcaggcctccgtgtccagcc

SEQ ID NO: 7959305 - DNA, 22 bp, Homo sapiens
ccatccacagtcttgattattt

SEQ ID NO: 7959306 - DNA, 22 bp, Homo sapiens
ccatcattatcactgacaacct

SEQ ID NO: 7959307 - DNA, 22 bp, Homo sapiens
ccatcagttttatctgacaaaa

SEQ ID NO: 7959308 - DNA, 22 bp, Homo sapiens
ccatccagaagggtttgaaaga

SEQ ID NO: 7959309 - DNA, 22 bp, Homo sapiens
ccatccagaagggtttgaaaga

SEQ ID NO: 7959310 - DNA, 21 bp, Homo sapiens
ccatccactgagtggttccct

SEQ ID NO: 7959311 - DNA, 22 bp, Homo sapiens
ccatccagaaacttccatcccc

SEQ ID NO: 7959312 - DNA, 18 bp, Homo sapiens
ccatcaccctaactagtg

SEQ ID NO: 7959313 - DNA, 22 bp, Homo sapiens
ccatcacagtccccatcgtgat

SEQ ID NO: 7959314 - DNA, 22 bp, Homo sapiens
ccatcagacaattctttctctt

SEQ ID NO: 7959315 - DNA, 22 bp, Homo sapiens
ccatcactcatctagatattta

SEQ ID NO: 7959316 - DNA, 22 bp, Homo sapiens
ccatcagagggctgctctgcaa

SEQ ID NO: 7959317 - DNA, 19 bp, Homo sapiens
ccatataaccagcaagtgt

SEQ ID NO: 7959318 - DNA, 19 bp, Homo sapiens
ccatataaccagcaagtgt

SEQ ID NO: 7959319 - DNA, 22 bp, Homo sapiens
ccatatttgcttcttgctgata

SEQ ID NO: 7959320 - DNA, 22 bp, Homo sapiens
ccatatcagaagattgtcaccc

SEQ ID NO: 7959321 - DNA, 22 bp, Homo sapiens
ccatcacagtccccatcgtgat

SEQ ID NO: 7959322 - DNA, 22 bp, Homo sapiens
ccatcacagtccccatcgtgat

SEQ ID NO: 7959323 - DNA, 22 bp, Homo sapiens
ccatcacagtccccatcgtgat

SEQ ID NO: 7959324 - DNA, 22 bp, Homo sapiens
ccatatttgcttcttgctgata

SEQ ID NO: 7959325 - DNA, 22 bp, Homo sapiens
ccatcaatgactaataaaatag

SEQ ID NO: 7959326 - DNA, 17 bp, Homo sapiens
ccatactgacatattga

SEQ ID NO: 7959327 - DNA, 22 bp, Homo sapiens
ccatagaactctgaggccagag

SEQ ID NO: 7959328 - DNA, 19 bp, Homo sapiens
ccatataaccagcaagtgt

SEQ ID NO: 7959329 - DNA, 22 bp, Homo sapiens
ccatagtgaattgtctcagacg

SEQ ID NO: 7959330 - DNA, 22 bp, Homo sapiens
ccatagcaagaggagcagaaat

SEQ ID NO: 7959331 - DNA, 22 bp, Homo sapiens
ccatagtgaattgtctcagacg

SEQ ID NO: 7959332 - DNA, 22 bp, Homo sapiens
ccatacacacaccaaatttgta

SEQ ID NO: 7959333 - DNA, 17 bp, Homo sapiens
ccatactgacatattga

SEQ ID NO: 7959334 - DNA, 21 bp, Homo sapiens
ccatacctacctcacctggtt

SEQ ID NO: 7959335 - DNA, 22 bp, Homo sapiens
ccagttacaagtgattcttggt

SEQ ID NO: 7959336 - DNA, 22 bp, Homo sapiens
tgaggctgagatatcagggagg

SEQ ID NO: 7959337 - DNA, 22 bp, Homo sapiens
tgaggctgagatatcagggagg

SEQ ID NO: 7959338 - DNA, 22 bp, Homo sapiens
tgaggctgagatatcagggagg

SEQ ID NO: 7959339 - DNA, 22 bp, Homo sapiens
tgaggctgagatatcagggagg

SEQ ID NO: 7959340 - DNA, 22 bp, Homo sapiens
tgaggctgagatatcagggagg

SEQ ID NO: 7959341 - DNA, 18 bp, Homo sapiens
tgaggctgagggtagagg

SEQ ID NO: 7959342 - DNA, 18 bp, Homo sapiens
tgaggctgagggtagagg

SEQ ID NO: 7959343 - DNA, 18 bp, Homo sapiens
tgaggctgagggtagagg

SEQ ID NO: 7959344 - DNA, 22 bp, Homo sapiens
ccagttaaacaacatccatttc

SEQ ID NO: 7959345 - DNA, 23 bp, Homo sapiens
tgaggctgattgatttttgctca

SEQ ID NO: 7959346 - DNA, 22 bp, Homo sapiens
tcttgcagttgcgcagtgcatg

SEQ ID NO: 7959347 - DNA, 22 bp, Homo sapiens
tcttgcaggcggctcagcaacc

SEQ ID NO: 7959348 - DNA, 22 bp, Homo sapiens
tcttgcaggcggctcagcaacc

SEQ ID NO: 7959349 - DNA, 22 bp, Homo sapiens
tcttgcaggcggctcagcaacc

SEQ ID NO: 7959350 - DNA, 22 bp, Homo sapiens
tcttgcagttgcgcagtgcatg

SEQ ID NO: 7959351 - DNA, 22 bp, Homo sapiens
tcttgcagttgcgcagtgcatg

SEQ ID NO: 7959352 - DNA, 22 bp, Homo sapiens
tctttggttgcactgcaggtgt

SEQ ID NO: 7959353 - DNA, 22 bp, Homo sapiens
tctttggttgcactgcaggtgt

SEQ ID NO: 7959354 - DNA, 22 bp, Homo sapiens
tctttggtttctgtctctgtaa

SEQ ID NO: 7959355 - DNA, 22 bp, Homo sapiens
tcttgccacttcatcccctttc

SEQ ID NO: 7959356 - DNA, 22 bp, Homo sapiens
tcttgccctcaacaagagcatg

SEQ ID NO: 7959357 - DNA, 22 bp, Homo sapiens
tcttgccgcgcaggcgcagttc

SEQ ID NO: 7959358 - DNA, 22 bp, Homo sapiens
tcttttctgccagctgagccct

SEQ ID NO: 7959359 - DNA, 22 bp, Homo sapiens
tcttttctgccacagcctgagc

SEQ ID NO: 7959360 - DNA, 22 bp, Homo sapiens
tctttgtaaatgcctagcataa

SEQ ID NO: 7959361 - DNA, 22 bp, Homo sapiens
tcttttcttcttaatggttaat

SEQ ID NO: 7959362 - DNA, 22 bp, Homo sapiens
tcttttcttcttaatggttaat

SEQ ID NO: 7959363 - DNA, 22 bp, Homo sapiens
tcttttctgtaactcagtgtct

SEQ ID NO: 7959364 - DNA, 22 bp, Homo sapiens
tcttttctggactctgcatgga

SEQ ID NO: 7959365 - DNA, 22 bp, Homo sapiens
tcttttctggactctgcatgga

SEQ ID NO: 7959366 - DNA, 22 bp, Homo sapiens
tcttttctgtaactcagtgtct

SEQ ID NO: 7959367 - DNA, 22 bp, Homo sapiens
tcttttctggactctgcatgga

SEQ ID NO: 7959368 - DNA, 22 bp, Homo sapiens
tcttttggaaatgatgtgcagg

SEQ ID NO: 7959369 - DNA, 22 bp, Homo sapiens
tcttttgagggccagaggaaga

SEQ ID NO: 7959370 - DNA, 22 bp, Homo sapiens
tcttttcttgcattattgcact

SEQ ID NO: 7959371 - DNA, 22 bp, Homo sapiens
tcttttcttgcattattgcact

SEQ ID NO: 7959372 - DNA, 22 bp, Homo sapiens
tcttttcttgcattattgcact

SEQ ID NO: 7959373 - DNA, 22 bp, Homo sapiens
tcttttcttgcattattgcact

SEQ ID NO: 7959374 - DNA, 22 bp, Homo sapiens
tcttttcttcttaatggttaat

SEQ ID NO: 7959375 - DNA, 22 bp, Homo sapiens
tcttttcttcttaatggttaat

SEQ ID NO: 7959376 - DNA, 22 bp, Homo sapiens
tcttttcttcttaatggttaat

SEQ ID NO: 7959377 - DNA, 22 bp, Homo sapiens
tcttttcttgcattattgcact

SEQ ID NO: 7959378 - DNA, 22 bp, Homo sapiens
tcttttcttgcattattgcact

SEQ ID NO: 7959379 - DNA, 22 bp, Homo sapiens
tcttttcttgcattattgcact

SEQ ID NO: 7959380 - DNA, 22 bp, Homo sapiens
tcttttgtactcagtattgaca

SEQ ID NO: 7959381 - DNA, 22 bp, Homo sapiens
tcttttgtactcagtattgaca

SEQ ID NO: 7959382 - DNA, 22 bp, Homo sapiens
tcttttgtagctaacacattca

SEQ ID NO: 7959383 - DNA, 22 bp, Homo sapiens
tcttttgtagctaacacattca

SEQ ID NO: 7959384 - DNA, 21 bp, Homo sapiens
tcttttgtaactatttcagcc

SEQ ID NO: 7959385 - DNA, 21 bp, Homo sapiens
tcttttgtaactatttcagcc

SEQ ID NO: 7959386 - DNA, 21 bp, Homo sapiens
tcttttgtaactatttcagcc

SEQ ID NO: 7959387 - DNA, 22 bp, Homo sapiens
tcttttgtgaggacaaggtacg

SEQ ID NO: 7959388 - DNA, 22 bp, Homo sapiens
tcttttgtgaggacaaggtacg

SEQ ID NO: 7959389 - DNA, 22 bp, Homo sapiens
tcttttgtgaggacaaggtacg

SEQ ID NO: 7959390 - DNA, 22 bp, Homo sapiens
tcttttgtcggtgtatcatgga

SEQ ID NO: 7959391 - DNA, 22 bp, Homo sapiens
tcttttgtcatagagcatggta

SEQ ID NO: 7959392 - DNA, 22 bp, Homo sapiens
tcttttgtcatcccttgtacat

SEQ ID NO: 7959393 - DNA, 22 bp, Homo sapiens
tcttgcagaggcactgtgtcag

SEQ ID NO: 7959394 - DNA, 22 bp, Homo sapiens
tcttgcagactcacaaggtact

SEQ ID NO: 7959395 - DNA, 22 bp, Homo sapiens
tcttgcagacagcttccagcct

SEQ ID NO: 7959396 - DNA, 22 bp, Homo sapiens
tcttgcagactcacaaggtact

SEQ ID NO: 7959397 - DNA, 22 bp, Homo sapiens
tcttgcagaggcactgtgtcag

SEQ ID NO: 7959398 - DNA, 22 bp, Homo sapiens
tcttgcagaggcactgtgtcag

SEQ ID NO: 7959399 - DNA, 22 bp, Homo sapiens
tcttgcagagggcccttctgct

SEQ ID NO: 7959400 - DNA, 22 bp, Homo sapiens
tcttgcagagggcccttctgct

SEQ ID NO: 7959401 - DNA, 22 bp, Homo sapiens
tcttgcagagtggttcccctct

SEQ ID NO: 7959402 - DNA, 19 bp, Homo sapiens
tcttgcagccccagcaggc

SEQ ID NO: 7959403 - DNA, 19 bp, Homo sapiens
tcttgcagccccagcaggc

SEQ ID NO: 7959404 - DNA, 20 bp, Homo sapiens
tcttgcagctcctgtaccat

SEQ ID NO: 7959405 - DNA, 22 bp, Homo sapiens
tcttgcaggcaaactacctcta

SEQ ID NO: 7959406 - DNA, 22 bp, Homo sapiens
tcttgcaggcatgaaaggactc

SEQ ID NO: 7959407 - DNA, 22 bp, Homo sapiens
tcttgcagcttcatctgcaatt

SEQ ID NO: 7959408 - DNA, 22 bp, Homo sapiens
tcttgcagcttcatctgcaatt

SEQ ID NO: 7959409 - DNA, 22 bp, Homo sapiens
tcttgcaccacacaaaaatttg

SEQ ID NO: 7959410 - DNA, 22 bp, Homo sapiens
tcttgcacttcatgaatatgtt

SEQ ID NO: 7959411 - DNA, 22 bp, Homo sapiens
tcttgattttgtgaataagttg

SEQ ID NO: 7959412 - DNA, 22 bp, Homo sapiens
tcttgattttgtgaataagttg

SEQ ID NO: 7959413 - DNA, 22 bp, Homo sapiens
tcttgattttgttaaaattaga

SEQ ID NO: 7959414 - DNA, 22 bp, Homo sapiens
tcttgattttgttaaaattaga

SEQ ID NO: 7959415 - DNA, 21 bp, Homo sapiens
tcttgattttggacttcttcc

SEQ ID NO: 7959416 - DNA, 22 bp, Homo sapiens
tcttgatttgtaaaagaaggat

SEQ ID NO: 7959417 - DNA, 22 bp, Homo sapiens
tcttgattttgtgaataagttg

SEQ ID NO: 7959418 - DNA, 22 bp, Homo sapiens
tcttgattttgtgaataagttg

SEQ ID NO: 7959419 - DNA, 22 bp, Homo sapiens
tcttgcagaaaatagtatagat

SEQ ID NO: 7959420 - DNA, 22 bp, Homo sapiens
tcttgcagaaaatagtatagat

SEQ ID NO: 7959421 - DNA, 22 bp, Homo sapiens
tcttgcacttcatgaatatgtt

SEQ ID NO: 7959422 - DNA, 22 bp, Homo sapiens
tcttgcagacagcttccagcct

SEQ ID NO: 7959423 - DNA, 22 bp, Homo sapiens
tcttgcagaagaagctgccaag

SEQ ID NO: 7959424 - DNA, 22 bp, Homo sapiens
tcttgcagaaataagtttaaat

SEQ ID NO: 7959425 - DNA, 22 bp, Homo sapiens
tcttgcagaagaagctgccaag

SEQ ID NO: 7959426 - DNA, 19 bp, Homo sapiens
ccaggcctctggggcctgt

SEQ ID NO: 7959427 - DNA, 19 bp, Homo sapiens
ccaggcctctggggcctgt

SEQ ID NO: 7959428 - DNA, 22 bp, Homo sapiens
ccaggcctctggctgcttagtc

SEQ ID NO: 7959429 - DNA, 19 bp, Homo sapiens
ccaggcctctggggcctgt

SEQ ID NO: 7959430 - DNA, 22 bp, Homo sapiens
ccaggcctctggctgcttagtc

SEQ ID NO: 7959431 - DNA, 23 bp, Homo sapiens
ccaggcctctcagagggtgtgcc

SEQ ID NO: 7959432 - DNA, 23 bp, Homo sapiens
ccaggcctctcagagggtgtgcc

SEQ ID NO: 7959433 - DNA, 22 bp, Homo sapiens
ccaggcctcctgtgagtggacc

SEQ ID NO: 7959434 - DNA, 23 bp, Homo sapiens
ccaggcctctcagagggtgtgcc

SEQ ID NO: 7959435 - DNA, 22 bp, Homo sapiens
ccaggcctctggctgcttagtc

SEQ ID NO: 7959436 - DNA, 22 bp, Homo sapiens
ccaggcctctggctgcttagtc

SEQ ID NO: 7959437 - DNA, 23 bp, Homo sapiens
ccaggcctctcagagggtgtgcc

SEQ ID NO: 7959438 - DNA, 23 bp, Homo sapiens
ccaggcctctcagagggtgtgcc

SEQ ID NO: 7959439 - DNA, 23 bp, Homo sapiens
ccaggcctctcagagggtgtgcc

SEQ ID NO: 7959440 - DNA, 22 bp, Homo sapiens
ccaggcctgcatctgctgcgca

SEQ ID NO: 7959441 - DNA, 22 bp, Homo sapiens
ccaggcctgattgggaatcttg

SEQ ID NO: 7959442 - DNA, 22 bp, Homo sapiens
ccaggcctgcatctgctgcgca

SEQ ID NO: 7959443 - DNA, 22 bp, Homo sapiens
tcttgatttgaattgcagttgt

SEQ ID NO: 7959444 - DNA, 22 bp, Homo sapiens
tcttgatttgaattgcagttgt

SEQ ID NO: 7959445 - DNA, 22 bp, Homo sapiens
tcttgatttattctacccagaa

SEQ ID NO: 7959446 - DNA, 22 bp, Homo sapiens
tcttgatttattctacccagaa

SEQ ID NO: 7959447 - DNA, 22 bp, Homo sapiens
tcttgatttgaattgcagttgt

SEQ ID NO: 7959448 - DNA, 22 bp, Homo sapiens
tcttgatttgtaaaagaaggat

SEQ ID NO: 7959449 - DNA, 22 bp, Homo sapiens
tcttgatttgtaaaagaaggat

SEQ ID NO: 7959450 - DNA, 19 bp, Homo sapiens
ccaggcctctggggcctgt

SEQ ID NO: 7959451 - DNA, 22 bp, Homo sapiens
ccaggcctgattgggaatcttg

SEQ ID NO: 7959452 - DNA, 19 bp, Homo sapiens
ccaggcctctggggcctgt

SEQ ID NO: 7959453 - DNA, 22 bp, Homo sapiens
ccaggcctgattgggaatcttg

SEQ ID NO: 7959454 - DNA, 22 bp, Homo sapiens
ccaggcctgattgggaatcttg

SEQ ID NO: 7959455 - DNA, 22 bp, Homo sapiens
ccaggcctgattgggaatcttg

SEQ ID NO: 7959456 - DNA, 22 bp, Homo sapiens
ccaggctgtaagagtgatgttg

SEQ ID NO: 7959457 - DNA, 22 bp, Homo sapiens
ccaggctgtaagagtgatgttg

SEQ ID NO: 7959458 - DNA, 21 bp, Homo sapiens
ccaggctgggagggcagttcc

SEQ ID NO: 7959459 - DNA, 21 bp, Homo sapiens
ccaggctgggagggcagttcc

SEQ ID NO: 7959460 - DNA, 21 bp, Homo sapiens
ccaggctgggagggcagttcc

SEQ ID NO: 7959461 - DNA, 22 bp, Homo sapiens
ccaggctgtgcttttcataaat

SEQ ID NO: 7959462 - DNA, 22 bp, Homo sapiens
ccaggctgtgcttttcataaat

SEQ ID NO: 7959463 - DNA, 22 bp, Homo sapiens
ccaggctgtgcttttcataaat

SEQ ID NO: 7959464 - DNA, 22 bp, Homo sapiens
ccaggctgtgcttttcataaat

SEQ ID NO: 7959465 - DNA, 22 bp, Homo sapiens
ccaggctgtaagagtgatgttg

SEQ ID NO: 7959466 - DNA, 22 bp, Homo sapiens
ccaggctgttttcaaacttggg

SEQ ID NO: 7959467 - DNA, 22 bp, Homo sapiens
ccaggctgttttcaaacttggg

SEQ ID NO: 7959468 - DNA, 22 bp, Homo sapiens
ccaggctgttttcaaacttggg

SEQ ID NO: 7959469 - DNA, 22 bp, Homo sapiens
ccaggctgtggtttagatagag

SEQ ID NO: 7959470 - DNA, 22 bp, Homo sapiens
ccaggctgttttcaaacttggg

SEQ ID NO: 7959471 - DNA, 22 bp, Homo sapiens
ccaggctgtggtttagatagag

SEQ ID NO: 7959472 - DNA, 22 bp, Homo sapiens
ccaggctgtggtttagatagag

SEQ ID NO: 7959473 - DNA, 22 bp, Homo sapiens
ccaggctgtggtttagatagag

SEQ ID NO: 7959474 - DNA, 22 bp, Homo sapiens
ccaggctgtggtttagatagag

SEQ ID NO: 7959475 - DNA, 22 bp, Homo sapiens
tgaaatgaatgtgattcgatag

SEQ ID NO: 7959476 - DNA, 22 bp, Homo sapiens
tgaaatgaagggcttgttctgg

SEQ ID NO: 7959477 - DNA, 22 bp, Homo sapiens
tgaaatgacagtcttaagctct

SEQ ID NO: 7959478 - DNA, 22 bp, Homo sapiens
tgaaatgacaaaggtttttctt

SEQ ID NO: 7959479 - DNA, 22 bp, Homo sapiens
tgaaatgacagtcttaagctct

SEQ ID NO: 7959480 - DNA, 22 bp, Homo sapiens
tgaaatgacagtcttaagctct

SEQ ID NO: 7959481 - DNA, 22 bp, Homo sapiens
tgaaatgagagcacagaataaa

SEQ ID NO: 7959482 - DNA, 21 bp, Homo sapiens
tgaaatgagaatgctgagcac

SEQ ID NO: 7959483 - DNA, 22 bp, Homo sapiens
tgaaatgaagggcttgttctgg

SEQ ID NO: 7959484 - DNA, 22 bp, Homo sapiens
tgaaatgaaacagaacatatca

SEQ ID NO: 7959485 - DNA, 22 bp, Homo sapiens
ccaggcttcctaatgtgtgcag

SEQ ID NO: 7959486 - DNA, 22 bp, Homo sapiens
ccaggcttgaagggaagaatgg

SEQ ID NO: 7959487 - DNA, 22 bp, Homo sapiens
ccaggcttccctgagaggctgc

SEQ ID NO: 7959488 - DNA, 22 bp, Homo sapiens
ccaggcttccctgagaggctgc

SEQ ID NO: 7959489 - DNA, 22 bp, Homo sapiens
ccaggcttcctaatgtgtgcag

SEQ ID NO: 7959490 - DNA, 22 bp, Homo sapiens
ccaggcttccctgagaggctgc

SEQ ID NO: 7959491 - DNA, 22 bp, Homo sapiens
tcttttgtgccaagtaatgaat

SEQ ID NO: 7959492 - DNA, 22 bp, Homo sapiens
tcttttgtgattctttagttac

SEQ ID NO: 7959493 - DNA, 22 bp, Homo sapiens
tcttttgtgattcttcagttac

SEQ ID NO: 7959494 - DNA, 22 bp, Homo sapiens
tcttttgtgattctttagttac

SEQ ID NO: 7959495 - DNA, 22 bp, Homo sapiens
tcttttgtgattcttcagttac

SEQ ID NO: 7959496 - DNA, 22 bp, Homo sapiens
tcttttgtgattctttagttac

SEQ ID NO: 7959497 - DNA, 22 bp, Homo sapiens
tcttttgtgattctttagttac

SEQ ID NO: 7959498 - DNA, 22 bp, Homo sapiens
tcttttgtgattctttagttac

SEQ ID NO: 7959499 - DNA, 22 bp, Homo sapiens
tcttttgtggatgaagaaatgg

SEQ ID NO: 7959500 - DNA, 22 bp, Homo sapiens
tcttttgtggatgaagaaatgg

SEQ ID NO: 7959501 - DNA, 22 bp, Homo sapiens
tcttttgtggatgaagaaatgg

SEQ ID NO: 7959502 - DNA, 22 bp, Homo sapiens
tgaaacaaatttggaaaatcta

SEQ ID NO: 7959503 - DNA, 22 bp, Homo sapiens
tgaaacaaatttggaaaatcta

SEQ ID NO: 7959504 - DNA, 22 bp, Homo sapiens
tgaaacaaatttggaaaatcta

SEQ ID NO: 7959505 - DNA, 22 bp, Homo sapiens
tgaaacaagatccacagacttg

SEQ ID NO: 7959506 - DNA, 18 bp, Homo sapiens
tgaaacaagaatggtgca

SEQ ID NO: 7959507 - DNA, 22 bp, Homo sapiens
tgaaacaaatttggaaaatcta

SEQ ID NO: 7959508 - DNA, 22 bp, Homo sapiens
tgaaacaagggccatgggaaac

SEQ ID NO: 7959509 - DNA, 22 bp, Homo sapiens
tgaaacaagggccatgggaaac

SEQ ID NO: 7959510 - DNA, 21 bp, Homo sapiens
tgaaacaatcagacagagtct

SEQ ID NO: 7959511 - DNA, 22 bp, Homo sapiens
tgaaacaagggccatgggaaac

SEQ ID NO: 7959512 - DNA, 21 bp, Homo sapiens
tgaaacaatcagacagagtct

SEQ ID NO: 7959513 - DNA, 21 bp, Homo sapiens
tgaaacaatcagacagagtct

SEQ ID NO: 7959514 - DNA, 22 bp, Homo sapiens
tgaaacaattagaatgtaatga

SEQ ID NO: 7959515 - DNA, 22 bp, Homo sapiens
tgaaacaattagaatgtaatga

SEQ ID NO: 7959516 - DNA, 22 bp, Homo sapiens
tgaaacaattagaatgtaatga

SEQ ID NO: 7959517 - DNA, 22 bp, Homo sapiens
tgaaacaattagaatgtaatga

SEQ ID NO: 7959518 - DNA, 22 bp, Homo sapiens
tgaaacaatgtgaagttgctga

SEQ ID NO: 7959519 - DNA, 22 bp, Homo sapiens
tgaaacaatgtgaagttgctga

SEQ ID NO: 7959520 - DNA, 22 bp, Homo sapiens
tgaaacaattagaatgtaatga

SEQ ID NO: 7959521 - DNA, 17 bp, Homo sapiens
tgaaacaccaagactgt

SEQ ID NO: 7959522 - DNA, 17 bp, Homo sapiens
tgaaacaccaagactgt

SEQ ID NO: 7959523 - DNA, 22 bp, Homo sapiens
tgaaacaattagaatgtaatga

SEQ ID NO: 7959524 - DNA, 22 bp, Homo sapiens
tgaaacaattagaatgtaatga

SEQ ID NO: 7959525 - DNA, 22 bp, Homo sapiens
tgaaacaattagaatgtaatga

SEQ ID NO: 7959526 - DNA, 21 bp, Homo sapiens
ccaggctgggagggcagttcc

SEQ ID NO: 7959527 - DNA, 21 bp, Homo sapiens
ccaggctggccatggtattga

SEQ ID NO: 7959528 - DNA, 21 bp, Homo sapiens
ccaggctgggagggcagttcc

SEQ ID NO: 7959529 - DNA, 21 bp, Homo sapiens
ccaggctgggagggcagttcc

SEQ ID NO: 7959530 - DNA, 23 bp, Homo sapiens
tgaaacagatgccaatgatcaag

SEQ ID NO: 7959531 - DNA, 23 bp, Homo sapiens
tgaaacagatgccaatgatcaag

SEQ ID NO: 7959532 - DNA, 22 bp, Homo sapiens
tgaaacagaagatgttcatgtg

SEQ ID NO: 7959533 - DNA, 22 bp, Homo sapiens
tgaaacagagtggatacagtga

SEQ ID NO: 7959534 - DNA, 22 bp, Homo sapiens
tgaagtaggcagcatgctgaga

SEQ ID NO: 7959535 - DNA, 22 bp, Homo sapiens
tgaagtacccgtttttattgca

SEQ ID NO: 7959536 - DNA, 22 bp, Homo sapiens
tgaagtacccgtttttattgca

SEQ ID NO: 7959537 - DNA, 22 bp, Homo sapiens
tgaagtacccgtttttattgca

SEQ ID NO: 7959538 - DNA, 22 bp, Homo sapiens
tgaagtaactgtccaggatcca

SEQ ID NO: 7959539 - DNA, 22 bp, Homo sapiens
tgaagtagcaggctgatggttt

SEQ ID NO: 7959540 - DNA, 22 bp, Homo sapiens
tgaagtatccatcttgttctag

SEQ ID NO: 7959541 - DNA, 22 bp, Homo sapiens
tgaagtatccatcttgttctag

SEQ ID NO: 7959542 - DNA, 22 bp, Homo sapiens
tgaagtatacggaaattgtgga

SEQ ID NO: 7959543 - DNA, 22 bp, Homo sapiens
tgaagtatccatcttgttctag

SEQ ID NO: 7959544 - DNA, 22 bp, Homo sapiens
tgaagtctattaactgatttct

SEQ ID NO: 7959545 - DNA, 22 bp, Homo sapiens
tgaagtcctcctgaccactcct

SEQ ID NO: 7959546 - DNA, 19 bp, Homo sapiens
tgaagtcctaacctccagt

SEQ ID NO: 7959547 - DNA, 22 bp, Homo sapiens
tgaagtcctaacttccagtaca

SEQ ID NO: 7959548 - DNA, 22 bp, Homo sapiens
tgaagtcctaaccctctagtcc

SEQ ID NO: 7959549 - DNA, 22 bp, Homo sapiens
tgaagtcagggattccatgaag

SEQ ID NO: 7959550 - DNA, 22 bp, Homo sapiens
tgaagtatcccaagatttacag

SEQ ID NO: 7959551 - DNA, 23 bp, Homo sapiens
tgaagtgaaatttcacaagggac

SEQ ID NO: 7959552 - DNA, 22 bp, Homo sapiens
tgaagtgaagaagcatgaatag

SEQ ID NO: 7959553 - DNA, 23 bp, Homo sapiens
tgaagtgaaatttcacaagggac

SEQ ID NO: 7959554 - DNA, 22 bp, Homo sapiens
tgaagtctattctatgccaggt

SEQ ID NO: 7959555 - DNA, 22 bp, Homo sapiens
tgaagtcttccagggaaacgtg

SEQ ID NO: 7959556 - DNA, 22 bp, Homo sapiens
tgaagtctttcagggctagaat

SEQ ID NO: 7959557 - DNA, 22 bp, Homo sapiens
tgaagtctttctgatcatttac

SEQ ID NO: 7959558 - DNA, 22 bp, Homo sapiens
tgaagtgacctggggcagtgta

SEQ ID NO: 7959559 - DNA, 22 bp, Homo sapiens
tgaagtgacctggggcagtgta

SEQ ID NO: 7959560 - DNA, 22 bp, Homo sapiens
tgaagtgattagaaccacttga

SEQ ID NO: 7959561 - DNA, 22 bp, Homo sapiens
tgaagtgattagaaccacttga

SEQ ID NO: 7959562 - DNA, 22 bp, Homo sapiens
tgaagtggaccctggacagacc

SEQ ID NO: 7959563 - DNA, 22 bp, Homo sapiens
tgaagtggaccctggacagacc

SEQ ID NO: 7959564 - DNA, 22 bp, Homo sapiens
ccagggcatgggaagaactgaa

SEQ ID NO: 7959565 - DNA, 22 bp, Homo sapiens
tgaaggtggggcttaggaatct

SEQ ID NO: 7959566 - DNA, 22 bp, Homo sapiens
ccagggcatgggaagaactgaa

SEQ ID NO: 7959567 - DNA, 22 bp, Homo sapiens
ccagggcatcctcacatcgcag

SEQ ID NO: 7959568 - DNA, 22 bp, Homo sapiens
ccagggcatcctcacatcgcag

SEQ ID NO: 7959569 - DNA, 22 bp, Homo sapiens
tgaaggtgtctttgtgaacatc

SEQ ID NO: 7959570 - DNA, 22 bp, Homo sapiens
tgaaggtgtctttgtgaacatc

SEQ ID NO: 7959571 - DNA, 21 bp, Homo sapiens
tgaaggtgttcatgatgcggt

SEQ ID NO: 7959572 - DNA, 19 bp, Homo sapiens
tgaaggtgtatgtgctggg

SEQ ID NO: 7959573 - DNA, 22 bp, Homo sapiens
tgaaggtgtatgctgtgggtca

SEQ ID NO: 7959574 - DNA, 22 bp, Homo sapiens
tgaaggtgtatgctgtgggtca

SEQ ID NO: 7959575 - DNA, 22 bp, Homo sapiens
ccagggcagtgggagaaggtgc

SEQ ID NO: 7959576 - DNA, 22 bp, Homo sapiens
ccagggcagtgggagaaggtgc

SEQ ID NO: 7959577 - DNA, 22 bp, Homo sapiens
ccagggcagtgggagaaggtgc

SEQ ID NO: 7959578 - DNA, 22 bp, Homo sapiens
ccagggcagtgggagaaggtgc

SEQ ID NO: 7959579 - DNA, 22 bp, Homo sapiens
ccagggcagtgggagaaggtgc

SEQ ID NO: 7959580 - DNA, 22 bp, Homo sapiens
ccagggcagtgggagaaggtgc

SEQ ID NO: 7959581 - DNA, 22 bp, Homo sapiens
ccagggcatcacatccagtgtt

SEQ ID NO: 7959582 - DNA, 22 bp, Homo sapiens
ccagggcatcacatccagtgtt

SEQ ID NO: 7959583 - DNA, 22 bp, Homo sapiens
ccagggcatcacatccagtgtt

SEQ ID NO: 7959584 - DNA, 22 bp, Homo sapiens
ccagggcatcacatccagtgtt

SEQ ID NO: 7959585 - DNA, 22 bp, Homo sapiens
ccagggcatcacatccagtgtt

SEQ ID NO: 7959586 - DNA, 22 bp, Homo sapiens
ccagggcatcacatccagtgtt

SEQ ID NO: 7959587 - DNA, 22 bp, Homo sapiens
ccagggctccccagaagtaccc

SEQ ID NO: 7959588 - DNA, 22 bp, Homo sapiens
ccagggctccccagaagtaccc

SEQ ID NO: 7959589 - DNA, 22 bp, Homo sapiens
ccagggctccccagaagtaccc

SEQ ID NO: 7959590 - DNA, 22 bp, Homo sapiens
ccagggctccccagaagtaccc

SEQ ID NO: 7959591 - DNA, 22 bp, Homo sapiens
ccagggctccccagaagtaccc

SEQ ID NO: 7959592 - DNA, 22 bp, Homo sapiens
ccagggctccccagaagtaccc

SEQ ID NO: 7959593 - DNA, 22 bp, Homo sapiens
ccagggctccattgctcatcct

SEQ ID NO: 7959594 - DNA, 22 bp, Homo sapiens
ccagggctccattgctcatcct

SEQ ID NO: 7959595 - DNA, 22 bp, Homo sapiens
ccagggctctatgagggtggag

SEQ ID NO: 7959596 - DNA, 22 bp, Homo sapiens
ccagggctctatgagggtggag

SEQ ID NO: 7959597 - DNA, 22 bp, Homo sapiens
ccagggctctatgagggtggag

SEQ ID NO: 7959598 - DNA, 22 bp, Homo sapiens
ccagggctctatgagggtggag

SEQ ID NO: 7959599 - DNA, 22 bp, Homo sapiens
ccagggctcgggtgcttagtca

SEQ ID NO: 7959600 - DNA, 22 bp, Homo sapiens
ccagggctctatgagggtggag

SEQ ID NO: 7959601 - DNA, 22 bp, Homo sapiens
ccagggctcgggtgcttagtca

SEQ ID NO: 7959602 - DNA, 22 bp, Homo sapiens
ccagggctcgggtgcttagtca

SEQ ID NO: 7959603 - DNA, 22 bp, Homo sapiens
ccagggctccattgctcatcct

SEQ ID NO: 7959604 - DNA, 22 bp, Homo sapiens
ccagggctccattgctcatcct

SEQ ID NO: 7959605 - DNA, 22 bp, Homo sapiens
ccagggcctacagcttaagtcc

SEQ ID NO: 7959606 - DNA, 22 bp, Homo sapiens
ccagggcctcgtgttctgagtg

SEQ ID NO: 7959607 - DNA, 22 bp, Homo sapiens
ccagggcctcgtgttctgagtg

SEQ ID NO: 7959608 - DNA, 22 bp, Homo sapiens
ccagggctccattgctcatcct

SEQ ID NO: 7959609 - DNA, 22 bp, Homo sapiens
ccagggcctacagcttaagtcc

SEQ ID NO: 7959610 - DNA, 22 bp, Homo sapiens
ccagggcctacagcttaagtcc

SEQ ID NO: 7959611 - DNA, 22 bp, Homo sapiens
ccagggcctacagcttaagtcc

SEQ ID NO: 7959612 - DNA, 22 bp, Homo sapiens
tgaagttatatatgttgaaaat

SEQ ID NO: 7959613 - DNA, 22 bp, Homo sapiens
ccagggctgagctgtgaccatg

SEQ ID NO: 7959614 - DNA, 22 bp, Homo sapiens
ccagggctgagctgtgaccatg

SEQ ID NO: 7959615 - DNA, 22 bp, Homo sapiens
ccagggctgagctgtgaccatg

SEQ ID NO: 7959616 - DNA, 22 bp, Homo sapiens
ccagggctgagctgtgaccatg

SEQ ID NO: 7959617 - DNA, 22 bp, Homo sapiens
ccagggctgagctgtgaccatg

SEQ ID NO: 7959618 - DNA, 22 bp, Homo sapiens
ccagggctgagctgtgaccatg

SEQ ID NO: 7959619 - DNA, 22 bp, Homo sapiens
ccagggctgagctgtgaccatg

SEQ ID NO: 7959620 - DNA, 22 bp, Homo sapiens
ccagggctgccgcatccctggt

SEQ ID NO: 7959621 - DNA, 22 bp, Homo sapiens
ccagggctgccgcatccctggt

SEQ ID NO: 7959622 - DNA, 22 bp, Homo sapiens
ccagggctgccgcatccctggt

SEQ ID NO: 7959623 - DNA, 22 bp, Homo sapiens
ccagggctgcctggccgtgtgt

SEQ ID NO: 7959624 - DNA, 22 bp, Homo sapiens
ccagggctgccgcatccctggt

SEQ ID NO: 7959625 - DNA, 22 bp, Homo sapiens
ccagggctgccgcatccctggt

SEQ ID NO: 7959626 - DNA, 22 bp, Homo sapiens
ccagggctctatgagggtggag

SEQ ID NO: 7959627 - DNA, 22 bp, Homo sapiens
ccagggctctatgagggtggag

SEQ ID NO: 7959628 - DNA, 22 bp, Homo sapiens
ccagggctctatgagggtggag

SEQ ID NO: 7959629 - DNA, 22 bp, Homo sapiens
ccagggctctgcttctgccatg

SEQ ID NO: 7959630 - DNA, 22 bp, Homo sapiens
ccagggctctgcttctgccatg

SEQ ID NO: 7959631 - DNA, 22 bp, Homo sapiens
ccagggctctgcttctgccatg

SEQ ID NO: 7959632 - DNA, 22 bp, Homo sapiens
ccagggctctgcttctgccatg

SEQ ID NO: 7959633 - DNA, 22 bp, Homo sapiens
ccagggctctgcttctgccatg

SEQ ID NO: 7959634 - DNA, 22 bp, Homo sapiens
ccagggctctgcttctgccatg

SEQ ID NO: 7959635 - DNA, 22 bp, Homo sapiens
ccagggctctgcttctgccatg

SEQ ID NO: 7959636 - DNA, 22 bp, Homo sapiens
ccagggctgagctgtgaccatg

SEQ ID NO: 7959637 - DNA, 22 bp, Homo sapiens
ccagggctgagactgtattggg

SEQ ID NO: 7959638 - DNA, 22 bp, Homo sapiens
ccagggctgagactgtattggg

SEQ ID NO: 7959639 - DNA, 22 bp, Homo sapiens
ccagggcaacgctgtctcagag

SEQ ID NO: 7959640 - DNA, 22 bp, Homo sapiens
ccagggcaacgctgtctcagag

SEQ ID NO: 7959641 - DNA, 22 bp, Homo sapiens
ccagggcaacgctgtctcagag

SEQ ID NO: 7959642 - DNA, 22 bp, Homo sapiens
ccagggcaacgctgtctcagag

SEQ ID NO: 7959643 - DNA, 22 bp, Homo sapiens
ccagggcaacgctgtctcagag

SEQ ID NO: 7959644 - DNA, 22 bp, Homo sapiens
ccagggcaacgctgtctcagag

SEQ ID NO: 7959645 - DNA, 22 bp, Homo sapiens
ccagggcaacgctgtctcagag

SEQ ID NO: 7959646 - DNA, 22 bp, Homo sapiens
ccagggcaacgctgtctcagag

SEQ ID NO: 7959647 - DNA, 22 bp, Homo sapiens
ccagggcaaatgagatcatagc

SEQ ID NO: 7959648 - DNA, 22 bp, Homo sapiens
ccagggcaaatgagatcatagc

SEQ ID NO: 7959649 - DNA, 21 bp, Homo sapiens
ccagggatgttgaactgaaag

SEQ ID NO: 7959650 - DNA, 22 bp, Homo sapiens
ccagggcaaatgagatcatagc

SEQ ID NO: 7959651 - DNA, 22 bp, Homo sapiens
ccagggcaaatgagatcatagc

SEQ ID NO: 7959652 - DNA, 22 bp, Homo sapiens
ccagggatgtggcagcaccata

SEQ ID NO: 7959653 - DNA, 22 bp, Homo sapiens
ccagggatgtggcagcaccata

SEQ ID NO: 7959654 - DNA, 21 bp, Homo sapiens
ccagggatgttgaactgaaag

SEQ ID NO: 7959655 - DNA, 22 bp, Homo sapiens
ccagggcaacgctgtctcagag

SEQ ID NO: 7959656 - DNA, 22 bp, Homo sapiens
ccagggcaacgctgtctcagag

SEQ ID NO: 7959657 - DNA, 22 bp, Homo sapiens
ccagggcaacgctgtctcagag

SEQ ID NO: 7959658 - DNA, 22 bp, Homo sapiens
ccagggcaacgctgtctcagag

SEQ ID NO: 7959659 - DNA, 22 bp, Homo sapiens
ccagggcaacgctgtctcagag

SEQ ID NO: 7959660 - DNA, 22 bp, Homo sapiens
ccagggcaattatttggagggt

SEQ ID NO: 7959661 - DNA, 22 bp, Homo sapiens
ccagggcaattatttggagggt

SEQ ID NO: 7959662 - DNA, 22 bp, Homo sapiens
ccagggcaattatttggagggt

SEQ ID NO: 7959663 - DNA, 22 bp, Homo sapiens
ccagggcaattatttggagggt

SEQ ID NO: 7959664 - DNA, 22 bp, Homo sapiens
ccagggcaggggctggagttca

SEQ ID NO: 7959665 - DNA, 22 bp, Homo sapiens
ccagggcaggggctggagttca

SEQ ID NO: 7959666 - DNA, 22 bp, Homo sapiens
ccagggcagggaccacgtgtct

SEQ ID NO: 7959667 - DNA, 22 bp, Homo sapiens
ccagggcagggaccacgtgtct

SEQ ID NO: 7959668 - DNA, 22 bp, Homo sapiens
ccagggcacgttgggacagtac

SEQ ID NO: 7959669 - DNA, 22 bp, Homo sapiens
ccagggcacgttgggacagtac

SEQ ID NO: 7959670 - DNA, 22 bp, Homo sapiens
ccagggcacgttgggacagtac

SEQ ID NO: 7959671 - DNA, 22 bp, Homo sapiens
ccagggcaggagaaagactcac

SEQ ID NO: 7959672 - DNA, 22 bp, Homo sapiens
ccagggcacgttgggacagtac

SEQ ID NO: 7959673 - DNA, 22 bp, Homo sapiens
ccagggcacgttgggacagtac

SEQ ID NO: 7959674 - DNA, 22 bp, Homo sapiens
ccagggcacgttgggacagtac

SEQ ID NO: 7959675 - DNA, 22 bp, Homo sapiens
ccagggcacgttgggacagtac

SEQ ID NO: 7959676 - DNA, 22 bp, Homo sapiens
ccagggcacgttgggacagtac

SEQ ID NO: 7959677 - DNA, 22 bp, Homo sapiens
ccagggcacgttgggacagtac

SEQ ID NO: 7959678 - DNA, 18 bp, Homo sapiens
ccagggatgcatggtccc

SEQ ID NO: 7959679 - DNA, 18 bp, Homo sapiens
ccagggatgcatggtccc

SEQ ID NO: 7959680 - DNA, 18 bp, Homo sapiens
ccagggatgcatggtccc

SEQ ID NO: 7959681 - DNA, 22 bp, Homo sapiens
ccagggagtttccaatctgaga

SEQ ID NO: 7959682 - DNA, 23 bp, Homo sapiens
ccagggagtgctactatcaagcc

SEQ ID NO: 7959683 - DNA, 23 bp, Homo sapiens
ccagggagtgctactatcaagcc

SEQ ID NO: 7959684 - DNA, 23 bp, Homo sapiens
ccagggagtgctactatcaagcc

SEQ ID NO: 7959685 - DNA, 23 bp, Homo sapiens
ccagggagtgctactatcaagcc

SEQ ID NO: 7959686 - DNA, 23 bp, Homo sapiens
ccagggagtgctactatcaagcc

SEQ ID NO: 7959687 - DNA, 22 bp, Homo sapiens
ccagggagtttccaatctgaga

SEQ ID NO: 7959688 - DNA, 22 bp, Homo sapiens
ccagggagtttccaatctgaga

SEQ ID NO: 7959689 - DNA, 23 bp, Homo sapiens
ccagggagtgctactatcaagcc

SEQ ID NO: 7959690 - DNA, 22 bp, Homo sapiens
ccagggagtttccaatctgaga

SEQ ID NO: 7959691 - DNA, 22 bp, Homo sapiens
ccagggagggtcctgtggcttc

SEQ ID NO: 7959692 - DNA, 22 bp, Homo sapiens
ccagggagggtcctgtggcttc

SEQ ID NO: 7959693 - DNA, 22 bp, Homo sapiens
ccagggagggtcctgtggcttc

SEQ ID NO: 7959694 - DNA, 22 bp, Homo sapiens
ccagggagggtcctgtggcttc

SEQ ID NO: 7959695 - DNA, 22 bp, Homo sapiens
ccagggagggtcctgtggcttc

SEQ ID NO: 7959696 - DNA, 22 bp, Homo sapiens
ccagggagggtcctgtggcttc

SEQ ID NO: 7959697 - DNA, 17 bp, Homo sapiens
ccagggaggggccgcgc

SEQ ID NO: 7959698 - DNA, 17 bp, Homo sapiens
ccagggaggggccgcgc

SEQ ID NO: 7959699 - DNA, 22 bp, Homo sapiens
ccagggagggtcctgtggcttc

SEQ ID NO: 7959700 - DNA, 22 bp, Homo sapiens
ccagggagggtcctgtggcttc

SEQ ID NO: 7959701 - DNA, 22 bp, Homo sapiens
ccagggagggtcctgtggcttc

SEQ ID NO: 7959702 - DNA, 23 bp, Homo sapiens
ccagggaggttgattggttaccc

SEQ ID NO: 7959703 - DNA, 22 bp, Homo sapiens
ccagggagggtcctgtggcttc

SEQ ID NO: 7959704 - DNA, 23 bp, Homo sapiens
ccagggaggttgattggttaccc

SEQ ID NO: 7959705 - DNA, 22 bp, Homo sapiens
ccagggagggtcctgtggcttc

SEQ ID NO: 7959706 - DNA, 23 bp, Homo sapiens
ccagggaggttgattggttaccc

SEQ ID NO: 7959707 - DNA, 22 bp, Homo sapiens
tgaaatgagataatttaagtgc

SEQ ID NO: 7959708 - DNA, 22 bp, Homo sapiens
tgaaatgagataatttaagtgc

SEQ ID NO: 7959709 - DNA, 22 bp, Homo sapiens
tgaaatgagatagataatcagg

SEQ ID NO: 7959710 - DNA, 22 bp, Homo sapiens
tgaaatgagatagataatcagg

SEQ ID NO: 7959711 - DNA, 22 bp, Homo sapiens
tgaaatgatatctgataacaaa

SEQ ID NO: 7959712 - DNA, 22 bp, Homo sapiens
tgaaatgagcatttattcttta

SEQ ID NO: 7959713 - DNA, 22 bp, Homo sapiens
tgaaatgagatagataatcagg

SEQ ID NO: 7959714 - DNA, 22 bp, Homo sapiens
tgaaatgatcagtttggttact

SEQ ID NO: 7959715 - DNA, 22 bp, Homo sapiens
tgaaatgatatctgataacaaa

SEQ ID NO: 7959716 - DNA, 22 bp, Homo sapiens
tgaaatgatcagtttggttact

SEQ ID NO: 7959717 - DNA, 22 bp, Homo sapiens
ccagggaagattagaagccact

SEQ ID NO: 7959718 - DNA, 22 bp, Homo sapiens
ccagggaagattagaagccact

SEQ ID NO: 7959719 - DNA, 22 bp, Homo sapiens
tgaaatgatgtacaagaaggca

SEQ ID NO: 7959720 - DNA, 22 bp, Homo sapiens
tgaaatgatgtacaagaaggca

SEQ ID NO: 7959721 - DNA, 17 bp, Homo sapiens
ccagggaggggccgcgc

SEQ ID NO: 7959722 - DNA, 23 bp, Homo sapiens
ccagggaaggccatcttcaactg

SEQ ID NO: 7959723 - DNA, 22 bp, Homo sapiens
ccagggaaggactctctttccc

SEQ ID NO: 7959724 - DNA, 17 bp, Homo sapiens
ccagggaggggccgcgc

SEQ ID NO: 7959725 - DNA, 17 bp, Homo sapiens
ccagggaggggccgcgc

SEQ ID NO: 7959726 - DNA, 17 bp, Homo sapiens
ccagggaggggccgcgc

SEQ ID NO: 7959727 - DNA, 22 bp, Homo sapiens
ccagggaagattagaagccact

SEQ ID NO: 7959728 - DNA, 22 bp, Homo sapiens
ccagggaagattagaagccact

SEQ ID NO: 7959729 - DNA, 22 bp, Homo sapiens
ccagggaagattagaagccact

SEQ ID NO: 7959730 - DNA, 22 bp, Homo sapiens
ccagggaagctggtcacgcagg

SEQ ID NO: 7959731 - DNA, 22 bp, Homo sapiens
ccaggcaggcgatggtgcagtg

SEQ ID NO: 7959732 - DNA, 22 bp, Homo sapiens
ccaggcaggcgatggtgcagtg

SEQ ID NO: 7959733 - DNA, 22 bp, Homo sapiens
ccaggcaggcgatggtgcagtg

SEQ ID NO: 7959734 - DNA, 22 bp, Homo sapiens
ccaggcaggcgatggtgcagtg

SEQ ID NO: 7959735 - DNA, 22 bp, Homo sapiens
ccaggcaggcgatggtgcagtg

SEQ ID NO: 7959736 - DNA, 22 bp, Homo sapiens
ccaggcaggcgatggtgcagtg

SEQ ID NO: 7959737 - DNA, 22 bp, Homo sapiens
ccaggcccccgagcagaagaca

SEQ ID NO: 7959738 - DNA, 22 bp, Homo sapiens
ccaggcccccgagcagaagaca

SEQ ID NO: 7959739 - DNA, 22 bp, Homo sapiens
ccaggcccccgagcagaagaca

SEQ ID NO: 7959740 - DNA, 22 bp, Homo sapiens
ccaggcccccgagcagaagaca

SEQ ID NO: 7959741 - DNA, 19 bp, Homo sapiens
ccaggcctcctgggaggtc

SEQ ID NO: 7959742 - DNA, 19 bp, Homo sapiens
ccaggcctcctgggaggtc

SEQ ID NO: 7959743 - DNA, 19 bp, Homo sapiens
ccaggcctcctgggaggtc

SEQ ID NO: 7959744 - DNA, 19 bp, Homo sapiens
ccaggcctcctgggaggtc

SEQ ID NO: 7959745 - DNA, 19 bp, Homo sapiens
ccaggcctcctgggaggtc

SEQ ID NO: 7959746 - DNA, 19 bp, Homo sapiens
ccaggcctcctgggaggtc

SEQ ID NO: 7959747 - DNA, 22 bp, Homo sapiens
ccaggcctcctgtgagtggacc

SEQ ID NO: 7959748 - DNA, 22 bp, Homo sapiens
ccaggcctcctgtgagtggacc

SEQ ID NO: 7959749 - DNA, 22 bp, Homo sapiens
ccaggcctcctgtgagtggacc

SEQ ID NO: 7959750 - DNA, 22 bp, Homo sapiens
ccaggcctcctgtgagtggacc

SEQ ID NO: 7959751 - DNA, 22 bp, Homo sapiens
ccaggcctcctgtgagtggacc

SEQ ID NO: 7959752 - DNA, 22 bp, Homo sapiens
ccaggcctcctgtgagtggacc

SEQ ID NO: 7959753 - DNA, 22 bp, Homo sapiens
ccaggcaggcgatggtgcagtg

SEQ ID NO: 7959754 - DNA, 22 bp, Homo sapiens
ccaggcaggcgatggtgcagtg

SEQ ID NO: 7959755 - DNA, 22 bp, Homo sapiens
ccaggcaggcgatggtgcagtg

SEQ ID NO: 7959756 - DNA, 22 bp, Homo sapiens
ccaggcaggcgatggtgcagtg

SEQ ID NO: 7959757 - DNA, 22 bp, Homo sapiens
ccaggcaggcgatggtgcagtg

SEQ ID NO: 7959758 - DNA, 22 bp, Homo sapiens
ccaggcaggcgatggtgcagtg

SEQ ID NO: 7959759 - DNA, 22 bp, Homo sapiens
ccaggcaggcgatggtgcagtg

SEQ ID NO: 7959760 - DNA, 22 bp, Homo sapiens
ccaggcaggcagcgttctcagg

SEQ ID NO: 7959761 - DNA, 22 bp, Homo sapiens
ccaggcaggcagcgttctcagg

SEQ ID NO: 7959762 - DNA, 22 bp, Homo sapiens
ccaggcaggcagcgttctcagg

SEQ ID NO: 7959763 - DNA, 22 bp, Homo sapiens
ccaggcaggcagcgttctcagg

SEQ ID NO: 7959764 - DNA, 22 bp, Homo sapiens
ccaggcaggcagcgttctcagg

SEQ ID NO: 7959765 - DNA, 22 bp, Homo sapiens
ccaggcaggcagcgttctcagg

SEQ ID NO: 7959766 - DNA, 22 bp, Homo sapiens
ccaggcaggcgatggtgcagtg

SEQ ID NO: 7959767 - DNA, 22 bp, Homo sapiens
ccaggcaggcagcgttctcagg

SEQ ID NO: 7959768 - DNA, 22 bp, Homo sapiens
ccaggcagcctgctccattctg

SEQ ID NO: 7959769 - DNA, 22 bp, Homo sapiens
ccaggcagcctgctccattctg

SEQ ID NO: 7959770 - DNA, 22 bp, Homo sapiens
ccaggcagctctgatttatgtc

SEQ ID NO: 7959771 - DNA, 22 bp, Homo sapiens
ccaggcagctctgatttatgtc

SEQ ID NO: 7959772 - DNA, 22 bp, Homo sapiens
ccaggcaggcagcgttctcagg

SEQ ID NO: 7959773 - DNA, 22 bp, Homo sapiens
ccaggcagctctgatttatgtc

SEQ ID NO: 7959774 - DNA, 22 bp, Homo sapiens
ccaggcagctctgatttatgtc

SEQ ID NO: 7959775 - DNA, 22 bp, Homo sapiens
ccaggcagcctgctccattctg

SEQ ID NO: 7959776 - DNA, 22 bp, Homo sapiens
ccaggcagcctgctccattctg

SEQ ID NO: 7959777 - DNA, 22 bp, Homo sapiens
ccaggcagcctgctccattctg

SEQ ID NO: 7959778 - DNA, 22 bp, Homo sapiens
ccaggcagcctgctccattctg

SEQ ID NO: 7959779 - DNA, 22 bp, Homo sapiens
ccaggcagccaagtgtgtgtgt

SEQ ID NO: 7959780 - DNA, 22 bp, Homo sapiens
ccaggcagccaagtgtgtgtgt

SEQ ID NO: 7959781 - DNA, 22 bp, Homo sapiens
ccaggcagccaagtgtgtgtgt

SEQ ID NO: 7959782 - DNA, 22 bp, Homo sapiens
ccaggcagccaagtgtgtgtgt

SEQ ID NO: 7959783 - DNA, 22 bp, Homo sapiens
ccaggcagccaagtgtgtgtgt

SEQ ID NO: 7959784 - DNA, 22 bp, Homo sapiens
ccaggcagccaagtgtgtgtgt

SEQ ID NO: 7959785 - DNA, 22 bp, Homo sapiens
ccaggcagcaaattttctgaat

SEQ ID NO: 7959786 - DNA, 22 bp, Homo sapiens
ccaggcagcaaattttctgaat

SEQ ID NO: 7959787 - DNA, 22 bp, Homo sapiens
tcttctggatgagagcggaggc

SEQ ID NO: 7959788 - DNA, 22 bp, Homo sapiens
tcttctgatgccagtaaccatg

SEQ ID NO: 7959789 - DNA, 22 bp, Homo sapiens
tcttctgatgccagtaaccatg

SEQ ID NO: 7959790 - DNA, 22 bp, Homo sapiens
tcttctgaaggtaggaagcatt

SEQ ID NO: 7959791 - DNA, 22 bp, Homo sapiens
tcttctgaaggtaggaagcatt

SEQ ID NO: 7959792 - DNA, 22 bp, Homo sapiens
tcttctgaaggtaggaagcatt

SEQ ID NO: 7959793 - DNA, 19 bp, Homo sapiens
tcttctgacttcaagaaac

SEQ ID NO: 7959794 - DNA, 19 bp, Homo sapiens
tcttctgacttcaagaaac

SEQ ID NO: 7959795 - DNA, 19 bp, Homo sapiens
tcttctgacttgagaaaga

SEQ ID NO: 7959796 - DNA, 19 bp, Homo sapiens
tcttctgacttgagaaaga

SEQ ID NO: 7959797 - DNA, 19 bp, Homo sapiens
tcttctgacttcaagaaac

SEQ ID NO: 7959798 - DNA, 22 bp, Homo sapiens
tcttctgagacttctctttggt

SEQ ID NO: 7959799 - DNA, 22 bp, Homo sapiens
tcttctgaaactagtgggaaag

SEQ ID NO: 7959800 - DNA, 17 bp, Homo sapiens
tcttctcttccagtctt

SEQ ID NO: 7959801 - DNA, 17 bp, Homo sapiens
tcttctcttccagtctt

SEQ ID NO: 7959802 - DNA, 17 bp, Homo sapiens
tcttctcttccagtctt

SEQ ID NO: 7959803 - DNA, 17 bp, Homo sapiens
tcttctcttccagtctt

SEQ ID NO: 7959804 - DNA, 17 bp, Homo sapiens
tcttctcttccagtctt

SEQ ID NO: 7959805 - DNA, 17 bp, Homo sapiens
tcttctcttccagtctt

SEQ ID NO: 7959806 - DNA, 17 bp, Homo sapiens
tcttctcttccagtctt

SEQ ID NO: 7959807 - DNA, 22 bp, Homo sapiens
tcttctctgtggcctggtggtg

SEQ ID NO: 7959808 - DNA, 22 bp, Homo sapiens
tcttctctgtggcctggtggtg

SEQ ID NO: 7959809 - DNA, 22 bp, Homo sapiens
tcttagaaactgtatcgattag

SEQ ID NO: 7959810 - DNA, 22 bp, Homo sapiens
tcttagaaactgtatcgattag

SEQ ID NO: 7959811 - DNA, 22 bp, Homo sapiens
tcttagaaaaatggtatgtttt

SEQ ID NO: 7959812 - DNA, 22 bp, Homo sapiens
tcttagaaaaatggtatgtttt

SEQ ID NO: 7959813 - DNA, 22 bp, Homo sapiens
tcttagaaatgaagttctttct

SEQ ID NO: 7959814 - DNA, 22 bp, Homo sapiens
tcttagaaatgaagttctttct

SEQ ID NO: 7959815 - DNA, 22 bp, Homo sapiens
tcttagaaattccccagtggct

SEQ ID NO: 7959816 - DNA, 22 bp, Homo sapiens
tcttagaaatgaagttctttct

SEQ ID NO: 7959817 - DNA, 22 bp, Homo sapiens
tcttcctatggggctgcaggaa

SEQ ID NO: 7959818 - DNA, 22 bp, Homo sapiens
tcttagaagtttatggcacgga

SEQ ID NO: 7959819 - DNA, 22 bp, Homo sapiens
tcttagaaattccccagtggct

SEQ ID NO: 7959820 - DNA, 22 bp, Homo sapiens
tcttagaaattccccagtggct

SEQ ID NO: 7959821 - DNA, 22 bp, Homo sapiens
tcttagaagttcatgttccagc

SEQ ID NO: 7959822 - DNA, 22 bp, Homo sapiens
tcttagaagttcatgttccagc

SEQ ID NO: 7959823 - DNA, 22 bp, Homo sapiens
tcttctctgtggcctggtggtg

SEQ ID NO: 7959824 - DNA, 22 bp, Homo sapiens
tcttctctgtggcctggtggtg

SEQ ID NO: 7959825 - DNA, 22 bp, Homo sapiens
tcttctctgtggcctggtggtg

SEQ ID NO: 7959826 - DNA, 22 bp, Homo sapiens
tcttctctcctgcttggcagaa

SEQ ID NO: 7959827 - DNA, 22 bp, Homo sapiens
tcttctctcctgcttggcagaa

SEQ ID NO: 7959828 - DNA, 22 bp, Homo sapiens
tcttcctcatgaattctcgtat

SEQ ID NO: 7959829 - DNA, 22 bp, Homo sapiens
tcttcctcatgaattctcgtat

SEQ ID NO: 7959830 - DNA, 22 bp, Homo sapiens
tcttcctcaatgtaacaacccc

SEQ ID NO: 7959831 - DNA, 22 bp, Homo sapiens
tcttctctcatgtaggagggaa

SEQ ID NO: 7959832 - DNA, 22 bp, Homo sapiens
tcttctctcctgcttggcagaa

SEQ ID NO: 7959833 - DNA, 22 bp, Homo sapiens
ccaggcagatgggccggcttca

SEQ ID NO: 7959834 - DNA, 22 bp, Homo sapiens
ccaggcagatgggccggcttca

SEQ ID NO: 7959835 - DNA, 22 bp, Homo sapiens
ccaggcagatgggccggcttca

SEQ ID NO: 7959836 - DNA, 22 bp, Homo sapiens
ccaggcagatgggccggcttca

SEQ ID NO: 7959837 - DNA, 22 bp, Homo sapiens
ccaggcagatgggccggcttca

SEQ ID NO: 7959838 - DNA, 22 bp, Homo sapiens
ccaggcagatgggccggcttca

SEQ ID NO: 7959839 - DNA, 22 bp, Homo sapiens
ccaggcagagtgctccagaaag

SEQ ID NO: 7959840 - DNA, 22 bp, Homo sapiens
ccaggcagagtgctccagaaag

SEQ ID NO: 7959841 - DNA, 22 bp, Homo sapiens
ccaggcagagtgctccagaaag

SEQ ID NO: 7959842 - DNA, 22 bp, Homo sapiens
ccaggcagagtgctccagaaag

SEQ ID NO: 7959843 - DNA, 22 bp, Homo sapiens
ccaggcagagtgctccagaaag

SEQ ID NO: 7959844 - DNA, 22 bp, Homo sapiens
ccaggcagagtgctccagaaag

SEQ ID NO: 7959845 - DNA, 22 bp, Homo sapiens
ccaggcagagtgctccagaaag

SEQ ID NO: 7959846 - DNA, 22 bp, Homo sapiens
ccaggcagagtgctccagaaag

SEQ ID NO: 7959847 - DNA, 22 bp, Homo sapiens
ccaggcagagtgctccagaaag

SEQ ID NO: 7959848 - DNA, 22 bp, Homo sapiens
ccaggcagagtgctccagaaag

SEQ ID NO: 7959849 - DNA, 22 bp, Homo sapiens
ccaggcagagggatccccatcc

SEQ ID NO: 7959850 - DNA, 22 bp, Homo sapiens
ccaggcagagggaatagcaagt

SEQ ID NO: 7959851 - DNA, 22 bp, Homo sapiens
ccaggcagagggaatagcaagt

SEQ ID NO: 7959852 - DNA, 22 bp, Homo sapiens
ccaggcagagggaatagcaagt

SEQ ID NO: 7959853 - DNA, 22 bp, Homo sapiens
ccaggcagagggaatagcaagt

SEQ ID NO: 7959854 - DNA, 22 bp, Homo sapiens
ccaggcagagggaatagcaagt

SEQ ID NO: 7959855 - DNA, 22 bp, Homo sapiens
ccaggcagagggaatagcaagt

SEQ ID NO: 7959856 - DNA, 22 bp, Homo sapiens
ccaggcagagggaatagcaagt

SEQ ID NO: 7959857 - DNA, 22 bp, Homo sapiens
ccaggcagagggaatagcaagt

SEQ ID NO: 7959858 - DNA, 22 bp, Homo sapiens
ccaggcagagggaatagcaagt

SEQ ID NO: 7959859 - DNA, 22 bp, Homo sapiens
ccaggcagagggaatagcaagt

SEQ ID NO: 7959860 - DNA, 22 bp, Homo sapiens
ccaggcagagggatccccatcc

SEQ ID NO: 7959861 - DNA, 22 bp, Homo sapiens
ccaggcagagggatccccatcc

SEQ ID NO: 7959862 - DNA, 22 bp, Homo sapiens
ccaggcagagggatccccatcc

SEQ ID NO: 7959863 - DNA, 22 bp, Homo sapiens
ccaggcagagggatccccatcc

SEQ ID NO: 7959864 - DNA, 22 bp, Homo sapiens
ccaggcagagggatccccatcc

SEQ ID NO: 7959865 - DNA, 22 bp, Homo sapiens
ccaggcagagggatccccatcc

SEQ ID NO: 7959866 - DNA, 22 bp, Homo sapiens
tcttaattctgtgtcttcacta

SEQ ID NO: 7959867 - DNA, 22 bp, Homo sapiens
tcttaattgagaacagtgtagg

SEQ ID NO: 7959868 - DNA, 22 bp, Homo sapiens
tcttacaagaaggaaaagggag

SEQ ID NO: 7959869 - DNA, 22 bp, Homo sapiens
tcttacaagaaataagccaatg

SEQ ID NO: 7959870 - DNA, 22 bp, Homo sapiens
tcttaatgctagccaatagaga

SEQ ID NO: 7959871 - DNA, 22 bp, Homo sapiens
tcttaatggcatgcaggtttca

SEQ ID NO: 7959872 - DNA, 22 bp, Homo sapiens
tcttaattctgtgtcttcacta

SEQ ID NO: 7959873 - DNA, 22 bp, Homo sapiens
ccaggcagcaaattttctgaat

SEQ ID NO: 7959874 - DNA, 22 bp, Homo sapiens
ccaggcagcaaattttctgaat

SEQ ID NO: 7959875 - DNA, 22 bp, Homo sapiens
ccaggcagcaaattttctgaat

SEQ ID NO: 7959876 - DNA, 22 bp, Homo sapiens
ccaggcagcaaattttctgaat

SEQ ID NO: 7959877 - DNA, 22 bp, Homo sapiens
ccaggcagcaaattttctgaat

SEQ ID NO: 7959878 - DNA, 22 bp, Homo sapiens
ccaggcagcaaattttctgaat

SEQ ID NO: 7959879 - DNA, 22 bp, Homo sapiens
ccaggcagatgggccggcttca

SEQ ID NO: 7959880 - DNA, 22 bp, Homo sapiens
tcttacccggcaacgtgtgtcg

SEQ ID NO: 7959881 - DNA, 22 bp, Homo sapiens
tcttaccaggagccctctgagg

SEQ ID NO: 7959882 - DNA, 22 bp, Homo sapiens
tcttacatatagcatgagtaca

SEQ ID NO: 7959883 - DNA, 22 bp, Homo sapiens
tcttacatatacgtcatttagt

SEQ ID NO: 7959884 - DNA, 22 bp, Homo sapiens
tcttacatatagcatgagtaca

SEQ ID NO: 7959885 - DNA, 22 bp, Homo sapiens
tcttacagccactctgtgaagc

SEQ ID NO: 7959886 - DNA, 20 bp, Homo sapiens
tcttacaatcgttacatcca

SEQ ID NO: 7959887 - DNA, 20 bp, Homo sapiens
tcttacaatcgttacatcca

SEQ ID NO: 7959888 - DNA, 20 bp, Homo sapiens
tcttacaatcgttacatcca

SEQ ID NO: 7959889 - DNA, 22 bp, Homo sapiens
tcttacaagtcacccgctttct

SEQ ID NO: 7959890 - DNA, 22 bp, Homo sapiens
ccaggaggctctgactggaccc

SEQ ID NO: 7959891 - DNA, 22 bp, Homo sapiens
ccaggaggctctgactggaccc

SEQ ID NO: 7959892 - DNA, 22 bp, Homo sapiens
ccaggaggctctgactggaccc

SEQ ID NO: 7959893 - DNA, 22 bp, Homo sapiens
ccaggaggctctgactggaccc

SEQ ID NO: 7959894 - DNA, 22 bp, Homo sapiens
ccaggaggctcttgtccctggt

SEQ ID NO: 7959895 - DNA, 22 bp, Homo sapiens
ccaggaggctcttgtccctggt

SEQ ID NO: 7959896 - DNA, 22 bp, Homo sapiens
ccaggaggctcttgtccctggt

SEQ ID NO: 7959897 - DNA, 22 bp, Homo sapiens
ccaggaggctcttgtccctggt

SEQ ID NO: 7959898 - DNA, 22 bp, Homo sapiens
ccaggaggctctgcccatccca

SEQ ID NO: 7959899 - DNA, 22 bp, Homo sapiens
ccaggaggctctgcccatccca

SEQ ID NO: 7959900 - DNA, 22 bp, Homo sapiens
ccaggaggctctgcccatccca

SEQ ID NO: 7959901 - DNA, 22 bp, Homo sapiens
ccaggaggctctgactggaccc

SEQ ID NO: 7959902 - DNA, 22 bp, Homo sapiens
ccaggaggctctgactggaccc

SEQ ID NO: 7959903 - DNA, 22 bp, Homo sapiens
ccaggaggcggaggttgcagtg

SEQ ID NO: 7959904 - DNA, 22 bp, Homo sapiens
ccaggaggcggaggttgcagtg

SEQ ID NO: 7959905 - DNA, 22 bp, Homo sapiens
ccaggaggcggaggttgcagtg

SEQ ID NO: 7959906 - DNA, 22 bp, Homo sapiens
ccaggaggcggaggttgcagtg

SEQ ID NO: 7959907 - DNA, 22 bp, Homo sapiens
ccaggaggcggaggttgcagtg

SEQ ID NO: 7959908 - DNA, 22 bp, Homo sapiens
ccaggaggcggaggttgcagcg

SEQ ID NO: 7959909 - DNA, 22 bp, Homo sapiens
ccaggcacttgtttgccaggca

SEQ ID NO: 7959910 - DNA, 22 bp, Homo sapiens
ccaggcacttgtttgccaggca

SEQ ID NO: 7959911 - DNA, 22 bp, Homo sapiens
ccaggcagaatgaaacccctgt

SEQ ID NO: 7959912 - DNA, 22 bp, Homo sapiens
ccaggcacttgtttgccaggca

SEQ ID NO: 7959913 - DNA, 22 bp, Homo sapiens
ccaggcacttgtttgccaggca

SEQ ID NO: 7959914 - DNA, 22 bp, Homo sapiens
ccaggcacttgtttgccaggca

SEQ ID NO: 7959915 - DNA, 22 bp, Homo sapiens
ccaggcacttgtttgccaggca

SEQ ID NO: 7959916 - DNA, 21 bp, Homo sapiens
ccaggcagagctgtgagttct

SEQ ID NO: 7959917 - DNA, 21 bp, Homo sapiens
ccaggcagagctgtgagttct

SEQ ID NO: 7959918 - DNA, 21 bp, Homo sapiens
ccaggcagagctgtgagttct

SEQ ID NO: 7959919 - DNA, 21 bp, Homo sapiens
ccaggcagagctgtgagttct

SEQ ID NO: 7959920 - DNA, 21 bp, Homo sapiens
ccaggcagagctgtgagttct

SEQ ID NO: 7959921 - DNA, 21 bp, Homo sapiens
ccaggcagagctgtgagttct

SEQ ID NO: 7959922 - DNA, 22 bp, Homo sapiens
ccaggcagaatgaaacccctgt

SEQ ID NO: 7959923 - DNA, 22 bp, Homo sapiens
ccaggcacttgtttgccaggca

SEQ ID NO: 7959924 - DNA, 22 bp, Homo sapiens
ccaggcagaatgaaacccctgt

SEQ ID NO: 7959925 - DNA, 22 bp, Homo sapiens
ccaggcagaatgaaacccctgt

SEQ ID NO: 7959926 - DNA, 22 bp, Homo sapiens
ccaggcacttgtttgccaggca

SEQ ID NO: 7959927 - DNA, 22 bp, Homo sapiens
ccaggcagaatgaaacccctgt

SEQ ID NO: 7959928 - DNA, 22 bp, Homo sapiens
ccaggcagaatgaaacccctgt

SEQ ID NO: 7959929 - DNA, 22 bp, Homo sapiens
ccaggcaattctgaaagcattt

SEQ ID NO: 7959930 - DNA, 22 bp, Homo sapiens
ccaggcacactgccctgccctt

SEQ ID NO: 7959931 - DNA, 22 bp, Homo sapiens
ccaggcacactgccctgccctt

SEQ ID NO: 7959932 - DNA, 22 bp, Homo sapiens
ccaggcaagtagaagctgtggt

SEQ ID NO: 7959933 - DNA, 22 bp, Homo sapiens
ccaggcaagtagaagctgtggt

SEQ ID NO: 7959934 - DNA, 22 bp, Homo sapiens
ccaggaggcttcgtccgtggag

SEQ ID NO: 7959935 - DNA, 22 bp, Homo sapiens
ccaggaggcttcgtccgtggag

SEQ ID NO: 7959936 - DNA, 22 bp, Homo sapiens
ccaggaggctcttgtccctggt

SEQ ID NO: 7959937 - DNA, 16 bp, Homo sapiens
ccaggaggctgacacc

SEQ ID NO: 7959938 - DNA, 16 bp, Homo sapiens
ccaggaggctgacacc

SEQ ID NO: 7959939 - DNA, 22 bp, Homo sapiens
tctgggcttttgcactggccat

SEQ ID NO: 7959940 - DNA, 22 bp, Homo sapiens
tctgggcttttgcactggccat

SEQ ID NO: 7959941 - DNA, 21 bp, Homo sapiens
tctggggaagacatctaggat

SEQ ID NO: 7959942 - DNA, 21 bp, Homo sapiens
tctggggaagacatctaggat

SEQ ID NO: 7959943 - DNA, 21 bp, Homo sapiens
tctggggaagacatctaggat

SEQ ID NO: 7959944 - DNA, 22 bp, Homo sapiens
tctggggaatgttcatttctga

SEQ ID NO: 7959945 - DNA, 22 bp, Homo sapiens
tctgggctctgtcagcacctct

SEQ ID NO: 7959946 - DNA, 22 bp, Homo sapiens
tctgggctctgtcagcacctct

SEQ ID NO: 7959947 - DNA, 22 bp, Homo sapiens
tctgggctctgtcagcacctct

SEQ ID NO: 7959948 - DNA, 22 bp, Homo sapiens
tctgggcttttgcactggccat

SEQ ID NO: 7959949 - DNA, 22 bp, Homo sapiens
tctgggcttttgcactggccat

SEQ ID NO: 7959950 - DNA, 22 bp, Homo sapiens
tctgggcttttgcactggccat

SEQ ID NO: 7959951 - DNA, 22 bp, Homo sapiens
tctgggcttttccatgcctgtg

SEQ ID NO: 7959952 - DNA, 22 bp, Homo sapiens
tctggggacggggcccagcaat

SEQ ID NO: 7959953 - DNA, 22 bp, Homo sapiens
tctggggacggggcccagcaat

SEQ ID NO: 7959954 - DNA, 22 bp, Homo sapiens
tctggggaccatggcatctaaa

SEQ ID NO: 7959955 - DNA, 22 bp, Homo sapiens
tctggggacggggcccagcaat

SEQ ID NO: 7959956 - DNA, 22 bp, Homo sapiens
tctggggaccatggcatctaaa

SEQ ID NO: 7959957 - DNA, 22 bp, Homo sapiens
tctggggaccatggcatctaaa

SEQ ID NO: 7959958 - DNA, 22 bp, Homo sapiens
tctggggaccatggcatctaaa

SEQ ID NO: 7959959 - DNA, 22 bp, Homo sapiens
tctggggagggagccacaggtc

SEQ ID NO: 7959960 - DNA, 22 bp, Homo sapiens
tctggggagggagccacaggtc

SEQ ID NO: 7959961 - DNA, 22 bp, Homo sapiens
tctggggagggagccacaggtc

SEQ ID NO: 7959962 - DNA, 22 bp, Homo sapiens
tctggggagcagccctggtgag

SEQ ID NO: 7959963 - DNA, 22 bp, Homo sapiens
tctggggagcagccctggtgag

SEQ ID NO: 7959964 - DNA, 22 bp, Homo sapiens
tctggggagcagccctggtgag

SEQ ID NO: 7959965 - DNA, 22 bp, Homo sapiens
ccaggagcaacttgaaggcaag

SEQ ID NO: 7959966 - DNA, 22 bp, Homo sapiens
ccaggagcaacttgaaggcaag

SEQ ID NO: 7959967 - DNA, 22 bp, Homo sapiens
ccaggagcaacttgaaggcaag

SEQ ID NO: 7959968 - DNA, 22 bp, Homo sapiens
ccaggagcaccaggcctgtgcc

SEQ ID NO: 7959969 - DNA, 22 bp, Homo sapiens
ccaggagcaacttgaaggcaag

SEQ ID NO: 7959970 - DNA, 22 bp, Homo sapiens
ccaggagcaacttgaaggcaag

SEQ ID NO: 7959971 - DNA, 22 bp, Homo sapiens
ccaggagcaacttgaaggcaag

SEQ ID NO: 7959972 - DNA, 22 bp, Homo sapiens
ccaggagcaaagatcactggga

SEQ ID NO: 7959973 - DNA, 22 bp, Homo sapiens
ccaggagcaaagatcactggga

SEQ ID NO: 7959974 - DNA, 22 bp, Homo sapiens
ccaggagcaacttgaaggcaag

SEQ ID NO: 7959975 - DNA, 22 bp, Homo sapiens
ccaggagcaaagatcactggga

SEQ ID NO: 7959976 - DNA, 22 bp, Homo sapiens
ccaggagagcaaaggtcactct

SEQ ID NO: 7959977 - DNA, 22 bp, Homo sapiens
ccaggagagcaaaggtcactct

SEQ ID NO: 7959978 - DNA, 22 bp, Homo sapiens
tctggggagtcaaagagacctg

SEQ ID NO: 7959979 - DNA, 22 bp, Homo sapiens
ccaggagagcaaaggtcactct

SEQ ID NO: 7959980 - DNA, 22 bp, Homo sapiens
ccaggagagcaaaggtcactct

SEQ ID NO: 7959981 - DNA, 22 bp, Homo sapiens
tctggggatgaggacctagatg

SEQ ID NO: 7959982 - DNA, 22 bp, Homo sapiens
tctggggatgaggacctagatg

SEQ ID NO: 7959983 - DNA, 22 bp, Homo sapiens
tctggggatgaggacctagatg

SEQ ID NO: 7959984 - DNA, 22 bp, Homo sapiens
tctggggagtgcctaagtggaa

SEQ ID NO: 7959985 - DNA, 22 bp, Homo sapiens
tctggggataagacccaggtat

SEQ ID NO: 7959986 - DNA, 22 bp, Homo sapiens
tctggggatgaggacctagatg

SEQ ID NO: 7959987 - DNA, 22 bp, Homo sapiens
tctggggataagacccaggtat

SEQ ID NO: 7959988 - DNA, 22 bp, Homo sapiens
tctggggagtgcctaagtggaa

SEQ ID NO: 7959989 - DNA, 22 bp, Homo sapiens
tctggggagtgcctaagtggaa

SEQ ID NO: 7959990 - DNA, 22 bp, Homo sapiens
tctggggagtcaaagagacctg

SEQ ID NO: 7959991 - DNA, 22 bp, Homo sapiens
tctggggagtcaaagagacctg

SEQ ID NO: 7959992 - DNA, 22 bp, Homo sapiens
tctgggccctgagatgttcttc

SEQ ID NO: 7959993 - DNA, 22 bp, Homo sapiens
tctgggccctgagatgttcttc

SEQ ID NO: 7959994 - DNA, 22 bp, Homo sapiens
tctgggccctgagatgttcttc

SEQ ID NO: 7959995 - DNA, 22 bp, Homo sapiens
tctgggccctaaaccagctcta

SEQ ID NO: 7959996 - DNA, 22 bp, Homo sapiens
tctgggccctgagatgttcttc

SEQ ID NO: 7959997 - DNA, 22 bp, Homo sapiens
tctgggccctgagatgttcttc

SEQ ID NO: 7959998 - DNA, 22 bp, Homo sapiens
tctgggccggagccgacggcag

SEQ ID NO: 7959999 - DNA, 22 bp, Homo sapiens
tctgggccggagccgacggcag

SEQ ID NO: 7960000 - DNA, 22 bp, Homo sapiens
tctgggccgctgcgttccatga

SEQ ID NO: 7960001 - DNA, 22 bp, Homo sapiens
tctgggccgctgcgttccatga

SEQ ID NO: 7960002 - DNA, 22 bp, Homo sapiens
tctgggccgctgcgttccatga

SEQ ID NO: 7960003 - DNA, 22 bp, Homo sapiens
tctgggccgctgcgttccatga

SEQ ID NO: 7960004 - DNA, 22 bp, Homo sapiens
tctgggcctatagaagtctacc

SEQ ID NO: 7960005 - DNA, 22 bp, Homo sapiens
tctgggcctatagaagtctacc

SEQ ID NO: 7960006 - DNA, 22 bp, Homo sapiens
tctgggcctcacctgctgctca

SEQ ID NO: 7960007 - DNA, 22 bp, Homo sapiens
tctgggcctcacctgctgctca

SEQ ID NO: 7960008 - DNA, 22 bp, Homo sapiens
tctgggcctcacctgctgctca

SEQ ID NO: 7960009 - DNA, 22 bp, Homo sapiens
tctgggccggagccgacggcag

SEQ ID NO: 7960010 - DNA, 22 bp, Homo sapiens
tctgggcctatagaagtctacc

SEQ ID NO: 7960011 - DNA, 22 bp, Homo sapiens
tctgggccggagccgacggcag

SEQ ID NO: 7960012 - DNA, 22 bp, Homo sapiens
ccagcactcgctgattttagga

SEQ ID NO: 7960013 - DNA, 22 bp, Homo sapiens
ccagcactctattgaatattct

SEQ ID NO: 7960014 - DNA, 22 bp, Homo sapiens
ccagcaccttgatcttggagtt

SEQ ID NO: 7960015 - DNA, 22 bp, Homo sapiens
ccagcaccttgatcttggagtt

SEQ ID NO: 7960016 - DNA, 22 bp, Homo sapiens
ccagcactctattgaatattct

SEQ ID NO: 7960017 - DNA, 22 bp, Homo sapiens
ccagcactctgtcccagcttcc

SEQ ID NO: 7960018 - DNA, 22 bp, Homo sapiens
ccagcactctgtcccagcttcc

SEQ ID NO: 7960019 - DNA, 22 bp, Homo sapiens
tctgggaggctgggtcccgtcc

SEQ ID NO: 7960020 - DNA, 22 bp, Homo sapiens
tctgggaggctgggtcccgtcc

SEQ ID NO: 7960021 - DNA, 20 bp, Homo sapiens
tctgggagggacaagtctcc

SEQ ID NO: 7960022 - DNA, 22 bp, Homo sapiens
tctgggagggagcctcagaatc

SEQ ID NO: 7960023 - DNA, 20 bp, Homo sapiens
tctgggagggacaagtctcc

SEQ ID NO: 7960024 - DNA, 22 bp, Homo sapiens
tctgggcctgtctcagagctgg

SEQ ID NO: 7960025 - DNA, 22 bp, Homo sapiens
tctgggccttggagtggggaga

SEQ ID NO: 7960026 - DNA, 22 bp, Homo sapiens
tctgggcctgtctcagagctgg

SEQ ID NO: 7960027 - DNA, 22 bp, Homo sapiens
tctgggcctgtctcagagctgg

SEQ ID NO: 7960028 - DNA, 22 bp, Homo sapiens
tctgggcctgatggctaaagcc

SEQ ID NO: 7960029 - DNA, 22 bp, Homo sapiens
tctgggcctgtctcagagctgg

SEQ ID NO: 7960030 - DNA, 22 bp, Homo sapiens
tctgggcctgatggctaaagcc

SEQ ID NO: 7960031 - DNA, 22 bp, Homo sapiens
tctgggcctgatggctaaagcc

SEQ ID NO: 7960032 - DNA, 22 bp, Homo sapiens
tctgggcctgatggctaaagcc

SEQ ID NO: 7960033 - DNA, 22 bp, Homo sapiens
tctgggcctcagtttcttcatc

SEQ ID NO: 7960034 - DNA, 22 bp, Homo sapiens
tctgggcctcagtttcttcatc

SEQ ID NO: 7960035 - DNA, 22 bp, Homo sapiens
tctgggcctcacctgctgctca

SEQ ID NO: 7960036 - DNA, 22 bp, Homo sapiens
tctgggcctcacctgctgctca

SEQ ID NO: 7960037 - DNA, 22 bp, Homo sapiens
tctgggcctcagtttcttcatc

SEQ ID NO: 7960038 - DNA, 22 bp, Homo sapiens
tctgggcctcagtttcttcatc

SEQ ID NO: 7960039 - DNA, 22 bp, Homo sapiens
tctgggcctcagtttcttcatc

SEQ ID NO: 7960040 - DNA, 22 bp, Homo sapiens
tctgggctatatggtctctgct

SEQ ID NO: 7960041 - DNA, 22 bp, Homo sapiens
tctgggctatatggtctctgct

SEQ ID NO: 7960042 - DNA, 22 bp, Homo sapiens
tctgggctatatggtctctgct

SEQ ID NO: 7960043 - DNA, 22 bp, Homo sapiens
tctgggccttggagtggggaga

SEQ ID NO: 7960044 - DNA, 22 bp, Homo sapiens
tctgggccttggagtggggaga

SEQ ID NO: 7960045 - DNA, 22 bp, Homo sapiens
tctgggctcacgagtctggaca

SEQ ID NO: 7960046 - DNA, 22 bp, Homo sapiens
tctgggctcacgagtctggaca

SEQ ID NO: 7960047 - DNA, 22 bp, Homo sapiens
tctgggctcacgagtctggaca

SEQ ID NO: 7960048 - DNA, 22 bp, Homo sapiens
tctgggctcacgagtctggaca

SEQ ID NO: 7960049 - DNA, 22 bp, Homo sapiens
tctgggctatatggtctctgct

SEQ ID NO: 7960050 - DNA, 22 bp, Homo sapiens
tctgggctctgcgaagcccttc

SEQ ID NO: 7960051 - DNA, 22 bp, Homo sapiens
tctgggctctgcgaagcccttc

SEQ ID NO: 7960052 - DNA, 22 bp, Homo sapiens
tctgggctcacgagtctggaca

SEQ ID NO: 7960053 - DNA, 22 bp, Homo sapiens
tctgggctctgggaattaggga

SEQ ID NO: 7960054 - DNA, 22 bp, Homo sapiens
tctgggctctgggaattaggga

SEQ ID NO: 7960055 - DNA, 22 bp, Homo sapiens
tctgggctctgggaattaggga

SEQ ID NO: 7960056 - DNA, 22 bp, Homo sapiens
tctgggctctgtcagcacctct

SEQ ID NO: 7960057 - DNA, 22 bp, Homo sapiens
tctgttcatgtctttttaagtg

SEQ ID NO: 7960058 - DNA, 22 bp, Homo sapiens
tctgttcatgtctttttaagtg

SEQ ID NO: 7960059 - DNA, 22 bp, Homo sapiens
tctgttcatctcatgggagaat

SEQ ID NO: 7960060 - DNA, 22 bp, Homo sapiens
tctgttcatgaaatatcttttt

SEQ ID NO: 7960061 - DNA, 22 bp, Homo sapiens
tctgttctaagcattctatgtg

SEQ ID NO: 7960062 - DNA, 22 bp, Homo sapiens
tctgttctaagcattctatgtg

SEQ ID NO: 7960063 - DNA, 22 bp, Homo sapiens
tctgttcctgcatagtacctca

SEQ ID NO: 7960064 - DNA, 22 bp, Homo sapiens
tctgttcctgcatagtacctca

SEQ ID NO: 7960065 - DNA, 22 bp, Homo sapiens
tctgttcctggtctctggagct

SEQ ID NO: 7960066 - DNA, 22 bp, Homo sapiens
tctgttcttcctacattcacat

SEQ ID NO: 7960067 - DNA, 22 bp, Homo sapiens
tctgttcttgcttttctccaac

SEQ ID NO: 7960068 - DNA, 22 bp, Homo sapiens
ccaggaggcggaggttgcagcg

SEQ ID NO: 7960069 - DNA, 22 bp, Homo sapiens
tctgttcttaaagcattcttgc

SEQ ID NO: 7960070 - DNA, 22 bp, Homo sapiens
tctgttcttaaagcattcttgc

SEQ ID NO: 7960071 - DNA, 22 bp, Homo sapiens
tctgttcttaaagcattcttgc

SEQ ID NO: 7960072 - DNA, 22 bp, Homo sapiens
tctgttcttcctacattcacat

SEQ ID NO: 7960073 - DNA, 22 bp, Homo sapiens
tctgttcttcctacattcacat

SEQ ID NO: 7960074 - DNA, 22 bp, Homo sapiens
tctgttcttcctacattcacat

SEQ ID NO: 7960075 - DNA, 22 bp, Homo sapiens
tctgttctattggtctatgtgt

SEQ ID NO: 7960076 - DNA, 22 bp, Homo sapiens
tctgttctattggtctatgtgt

SEQ ID NO: 7960077 - DNA, 20 bp, Homo sapiens
tctgttattgcatgtacata

SEQ ID NO: 7960078 - DNA, 20 bp, Homo sapiens
tctgttcaaatcttagttcc

SEQ ID NO: 7960079 - DNA, 23 bp, Homo sapiens
tctgtggctccttcaggctgctg

SEQ ID NO: 7960080 - DNA, 23 bp, Homo sapiens
tctgtggctccttcaggctgctg

SEQ ID NO: 7960081 - DNA, 21 bp, Homo sapiens
tctgtggcggactctaggccc

SEQ ID NO: 7960082 - DNA, 22 bp, Homo sapiens
ccaggagcctgggccaggctgg

SEQ ID NO: 7960083 - DNA, 22 bp, Homo sapiens
ccaggagcctgggccaggctgg

SEQ ID NO: 7960084 - DNA, 22 bp, Homo sapiens
ccaggagccctgccacaatggt

SEQ ID NO: 7960085 - DNA, 22 bp, Homo sapiens
ccaggagcctgggccaggctgg

SEQ ID NO: 7960086 - DNA, 22 bp, Homo sapiens
ccaggagcctgggccaggctgg

SEQ ID NO: 7960087 - DNA, 22 bp, Homo sapiens
ccaggagcctgggccaggctgg

SEQ ID NO: 7960088 - DNA, 22 bp, Homo sapiens
tctgttcagaaatggaagtgcc

SEQ ID NO: 7960089 - DNA, 19 bp, Homo sapiens
tctgttcacattgtttcgc

SEQ ID NO: 7960090 - DNA, 23 bp, Homo sapiens
tctgttcaaggctttctccttga

SEQ ID NO: 7960091 - DNA, 17 bp, Homo sapiens
tctgttcaagtgagagg

SEQ ID NO: 7960092 - DNA, 22 bp, Homo sapiens
tctgttcaggtttcagagaact

SEQ ID NO: 7960093 - DNA, 22 bp, Homo sapiens
tctgttcaggtttcagagaact

SEQ ID NO: 7960094 - DNA, 22 bp, Homo sapiens
tctgttcagctgcctcagggta

SEQ ID NO: 7960095 - DNA, 22 bp, Homo sapiens
tctgttcagacactttacatgt

SEQ ID NO: 7960096 - DNA, 22 bp, Homo sapiens
tctgttcagttgattagacaga

SEQ ID NO: 7960097 - DNA, 22 bp, Homo sapiens
tctgttcagttgattagacaga

SEQ ID NO: 7960098 - DNA, 22 bp, Homo sapiens
tctgttcaggtttcagagaact

SEQ ID NO: 7960099 - DNA, 22 bp, Homo sapiens
tctgttcagttgatgtagtttt

SEQ ID NO: 7960100 - DNA, 22 bp, Homo sapiens
tctgttcatagtagtgtatatg

SEQ ID NO: 7960101 - DNA, 22 bp, Homo sapiens
tctgttcatcatctggacacat

SEQ ID NO: 7960102 - DNA, 19 bp, Homo sapiens
ccaggagcagtggtgagct

SEQ ID NO: 7960103 - DNA, 19 bp, Homo sapiens
ccaggagcagtggtgagct

SEQ ID NO: 7960104 - DNA, 19 bp, Homo sapiens
ccaggagcagtggtgagct

SEQ ID NO: 7960105 - DNA, 19 bp, Homo sapiens
ccaggagcagtggtgagct

SEQ ID NO: 7960106 - DNA, 19 bp, Homo sapiens
ccaggagcagtggtgagct

SEQ ID NO: 7960107 - DNA, 22 bp, Homo sapiens
ccaggagcagggctggctgcac

SEQ ID NO: 7960108 - DNA, 19 bp, Homo sapiens
ccaggagcagtggtgagct

SEQ ID NO: 7960109 - DNA, 22 bp, Homo sapiens
ccaggagcagggctggctgcac

SEQ ID NO: 7960110 - DNA, 22 bp, Homo sapiens
ccaggagcagggctggctgcac

SEQ ID NO: 7960111 - DNA, 22 bp, Homo sapiens
ccaggagcagggctggctgcac

SEQ ID NO: 7960112 - DNA, 22 bp, Homo sapiens
ccaggagcaggagctggacaga

SEQ ID NO: 7960113 - DNA, 22 bp, Homo sapiens
ccaggagcaggagctggacaga

SEQ ID NO: 7960114 - DNA, 22 bp, Homo sapiens
ccaggagcaggagctggacaga

SEQ ID NO: 7960115 - DNA, 22 bp, Homo sapiens
ccaggagcagggctggctgcac

SEQ ID NO: 7960116 - DNA, 22 bp, Homo sapiens
ccaggagcagggctggctgcac

SEQ ID NO: 7960117 - DNA, 22 bp, Homo sapiens
ccaggagcagggctggctgcac

SEQ ID NO: 7960118 - DNA, 22 bp, Homo sapiens
ccaggagccactcaggcccaca

SEQ ID NO: 7960119 - DNA, 22 bp, Homo sapiens
ccaggagccactcaggcccaca

SEQ ID NO: 7960120 - DNA, 22 bp, Homo sapiens
ccaggagccctgccacaatggt

SEQ ID NO: 7960121 - DNA, 22 bp, Homo sapiens
ccaggagccctgccacaatggt

SEQ ID NO: 7960122 - DNA, 22 bp, Homo sapiens
ccaggagccctgccacaatggt

SEQ ID NO: 7960123 - DNA, 22 bp, Homo sapiens
ccaggagccactcaggcccaca

SEQ ID NO: 7960124 - DNA, 22 bp, Homo sapiens
ccaggagccactcaggcccaca

SEQ ID NO: 7960125 - DNA, 22 bp, Homo sapiens
ccaggagcattaagagaacata

SEQ ID NO: 7960126 - DNA, 22 bp, Homo sapiens
ccaggagcattaagagaacata

SEQ ID NO: 7960127 - DNA, 22 bp, Homo sapiens
ccaggagccactcaggcccaca

SEQ ID NO: 7960128 - DNA, 22 bp, Homo sapiens
ccaggagcattaagagaacata

SEQ ID NO: 7960129 - DNA, 22 bp, Homo sapiens
ccaggagcattaagagaacata

SEQ ID NO: 7960130 - DNA, 19 bp, Homo sapiens
ccaggagcagtggtgagct

SEQ ID NO: 7960131 - DNA, 22 bp, Homo sapiens
ccaggagcaggagctgcagctg

SEQ ID NO: 7960132 - DNA, 22 bp, Homo sapiens
ccaggagcaggagctggacaga

SEQ ID NO: 7960133 - DNA, 22 bp, Homo sapiens
ccaggagcaggagctggacaga

SEQ ID NO: 7960134 - DNA, 22 bp, Homo sapiens
ccaggagcaggagctgcagctg

SEQ ID NO: 7960135 - DNA, 22 bp, Homo sapiens
ccaggagcaggagctgcagctg

SEQ ID NO: 7960136 - DNA, 22 bp, Homo sapiens
ccaggagcaggagctggacaga

SEQ ID NO: 7960137 - DNA, 22 bp, Homo sapiens
ccaggagcaggagctggacaga

SEQ ID NO: 7960138 - DNA, 22 bp, Homo sapiens
ccaggagcaggagctggacaga

SEQ ID NO: 7960139 - DNA, 22 bp, Homo sapiens
ccaggagcagccggcccacctg

SEQ ID NO: 7960140 - DNA, 22 bp, Homo sapiens
ccaggagcagatatggacataa

SEQ ID NO: 7960141 - DNA, 22 bp, Homo sapiens
ccaggagcagatatggacataa

SEQ ID NO: 7960142 - DNA, 22 bp, Homo sapiens
ccaggagcagccggcccacctg

SEQ ID NO: 7960143 - DNA, 22 bp, Homo sapiens
ccaggagcaggagctgcagctg

SEQ ID NO: 7960144 - DNA, 22 bp, Homo sapiens
ccaggagcagccggcccacctg

SEQ ID NO: 7960145 - DNA, 22 bp, Homo sapiens
ccaggagcaccaggcctgtgcc

SEQ ID NO: 7960146 - DNA, 22 bp, Homo sapiens
ccaggagcaccaggcctgtgcc

SEQ ID NO: 7960147 - DNA, 22 bp, Homo sapiens
ccaggagcaccaggcctgtgcc

SEQ ID NO: 7960148 - DNA, 22 bp, Homo sapiens
ccaggagcagagtaggtgttca

SEQ ID NO: 7960149 - DNA, 22 bp, Homo sapiens
ccaggagcaccaggcctgtgcc

SEQ ID NO: 7960150 - DNA, 22 bp, Homo sapiens
ccaggagcaccaggcctgtgcc

SEQ ID NO: 7960151 - DNA, 22 bp, Homo sapiens
ccaggagcagatatggacataa

SEQ ID NO: 7960152 - DNA, 22 bp, Homo sapiens
ccaggagcagatatggacataa

SEQ ID NO: 7960153 - DNA, 22 bp, Homo sapiens
ccaggagcagatatggacataa

SEQ ID NO: 7960154 - DNA, 22 bp, Homo sapiens
ccaggagcagagtaggtgttca

SEQ ID NO: 7960155 - DNA, 22 bp, Homo sapiens
ccaggagcagagtaggtgttca

SEQ ID NO: 7960156 - DNA, 22 bp, Homo sapiens
ccaggagcagatatggacataa

SEQ ID NO: 7960157 - DNA, 22 bp, Homo sapiens
ccaggagcagatatggacataa

SEQ ID NO: 7960158 - DNA, 22 bp, Homo sapiens
ccacaggctgctgcaggtcccg

SEQ ID NO: 7960159 - DNA, 22 bp, Homo sapiens
ccacaggctgctgcaggtcccg

SEQ ID NO: 7960160 - DNA, 22 bp, Homo sapiens
ccacaggcggagtggcgggcag

SEQ ID NO: 7960161 - DNA, 22 bp, Homo sapiens
ccacaggctgctgcaggtcccg

SEQ ID NO: 7960162 - DNA, 22 bp, Homo sapiens
ccacaggctgctgcaggtcccg

SEQ ID NO: 7960163 - DNA, 22 bp, Homo sapiens
ccacaggctgctgcaggtcccg

SEQ ID NO: 7960164 - DNA, 22 bp, Homo sapiens
ccacaggctgctgcaggtcccg

SEQ ID NO: 7960165 - DNA, 22 bp, Homo sapiens
ccacaggctgctgcaggtcccg

SEQ ID NO: 7960166 - DNA, 22 bp, Homo sapiens
ccacaggctgctgcaggtcccg

SEQ ID NO: 7960167 - DNA, 22 bp, Homo sapiens
ccacagggaacatgacagcctt

SEQ ID NO: 7960168 - DNA, 22 bp, Homo sapiens
ccacagggaacatgacagcctt

SEQ ID NO: 7960169 - DNA, 22 bp, Homo sapiens
ccacagggaacatgacagcctt

SEQ ID NO: 7960170 - DNA, 22 bp, Homo sapiens
ccacagggaacatgacagcctt

SEQ ID NO: 7960171 - DNA, 22 bp, Homo sapiens
ccacaggctgctgcaggtcccg

SEQ ID NO: 7960172 - DNA, 22 bp, Homo sapiens
ccacagggcctttcctgctggc

SEQ ID NO: 7960173 - DNA, 22 bp, Homo sapiens
ccacagggcctttcctgctggc

SEQ ID NO: 7960174 - DNA, 22 bp, Homo sapiens
ccacagggcacagacaggaagc

SEQ ID NO: 7960175 - DNA, 22 bp, Homo sapiens
ccacagggcacagacaggaagc

SEQ ID NO: 7960176 - DNA, 22 bp, Homo sapiens
ccacagggcctttcctgctggc

SEQ ID NO: 7960177 - DNA, 22 bp, Homo sapiens
ccacagggcacagacaggaagc

SEQ ID NO: 7960178 - DNA, 22 bp, Homo sapiens
ccacagggcacagacaggaagc

SEQ ID NO: 7960179 - DNA, 22 bp, Homo sapiens
ccacagggcacaagggaggttg

SEQ ID NO: 7960180 - DNA, 22 bp, Homo sapiens
ccacagggcacaagggaggttg

SEQ ID NO: 7960181 - DNA, 22 bp, Homo sapiens
ccacagggcacaagggaggttg

SEQ ID NO: 7960182 - DNA, 22 bp, Homo sapiens
ccacagggataggaatggggct

SEQ ID NO: 7960183 - DNA, 22 bp, Homo sapiens
tcctggagctggtgtctttccc

SEQ ID NO: 7960184 - DNA, 22 bp, Homo sapiens
tcctggagctggtgtctttccc

SEQ ID NO: 7960185 - DNA, 22 bp, Homo sapiens
tcctggagcttcagtttccttt

SEQ ID NO: 7960186 - DNA, 22 bp, Homo sapiens
tcctggagcttcagtttccttt

SEQ ID NO: 7960187 - DNA, 22 bp, Homo sapiens
tcctggagctgactccgtttga

SEQ ID NO: 7960188 - DNA, 20 bp, Homo sapiens
tcctggagctgcttgaattc

SEQ ID NO: 7960189 - DNA, 22 bp, Homo sapiens
tcctggagcttccttcatggta

SEQ ID NO: 7960190 - DNA, 22 bp, Homo sapiens
tcctggagcttccttcatggta

SEQ ID NO: 7960191 - DNA, 22 bp, Homo sapiens
tcctggagcttccttcatggta

SEQ ID NO: 7960192 - DNA, 22 bp, Homo sapiens
tcctggaggacagaggcatctc

SEQ ID NO: 7960193 - DNA, 22 bp, Homo sapiens
tcctggaggaataagttttcca

SEQ ID NO: 7960194 - DNA, 22 bp, Homo sapiens
ccacagctgaccgcaggtgagc

SEQ ID NO: 7960195 - DNA, 22 bp, Homo sapiens
ccacagctgaccgcaggtgagc

SEQ ID NO: 7960196 - DNA, 22 bp, Homo sapiens
ccacaggcggagtggcgggcag

SEQ ID NO: 7960197 - DNA, 22 bp, Homo sapiens
ccacaggcggagtggcgggcag

SEQ ID NO: 7960198 - DNA, 22 bp, Homo sapiens
ccacagctgacaatggatagac

SEQ ID NO: 7960199 - DNA, 22 bp, Homo sapiens
ccacagctgacaatggatagac

SEQ ID NO: 7960200 - DNA, 22 bp, Homo sapiens
ccacagctgaccgcaggtgagc

SEQ ID NO: 7960201 - DNA, 22 bp, Homo sapiens
ccacagctgaccgcaggtgagc

SEQ ID NO: 7960202 - DNA, 22 bp, Homo sapiens
ccacagctgaccgcaggtgagc

SEQ ID NO: 7960203 - DNA, 22 bp, Homo sapiens
tcctggctaatgctgctgatgg

SEQ ID NO: 7960204 - DNA, 22 bp, Homo sapiens
tcctggctaacacggtgacacc

SEQ ID NO: 7960205 - DNA, 22 bp, Homo sapiens
tcctggctaacacggtgacacc

SEQ ID NO: 7960206 - DNA, 22 bp, Homo sapiens
tcctggctaacacggtgacacc

SEQ ID NO: 7960207 - DNA, 16 bp, Homo sapiens
tcctggcctttggaag

SEQ ID NO: 7960208 - DNA, 16 bp, Homo sapiens
tcctggcctttggaag

SEQ ID NO: 7960209 - DNA, 22 bp, Homo sapiens
tcctggccttgctcctgatgcc

SEQ ID NO: 7960210 - DNA, 22 bp, Homo sapiens
tcctggccttgcgtcttgggag

SEQ ID NO: 7960211 - DNA, 22 bp, Homo sapiens
tcctggccttgctcctgatgcc

SEQ ID NO: 7960212 - DNA, 20 bp, Homo sapiens
tcctggccttctcgggcagt

SEQ ID NO: 7960213 - DNA, 22 bp, Homo sapiens
tcctggccttgcgtcttgggag

SEQ ID NO: 7960214 - DNA, 22 bp, Homo sapiens
tcctggccttgcgtcttgggag

SEQ ID NO: 7960215 - DNA, 22 bp, Homo sapiens
tcctggctccactgagcaggcc

SEQ ID NO: 7960216 - DNA, 22 bp, Homo sapiens
tcctggctcaggcccctggtgc

SEQ ID NO: 7960217 - DNA, 22 bp, Homo sapiens
tcctggctccactgagcaggcc

SEQ ID NO: 7960218 - DNA, 22 bp, Homo sapiens
tcctggctccactgagcaggcc

SEQ ID NO: 7960219 - DNA, 22 bp, Homo sapiens
ccaccaggcactcacagggaag

SEQ ID NO: 7960220 - DNA, 22 bp, Homo sapiens
ccaccaggacagccctgagggg

SEQ ID NO: 7960221 - DNA, 22 bp, Homo sapiens
ccaccaggacagccctgagggg

SEQ ID NO: 7960222 - DNA, 22 bp, Homo sapiens
tcctggctagttttgctgaaat

SEQ ID NO: 7960223 - DNA, 22 bp, Homo sapiens
tcctggctagttttgctgaaat

SEQ ID NO: 7960224 - DNA, 22 bp, Homo sapiens
tcctggctagttttgctgaaat

SEQ ID NO: 7960225 - DNA, 22 bp, Homo sapiens
tcctggctaatgctgctgatgg

SEQ ID NO: 7960226 - DNA, 22 bp, Homo sapiens
tcctggctaatgctgctgatgg

SEQ ID NO: 7960227 - DNA, 22 bp, Homo sapiens
tcctggctaatgctgctgatgg

SEQ ID NO: 7960228 - DNA, 22 bp, Homo sapiens
tcctggctcaggcccctggtgc

SEQ ID NO: 7960229 - DNA, 22 bp, Homo sapiens
tcctggctagttttgctgaaat

SEQ ID NO: 7960230 - DNA, 22 bp, Homo sapiens
tcctggctagttttgctgaaat

SEQ ID NO: 7960231 - DNA, 22 bp, Homo sapiens
tcctggctcaggcccctggtgc

SEQ ID NO: 7960232 - DNA, 22 bp, Homo sapiens
tcctggctcaggcccctggtgc

SEQ ID NO: 7960233 - DNA, 20 bp, Homo sapiens
tcctggccttctcgggcagt

SEQ ID NO: 7960234 - DNA, 20 bp, Homo sapiens
tcctggccttctcgggcagt

SEQ ID NO: 7960235 - DNA, 22 bp, Homo sapiens
tcctggccttatccccaaactg

SEQ ID NO: 7960236 - DNA, 22 bp, Homo sapiens
tcctggccttatccccaaactg

SEQ ID NO: 7960237 - DNA, 22 bp, Homo sapiens
tcctggcctgtctggagtagct

SEQ ID NO: 7960238 - DNA, 22 bp, Homo sapiens
tcctggcctgtctggagtagct

SEQ ID NO: 7960239 - DNA, 22 bp, Homo sapiens
tcctggccttagcgaggcggtc

SEQ ID NO: 7960240 - DNA, 22 bp, Homo sapiens
tcctggccttagcgaggcggtc

SEQ ID NO: 7960241 - DNA, 22 bp, Homo sapiens
tcctggccttagcgaggcggtc

SEQ ID NO: 7960242 - DNA, 22 bp, Homo sapiens
tcctggccttagcgaggcggtc

SEQ ID NO: 7960243 - DNA, 21 bp, Homo sapiens
ccacaggggctcccctgtcag

SEQ ID NO: 7960244 - DNA, 21 bp, Homo sapiens
ccacaggggctcccctgtcag

SEQ ID NO: 7960245 - DNA, 22 bp, Homo sapiens
ccacagggctctaggcgcttcc

SEQ ID NO: 7960246 - DNA, 22 bp, Homo sapiens
ccacagggcctttcctgctggc

SEQ ID NO: 7960247 - DNA, 22 bp, Homo sapiens
ccacagggcctttcctgctggc

SEQ ID NO: 7960248 - DNA, 21 bp, Homo sapiens
ccacaggggctcccctgtcag

SEQ ID NO: 7960249 - DNA, 22 bp, Homo sapiens
ccacaggggtctctgtagctga

SEQ ID NO: 7960250 - DNA, 21 bp, Homo sapiens
ccacaggggctcccctgtcag

SEQ ID NO: 7960251 - DNA, 22 bp, Homo sapiens
ccacaggggtctctgtagctga

SEQ ID NO: 7960252 - DNA, 22 bp, Homo sapiens
ccacaggggtctctgtagctga

SEQ ID NO: 7960253 - DNA, 22 bp, Homo sapiens
ccaagagccatcctggtcaaca

SEQ ID NO: 7960254 - DNA, 20 bp, Homo sapiens
ccaagagcatgcatgaggaa

SEQ ID NO: 7960255 - DNA, 20 bp, Homo sapiens
ccaagagcatgcatgaggaa

SEQ ID NO: 7960256 - DNA, 21 bp, Homo sapiens
ccaagagcaatgctaaggaga

SEQ ID NO: 7960257 - DNA, 21 bp, Homo sapiens
ccaagagcaatgctaaggaga

SEQ ID NO: 7960258 - DNA, 21 bp, Homo sapiens
ccaagagcaatgctaaggaga

SEQ ID NO: 7960259 - DNA, 23 bp, Homo sapiens
ccaagactgttaggagtggggag

SEQ ID NO: 7960260 - DNA, 22 bp, Homo sapiens
ccaagagctacagatatgaaat

SEQ ID NO: 7960261 - DNA, 22 bp, Homo sapiens
ccaagagctacagatatgaaat

SEQ ID NO: 7960262 - DNA, 22 bp, Homo sapiens
ccaagagcctcagctgccgtgc

SEQ ID NO: 7960263 - DNA, 22 bp, Homo sapiens
ccaagaggaccttgccagggca

SEQ ID NO: 7960264 - DNA, 22 bp, Homo sapiens
ccaagaggaccttgccagggca

SEQ ID NO: 7960265 - DNA, 22 bp, Homo sapiens
ccaagaggcagaatgcagagaa

SEQ ID NO: 7960266 - DNA, 22 bp, Homo sapiens
ccaagaggcagaatgcagagaa

SEQ ID NO: 7960267 - DNA, 21 bp, Homo sapiens
ccaagactcccatctagtggt

SEQ ID NO: 7960268 - DNA, 23 bp, Homo sapiens
ccaagactgttaggagtggggag

SEQ ID NO: 7960269 - DNA, 23 bp, Homo sapiens
ccaagactgttaggagtggggag

SEQ ID NO: 7960270 - DNA, 23 bp, Homo sapiens
ccaagactgttaggagtggggag

SEQ ID NO: 7960271 - DNA, 23 bp, Homo sapiens
ccaagactgttaggagtggggag

SEQ ID NO: 7960272 - DNA, 22 bp, Homo sapiens
ccaacttctccatcagataaga

SEQ ID NO: 7960273 - DNA, 22 bp, Homo sapiens
ccaactctgaaaatccagatat

SEQ ID NO: 7960274 - DNA, 22 bp, Homo sapiens
ccaactctgaaaatccagatat

SEQ ID NO: 7960275 - DNA, 22 bp, Homo sapiens
ccaactctgaaaatccagatat

SEQ ID NO: 7960276 - DNA, 22 bp, Homo sapiens
ccaaccagctatggaatcttgt

SEQ ID NO: 7960277 - DNA, 22 bp, Homo sapiens
ccaacagtccagatgagatggt

SEQ ID NO: 7960278 - DNA, 22 bp, Homo sapiens
ccaacagtccagatgagatggt

SEQ ID NO: 7960279 - DNA, 22 bp, Homo sapiens
ccaacagtccagatgagatggt

SEQ ID NO: 7960280 - DNA, 19 bp, Homo sapiens
ccaacagtactgaagcact

SEQ ID NO: 7960281 - DNA, 22 bp, Homo sapiens
ccaacaccatctgagctccagc

SEQ ID NO: 7960282 - DNA, 22 bp, Homo sapiens
ccaacaccatctgagctccagc

SEQ ID NO: 7960283 - DNA, 22 bp, Homo sapiens
ccaacaggttgagagtctgaat

SEQ ID NO: 7960284 - DNA, 22 bp, Homo sapiens
tcctgaggtatatgctttgcag

SEQ ID NO: 7960285 - DNA, 22 bp, Homo sapiens
tcctgaggtctgaaaaaggagc

SEQ ID NO: 7960286 - DNA, 22 bp, Homo sapiens
tcctgaggtgctcagccaggaa

SEQ ID NO: 7960287 - DNA, 22 bp, Homo sapiens
tcctgaggtgctcagccaggaa

SEQ ID NO: 7960288 - DNA, 22 bp, Homo sapiens
tcctgaggtgctcagccaggaa

SEQ ID NO: 7960289 - DNA, 23 bp, Homo sapiens
tcctgagggtttcccagccttgg

SEQ ID NO: 7960290 - DNA, 23 bp, Homo sapiens
tcctgagggtttcccagccttgg

SEQ ID NO: 7960291 - DNA, 23 bp, Homo sapiens
tcctgagggtttcccagccttgg

SEQ ID NO: 7960292 - DNA, 23 bp, Homo sapiens
tcctgagggtttcccagccttgg

SEQ ID NO: 7960293 - DNA, 22 bp, Homo sapiens
tcctgagggctgcagtcatagg

SEQ ID NO: 7960294 - DNA, 22 bp, Homo sapiens
tcctgagggctgcagtcatagg

SEQ ID NO: 7960295 - DNA, 22 bp, Homo sapiens
tcctgagggctgcagtcatagg

SEQ ID NO: 7960296 - DNA, 22 bp, Homo sapiens
tcctgaggtggattgagcagag

SEQ ID NO: 7960297 - DNA, 22 bp, Homo sapiens
tcctgaggtggattgagcagag

SEQ ID NO: 7960298 - DNA, 22 bp, Homo sapiens
tcctgaggtggattgagcagag

SEQ ID NO: 7960299 - DNA, 22 bp, Homo sapiens
tcctgaggtggattgagcagag

SEQ ID NO: 7960300 - DNA, 22 bp, Homo sapiens
tcctgaggtggattgagcagag

SEQ ID NO: 7960301 - DNA, 22 bp, Homo sapiens
tcctgaggtggattgagcagag

SEQ ID NO: 7960302 - DNA, 22 bp, Homo sapiens
tcctgaggtggattgagcagag

SEQ ID NO: 7960303 - DNA, 22 bp, Homo sapiens
tcctgaggtggattgagcagag

SEQ ID NO: 7960304 - DNA, 22 bp, Homo sapiens
ccaaattaaatcatacagacag

SEQ ID NO: 7960305 - DNA, 22 bp, Homo sapiens
tcctgaggtggattgagcagag

SEQ ID NO: 7960306 - DNA, 22 bp, Homo sapiens
ccaaattctgtgttcaaactca

SEQ ID NO: 7960307 - DNA, 21 bp, Homo sapiens
tcctgccttagtccagagcag

SEQ ID NO: 7960308 - DNA, 22 bp, Homo sapiens
tcctgccttcatactgctgtat

SEQ ID NO: 7960309 - DNA, 21 bp, Homo sapiens
tcctgccttagtccagagcag

SEQ ID NO: 7960310 - DNA, 21 bp, Homo sapiens
tcctgccttagtccagagcag

SEQ ID NO: 7960311 - DNA, 21 bp, Homo sapiens
tcctgccttagtccagagcag

SEQ ID NO: 7960312 - DNA, 21 bp, Homo sapiens
tcctgccttagtccagagcag

SEQ ID NO: 7960313 - DNA, 21 bp, Homo sapiens
tcctgccttagtccagagcag

SEQ ID NO: 7960314 - DNA, 21 bp, Homo sapiens
tcctgccttagtccagagcag

SEQ ID NO: 7960315 - DNA, 21 bp, Homo sapiens
tcctgccttagtccagagcag

SEQ ID NO: 7960316 - DNA, 22 bp, Homo sapiens
tcctgccttagagcaaggaaaa

SEQ ID NO: 7960317 - DNA, 22 bp, Homo sapiens
tcctgccttagagcaaggaaaa

SEQ ID NO: 7960318 - DNA, 22 bp, Homo sapiens
tcctgccttagagcaaggaaaa

SEQ ID NO: 7960319 - DNA, 19 bp, Homo sapiens
tcctgcccaccagccaggg

SEQ ID NO: 7960320 - DNA, 22 bp, Homo sapiens
tcctgcccagagctctccactc

SEQ ID NO: 7960321 - DNA, 22 bp, Homo sapiens
tcctgcccagagctctccactc

SEQ ID NO: 7960322 - DNA, 22 bp, Homo sapiens
tcctgcccagagctctccactc

SEQ ID NO: 7960323 - DNA, 19 bp, Homo sapiens
tcctgcccaccagccaggg

SEQ ID NO: 7960324 - DNA, 22 bp, Homo sapiens
ccaagaggggcagagggctgca

SEQ ID NO: 7960325 - DNA, 22 bp, Homo sapiens
ccaagagggttgccctgagcgt

SEQ ID NO: 7960326 - DNA, 22 bp, Homo sapiens
ccaagaggttgaggctgcagtg

SEQ ID NO: 7960327 - DNA, 22 bp, Homo sapiens
tcctgccttcatactgctgtat

SEQ ID NO: 7960328 - DNA, 22 bp, Homo sapiens
tcctgccttcatactgctgtat

SEQ ID NO: 7960329 - DNA, 22 bp, Homo sapiens
tcctgccttcatactgctgtat

SEQ ID NO: 7960330 - DNA, 22 bp, Homo sapiens
tcctgccttcatactgctgtat

SEQ ID NO: 7960331 - DNA, 22 bp, Homo sapiens
tcctgccttcatactgctgtat

SEQ ID NO: 7960332 - DNA, 22 bp, Homo sapiens
tcctgccttcatactgctgtat

SEQ ID NO: 7960333 - DNA, 22 bp, Homo sapiens
tcctgccttgcctgggacatca

SEQ ID NO: 7960334 - DNA, 22 bp, Homo sapiens
tcctgccttgcctgggacatca

SEQ ID NO: 7960335 - DNA, 22 bp, Homo sapiens
tcctgccttgcctgggacatca

SEQ ID NO: 7960336 - DNA, 22 bp, Homo sapiens
tcctgccttgcctgggacatca

SEQ ID NO: 7960337 - DNA, 22 bp, Homo sapiens
tcctgccttgcctgggacatca

SEQ ID NO: 7960338 - DNA, 23 bp, Homo sapiens
tcctgctgaaagctccagctggc

SEQ ID NO: 7960339 - DNA, 23 bp, Homo sapiens
tcctgctgaaagctccagctggc

SEQ ID NO: 7960340 - DNA, 22 bp, Homo sapiens
tcctgctctgatgggttctcct

SEQ ID NO: 7960341 - DNA, 22 bp, Homo sapiens
tcctgcgttcccctggcgccgg

SEQ ID NO: 7960342 - DNA, 22 bp, Homo sapiens
tcctgctagagaataacagcac

SEQ ID NO: 7960343 - DNA, 22 bp, Homo sapiens
tcctgctagagaataacagcac

SEQ ID NO: 7960344 - DNA, 22 bp, Homo sapiens
tcctggagccacggagctttca

SEQ ID NO: 7960345 - DNA, 22 bp, Homo sapiens
tcctggagccaggacccttccc

SEQ ID NO: 7960346 - DNA, 22 bp, Homo sapiens
tcctggagccaggacccttccc

SEQ ID NO: 7960347 - DNA, 22 bp, Homo sapiens
tcctggagccatgattcccctc

SEQ ID NO: 7960348 - DNA, 22 bp, Homo sapiens
cattttcagcacccatctgaaa

SEQ ID NO: 7960349 - DNA, 22 bp, Homo sapiens
cattttcagcacccatctgaaa

SEQ ID NO: 7960350 - DNA, 22 bp, Homo sapiens
cattttatgtttatggagtgct

SEQ ID NO: 7960351 - DNA, 22 bp, Homo sapiens
cattttatgtttatggagtgct

SEQ ID NO: 7960352 - DNA, 22 bp, Homo sapiens
cattttatgtttatggagtgct

SEQ ID NO: 7960353 - DNA, 22 bp, Homo sapiens
cattttatgtttatggagtgct

SEQ ID NO: 7960354 - DNA, 22 bp, Homo sapiens
cattttatcctctgggaagcta

SEQ ID NO: 7960355 - DNA, 22 bp, Homo sapiens
cattttatcctctgggaagcta

SEQ ID NO: 7960356 - DNA, 22 bp, Homo sapiens
cattttactgactcttgaatta

SEQ ID NO: 7960357 - DNA, 22 bp, Homo sapiens
cattttatgtttatggagtgct

SEQ ID NO: 7960358 - DNA, 22 bp, Homo sapiens
cattttatcctctgggaagcta

SEQ ID NO: 7960359 - DNA, 22 bp, Homo sapiens
cattttacctagaagctgaaag

SEQ ID NO: 7960360 - DNA, 22 bp, Homo sapiens
cattttacctagaagctgaaag

SEQ ID NO: 7960361 - DNA, 22 bp, Homo sapiens
cattttacctagaagctgaaag

SEQ ID NO: 7960362 - DNA, 19 bp, Homo sapiens
cattttaagcatccccagt

SEQ ID NO: 7960363 - DNA, 22 bp, Homo sapiens
cattttactgactcttgaatta

SEQ ID NO: 7960364 - DNA, 22 bp, Homo sapiens
cattttactgactcttgaatta

SEQ ID NO: 7960365 - DNA, 22 bp, Homo sapiens
cattttacgacatagggcaggc

SEQ ID NO: 7960366 - DNA, 21 bp, Homo sapiens
catttctattgatgagaaaag

SEQ ID NO: 7960367 - DNA, 21 bp, Homo sapiens
catttctattgatgagaaaag

SEQ ID NO: 7960368 - DNA, 22 bp, Homo sapiens
catttctatggcaatgggaaaa

SEQ ID NO: 7960369 - DNA, 23 bp, Homo sapiens
catttctaggtgtgtttggccat

SEQ ID NO: 7960370 - DNA, 22 bp, Homo sapiens
catttctatggcaatgggaaaa

SEQ ID NO: 7960371 - DNA, 23 bp, Homo sapiens
catttctaggtgtgtttggccat

SEQ ID NO: 7960372 - DNA, 22 bp, Homo sapiens
catttctagggatcataaagta

SEQ ID NO: 7960373 - DNA, 22 bp, Homo sapiens
catttgtcatcactgagctgcc

SEQ ID NO: 7960374 - DNA, 22 bp, Homo sapiens
catttgtcatcactgagctgcc

SEQ ID NO: 7960375 - DNA, 22 bp, Homo sapiens
catttgtctctaggaagtgagg

SEQ ID NO: 7960376 - DNA, 21 bp, Homo sapiens
catttctattgatgagaaaag

SEQ ID NO: 7960377 - DNA, 21 bp, Homo sapiens
catttctattgatgagaaaag

SEQ ID NO: 7960378 - DNA, 22 bp, Homo sapiens
catttgtgcttttataaaatag

SEQ ID NO: 7960379 - DNA, 22 bp, Homo sapiens
catttgtctctaggaagtgagg

SEQ ID NO: 7960380 - DNA, 22 bp, Homo sapiens
catttgtgcttttataaaatag

SEQ ID NO: 7960381 - DNA, 22 bp, Homo sapiens
catttgtgtgggaacccatcag

SEQ ID NO: 7960382 - DNA, 22 bp, Homo sapiens
cattttaagatgacctggtttc

SEQ ID NO: 7960383 - DNA, 22 bp, Homo sapiens
cattttaagatgacctggtttc

SEQ ID NO: 7960384 - DNA, 22 bp, Homo sapiens
cattttaagatgacctggtttc

SEQ ID NO: 7960385 - DNA, 22 bp, Homo sapiens
cattttaaatgatttaagccaa

SEQ ID NO: 7960386 - DNA, 22 bp, Homo sapiens
cattttaaatgatttaagccaa

SEQ ID NO: 7960387 - DNA, 22 bp, Homo sapiens
catttgttaaccagtgtggatt

SEQ ID NO: 7960388 - DNA, 22 bp, Homo sapiens
cattttaaatgatttaagccaa

SEQ ID NO: 7960389 - DNA, 22 bp, Homo sapiens
cattttaaatgatttaagccaa

SEQ ID NO: 7960390 - DNA, 22 bp, Homo sapiens
cattttaaatgatttaagccaa

SEQ ID NO: 7960391 - DNA, 19 bp, Homo sapiens
cattttaagcatccccagt

SEQ ID NO: 7960392 - DNA, 19 bp, Homo sapiens
cattttaagcatccccagt

SEQ ID NO: 7960393 - DNA, 19 bp, Homo sapiens
cattttaagcatccccagt

SEQ ID NO: 7960394 - DNA, 19 bp, Homo sapiens
cattttaagcatccccagt

SEQ ID NO: 7960395 - DNA, 19 bp, Homo sapiens
cattttaagcatccccagt

SEQ ID NO: 7960396 - DNA, 22 bp, Homo sapiens
cattttaagatgacctggtttc

SEQ ID NO: 7960397 - DNA, 22 bp, Homo sapiens
cattttaagatgacctggtttc

SEQ ID NO: 7960398 - DNA, 22 bp, Homo sapiens
cattttgtgctagacactatgg

SEQ ID NO: 7960399 - DNA, 22 bp, Homo sapiens
cattttgtgctagacactatgg

SEQ ID NO: 7960400 - DNA, 22 bp, Homo sapiens
cattttgtgctagacactatgg

SEQ ID NO: 7960401 - DNA, 22 bp, Homo sapiens
cattttgtgcacacgtggagtt

SEQ ID NO: 7960402 - DNA, 22 bp, Homo sapiens
cattttgtagcaatgactgttg

SEQ ID NO: 7960403 - DNA, 22 bp, Homo sapiens
cattttgtagcaatgactgttg

SEQ ID NO: 7960404 - DNA, 22 bp, Homo sapiens
cattttgtaagtctctcttgtt

SEQ ID NO: 7960405 - DNA, 22 bp, Homo sapiens
cattttgtaagtctctcttgtt

SEQ ID NO: 7960406 - DNA, 22 bp, Homo sapiens
cattttgtagcaatgactgttg

SEQ ID NO: 7960407 - DNA, 22 bp, Homo sapiens
cattttgtagcaatgactgttg

SEQ ID NO: 7960408 - DNA, 19 bp, Homo sapiens
cattttctcattgtgcccc

SEQ ID NO: 7960409 - DNA, 19 bp, Homo sapiens
cattttctcattgtgcccc

SEQ ID NO: 7960410 - DNA, 22 bp, Homo sapiens
cattttcatgagtttctgttca

SEQ ID NO: 7960411 - DNA, 22 bp, Homo sapiens
cattttccacaggcctatttcc

SEQ ID NO: 7960412 - DNA, 22 bp, Homo sapiens
cattttcatgagtttctgttca

SEQ ID NO: 7960413 - DNA, 22 bp, Homo sapiens
cattttcctctgctggtgttca

SEQ ID NO: 7960414 - DNA, 22 bp, Homo sapiens
cattttcctctgctggtgttca

SEQ ID NO: 7960415 - DNA, 22 bp, Homo sapiens
cattttctcaatgaaccctctt

SEQ ID NO: 7960416 - DNA, 22 bp, Homo sapiens
cattttccacaggcctatttcc

SEQ ID NO: 7960417 - DNA, 19 bp, Homo sapiens
cattttcccatcatccttt

SEQ ID NO: 7960418 - DNA, 22 bp, Homo sapiens
cattttccacaggcctatttcc

SEQ ID NO: 7960419 - DNA, 19 bp, Homo sapiens
cattttcccatcatccttt

SEQ ID NO: 7960420 - DNA, 19 bp, Homo sapiens
cattttcccatcatccttt

SEQ ID NO: 7960421 - DNA, 22 bp, Homo sapiens
tcctgagggactggttcctcgc

SEQ ID NO: 7960422 - DNA, 20 bp, Homo sapiens
tcctgaggcttcgccagtgt

SEQ ID NO: 7960423 - DNA, 22 bp, Homo sapiens
tcctgagggcgattcagcaggt

SEQ ID NO: 7960424 - DNA, 22 bp, Homo sapiens
tcctgagggcgattcagcaggt

SEQ ID NO: 7960425 - DNA, 22 bp, Homo sapiens
tcctgagggcgattcagcaggt

SEQ ID NO: 7960426 - DNA, 22 bp, Homo sapiens
tcctgagggcgattcagcaggt

SEQ ID NO: 7960427 - DNA, 22 bp, Homo sapiens
tcctgagggcgattcagcaggt

SEQ ID NO: 7960428 - DNA, 22 bp, Homo sapiens
tcctgagggctcggggctcatg

SEQ ID NO: 7960429 - DNA, 22 bp, Homo sapiens
tcctgagggctcggggctcatg

SEQ ID NO: 7960430 - DNA, 22 bp, Homo sapiens
tcctgagggctcggggctcatg

SEQ ID NO: 7960431 - DNA, 22 bp, Homo sapiens
tcctgaggctcactttgaatgt

SEQ ID NO: 7960432 - DNA, 20 bp, Homo sapiens
tcctgaggcttcgccagtgt

SEQ ID NO: 7960433 - DNA, 22 bp, Homo sapiens
tcctgagggactggttcctcgc

SEQ ID NO: 7960434 - DNA, 22 bp, Homo sapiens
ccaaaaattagatacacatata

SEQ ID NO: 7960435 - DNA, 22 bp, Homo sapiens
tcctgagaaggcacagcttgca

SEQ ID NO: 7960436 - DNA, 22 bp, Homo sapiens
tcctgagaaggcacagcttgca

SEQ ID NO: 7960437 - DNA, 22 bp, Homo sapiens
ccaaaaagtacatttaggtgtg

SEQ ID NO: 7960438 - DNA, 22 bp, Homo sapiens
ccaaaaagctcagagatatgtt

SEQ ID NO: 7960439 - DNA, 22 bp, Homo sapiens
ccaaaaattagatacacatata

SEQ ID NO: 7960440 - DNA, 22 bp, Homo sapiens
ccaaaaattagatacacatata

SEQ ID NO: 7960441 - DNA, 22 bp, Homo sapiens
tcctgacttaactactctctgg

SEQ ID NO: 7960442 - DNA, 22 bp, Homo sapiens
ccaaaaattagatacacatata

SEQ ID NO: 7960443 - DNA, 20 bp, Homo sapiens
catttcattgtgtcttcact

SEQ ID NO: 7960444 - DNA, 20 bp, Homo sapiens
catttcattgtgtcttcact

SEQ ID NO: 7960445 - DNA, 22 bp, Homo sapiens
catttccactctgggagtcaga

SEQ ID NO: 7960446 - DNA, 22 bp, Homo sapiens
catttcattcctttgaaagtgg

SEQ ID NO: 7960447 - DNA, 22 bp, Homo sapiens
catttcattcctttgaaagtgg

SEQ ID NO: 7960448 - DNA, 21 bp, Homo sapiens
catttcatgattatagaaatg

SEQ ID NO: 7960449 - DNA, 22 bp, Homo sapiens
catttcattcctttgaaagtgg

SEQ ID NO: 7960450 - DNA, 21 bp, Homo sapiens
catttcatgattatagaaatg

SEQ ID NO: 7960451 - DNA, 21 bp, Homo sapiens
catttcatgattatagaaatg

SEQ ID NO: 7960452 - DNA, 22 bp, Homo sapiens
catttcactattcactaaaagg

SEQ ID NO: 7960453 - DNA, 22 bp, Homo sapiens
catttcactattcactaaaagg

SEQ ID NO: 7960454 - DNA, 21 bp, Homo sapiens
catttcagtaaggaagcctgt

SEQ ID NO: 7960455 - DNA, 21 bp, Homo sapiens
catttcagtaaggaagcctgt

SEQ ID NO: 7960456 - DNA, 22 bp, Homo sapiens
catttcagtgtcttgtgatgaa

SEQ ID NO: 7960457 - DNA, 22 bp, Homo sapiens
catttcatagttgtcacaataa

SEQ ID NO: 7960458 - DNA, 21 bp, Homo sapiens
catttcatgattatagaaatg

SEQ ID NO: 7960459 - DNA, 22 bp, Homo sapiens
catttcatagttgtcacaataa

SEQ ID NO: 7960460 - DNA, 22 bp, Homo sapiens
catttcatagttgtcacaataa

SEQ ID NO: 7960461 - DNA, 22 bp, Homo sapiens
catttcatagttgtcacaataa

SEQ ID NO: 7960462 - DNA, 22 bp, Homo sapiens
catttccacttctgaaaactgg

SEQ ID NO: 7960463 - DNA, 22 bp, Homo sapiens
catttccacttctgaaaactgg

SEQ ID NO: 7960464 - DNA, 22 bp, Homo sapiens
catttccccctcatgttgcagc

SEQ ID NO: 7960465 - DNA, 22 bp, Homo sapiens
catttccagctcctgcatcatg

SEQ ID NO: 7960466 - DNA, 22 bp, Homo sapiens
catttccagctcctgcatcatg

SEQ ID NO: 7960467 - DNA, 22 bp, Homo sapiens
catttccagctcctgcatcatg

SEQ ID NO: 7960468 - DNA, 22 bp, Homo sapiens
catttccagctcctgcatcatg

SEQ ID NO: 7960469 - DNA, 22 bp, Homo sapiens
catttcctgtctggaggtcaaa

SEQ ID NO: 7960470 - DNA, 22 bp, Homo sapiens
catttctaagaagatctgggta

SEQ ID NO: 7960471 - DNA, 22 bp, Homo sapiens
catttcctgtctggaggtcaaa

SEQ ID NO: 7960472 - DNA, 22 bp, Homo sapiens
catttctaagaaggctgcacat

SEQ ID NO: 7960473 - DNA, 21 bp, Homo sapiens
catttctaagcctggctatag

SEQ ID NO: 7960474 - DNA, 22 bp, Homo sapiens
catttctaagaaggctgcacat

SEQ ID NO: 7960475 - DNA, 22 bp, Homo sapiens
catttctacagcttcttcagaa

SEQ ID NO: 7960476 - DNA, 22 bp, Homo sapiens
catttctacagcttcttcagaa

SEQ ID NO: 7960477 - DNA, 22 bp, Homo sapiens
catttctacagcttcttcagaa

SEQ ID NO: 7960478 - DNA, 22 bp, Homo sapiens
catttctagggatcataaagta

SEQ ID NO: 7960479 - DNA, 22 bp, Homo sapiens
catttctagggatcataaagta

SEQ ID NO: 7960480 - DNA, 22 bp, Homo sapiens
catttctagagtcccaagaggt

SEQ ID NO: 7960481 - DNA, 22 bp, Homo sapiens
catttctaccaaatgtgactgg

SEQ ID NO: 7960482 - DNA, 22 bp, Homo sapiens
catttctaccaaatgtgactgg

SEQ ID NO: 7960483 - DNA, 22 bp, Homo sapiens
catttctaccaaatgtgactgg

SEQ ID NO: 7960484 - DNA, 22 bp, Homo sapiens
catttctagacaagtcctggag

SEQ ID NO: 7960485 - DNA, 22 bp, Homo sapiens
catttcacagtaaagtgatttc

SEQ ID NO: 7960486 - DNA, 22 bp, Homo sapiens
catttattggcatgtagtaggt

SEQ ID NO: 7960487 - DNA, 22 bp, Homo sapiens
catttattggcatgtagtaggt

SEQ ID NO: 7960488 - DNA, 22 bp, Homo sapiens
catttattggcatgtagtaggt

SEQ ID NO: 7960489 - DNA, 22 bp, Homo sapiens
catttattggcatgtagtaggt

SEQ ID NO: 7960490 - DNA, 22 bp, Homo sapiens
catttattggcatgtagtaggt

SEQ ID NO: 7960491 - DNA, 22 bp, Homo sapiens
catttattggcatgtagtaggt

SEQ ID NO: 7960492 - DNA, 22 bp, Homo sapiens
catttcaccttagagaattatt

SEQ ID NO: 7960493 - DNA, 22 bp, Homo sapiens
catttcacgcacactcattact

SEQ ID NO: 7960494 - DNA, 22 bp, Homo sapiens
tccatatacaacttaatcttta

SEQ ID NO: 7960495 - DNA, 22 bp, Homo sapiens
tccatataatgggattccttat

SEQ ID NO: 7960496 - DNA, 22 bp, Homo sapiens
tccatatacaacttaatcttta

SEQ ID NO: 7960497 - DNA, 22 bp, Homo sapiens
tccatactggagtccacagttc

SEQ ID NO: 7960498 - DNA, 23 bp, Homo sapiens
tccatactctaaacatgttattt

SEQ ID NO: 7960499 - DNA, 22 bp, Homo sapiens
tccatagtagaaaatgggacag

SEQ ID NO: 7960500 - DNA, 22 bp, Homo sapiens
tccatagtgaatgggtaatgca

SEQ ID NO: 7960501 - DNA, 22 bp, Homo sapiens
tccatacccagctttctcacac

SEQ ID NO: 7960502 - DNA, 22 bp, Homo sapiens
tccatacatatccaaagagaag

SEQ ID NO: 7960503 - DNA, 22 bp, Homo sapiens
tccatacatatccaaagagaag

SEQ ID NO: 7960504 - DNA, 22 bp, Homo sapiens
tccatacattgaaataccattc

SEQ ID NO: 7960505 - DNA, 22 bp, Homo sapiens
tccatacatatccaaagagaag

SEQ ID NO: 7960506 - DNA, 22 bp, Homo sapiens
tccatacatacagatatgcatt

SEQ ID NO: 7960507 - DNA, 22 bp, Homo sapiens
tccatacatacagatatgcatt

SEQ ID NO: 7960508 - DNA, 22 bp, Homo sapiens
tccatacatacagatatgcatt

SEQ ID NO: 7960509 - DNA, 22 bp, Homo sapiens
tccatacataaaatgtttaatg

SEQ ID NO: 7960510 - DNA, 22 bp, Homo sapiens
tccatacatacagatatgcatt

SEQ ID NO: 7960511 - DNA, 20 bp, Homo sapiens
tccagttttggagacattct

SEQ ID NO: 7960512 - DNA, 20 bp, Homo sapiens
tccagttttggagacattct

SEQ ID NO: 7960513 - DNA, 18 bp, Homo sapiens
tccagttttcccagcatc

SEQ ID NO: 7960514 - DNA, 22 bp, Homo sapiens
tccagtttggttctgttctcca

SEQ ID NO: 7960515 - DNA, 22 bp, Homo sapiens
tccagttttaatactcactgcc

SEQ ID NO: 7960516 - DNA, 22 bp, Homo sapiens
tccagttttaatactcactgcc

SEQ ID NO: 7960517 - DNA, 22 bp, Homo sapiens
tccagtttgggtgtgagctgcg

SEQ ID NO: 7960518 - DNA, 19 bp, Homo sapiens
tccagtttggcaggaagac

SEQ ID NO: 7960519 - DNA, 22 bp, Homo sapiens
tccagtttctctcaatcaatta

SEQ ID NO: 7960520 - DNA, 22 bp, Homo sapiens
tccagtttcctgtggctgccta

SEQ ID NO: 7960521 - DNA, 22 bp, Homo sapiens
tccagtttctctcaatcaatta

SEQ ID NO: 7960522 - DNA, 22 bp, Homo sapiens
tccaggtcctactggcccatag

SEQ ID NO: 7960523 - DNA, 22 bp, Homo sapiens
tccaggtcctactggcccatag

SEQ ID NO: 7960524 - DNA, 22 bp, Homo sapiens
tccaggtccctggggagatttt

SEQ ID NO: 7960525 - DNA, 18 bp, Homo sapiens
tccaggtcccaggggaag

SEQ ID NO: 7960526 - DNA, 21 bp, Homo sapiens
tccataagagaccatctccta

SEQ ID NO: 7960527 - DNA, 22 bp, Homo sapiens
tccataaattttatgaacatat

SEQ ID NO: 7960528 - DNA, 22 bp, Homo sapiens
tccataaaccagaaaatcaaga

SEQ ID NO: 7960529 - DNA, 22 bp, Homo sapiens
tccataaatgaaatagaacgct

SEQ ID NO: 7960530 - DNA, 22 bp, Homo sapiens
tccataaaccagaaaatcaaga

SEQ ID NO: 7960531 - DNA, 22 bp, Homo sapiens
tccatacagaatgcagtaaggg

SEQ ID NO: 7960532 - DNA, 22 bp, Homo sapiens
tccatacacatttatttggcct

SEQ ID NO: 7960533 - DNA, 22 bp, Homo sapiens
tccatacacattgaattttagt

SEQ ID NO: 7960534 - DNA, 22 bp, Homo sapiens
tccatacagaatgcagtaaggg

SEQ ID NO: 7960535 - DNA, 22 bp, Homo sapiens
tccatacagtccacacggtgca

SEQ ID NO: 7960536 - DNA, 22 bp, Homo sapiens
tccatacagtgactcaggaatc

SEQ ID NO: 7960537 - DNA, 22 bp, Homo sapiens
tccatacagtgactcaggaatc

SEQ ID NO: 7960538 - DNA, 22 bp, Homo sapiens
tccatacagtgactcaggaatc

SEQ ID NO: 7960539 - DNA, 19 bp, Homo sapiens
tccatacaaactgttgaaa

SEQ ID NO: 7960540 - DNA, 19 bp, Homo sapiens
tccatacaaactgttgaaa

SEQ ID NO: 7960541 - DNA, 17 bp, Homo sapiens
tccatacaattctctct

SEQ ID NO: 7960542 - DNA, 22 bp, Homo sapiens
tccatacacattgaattttagt

SEQ ID NO: 7960543 - DNA, 22 bp, Homo sapiens
ccaccccaaatgaagacctctc

SEQ ID NO: 7960544 - DNA, 22 bp, Homo sapiens
ccacccatgtgactacctcatg

SEQ ID NO: 7960545 - DNA, 22 bp, Homo sapiens
ccaccccaaatgaagacctctc

SEQ ID NO: 7960546 - DNA, 22 bp, Homo sapiens
ccacccctgggtgcagggagcg

SEQ ID NO: 7960547 - DNA, 22 bp, Homo sapiens
ccacccctgggtgcagggagcg

SEQ ID NO: 7960548 - DNA, 22 bp, Homo sapiens
ccaccccaaatgaagacctctc

SEQ ID NO: 7960549 - DNA, 18 bp, Homo sapiens
ccacccagggggagagga

SEQ ID NO: 7960550 - DNA, 22 bp, Homo sapiens
ccaccaggcactcacagggaag

SEQ ID NO: 7960551 - DNA, 18 bp, Homo sapiens
ccacccagggggagagga

SEQ ID NO: 7960552 - DNA, 20 bp, Homo sapiens
ccaccctccaggaacacata

SEQ ID NO: 7960553 - DNA, 22 bp, Homo sapiens
ccaccctgagccgcaagagcag

SEQ ID NO: 7960554 - DNA, 19 bp, Homo sapiens
ccacccctttgctgggccc

SEQ ID NO: 7960555 - DNA, 19 bp, Homo sapiens
ccacccctttgctgggccc

SEQ ID NO: 7960556 - DNA, 19 bp, Homo sapiens
ccacccctttgctgggccc

SEQ ID NO: 7960557 - DNA, 19 bp, Homo sapiens
ccacccctttgctgggccc

SEQ ID NO: 7960558 - DNA, 19 bp, Homo sapiens
ccacccctttgctgggccc

SEQ ID NO: 7960559 - DNA, 19 bp, Homo sapiens
ccacccctttgctgggccc

SEQ ID NO: 7960560 - DNA, 22 bp, Homo sapiens
ccacccctgtagagggacagac

SEQ ID NO: 7960561 - DNA, 22 bp, Homo sapiens
ccacccctgtagagggacagac

SEQ ID NO: 7960562 - DNA, 22 bp, Homo sapiens
ccacccctgggtgcagggagcg

SEQ ID NO: 7960563 - DNA, 22 bp, Homo sapiens
ccacccctgggtgcagggagcg

SEQ ID NO: 7960564 - DNA, 22 bp, Homo sapiens
ccacccctgggtgcagggagcg

SEQ ID NO: 7960565 - DNA, 22 bp, Homo sapiens
ccacccctgggtgcagggagcg

SEQ ID NO: 7960566 - DNA, 22 bp, Homo sapiens
ccaccctgaggaatggtccggc

SEQ ID NO: 7960567 - DNA, 22 bp, Homo sapiens
ccaccctgagccgcaagagcag

SEQ ID NO: 7960568 - DNA, 22 bp, Homo sapiens
ccaccctgagccgcaagagcag

SEQ ID NO: 7960569 - DNA, 22 bp, Homo sapiens
ccaccctgccttgggccagtga

SEQ ID NO: 7960570 - DNA, 22 bp, Homo sapiens
ccaccctgccttgggccagtga

SEQ ID NO: 7960571 - DNA, 22 bp, Homo sapiens
ccaccctgccttgggccagtga

SEQ ID NO: 7960572 - DNA, 22 bp, Homo sapiens
ccaccctgccttgggccagtga

SEQ ID NO: 7960573 - DNA, 22 bp, Homo sapiens
ccaccctgccttgggccagtga

SEQ ID NO: 7960574 - DNA, 22 bp, Homo sapiens
ccaccctggacaggcctctgag

SEQ ID NO: 7960575 - DNA, 20 bp, Homo sapiens
ccaccctgctaagaatacac

SEQ ID NO: 7960576 - DNA, 20 bp, Homo sapiens
ccaccctgctaagaatacac

SEQ ID NO: 7960577 - DNA, 22 bp, Homo sapiens
tcctgtggtcattcttctgccc

SEQ ID NO: 7960578 - DNA, 22 bp, Homo sapiens
tcctgtggtcattcttctgccc

SEQ ID NO: 7960579 - DNA, 22 bp, Homo sapiens
ccaccctggacaggcctctgag

SEQ ID NO: 7960580 - DNA, 22 bp, Homo sapiens
ccaccctggacaggcctctgag

SEQ ID NO: 7960581 - DNA, 20 bp, Homo sapiens
tcctgtgtgtctcatcaacc

SEQ ID NO: 7960582 - DNA, 20 bp, Homo sapiens
tcctgtgtgtctcatcaacc

SEQ ID NO: 7960583 - DNA, 22 bp, Homo sapiens
tcctgtgtgtggcctttcccag

SEQ ID NO: 7960584 - DNA, 22 bp, Homo sapiens
tcctgtgtgtggcctttcccag

SEQ ID NO: 7960585 - DNA, 22 bp, Homo sapiens
tcctgtgtgggcaggatgagaa

SEQ ID NO: 7960586 - DNA, 22 bp, Homo sapiens
tcctgtgtgctttctttaggtt

SEQ ID NO: 7960587 - DNA, 22 bp, Homo sapiens
tcctgtgtgggcaggatgagaa

SEQ ID NO: 7960588 - DNA, 22 bp, Homo sapiens
tcctgtgtctcagcgtgaagca

SEQ ID NO: 7960589 - DNA, 22 bp, Homo sapiens
tcctgtgtcaattcctcattct

SEQ ID NO: 7960590 - DNA, 22 bp, Homo sapiens
tcctgtgtaaatagatctggtt

SEQ ID NO: 7960591 - DNA, 22 bp, Homo sapiens
tcctgtgtctcagcgtgaagca

SEQ ID NO: 7960592 - DNA, 22 bp, Homo sapiens
tcctgtggtcattcttctgccc

SEQ ID NO: 7960593 - DNA, 22 bp, Homo sapiens
tcctgtggtctggaaggaatgg

SEQ ID NO: 7960594 - DNA, 22 bp, Homo sapiens
tcctgtttaggctgtggtctgg

SEQ ID NO: 7960595 - DNA, 22 bp, Homo sapiens
tcctgttgttcgcctgcgatgg

SEQ ID NO: 7960596 - DNA, 22 bp, Homo sapiens
tcctgttgctgtagtggttaag

SEQ ID NO: 7960597 - DNA, 22 bp, Homo sapiens
tcctgttgttcgcctgcgatgg

SEQ ID NO: 7960598 - DNA, 22 bp, Homo sapiens
tcctgtttatctgtgtgactcg

SEQ ID NO: 7960599 - DNA, 17 bp, Homo sapiens
tcctgtttatcattgat

SEQ ID NO: 7960600 - DNA, 22 bp, Homo sapiens
tcctgtgttgatagagatggtt

SEQ ID NO: 7960601 - DNA, 22 bp, Homo sapiens
tcctgtgttctaggtatggtct

SEQ ID NO: 7960602 - DNA, 22 bp, Homo sapiens
tcctgtgttcaagtcattcatt

SEQ ID NO: 7960603 - DNA, 22 bp, Homo sapiens
tcctgtgttactgcctggagcg

SEQ ID NO: 7960604 - DNA, 22 bp, Homo sapiens
tcctgtgttacccttgcagtga

SEQ ID NO: 7960605 - DNA, 22 bp, Homo sapiens
tcctgtgttaaagggggtgcta

SEQ ID NO: 7960606 - DNA, 22 bp, Homo sapiens
tctagaaacatgacattgatct

SEQ ID NO: 7960607 - DNA, 22 bp, Homo sapiens
tctagaaacatgacattgatct

SEQ ID NO: 7960608 - DNA, 22 bp, Homo sapiens
tctagaaacatgacattgatct

SEQ ID NO: 7960609 - DNA, 22 bp, Homo sapiens
tctaatgctctgagaacagtgc

SEQ ID NO: 7960610 - DNA, 22 bp, Homo sapiens
tctaatgatcaagtgatgacag

SEQ ID NO: 7960611 - DNA, 22 bp, Homo sapiens
tcctgtttctcctgcaaaatcc

SEQ ID NO: 7960612 - DNA, 22 bp, Homo sapiens
tcctgtttttgtaatcgactct

SEQ ID NO: 7960613 - DNA, 22 bp, Homo sapiens
tctaatgaaagatgtaggaact

SEQ ID NO: 7960614 - DNA, 22 bp, Homo sapiens
tcctgtttccaatttgttgggt

SEQ ID NO: 7960615 - DNA, 22 bp, Homo sapiens
tcctgtttccaatttgttgggt

SEQ ID NO: 7960616 - DNA, 22 bp, Homo sapiens
tcctgtttccaatttgttgggt

SEQ ID NO: 7960617 - DNA, 22 bp, Homo sapiens
tcctgtttcaacccttacactg

SEQ ID NO: 7960618 - DNA, 22 bp, Homo sapiens
tcctgtttcaacccttacactg

SEQ ID NO: 7960619 - DNA, 22 bp, Homo sapiens
tctagaaagtttgtactgattt

SEQ ID NO: 7960620 - DNA, 22 bp, Homo sapiens
tctagaaagtactagagctggt

SEQ ID NO: 7960621 - DNA, 22 bp, Homo sapiens
tctagaaagtactagagctggt

SEQ ID NO: 7960622 - DNA, 22 bp, Homo sapiens
tctagaaagtactagagctggt

SEQ ID NO: 7960623 - DNA, 22 bp, Homo sapiens
tctagaaagccaaattaggaat

SEQ ID NO: 7960624 - DNA, 22 bp, Homo sapiens
tctagaaagccaaattaggaat

SEQ ID NO: 7960625 - DNA, 18 bp, Homo sapiens
tctagaaacccagactct

SEQ ID NO: 7960626 - DNA, 18 bp, Homo sapiens
tctagaaacccagactct

SEQ ID NO: 7960627 - DNA, 22 bp, Homo sapiens
tctagaacttctctaaaatgaa

SEQ ID NO: 7960628 - DNA, 21 bp, Homo sapiens
tctagaagaggttgagaatat

SEQ ID NO: 7960629 - DNA, 22 bp, Homo sapiens
tctagaacttctctaaaatgaa

SEQ ID NO: 7960630 - DNA, 22 bp, Homo sapiens
tctagaagggtgccgatcttag

SEQ ID NO: 7960631 - DNA, 21 bp, Homo sapiens
tctagaagaggttgagaatat

SEQ ID NO: 7960632 - DNA, 22 bp, Homo sapiens
tctagaaattttgccttgtatt

SEQ ID NO: 7960633 - DNA, 22 bp, Homo sapiens
tctagaaagtttgtactgattt

SEQ ID NO: 7960634 - DNA, 22 bp, Homo sapiens
tctagaaattttgccttgtatt

SEQ ID NO: 7960635 - DNA, 22 bp, Homo sapiens
tctagaaattttgccttgtatt

SEQ ID NO: 7960636 - DNA, 22 bp, Homo sapiens
tctagaactccagttaggcaat

SEQ ID NO: 7960637 - DNA, 22 bp, Homo sapiens
tctagaactccagttaggcaat

SEQ ID NO: 7960638 - DNA, 22 bp, Homo sapiens
tctagaagtatattgtagggtg

SEQ ID NO: 7960639 - DNA, 17 bp, Homo sapiens
tctagaagtgcttacat

SEQ ID NO: 7960640 - DNA, 22 bp, Homo sapiens
tctagaatactgtgacatgcca

SEQ ID NO: 7960641 - DNA, 22 bp, Homo sapiens
tctagaatactgtgacatgcca

SEQ ID NO: 7960642 - DNA, 22 bp, Homo sapiens
tctagaatagattctgctgatc

SEQ ID NO: 7960643 - DNA, 22 bp, Homo sapiens
tctagaatagattctgctgatc

SEQ ID NO: 7960644 - DNA, 22 bp, Homo sapiens
tctagaatagattctgctgatc

SEQ ID NO: 7960645 - DNA, 22 bp, Homo sapiens
tctagaatcactgtttccatct

SEQ ID NO: 7960646 - DNA, 21 bp, Homo sapiens
tctagaatcctgtataagact

SEQ ID NO: 7960647 - DNA, 22 bp, Homo sapiens
tctagaatgacatgcaagagta

SEQ ID NO: 7960648 - DNA, 22 bp, Homo sapiens
tctagaatctaaactatagttt

SEQ ID NO: 7960649 - DNA, 22 bp, Homo sapiens
tctagaatctaaactatagttt

SEQ ID NO: 7960650 - DNA, 21 bp, Homo sapiens
tctagaatcctgtataagact

SEQ ID NO: 7960651 - DNA, 21 bp, Homo sapiens
tctagaatcctgtataagact

SEQ ID NO: 7960652 - DNA, 21 bp, Homo sapiens
tctagaatcctgtataagact

SEQ ID NO: 7960653 - DNA, 22 bp, Homo sapiens
tctagaatgttccaccttgttt

SEQ ID NO: 7960654 - DNA, 22 bp, Homo sapiens
tctagaatggctgggcacagct

SEQ ID NO: 7960655 - DNA, 22 bp, Homo sapiens
tctagaatggctgggcacagct

SEQ ID NO: 7960656 - DNA, 22 bp, Homo sapiens
tctagaatggctgggcacagct

SEQ ID NO: 7960657 - DNA, 22 bp, Homo sapiens
tctagaatgacatgcaagagta

SEQ ID NO: 7960658 - DNA, 22 bp, Homo sapiens
tctagaatggctgggcacagct

SEQ ID NO: 7960659 - DNA, 22 bp, Homo sapiens
tctagaatgacatgcaagagta

SEQ ID NO: 7960660 - DNA, 22 bp, Homo sapiens
tctagaagtatattgtagggtg

SEQ ID NO: 7960661 - DNA, 22 bp, Homo sapiens
tctagaattcccttttgacaat

SEQ ID NO: 7960662 - DNA, 22 bp, Homo sapiens
tctagaattcccttttgacaat

SEQ ID NO: 7960663 - DNA, 22 bp, Homo sapiens
tctagaatgttccaccttgttt

SEQ ID NO: 7960664 - DNA, 22 bp, Homo sapiens
tctataaatgcagatatgtgtg

SEQ ID NO: 7960665 - DNA, 22 bp, Homo sapiens
tctagaatttgcgtaggttaga

SEQ ID NO: 7960666 - DNA, 22 bp, Homo sapiens
tctagaatttgcgtaggttaga

SEQ ID NO: 7960667 - DNA, 22 bp, Homo sapiens
tctataaattatgcagtctcag

SEQ ID NO: 7960668 - DNA, 22 bp, Homo sapiens
tctataaatgcagatatgtgtg

SEQ ID NO: 7960669 - DNA, 22 bp, Homo sapiens
tctataaattatgcagtctcag

SEQ ID NO: 7960670 - DNA, 21 bp, Homo sapiens
tctataactatagtgacagat

SEQ ID NO: 7960671 - DNA, 21 bp, Homo sapiens
tctataactatagtgacagat

SEQ ID NO: 7960672 - DNA, 22 bp, Homo sapiens
tctataatcctatttcaactgc

SEQ ID NO: 7960673 - DNA, 21 bp, Homo sapiens
tctataatatgcaggtcatca

SEQ ID NO: 7960674 - DNA, 22 bp, Homo sapiens
tctataatcctatttcaactgc

SEQ ID NO: 7960675 - DNA, 22 bp, Homo sapiens
tctatacaagtttcactttgac

SEQ ID NO: 7960676 - DNA, 22 bp, Homo sapiens
tctataatggaaagtggatgtg

SEQ ID NO: 7960677 - DNA, 22 bp, Homo sapiens
tctatacaagtttcactttgac

SEQ ID NO: 7960678 - DNA, 22 bp, Homo sapiens
tctcaggaagtgatattgagac

SEQ ID NO: 7960679 - DNA, 22 bp, Homo sapiens
tctcaggaatagagtggcagca

SEQ ID NO: 7960680 - DNA, 22 bp, Homo sapiens
tctcaggaaataggatttgagt

SEQ ID NO: 7960681 - DNA, 22 bp, Homo sapiens
tctcaggaaaaatccctagctt

SEQ ID NO: 7960682 - DNA, 22 bp, Homo sapiens
tctcaggaaataggatttgagt

SEQ ID NO: 7960683 - DNA, 22 bp, Homo sapiens
tctcaggaagattagggctaag

SEQ ID NO: 7960684 - DNA, 22 bp, Homo sapiens
tctcagagaagtgatgagcaat

SEQ ID NO: 7960685 - DNA, 22 bp, Homo sapiens
tctcagctgcctgccctgctcc

SEQ ID NO: 7960686 - DNA, 22 bp, Homo sapiens
tctcagcttgagtggatgagct

SEQ ID NO: 7960687 - DNA, 22 bp, Homo sapiens
tctatacacacaaagaatgctt

SEQ ID NO: 7960688 - DNA, 23 bp, Homo sapiens
tctatacatactgcagcctctgg

SEQ ID NO: 7960689 - DNA, 22 bp, Homo sapiens
tctatacatgtgcacacacatc

SEQ ID NO: 7960690 - DNA, 22 bp, Homo sapiens
tctatacatgtgcacacacatc

SEQ ID NO: 7960691 - DNA, 22 bp, Homo sapiens
tctcagagaagtgatgagcaat

SEQ ID NO: 7960692 - DNA, 22 bp, Homo sapiens
tctcagagaagtgatgagcaat

SEQ ID NO: 7960693 - DNA, 22 bp, Homo sapiens
tctcagagaagtgatgagcaat

SEQ ID NO: 7960694 - DNA, 22 bp, Homo sapiens
tctcagagaagtgatgagcaat

SEQ ID NO: 7960695 - DNA, 22 bp, Homo sapiens
tctatagatcagtaaatatctc

SEQ ID NO: 7960696 - DNA, 22 bp, Homo sapiens
tctatagacttggacatatagt

SEQ ID NO: 7960697 - DNA, 22 bp, Homo sapiens
tctatacctttgctgtgacttt

SEQ ID NO: 7960698 - DNA, 22 bp, Homo sapiens
tctataccaggggcctgcagtg

SEQ ID NO: 7960699 - DNA, 22 bp, Homo sapiens
tctatagacttggacatatagt

SEQ ID NO: 7960700 - DNA, 22 bp, Homo sapiens
tctcagtgtggtgcttaggata

SEQ ID NO: 7960701 - DNA, 22 bp, Homo sapiens
tctcagtgtggtgcttaggata

SEQ ID NO: 7960702 - DNA, 22 bp, Homo sapiens
tctcagtggtgttttgagtcca

SEQ ID NO: 7960703 - DNA, 22 bp, Homo sapiens
tctcagtggtgttttgagtcca

SEQ ID NO: 7960704 - DNA, 22 bp, Homo sapiens
tctcagtgtgttgagaggtctg

SEQ ID NO: 7960705 - DNA, 22 bp, Homo sapiens
tctcagtgtgttgagaggtctg

SEQ ID NO: 7960706 - DNA, 22 bp, Homo sapiens
tctcagtgtgttgagaggtctg

SEQ ID NO: 7960707 - DNA, 22 bp, Homo sapiens
tctcagtgggaagggcacagtt

SEQ ID NO: 7960708 - DNA, 22 bp, Homo sapiens
tctcagtggcttcctcactttt

SEQ ID NO: 7960709 - DNA, 22 bp, Homo sapiens
tctcagtggcttcctcactttt

SEQ ID NO: 7960710 - DNA, 22 bp, Homo sapiens
tctcagtgggaagggcacagtt

SEQ ID NO: 7960711 - DNA, 22 bp, Homo sapiens
tctcagtgggaagggcacagtt

SEQ ID NO: 7960712 - DNA, 22 bp, Homo sapiens
tctcagtgggaagggcacagtt

SEQ ID NO: 7960713 - DNA, 22 bp, Homo sapiens
tctcagtgggaagggcacagtt

SEQ ID NO: 7960714 - DNA, 22 bp, Homo sapiens
tctcagtgggttaaaagagaag

SEQ ID NO: 7960715 - DNA, 22 bp, Homo sapiens
tctcagtgggttaaaagagaag

SEQ ID NO: 7960716 - DNA, 22 bp, Homo sapiens
tctcagtggtggcattccagac

SEQ ID NO: 7960717 - DNA, 22 bp, Homo sapiens
tctcagtgtttaaaaagatttc

SEQ ID NO: 7960718 - DNA, 22 bp, Homo sapiens
tctcagtgtttaaaaagatttc

SEQ ID NO: 7960719 - DNA, 22 bp, Homo sapiens
tctcagtgttgttctgcagatg

SEQ ID NO: 7960720 - DNA, 22 bp, Homo sapiens
tctcagtgttgttctgcagatg

SEQ ID NO: 7960721 - DNA, 22 bp, Homo sapiens
tctcagtgtgttttctctcaga

SEQ ID NO: 7960722 - DNA, 22 bp, Homo sapiens
tctcagtgtgttttctctcaga

SEQ ID NO: 7960723 - DNA, 22 bp, Homo sapiens
tctcagtgttatctatctgcct

SEQ ID NO: 7960724 - DNA, 22 bp, Homo sapiens
tctcagtgttgttctgcagatg

SEQ ID NO: 7960725 - DNA, 22 bp, Homo sapiens
tctcagttcttctcattccaga

SEQ ID NO: 7960726 - DNA, 22 bp, Homo sapiens
tctcagtgtttaaaaagatttc

SEQ ID NO: 7960727 - DNA, 23 bp, Homo sapiens
tctcagttccagaggctacaagt

SEQ ID NO: 7960728 - DNA, 23 bp, Homo sapiens
tctcagttccagaggctacaagt

SEQ ID NO: 7960729 - DNA, 22 bp, Homo sapiens
ccagagaggccttggcaagaca

SEQ ID NO: 7960730 - DNA, 22 bp, Homo sapiens
ccagagaggccttggcaagaca

SEQ ID NO: 7960731 - DNA, 22 bp, Homo sapiens
ccagagaggccttggcaagaca

SEQ ID NO: 7960732 - DNA, 22 bp, Homo sapiens
tctcaggactcctctggccata

SEQ ID NO: 7960733 - DNA, 22 bp, Homo sapiens
tctcaggactcctctggccata

SEQ ID NO: 7960734 - DNA, 22 bp, Homo sapiens
tctcaggactcctctggccata

SEQ ID NO: 7960735 - DNA, 22 bp, Homo sapiens
tctcaggactcctctggccata

SEQ ID NO: 7960736 - DNA, 23 bp, Homo sapiens
tctcaggacacacatgtctatca

SEQ ID NO: 7960737 - DNA, 22 bp, Homo sapiens
tctcaggaatagagtggcagca

SEQ ID NO: 7960738 - DNA, 23 bp, Homo sapiens
tctcaggacacacatgtctatca

SEQ ID NO: 7960739 - DNA, 22 bp, Homo sapiens
tctcaggagccacagcgggagt

SEQ ID NO: 7960740 - DNA, 22 bp, Homo sapiens
tctcaggagccacagcgggagt

SEQ ID NO: 7960741 - DNA, 22 bp, Homo sapiens
tctcaggactttgggaagctca

SEQ ID NO: 7960742 - DNA, 22 bp, Homo sapiens
tctcaggactttgggaagctca

SEQ ID NO: 7960743 - DNA, 22 bp, Homo sapiens
tctcaggagccacagcgggagt

SEQ ID NO: 7960744 - DNA, 23 bp, Homo sapiens
tctcaggcaaaccaggacaagtt

SEQ ID NO: 7960745 - DNA, 23 bp, Homo sapiens
tctcaggcaaaccaggacaagtt

SEQ ID NO: 7960746 - DNA, 22 bp, Homo sapiens
tctcaggatctaatacatggta

SEQ ID NO: 7960747 - DNA, 22 bp, Homo sapiens
tctcaggatctaatacatggta

SEQ ID NO: 7960748 - DNA, 22 bp, Homo sapiens
tctcaggagtagtgggatccat

SEQ ID NO: 7960749 - DNA, 22 bp, Homo sapiens
tctcaggagtagtgggatccat

SEQ ID NO: 7960750 - DNA, 22 bp, Homo sapiens
tctcaggatctaatacatggta

SEQ ID NO: 7960751 - DNA, 22 bp, Homo sapiens
tctcagtggatctcagaatttt

SEQ ID NO: 7960752 - DNA, 20 bp, Homo sapiens
tctcaggccccagttttctt

SEQ ID NO: 7960753 - DNA, 22 bp, Homo sapiens
tctcagtggatctcagaatttt

SEQ ID NO: 7960754 - DNA, 22 bp, Homo sapiens
tctcagtggatctcagaatttt

SEQ ID NO: 7960755 - DNA, 22 bp, Homo sapiens
tctcagtggatctcagaatttt

SEQ ID NO: 7960756 - DNA, 22 bp, Homo sapiens
tctcaggcattcccacatagaa

SEQ ID NO: 7960757 - DNA, 22 bp, Homo sapiens
tctcaggcccactgtgttgaaa

SEQ ID NO: 7960758 - DNA, 20 bp, Homo sapiens
tctcaggccccagttttctt

SEQ ID NO: 7960759 - DNA, 22 bp, Homo sapiens
tctcaggcactgggtgccaact

SEQ ID NO: 7960760 - DNA, 22 bp, Homo sapiens
tctcaggcatctgtgtggcaca

SEQ ID NO: 7960761 - DNA, 17 bp, Homo sapiens
tctcaggcacgtgtggc

SEQ ID NO: 7960762 - DNA, 22 bp, Homo sapiens
tctcaggcatctgtgtggcaca

SEQ ID NO: 7960763 - DNA, 22 bp, Homo sapiens
tctcaggcatggtttgttcatc

SEQ ID NO: 7960764 - DNA, 22 bp, Homo sapiens
tctcaggcattcccacatagaa

SEQ ID NO: 7960765 - DNA, 22 bp, Homo sapiens
tctcaggcattcccacatagaa

SEQ ID NO: 7960766 - DNA, 22 bp, Homo sapiens
ccagaggggctgagcaggtcac

SEQ ID NO: 7960767 - DNA, 22 bp, Homo sapiens
ccagaggggctgagcaggtcac

SEQ ID NO: 7960768 - DNA, 22 bp, Homo sapiens
ccagaggggctgagcaggtcac

SEQ ID NO: 7960769 - DNA, 22 bp, Homo sapiens
ccagaggggctgagcaggtcac

SEQ ID NO: 7960770 - DNA, 22 bp, Homo sapiens
ccagaggggctgagcaggtcac

SEQ ID NO: 7960771 - DNA, 22 bp, Homo sapiens
ccagaggggctgagcaggtcac

SEQ ID NO: 7960772 - DNA, 20 bp, Homo sapiens
ccagagggtagggccgcccc

SEQ ID NO: 7960773 - DNA, 20 bp, Homo sapiens
ccagagggtagggccgcccc

SEQ ID NO: 7960774 - DNA, 20 bp, Homo sapiens
ccagagggtagggccgcccc

SEQ ID NO: 7960775 - DNA, 20 bp, Homo sapiens
ccagagggtagggccgcccc

SEQ ID NO: 7960776 - DNA, 22 bp, Homo sapiens
ccagaggggtgggcctggttta

SEQ ID NO: 7960777 - DNA, 22 bp, Homo sapiens
ccagaggggtgggcctggttta

SEQ ID NO: 7960778 - DNA, 22 bp, Homo sapiens
ccagagggcttggtttgggcca

SEQ ID NO: 7960779 - DNA, 22 bp, Homo sapiens
ccagaggggcacaaaagtagaa

SEQ ID NO: 7960780 - DNA, 22 bp, Homo sapiens
ccagaggggcacaaaagtagaa

SEQ ID NO: 7960781 - DNA, 22 bp, Homo sapiens
ccagaggggcacaaaagtagaa

SEQ ID NO: 7960782 - DNA, 22 bp, Homo sapiens
ccagagggcctttggagttatc

SEQ ID NO: 7960783 - DNA, 22 bp, Homo sapiens
ccagagggcctttggagttatc

SEQ ID NO: 7960784 - DNA, 22 bp, Homo sapiens
ccagagggcttggtttgggcca

SEQ ID NO: 7960785 - DNA, 22 bp, Homo sapiens
ccagagggcttggtttgggcca

SEQ ID NO: 7960786 - DNA, 22 bp, Homo sapiens
ccagagggcctttggagttatc

SEQ ID NO: 7960787 - DNA, 22 bp, Homo sapiens
ccagagggcaaaatgaagctta

SEQ ID NO: 7960788 - DNA, 22 bp, Homo sapiens
ccagagggcaaaatgaagctta

SEQ ID NO: 7960789 - DNA, 22 bp, Homo sapiens
ccagagggccctggtctcagct

SEQ ID NO: 7960790 - DNA, 22 bp, Homo sapiens
ccagagggccctggtctcagct

SEQ ID NO: 7960791 - DNA, 22 bp, Homo sapiens
ccagagggccctggtctcagct

SEQ ID NO: 7960792 - DNA, 22 bp, Homo sapiens
ccagagggccctggtctcagct

SEQ ID NO: 7960793 - DNA, 22 bp, Homo sapiens
ccagagggccctggtctcagct

SEQ ID NO: 7960794 - DNA, 22 bp, Homo sapiens
ccagaggtctcctgcacgggat

SEQ ID NO: 7960795 - DNA, 22 bp, Homo sapiens
ccagaggtgaacaggaggctgt

SEQ ID NO: 7960796 - DNA, 22 bp, Homo sapiens
ccagaggtcctgtgatgctgca

SEQ ID NO: 7960797 - DNA, 22 bp, Homo sapiens
ccagaggtctcctgcacgggat

SEQ ID NO: 7960798 - DNA, 22 bp, Homo sapiens
ccagaggtgaacaggaggctgt

SEQ ID NO: 7960799 - DNA, 22 bp, Homo sapiens
ccagaggtgaacaggaggctgt

SEQ ID NO: 7960800 - DNA, 22 bp, Homo sapiens
ccagaggtgaacaggaggctgt

SEQ ID NO: 7960801 - DNA, 22 bp, Homo sapiens
ccagaggtgagggggattcttg

SEQ ID NO: 7960802 - DNA, 22 bp, Homo sapiens
tctctgggataaactgggccag

SEQ ID NO: 7960803 - DNA, 22 bp, Homo sapiens
tctctgggataaactgggccag

SEQ ID NO: 7960804 - DNA, 22 bp, Homo sapiens
tctctgggataaactgggccag

SEQ ID NO: 7960805 - DNA, 22 bp, Homo sapiens
tctctgggataaactgggccag

SEQ ID NO: 7960806 - DNA, 22 bp, Homo sapiens
ccagaggtcctgctcactggtg

SEQ ID NO: 7960807 - DNA, 22 bp, Homo sapiens
ccagaggtcctgtgatgctgca

SEQ ID NO: 7960808 - DNA, 22 bp, Homo sapiens
ccagaggtcctgtgatgctgca

SEQ ID NO: 7960809 - DNA, 22 bp, Homo sapiens
ccagaggtcccctgccaggagg

SEQ ID NO: 7960810 - DNA, 18 bp, Homo sapiens
ccagagggtgcgtcagct

SEQ ID NO: 7960811 - DNA, 22 bp, Homo sapiens
ccagaggtcccctgccaggagg

SEQ ID NO: 7960812 - DNA, 18 bp, Homo sapiens
ccagagggtgcgtcagct

SEQ ID NO: 7960813 - DNA, 18 bp, Homo sapiens
ccagagggtgcgtcagct

SEQ ID NO: 7960814 - DNA, 18 bp, Homo sapiens
ccagagggtgcgtcagct

SEQ ID NO: 7960815 - DNA, 18 bp, Homo sapiens
ccagagggtgcgtcagct

SEQ ID NO: 7960816 - DNA, 18 bp, Homo sapiens
ccagagggtgcgtcagct

SEQ ID NO: 7960817 - DNA, 22 bp, Homo sapiens
tctctgtagggctgcttgagta

SEQ ID NO: 7960818 - DNA, 22 bp, Homo sapiens
tctctgtatcccagaaccaaaa

SEQ ID NO: 7960819 - DNA, 22 bp, Homo sapiens
tctctgtcacacaatctacaca

SEQ ID NO: 7960820 - DNA, 22 bp, Homo sapiens
ccagatgtccctctcaggtttg

SEQ ID NO: 7960821 - DNA, 22 bp, Homo sapiens
tctctgtaaaatgtggatgata

SEQ ID NO: 7960822 - DNA, 20 bp, Homo sapiens
tctctgtaaatcttctttta

SEQ ID NO: 7960823 - DNA, 22 bp, Homo sapiens
tctctgggataaactgggccag

SEQ ID NO: 7960824 - DNA, 22 bp, Homo sapiens
tctctgggatcaggtggcccag

SEQ ID NO: 7960825 - DNA, 22 bp, Homo sapiens
tctctgtacagtacatgccgtg

SEQ ID NO: 7960826 - DNA, 22 bp, Homo sapiens
tctctgtagacctgaccagcac

SEQ ID NO: 7960827 - DNA, 22 bp, Homo sapiens
tctctgtaaggaagaattagat

SEQ ID NO: 7960828 - DNA, 22 bp, Homo sapiens
tctctgtaaggaagaattagat

SEQ ID NO: 7960829 - DNA, 22 bp, Homo sapiens
ccagatgtgagcagagccttga

SEQ ID NO: 7960830 - DNA, 22 bp, Homo sapiens
ccagatgtctgagccacactcc

SEQ ID NO: 7960831 - DNA, 22 bp, Homo sapiens
ccagatgtccctctcaggtttg

SEQ ID NO: 7960832 - DNA, 22 bp, Homo sapiens
ccagatgtccctctcaggtttg

SEQ ID NO: 7960833 - DNA, 22 bp, Homo sapiens
ccagatgttcccctggaggcct

SEQ ID NO: 7960834 - DNA, 20 bp, Homo sapiens
ccagatgtttacattcatac

SEQ ID NO: 7960835 - DNA, 20 bp, Homo sapiens
ccagatgtttacattcatac

SEQ ID NO: 7960836 - DNA, 22 bp, Homo sapiens
ccagatttgagcgtcttaaacc

SEQ ID NO: 7960837 - DNA, 22 bp, Homo sapiens
ccagattcagatatggcagtgg

SEQ ID NO: 7960838 - DNA, 22 bp, Homo sapiens
ccagatttgagcgtcttaaacc

SEQ ID NO: 7960839 - DNA, 22 bp, Homo sapiens
ccagcaaggtccagcataggga

SEQ ID NO: 7960840 - DNA, 22 bp, Homo sapiens
ccagcaaggtccagcataggga

SEQ ID NO: 7960841 - DNA, 22 bp, Homo sapiens
ccagcaaggtccagcataggga

SEQ ID NO: 7960842 - DNA, 22 bp, Homo sapiens
ccagcaagtgcagatggccaag

SEQ ID NO: 7960843 - DNA, 20 bp, Homo sapiens
ccagcaccctctcagctgaa

SEQ ID NO: 7960844 - DNA, 20 bp, Homo sapiens
ccagcaccctctcagctgaa

SEQ ID NO: 7960845 - DNA, 20 bp, Homo sapiens
ccagcaccctctcagctgaa

SEQ ID NO: 7960846 - DNA, 20 bp, Homo sapiens
ccagcaccctctcagctgaa

SEQ ID NO: 7960847 - DNA, 20 bp, Homo sapiens
ccagcaccctctcagctgaa

SEQ ID NO: 7960848 - DNA, 22 bp, Homo sapiens
ccagagcccagggtcatgcagg

SEQ ID NO: 7960849 - DNA, 22 bp, Homo sapiens
ccagagcccagcacacggtgct

SEQ ID NO: 7960850 - DNA, 22 bp, Homo sapiens
ccagagcccagcacacggtgct

SEQ ID NO: 7960851 - DNA, 22 bp, Homo sapiens
ccagagccagagaggtgcctgc

SEQ ID NO: 7960852 - DNA, 22 bp, Homo sapiens
ccagagccagagaggtgcctgc

SEQ ID NO: 7960853 - DNA, 22 bp, Homo sapiens
ccagagccagagaggtgcctgc

SEQ ID NO: 7960854 - DNA, 22 bp, Homo sapiens
ccagagccagagaggtgcctgc

SEQ ID NO: 7960855 - DNA, 22 bp, Homo sapiens
ccagagccagagaggtgcctgc

SEQ ID NO: 7960856 - DNA, 22 bp, Homo sapiens
ccagagcatgaagggcaatgac

SEQ ID NO: 7960857 - DNA, 22 bp, Homo sapiens
ccagagcatgaagggcaatgac

SEQ ID NO: 7960858 - DNA, 22 bp, Homo sapiens
ccagagcagggcagcagggctc

SEQ ID NO: 7960859 - DNA, 22 bp, Homo sapiens
ccagagagggcgccacctggag

SEQ ID NO: 7960860 - DNA, 22 bp, Homo sapiens
ccagagagggcgccacctggag

SEQ ID NO: 7960861 - DNA, 22 bp, Homo sapiens
ccagagagggcgccacctggag

SEQ ID NO: 7960862 - DNA, 20 bp, Homo sapiens
ccagagcagccactgaagtt

SEQ ID NO: 7960863 - DNA, 20 bp, Homo sapiens
ccagagcagccactgaagtt

SEQ ID NO: 7960864 - DNA, 20 bp, Homo sapiens
ccagagcagccactgaagtt

SEQ ID NO: 7960865 - DNA, 20 bp, Homo sapiens
ccagagcagccactgaagtt

SEQ ID NO: 7960866 - DNA, 22 bp, Homo sapiens
ccagagcagggcagcagggctc

SEQ ID NO: 7960867 - DNA, 22 bp, Homo sapiens
ccagagcagggcagcagggctc

SEQ ID NO: 7960868 - DNA, 22 bp, Homo sapiens
ccagagcagggcagcagggctc

SEQ ID NO: 7960869 - DNA, 22 bp, Homo sapiens
ccagagcagggcagcagggctc

SEQ ID NO: 7960870 - DNA, 22 bp, Homo sapiens
ccagagcagggcagcagggctc

SEQ ID NO: 7960871 - DNA, 22 bp, Homo sapiens
ccagagcagggcagcagggctc

SEQ ID NO: 7960872 - DNA, 22 bp, Homo sapiens
ccagagcagggcagcagggctc

SEQ ID NO: 7960873 - DNA, 22 bp, Homo sapiens
ccagagcagggcagcagggctc

SEQ ID NO: 7960874 - DNA, 22 bp, Homo sapiens
ccagagcagggcagcagggctc

SEQ ID NO: 7960875 - DNA, 22 bp, Homo sapiens
ccagagcagggcagcagggctc

SEQ ID NO: 7960876 - DNA, 22 bp, Homo sapiens
ccagagcagggcagcagggctc

SEQ ID NO: 7960877 - DNA, 20 bp, Homo sapiens
ccagagcagccactgaagtt

SEQ ID NO: 7960878 - DNA, 22 bp, Homo sapiens
ccagagccggctccctcagctt

SEQ ID NO: 7960879 - DNA, 22 bp, Homo sapiens
ccagagccggctccctcagctt

SEQ ID NO: 7960880 - DNA, 22 bp, Homo sapiens
ccagagccggctccctcagctt

SEQ ID NO: 7960881 - DNA, 22 bp, Homo sapiens
ccagagccggctccctcagctt

SEQ ID NO: 7960882 - DNA, 22 bp, Homo sapiens
ccagagccggctccctcagctt

SEQ ID NO: 7960883 - DNA, 22 bp, Homo sapiens
ccagagccggctccctcagctt

SEQ ID NO: 7960884 - DNA, 22 bp, Homo sapiens
ccagagcccgggacctggactt

SEQ ID NO: 7960885 - DNA, 22 bp, Homo sapiens
ccagagcccgggacctggactt

SEQ ID NO: 7960886 - DNA, 22 bp, Homo sapiens
ccagagcccgggacctggactt

SEQ ID NO: 7960887 - DNA, 22 bp, Homo sapiens
ccagagcccgggacctggactt

SEQ ID NO: 7960888 - DNA, 22 bp, Homo sapiens
ccagagcccctgagcttccctg

SEQ ID NO: 7960889 - DNA, 22 bp, Homo sapiens
ccagagcccagggtcatgcagg

SEQ ID NO: 7960890 - DNA, 22 bp, Homo sapiens
ccagagcccagggtcatgcagg

SEQ ID NO: 7960891 - DNA, 22 bp, Homo sapiens
ccagagcccagggtcatgcagg

SEQ ID NO: 7960892 - DNA, 22 bp, Homo sapiens
ccagagcccctgagcttccctg

SEQ ID NO: 7960893 - DNA, 22 bp, Homo sapiens
ccagaggctgggttcacctcag

SEQ ID NO: 7960894 - DNA, 22 bp, Homo sapiens
ccagaggctgggttcacctcag

SEQ ID NO: 7960895 - DNA, 22 bp, Homo sapiens
ccagaggctgggttcacctcag

SEQ ID NO: 7960896 - DNA, 22 bp, Homo sapiens
ccagaggctgggttcacctcag

SEQ ID NO: 7960897 - DNA, 22 bp, Homo sapiens
ccagaggctgggttcacctcag

SEQ ID NO: 7960898 - DNA, 22 bp, Homo sapiens
ccagaggctgggttcacctcag

SEQ ID NO: 7960899 - DNA, 22 bp, Homo sapiens
ccagaggctgggttcacctcag

SEQ ID NO: 7960900 - DNA, 22 bp, Homo sapiens
ccagaggctggggaaggataca

SEQ ID NO: 7960901 - DNA, 22 bp, Homo sapiens
ccagaggctggggaaggataca

SEQ ID NO: 7960902 - DNA, 22 bp, Homo sapiens
ccagaggctggggaaggataca

SEQ ID NO: 7960903 - DNA, 22 bp, Homo sapiens
ccagaggctggggaaggataca

SEQ ID NO: 7960904 - DNA, 22 bp, Homo sapiens
ccagaggctggcagccagctga

SEQ ID NO: 7960905 - DNA, 22 bp, Homo sapiens
ccagaggctggcagccagctga

SEQ ID NO: 7960906 - DNA, 22 bp, Homo sapiens
ccagaggctggcagccagctga

SEQ ID NO: 7960907 - DNA, 22 bp, Homo sapiens
ccagagggagccaccagggtgt

SEQ ID NO: 7960908 - DNA, 22 bp, Homo sapiens
ccagagggagccaccagggtgt

SEQ ID NO: 7960909 - DNA, 22 bp, Homo sapiens
ccagagggacgttaccagttca

SEQ ID NO: 7960910 - DNA, 22 bp, Homo sapiens
ccagagggacgttaccagttca

SEQ ID NO: 7960911 - DNA, 22 bp, Homo sapiens
ccagagggaagaggaagcgctg

SEQ ID NO: 7960912 - DNA, 22 bp, Homo sapiens
ccagagggaagaggaagcgctg

SEQ ID NO: 7960913 - DNA, 22 bp, Homo sapiens
ccagagggagccaccagggtgt

SEQ ID NO: 7960914 - DNA, 22 bp, Homo sapiens
ccagagggagccaccagggtgt

SEQ ID NO: 7960915 - DNA, 22 bp, Homo sapiens
ccagagggaactgggcctcatt

SEQ ID NO: 7960916 - DNA, 22 bp, Homo sapiens
ccagagggaactgggcctcatt

SEQ ID NO: 7960917 - DNA, 22 bp, Homo sapiens
ccagagggaactgggcctcatt

SEQ ID NO: 7960918 - DNA, 22 bp, Homo sapiens
ccagagggaagaggaagcgctg

SEQ ID NO: 7960919 - DNA, 22 bp, Homo sapiens
ccagagggaagaggaagcgctg

SEQ ID NO: 7960920 - DNA, 22 bp, Homo sapiens
ccagagggaagaggaagcgctg

SEQ ID NO: 7960921 - DNA, 22 bp, Homo sapiens
ccagaggctggcagccagctga

SEQ ID NO: 7960922 - DNA, 22 bp, Homo sapiens
ccagaggctggcagccagctga

SEQ ID NO: 7960923 - DNA, 22 bp, Homo sapiens
ccagaggctggcagccagctga

SEQ ID NO: 7960924 - DNA, 22 bp, Homo sapiens
ccagaggatcagtactggctgg

SEQ ID NO: 7960925 - DNA, 22 bp, Homo sapiens
ccagaggatcagtactggctgg

SEQ ID NO: 7960926 - DNA, 22 bp, Homo sapiens
ccagaggatcagtactggctgg

SEQ ID NO: 7960927 - DNA, 22 bp, Homo sapiens
ccagaggatcagtactggctgg

SEQ ID NO: 7960928 - DNA, 22 bp, Homo sapiens
ccagagcctcttatgaagatcg

SEQ ID NO: 7960929 - DNA, 22 bp, Homo sapiens
ccagagcctcttatgaagatcg

SEQ ID NO: 7960930 - DNA, 21 bp, Homo sapiens
ccagagcctgagaggattatg

SEQ ID NO: 7960931 - DNA, 22 bp, Homo sapiens
ccagagcctcaacacaggtcct

SEQ ID NO: 7960932 - DNA, 22 bp, Homo sapiens
ccagagcctcaacacaggtcct

SEQ ID NO: 7960933 - DNA, 22 bp, Homo sapiens
ccagagcctaagatctgatcct

SEQ ID NO: 7960934 - DNA, 22 bp, Homo sapiens
ccagagcctaagatctgatcct

SEQ ID NO: 7960935 - DNA, 22 bp, Homo sapiens
ccagagcctaagatctgatcct

SEQ ID NO: 7960936 - DNA, 22 bp, Homo sapiens
ccagagcctcgcccggagcctc

SEQ ID NO: 7960937 - DNA, 22 bp, Homo sapiens
ccagagcctcaacacaggtcct

SEQ ID NO: 7960938 - DNA, 22 bp, Homo sapiens
ccagagcctcgcccggagcctc

SEQ ID NO: 7960939 - DNA, 22 bp, Homo sapiens
ccagagcctcgcccggagcctc

SEQ ID NO: 7960940 - DNA, 22 bp, Homo sapiens
ccagagcctcttatgaagatcg

SEQ ID NO: 7960941 - DNA, 22 bp, Homo sapiens
ccagagcctcgcccggagcctc

SEQ ID NO: 7960942 - DNA, 22 bp, Homo sapiens
ccagagcctcgcccggagcctc

SEQ ID NO: 7960943 - DNA, 22 bp, Homo sapiens
catcataataacccagacacag

SEQ ID NO: 7960944 - DNA, 22 bp, Homo sapiens
catcagtttggtcaatgatggg

SEQ ID NO: 7960945 - DNA, 22 bp, Homo sapiens
catcataaaattgagataactg

SEQ ID NO: 7960946 - DNA, 22 bp, Homo sapiens
catcatatggaatttaaagtca

SEQ ID NO: 7960947 - DNA, 22 bp, Homo sapiens
catcatatatttctacaagtgc

SEQ ID NO: 7960948 - DNA, 22 bp, Homo sapiens
catcatatatttctacaagtgc

SEQ ID NO: 7960949 - DNA, 22 bp, Homo sapiens
tcagtgtcttctctttcctacc

SEQ ID NO: 7960950 - DNA, 22 bp, Homo sapiens
tcagtgtcttctctttcctacc

SEQ ID NO: 7960951 - DNA, 22 bp, Homo sapiens
tcagtgtctgtgggcaggatgg

SEQ ID NO: 7960952 - DNA, 22 bp, Homo sapiens
tcagtgtcttgacctgggtgtg

SEQ ID NO: 7960953 - DNA, 22 bp, Homo sapiens
tcagtgtcttgacctgggtgtg

SEQ ID NO: 7960954 - DNA, 22 bp, Homo sapiens
tcagtgtcttctctttcctacc

SEQ ID NO: 7960955 - DNA, 22 bp, Homo sapiens
tcagtgtcttctctttcctacc

SEQ ID NO: 7960956 - DNA, 22 bp, Homo sapiens
tcagtgctgtaaacaaaaggaa

SEQ ID NO: 7960957 - DNA, 22 bp, Homo sapiens
tcagtgctgctttatgacagtt

SEQ ID NO: 7960958 - DNA, 22 bp, Homo sapiens
tcagtgctgctttatgacagtt

SEQ ID NO: 7960959 - DNA, 22 bp, Homo sapiens
tcagtgctgtgtaaatgtatta

SEQ ID NO: 7960960 - DNA, 22 bp, Homo sapiens
tcagtgctgtaaacaaaaggaa

SEQ ID NO: 7960961 - DNA, 20 bp, Homo sapiens
catcatcacatgagccaatt

SEQ ID NO: 7960962 - DNA, 22 bp, Homo sapiens
tcagtgtgcactctgtgaccca

SEQ ID NO: 7960963 - DNA, 22 bp, Homo sapiens
tcagtgtggcccagggaagcag

SEQ ID NO: 7960964 - DNA, 22 bp, Homo sapiens
tcagtgtgcacgatacagattg

SEQ ID NO: 7960965 - DNA, 22 bp, Homo sapiens
tcagtgtgcacatggtagcagt

SEQ ID NO: 7960966 - DNA, 22 bp, Homo sapiens
tcagtgtgcacgatacagattg

SEQ ID NO: 7960967 - DNA, 22 bp, Homo sapiens
tcagtgtgcacatggtagcagt

SEQ ID NO: 7960968 - DNA, 22 bp, Homo sapiens
tcagtgtgcacatggtagcagt

SEQ ID NO: 7960969 - DNA, 23 bp, Homo sapiens
tcagtgtgcaagaatggagaagc

SEQ ID NO: 7960970 - DNA, 22 bp, Homo sapiens
tcagtgtgcacatggtagcagt

SEQ ID NO: 7960971 - DNA, 23 bp, Homo sapiens
tcagtgtgcaagaatggagaagc

SEQ ID NO: 7960972 - DNA, 23 bp, Homo sapiens
tcagtgtgcaagaatggagaagc

SEQ ID NO: 7960973 - DNA, 23 bp, Homo sapiens
tcagtgtgcaagaatggagaagc

SEQ ID NO: 7960974 - DNA, 22 bp, Homo sapiens
tcagtgtgtagtaaattgtagg

SEQ ID NO: 7960975 - DNA, 22 bp, Homo sapiens
tcagtgtgtacactgagcattt

SEQ ID NO: 7960976 - DNA, 22 bp, Homo sapiens
tcagtgtgtaattctttgtttc

SEQ ID NO: 7960977 - DNA, 22 bp, Homo sapiens
tcagtgtgggtaagcatgctgt

SEQ ID NO: 7960978 - DNA, 22 bp, Homo sapiens
tcagtgtgggtaagcatgctgt

SEQ ID NO: 7960979 - DNA, 22 bp, Homo sapiens
tcagtgtggcccagggaagcag

SEQ ID NO: 7960980 - DNA, 22 bp, Homo sapiens
tcagtgtggaaaatcctttggc

SEQ ID NO: 7960981 - DNA, 20 bp, Homo sapiens
tcagtgtggcggggacctca

SEQ ID NO: 7960982 - DNA, 22 bp, Homo sapiens
tcagtgtgaattcattttagat

SEQ ID NO: 7960983 - DNA, 22 bp, Homo sapiens
tcagtgtgactgatggctttat

SEQ ID NO: 7960984 - DNA, 22 bp, Homo sapiens
tcagtgtgaattcaggagccta

SEQ ID NO: 7960985 - DNA, 22 bp, Homo sapiens
tcagtgtgaattcaggagccta

SEQ ID NO: 7960986 - DNA, 22 bp, Homo sapiens
tcagtgtcttgacctgggtgtg

SEQ ID NO: 7960987 - DNA, 22 bp, Homo sapiens
tcagtgtcttgggcttgaatgc

SEQ ID NO: 7960988 - DNA, 22 bp, Homo sapiens
tcagtgtgaggggctgggtcct

SEQ ID NO: 7960989 - DNA, 22 bp, Homo sapiens
tcagtgtgaggtcttccacccg

SEQ ID NO: 7960990 - DNA, 19 bp, Homo sapiens
tcagtgtgacttggtcagt

SEQ ID NO: 7960991 - DNA, 22 bp, Homo sapiens
tcagtgtgaggggctgggtcct

SEQ ID NO: 7960992 - DNA, 19 bp, Homo sapiens
tcagtgtgacttggtcagt

SEQ ID NO: 7960993 - DNA, 21 bp, Homo sapiens
tcagtgtgactggcaaattga

SEQ ID NO: 7960994 - DNA, 22 bp, Homo sapiens
tcagtgtgattaggctatctga

SEQ ID NO: 7960995 - DNA, 22 bp, Homo sapiens
tcagtgtgattaggctatctga

SEQ ID NO: 7960996 - DNA, 22 bp, Homo sapiens
tcagtgtgagtaccatgctcag

SEQ ID NO: 7960997 - DNA, 22 bp, Homo sapiens
tcagtgtgagtaccatgctcag

SEQ ID NO: 7960998 - DNA, 22 bp, Homo sapiens
catcagtggtaactgaatggtt

SEQ ID NO: 7960999 - DNA, 22 bp, Homo sapiens
catcagtggatatagattagcg

SEQ ID NO: 7961000 - DNA, 22 bp, Homo sapiens
catcagtgttgatccaccagca

SEQ ID NO: 7961001 - DNA, 22 bp, Homo sapiens
catcagtgttcactattccttc

SEQ ID NO: 7961002 - DNA, 22 bp, Homo sapiens
catcagtgttcactattccttc

SEQ ID NO: 7961003 - DNA, 22 bp, Homo sapiens
catcagtgttggcttctcagag

SEQ ID NO: 7961004 - DNA, 20 bp, Homo sapiens
catcagtgcctgacaggtcc

SEQ ID NO: 7961005 - DNA, 22 bp, Homo sapiens
catcagtgcggcatctgtcatc

SEQ ID NO: 7961006 - DNA, 22 bp, Homo sapiens
catcagtgagccccttgatgag

SEQ ID NO: 7961007 - DNA, 23 bp, Homo sapiens
catcagtgagggggaatcactaa

SEQ ID NO: 7961008 - DNA, 22 bp, Homo sapiens
catcagtgcccttggggatgcc

SEQ ID NO: 7961009 - DNA, 22 bp, Homo sapiens
catcagtctagattctagtacc

SEQ ID NO: 7961010 - DNA, 22 bp, Homo sapiens
catcagtctagattctagtacc

SEQ ID NO: 7961011 - DNA, 22 bp, Homo sapiens
catcagtctagattctagtacc

SEQ ID NO: 7961012 - DNA, 22 bp, Homo sapiens
catcagtctgaaagccagggag

SEQ ID NO: 7961013 - DNA, 22 bp, Homo sapiens
catcagtcagtctcttcagtat

SEQ ID NO: 7961014 - DNA, 22 bp, Homo sapiens
catcagtcagtctcttcagtat

SEQ ID NO: 7961015 - DNA, 22 bp, Homo sapiens
catcagtcccacggagcagccc

SEQ ID NO: 7961016 - DNA, 22 bp, Homo sapiens
catcagtgagccccttgatgag

SEQ ID NO: 7961017 - DNA, 22 bp, Homo sapiens
catcagtgaaagtgaatgttct

SEQ ID NO: 7961018 - DNA, 22 bp, Homo sapiens
catcagtctgtgaagagggcta

SEQ ID NO: 7961019 - DNA, 22 bp, Homo sapiens
catcagtgaaagtgaatgttct

SEQ ID NO: 7961020 - DNA, 22 bp, Homo sapiens
catcagcactatgattaaagta

SEQ ID NO: 7961021 - DNA, 22 bp, Homo sapiens
catcagcaggcaacactcttgg

SEQ ID NO: 7961022 - DNA, 22 bp, Homo sapiens
catcagcactatgattaaagta

SEQ ID NO: 7961023 - DNA, 22 bp, Homo sapiens
catcagagttaacatcatgact

SEQ ID NO: 7961024 - DNA, 22 bp, Homo sapiens
catcagagtggtggcctggtgt

SEQ ID NO: 7961025 - DNA, 22 bp, Homo sapiens
catcagagtggtggcctggtgt

SEQ ID NO: 7961026 - DNA, 22 bp, Homo sapiens
catcagcagtcacatgatgctg

SEQ ID NO: 7961027 - DNA, 22 bp, Homo sapiens
catcagcctggaaggcagcctg

SEQ ID NO: 7961028 - DNA, 22 bp, Homo sapiens
catcagctcttcattcttgatt

SEQ ID NO: 7961029 - DNA, 22 bp, Homo sapiens
catcagctcttcattcttgatt

SEQ ID NO: 7961030 - DNA, 22 bp, Homo sapiens
catcagctgagggtgagcagaa

SEQ ID NO: 7961031 - DNA, 22 bp, Homo sapiens
catcaggataagttccaggtgg

SEQ ID NO: 7961032 - DNA, 22 bp, Homo sapiens
catcaggatctctctggaatgc

SEQ ID NO: 7961033 - DNA, 22 bp, Homo sapiens
catcagtaaggcaacatagctt

SEQ ID NO: 7961034 - DNA, 18 bp, Homo sapiens
catcagtatccactaggt

SEQ ID NO: 7961035 - DNA, 22 bp, Homo sapiens
catcagtcagtcaacgcagttt

SEQ ID NO: 7961036 - DNA, 22 bp, Homo sapiens
catcagtcagtctcttcagtat

SEQ ID NO: 7961037 - DNA, 22 bp, Homo sapiens
catcaggaataaatgaggctgt

SEQ ID NO: 7961038 - DNA, 22 bp, Homo sapiens
catcaggaaaggacgtctagcc

SEQ ID NO: 7961039 - DNA, 22 bp, Homo sapiens
catcaggaaaaaactggagcca

SEQ ID NO: 7961040 - DNA, 22 bp, Homo sapiens
catcaggaaaaaactggagcca

SEQ ID NO: 7961041 - DNA, 22 bp, Homo sapiens
catcagctttggcgctgagcat

SEQ ID NO: 7961042 - DNA, 22 bp, Homo sapiens
tcatacaattcaatctctgatt

SEQ ID NO: 7961043 - DNA, 20 bp, Homo sapiens
tcatacacatgagcatgcag

SEQ ID NO: 7961044 - DNA, 20 bp, Homo sapiens
tcatacacatgagcatgcag

SEQ ID NO: 7961045 - DNA, 22 bp, Homo sapiens
tcatacacctatctctctgtgc

SEQ ID NO: 7961046 - DNA, 22 bp, Homo sapiens
tcatacaggctcaagctatacg

SEQ ID NO: 7961047 - DNA, 22 bp, Homo sapiens
tcatacacattcttattacttt

SEQ ID NO: 7961048 - DNA, 22 bp, Homo sapiens
tcatacacattcttattacttt

SEQ ID NO: 7961049 - DNA, 20 bp, Homo sapiens
tcatacacatgagcatgcag

SEQ ID NO: 7961050 - DNA, 22 bp, Homo sapiens
tcatacaactaagagtttcaga

SEQ ID NO: 7961051 - DNA, 22 bp, Homo sapiens
tcatacaactaagagtttcaga

SEQ ID NO: 7961052 - DNA, 22 bp, Homo sapiens
tcatacaactaagagtttcaga

SEQ ID NO: 7961053 - DNA, 22 bp, Homo sapiens
tcatacaagatcactttggcca

SEQ ID NO: 7961054 - DNA, 22 bp, Homo sapiens
tcatacaagatcactttggcca

SEQ ID NO: 7961055 - DNA, 22 bp, Homo sapiens
tcatacaaggagggtgttcaaa

SEQ ID NO: 7961056 - DNA, 22 bp, Homo sapiens
tcatacaaggagggtgttcaaa

SEQ ID NO: 7961057 - DNA, 22 bp, Homo sapiens
tcatacaaggagggtgttcaaa

SEQ ID NO: 7961058 - DNA, 22 bp, Homo sapiens
tcatacaaggagggtgttcaaa

SEQ ID NO: 7961059 - DNA, 22 bp, Homo sapiens
tcatacaaggagggtgttcaaa

SEQ ID NO: 7961060 - DNA, 22 bp, Homo sapiens
tcatacaattcaatctctgatt

SEQ ID NO: 7961061 - DNA, 22 bp, Homo sapiens
tcatacaattcaatctctgatt

SEQ ID NO: 7961062 - DNA, 22 bp, Homo sapiens
tcataatacaaagagttctgca

SEQ ID NO: 7961063 - DNA, 22 bp, Homo sapiens
tcataagtggtttatatgcttg

SEQ ID NO: 7961064 - DNA, 22 bp, Homo sapiens
tcataatgacaaacatactcag

SEQ ID NO: 7961065 - DNA, 22 bp, Homo sapiens
tcataatgacaaacatactcag

SEQ ID NO: 7961066 - DNA, 22 bp, Homo sapiens
tcataatgaccccagagtccgc

SEQ ID NO: 7961067 - DNA, 22 bp, Homo sapiens
tcataatgtagttcatggctgg

SEQ ID NO: 7961068 - DNA, 22 bp, Homo sapiens
tcataatgtagttcatggctgg

SEQ ID NO: 7961069 - DNA, 22 bp, Homo sapiens
tcataatgtagttcatggctgg

SEQ ID NO: 7961070 - DNA, 22 bp, Homo sapiens
tcataatgaccccagagtccgc

SEQ ID NO: 7961071 - DNA, 22 bp, Homo sapiens
tcataatgcacaggcccctgtg

SEQ ID NO: 7961072 - DNA, 22 bp, Homo sapiens
tcataattgtatacatttatgg

SEQ ID NO: 7961073 - DNA, 22 bp, Homo sapiens
tcataattgtatacatttatgg

SEQ ID NO: 7961074 - DNA, 22 bp, Homo sapiens
tcataattgtatacatttatgg

SEQ ID NO: 7961075 - DNA, 22 bp, Homo sapiens
tcatacaactaagagtttcaga

SEQ ID NO: 7961076 - DNA, 22 bp, Homo sapiens
tcatacataacttgtacagtga

SEQ ID NO: 7961077 - DNA, 22 bp, Homo sapiens
tcatacataaataagagtttag

SEQ ID NO: 7961078 - DNA, 22 bp, Homo sapiens
tcatacaggctcaagctatacg

SEQ ID NO: 7961079 - DNA, 22 bp, Homo sapiens
tcatcacatatgtcatgatttg

SEQ ID NO: 7961080 - DNA, 22 bp, Homo sapiens
tcatcacatatgtcatgatttg

SEQ ID NO: 7961081 - DNA, 22 bp, Homo sapiens
tcatcacatatgtcatgatttg

SEQ ID NO: 7961082 - DNA, 22 bp, Homo sapiens
tcatcacatatgtcatgatttg

SEQ ID NO: 7961083 - DNA, 22 bp, Homo sapiens
tcatcacaattttatgaccctc

SEQ ID NO: 7961084 - DNA, 22 bp, Homo sapiens
tcatcacaattttatgaccctc

SEQ ID NO: 7961085 - DNA, 22 bp, Homo sapiens
tcatcacatgtgtagtcatccc

SEQ ID NO: 7961086 - DNA, 22 bp, Homo sapiens
tcatcacatgtgtagtcatccc

SEQ ID NO: 7961087 - DNA, 22 bp, Homo sapiens
tcatcacatgtgtagtcatccc

SEQ ID NO: 7961088 - DNA, 22 bp, Homo sapiens
tcatcactcattggacaacaga

SEQ ID NO: 7961089 - DNA, 19 bp, Homo sapiens
tcatcacctaattctctat

SEQ ID NO: 7961090 - DNA, 19 bp, Homo sapiens
tcatcacccctcctctcta

SEQ ID NO: 7961091 - DNA, 22 bp, Homo sapiens
tcatcacatgtgtagtcatccc

SEQ ID NO: 7961092 - DNA, 20 bp, Homo sapiens
tcatcagataggttagtaca

SEQ ID NO: 7961093 - DNA, 22 bp, Homo sapiens
tcatcagagctcccccaaacgt

SEQ ID NO: 7961094 - DNA, 22 bp, Homo sapiens
tcatcagcaccctatgtccttt

SEQ ID NO: 7961095 - DNA, 22 bp, Homo sapiens
tcatcagctcatctgctcctag

SEQ ID NO: 7961096 - DNA, 22 bp, Homo sapiens
tcatcactgtatcattgataga

SEQ ID NO: 7961097 - DNA, 22 bp, Homo sapiens
tcatcactgtatcattgataga

SEQ ID NO: 7961098 - DNA, 22 bp, Homo sapiens
catcctgagaggtctctctacc

SEQ ID NO: 7961099 - DNA, 22 bp, Homo sapiens
catcctgcggggagcagagggc

SEQ ID NO: 7961100 - DNA, 22 bp, Homo sapiens
catcctgactgggtaaagctta

SEQ ID NO: 7961101 - DNA, 22 bp, Homo sapiens
catcctggttaccccatagtca

SEQ ID NO: 7961102 - DNA, 22 bp, Homo sapiens
catcctgactgtaactaagaga

SEQ ID NO: 7961103 - DNA, 22 bp, Homo sapiens
catcctgagaaaataaaggaga

SEQ ID NO: 7961104 - DNA, 22 bp, Homo sapiens
catcgtatggccgaatgtacat

SEQ ID NO: 7961105 - DNA, 22 bp, Homo sapiens
catccttctcaaagagtgcatg

SEQ ID NO: 7961106 - DNA, 22 bp, Homo sapiens
catccttctcaaagagtgcatg

SEQ ID NO: 7961107 - DNA, 18 bp, Homo sapiens
catccttatagctgagaa

SEQ ID NO: 7961108 - DNA, 22 bp, Homo sapiens
catctaaatttgactccaagga

SEQ ID NO: 7961109 - DNA, 22 bp, Homo sapiens
catcgtgtctaggtgtgcagca

SEQ ID NO: 7961110 - DNA, 22 bp, Homo sapiens
catccttcaaaggctacaatta

SEQ ID NO: 7961111 - DNA, 22 bp, Homo sapiens
catcctgtttctgtgcagcatg

SEQ ID NO: 7961112 - DNA, 22 bp, Homo sapiens
catcctgtttctgtgcagcatg

SEQ ID NO: 7961113 - DNA, 22 bp, Homo sapiens
catcctgtgatgtctttggctg

SEQ ID NO: 7961114 - DNA, 22 bp, Homo sapiens
catcctgtgatgtctttggctg

SEQ ID NO: 7961115 - DNA, 22 bp, Homo sapiens
catccctgtctgccactctgaa

SEQ ID NO: 7961116 - DNA, 19 bp, Homo sapiens
tcagtgtgtgggaggtggt

SEQ ID NO: 7961117 - DNA, 19 bp, Homo sapiens
tcagtgtgtgggaggtggt

SEQ ID NO: 7961118 - DNA, 22 bp, Homo sapiens
tcagtgtgtctctgcatttggg

SEQ ID NO: 7961119 - DNA, 19 bp, Homo sapiens
tcagtgtgtgggaggtggt

SEQ ID NO: 7961120 - DNA, 22 bp, Homo sapiens
tcagtgtgtagtaaattgtagg

SEQ ID NO: 7961121 - DNA, 22 bp, Homo sapiens
catccgcatgcaagtgctgtcc

SEQ ID NO: 7961122 - DNA, 22 bp, Homo sapiens
catccgcatgcaagtgctgtcc

SEQ ID NO: 7961123 - DNA, 22 bp, Homo sapiens
catccgcatgcaagtgctgtcc

SEQ ID NO: 7961124 - DNA, 22 bp, Homo sapiens
catcctgaagaagccgcactgt

SEQ ID NO: 7961125 - DNA, 22 bp, Homo sapiens
catcctgacaagaaagccagaa

SEQ ID NO: 7961126 - DNA, 22 bp, Homo sapiens
catccgttaataaaaagacagt

SEQ ID NO: 7961127 - DNA, 22 bp, Homo sapiens
catcctctccagcagtggagtg

SEQ ID NO: 7961128 - DNA, 22 bp, Homo sapiens
catcctgaaagaaacatttcct

SEQ ID NO: 7961129 - DNA, 22 bp, Homo sapiens
tcagtttcctcatctacaaaag

SEQ ID NO: 7961130 - DNA, 22 bp, Homo sapiens
tcagtttcacttgaagaaaaga

SEQ ID NO: 7961131 - DNA, 19 bp, Homo sapiens
catctatcctcattctctg

SEQ ID NO: 7961132 - DNA, 22 bp, Homo sapiens
tcagtttcacagtctgtgcaga

SEQ ID NO: 7961133 - DNA, 22 bp, Homo sapiens
tcagtttcattatccataaaat

SEQ ID NO: 7961134 - DNA, 22 bp, Homo sapiens
tcagtttcacttgaagaaaaga

SEQ ID NO: 7961135 - DNA, 22 bp, Homo sapiens
tcataagctagctgcaccatat

SEQ ID NO: 7961136 - DNA, 22 bp, Homo sapiens
tcataagattgaaacttggaag

SEQ ID NO: 7961137 - DNA, 19 bp, Homo sapiens
tcataaggagagaggaaat

SEQ ID NO: 7961138 - DNA, 22 bp, Homo sapiens
tcataacaggctgagaggattt

SEQ ID NO: 7961139 - DNA, 22 bp, Homo sapiens
tcataacaacctggaaggccag

SEQ ID NO: 7961140 - DNA, 22 bp, Homo sapiens
tcataacactggtgattaagaa

SEQ ID NO: 7961141 - DNA, 22 bp, Homo sapiens
tcataacaacctggaaggccag

SEQ ID NO: 7961142 - DNA, 22 bp, Homo sapiens
tcataacaggctgagaggattt

SEQ ID NO: 7961143 - DNA, 22 bp, Homo sapiens
catctacactgattaggtgaac

SEQ ID NO: 7961144 - DNA, 22 bp, Homo sapiens
catctacaggagaatgtcactg

SEQ ID NO: 7961145 - DNA, 22 bp, Homo sapiens
catctacaggagaatgtcactg

SEQ ID NO: 7961146 - DNA, 22 bp, Homo sapiens
catctacaggagaatgtcactg

SEQ ID NO: 7961147 - DNA, 22 bp, Homo sapiens
catctacaggagaatgtcactg

SEQ ID NO: 7961148 - DNA, 22 bp, Homo sapiens
catctaaccagtcgtttttgga

SEQ ID NO: 7961149 - DNA, 22 bp, Homo sapiens
catctacactgattaggtgaac

SEQ ID NO: 7961150 - DNA, 18 bp, Homo sapiens
catctacaaatgccagaa

SEQ ID NO: 7961151 - DNA, 19 bp, Homo sapiens
catctatcctcattctctg

SEQ ID NO: 7961152 - DNA, 23 bp, Homo sapiens
catctagcatccagtgagtagtg

SEQ ID NO: 7961153 - DNA, 23 bp, Homo sapiens
catctagcatccagtgagtagtg

SEQ ID NO: 7961154 - DNA, 22 bp, Homo sapiens
catctagaaaaaagacctgttg

SEQ ID NO: 7961155 - DNA, 22 bp, Homo sapiens
catctagaaaaaagacctgttg

SEQ ID NO: 7961156 - DNA, 22 bp, Homo sapiens
catctagaaaaaagacctgttg

SEQ ID NO: 7961157 - DNA, 22 bp, Homo sapiens
catctacatgcttgccactgct

SEQ ID NO: 7961158 - DNA, 22 bp, Homo sapiens
catctacctccaccctatatat

SEQ ID NO: 7961159 - DNA, 22 bp, Homo sapiens
catctaccagaattgctataaa

SEQ ID NO: 7961160 - DNA, 22 bp, Homo sapiens
cagtgtcaccaggcgagtctcc

SEQ ID NO: 7961161 - DNA, 22 bp, Homo sapiens
cagtgtataaactttaacatag

SEQ ID NO: 7961162 - DNA, 22 bp, Homo sapiens
cagtgtaagctctagactagaa

SEQ ID NO: 7961163 - DNA, 22 bp, Homo sapiens
cagtgtaagaattcaaagccta

SEQ ID NO: 7961164 - DNA, 22 bp, Homo sapiens
cagtgtacttggaatgtaacag

SEQ ID NO: 7961165 - DNA, 22 bp, Homo sapiens
cagtggtttctgaacagtgtgc

SEQ ID NO: 7961166 - DNA, 22 bp, Homo sapiens
cagtggtttctgaacagtgtgc

SEQ ID NO: 7961167 - DNA, 22 bp, Homo sapiens
cagtggtttccaaacttgttcc

SEQ ID NO: 7961168 - DNA, 22 bp, Homo sapiens
cagtggtttccaaacttgttcc

SEQ ID NO: 7961169 - DNA, 22 bp, Homo sapiens
cagtggtttccaaacttgttcc

SEQ ID NO: 7961170 - DNA, 22 bp, Homo sapiens
cagtggttttcagctgggagtt

SEQ ID NO: 7961171 - DNA, 22 bp, Homo sapiens
cagtggttttatatctaagctt

SEQ ID NO: 7961172 - DNA, 22 bp, Homo sapiens
cagtggttttatatctaagctt

SEQ ID NO: 7961173 - DNA, 22 bp, Homo sapiens
cagtggttttgagattcagggt

SEQ ID NO: 7961174 - DNA, 22 bp, Homo sapiens
cagtggttttcagctgggagtt

SEQ ID NO: 7961175 - DNA, 22 bp, Homo sapiens
cagtgggtgatgagtcctgggg

SEQ ID NO: 7961176 - DNA, 22 bp, Homo sapiens
cagtggttttgagattcagggt

SEQ ID NO: 7961177 - DNA, 22 bp, Homo sapiens
cagtgtctcaaaacaagttgct

SEQ ID NO: 7961178 - DNA, 22 bp, Homo sapiens
cagtgtctacagtggctggagg

SEQ ID NO: 7961179 - DNA, 22 bp, Homo sapiens
cagtgtctcaaaacaagttgct

SEQ ID NO: 7961180 - DNA, 22 bp, Homo sapiens
cagtgtctcaaaacaagttgct

SEQ ID NO: 7961181 - DNA, 22 bp, Homo sapiens
tcactgtttcatccctagcact

SEQ ID NO: 7961182 - DNA, 22 bp, Homo sapiens
tcactgttgatgggcatgcagg

SEQ ID NO: 7961183 - DNA, 22 bp, Homo sapiens
tcactgtttcctgtactggaca

SEQ ID NO: 7961184 - DNA, 22 bp, Homo sapiens
tcactgtttcatccctagcact

SEQ ID NO: 7961185 - DNA, 22 bp, Homo sapiens
cagtgtcaggatcagtatattt

SEQ ID NO: 7961186 - DNA, 22 bp, Homo sapiens
cagtgtcaggatcagtatattt

SEQ ID NO: 7961187 - DNA, 22 bp, Homo sapiens
cagtgtcaccaggcgagtctcc

SEQ ID NO: 7961188 - DNA, 22 bp, Homo sapiens
cagtgtataaactttaacatag

SEQ ID NO: 7961189 - DNA, 22 bp, Homo sapiens
cagtgtcaccaggcgagtctcc

SEQ ID NO: 7961190 - DNA, 22 bp, Homo sapiens
cagtgtctacagtggctggagg

SEQ ID NO: 7961191 - DNA, 22 bp, Homo sapiens
tcacttattttctaaccaaagg

SEQ ID NO: 7961192 - DNA, 22 bp, Homo sapiens
tcacttcacacccactatcatg

SEQ ID NO: 7961193 - DNA, 22 bp, Homo sapiens
tcaggaagttttgaatcaactg

SEQ ID NO: 7961194 - DNA, 22 bp, Homo sapiens
tcacttcccagacggggtggca

SEQ ID NO: 7961195 - DNA, 22 bp, Homo sapiens
tcaggaagttttgaatcaactg

SEQ ID NO: 7961196 - DNA, 22 bp, Homo sapiens
tcaggaatccagacagggcaca

SEQ ID NO: 7961197 - DNA, 22 bp, Homo sapiens
tcacttatgtgtgattgatgcc

SEQ ID NO: 7961198 - DNA, 20 bp, Homo sapiens
tcacttattctcaacttgtg

SEQ ID NO: 7961199 - DNA, 22 bp, Homo sapiens
tcacttattaactcataccatt

SEQ ID NO: 7961200 - DNA, 22 bp, Homo sapiens
tcacttattgctcatctcatgc

SEQ ID NO: 7961201 - DNA, 22 bp, Homo sapiens
tcacttatgtgtgattgatgcc

SEQ ID NO: 7961202 - DNA, 22 bp, Homo sapiens
tcacttagatggggatcatcac

SEQ ID NO: 7961203 - DNA, 22 bp, Homo sapiens
tcacttagatggggatcatcac

SEQ ID NO: 7961204 - DNA, 22 bp, Homo sapiens
tcacttagatggggatcatcac

SEQ ID NO: 7961205 - DNA, 22 bp, Homo sapiens
tcacttagatggggatcatcac

SEQ ID NO: 7961206 - DNA, 22 bp, Homo sapiens
tcacttataaaatgcaagatct

SEQ ID NO: 7961207 - DNA, 21 bp, Homo sapiens
tcacttataatgtatttgctg

SEQ ID NO: 7961208 - DNA, 22 bp, Homo sapiens
tcactgtttcctgtactggaca

SEQ ID NO: 7961209 - DNA, 22 bp, Homo sapiens
tcactgttttgcctgcacttcc

SEQ ID NO: 7961210 - DNA, 22 bp, Homo sapiens
tcactgtttgcagtgaagagaa

SEQ ID NO: 7961211 - DNA, 22 bp, Homo sapiens
tcacttagatggggatcatcac

SEQ ID NO: 7961212 - DNA, 22 bp, Homo sapiens
tcacttaaaaattctagttatg

SEQ ID NO: 7961213 - DNA, 22 bp, Homo sapiens
tcacttaaaaattctagttatg

SEQ ID NO: 7961214 - DNA, 22 bp, Homo sapiens
tcactgttttgcctgcacttcc

SEQ ID NO: 7961215 - DNA, 22 bp, Homo sapiens
tcaggcagaattatcaaaagat

SEQ ID NO: 7961216 - DNA, 22 bp, Homo sapiens
tcaggcagaattatcaaaagat

SEQ ID NO: 7961217 - DNA, 22 bp, Homo sapiens
tcaggcagaattatcaaaagat

SEQ ID NO: 7961218 - DNA, 22 bp, Homo sapiens
tcaggcagaattatcaaaagat

SEQ ID NO: 7961219 - DNA, 22 bp, Homo sapiens
tcaggcagaattatcaaaagat

SEQ ID NO: 7961220 - DNA, 22 bp, Homo sapiens
tcaggcagaattatcaaaagat

SEQ ID NO: 7961221 - DNA, 22 bp, Homo sapiens
tcaggcagaattatcaaaagat

SEQ ID NO: 7961222 - DNA, 22 bp, Homo sapiens
tcaggagggagtgtggatagag

SEQ ID NO: 7961223 - DNA, 21 bp, Homo sapiens
tcaggaggctcagactcctgc

SEQ ID NO: 7961224 - DNA, 22 bp, Homo sapiens
tcaggcagaaaaatcactaatt

SEQ ID NO: 7961225 - DNA, 22 bp, Homo sapiens
tcaggcagaaaaatcactaatt

SEQ ID NO: 7961226 - DNA, 22 bp, Homo sapiens
tcaggcagaaaaatcactaatt

SEQ ID NO: 7961227 - DNA, 22 bp, Homo sapiens
tcaggcagaaaaatcactaatt

SEQ ID NO: 7961228 - DNA, 21 bp, Homo sapiens
tcaggaggctcagactcctgc

SEQ ID NO: 7961229 - DNA, 21 bp, Homo sapiens
tcaggaggctcagactcctgc

SEQ ID NO: 7961230 - DNA, 21 bp, Homo sapiens
tcaggaggctcagactcctgc

SEQ ID NO: 7961231 - DNA, 22 bp, Homo sapiens
tcaggaggcgtctcgctggggc

SEQ ID NO: 7961232 - DNA, 22 bp, Homo sapiens
tcaggaggcgtctcgctggggc

SEQ ID NO: 7961233 - DNA, 22 bp, Homo sapiens
tcaggaggcgtctcgctggggc

SEQ ID NO: 7961234 - DNA, 22 bp, Homo sapiens
tcaggaggcggtgctgcctttg

SEQ ID NO: 7961235 - DNA, 22 bp, Homo sapiens
tcaggaggcggtgctgcctttg

SEQ ID NO: 7961236 - DNA, 22 bp, Homo sapiens
tcaggaggcgtctcgctggggc

SEQ ID NO: 7961237 - DNA, 22 bp, Homo sapiens
tcaggaggctcaagacctggca

SEQ ID NO: 7961238 - DNA, 22 bp, Homo sapiens
tcaggaggctcaagacctggca

SEQ ID NO: 7961239 - DNA, 22 bp, Homo sapiens
tcaggaggctcaagacctggca

SEQ ID NO: 7961240 - DNA, 22 bp, Homo sapiens
tcaggaggcgtgctggggtaca

SEQ ID NO: 7961241 - DNA, 22 bp, Homo sapiens
tcaggaggcgtgctggggtaca

SEQ ID NO: 7961242 - DNA, 22 bp, Homo sapiens
tcaggaggccaccaggacctgt

SEQ ID NO: 7961243 - DNA, 22 bp, Homo sapiens
tcaggaggccaccaggacctgt

SEQ ID NO: 7961244 - DNA, 22 bp, Homo sapiens
tcaggaggccaccaggacctgt

SEQ ID NO: 7961245 - DNA, 22 bp, Homo sapiens
tcaggaggccaccaggacctgt

SEQ ID NO: 7961246 - DNA, 22 bp, Homo sapiens
tcaggaatgaggataaacattg

SEQ ID NO: 7961247 - DNA, 22 bp, Homo sapiens
tcaggaatgaggataaacattg

SEQ ID NO: 7961248 - DNA, 22 bp, Homo sapiens
tcaggaatgaggataaacattg

SEQ ID NO: 7961249 - DNA, 22 bp, Homo sapiens
tcaggaggccggcaggatttga

SEQ ID NO: 7961250 - DNA, 22 bp, Homo sapiens
tcaggaggccggcaggatttga

SEQ ID NO: 7961251 - DNA, 22 bp, Homo sapiens
tcaggaggccaccaggacctgt

SEQ ID NO: 7961252 - DNA, 22 bp, Homo sapiens
tcaggaggccggcaggatttga

SEQ ID NO: 7961253 - DNA, 22 bp, Homo sapiens
tcaggaggccggcaggatttga

SEQ ID NO: 7961254 - DNA, 22 bp, Homo sapiens
tcaggaggccggcaggatttga

SEQ ID NO: 7961255 - DNA, 22 bp, Homo sapiens
tcaggaggccgtgtgctcagtg

SEQ ID NO: 7961256 - DNA, 22 bp, Homo sapiens
tcaggaggccgtgtgctcagtg

SEQ ID NO: 7961257 - DNA, 22 bp, Homo sapiens
tcaggaggccgtgtgctcagtg

SEQ ID NO: 7961258 - DNA, 22 bp, Homo sapiens
tcaggaggcctgagtagctcta

SEQ ID NO: 7961259 - DNA, 22 bp, Homo sapiens
tcaggaggcctgagtagctcta

SEQ ID NO: 7961260 - DNA, 22 bp, Homo sapiens
tcaggaggcctgagtagctcta

SEQ ID NO: 7961261 - DNA, 22 bp, Homo sapiens
tcaggaggcctgagtagctcta

SEQ ID NO: 7961262 - DNA, 22 bp, Homo sapiens
tcaggaggccgtgtgctcagtg

SEQ ID NO: 7961263 - DNA, 22 bp, Homo sapiens
tcaggaggccgtgtgctcagtg

SEQ ID NO: 7961264 - DNA, 22 bp, Homo sapiens
tcaggaggcggaggttgcagtg

SEQ ID NO: 7961265 - DNA, 22 bp, Homo sapiens
tcaggaggcggaggttgcagtg

SEQ ID NO: 7961266 - DNA, 22 bp, Homo sapiens
tcaggaggcggaggttgcagtg

SEQ ID NO: 7961267 - DNA, 22 bp, Homo sapiens
tcaggaggcggtgctgcctttg

SEQ ID NO: 7961268 - DNA, 22 bp, Homo sapiens
tcaggaggcggtgctgcctttg

SEQ ID NO: 7961269 - DNA, 22 bp, Homo sapiens
tcaggaggcggtgctgcctttg

SEQ ID NO: 7961270 - DNA, 18 bp, Homo sapiens
tcaggctgccctgtgtct

SEQ ID NO: 7961271 - DNA, 22 bp, Homo sapiens
tcaggctgcctatcagactgtg

SEQ ID NO: 7961272 - DNA, 18 bp, Homo sapiens
tcaggctgccctgtgtct

SEQ ID NO: 7961273 - DNA, 22 bp, Homo sapiens
tcaggctgcctatcagactgtg

SEQ ID NO: 7961274 - DNA, 22 bp, Homo sapiens
tcaggctgcctatcagactgtg

SEQ ID NO: 7961275 - DNA, 22 bp, Homo sapiens
tcaggctgcctatcagactgtg

SEQ ID NO: 7961276 - DNA, 22 bp, Homo sapiens
catcacattagtctcaagagaa

SEQ ID NO: 7961277 - DNA, 21 bp, Homo sapiens
catcacattactcaaagtcct

SEQ ID NO: 7961278 - DNA, 22 bp, Homo sapiens
catcagagtggtggcctggtgt

SEQ ID NO: 7961279 - DNA, 22 bp, Homo sapiens
catcagagtcagagctctttct

SEQ ID NO: 7961280 - DNA, 22 bp, Homo sapiens
tcaggctgcatctgtaagggtg

SEQ ID NO: 7961281 - DNA, 22 bp, Homo sapiens
tcaggctgcagtggcaaaagac

SEQ ID NO: 7961282 - DNA, 22 bp, Homo sapiens
tcaggctgcatctgtaagggtg

SEQ ID NO: 7961283 - DNA, 22 bp, Homo sapiens
tcaggctgcatctgtaagggtg

SEQ ID NO: 7961284 - DNA, 22 bp, Homo sapiens
tcaggctgcatctgtaagggtg

SEQ ID NO: 7961285 - DNA, 22 bp, Homo sapiens
tcaggctgcatctgtaagggtg

SEQ ID NO: 7961286 - DNA, 22 bp, Homo sapiens
tcaggctgcatctgtaagggtg

SEQ ID NO: 7961287 - DNA, 22 bp, Homo sapiens
tcaggctgcccgttcagggctc

SEQ ID NO: 7961288 - DNA, 18 bp, Homo sapiens
tcaggctgccctgtgtct

SEQ ID NO: 7961289 - DNA, 18 bp, Homo sapiens
tcaggctgccctgtgtct

SEQ ID NO: 7961290 - DNA, 22 bp, Homo sapiens
tcaggctgcccgttcagggctc

SEQ ID NO: 7961291 - DNA, 22 bp, Homo sapiens
tcaggctgcccgttcagggctc

SEQ ID NO: 7961292 - DNA, 22 bp, Homo sapiens
tcaggctgcccgttcagggctc

SEQ ID NO: 7961293 - DNA, 22 bp, Homo sapiens
tcaggctgcccgttcagggctc

SEQ ID NO: 7961294 - DNA, 22 bp, Homo sapiens
tcaggctgcagctgtcagcagc

SEQ ID NO: 7961295 - DNA, 22 bp, Homo sapiens
tcaggctgcagctgtcagcagc

SEQ ID NO: 7961296 - DNA, 22 bp, Homo sapiens
tcaggctgcagctgtcagcagc

SEQ ID NO: 7961297 - DNA, 22 bp, Homo sapiens
tcaggctgatttcttttgaggg

SEQ ID NO: 7961298 - DNA, 22 bp, Homo sapiens
tcaggctgatttcttttgaggg

SEQ ID NO: 7961299 - DNA, 22 bp, Homo sapiens
tcaggctgatttcttttgaggg

SEQ ID NO: 7961300 - DNA, 22 bp, Homo sapiens
catcacaaatgtaataatgtct

SEQ ID NO: 7961301 - DNA, 22 bp, Homo sapiens
catcaattggccaaggagcagt

SEQ ID NO: 7961302 - DNA, 22 bp, Homo sapiens
catcaatgtgcagagatgaacg

SEQ ID NO: 7961303 - DNA, 22 bp, Homo sapiens
catcaattggccaaggagcagt

SEQ ID NO: 7961304 - DNA, 22 bp, Homo sapiens
tcaggctgcagtggcaaaagac

SEQ ID NO: 7961305 - DNA, 22 bp, Homo sapiens
tcaggctgcagtggcaaaagac

SEQ ID NO: 7961306 - DNA, 22 bp, Homo sapiens
tcaggctgcagctgtcagcagc

SEQ ID NO: 7961307 - DNA, 22 bp, Homo sapiens
tcaggctgcagctgtcagcagc

SEQ ID NO: 7961308 - DNA, 22 bp, Homo sapiens
catcaagagtcttactatcagt

SEQ ID NO: 7961309 - DNA, 22 bp, Homo sapiens
catcaagagtcttactatcagt

SEQ ID NO: 7961310 - DNA, 21 bp, Homo sapiens
catcaactcttgtgctcacac

SEQ ID NO: 7961311 - DNA, 22 bp, Homo sapiens
catcaacagtgtcagatgatgc

SEQ ID NO: 7961312 - DNA, 22 bp, Homo sapiens
catcaacagtgtcagatgatgc

SEQ ID NO: 7961313 - DNA, 22 bp, Homo sapiens
catcaacagtgtcagatgatgc

SEQ ID NO: 7961314 - DNA, 20 bp, Homo sapiens
catcaacaccttgtcagcct

SEQ ID NO: 7961315 - DNA, 23 bp, Homo sapiens
catcaagtacttttgacaagtgt

SEQ ID NO: 7961316 - DNA, 22 bp, Homo sapiens
catcaagtcatcaaagaattca

SEQ ID NO: 7961317 - DNA, 22 bp, Homo sapiens
catcaagtgcctttcacctcta

SEQ ID NO: 7961318 - DNA, 22 bp, Homo sapiens
catcaatagggtttgaaagcaa

SEQ ID NO: 7961319 - DNA, 22 bp, Homo sapiens
catcaatgtgcagagatgaacg

SEQ ID NO: 7961320 - DNA, 22 bp, Homo sapiens
catcaaacaaatgcttttagat

SEQ ID NO: 7961321 - DNA, 22 bp, Homo sapiens
catcaaaattagacattgttga

SEQ ID NO: 7961322 - DNA, 22 bp, Homo sapiens
catcaaaattagacattgttga

SEQ ID NO: 7961323 - DNA, 22 bp, Homo sapiens
catcaaagttgatatccaatta

SEQ ID NO: 7961324 - DNA, 21 bp, Homo sapiens
catattaaatcggtgccttta

SEQ ID NO: 7961325 - DNA, 21 bp, Homo sapiens
catattaaatcggtgccttta

SEQ ID NO: 7961326 - DNA, 22 bp, Homo sapiens
catatgttgacatttaaacctc

SEQ ID NO: 7961327 - DNA, 22 bp, Homo sapiens
catcaaaattagacattgttga

SEQ ID NO: 7961328 - DNA, 19 bp, Homo sapiens
catatttttgggctggcat

SEQ ID NO: 7961329 - DNA, 22 bp, Homo sapiens
catcaaaattagacattgttga

SEQ ID NO: 7961330 - DNA, 22 bp, Homo sapiens
catcaaatgccatatatggttg

SEQ ID NO: 7961331 - DNA, 22 bp, Homo sapiens
catcaaatctgacttttcttcc

SEQ ID NO: 7961332 - DNA, 22 bp, Homo sapiens
catcaaatggcaagtgaaagct

SEQ ID NO: 7961333 - DNA, 22 bp, Homo sapiens
catcaaattatgtgtcaaagca

SEQ ID NO: 7961334 - DNA, 22 bp, Homo sapiens
catcaaataggaatatttggca

SEQ ID NO: 7961335 - DNA, 22 bp, Homo sapiens
catcaaatactacatgggttgg

SEQ ID NO: 7961336 - DNA, 22 bp, Homo sapiens
catcaaataaagaaattccttg

SEQ ID NO: 7961337 - DNA, 22 bp, Homo sapiens
catcaaatctgacttttcttcc

SEQ ID NO: 7961338 - DNA, 22 bp, Homo sapiens
catcaaataggaatatttggca

SEQ ID NO: 7961339 - DNA, 22 bp, Homo sapiens
catcaaataggaatatttggca

SEQ ID NO: 7961340 - DNA, 22 bp, Homo sapiens
catcaaagttgatatccaatta

SEQ ID NO: 7961341 - DNA, 22 bp, Homo sapiens
catcaaataaagaaattccttg

SEQ ID NO: 7961342 - DNA, 22 bp, Homo sapiens
tcaggcagagggagaagccaag

SEQ ID NO: 7961343 - DNA, 22 bp, Homo sapiens
catatgtatttctcataattag

SEQ ID NO: 7961344 - DNA, 22 bp, Homo sapiens
tcaggcagagggagaagccaag

SEQ ID NO: 7961345 - DNA, 22 bp, Homo sapiens
tcaggcagagggagaagccaag

SEQ ID NO: 7961346 - DNA, 22 bp, Homo sapiens
tcaggcagagggagaagccaag

SEQ ID NO: 7961347 - DNA, 22 bp, Homo sapiens
tcaggcagagggagaagccaag

SEQ ID NO: 7961348 - DNA, 22 bp, Homo sapiens
tcaggcagagggagaagccaag

SEQ ID NO: 7961349 - DNA, 22 bp, Homo sapiens
tcaggcagagggagaagccaag

SEQ ID NO: 7961350 - DNA, 22 bp, Homo sapiens
tcaggcagagggagaagccaag

SEQ ID NO: 7961351 - DNA, 22 bp, Homo sapiens
tcaggcagagggagaagccaag

SEQ ID NO: 7961352 - DNA, 22 bp, Homo sapiens
tcaggcagaggatggggagcgt

SEQ ID NO: 7961353 - DNA, 22 bp, Homo sapiens
tcaggcagaggatggggagcgt

SEQ ID NO: 7961354 - DNA, 22 bp, Homo sapiens
tcaggcagaggatggggagcgt

SEQ ID NO: 7961355 - DNA, 22 bp, Homo sapiens
tcaggcagaggatggggagcgt

SEQ ID NO: 7961356 - DNA, 22 bp, Homo sapiens
tcaggcagaggatggggagcgt

SEQ ID NO: 7961357 - DNA, 22 bp, Homo sapiens
tcaggcagaggatggggagcgt

SEQ ID NO: 7961358 - DNA, 22 bp, Homo sapiens
tcaggcagagctgtggagctct

SEQ ID NO: 7961359 - DNA, 22 bp, Homo sapiens
tcaggcagagctgtggagctct

SEQ ID NO: 7961360 - DNA, 22 bp, Homo sapiens
tcaggcagaccaccgtgggcag

SEQ ID NO: 7961361 - DNA, 22 bp, Homo sapiens
tcaggcagaccaccgtgggcag

SEQ ID NO: 7961362 - DNA, 22 bp, Homo sapiens
tcaggcagagctgtggagctct

SEQ ID NO: 7961363 - DNA, 22 bp, Homo sapiens
tcaggcagagctgtggagctct

SEQ ID NO: 7961364 - DNA, 22 bp, Homo sapiens
tcaggcagagctgtggagctct

SEQ ID NO: 7961365 - DNA, 22 bp, Homo sapiens
tcaggcagagctgtggagctct

SEQ ID NO: 7961366 - DNA, 22 bp, Homo sapiens
tcaggcagaccaccgtgggcag

SEQ ID NO: 7961367 - DNA, 22 bp, Homo sapiens
tcaggcagaccaccgtgggcag

SEQ ID NO: 7961368 - DNA, 22 bp, Homo sapiens
tcaggcagaccaccgtgggcag

SEQ ID NO: 7961369 - DNA, 22 bp, Homo sapiens
tcaggcagaccaccgtgggcag

SEQ ID NO: 7961370 - DNA, 22 bp, Homo sapiens
tcaggcagaccaccgtgggcag

SEQ ID NO: 7961371 - DNA, 22 bp, Homo sapiens
tcaggcagaccaccgtgggcag

SEQ ID NO: 7961372 - DNA, 22 bp, Homo sapiens
tcaggcagaccaccgtgggcag

SEQ ID NO: 7961373 - DNA, 20 bp, Homo sapiens
catggtggaggagcagggcc

SEQ ID NO: 7961374 - DNA, 20 bp, Homo sapiens
catggtggaggagcagggcc

SEQ ID NO: 7961375 - DNA, 20 bp, Homo sapiens
catggtggaggagcagggcc

SEQ ID NO: 7961376 - DNA, 22 bp, Homo sapiens
catggtttcatgagaattaccc

SEQ ID NO: 7961377 - DNA, 19 bp, Homo sapiens
catggtgaaaccccgtctc

SEQ ID NO: 7961378 - DNA, 19 bp, Homo sapiens
catggtgaaaccccgtctc

SEQ ID NO: 7961379 - DNA, 19 bp, Homo sapiens
catggtgaaaccccgtctc

SEQ ID NO: 7961380 - DNA, 19 bp, Homo sapiens
catggtgaaaccccgtctc

SEQ ID NO: 7961381 - DNA, 19 bp, Homo sapiens
catggtgaaaccccgtctc

SEQ ID NO: 7961382 - DNA, 22 bp, Homo sapiens
catggtgcagggcacatgagga

SEQ ID NO: 7961383 - DNA, 22 bp, Homo sapiens
catggtgcaggagagaaggcag

SEQ ID NO: 7961384 - DNA, 23 bp, Homo sapiens
catggaaaactgaaagctgacct

SEQ ID NO: 7961385 - DNA, 22 bp, Homo sapiens
catggaacaaggaagatgtttg

SEQ ID NO: 7961386 - DNA, 22 bp, Homo sapiens
catgggctctctgagctccagg

SEQ ID NO: 7961387 - DNA, 22 bp, Homo sapiens
catgggctctctgagctccagg

SEQ ID NO: 7961388 - DNA, 22 bp, Homo sapiens
catgggctcttctggactgcac

SEQ ID NO: 7961389 - DNA, 22 bp, Homo sapiens
catgggctcttctggactgcac

SEQ ID NO: 7961390 - DNA, 22 bp, Homo sapiens
catgggctcttctggactgcac

SEQ ID NO: 7961391 - DNA, 22 bp, Homo sapiens
catgggctcttctggactgcac

SEQ ID NO: 7961392 - DNA, 19 bp, Homo sapiens
catggtgaaaccccgtctc

SEQ ID NO: 7961393 - DNA, 19 bp, Homo sapiens
catggtgaaaccccgtctc

SEQ ID NO: 7961394 - DNA, 19 bp, Homo sapiens
catggtgaaaccccgtctc

SEQ ID NO: 7961395 - DNA, 19 bp, Homo sapiens
catggtgaaaccccgtctc

SEQ ID NO: 7961396 - DNA, 22 bp, Homo sapiens
catgtaaaaaattaggtcatct

SEQ ID NO: 7961397 - DNA, 22 bp, Homo sapiens
catgtaaaaaattaggtcatct

SEQ ID NO: 7961398 - DNA, 22 bp, Homo sapiens
catgtaaaaagaagaatctgga

SEQ ID NO: 7961399 - DNA, 22 bp, Homo sapiens
catggtttttaccctacaccat

SEQ ID NO: 7961400 - DNA, 22 bp, Homo sapiens
catggtttttaccctacaccat

SEQ ID NO: 7961401 - DNA, 22 bp, Homo sapiens
catgtaaaaaattaggtcatct

SEQ ID NO: 7961402 - DNA, 22 bp, Homo sapiens
catgtaaaaaattaggtcatct

SEQ ID NO: 7961403 - DNA, 22 bp, Homo sapiens
catggttttgagcctattatgc

SEQ ID NO: 7961404 - DNA, 22 bp, Homo sapiens
catgtaaaacactcagaacagt

SEQ ID NO: 7961405 - DNA, 22 bp, Homo sapiens
catgtaaaacactcagaacagt

SEQ ID NO: 7961406 - DNA, 22 bp, Homo sapiens
catgtaaaaagaagaatctgga

SEQ ID NO: 7961407 - DNA, 22 bp, Homo sapiens
catgtaaaccattgtgagcatc

SEQ ID NO: 7961408 - DNA, 22 bp, Homo sapiens
catgtaaaccattgtgagcatc

SEQ ID NO: 7961409 - DNA, 22 bp, Homo sapiens
catgtaaaccattgtgagcatc

SEQ ID NO: 7961410 - DNA, 22 bp, Homo sapiens
catgtaaaacactcagaacagt

SEQ ID NO: 7961411 - DNA, 22 bp, Homo sapiens
catgtaaagaatttcacacaag

SEQ ID NO: 7961412 - DNA, 22 bp, Homo sapiens
catgtaaagaatttcacacaag

SEQ ID NO: 7961413 - DNA, 22 bp, Homo sapiens
catgtaaagcacttcataacag

SEQ ID NO: 7961414 - DNA, 22 bp, Homo sapiens
catgtaaagcacttcataacag

SEQ ID NO: 7961415 - DNA, 22 bp, Homo sapiens
catgtaaagcacttcataacag

SEQ ID NO: 7961416 - DNA, 22 bp, Homo sapiens
catgtaaagcatccttctaggg

SEQ ID NO: 7961417 - DNA, 22 bp, Homo sapiens
catgtaatcctggggagatgaa

SEQ ID NO: 7961418 - DNA, 22 bp, Homo sapiens
catgtacaaaaggcaaatgcct

SEQ ID NO: 7961419 - DNA, 22 bp, Homo sapiens
catgtacaaaaggcaaatgcct

SEQ ID NO: 7961420 - DNA, 22 bp, Homo sapiens
catgtaatgctgggagctgggc

SEQ ID NO: 7961421 - DNA, 22 bp, Homo sapiens
catgtaatcctggggagatgaa

SEQ ID NO: 7961422 - DNA, 22 bp, Homo sapiens
catgtacaaaaggcaaatgcct

SEQ ID NO: 7961423 - DNA, 22 bp, Homo sapiens
catgtacaaaaggcaaatgcct

SEQ ID NO: 7961424 - DNA, 22 bp, Homo sapiens
catgcttttcaatctatcttaa

SEQ ID NO: 7961425 - DNA, 22 bp, Homo sapiens
catgctttttgacaacaagctg

SEQ ID NO: 7961426 - DNA, 22 bp, Homo sapiens
catgcttttcaatctatcttaa

SEQ ID NO: 7961427 - DNA, 22 bp, Homo sapiens
catgctttttgacaacaagctg

SEQ ID NO: 7961428 - DNA, 22 bp, Homo sapiens
catgcttttttctagtataaat

SEQ ID NO: 7961429 - DNA, 22 bp, Homo sapiens
catgcttttttctagtataaat

SEQ ID NO: 7961430 - DNA, 22 bp, Homo sapiens
catgcttttttctagtataaat

SEQ ID NO: 7961431 - DNA, 22 bp, Homo sapiens
catgctttttgacaacaagctg

SEQ ID NO: 7961432 - DNA, 22 bp, Homo sapiens
catgcttttttctagtataaat

SEQ ID NO: 7961433 - DNA, 22 bp, Homo sapiens
catgctttgggtcagaaatgcc

SEQ ID NO: 7961434 - DNA, 22 bp, Homo sapiens
catgctttctgtccaaatgtta

SEQ ID NO: 7961435 - DNA, 22 bp, Homo sapiens
catgctttctgtccaaatgtta

SEQ ID NO: 7961436 - DNA, 22 bp, Homo sapiens
catgctttctgtccaaatgtta

SEQ ID NO: 7961437 - DNA, 22 bp, Homo sapiens
catgctttctgtccaaatgtta

SEQ ID NO: 7961438 - DNA, 22 bp, Homo sapiens
catgctttgggtcagaaatgcc

SEQ ID NO: 7961439 - DNA, 22 bp, Homo sapiens
catgcttttcaatctatcttaa

SEQ ID NO: 7961440 - DNA, 22 bp, Homo sapiens
catgctttgggtcagaaatgcc

SEQ ID NO: 7961441 - DNA, 22 bp, Homo sapiens
catgctttgggtcagaaatgcc

SEQ ID NO: 7961442 - DNA, 22 bp, Homo sapiens
catgctttgggtcagaaatgcc

SEQ ID NO: 7961443 - DNA, 22 bp, Homo sapiens
catgctttgggtcagaaatgcc

SEQ ID NO: 7961444 - DNA, 22 bp, Homo sapiens
catgctgttgaatatgacattg

SEQ ID NO: 7961445 - DNA, 22 bp, Homo sapiens
catgcttaaaaatgcagagagt

SEQ ID NO: 7961446 - DNA, 22 bp, Homo sapiens
catgcttacctgccaaagcact

SEQ ID NO: 7961447 - DNA, 22 bp, Homo sapiens
catgcttaaaaatgcagagagt

SEQ ID NO: 7961448 - DNA, 22 bp, Homo sapiens
catgcttaattggagcattcat

SEQ ID NO: 7961449 - DNA, 22 bp, Homo sapiens
catgcttattcattctgctaac

SEQ ID NO: 7961450 - DNA, 22 bp, Homo sapiens
catgcttatgatttgctaagcc

SEQ ID NO: 7961451 - DNA, 22 bp, Homo sapiens
catgcttacctgccaaagcact

SEQ ID NO: 7961452 - DNA, 22 bp, Homo sapiens
catgcttacttgtctcagcaga

SEQ ID NO: 7961453 - DNA, 22 bp, Homo sapiens
catgcttacttgtctcagcaga

SEQ ID NO: 7961454 - DNA, 22 bp, Homo sapiens
catgcttcatgcaaaattctga

SEQ ID NO: 7961455 - DNA, 22 bp, Homo sapiens
catgcttcacacactgaatgac

SEQ ID NO: 7961456 - DNA, 22 bp, Homo sapiens
catgctttaccaaagcagtgat

SEQ ID NO: 7961457 - DNA, 22 bp, Homo sapiens
catgctttaccaaagcagtgat

SEQ ID NO: 7961458 - DNA, 22 bp, Homo sapiens
catgctttctgtccaaatgtta

SEQ ID NO: 7961459 - DNA, 22 bp, Homo sapiens
tccagcacccaatgtggctaag

SEQ ID NO: 7961460 - DNA, 22 bp, Homo sapiens
tccagcacccaatgtggctaag

SEQ ID NO: 7961461 - DNA, 22 bp, Homo sapiens
tccagcacccaatgtggctaag

SEQ ID NO: 7961462 - DNA, 22 bp, Homo sapiens
tccagcacccaatgtggctaag

SEQ ID NO: 7961463 - DNA, 20 bp, Homo sapiens
tccagcaccctcacagagaa

SEQ ID NO: 7961464 - DNA, 22 bp, Homo sapiens
tccagcacagaatttcctagct

SEQ ID NO: 7961465 - DNA, 22 bp, Homo sapiens
tccagcacagaatttcctagct

SEQ ID NO: 7961466 - DNA, 22 bp, Homo sapiens
tccagcactcgcccagggcttg

SEQ ID NO: 7961467 - DNA, 22 bp, Homo sapiens
tccagcagaaaagaggtaggga

SEQ ID NO: 7961468 - DNA, 22 bp, Homo sapiens
tccagcacctggaggcgtcccc

SEQ ID NO: 7961469 - DNA, 20 bp, Homo sapiens
tccagcaccctcacagagaa

SEQ ID NO: 7961470 - DNA, 22 bp, Homo sapiens
tccagcactcgcccagggcttg

SEQ ID NO: 7961471 - DNA, 22 bp, Homo sapiens
tccagcagaaccagagacctgg

SEQ ID NO: 7961472 - DNA, 22 bp, Homo sapiens
tccagcagaaaagaggtaggga

SEQ ID NO: 7961473 - DNA, 22 bp, Homo sapiens
tccagcagaaaagaggtaggga

SEQ ID NO: 7961474 - DNA, 22 bp, Homo sapiens
tccagcagaaccagagacctgg

SEQ ID NO: 7961475 - DNA, 22 bp, Homo sapiens
catgctgttgaatatgacattg

SEQ ID NO: 7961476 - DNA, 22 bp, Homo sapiens
tccagcagaaccagagacctgg

SEQ ID NO: 7961477 - DNA, 22 bp, Homo sapiens
tccagcagaaccagagacctgg

SEQ ID NO: 7961478 - DNA, 22 bp, Homo sapiens
catgctatttatacataagtct

SEQ ID NO: 7961479 - DNA, 22 bp, Homo sapiens
catgctcacttttatactgtaa

SEQ ID NO: 7961480 - DNA, 22 bp, Homo sapiens
catgctcacaaaagatggcaaa

SEQ ID NO: 7961481 - DNA, 22 bp, Homo sapiens
catgctacttgctatgcaaaaa

SEQ ID NO: 7961482 - DNA, 22 bp, Homo sapiens
catgctatataggaagagcact

SEQ ID NO: 7961483 - DNA, 22 bp, Homo sapiens
catgctccagctccagacaggt

SEQ ID NO: 7961484 - DNA, 22 bp, Homo sapiens
catgctctagattctctctaat

SEQ ID NO: 7961485 - DNA, 22 bp, Homo sapiens
catgctctagattctctctaat

SEQ ID NO: 7961486 - DNA, 22 bp, Homo sapiens
catgctctccattggacacaga

SEQ ID NO: 7961487 - DNA, 22 bp, Homo sapiens
catgctctctggcaacttgtgt

SEQ ID NO: 7961488 - DNA, 22 bp, Homo sapiens
catgctctctggcaacttgtgt

SEQ ID NO: 7961489 - DNA, 22 bp, Homo sapiens
tcatcagggatattggcctgaa

SEQ ID NO: 7961490 - DNA, 22 bp, Homo sapiens
tcatcagctcatctgctcctag

SEQ ID NO: 7961491 - DNA, 22 bp, Homo sapiens
tcatcagtcagaacttaagctt

SEQ ID NO: 7961492 - DNA, 22 bp, Homo sapiens
tcatcagtccttttcattatga

SEQ ID NO: 7961493 - DNA, 22 bp, Homo sapiens
tcatcagtccttttcattatga

SEQ ID NO: 7961494 - DNA, 22 bp, Homo sapiens
catgcattttctattcactcag

SEQ ID NO: 7961495 - DNA, 22 bp, Homo sapiens
catgccaggactctggaggctt

SEQ ID NO: 7961496 - DNA, 22 bp, Homo sapiens
catgccaacaacaagcaatgag

SEQ ID NO: 7961497 - DNA, 22 bp, Homo sapiens
catgctgtcctgccagggatgg

SEQ ID NO: 7961498 - DNA, 23 bp, Homo sapiens
catgctgtgatacaggaaggttg

SEQ ID NO: 7961499 - DNA, 22 bp, Homo sapiens
catgctgtactctgtgtcagaa

SEQ ID NO: 7961500 - DNA, 22 bp, Homo sapiens
catgctggtcagccagtggatg

SEQ ID NO: 7961501 - DNA, 22 bp, Homo sapiens
catgctggtcagccagtggatg

SEQ ID NO: 7961502 - DNA, 22 bp, Homo sapiens
catgctggtcagccagtggatg

SEQ ID NO: 7961503 - DNA, 22 bp, Homo sapiens
catgctggtcagccagtggatg

SEQ ID NO: 7961504 - DNA, 22 bp, Homo sapiens
catgctgtggtaaatcactgaa

SEQ ID NO: 7961505 - DNA, 22 bp, Homo sapiens
catgctgtgcatcttgatgacc

SEQ ID NO: 7961506 - DNA, 22 bp, Homo sapiens
catgctgtgtggttagaactgt

SEQ ID NO: 7961507 - DNA, 22 bp, Homo sapiens
catgctgtgtgttttagctcca

SEQ ID NO: 7961508 - DNA, 22 bp, Homo sapiens
catgctgggccttgggtgcact

SEQ ID NO: 7961509 - DNA, 22 bp, Homo sapiens
catgctgggccttgggtgcact

SEQ ID NO: 7961510 - DNA, 22 bp, Homo sapiens
catgctgggtaaaggtggtgaa

SEQ ID NO: 7961511 - DNA, 22 bp, Homo sapiens
catgctgggtaaaggtggtgaa

SEQ ID NO: 7961512 - DNA, 22 bp, Homo sapiens
catgctgatgaacttctacttg

SEQ ID NO: 7961513 - DNA, 22 bp, Homo sapiens
catgctgattcttcctgagctt

SEQ ID NO: 7961514 - DNA, 22 bp, Homo sapiens
catgctgcaggagctcttctca

SEQ ID NO: 7961515 - DNA, 22 bp, Homo sapiens
catgctgcaggagctcttctca

SEQ ID NO: 7961516 - DNA, 20 bp, Homo sapiens
catgctgcctccattgatgc

SEQ ID NO: 7961517 - DNA, 22 bp, Homo sapiens
catgctctgcagcagacctgtg

SEQ ID NO: 7961518 - DNA, 22 bp, Homo sapiens
catgctctccattggacacaga

SEQ ID NO: 7961519 - DNA, 22 bp, Homo sapiens
catgctctgcagcagacctgtg

SEQ ID NO: 7961520 - DNA, 22 bp, Homo sapiens
catgctgagcacattctgtatt

SEQ ID NO: 7961521 - DNA, 19 bp, Homo sapiens
catgctgacctgctgtggt

SEQ ID NO: 7961522 - DNA, 22 bp, Homo sapiens
tccaagaagcttacaatctaat

SEQ ID NO: 7961523 - DNA, 22 bp, Homo sapiens
tccaagaagtcatctaaactgt

SEQ ID NO: 7961524 - DNA, 22 bp, Homo sapiens
tccaagagaatactggagagta

SEQ ID NO: 7961525 - DNA, 22 bp, Homo sapiens
tccaagagaatactggagagta

SEQ ID NO: 7961526 - DNA, 22 bp, Homo sapiens
tccaagagaatactggagagta

SEQ ID NO: 7961527 - DNA, 22 bp, Homo sapiens
tccaagagaatactggagagta

SEQ ID NO: 7961528 - DNA, 22 bp, Homo sapiens
tccaagaatcactgacacagct

SEQ ID NO: 7961529 - DNA, 22 bp, Homo sapiens
tccaagagtaagaggactcttt

SEQ ID NO: 7961530 - DNA, 22 bp, Homo sapiens
tccaagaggagacactgggatg

SEQ ID NO: 7961531 - DNA, 22 bp, Homo sapiens
tccaagagtatagtttattggc

SEQ ID NO: 7961532 - DNA, 22 bp, Homo sapiens
tccaagagtatagtttattggc

SEQ ID NO: 7961533 - DNA, 22 bp, Homo sapiens
tccaagagttcaaggctacagt

SEQ ID NO: 7961534 - DNA, 22 bp, Homo sapiens
tccaagatctacagcagtttag

SEQ ID NO: 7961535 - DNA, 22 bp, Homo sapiens
tccaagatctacagcagtttag

SEQ ID NO: 7961536 - DNA, 22 bp, Homo sapiens
tccaagatctacagcagtttag

SEQ ID NO: 7961537 - DNA, 22 bp, Homo sapiens
tccaagatgtcggtcctgtcca

SEQ ID NO: 7961538 - DNA, 22 bp, Homo sapiens
tccaagatctacagcagtttag

SEQ ID NO: 7961539 - DNA, 18 bp, Homo sapiens
tccagagagggagaagtg

SEQ ID NO: 7961540 - DNA, 17 bp, Homo sapiens
tccagagaggcttccct

SEQ ID NO: 7961541 - DNA, 17 bp, Homo sapiens
tccagagaggcttccct

SEQ ID NO: 7961542 - DNA, 18 bp, Homo sapiens
tccagagagggagaagtg

SEQ ID NO: 7961543 - DNA, 18 bp, Homo sapiens
tccagagagggagaagtg

SEQ ID NO: 7961544 - DNA, 22 bp, Homo sapiens
tccaagcatgtggtcaggagcc

SEQ ID NO: 7961545 - DNA, 22 bp, Homo sapiens
tccaagcatgtggtcaggagcc

SEQ ID NO: 7961546 - DNA, 22 bp, Homo sapiens
tccaagcatgtggtcaggagcc

SEQ ID NO: 7961547 - DNA, 22 bp, Homo sapiens
tccaagcatgtggtcaggagcc

SEQ ID NO: 7961548 - DNA, 22 bp, Homo sapiens
tccaagcactgttaattaaact

SEQ ID NO: 7961549 - DNA, 22 bp, Homo sapiens
tccaagcactgttaattaaact

SEQ ID NO: 7961550 - DNA, 22 bp, Homo sapiens
tccaagcaacaactaatttaca

SEQ ID NO: 7961551 - DNA, 22 bp, Homo sapiens
tccaagcaacaactaatttaca

SEQ ID NO: 7961552 - DNA, 22 bp, Homo sapiens
tccaagcactgttaattaaact

SEQ ID NO: 7961553 - DNA, 22 bp, Homo sapiens
tccagaggtgaacacccaggca

SEQ ID NO: 7961554 - DNA, 22 bp, Homo sapiens
tccagaggtgaacacccaggca

SEQ ID NO: 7961555 - DNA, 18 bp, Homo sapiens
tccagaggtgttggagcc

SEQ ID NO: 7961556 - DNA, 18 bp, Homo sapiens
tccagaggtgttggagcc

SEQ ID NO: 7961557 - DNA, 18 bp, Homo sapiens
tccagaggtgttggagcc

SEQ ID NO: 7961558 - DNA, 18 bp, Homo sapiens
tccagaggtgttggagcc

SEQ ID NO: 7961559 - DNA, 22 bp, Homo sapiens
tccagatagagtcctgttagta

SEQ ID NO: 7961560 - DNA, 22 bp, Homo sapiens
catgtgtagtgaaataagcagt

SEQ ID NO: 7961561 - DNA, 22 bp, Homo sapiens
catgtgtaattgtaaaaggtaa

SEQ ID NO: 7961562 - DNA, 22 bp, Homo sapiens
catgtgtaggtataacttgtga

SEQ ID NO: 7961563 - DNA, 22 bp, Homo sapiens
catgtgtacccttcctctgggg

SEQ ID NO: 7961564 - DNA, 22 bp, Homo sapiens
catgtgtaccagctgttctttg

SEQ ID NO: 7961565 - DNA, 22 bp, Homo sapiens
catgtgtaattgtaaaaggtaa

SEQ ID NO: 7961566 - DNA, 22 bp, Homo sapiens
catgtgggaagaggccagctgg

SEQ ID NO: 7961567 - DNA, 22 bp, Homo sapiens
catgtgtaaggctcacaggcag

SEQ ID NO: 7961568 - DNA, 22 bp, Homo sapiens
catgtgtattattcttgtggaa

SEQ ID NO: 7961569 - DNA, 22 bp, Homo sapiens
catgttttgtgtacagaatatt

SEQ ID NO: 7961570 - DNA, 22 bp, Homo sapiens
catgttttgtgtacagaatatt

SEQ ID NO: 7961571 - DNA, 22 bp, Homo sapiens
catgttttgtgtacagaatatt

SEQ ID NO: 7961572 - DNA, 22 bp, Homo sapiens
cattaataaacatttcagaaga

SEQ ID NO: 7961573 - DNA, 22 bp, Homo sapiens
catgttttgtgtacagaatatt

SEQ ID NO: 7961574 - DNA, 22 bp, Homo sapiens
catgttttgtgtacagaatatt

SEQ ID NO: 7961575 - DNA, 22 bp, Homo sapiens
cattaagtatttcagttactgt

SEQ ID NO: 7961576 - DNA, 22 bp, Homo sapiens
tccaggcttgagaccaggctct

SEQ ID NO: 7961577 - DNA, 22 bp, Homo sapiens
tccaggctttggggcaggagcg

SEQ ID NO: 7961578 - DNA, 22 bp, Homo sapiens
tccaggcttgagaccaggctct

SEQ ID NO: 7961579 - DNA, 22 bp, Homo sapiens
tccaggcttgagaccaggctct

SEQ ID NO: 7961580 - DNA, 22 bp, Homo sapiens
tccaggcttgagaccaggctct

SEQ ID NO: 7961581 - DNA, 22 bp, Homo sapiens
tccaggcttgagaccaggctct

SEQ ID NO: 7961582 - DNA, 22 bp, Homo sapiens
tccaggctttggggcaggagcg

SEQ ID NO: 7961583 - DNA, 22 bp, Homo sapiens
tccaggctttggggcaggagcg

SEQ ID NO: 7961584 - DNA, 22 bp, Homo sapiens
tccaggctttggggcaggagcg

SEQ ID NO: 7961585 - DNA, 22 bp, Homo sapiens
tccaggctttggggcaggagcg

SEQ ID NO: 7961586 - DNA, 22 bp, Homo sapiens
tccaggctttttcatgctgtct

SEQ ID NO: 7961587 - DNA, 22 bp, Homo sapiens
tccaggctttggggcaggagcg

SEQ ID NO: 7961588 - DNA, 22 bp, Homo sapiens
tccaggctttggggcaggagcg

SEQ ID NO: 7961589 - DNA, 22 bp, Homo sapiens
catgtgcattggggccagggag

SEQ ID NO: 7961590 - DNA, 22 bp, Homo sapiens
tccaggctttttcatgctgtct

SEQ ID NO: 7961591 - DNA, 22 bp, Homo sapiens
tccaggctttttcatgctgtct

SEQ ID NO: 7961592 - DNA, 22 bp, Homo sapiens
tccaggctttttcatgctgtct

SEQ ID NO: 7961593 - DNA, 22 bp, Homo sapiens
tccaggctttttcatgctgtct

SEQ ID NO: 7961594 - DNA, 22 bp, Homo sapiens
catgtgctgtagcagagaggaa

SEQ ID NO: 7961595 - DNA, 22 bp, Homo sapiens
catgtgctgtagcagagaggaa

SEQ ID NO: 7961596 - DNA, 22 bp, Homo sapiens
catgtggctttggcatgtgccc

SEQ ID NO: 7961597 - DNA, 22 bp, Homo sapiens
catgtggatggtctcctcatca

SEQ ID NO: 7961598 - DNA, 22 bp, Homo sapiens
catgtggatcggcctgggtagt

SEQ ID NO: 7961599 - DNA, 22 bp, Homo sapiens
catgtacactcatgtaactata

SEQ ID NO: 7961600 - DNA, 22 bp, Homo sapiens
catgtacactcatgtaactata

SEQ ID NO: 7961601 - DNA, 22 bp, Homo sapiens
catgtacactcatgtaactata

SEQ ID NO: 7961602 - DNA, 22 bp, Homo sapiens
catgtacactcatgtaactata

SEQ ID NO: 7961603 - DNA, 22 bp, Homo sapiens
catgtacactcatgtaactata

SEQ ID NO: 7961604 - DNA, 23 bp, Homo sapiens
catgtacagagtttgataaagtg

SEQ ID NO: 7961605 - DNA, 23 bp, Homo sapiens
catgtacagagtttgataaagtg

SEQ ID NO: 7961606 - DNA, 23 bp, Homo sapiens
catgtacagagtttgataaagtg

SEQ ID NO: 7961607 - DNA, 23 bp, Homo sapiens
catgtacagagtttgataaagtg

SEQ ID NO: 7961608 - DNA, 22 bp, Homo sapiens
catgtacagccagggttgagaa

SEQ ID NO: 7961609 - DNA, 22 bp, Homo sapiens
catgtacagccagggttgagaa

SEQ ID NO: 7961610 - DNA, 22 bp, Homo sapiens
catgtacagccagggttgagaa

SEQ ID NO: 7961611 - DNA, 22 bp, Homo sapiens
catgtacacacaaagggacaat

SEQ ID NO: 7961612 - DNA, 22 bp, Homo sapiens
catgtacacacaaagggacaat

SEQ ID NO: 7961613 - DNA, 22 bp, Homo sapiens
catgtacacacaaagggacaat

SEQ ID NO: 7961614 - DNA, 22 bp, Homo sapiens
catgtacaaggatgctcagagt

SEQ ID NO: 7961615 - DNA, 22 bp, Homo sapiens
catgtacaaggatgctcagagt

SEQ ID NO: 7961616 - DNA, 22 bp, Homo sapiens
catgtacaaggatgctcagagt

SEQ ID NO: 7961617 - DNA, 23 bp, Homo sapiens
catgtacacacagctgtacagtg

SEQ ID NO: 7961618 - DNA, 23 bp, Homo sapiens
catgtacacacagctgtacagtg

SEQ ID NO: 7961619 - DNA, 23 bp, Homo sapiens
catgtacacacagctgtacagtg

SEQ ID NO: 7961620 - DNA, 23 bp, Homo sapiens
catgtacacacagctgtacagtg

SEQ ID NO: 7961621 - DNA, 23 bp, Homo sapiens
catgtacacacagctgtacagtg

SEQ ID NO: 7961622 - DNA, 23 bp, Homo sapiens
catgtacacacagctgtacagtg

SEQ ID NO: 7961623 - DNA, 23 bp, Homo sapiens
catgtacacacagctgtacagtg

SEQ ID NO: 7961624 - DNA, 22 bp, Homo sapiens
tccaggcttgagaccaggctct

SEQ ID NO: 7961625 - DNA, 22 bp, Homo sapiens
tccaggcttgagaccaggctct

SEQ ID NO: 7961626 - DNA, 22 bp, Homo sapiens
tccaggcttgagaccaggctct

SEQ ID NO: 7961627 - DNA, 22 bp, Homo sapiens
tccaggcttgagaccaggctct

SEQ ID NO: 7961628 - DNA, 22 bp, Homo sapiens
tccaggcttcacgtctgccctc

SEQ ID NO: 7961629 - DNA, 22 bp, Homo sapiens
tccaggcttcacgtctgccctc

SEQ ID NO: 7961630 - DNA, 22 bp, Homo sapiens
tccaggcttcacgtctgccctc

SEQ ID NO: 7961631 - DNA, 22 bp, Homo sapiens
tccaggcttcacgtctgccctc

SEQ ID NO: 7961632 - DNA, 23 bp, Homo sapiens
catgtacacacagctgtacagtg

SEQ ID NO: 7961633 - DNA, 22 bp, Homo sapiens
tccaggctgtgcgcaccgtgtg

SEQ ID NO: 7961634 - DNA, 22 bp, Homo sapiens
tccaggctgtgcgcaccgtgtg

SEQ ID NO: 7961635 - DNA, 22 bp, Homo sapiens
tccaggcttcacgtctgccctc

SEQ ID NO: 7961636 - DNA, 22 bp, Homo sapiens
tccaggcttcacgtctgccctc

SEQ ID NO: 7961637 - DNA, 22 bp, Homo sapiens
tccaggcttcacgtctgccctc

SEQ ID NO: 7961638 - DNA, 22 bp, Homo sapiens
tccaggctgtgcgcaccgtgtg

SEQ ID NO: 7961639 - DNA, 22 bp, Homo sapiens
tccaggctgtgcgcaccgtgtg

SEQ ID NO: 7961640 - DNA, 22 bp, Homo sapiens
tccaggctgtgcgcaccgtgtg

SEQ ID NO: 7961641 - DNA, 22 bp, Homo sapiens
catgtacagtttttctgtcctg

SEQ ID NO: 7961642 - DNA, 22 bp, Homo sapiens
catgtacagtttttctgtcctg

SEQ ID NO: 7961643 - DNA, 22 bp, Homo sapiens
catgtacatgcatgggcactgt

SEQ ID NO: 7961644 - DNA, 22 bp, Homo sapiens
catgtacatgcatgggcactgt

SEQ ID NO: 7961645 - DNA, 22 bp, Homo sapiens
catgtacatgcatgggcactgt

SEQ ID NO: 7961646 - DNA, 22 bp, Homo sapiens
catgtacatgcatgggcactgt

SEQ ID NO: 7961647 - DNA, 22 bp, Homo sapiens
tccaggctgggctgaagggtgc

SEQ ID NO: 7961648 - DNA, 22 bp, Homo sapiens
tccaggctcctgactttttggg

SEQ ID NO: 7961649 - DNA, 22 bp, Homo sapiens
tccaggctcctgactttttggg

SEQ ID NO: 7961650 - DNA, 22 bp, Homo sapiens
tccaggctgtgcatgagtttag

SEQ ID NO: 7961651 - DNA, 22 bp, Homo sapiens
tccaggctgtgcatgagtttag

SEQ ID NO: 7961652 - DNA, 22 bp, Homo sapiens
tccaggctgggctgaagggtgc

SEQ ID NO: 7961653 - DNA, 22 bp, Homo sapiens
cattaattgtatttttcaaagt

SEQ ID NO: 7961654 - DNA, 22 bp, Homo sapiens
cattacaaacatgttaagattt

SEQ ID NO: 7961655 - DNA, 22 bp, Homo sapiens
cattacaaacatgttaagattt

SEQ ID NO: 7961656 - DNA, 22 bp, Homo sapiens
cattacaaacatgttaagattt

SEQ ID NO: 7961657 - DNA, 22 bp, Homo sapiens
cattaataaacatttcagaaga

SEQ ID NO: 7961658 - DNA, 22 bp, Homo sapiens
cattaataaacatttcagaaga

SEQ ID NO: 7961659 - DNA, 22 bp, Homo sapiens
cattaataaacatttcagaaga

SEQ ID NO: 7961660 - DNA, 22 bp, Homo sapiens
cattaatattgttcttctttag

SEQ ID NO: 7961661 - DNA, 22 bp, Homo sapiens
cattaatattgttcttctttag

SEQ ID NO: 7961662 - DNA, 22 bp, Homo sapiens
cattacaaccccaaattacaaa

SEQ ID NO: 7961663 - DNA, 22 bp, Homo sapiens
cattacaaccccaaattacaaa

SEQ ID NO: 7961664 - DNA, 22 bp, Homo sapiens
cattacaaccccaaattacaaa

SEQ ID NO: 7961665 - DNA, 22 bp, Homo sapiens
cattacaaccccaaattacaaa

SEQ ID NO: 7961666 - DNA, 19 bp, Homo sapiens
cattacaaatttgtaggga

SEQ ID NO: 7961667 - DNA, 19 bp, Homo sapiens
cattacaaatttgtaggga

SEQ ID NO: 7961668 - DNA, 19 bp, Homo sapiens
cattacaaatttgtaggga

SEQ ID NO: 7961669 - DNA, 22 bp, Homo sapiens
cattacaacaatctgccatggc

SEQ ID NO: 7961670 - DNA, 22 bp, Homo sapiens
cattacaaagttataaacagtt

SEQ ID NO: 7961671 - DNA, 22 bp, Homo sapiens
cattacaaagttataaacagtt

SEQ ID NO: 7961672 - DNA, 22 bp, Homo sapiens
cattacaaagttataaacagtt

SEQ ID NO: 7961673 - DNA, 22 bp, Homo sapiens
cattacaaagttataaacagtt

SEQ ID NO: 7961674 - DNA, 22 bp, Homo sapiens
cattacaaagttataaacagtt

SEQ ID NO: 7961675 - DNA, 22 bp, Homo sapiens
tccagggcaggtgctgggctct

SEQ ID NO: 7961676 - DNA, 22 bp, Homo sapiens
tccagggcaggtgctgggctct

SEQ ID NO: 7961677 - DNA, 22 bp, Homo sapiens
tccagggcaggtgctgggctct

SEQ ID NO: 7961678 - DNA, 22 bp, Homo sapiens
tccagggcaggtgctgggctct

SEQ ID NO: 7961679 - DNA, 22 bp, Homo sapiens
tccagggcagtgactacagcgg

SEQ ID NO: 7961680 - DNA, 22 bp, Homo sapiens
tccagggcagtgactacagcgg

SEQ ID NO: 7961681 - DNA, 22 bp, Homo sapiens
tccagggcagtgactacagcgg

SEQ ID NO: 7961682 - DNA, 22 bp, Homo sapiens
tccagggcagtgactacagcgg

SEQ ID NO: 7961683 - DNA, 22 bp, Homo sapiens
tccagggcagtgactacagcgg

SEQ ID NO: 7961684 - DNA, 22 bp, Homo sapiens
tccagggcagtgactacagcgg

SEQ ID NO: 7961685 - DNA, 23 bp, Homo sapiens
tccagggcagtggctgggtctgc

SEQ ID NO: 7961686 - DNA, 23 bp, Homo sapiens
tccagggcagtggctgggtctgc

SEQ ID NO: 7961687 - DNA, 22 bp, Homo sapiens
cattacaaccccaaattacaaa

SEQ ID NO: 7961688 - DNA, 21 bp, Homo sapiens
cattacaagatttccaatttg

SEQ ID NO: 7961689 - DNA, 22 bp, Homo sapiens
cattacaaccccaaattacaaa

SEQ ID NO: 7961690 - DNA, 22 bp, Homo sapiens
cattacaaccccaaattacaaa

SEQ ID NO: 7961691 - DNA, 22 bp, Homo sapiens
cattacaaccccaaattacaaa

SEQ ID NO: 7961692 - DNA, 22 bp, Homo sapiens
tccagggcagggtgcgcatggg

SEQ ID NO: 7961693 - DNA, 22 bp, Homo sapiens
tccagggcagggtgcgcatggg

SEQ ID NO: 7961694 - DNA, 22 bp, Homo sapiens
tccagggcagggtgcgcatggg

SEQ ID NO: 7961695 - DNA, 22 bp, Homo sapiens
tccagggcaggtgctgggctct

SEQ ID NO: 7961696 - DNA, 22 bp, Homo sapiens
tccagggcaggtgctgggctct

SEQ ID NO: 7961697 - DNA, 22 bp, Homo sapiens
tccagggttgtgggcttcagca

SEQ ID NO: 7961698 - DNA, 22 bp, Homo sapiens
tccagggttgtgggcttcagca

SEQ ID NO: 7961699 - DNA, 22 bp, Homo sapiens
tccagggttgtgggcttcagca

SEQ ID NO: 7961700 - DNA, 22 bp, Homo sapiens
tccagggttgtgggcttcagca

SEQ ID NO: 7961701 - DNA, 22 bp, Homo sapiens
tccagggtgtgtttactggggt

SEQ ID NO: 7961702 - DNA, 22 bp, Homo sapiens
tccagggtcagaagtcacatac

SEQ ID NO: 7961703 - DNA, 22 bp, Homo sapiens
tccagggtcagaagtcacatac

SEQ ID NO: 7961704 - DNA, 21 bp, Homo sapiens
tccagggtcagaagttcagtg

SEQ ID NO: 7961705 - DNA, 21 bp, Homo sapiens
tccagggtcagaagttcagtg

SEQ ID NO: 7961706 - DNA, 22 bp, Homo sapiens
tccagggtgtgtttactggggt

SEQ ID NO: 7961707 - DNA, 22 bp, Homo sapiens
tccaggggtgatttttgacttg

SEQ ID NO: 7961708 - DNA, 19 bp, Homo sapiens
tccaggggctccacctcct

SEQ ID NO: 7961709 - DNA, 22 bp, Homo sapiens
tccaggtcagacttctgtgccc

SEQ ID NO: 7961710 - DNA, 22 bp, Homo sapiens
tccaggtatgacaggccactcc

SEQ ID NO: 7961711 - DNA, 22 bp, Homo sapiens
tccaggtatgacatggctgttt

SEQ ID NO: 7961712 - DNA, 22 bp, Homo sapiens
tccaggtattactaagtgttaa

SEQ ID NO: 7961713 - DNA, 22 bp, Homo sapiens
tccaggtattactaagtgttaa

SEQ ID NO: 7961714 - DNA, 22 bp, Homo sapiens
tccaggtagggaataaatgtca

SEQ ID NO: 7961715 - DNA, 22 bp, Homo sapiens
tccaggtagggaataaatgtca

SEQ ID NO: 7961716 - DNA, 22 bp, Homo sapiens
tccaggtactcattggctgtta

SEQ ID NO: 7961717 - DNA, 18 bp, Homo sapiens
tccaggtcccaggggaag

SEQ ID NO: 7961718 - DNA, 22 bp, Homo sapiens
tccaggtcccagactgggcagc

SEQ ID NO: 7961719 - DNA, 22 bp, Homo sapiens
tccaggtcccagactgggcagc

SEQ ID NO: 7961720 - DNA, 22 bp, Homo sapiens
tccaggtcccagactgggcagc

SEQ ID NO: 7961721 - DNA, 22 bp, Homo sapiens
tccaggtcatcttggagagctg

SEQ ID NO: 7961722 - DNA, 22 bp, Homo sapiens
tccaggtcagacttctgtgccc

SEQ ID NO: 7961723 - DNA, 22 bp, Homo sapiens
tccaggtcagacttctgtgccc

SEQ ID NO: 7961724 - DNA, 22 bp, Homo sapiens
tccaggtcatcttggagagctg

SEQ ID NO: 7961725 - DNA, 22 bp, Homo sapiens
tccaggtcatcttggagagctg

SEQ ID NO: 7961726 - DNA, 22 bp, Homo sapiens
tccaggtccagaggttcaactg

SEQ ID NO: 7961727 - DNA, 22 bp, Homo sapiens
tccaggtcccagactgggcagc

SEQ ID NO: 7961728 - DNA, 23 bp, Homo sapiens
tccagggcagtggctgggtctgc

SEQ ID NO: 7961729 - DNA, 23 bp, Homo sapiens
tccagggcagtggctgggtctgc

SEQ ID NO: 7961730 - DNA, 22 bp, Homo sapiens
tccagggcatccacgcgtgggg

SEQ ID NO: 7961731 - DNA, 22 bp, Homo sapiens
tccagggcatccacgcgtgggg

SEQ ID NO: 7961732 - DNA, 22 bp, Homo sapiens
tccagggcatccacgcgtgggg

SEQ ID NO: 7961733 - DNA, 22 bp, Homo sapiens
tccagggcatccacgcgtgggg

SEQ ID NO: 7961734 - DNA, 22 bp, Homo sapiens
tccagggcatgctcagactcag

SEQ ID NO: 7961735 - DNA, 22 bp, Homo sapiens
tccagggcatgctcagactcag

SEQ ID NO: 7961736 - DNA, 22 bp, Homo sapiens
tccagggcatgctcagactcag

SEQ ID NO: 7961737 - DNA, 22 bp, Homo sapiens
tccagggcatgctcagactcag

SEQ ID NO: 7961738 - DNA, 22 bp, Homo sapiens
tccagggcatgctcagactcag

SEQ ID NO: 7961739 - DNA, 22 bp, Homo sapiens
tccagggcatggggagagagtg

SEQ ID NO: 7961740 - DNA, 22 bp, Homo sapiens
tccagggcatggggagagagtg

SEQ ID NO: 7961741 - DNA, 19 bp, Homo sapiens
tccaggggctccacctcct

SEQ ID NO: 7961742 - DNA, 21 bp, Homo sapiens
tccaggggccagcacccaagc

SEQ ID NO: 7961743 - DNA, 21 bp, Homo sapiens
tccaggggccagcacccaagc

SEQ ID NO: 7961744 - DNA, 22 bp, Homo sapiens
tccaggggagactagacccaca

SEQ ID NO: 7961745 - DNA, 22 bp, Homo sapiens
tccaggggagactagacccaca

SEQ ID NO: 7961746 - DNA, 22 bp, Homo sapiens
tccagggccaagtcatggaacc

SEQ ID NO: 7961747 - DNA, 22 bp, Homo sapiens
tccagggccaagtcatggaacc

SEQ ID NO: 7961748 - DNA, 22 bp, Homo sapiens
tccaggggacactgtttctcca

SEQ ID NO: 7961749 - DNA, 22 bp, Homo sapiens
tccagggcatggggagagagtg

SEQ ID NO: 7961750 - DNA, 22 bp, Homo sapiens
tccagggcatggggagagagtg

SEQ ID NO: 7961751 - DNA, 22 bp, Homo sapiens
tccagggcatggggagagagtg

SEQ ID NO: 7961752 - DNA, 22 bp, Homo sapiens
tccagggcatggggagagagtg

SEQ ID NO: 7961753 - DNA, 22 bp, Homo sapiens
caggctgagggttaggccttag

SEQ ID NO: 7961754 - DNA, 22 bp, Homo sapiens
caggctgatagggtccaaagtt

SEQ ID NO: 7961755 - DNA, 22 bp, Homo sapiens
caggctgagggttaggccttag

SEQ ID NO: 7961756 - DNA, 22 bp, Homo sapiens
caggctgaggcagtagggtttg

SEQ ID NO: 7961757 - DNA, 22 bp, Homo sapiens
caggctgaggcagtagggtttg

SEQ ID NO: 7961758 - DNA, 22 bp, Homo sapiens
caggctgattaggcctcgtcca

SEQ ID NO: 7961759 - DNA, 22 bp, Homo sapiens
caggctgatcagggctgggatg

SEQ ID NO: 7961760 - DNA, 22 bp, Homo sapiens
caggctgatcagggctgggatg

SEQ ID NO: 7961761 - DNA, 22 bp, Homo sapiens
caggctgatcagggctgggatg

SEQ ID NO: 7961762 - DNA, 22 bp, Homo sapiens
caggctgatcagggctgggatg

SEQ ID NO: 7961763 - DNA, 22 bp, Homo sapiens
caggctgatagggtccaaagtt

SEQ ID NO: 7961764 - DNA, 22 bp, Homo sapiens
caggctgcagcagcagtggccc

SEQ ID NO: 7961765 - DNA, 22 bp, Homo sapiens
caggctgcagcagcagtggccc

SEQ ID NO: 7961766 - DNA, 22 bp, Homo sapiens
caggctgcagaggcctttcatg

SEQ ID NO: 7961767 - DNA, 22 bp, Homo sapiens
caggctgcagaggcctttcatg

SEQ ID NO: 7961768 - DNA, 22 bp, Homo sapiens
caggctgcagaggcctttcatg

SEQ ID NO: 7961769 - DNA, 22 bp, Homo sapiens
caggctgcagaggcctttcatg

SEQ ID NO: 7961770 - DNA, 22 bp, Homo sapiens
caggctgattaggcctcgtcca

SEQ ID NO: 7961771 - DNA, 22 bp, Homo sapiens
caggctgattaggcctcgtcca

SEQ ID NO: 7961772 - DNA, 22 bp, Homo sapiens
caggctgcaagaaaggcattca

SEQ ID NO: 7961773 - DNA, 22 bp, Homo sapiens
caggctgcaagaaaggcattca

SEQ ID NO: 7961774 - DNA, 22 bp, Homo sapiens
caggctgcaagaaaggcattca

SEQ ID NO: 7961775 - DNA, 22 bp, Homo sapiens
caggctgcagcagcagtggccc

SEQ ID NO: 7961776 - DNA, 22 bp, Homo sapiens
caggctgcagcagcagtggccc

SEQ ID NO: 7961777 - DNA, 22 bp, Homo sapiens
caggctgcagcagcagtggccc

SEQ ID NO: 7961778 - DNA, 22 bp, Homo sapiens
caggctgcagcagcagtggccc

SEQ ID NO: 7961779 - DNA, 22 bp, Homo sapiens
taccctgcaggattgctgtgca

SEQ ID NO: 7961780 - DNA, 22 bp, Homo sapiens
taccctgaagtagctctttccc

SEQ ID NO: 7961781 - DNA, 22 bp, Homo sapiens
taccctgaagtagctctttccc

SEQ ID NO: 7961782 - DNA, 22 bp, Homo sapiens
taccctggagcaagtttcctca

SEQ ID NO: 7961783 - DNA, 22 bp, Homo sapiens
taccctgctagctagcatctct

SEQ ID NO: 7961784 - DNA, 19 bp, Homo sapiens
taccctgggctctctgccc

SEQ ID NO: 7961785 - DNA, 22 bp, Homo sapiens
tacctagacatgaacacagatg

SEQ ID NO: 7961786 - DNA, 20 bp, Homo sapiens
taccctggctatgcttctga

SEQ ID NO: 7961787 - DNA, 22 bp, Homo sapiens
taccctgggagcttagaagaat

SEQ ID NO: 7961788 - DNA, 19 bp, Homo sapiens
taccctcagggcctcattt

SEQ ID NO: 7961789 - DNA, 19 bp, Homo sapiens
taccctcagggcctcattt

SEQ ID NO: 7961790 - DNA, 22 bp, Homo sapiens
taccctctcccggtccagcttt

SEQ ID NO: 7961791 - DNA, 22 bp, Homo sapiens
taccctctcccggtccagcttt

SEQ ID NO: 7961792 - DNA, 22 bp, Homo sapiens
tacctcatgctgtacagcacgt

SEQ ID NO: 7961793 - DNA, 22 bp, Homo sapiens
tacctcagattgctgccttggg

SEQ ID NO: 7961794 - DNA, 22 bp, Homo sapiens
tacctcagattgctgccttggg

SEQ ID NO: 7961795 - DNA, 22 bp, Homo sapiens
tacctcactgaagctgagtttt

SEQ ID NO: 7961796 - DNA, 22 bp, Homo sapiens
tacctcattacatctgcaatga

SEQ ID NO: 7961797 - DNA, 22 bp, Homo sapiens
tacctctctaaacccagggaca

SEQ ID NO: 7961798 - DNA, 22 bp, Homo sapiens
tacctcaagttccaggaaagcg

SEQ ID NO: 7961799 - DNA, 22 bp, Homo sapiens
tacctcaagttccaggaaagcg

SEQ ID NO: 7961800 - DNA, 22 bp, Homo sapiens
tacctcaagttccaggaaagcg

SEQ ID NO: 7961801 - DNA, 23 bp, Homo sapiens
tacctattttcttaacacatcta

SEQ ID NO: 7961802 - DNA, 23 bp, Homo sapiens
tacctattttcttaacacatcta

SEQ ID NO: 7961803 - DNA, 22 bp, Homo sapiens
tacctataggtacaattacaag

SEQ ID NO: 7961804 - DNA, 22 bp, Homo sapiens
tacctagaccagttacaatgca

SEQ ID NO: 7961805 - DNA, 22 bp, Homo sapiens
tagaaagacagaggttttgtct

SEQ ID NO: 7961806 - DNA, 22 bp, Homo sapiens
tagaaagacagaggttttgtct

SEQ ID NO: 7961807 - DNA, 22 bp, Homo sapiens
tagaaagacaatgggaagtgct

SEQ ID NO: 7961808 - DNA, 22 bp, Homo sapiens
tagaaagacaatgggaagtgct

SEQ ID NO: 7961809 - DNA, 22 bp, Homo sapiens
tagaaagacaatgggaagtgct

SEQ ID NO: 7961810 - DNA, 22 bp, Homo sapiens
tagaaacaagtttctctttggg

SEQ ID NO: 7961811 - DNA, 22 bp, Homo sapiens
tagaaacaagtttctctttggg

SEQ ID NO: 7961812 - DNA, 22 bp, Homo sapiens
tagaaacaagggagaggattct

SEQ ID NO: 7961813 - DNA, 22 bp, Homo sapiens
tagaaacaagggagaggattct

SEQ ID NO: 7961814 - DNA, 22 bp, Homo sapiens
tagaaagagcatagtattataa

SEQ ID NO: 7961815 - DNA, 22 bp, Homo sapiens
tagaaagagcatagtattataa

SEQ ID NO: 7961816 - DNA, 22 bp, Homo sapiens
tagaaagagcatagtattataa

SEQ ID NO: 7961817 - DNA, 22 bp, Homo sapiens
tagaaagagcatagtattataa

SEQ ID NO: 7961818 - DNA, 22 bp, Homo sapiens
tagaaagactgtccagatttca

SEQ ID NO: 7961819 - DNA, 22 bp, Homo sapiens
tagaaagagcatagtattataa

SEQ ID NO: 7961820 - DNA, 22 bp, Homo sapiens
tagaaagagcatagtattataa

SEQ ID NO: 7961821 - DNA, 22 bp, Homo sapiens
tagaaagactgtccagatttca

SEQ ID NO: 7961822 - DNA, 22 bp, Homo sapiens
tagaaagactgtccagatttca

SEQ ID NO: 7961823 - DNA, 22 bp, Homo sapiens
tagaaagacatgggccagcagc

SEQ ID NO: 7961824 - DNA, 22 bp, Homo sapiens
tagaaagacagaggttttgtct

SEQ ID NO: 7961825 - DNA, 22 bp, Homo sapiens
tagaaagacatgggccagcagc

SEQ ID NO: 7961826 - DNA, 22 bp, Homo sapiens
tagaaagacatgggccagcagc

SEQ ID NO: 7961827 - DNA, 22 bp, Homo sapiens
tagaaagcagaaaccatcagag

SEQ ID NO: 7961828 - DNA, 19 bp, Homo sapiens
tagaaagatgatgggtggg

SEQ ID NO: 7961829 - DNA, 22 bp, Homo sapiens
tagaaagcaaaatcctaccaag

SEQ ID NO: 7961830 - DNA, 22 bp, Homo sapiens
tagaaagagctttgcttccttt

SEQ ID NO: 7961831 - DNA, 22 bp, Homo sapiens
tagaaagagcatagtattataa

SEQ ID NO: 7961832 - DNA, 22 bp, Homo sapiens
tagaaagagctttgcttccttt

SEQ ID NO: 7961833 - DNA, 22 bp, Homo sapiens
tagaaagatctgtaggcaagag

SEQ ID NO: 7961834 - DNA, 22 bp, Homo sapiens
tagaaagatctgtaggcaagag

SEQ ID NO: 7961835 - DNA, 22 bp, Homo sapiens
tagaaagatctgtaggcaagag

SEQ ID NO: 7961836 - DNA, 22 bp, Homo sapiens
tagaaagatctgtaggcaagag

SEQ ID NO: 7961837 - DNA, 22 bp, Homo sapiens
tagacatacagtgcagtacata

SEQ ID NO: 7961838 - DNA, 22 bp, Homo sapiens
tagacagtgagctatgagtggt

SEQ ID NO: 7961839 - DNA, 22 bp, Homo sapiens
tagacaggagtcaggctagaat

SEQ ID NO: 7961840 - DNA, 22 bp, Homo sapiens
tagacaggagtcaggctagaat

SEQ ID NO: 7961841 - DNA, 22 bp, Homo sapiens
tagacatattgtatttacttaa

SEQ ID NO: 7961842 - DNA, 22 bp, Homo sapiens
tagacatagtttttatgactta

SEQ ID NO: 7961843 - DNA, 22 bp, Homo sapiens
tagacatagtttttatgactta

SEQ ID NO: 7961844 - DNA, 22 bp, Homo sapiens
tagacatacagtgcagtacata

SEQ ID NO: 7961845 - DNA, 23 bp, Homo sapiens
tagacataagctctgtcaccttc

SEQ ID NO: 7961846 - DNA, 22 bp, Homo sapiens
tagacataggaagtggaagctt

SEQ ID NO: 7961847 - DNA, 22 bp, Homo sapiens
tagacataggaagtggaagctt

SEQ ID NO: 7961848 - DNA, 22 bp, Homo sapiens
tagacattaggtaggttcatgg

SEQ ID NO: 7961849 - DNA, 22 bp, Homo sapiens
tagacattatgtattaagttct

SEQ ID NO: 7961850 - DNA, 22 bp, Homo sapiens
tagacattaggtaggttcatgg

SEQ ID NO: 7961851 - DNA, 22 bp, Homo sapiens
tagacatttctggttattgaca

SEQ ID NO: 7961852 - DNA, 22 bp, Homo sapiens
tagacatttctggttattgaca

SEQ ID NO: 7961853 - DNA, 22 bp, Homo sapiens
tagacattggccattcctgtgg

SEQ ID NO: 7961854 - DNA, 22 bp, Homo sapiens
tagacattatgtattaagttct

SEQ ID NO: 7961855 - DNA, 22 bp, Homo sapiens
tagacatttggcatggttttca

SEQ ID NO: 7961856 - DNA, 22 bp, Homo sapiens
tagacatttgtcaagaatgact

SEQ ID NO: 7961857 - DNA, 22 bp, Homo sapiens
tagacatttggagttttatgac

SEQ ID NO: 7961858 - DNA, 22 bp, Homo sapiens
tagacatttctggttattgaca

SEQ ID NO: 7961859 - DNA, 22 bp, Homo sapiens
cagggagaggcctctgttgccc

SEQ ID NO: 7961860 - DNA, 22 bp, Homo sapiens
cagggagaggcatcatagggaa

SEQ ID NO: 7961861 - DNA, 22 bp, Homo sapiens
cagggagaggcctctgttgccc

SEQ ID NO: 7961862 - DNA, 22 bp, Homo sapiens
cagggagaggcctctgttgccc

SEQ ID NO: 7961863 - DNA, 22 bp, Homo sapiens
cagggagaggcctctgttgccc

SEQ ID NO: 7961864 - DNA, 22 bp, Homo sapiens
cagggagaggctggtggagtaa

SEQ ID NO: 7961865 - DNA, 22 bp, Homo sapiens
cagggagaggctggtggagtaa

SEQ ID NO: 7961866 - DNA, 22 bp, Homo sapiens
cagggagaggctggtggagtaa

SEQ ID NO: 7961867 - DNA, 22 bp, Homo sapiens
cagggagaggctggtggagtaa

SEQ ID NO: 7961868 - DNA, 22 bp, Homo sapiens
cagggagatcttggctcctggt

SEQ ID NO: 7961869 - DNA, 22 bp, Homo sapiens
cagggagaggctggtggagtaa

SEQ ID NO: 7961870 - DNA, 22 bp, Homo sapiens
cagggagatcttggctcctggt

SEQ ID NO: 7961871 - DNA, 22 bp, Homo sapiens
cagggagaggcatcatagggaa

SEQ ID NO: 7961872 - DNA, 22 bp, Homo sapiens
cagggagaggcatcatagggaa

SEQ ID NO: 7961873 - DNA, 22 bp, Homo sapiens
cagggagaagtctggtcagtcc

SEQ ID NO: 7961874 - DNA, 22 bp, Homo sapiens
cagggagaagtctggtcagtcc

SEQ ID NO: 7961875 - DNA, 22 bp, Homo sapiens
cagggagaagtctggtcagtcc

SEQ ID NO: 7961876 - DNA, 22 bp, Homo sapiens
cagggagaggcatcatagggaa

SEQ ID NO: 7961877 - DNA, 22 bp, Homo sapiens
cagggagaggcatcatagggaa

SEQ ID NO: 7961878 - DNA, 22 bp, Homo sapiens
cagggagaggcatcatagggaa

SEQ ID NO: 7961879 - DNA, 22 bp, Homo sapiens
cagggagaggcatcatagggaa

SEQ ID NO: 7961880 - DNA, 22 bp, Homo sapiens
cagggagaggcctctgttgccc

SEQ ID NO: 7961881 - DNA, 22 bp, Homo sapiens
cagggagaagtctggtcagtcc

SEQ ID NO: 7961882 - DNA, 22 bp, Homo sapiens
cagggagaagtctggtcagtcc

SEQ ID NO: 7961883 - DNA, 22 bp, Homo sapiens
cagggagaagtctggtcagtcc

SEQ ID NO: 7961884 - DNA, 22 bp, Homo sapiens
cagggacagcgggactctgaca

SEQ ID NO: 7961885 - DNA, 22 bp, Homo sapiens
cagggacagccttggggtggcg

SEQ ID NO: 7961886 - DNA, 22 bp, Homo sapiens
tagaacagtataggctaaacat

SEQ ID NO: 7961887 - DNA, 22 bp, Homo sapiens
cagggacagccttggggtggcg

SEQ ID NO: 7961888 - DNA, 22 bp, Homo sapiens
cagggacagccttggggtggcg

SEQ ID NO: 7961889 - DNA, 22 bp, Homo sapiens
cagggacagccttggggtggcg

SEQ ID NO: 7961890 - DNA, 22 bp, Homo sapiens
tagaacagagttccagtgatca

SEQ ID NO: 7961891 - DNA, 22 bp, Homo sapiens
tagaacacttgaccactgctcc

SEQ ID NO: 7961892 - DNA, 22 bp, Homo sapiens
tagaacagagggttgcccagat

SEQ ID NO: 7961893 - DNA, 22 bp, Homo sapiens
tagaacaggctgtcagagcggg

SEQ ID NO: 7961894 - DNA, 22 bp, Homo sapiens
tagaacaggctgtcagagcggg

SEQ ID NO: 7961895 - DNA, 22 bp, Homo sapiens
tagaacagtataggctaaacat

SEQ ID NO: 7961896 - DNA, 22 bp, Homo sapiens
tagaacagcatttggctattaa

SEQ ID NO: 7961897 - DNA, 22 bp, Homo sapiens
tagaaatgttagatgtattgag

SEQ ID NO: 7961898 - DNA, 22 bp, Homo sapiens
tagaaatgttagatgtattgag

SEQ ID NO: 7961899 - DNA, 22 bp, Homo sapiens
tagaaatgttagatgtattgag

SEQ ID NO: 7961900 - DNA, 22 bp, Homo sapiens
tagaaatgttggtattaacatt

SEQ ID NO: 7961901 - DNA, 22 bp, Homo sapiens
tagaaatgttggtattaacatt

SEQ ID NO: 7961902 - DNA, 22 bp, Homo sapiens
tagaaatgttggtattaacatt

SEQ ID NO: 7961903 - DNA, 22 bp, Homo sapiens
tagaaatgttggtattaacatt

SEQ ID NO: 7961904 - DNA, 22 bp, Homo sapiens
tagaaatgttggtattaacatt

SEQ ID NO: 7961905 - DNA, 22 bp, Homo sapiens
tagaaatgttggtattaacatt

SEQ ID NO: 7961906 - DNA, 22 bp, Homo sapiens
tagaaattcaatgctctgagta

SEQ ID NO: 7961907 - DNA, 22 bp, Homo sapiens
tagaacaatgaatttctggagg

SEQ ID NO: 7961908 - DNA, 22 bp, Homo sapiens
tagaaattcaatgctctgagta

SEQ ID NO: 7961909 - DNA, 22 bp, Homo sapiens
tagaacaatgaatttctggagg

SEQ ID NO: 7961910 - DNA, 22 bp, Homo sapiens
tagaaatgtgataatagcttaa

SEQ ID NO: 7961911 - DNA, 22 bp, Homo sapiens
tagaaatgtgataatagcttaa

SEQ ID NO: 7961912 - DNA, 22 bp, Homo sapiens
tagaaatgtgataatagcttaa

SEQ ID NO: 7961913 - DNA, 22 bp, Homo sapiens
tagaaatgtgataatagcttaa

SEQ ID NO: 7961914 - DNA, 22 bp, Homo sapiens
tagaaatgtgataatagcttaa

SEQ ID NO: 7961915 - DNA, 22 bp, Homo sapiens
tagaaatgtgataatagcttaa

SEQ ID NO: 7961916 - DNA, 22 bp, Homo sapiens
tagaaatgtaggcttcctgaca

SEQ ID NO: 7961917 - DNA, 22 bp, Homo sapiens
tagaaatgtaggcttcctgaca

SEQ ID NO: 7961918 - DNA, 22 bp, Homo sapiens
tagaaatgtaggcttcctgaca

SEQ ID NO: 7961919 - DNA, 22 bp, Homo sapiens
tagaaagcatgcaagtttgatg

SEQ ID NO: 7961920 - DNA, 22 bp, Homo sapiens
tagaaatgtcgtctccacattt

SEQ ID NO: 7961921 - DNA, 22 bp, Homo sapiens
tagaaagcagtatctccatttt

SEQ ID NO: 7961922 - DNA, 22 bp, Homo sapiens
cagggatgctgcttaggcagtt

SEQ ID NO: 7961923 - DNA, 22 bp, Homo sapiens
cagggatgctgcttaggcagtt

SEQ ID NO: 7961924 - DNA, 22 bp, Homo sapiens
cagggatgagcagatggagcaa

SEQ ID NO: 7961925 - DNA, 22 bp, Homo sapiens
cagggatgctgcttaggcagtt

SEQ ID NO: 7961926 - DNA, 22 bp, Homo sapiens
cagggatgctgcttaggcagtt

SEQ ID NO: 7961927 - DNA, 22 bp, Homo sapiens
cagggatgctgcttaggcagtt

SEQ ID NO: 7961928 - DNA, 22 bp, Homo sapiens
cagggatgctgcttaggcagtt

SEQ ID NO: 7961929 - DNA, 22 bp, Homo sapiens
cagggatgctgcttaggcagtt

SEQ ID NO: 7961930 - DNA, 22 bp, Homo sapiens
cagggatgctgcttaggcagtt

SEQ ID NO: 7961931 - DNA, 22 bp, Homo sapiens
cagggatgctgttaaacatcct

SEQ ID NO: 7961932 - DNA, 22 bp, Homo sapiens
cagggatgctgttaaacatcct

SEQ ID NO: 7961933 - DNA, 22 bp, Homo sapiens
cagggatggagagactactggc

SEQ ID NO: 7961934 - DNA, 22 bp, Homo sapiens
cagggatggagagactactggc

SEQ ID NO: 7961935 - DNA, 22 bp, Homo sapiens
cagggatggagagactactggc

SEQ ID NO: 7961936 - DNA, 22 bp, Homo sapiens
cagggatggagagactactggc

SEQ ID NO: 7961937 - DNA, 22 bp, Homo sapiens
cagggatggcctggcgggccac

SEQ ID NO: 7961938 - DNA, 22 bp, Homo sapiens
cagggatgagagatggcacaga

SEQ ID NO: 7961939 - DNA, 22 bp, Homo sapiens
cagggatgagagatggcacaga

SEQ ID NO: 7961940 - DNA, 22 bp, Homo sapiens
cagggatgagaaagctctctaa

SEQ ID NO: 7961941 - DNA, 22 bp, Homo sapiens
cagggatgagagatggcacaga

SEQ ID NO: 7961942 - DNA, 22 bp, Homo sapiens
cagggatgagagatggcacaga

SEQ ID NO: 7961943 - DNA, 22 bp, Homo sapiens
cagggatgagagatggcacaga

SEQ ID NO: 7961944 - DNA, 22 bp, Homo sapiens
cagggatgagcagatggagcaa

SEQ ID NO: 7961945 - DNA, 22 bp, Homo sapiens
cagggatgagcagatggagcaa

SEQ ID NO: 7961946 - DNA, 22 bp, Homo sapiens
cagggatgagcagatggagcaa

SEQ ID NO: 7961947 - DNA, 22 bp, Homo sapiens
cagggatgagcagatggagcaa

SEQ ID NO: 7961948 - DNA, 22 bp, Homo sapiens
cagggatgagcagatggagcaa

SEQ ID NO: 7961949 - DNA, 22 bp, Homo sapiens
cagggatggcctggcgggccac

SEQ ID NO: 7961950 - DNA, 22 bp, Homo sapiens
cagggatggcctggcgggccac

SEQ ID NO: 7961951 - DNA, 22 bp, Homo sapiens
tagcaatgtgttgacttggtca

SEQ ID NO: 7961952 - DNA, 21 bp, Homo sapiens
tagcaattatagatgtctaaa

SEQ ID NO: 7961953 - DNA, 21 bp, Homo sapiens
tagcaattatagatgtctaaa

SEQ ID NO: 7961954 - DNA, 22 bp, Homo sapiens
tagcagcaaagcaggatctgct

SEQ ID NO: 7961955 - DNA, 22 bp, Homo sapiens
tagcagcaaagcaggatctgct

SEQ ID NO: 7961956 - DNA, 22 bp, Homo sapiens
tagcagcaaagcaggatctgct

SEQ ID NO: 7961957 - DNA, 22 bp, Homo sapiens
tagcacaaagagtctttcagag

SEQ ID NO: 7961958 - DNA, 17 bp, Homo sapiens
tagcacaaagcaggatt

SEQ ID NO: 7961959 - DNA, 22 bp, Homo sapiens
tagcagcaaaatgaccttctaa

SEQ ID NO: 7961960 - DNA, 22 bp, Homo sapiens
tagcagagtttggtacctgggg

SEQ ID NO: 7961961 - DNA, 22 bp, Homo sapiens
tagcagcacagaaagcctggag

SEQ ID NO: 7961962 - DNA, 22 bp, Homo sapiens
tagcagcacagaaagcctggag

SEQ ID NO: 7961963 - DNA, 22 bp, Homo sapiens
tagcagcacagaaagcctggag

SEQ ID NO: 7961964 - DNA, 22 bp, Homo sapiens
tagcagcacaaatggactatga

SEQ ID NO: 7961965 - DNA, 22 bp, Homo sapiens
tagcagcaattcaggtgtgatg

SEQ ID NO: 7961966 - DNA, 22 bp, Homo sapiens
tagcagcaatttcagaagtttg

SEQ ID NO: 7961967 - DNA, 22 bp, Homo sapiens
tagcagcaatttcagaagtttg

SEQ ID NO: 7961968 - DNA, 22 bp, Homo sapiens
tagcagcaatttcagaagtttg

SEQ ID NO: 7961969 - DNA, 22 bp, Homo sapiens
tagcagcacaaatggactatga

SEQ ID NO: 7961970 - DNA, 22 bp, Homo sapiens
tagcagcaattacacagtccgt

SEQ ID NO: 7961971 - DNA, 22 bp, Homo sapiens
tagcagcaattacacagtccgt

SEQ ID NO: 7961972 - DNA, 22 bp, Homo sapiens
tagcagcaagaatgggatgtgt

SEQ ID NO: 7961973 - DNA, 22 bp, Homo sapiens
tagcagcaattacacagtccgt

SEQ ID NO: 7961974 - DNA, 22 bp, Homo sapiens
tagcagcaagaatgggatgtgt

SEQ ID NO: 7961975 - DNA, 22 bp, Homo sapiens
tagcagcaattcaggtgtgatg

SEQ ID NO: 7961976 - DNA, 22 bp, Homo sapiens
tagcagcaattcaggtgtgatg

SEQ ID NO: 7961977 - DNA, 22 bp, Homo sapiens
tagcagcaattacacagtccgt

SEQ ID NO: 7961978 - DNA, 22 bp, Homo sapiens
tagcagcaattacacagtccgt

SEQ ID NO: 7961979 - DNA, 22 bp, Homo sapiens
cagggatgaccagagggatgtg

SEQ ID NO: 7961980 - DNA, 22 bp, Homo sapiens
cagggatgaccagagggatgtg

SEQ ID NO: 7961981 - DNA, 22 bp, Homo sapiens
cagggatgaccagagggatgtg

SEQ ID NO: 7961982 - DNA, 22 bp, Homo sapiens
cagggagtgtacaccatgtgta

SEQ ID NO: 7961983 - DNA, 22 bp, Homo sapiens
cagggagtttttgttcctctag

SEQ ID NO: 7961984 - DNA, 22 bp, Homo sapiens
cagggatgaccagagggatgtg

SEQ ID NO: 7961985 - DNA, 22 bp, Homo sapiens
cagggatgaccagagggatgtg

SEQ ID NO: 7961986 - DNA, 22 bp, Homo sapiens
cagggatgaccagagggatgtg

SEQ ID NO: 7961987 - DNA, 22 bp, Homo sapiens
cagggatgagaaagctctctaa

SEQ ID NO: 7961988 - DNA, 22 bp, Homo sapiens
cagggatgagaaagctctctaa

SEQ ID NO: 7961989 - DNA, 22 bp, Homo sapiens
cagggatgagaaagctctctaa

SEQ ID NO: 7961990 - DNA, 22 bp, Homo sapiens
cagggatgagaaagctctctaa

SEQ ID NO: 7961991 - DNA, 22 bp, Homo sapiens
cagggatgagaaagctctctaa

SEQ ID NO: 7961992 - DNA, 22 bp, Homo sapiens
cagggagggaggaaaatttgct

SEQ ID NO: 7961993 - DNA, 22 bp, Homo sapiens
cagggagggacaattgtcacct

SEQ ID NO: 7961994 - DNA, 22 bp, Homo sapiens
cagggagggaggaaaatttgct

SEQ ID NO: 7961995 - DNA, 22 bp, Homo sapiens
cagggagggaggaaaatttgct

SEQ ID NO: 7961996 - DNA, 22 bp, Homo sapiens
cagggagggacaattgtcacct

SEQ ID NO: 7961997 - DNA, 22 bp, Homo sapiens
cagggagggacaattgtcacct

SEQ ID NO: 7961998 - DNA, 22 bp, Homo sapiens
cagggagggacaattgtcacct

SEQ ID NO: 7961999 - DNA, 22 bp, Homo sapiens
cagggagcggagtcccatgcct

SEQ ID NO: 7962000 - DNA, 22 bp, Homo sapiens
cagggagctttcccaggaccct

SEQ ID NO: 7962001 - DNA, 22 bp, Homo sapiens
cagggagcctgaatgttccagg

SEQ ID NO: 7962002 - DNA, 22 bp, Homo sapiens
cagggagcctgaatgttccagg

SEQ ID NO: 7962003 - DNA, 22 bp, Homo sapiens
cagggagcctgaatgttccagg

SEQ ID NO: 7962004 - DNA, 22 bp, Homo sapiens
cagggagcctgaatgttccagg

SEQ ID NO: 7962005 - DNA, 22 bp, Homo sapiens
cagggagcctgaatgttccagg

SEQ ID NO: 7962006 - DNA, 22 bp, Homo sapiens
cagggagcctgaatgttccagg

SEQ ID NO: 7962007 - DNA, 22 bp, Homo sapiens
cagggagctttgtcttctcatt

SEQ ID NO: 7962008 - DNA, 22 bp, Homo sapiens
cagggagctttgtcttctcatt

SEQ ID NO: 7962009 - DNA, 22 bp, Homo sapiens
cagggagctttgtcttctcatt

SEQ ID NO: 7962010 - DNA, 22 bp, Homo sapiens
cagggagctttgtcttctcatt

SEQ ID NO: 7962011 - DNA, 22 bp, Homo sapiens
cagggagctttcccaggaccct

SEQ ID NO: 7962012 - DNA, 22 bp, Homo sapiens
cagggagctttcccaggaccct

SEQ ID NO: 7962013 - DNA, 22 bp, Homo sapiens
cagggagctttcccaggaccct

SEQ ID NO: 7962014 - DNA, 22 bp, Homo sapiens
cagggagctttcccaggaccct

SEQ ID NO: 7962015 - DNA, 22 bp, Homo sapiens
cagggaggatgggctgttttgc

SEQ ID NO: 7962016 - DNA, 22 bp, Homo sapiens
cagggaggctgtcttatgcctg

SEQ ID NO: 7962017 - DNA, 22 bp, Homo sapiens
cagggaggctgtcttatgcctg

SEQ ID NO: 7962018 - DNA, 22 bp, Homo sapiens
cagggaggctgtcttatgcctg

SEQ ID NO: 7962019 - DNA, 22 bp, Homo sapiens
cagggaggctgtcttatgcctg

SEQ ID NO: 7962020 - DNA, 23 bp, Homo sapiens
cagggaggagatactgtgtatct

SEQ ID NO: 7962021 - DNA, 23 bp, Homo sapiens
cagggaggagatactgtgtatct

SEQ ID NO: 7962022 - DNA, 23 bp, Homo sapiens
cagggaggagatactgtgtatct

SEQ ID NO: 7962023 - DNA, 23 bp, Homo sapiens
cagggaggagatactgtgtatct

SEQ ID NO: 7962024 - DNA, 23 bp, Homo sapiens
cagggaggagatactgtgtatct

SEQ ID NO: 7962025 - DNA, 22 bp, Homo sapiens
cagggaggatgggctgttttgc

SEQ ID NO: 7962026 - DNA, 22 bp, Homo sapiens
cagggaggatgggctgttttgc

SEQ ID NO: 7962027 - DNA, 22 bp, Homo sapiens
tagcagtgtctaggtaggccat

SEQ ID NO: 7962028 - DNA, 22 bp, Homo sapiens
tagcagtgtaaagtggctagaa

SEQ ID NO: 7962029 - DNA, 22 bp, Homo sapiens
tagcagtgtgcaaaatctttaa

SEQ ID NO: 7962030 - DNA, 22 bp, Homo sapiens
tagcagtgtctaggtaggccat

SEQ ID NO: 7962031 - DNA, 22 bp, Homo sapiens
tagcagtgttgccgttggctgc

SEQ ID NO: 7962032 - DNA, 22 bp, Homo sapiens
tagcataacaggtaagagtgag

SEQ ID NO: 7962033 - DNA, 22 bp, Homo sapiens
tagcataacaggtaagagtgag

SEQ ID NO: 7962034 - DNA, 22 bp, Homo sapiens
tagcataacaggtaagagtgag

SEQ ID NO: 7962035 - DNA, 22 bp, Homo sapiens
tagcataacaggtaagagtgag

SEQ ID NO: 7962036 - DNA, 22 bp, Homo sapiens
tagcataatttgtagaaaatca

SEQ ID NO: 7962037 - DNA, 22 bp, Homo sapiens
tagcatcagccacaccttgtac

SEQ ID NO: 7962038 - DNA, 22 bp, Homo sapiens
tagcatagtttggaaatgcagg

SEQ ID NO: 7962039 - DNA, 22 bp, Homo sapiens
tagcatagcacctgacacagag

SEQ ID NO: 7962040 - DNA, 22 bp, Homo sapiens
tagcagcacagaaagcctggag

SEQ ID NO: 7962041 - DNA, 22 bp, Homo sapiens
tagcagcacctacacgtcagag

SEQ ID NO: 7962042 - DNA, 22 bp, Homo sapiens
tagcagcacctacacgtcagag

SEQ ID NO: 7962043 - DNA, 22 bp, Homo sapiens
tagcagcacctacacgtcagag

SEQ ID NO: 7962044 - DNA, 22 bp, Homo sapiens
tagcagcactatttgttgtagt

SEQ ID NO: 7962045 - DNA, 22 bp, Homo sapiens
tagcagcacctacacgtcagag

SEQ ID NO: 7962046 - DNA, 22 bp, Homo sapiens
tagcagcacctttctaatctga

SEQ ID NO: 7962047 - DNA, 22 bp, Homo sapiens
tagcagcaggggaaacagctgt

SEQ ID NO: 7962048 - DNA, 20 bp, Homo sapiens
tagcagcagaaagaacttag

SEQ ID NO: 7962049 - DNA, 22 bp, Homo sapiens
tagcagcaggggaaacagctgt

SEQ ID NO: 7962050 - DNA, 18 bp, Homo sapiens
tagcagcactggccgctt

SEQ ID NO: 7962051 - DNA, 18 bp, Homo sapiens
tagcagcactggccgctt

SEQ ID NO: 7962052 - DNA, 20 bp, Homo sapiens
tagcagcagaaagaacttag

SEQ ID NO: 7962053 - DNA, 20 bp, Homo sapiens
tagcagcagaaagaacttag

SEQ ID NO: 7962054 - DNA, 20 bp, Homo sapiens
tagcagcagaaagaacttag

SEQ ID NO: 7962055 - DNA, 22 bp, Homo sapiens
tagcatagtttggaaatgcagg

SEQ ID NO: 7962056 - DNA, 22 bp, Homo sapiens
tagcatctaacatcttaggact

SEQ ID NO: 7962057 - DNA, 22 bp, Homo sapiens
tagcatctgcatttgtaactag

SEQ ID NO: 7962058 - DNA, 22 bp, Homo sapiens
tagcatctgtactgacataatc

SEQ ID NO: 7962059 - DNA, 22 bp, Homo sapiens
tagcatctggagaaacaagtcc

SEQ ID NO: 7962060 - DNA, 22 bp, Homo sapiens
tagcatctggagaaacaagtcc

SEQ ID NO: 7962061 - DNA, 22 bp, Homo sapiens
tagcatcttgatttcagaccag

SEQ ID NO: 7962062 - DNA, 22 bp, Homo sapiens
tagcatctgtttctctttgtga

SEQ ID NO: 7962063 - DNA, 22 bp, Homo sapiens
tagcatgtcagtcgccacacgt

SEQ ID NO: 7962064 - DNA, 22 bp, Homo sapiens
tagcatggctgtggtttcttct

SEQ ID NO: 7962065 - DNA, 22 bp, Homo sapiens
tagcattagagatagaaatagt

SEQ ID NO: 7962066 - DNA, 22 bp, Homo sapiens
tagcattaaaggtaagacatta

SEQ ID NO: 7962067 - DNA, 22 bp, Homo sapiens
tagcattaaaggtaagacatta

SEQ ID NO: 7962068 - DNA, 22 bp, Homo sapiens
tagcattagtcagatatgtttt

SEQ ID NO: 7962069 - DNA, 22 bp, Homo sapiens
tagcattagtcagatatgtttt

SEQ ID NO: 7962070 - DNA, 22 bp, Homo sapiens
cagggcaggacagatacattac

SEQ ID NO: 7962071 - DNA, 22 bp, Homo sapiens
cagggcagtttgtgcctatgag

SEQ ID NO: 7962072 - DNA, 22 bp, Homo sapiens
cagggcagtttgtgcctatgag

SEQ ID NO: 7962073 - DNA, 22 bp, Homo sapiens
cagggcagtttgtgcctatgag

SEQ ID NO: 7962074 - DNA, 22 bp, Homo sapiens
cagggcagtttgtgcctatgag

SEQ ID NO: 7962075 - DNA, 22 bp, Homo sapiens
cagggcagtttgtgcctatgag

SEQ ID NO: 7962076 - DNA, 22 bp, Homo sapiens
cagggcagtttgtgcctatgag

SEQ ID NO: 7962077 - DNA, 22 bp, Homo sapiens
cagggcagtttgtgcctatgag

SEQ ID NO: 7962078 - DNA, 22 bp, Homo sapiens
cagggcagtgaagaacacacgt

SEQ ID NO: 7962079 - DNA, 22 bp, Homo sapiens
cagggcagtgaagaacacacgt

SEQ ID NO: 7962080 - DNA, 22 bp, Homo sapiens
cagggcagtgaagaacacacgt

SEQ ID NO: 7962081 - DNA, 22 bp, Homo sapiens
cagggcagtgaagaacacacgt

SEQ ID NO: 7962082 - DNA, 22 bp, Homo sapiens
cagggcagtgaagaacacacgt

SEQ ID NO: 7962083 - DNA, 22 bp, Homo sapiens
cagggcagtaccgccctctggc

SEQ ID NO: 7962084 - DNA, 22 bp, Homo sapiens
cagggcagtaccgccctctggc

SEQ ID NO: 7962085 - DNA, 22 bp, Homo sapiens
cagggcagtaccgccctctggc

SEQ ID NO: 7962086 - DNA, 22 bp, Homo sapiens
cagggcagtaccgccctctggc

SEQ ID NO: 7962087 - DNA, 22 bp, Homo sapiens
cagggcagtaccgccctctggc

SEQ ID NO: 7962088 - DNA, 22 bp, Homo sapiens
cagggcaggacagatacattac

SEQ ID NO: 7962089 - DNA, 22 bp, Homo sapiens
cagggcaggatgctgtgattat

SEQ ID NO: 7962090 - DNA, 22 bp, Homo sapiens
cagggcaggacagatacattac

SEQ ID NO: 7962091 - DNA, 22 bp, Homo sapiens
cagggcagtaccgccctctggc

SEQ ID NO: 7962092 - DNA, 22 bp, Homo sapiens
cagggcagtaccgccctctggc

SEQ ID NO: 7962093 - DNA, 22 bp, Homo sapiens
cagggcagtaccgccctctggc

SEQ ID NO: 7962094 - DNA, 22 bp, Homo sapiens
cagggcatccgtgctccatgct

SEQ ID NO: 7962095 - DNA, 22 bp, Homo sapiens
cagggccaagctgcagcatctg

SEQ ID NO: 7962096 - DNA, 22 bp, Homo sapiens
cagggccaagcccctttggctg

SEQ ID NO: 7962097 - DNA, 22 bp, Homo sapiens
cagggccaagctgcagcatctg

SEQ ID NO: 7962098 - DNA, 22 bp, Homo sapiens
cagggcattacttcaggtcctt

SEQ ID NO: 7962099 - DNA, 22 bp, Homo sapiens
cagggccaagcccctttggctg

SEQ ID NO: 7962100 - DNA, 22 bp, Homo sapiens
cagggcagttttacttctctct

SEQ ID NO: 7962101 - DNA, 22 bp, Homo sapiens
cagggcagttttacttctctct

SEQ ID NO: 7962102 - DNA, 22 bp, Homo sapiens
cagggcataagatgaggctgta

SEQ ID NO: 7962103 - DNA, 22 bp, Homo sapiens
cagggcagttttacttctctct

SEQ ID NO: 7962104 - DNA, 22 bp, Homo sapiens
cagggcagttttacttctctct

SEQ ID NO: 7962105 - DNA, 22 bp, Homo sapiens
cagggcagttttacttctctct

SEQ ID NO: 7962106 - DNA, 22 bp, Homo sapiens
cagggcagttttacttctctct

SEQ ID NO: 7962107 - DNA, 22 bp, Homo sapiens
cagggcagttttacttctctct

SEQ ID NO: 7962108 - DNA, 22 bp, Homo sapiens
cagggcagttttacttctctct

SEQ ID NO: 7962109 - DNA, 22 bp, Homo sapiens
cagggcagtttgtgcctatgag

SEQ ID NO: 7962110 - DNA, 22 bp, Homo sapiens
cagggcagtttgtgcctatgag

SEQ ID NO: 7962111 - DNA, 22 bp, Homo sapiens
tacaatagggcttttgtttatg

SEQ ID NO: 7962112 - DNA, 22 bp, Homo sapiens
tacaatatgtgaactttggtgt

SEQ ID NO: 7962113 - DNA, 22 bp, Homo sapiens
tacaatatgtgaactttggtgt

SEQ ID NO: 7962114 - DNA, 22 bp, Homo sapiens
tacaatatgtgaactttggtgt

SEQ ID NO: 7962115 - DNA, 22 bp, Homo sapiens
tacacagaacctggtgtacagt

SEQ ID NO: 7962116 - DNA, 22 bp, Homo sapiens
tacacagaagccagaaggcctg

SEQ ID NO: 7962117 - DNA, 22 bp, Homo sapiens
tacacagaagccagaaggcctg

SEQ ID NO: 7962118 - DNA, 22 bp, Homo sapiens
tacacagaagccagaaggcctg

SEQ ID NO: 7962119 - DNA, 22 bp, Homo sapiens
tacacagactcttcaattcaga

SEQ ID NO: 7962120 - DNA, 22 bp, Homo sapiens
tacacagactcttcaattcaga

SEQ ID NO: 7962121 - DNA, 22 bp, Homo sapiens
tacacagactcttcaattcaga

SEQ ID NO: 7962122 - DNA, 22 bp, Homo sapiens
tacacagactcttcaattcaga

SEQ ID NO: 7962123 - DNA, 22 bp, Homo sapiens
tacacagatatgtgatcaatca

SEQ ID NO: 7962124 - DNA, 22 bp, Homo sapiens
tacacagatatgtgatcaatca

SEQ ID NO: 7962125 - DNA, 22 bp, Homo sapiens
tacacagatatgtgatcaatca

SEQ ID NO: 7962126 - DNA, 22 bp, Homo sapiens
tacacagatatgtgatcaatca

SEQ ID NO: 7962127 - DNA, 22 bp, Homo sapiens
tacacagatatgtgatcaatca

SEQ ID NO: 7962128 - DNA, 22 bp, Homo sapiens
tacacagatatgtgatcaatca

SEQ ID NO: 7962129 - DNA, 22 bp, Homo sapiens
tacacagactcttcaattcaga

SEQ ID NO: 7962130 - DNA, 22 bp, Homo sapiens
tacacagagactcaaaagggca

SEQ ID NO: 7962131 - DNA, 22 bp, Homo sapiens
tacacagagactcaaaagggca

SEQ ID NO: 7962132 - DNA, 22 bp, Homo sapiens
tacacagaggctgatgtcttag

SEQ ID NO: 7962133 - DNA, 22 bp, Homo sapiens
tacacagaggcagctgtctgct

SEQ ID NO: 7962134 - DNA, 22 bp, Homo sapiens
tacacagaggctgatgtcttag

SEQ ID NO: 7962135 - DNA, 22 bp, Homo sapiens
tacacagaggcagctgtctgct

SEQ ID NO: 7962136 - DNA, 22 bp, Homo sapiens
tacacagaggcagctgtctgct

SEQ ID NO: 7962137 - DNA, 22 bp, Homo sapiens
tacacagggagagattggaaac

SEQ ID NO: 7962138 - DNA, 22 bp, Homo sapiens
tacacagggagagattggaaac

SEQ ID NO: 7962139 - DNA, 22 bp, Homo sapiens
tacacagggagagattggaaac

SEQ ID NO: 7962140 - DNA, 22 bp, Homo sapiens
tacacagggtatggcttgagga

SEQ ID NO: 7962141 - DNA, 22 bp, Homo sapiens
tacacaggggagcatggttgac

SEQ ID NO: 7962142 - DNA, 22 bp, Homo sapiens
tacacagatttcagtatcatca

SEQ ID NO: 7962143 - DNA, 22 bp, Homo sapiens
tacacagatttcagtatcatca

SEQ ID NO: 7962144 - DNA, 22 bp, Homo sapiens
tacacagatttaaaagcaggga

SEQ ID NO: 7962145 - DNA, 22 bp, Homo sapiens
tacacagatttcagtatcatca

SEQ ID NO: 7962146 - DNA, 22 bp, Homo sapiens
tacacagatttcagtatcatca

SEQ ID NO: 7962147 - DNA, 22 bp, Homo sapiens
tacacagatttaaaagcaggga

SEQ ID NO: 7962148 - DNA, 22 bp, Homo sapiens
tacacagtaaatggtaaataca

SEQ ID NO: 7962149 - DNA, 22 bp, Homo sapiens
caggccaaaattcaggcattct

SEQ ID NO: 7962150 - DNA, 22 bp, Homo sapiens
caggccaaagatcccattgaca

SEQ ID NO: 7962151 - DNA, 22 bp, Homo sapiens
caggccaaaattcaggcattct

SEQ ID NO: 7962152 - DNA, 22 bp, Homo sapiens
caggccaactgcatggtgacca

SEQ ID NO: 7962153 - DNA, 22 bp, Homo sapiens
caggccaactgcatggtgacca

SEQ ID NO: 7962154 - DNA, 22 bp, Homo sapiens
caggccaaagatcccattgaca

SEQ ID NO: 7962155 - DNA, 22 bp, Homo sapiens
caggccaaagatcccattgaca

SEQ ID NO: 7962156 - DNA, 22 bp, Homo sapiens
caggccaataaatgtgatggcc

SEQ ID NO: 7962157 - DNA, 22 bp, Homo sapiens
caggccaataaatgtgatggcc

SEQ ID NO: 7962158 - DNA, 22 bp, Homo sapiens
caggccaagtcccaagtgcggg

SEQ ID NO: 7962159 - DNA, 22 bp, Homo sapiens
caggccaactgcatggtgacca

SEQ ID NO: 7962160 - DNA, 22 bp, Homo sapiens
caggccaagcctccccagctcc

SEQ ID NO: 7962161 - DNA, 22 bp, Homo sapiens
caggccaagcctccccagctcc

SEQ ID NO: 7962162 - DNA, 22 bp, Homo sapiens
caggccaagtcccaagtgcggg

SEQ ID NO: 7962163 - DNA, 22 bp, Homo sapiens
cagctctgcctctggggctgag

SEQ ID NO: 7962164 - DNA, 22 bp, Homo sapiens
cagctctgctgggaggatgcag

SEQ ID NO: 7962165 - DNA, 22 bp, Homo sapiens
cagctctgctgggaggatgcag

SEQ ID NO: 7962166 - DNA, 22 bp, Homo sapiens
gtggagaggagcagctacctca

SEQ ID NO: 7962167 - DNA, 22 bp, Homo sapiens
gtggagaggagcagctacctca

SEQ ID NO: 7962168 - DNA, 22 bp, Homo sapiens
cagctctgctgggaggatgcag

SEQ ID NO: 7962169 - DNA, 22 bp, Homo sapiens
cagctctgccatcatctgcctt

SEQ ID NO: 7962170 - DNA, 22 bp, Homo sapiens
cagctctgcctctggggctgag

SEQ ID NO: 7962171 - DNA, 22 bp, Homo sapiens
cagctctgccatcatctgcctt

SEQ ID NO: 7962172 - DNA, 22 bp, Homo sapiens
cagctctgccatcatctgcctt

SEQ ID NO: 7962173 - DNA, 22 bp, Homo sapiens
cagctctgcctctggggctgag

SEQ ID NO: 7962174 - DNA, 22 bp, Homo sapiens
cagctctgcctctggggctgag

SEQ ID NO: 7962175 - DNA, 22 bp, Homo sapiens
cagctctgccacttcctagcta

SEQ ID NO: 7962176 - DNA, 22 bp, Homo sapiens
cagctctgccacttcctagcta

SEQ ID NO: 7962177 - DNA, 22 bp, Homo sapiens
cagctctgccatcatctgcctt

SEQ ID NO: 7962178 - DNA, 22 bp, Homo sapiens
cagctctgccatcatctgcctt

SEQ ID NO: 7962179 - DNA, 17 bp, Homo sapiens
cagctctgcatcttcct

SEQ ID NO: 7962180 - DNA, 17 bp, Homo sapiens
cagctctgcatcttcct

SEQ ID NO: 7962181 - DNA, 17 bp, Homo sapiens
cagctctgcatcttcct

SEQ ID NO: 7962182 - DNA, 22 bp, Homo sapiens
cagctctgccacttcctagcta

SEQ ID NO: 7962183 - DNA, 22 bp, Homo sapiens
cagctctgccacttcctagcta

SEQ ID NO: 7962184 - DNA, 22 bp, Homo sapiens
cagctctgccacttcctagcta

SEQ ID NO: 7962185 - DNA, 22 bp, Homo sapiens
cagctctgccacttcctagcta

SEQ ID NO: 7962186 - DNA, 20 bp, Homo sapiens
gtggagaggctggcgggact

SEQ ID NO: 7962187 - DNA, 20 bp, Homo sapiens
gtggagaggctggcgggact

SEQ ID NO: 7962188 - DNA, 22 bp, Homo sapiens
gtggagcaatcagagggtcagt

SEQ ID NO: 7962189 - DNA, 22 bp, Homo sapiens
gtggagcaatcagagggtcagt

SEQ ID NO: 7962190 - DNA, 22 bp, Homo sapiens
gtggagcacggaggaggcccct

SEQ ID NO: 7962191 - DNA, 22 bp, Homo sapiens
gtggagcaatcagagggtcagt

SEQ ID NO: 7962192 - DNA, 22 bp, Homo sapiens
gtggagatcctgagtgcatctg

SEQ ID NO: 7962193 - DNA, 22 bp, Homo sapiens
gtggagcaatcagagggtcagt

SEQ ID NO: 7962194 - DNA, 22 bp, Homo sapiens
gtggagcaggactagctgagaa

SEQ ID NO: 7962195 - DNA, 22 bp, Homo sapiens
gtggagcacggaggaggcccct

SEQ ID NO: 7962196 - DNA, 22 bp, Homo sapiens
gtggagcacggaggaggcccct

SEQ ID NO: 7962197 - DNA, 22 bp, Homo sapiens
gtggagcaggactagctgagaa

SEQ ID NO: 7962198 - DNA, 22 bp, Homo sapiens
gtggagcaggactagctgagaa

SEQ ID NO: 7962199 - DNA, 22 bp, Homo sapiens
gtggagcaggactagctgagaa

SEQ ID NO: 7962200 - DNA, 22 bp, Homo sapiens
gtggagcataacacactagcct

SEQ ID NO: 7962201 - DNA, 22 bp, Homo sapiens
gtggagcatgtgaggactgagt

SEQ ID NO: 7962202 - DNA, 22 bp, Homo sapiens
gtggagcatgtgaggactgagt

SEQ ID NO: 7962203 - DNA, 22 bp, Homo sapiens
gtggagcataacacactagcct

SEQ ID NO: 7962204 - DNA, 22 bp, Homo sapiens
gtggagcataacacactagcct

SEQ ID NO: 7962205 - DNA, 22 bp, Homo sapiens
gtggagcaggactagctgagaa

SEQ ID NO: 7962206 - DNA, 22 bp, Homo sapiens
gtggagcatgtgaggactgagt

SEQ ID NO: 7962207 - DNA, 22 bp, Homo sapiens
gtggagcatgtgaggactgagt

SEQ ID NO: 7962208 - DNA, 22 bp, Homo sapiens
gtggagcatgtgaggactgagt

SEQ ID NO: 7962209 - DNA, 23 bp, Homo sapiens
gtggagccacatcacaggctcct

SEQ ID NO: 7962210 - DNA, 22 bp, Homo sapiens
gtggagccaggatctccgcaca

SEQ ID NO: 7962211 - DNA, 22 bp, Homo sapiens
tacactgtgacaatcatgacag

SEQ ID NO: 7962212 - DNA, 22 bp, Homo sapiens
tacactgtgacaatcatgacag

SEQ ID NO: 7962213 - DNA, 22 bp, Homo sapiens
tacactgtgacaatcatgacag

SEQ ID NO: 7962214 - DNA, 22 bp, Homo sapiens
tacactgtgacaatcatgacag

SEQ ID NO: 7962215 - DNA, 22 bp, Homo sapiens
tacactgtcagatttcgattgc

SEQ ID NO: 7962216 - DNA, 22 bp, Homo sapiens
tacactgtcagatttcgattgc

SEQ ID NO: 7962217 - DNA, 22 bp, Homo sapiens
tacactgtaggtggcaggcagc

SEQ ID NO: 7962218 - DNA, 22 bp, Homo sapiens
tacactgtaggtggcaggcagc

SEQ ID NO: 7962219 - DNA, 22 bp, Homo sapiens
tacactggctgttttgcagaaa

SEQ ID NO: 7962220 - DNA, 22 bp, Homo sapiens
tacactgtcagatttcgattgc

SEQ ID NO: 7962221 - DNA, 22 bp, Homo sapiens
tacactgtcttagaaaggggca

SEQ ID NO: 7962222 - DNA, 22 bp, Homo sapiens
tacactgtggtaaactcaaagt

SEQ ID NO: 7962223 - DNA, 22 bp, Homo sapiens
tacactgtggtaaactcaaagt

SEQ ID NO: 7962224 - DNA, 22 bp, Homo sapiens
tacactgtgaggtttccaaggg

SEQ ID NO: 7962225 - DNA, 22 bp, Homo sapiens
tacactgtgacaatcatgacag

SEQ ID NO: 7962226 - DNA, 22 bp, Homo sapiens
tacactgtgaggtttccaaggg

SEQ ID NO: 7962227 - DNA, 22 bp, Homo sapiens
tacactgtgtaaaatgcacttt

SEQ ID NO: 7962228 - DNA, 22 bp, Homo sapiens
tacactgtgtaaaatgcacttt

SEQ ID NO: 7962229 - DNA, 22 bp, Homo sapiens
tacactgtggtaaactcaaagt

SEQ ID NO: 7962230 - DNA, 22 bp, Homo sapiens
tacactgtgtaaaatgcacttt

SEQ ID NO: 7962231 - DNA, 22 bp, Homo sapiens
tacactgtgtaaaatgcacttt

SEQ ID NO: 7962232 - DNA, 22 bp, Homo sapiens
caggccctgccttggcatgtgt

SEQ ID NO: 7962233 - DNA, 22 bp, Homo sapiens
caggccctgccttggcatgtgt

SEQ ID NO: 7962234 - DNA, 22 bp, Homo sapiens
tacactgagcaggaagaagtgg

SEQ ID NO: 7962235 - DNA, 22 bp, Homo sapiens
caggccctgctgctgagacctt

SEQ ID NO: 7962236 - DNA, 22 bp, Homo sapiens
tacactggacaggagtaggaag

SEQ ID NO: 7962237 - DNA, 22 bp, Homo sapiens
tacactgctgctttgcccgtga

SEQ ID NO: 7962238 - DNA, 22 bp, Homo sapiens
tacactggacaggagtaggaag

SEQ ID NO: 7962239 - DNA, 22 bp, Homo sapiens
tacactggctgttttgcagaaa

SEQ ID NO: 7962240 - DNA, 22 bp, Homo sapiens
tacactggggctctgggagtga

SEQ ID NO: 7962241 - DNA, 22 bp, Homo sapiens
tacactggggctctgggagtga

SEQ ID NO: 7962242 - DNA, 22 bp, Homo sapiens
tacactgtacgctctgcttcaa

SEQ ID NO: 7962243 - DNA, 22 bp, Homo sapiens
tacactgtaggtggcaggcagc

SEQ ID NO: 7962244 - DNA, 22 bp, Homo sapiens
tacactggccaaatgcctttgg

SEQ ID NO: 7962245 - DNA, 22 bp, Homo sapiens
tacactggccaaatgcctttgg

SEQ ID NO: 7962246 - DNA, 22 bp, Homo sapiens
tacactggccccagggcggggc

SEQ ID NO: 7962247 - DNA, 22 bp, Homo sapiens
tacactggccccagggcggggc

SEQ ID NO: 7962248 - DNA, 22 bp, Homo sapiens
tacactggattagctgtcctac

SEQ ID NO: 7962249 - DNA, 22 bp, Homo sapiens
tacactggagcccttggggtct

SEQ ID NO: 7962250 - DNA, 22 bp, Homo sapiens
tacactggagcccttggggtct

SEQ ID NO: 7962251 - DNA, 22 bp, Homo sapiens
tacactggattagctgtcctac

SEQ ID NO: 7962252 - DNA, 22 bp, Homo sapiens
tacactttgtgatgccgggagc

SEQ ID NO: 7962253 - DNA, 22 bp, Homo sapiens
tacagacattcaattttgaccc

SEQ ID NO: 7962254 - DNA, 22 bp, Homo sapiens
tacagacattcaattttgaccc

SEQ ID NO: 7962255 - DNA, 22 bp, Homo sapiens
tacagacattcaattttgaccc

SEQ ID NO: 7962256 - DNA, 22 bp, Homo sapiens
tacactttcgtttgtggattag

SEQ ID NO: 7962257 - DNA, 22 bp, Homo sapiens
tacactttcgtttgtggattag

SEQ ID NO: 7962258 - DNA, 22 bp, Homo sapiens
tacacttataactctgtgtgtg

SEQ ID NO: 7962259 - DNA, 22 bp, Homo sapiens
tacactgtttttggaaagaaga

SEQ ID NO: 7962260 - DNA, 22 bp, Homo sapiens
tacactgtgtaaaatgcacttt

SEQ ID NO: 7962261 - DNA, 22 bp, Homo sapiens
tacactgtgtaaaatgcacttt

SEQ ID NO: 7962262 - DNA, 22 bp, Homo sapiens
tacactgtgtaaaatgcacttt

SEQ ID NO: 7962263 - DNA, 22 bp, Homo sapiens
tacactgtttgaactgtggtcg

SEQ ID NO: 7962264 - DNA, 22 bp, Homo sapiens
tacactgtttttggaaagaaga

SEQ ID NO: 7962265 - DNA, 22 bp, Homo sapiens
tacactgtttttggaaagaaga

SEQ ID NO: 7962266 - DNA, 22 bp, Homo sapiens
tacagagaactcatagaaagaa

SEQ ID NO: 7962267 - DNA, 22 bp, Homo sapiens
tacagagaataataggacaggt

SEQ ID NO: 7962268 - DNA, 22 bp, Homo sapiens
tacagagaataataggacaggt

SEQ ID NO: 7962269 - DNA, 22 bp, Homo sapiens
tacagagaataataggacaggt

SEQ ID NO: 7962270 - DNA, 22 bp, Homo sapiens
tacagacatttactccactcct

SEQ ID NO: 7962271 - DNA, 22 bp, Homo sapiens
tacagaccagtagttctcagcg

SEQ ID NO: 7962272 - DNA, 22 bp, Homo sapiens
tacagacatttactccactcct

SEQ ID NO: 7962273 - DNA, 22 bp, Homo sapiens
tacagagaactcatagaaagaa

SEQ ID NO: 7962274 - DNA, 22 bp, Homo sapiens
caggccctcgtggtgagctggg

SEQ ID NO: 7962275 - DNA, 22 bp, Homo sapiens
caggccctcgtggtgagctggg

SEQ ID NO: 7962276 - DNA, 22 bp, Homo sapiens
caggccctcgtggtgagctggg

SEQ ID NO: 7962277 - DNA, 22 bp, Homo sapiens
caggccctcgtggtgagctggg

SEQ ID NO: 7962278 - DNA, 22 bp, Homo sapiens
caggccctcgcccgcagcgacc

SEQ ID NO: 7962279 - DNA, 22 bp, Homo sapiens
caggccctcgcccgcagcgacc

SEQ ID NO: 7962280 - DNA, 22 bp, Homo sapiens
caggccctcgtggtgagctggg

SEQ ID NO: 7962281 - DNA, 22 bp, Homo sapiens
caggccctcaggcaagggctct

SEQ ID NO: 7962282 - DNA, 22 bp, Homo sapiens
caggccctcaggcaagggctct

SEQ ID NO: 7962283 - DNA, 22 bp, Homo sapiens
caggccctcctgtgatctgcct

SEQ ID NO: 7962284 - DNA, 22 bp, Homo sapiens
caggccctcctgtgatctgcct

SEQ ID NO: 7962285 - DNA, 22 bp, Homo sapiens
caggccctcctgtgatctgcct

SEQ ID NO: 7962286 - DNA, 22 bp, Homo sapiens
caggccctcctgtgatctgcct

SEQ ID NO: 7962287 - DNA, 22 bp, Homo sapiens
caggcccaggggtctggcccac

SEQ ID NO: 7962288 - DNA, 22 bp, Homo sapiens
caggccctgcactaggccctgg

SEQ ID NO: 7962289 - DNA, 22 bp, Homo sapiens
caggccctgcacagtggtcctg

SEQ ID NO: 7962290 - DNA, 22 bp, Homo sapiens
caggccctgccttgagggacct

SEQ ID NO: 7962291 - DNA, 22 bp, Homo sapiens
caggccctcgtggtgagctggg

SEQ ID NO: 7962292 - DNA, 22 bp, Homo sapiens
caggccctgcacagtggtcctg

SEQ ID NO: 7962293 - DNA, 22 bp, Homo sapiens
caggccccattcctcttgggac

SEQ ID NO: 7962294 - DNA, 22 bp, Homo sapiens
caggccctcaggcaagggctct

SEQ ID NO: 7962295 - DNA, 22 bp, Homo sapiens
caggcccaggggtctggcccac

SEQ ID NO: 7962296 - DNA, 22 bp, Homo sapiens
caggcccaggggtctggcccac

SEQ ID NO: 7962297 - DNA, 22 bp, Homo sapiens
caggcccaggggtctggcccac

SEQ ID NO: 7962298 - DNA, 22 bp, Homo sapiens
caggccacgccccggcgtgtga

SEQ ID NO: 7962299 - DNA, 22 bp, Homo sapiens
caggcccaggggtctggcccac

SEQ ID NO: 7962300 - DNA, 22 bp, Homo sapiens
caggcccaggggtctggcccac

SEQ ID NO: 7962301 - DNA, 22 bp, Homo sapiens
caggccaccagatacatgcccc

SEQ ID NO: 7962302 - DNA, 22 bp, Homo sapiens
caggccaccagatacatgcccc

SEQ ID NO: 7962303 - DNA, 22 bp, Homo sapiens
caggccacgccccggcgtgtga

SEQ ID NO: 7962304 - DNA, 22 bp, Homo sapiens
caggccacacggcggctccctg

SEQ ID NO: 7962305 - DNA, 22 bp, Homo sapiens
caggccacacggcggctccctg

SEQ ID NO: 7962306 - DNA, 22 bp, Homo sapiens
caggccacagctaaagaggatt

SEQ ID NO: 7962307 - DNA, 22 bp, Homo sapiens
caggccacagctaaagaggatt

SEQ ID NO: 7962308 - DNA, 22 bp, Homo sapiens
caggccacagctaaagaggatt

SEQ ID NO: 7962309 - DNA, 22 bp, Homo sapiens
caggccaccagatacatgcccc

SEQ ID NO: 7962310 - DNA, 22 bp, Homo sapiens
caggccaccagatacatgcccc

SEQ ID NO: 7962311 - DNA, 22 bp, Homo sapiens
caggccaccagatacatgcccc

SEQ ID NO: 7962312 - DNA, 22 bp, Homo sapiens
caggccacaagttgggttcaag

SEQ ID NO: 7962313 - DNA, 22 bp, Homo sapiens
caggccaatatcacatgctatg

SEQ ID NO: 7962314 - DNA, 22 bp, Homo sapiens
caggccaatatcacatgctatg

SEQ ID NO: 7962315 - DNA, 22 bp, Homo sapiens
caggccaatatcacatgctatg

SEQ ID NO: 7962316 - DNA, 22 bp, Homo sapiens
caggcctgtgagttgaggcccc

SEQ ID NO: 7962317 - DNA, 22 bp, Homo sapiens
caggcctgtgacaccgtgtctg

SEQ ID NO: 7962318 - DNA, 22 bp, Homo sapiens
caggcctgtgacaccgtgtctg

SEQ ID NO: 7962319 - DNA, 22 bp, Homo sapiens
caggcctgtctgcacatgaggc

SEQ ID NO: 7962320 - DNA, 22 bp, Homo sapiens
caggcctgtgacaccgtgtctg

SEQ ID NO: 7962321 - DNA, 22 bp, Homo sapiens
caggcctgtgacaccgtgtctg

SEQ ID NO: 7962322 - DNA, 22 bp, Homo sapiens
caggcctgtgagttgaggcccc

SEQ ID NO: 7962323 - DNA, 22 bp, Homo sapiens
caggcctgtgagttgaggcccc

SEQ ID NO: 7962324 - DNA, 22 bp, Homo sapiens
caggcctgtgagttgaggcccc

SEQ ID NO: 7962325 - DNA, 22 bp, Homo sapiens
caggcctgtgagttgaggcccc

SEQ ID NO: 7962326 - DNA, 22 bp, Homo sapiens
caggccttaaggactcggagaa

SEQ ID NO: 7962327 - DNA, 22 bp, Homo sapiens
caggcctgtctgcacatgaggc

SEQ ID NO: 7962328 - DNA, 22 bp, Homo sapiens
caggcctggagtgcaatggcac

SEQ ID NO: 7962329 - DNA, 22 bp, Homo sapiens
caggcctggagtgcaatggcac

SEQ ID NO: 7962330 - DNA, 22 bp, Homo sapiens
caggcctggagtgcaatggcac

SEQ ID NO: 7962331 - DNA, 22 bp, Homo sapiens
tacagctgagtttaggtacagg

SEQ ID NO: 7962332 - DNA, 22 bp, Homo sapiens
tacagctgagtttaggtacagg

SEQ ID NO: 7962333 - DNA, 22 bp, Homo sapiens
tacagctgcaagggtttctggg

SEQ ID NO: 7962334 - DNA, 23 bp, Homo sapiens
tacagctgcagaatcaggctaag

SEQ ID NO: 7962335 - DNA, 22 bp, Homo sapiens
tacagctgctggtgctccatgc

SEQ ID NO: 7962336 - DNA, 22 bp, Homo sapiens
tacagctgctggtgctccatgc

SEQ ID NO: 7962337 - DNA, 22 bp, Homo sapiens
tacagctggactggtagctgtg

SEQ ID NO: 7962338 - DNA, 22 bp, Homo sapiens
caggcctggagtgcaatggcac

SEQ ID NO: 7962339 - DNA, 17 bp, Homo sapiens
caggccttgagccttta

SEQ ID NO: 7962340 - DNA, 22 bp, Homo sapiens
caggccttgagttttgggcttt

SEQ ID NO: 7962341 - DNA, 17 bp, Homo sapiens
caggccttgagccttta

SEQ ID NO: 7962342 - DNA, 22 bp, Homo sapiens
caggccttgaaggcctgcggga

SEQ ID NO: 7962343 - DNA, 22 bp, Homo sapiens
caggccttgaaggcctgcggga

SEQ ID NO: 7962344 - DNA, 22 bp, Homo sapiens
caggccttgaaggcctgcggga

SEQ ID NO: 7962345 - DNA, 22 bp, Homo sapiens
caggccttgaaggcctgcggga

SEQ ID NO: 7962346 - DNA, 22 bp, Homo sapiens
caggccttctccctccctcaac

SEQ ID NO: 7962347 - DNA, 22 bp, Homo sapiens
caggccttctccctccctcaac

SEQ ID NO: 7962348 - DNA, 20 bp, Homo sapiens
caggccttcaggatggctgg

SEQ ID NO: 7962349 - DNA, 22 bp, Homo sapiens
caggccttatctccaccctgca

SEQ ID NO: 7962350 - DNA, 22 bp, Homo sapiens
caggccttatctccaccctgca

SEQ ID NO: 7962351 - DNA, 22 bp, Homo sapiens
caggccttagtaggtgctccct

SEQ ID NO: 7962352 - DNA, 22 bp, Homo sapiens
caggccttaaggactcggagaa

SEQ ID NO: 7962353 - DNA, 22 bp, Homo sapiens
caggccttagtaggtgctccct

SEQ ID NO: 7962354 - DNA, 17 bp, Homo sapiens
tacagttagaatctgga

SEQ ID NO: 7962355 - DNA, 17 bp, Homo sapiens
tacagttagaatctgga

SEQ ID NO: 7962356 - DNA, 22 bp, Homo sapiens
tacagttactttgaaaattgat

SEQ ID NO: 7962357 - DNA, 22 bp, Homo sapiens
caggccttgggagagggtagat

SEQ ID NO: 7962358 - DNA, 22 bp, Homo sapiens
caggccttgggacccagactgg

SEQ ID NO: 7962359 - DNA, 22 bp, Homo sapiens
caggccttgggacccagactgg

SEQ ID NO: 7962360 - DNA, 22 bp, Homo sapiens
caggccttgggacacccttcac

SEQ ID NO: 7962361 - DNA, 22 bp, Homo sapiens
caggccttgcgtcccatggcct

SEQ ID NO: 7962362 - DNA, 22 bp, Homo sapiens
caggccttgcgtcccatggcct

SEQ ID NO: 7962363 - DNA, 22 bp, Homo sapiens
caggccttgcagtctgttgtaa

SEQ ID NO: 7962364 - DNA, 22 bp, Homo sapiens
caggccttgagttttgggcttt

SEQ ID NO: 7962365 - DNA, 22 bp, Homo sapiens
caggccttgagttttgggcttt

SEQ ID NO: 7962366 - DNA, 22 bp, Homo sapiens
tacagagacccacaagagactg

SEQ ID NO: 7962367 - DNA, 22 bp, Homo sapiens
tacagagacccacaagagactg

SEQ ID NO: 7962368 - DNA, 22 bp, Homo sapiens
tacagagacccacaagagactg

SEQ ID NO: 7962369 - DNA, 22 bp, Homo sapiens
tacagagacccacaagagactg

SEQ ID NO: 7962370 - DNA, 22 bp, Homo sapiens
tacagagactttatggcacaaa

SEQ ID NO: 7962371 - DNA, 22 bp, Homo sapiens
tacagagactttatggcacaaa

SEQ ID NO: 7962372 - DNA, 22 bp, Homo sapiens
tacagagagataagtgtaaaag

SEQ ID NO: 7962373 - DNA, 22 bp, Homo sapiens
tacagagagaggggttaccagg

SEQ ID NO: 7962374 - DNA, 22 bp, Homo sapiens
tacagagagaggggttaccagg

SEQ ID NO: 7962375 - DNA, 22 bp, Homo sapiens
tacagagagtacagcatccaca

SEQ ID NO: 7962376 - DNA, 22 bp, Homo sapiens
tacagagagtacagcatccaca

SEQ ID NO: 7962377 - DNA, 22 bp, Homo sapiens
tacagagaggtgacccttgggc

SEQ ID NO: 7962378 - DNA, 22 bp, Homo sapiens
tacagagaggtgacccttgggc

SEQ ID NO: 7962379 - DNA, 22 bp, Homo sapiens
tacagagagctccggacattca

SEQ ID NO: 7962380 - DNA, 22 bp, Homo sapiens
tacagcagggcgctgtgatgaa

SEQ ID NO: 7962381 - DNA, 22 bp, Homo sapiens
tacagcatatacagaatgaaca

SEQ ID NO: 7962382 - DNA, 22 bp, Homo sapiens
tacagcagggcgctgtgatgaa

SEQ ID NO: 7962383 - DNA, 22 bp, Homo sapiens
tacagcagggcgctgtgatgaa

SEQ ID NO: 7962384 - DNA, 22 bp, Homo sapiens
tacagagagtacagcatccaca

SEQ ID NO: 7962385 - DNA, 22 bp, Homo sapiens
tacagcagcccaccttcttctg

SEQ ID NO: 7962386 - DNA, 23 bp, Homo sapiens
tacagccatgtcgctgatttaac

SEQ ID NO: 7962387 - DNA, 22 bp, Homo sapiens
tacagcctccacaggccaagtg

SEQ ID NO: 7962388 - DNA, 22 bp, Homo sapiens
tacagcctcatcacgggagctg

SEQ ID NO: 7962389 - DNA, 20 bp, Homo sapiens
tacagcccctgcttctgttg

SEQ ID NO: 7962390 - DNA, 20 bp, Homo sapiens
tacagcctattcaccacata

SEQ ID NO: 7962391 - DNA, 22 bp, Homo sapiens
tacagcattttgtagagtacta

SEQ ID NO: 7962392 - DNA, 22 bp, Homo sapiens
tacagcattgtgtcttcactca

SEQ ID NO: 7962393 - DNA, 22 bp, Homo sapiens
tacagccatcatgtatgtatat

SEQ ID NO: 7962394 - DNA, 22 bp, Homo sapiens
tacagccacggtctatggaggc

SEQ ID NO: 7962395 - DNA, 22 bp, Homo sapiens
tacagcattgtgtcttcactca

SEQ ID NO: 7962396 - DNA, 22 bp, Homo sapiens
tacagcatgtccttagcaaggc

SEQ ID NO: 7962397 - DNA, 22 bp, Homo sapiens
tacagctagagggcacgtgaac

SEQ ID NO: 7962398 - DNA, 22 bp, Homo sapiens
tacagctaggcaaaaatgacat

SEQ ID NO: 7962399 - DNA, 22 bp, Homo sapiens
tacagctcagaacctcactgtc

SEQ ID NO: 7962400 - DNA, 22 bp, Homo sapiens
tacagctcagaacctcactgtc

SEQ ID NO: 7962401 - DNA, 21 bp, Homo sapiens
tacagctcggcagataaagcc

SEQ ID NO: 7962402 - DNA, 22 bp, Homo sapiens
tacagctcccggggagcttcgt

SEQ ID NO: 7962403 - DNA, 22 bp, Homo sapiens
tacagctccaaaaatcactgtt

SEQ ID NO: 7962404 - DNA, 22 bp, Homo sapiens
tacagcctcgaactcctgcatt

SEQ ID NO: 7962405 - DNA, 22 bp, Homo sapiens
tacagcctcgaactcctgcatt

SEQ ID NO: 7962406 - DNA, 22 bp, Homo sapiens
tacagcctgttacctatatttg

SEQ ID NO: 7962407 - DNA, 22 bp, Homo sapiens
tacagccttcatctttgccttg

SEQ ID NO: 7962408 - DNA, 22 bp, Homo sapiens
tacagccttcatctttgccttg

SEQ ID NO: 7962409 - DNA, 22 bp, Homo sapiens
tacagccttcatctttgccttg

SEQ ID NO: 7962410 - DNA, 22 bp, Homo sapiens
tacagttatatgtgataagtaa

SEQ ID NO: 7962411 - DNA, 22 bp, Homo sapiens
tacagttccaggatcatagggt

SEQ ID NO: 7962412 - DNA, 22 bp, Homo sapiens
tacagttcctctcgtggaggtg

SEQ ID NO: 7962413 - DNA, 22 bp, Homo sapiens
tacagttcctctcgtggaggtg

SEQ ID NO: 7962414 - DNA, 22 bp, Homo sapiens
tacagtttacatgagaggaagc

SEQ ID NO: 7962415 - DNA, 22 bp, Homo sapiens
tacagtttacatgagaggaagc

SEQ ID NO: 7962416 - DNA, 22 bp, Homo sapiens
tacagtttacatgagaggaagc

SEQ ID NO: 7962417 - DNA, 22 bp, Homo sapiens
tacagtttaacactttggagaa

SEQ ID NO: 7962418 - DNA, 22 bp, Homo sapiens
tacagttctttgaaggatctag

SEQ ID NO: 7962419 - DNA, 22 bp, Homo sapiens
tacagtttctcattatgctctc

SEQ ID NO: 7962420 - DNA, 22 bp, Homo sapiens
tacagtttagaaccatagatgg

SEQ ID NO: 7962421 - DNA, 22 bp, Homo sapiens
tacagtttagaaccatagatgg

SEQ ID NO: 7962422 - DNA, 22 bp, Homo sapiens
tacagtttcccagcagatgcaa

SEQ ID NO: 7962423 - DNA, 22 bp, Homo sapiens
tacagtttgtatggtcaggaat

SEQ ID NO: 7962424 - DNA, 22 bp, Homo sapiens
tacagtttgtatggtcaggaat

SEQ ID NO: 7962425 - DNA, 22 bp, Homo sapiens
caggctcaaggctgacttccat

SEQ ID NO: 7962426 - DNA, 22 bp, Homo sapiens
tacagtttgtatggtcaggaat

SEQ ID NO: 7962427 - DNA, 22 bp, Homo sapiens
caggctcaaggctgacttccat

SEQ ID NO: 7962428 - DNA, 22 bp, Homo sapiens
caggctcaatggccacttgggc

SEQ ID NO: 7962429 - DNA, 22 bp, Homo sapiens
caggctcactgtaaggtcagct

SEQ ID NO: 7962430 - DNA, 22 bp, Homo sapiens
caggctccagcttcctgctcag

SEQ ID NO: 7962431 - DNA, 22 bp, Homo sapiens
caggctccagcttcctgctcag

SEQ ID NO: 7962432 - DNA, 22 bp, Homo sapiens
caggctccactgtaggcagctc

SEQ ID NO: 7962433 - DNA, 22 bp, Homo sapiens
caggctccattaatcatcctgc

SEQ ID NO: 7962434 - DNA, 22 bp, Homo sapiens
caggctccagcttcctgctcag

SEQ ID NO: 7962435 - DNA, 22 bp, Homo sapiens
caggctcccaccctcctgcagc

SEQ ID NO: 7962436 - DNA, 22 bp, Homo sapiens
caggctcccaccctcctgcagc

SEQ ID NO: 7962437 - DNA, 22 bp, Homo sapiens
caggctcccacaagctcccagc

SEQ ID NO: 7962438 - DNA, 22 bp, Homo sapiens
caggctcccacaagctcccagc

SEQ ID NO: 7962439 - DNA, 22 bp, Homo sapiens
caggctccattaatcatcctgc

SEQ ID NO: 7962440 - DNA, 22 bp, Homo sapiens
caggctcccgaaatcacccatg

SEQ ID NO: 7962441 - DNA, 22 bp, Homo sapiens
caggctcccgctccactgggca

SEQ ID NO: 7962442 - DNA, 22 bp, Homo sapiens
caggctcccgctccactgggca

SEQ ID NO: 7962443 - DNA, 22 bp, Homo sapiens
caggctcccgaaatcacccatg

SEQ ID NO: 7962444 - DNA, 22 bp, Homo sapiens
caggctcccaccctcctgcagc

SEQ ID NO: 7962445 - DNA, 22 bp, Homo sapiens
caggctcccaccctcctgcagc

SEQ ID NO: 7962446 - DNA, 22 bp, Homo sapiens
caggctccctgggcagtggcag

SEQ ID NO: 7962447 - DNA, 22 bp, Homo sapiens
caggctccctgggcagtggcag

SEQ ID NO: 7962448 - DNA, 22 bp, Homo sapiens
caggctccctgggcagtggcag

SEQ ID NO: 7962449 - DNA, 22 bp, Homo sapiens
caggctccctgggcagtggcag

SEQ ID NO: 7962450 - DNA, 22 bp, Homo sapiens
caggctccctgggcagtggcag

SEQ ID NO: 7962451 - DNA, 22 bp, Homo sapiens
caggctccctgggcagtggcag

SEQ ID NO: 7962452 - DNA, 20 bp, Homo sapiens
caggctccgcaggactaggg

SEQ ID NO: 7962453 - DNA, 20 bp, Homo sapiens
caggctccgcaggactaggg

SEQ ID NO: 7962454 - DNA, 22 bp, Homo sapiens
caggctccctgcaggccagtga

SEQ ID NO: 7962455 - DNA, 22 bp, Homo sapiens
caggctccctgcaggccagtga

SEQ ID NO: 7962456 - DNA, 22 bp, Homo sapiens
caggctccctgccagggccggc

SEQ ID NO: 7962457 - DNA, 22 bp, Homo sapiens
caggctccctgccagggccggc

SEQ ID NO: 7962458 - DNA, 22 bp, Homo sapiens
caggctccctgccagggccggc

SEQ ID NO: 7962459 - DNA, 22 bp, Homo sapiens
caggctccctgccagggccggc

SEQ ID NO: 7962460 - DNA, 22 bp, Homo sapiens
caggctccctgggcagtggcag

SEQ ID NO: 7962461 - DNA, 22 bp, Homo sapiens
caggctccctgggcagtggcag

SEQ ID NO: 7962462 - DNA, 22 bp, Homo sapiens
caggctccctgccagggccggc

SEQ ID NO: 7962463 - DNA, 22 bp, Homo sapiens
caggctccctaagtcagcagcc

SEQ ID NO: 7962464 - DNA, 22 bp, Homo sapiens
caggctccctaagtcagcagcc

SEQ ID NO: 7962465 - DNA, 22 bp, Homo sapiens
caggctccctaagtcagcagcc

SEQ ID NO: 7962466 - DNA, 22 bp, Homo sapiens
caggctccctaagtcagcagcc

SEQ ID NO: 7962467 - DNA, 22 bp, Homo sapiens
caggctccctgcaggccagtga

SEQ ID NO: 7962468 - DNA, 22 bp, Homo sapiens
caggctccctgcaggccagtga

SEQ ID NO: 7962469 - DNA, 22 bp, Homo sapiens
caggctccctgcaggccagtga

SEQ ID NO: 7962470 - DNA, 22 bp, Homo sapiens
caggctcccgctccactgggca

SEQ ID NO: 7962471 - DNA, 22 bp, Homo sapiens
caggctcccgctccactgggca

SEQ ID NO: 7962472 - DNA, 23 bp, Homo sapiens
caggctcccggaccaggatccgc

SEQ ID NO: 7962473 - DNA, 23 bp, Homo sapiens
caggctcccggaccaggatccgc

SEQ ID NO: 7962474 - DNA, 23 bp, Homo sapiens
caggctcccggaccaggatccgc

SEQ ID NO: 7962475 - DNA, 23 bp, Homo sapiens
caggctcccggaccaggatccgc

SEQ ID NO: 7962476 - DNA, 23 bp, Homo sapiens
caggctcccggaccaggatccgc

SEQ ID NO: 7962477 - DNA, 23 bp, Homo sapiens
caggctcccggaccaggatccgc

SEQ ID NO: 7962478 - DNA, 17 bp, Homo sapiens
caggctccttccagatt

SEQ ID NO: 7962479 - DNA, 22 bp, Homo sapiens
caggctccttcccagggatggt

SEQ ID NO: 7962480 - DNA, 22 bp, Homo sapiens
caggctccttatcttacaactt

SEQ ID NO: 7962481 - DNA, 22 bp, Homo sapiens
caggctcctcactcatgctccc

SEQ ID NO: 7962482 - DNA, 20 bp, Homo sapiens
caggctccgcaggactaggg

SEQ ID NO: 7962483 - DNA, 20 bp, Homo sapiens
caggctccgcaggactaggg

SEQ ID NO: 7962484 - DNA, 22 bp, Homo sapiens
caggctcctcactcatgctccc

SEQ ID NO: 7962485 - DNA, 20 bp, Homo sapiens
caggctccgcaggactaggg

SEQ ID NO: 7962486 - DNA, 22 bp, Homo sapiens
caggctcctcactcatgctccc

SEQ ID NO: 7962487 - DNA, 22 bp, Homo sapiens
caggctccttcccagggatggt

SEQ ID NO: 7962488 - DNA, 22 bp, Homo sapiens
caggctccttcccagggatggt

SEQ ID NO: 7962489 - DNA, 22 bp, Homo sapiens
caggctccttcccagggatggt

SEQ ID NO: 7962490 - DNA, 22 bp, Homo sapiens
caggctcggaagtgctggcttt

SEQ ID NO: 7962491 - DNA, 22 bp, Homo sapiens
caggctctaggttagtaggaga

SEQ ID NO: 7962492 - DNA, 22 bp, Homo sapiens
caggctctaggttagtaggaga

SEQ ID NO: 7962493 - DNA, 22 bp, Homo sapiens
caggctctaggttagtaggaga

SEQ ID NO: 7962494 - DNA, 21 bp, Homo sapiens
caggctctgctagaggagcct

SEQ ID NO: 7962495 - DNA, 22 bp, Homo sapiens
caggctctaggttagtaggaga

SEQ ID NO: 7962496 - DNA, 21 bp, Homo sapiens
caggctctgctagaggagcct

SEQ ID NO: 7962497 - DNA, 22 bp, Homo sapiens
tatatacaaggtaggtttaggt

SEQ ID NO: 7962498 - DNA, 22 bp, Homo sapiens
tatatagaaaagcagatgttgg

SEQ ID NO: 7962499 - DNA, 22 bp, Homo sapiens
tatatagaaaagcagatgttgg

SEQ ID NO: 7962500 - DNA, 22 bp, Homo sapiens
tatatactttcttcctgggtag

SEQ ID NO: 7962501 - DNA, 22 bp, Homo sapiens
tatatagctaaaagagatattg

SEQ ID NO: 7962502 - DNA, 19 bp, Homo sapiens
tatatagatgtgtgtgtat

SEQ ID NO: 7962503 - DNA, 18 bp, Homo sapiens
tatatagagaaacccatt

SEQ ID NO: 7962504 - DNA, 22 bp, Homo sapiens
tatatagaaaagcagatgttgg

SEQ ID NO: 7962505 - DNA, 22 bp, Homo sapiens
tatatagaaaagcagatgttgg

SEQ ID NO: 7962506 - DNA, 22 bp, Homo sapiens
tatattcatattgttgtctctc

SEQ ID NO: 7962507 - DNA, 22 bp, Homo sapiens
tatattcattttaaagccatct

SEQ ID NO: 7962508 - DNA, 22 bp, Homo sapiens
tatatatatgcacacacaccta

SEQ ID NO: 7962509 - DNA, 22 bp, Homo sapiens
tatatatatgcacacacaccta

SEQ ID NO: 7962510 - DNA, 22 bp, Homo sapiens
tatattcaatgattagtatcag

SEQ ID NO: 7962511 - DNA, 22 bp, Homo sapiens
tatatacaaggtaggtttaggt

SEQ ID NO: 7962512 - DNA, 22 bp, Homo sapiens
tatatacaaggtaggtttaggt

SEQ ID NO: 7962513 - DNA, 22 bp, Homo sapiens
tatatacaaggtaggtttaggt

SEQ ID NO: 7962514 - DNA, 22 bp, Homo sapiens
tatatacaaggtaggtttaggt

SEQ ID NO: 7962515 - DNA, 22 bp, Homo sapiens
tatatacaaggtaggtttaggt

SEQ ID NO: 7962516 - DNA, 22 bp, Homo sapiens
tatataattttctgccatatcc

SEQ ID NO: 7962517 - DNA, 22 bp, Homo sapiens
tatataattttctgccatatcc

SEQ ID NO: 7962518 - DNA, 22 bp, Homo sapiens
tatataattttctgccatatcc

SEQ ID NO: 7962519 - DNA, 22 bp, Homo sapiens
tatataatttgtaaaagcacct

SEQ ID NO: 7962520 - DNA, 22 bp, Homo sapiens
tatataatttgtaaaagcacct

SEQ ID NO: 7962521 - DNA, 22 bp, Homo sapiens
tatataactactattttgctca

SEQ ID NO: 7962522 - DNA, 22 bp, Homo sapiens
tagttttagtcccattttacag

SEQ ID NO: 7962523 - DNA, 21 bp, Homo sapiens
tatacatgtgcacacacatgc

SEQ ID NO: 7962524 - DNA, 21 bp, Homo sapiens
tatacatgtgtgcatacgtgt

SEQ ID NO: 7962525 - DNA, 22 bp, Homo sapiens
tagttttagcagcaatgggatg

SEQ ID NO: 7962526 - DNA, 22 bp, Homo sapiens
tagttttagtcccattttacag

SEQ ID NO: 7962527 - DNA, 22 bp, Homo sapiens
tagttttagtcccattttacag

SEQ ID NO: 7962528 - DNA, 22 bp, Homo sapiens
tatacatcagtatgtttagata

SEQ ID NO: 7962529 - DNA, 22 bp, Homo sapiens
tagttttacttgcgatgataat

SEQ ID NO: 7962530 - DNA, 22 bp, Homo sapiens
tagttttacttgcgatgataat

SEQ ID NO: 7962531 - DNA, 22 bp, Homo sapiens
tagttttacttgcgatgataat

SEQ ID NO: 7962532 - DNA, 22 bp, Homo sapiens
tagttttacttgcgatgataat

SEQ ID NO: 7962533 - DNA, 22 bp, Homo sapiens
tagttttacatcagccattgtt

SEQ ID NO: 7962534 - DNA, 22 bp, Homo sapiens
tagttttacttgcgatgataat

SEQ ID NO: 7962535 - DNA, 22 bp, Homo sapiens
tagttttagcagcaatgggatg

SEQ ID NO: 7962536 - DNA, 22 bp, Homo sapiens
tagttttacttgcgatgataat

SEQ ID NO: 7962537 - DNA, 22 bp, Homo sapiens
tagttttacatcagccattgtt

SEQ ID NO: 7962538 - DNA, 22 bp, Homo sapiens
tagtttgtagaaatctagaaat

SEQ ID NO: 7962539 - DNA, 22 bp, Homo sapiens
tagtttctttcacgtagtaata

SEQ ID NO: 7962540 - DNA, 22 bp, Homo sapiens
tagtttcttcacctgtaaaatg

SEQ ID NO: 7962541 - DNA, 22 bp, Homo sapiens
tagtttctggttcttgctctgg

SEQ ID NO: 7962542 - DNA, 22 bp, Homo sapiens
tagtttctggttcttgctctgg

SEQ ID NO: 7962543 - DNA, 22 bp, Homo sapiens
tagtttcttgattagccacttt

SEQ ID NO: 7962544 - DNA, 22 bp, Homo sapiens
tagtttcttcacctgtaaaatg

SEQ ID NO: 7962545 - DNA, 22 bp, Homo sapiens
tagtttcttcacctgtaaaatg

SEQ ID NO: 7962546 - DNA, 22 bp, Homo sapiens
tagtttctgaggattgaaagat

SEQ ID NO: 7962547 - DNA, 22 bp, Homo sapiens
tagtttctgaggattgaaagat

SEQ ID NO: 7962548 - DNA, 22 bp, Homo sapiens
tagtttctgaggattgaaagat

SEQ ID NO: 7962549 - DNA, 22 bp, Homo sapiens
tagtttctgggttggcttctac

SEQ ID NO: 7962550 - DNA, 22 bp, Homo sapiens
tagtttctgcctcggaagctga

SEQ ID NO: 7962551 - DNA, 22 bp, Homo sapiens
tagtttctcagggaggaaagaa

SEQ ID NO: 7962552 - DNA, 22 bp, Homo sapiens
tagtttctgaggattgaaagat

SEQ ID NO: 7962553 - DNA, 22 bp, Homo sapiens
tagtttctcagggaggaaagaa

SEQ ID NO: 7962554 - DNA, 22 bp, Homo sapiens
tagtttctagtcaatcttcttt

SEQ ID NO: 7962555 - DNA, 22 bp, Homo sapiens
tagtttctagtaacaaacccat

SEQ ID NO: 7962556 - DNA, 22 bp, Homo sapiens
tagtttctagtcaatcttcttt

SEQ ID NO: 7962557 - DNA, 22 bp, Homo sapiens
tagtttctagacagtaagaatt

SEQ ID NO: 7962558 - DNA, 22 bp, Homo sapiens
tagtgttctaagaacatccatg

SEQ ID NO: 7962559 - DNA, 22 bp, Homo sapiens
tagtgtgtggtctctcccttgt

SEQ ID NO: 7962560 - DNA, 22 bp, Homo sapiens
tagtgttaattcagtttataat

SEQ ID NO: 7962561 - DNA, 22 bp, Homo sapiens
tagtgtgtccctggggagtgtt

SEQ ID NO: 7962562 - DNA, 22 bp, Homo sapiens
tagtgtggtaaataaatgtttt

SEQ ID NO: 7962563 - DNA, 22 bp, Homo sapiens
tagtgtggccccaagaggatct

SEQ ID NO: 7962564 - DNA, 22 bp, Homo sapiens
tagtgtggtatcttctatggaa

SEQ ID NO: 7962565 - DNA, 22 bp, Homo sapiens
tagtgtcttccaggacatggta

SEQ ID NO: 7962566 - DNA, 22 bp, Homo sapiens
tagtgtggccccaagaggatct

SEQ ID NO: 7962567 - DNA, 22 bp, Homo sapiens
tagtgtcttcaggagatatgag

SEQ ID NO: 7962568 - DNA, 22 bp, Homo sapiens
tagtgtctgtccatcagtaact

SEQ ID NO: 7962569 - DNA, 22 bp, Homo sapiens
tagtgtctgtccatcagtaact

SEQ ID NO: 7962570 - DNA, 22 bp, Homo sapiens
tagtgtctgttgcttttgttca

SEQ ID NO: 7962571 - DNA, 21 bp, Homo sapiens
tagtgtcttaagagccttgca

SEQ ID NO: 7962572 - DNA, 22 bp, Homo sapiens
tagtgtctgacatttaagagca

SEQ ID NO: 7962573 - DNA, 22 bp, Homo sapiens
tagtgtctgatccgtagttaca

SEQ ID NO: 7962574 - DNA, 22 bp, Homo sapiens
tagtacagtggcattcaaactt

SEQ ID NO: 7962575 - DNA, 22 bp, Homo sapiens
tagtacagtggagagcaaagaa

SEQ ID NO: 7962576 - DNA, 22 bp, Homo sapiens
tagtacagtggagagcaaagaa

SEQ ID NO: 7962577 - DNA, 22 bp, Homo sapiens
tagtacagtggagagcaaagaa

SEQ ID NO: 7962578 - DNA, 22 bp, Homo sapiens
tagtacagtactgggctctagt

SEQ ID NO: 7962579 - DNA, 22 bp, Homo sapiens
tagtacagagacactggaggaa

SEQ ID NO: 7962580 - DNA, 22 bp, Homo sapiens
tagtacagagacactggaggaa

SEQ ID NO: 7962581 - DNA, 22 bp, Homo sapiens
tagtacagaattaataattgtg

SEQ ID NO: 7962582 - DNA, 22 bp, Homo sapiens
tagtacagaattaataattgtg

SEQ ID NO: 7962583 - DNA, 22 bp, Homo sapiens
tagtacagaaaacctcagggtc

SEQ ID NO: 7962584 - DNA, 22 bp, Homo sapiens
tagtacactctgtaagtttaaa

SEQ ID NO: 7962585 - DNA, 22 bp, Homo sapiens
tagtacactctgtaagtttaaa

SEQ ID NO: 7962586 - DNA, 22 bp, Homo sapiens
tagtaatcagaggtaaacttta

SEQ ID NO: 7962587 - DNA, 19 bp, Homo sapiens
tagtacacactctaattcc

SEQ ID NO: 7962588 - DNA, 19 bp, Homo sapiens
tagtacacactctaattcc

SEQ ID NO: 7962589 - DNA, 19 bp, Homo sapiens
tagtacaaaagcagccata

SEQ ID NO: 7962590 - DNA, 22 bp, Homo sapiens
tagtacaactcacttgatttta

SEQ ID NO: 7962591 - DNA, 22 bp, Homo sapiens
tagtacagttccatcaaagcag

SEQ ID NO: 7962592 - DNA, 22 bp, Homo sapiens
cagggctgagaatttagagaca

SEQ ID NO: 7962593 - DNA, 22 bp, Homo sapiens
cagggctgaggacacaagtaaa

SEQ ID NO: 7962594 - DNA, 22 bp, Homo sapiens
cagggctgaggacacaagtaaa

SEQ ID NO: 7962595 - DNA, 22 bp, Homo sapiens
cagggctgaggacacaagtaaa

SEQ ID NO: 7962596 - DNA, 22 bp, Homo sapiens
cagggctgagtcatatagcctt

SEQ ID NO: 7962597 - DNA, 22 bp, Homo sapiens
cagggctgagtcatatagcctt

SEQ ID NO: 7962598 - DNA, 22 bp, Homo sapiens
cagggctgaggacacaagtaaa

SEQ ID NO: 7962599 - DNA, 22 bp, Homo sapiens
cagggctgagtcatatagcctt

SEQ ID NO: 7962600 - DNA, 22 bp, Homo sapiens
cagggctgagtcatatagcctt

SEQ ID NO: 7962601 - DNA, 22 bp, Homo sapiens
cagggctgctggccgtgccctc

SEQ ID NO: 7962602 - DNA, 22 bp, Homo sapiens
cagggctggatcctccagactc

SEQ ID NO: 7962603 - DNA, 22 bp, Homo sapiens
cagggctggatttcatttctag

SEQ ID NO: 7962604 - DNA, 22 bp, Homo sapiens
tagtgattgctgatattccatt

SEQ ID NO: 7962605 - DNA, 22 bp, Homo sapiens
tagtgatttagaattcaaatgt

SEQ ID NO: 7962606 - DNA, 23 bp, Homo sapiens
tagtgattggaaaaactagtttt

SEQ ID NO: 7962607 - DNA, 22 bp, Homo sapiens
tagtgattttcatattacatta

SEQ ID NO: 7962608 - DNA, 22 bp, Homo sapiens
tagtgtctagtgagtttgatgc

SEQ ID NO: 7962609 - DNA, 22 bp, Homo sapiens
tagtgtctattgaccggaaaga

SEQ ID NO: 7962610 - DNA, 22 bp, Homo sapiens
tagtgtctcggggcccaggatt

SEQ ID NO: 7962611 - DNA, 22 bp, Homo sapiens
tagtgtctcttcctgtttgaaa

SEQ ID NO: 7962612 - DNA, 22 bp, Homo sapiens
tagtgtctgaatgcacctgttt

SEQ ID NO: 7962613 - DNA, 22 bp, Homo sapiens
cagggctgctggccgtgccctc

SEQ ID NO: 7962614 - DNA, 22 bp, Homo sapiens
cagggctgctggccgtgccctc

SEQ ID NO: 7962615 - DNA, 22 bp, Homo sapiens
cagggctggatcctccagactc

SEQ ID NO: 7962616 - DNA, 22 bp, Homo sapiens
cagggctgctggccgtgccctc

SEQ ID NO: 7962617 - DNA, 22 bp, Homo sapiens
cagggctgctggccgtgccctc

SEQ ID NO: 7962618 - DNA, 22 bp, Homo sapiens
cagggctggatcctccagactc

SEQ ID NO: 7962619 - DNA, 22 bp, Homo sapiens
cagggctggatcctccagactc

SEQ ID NO: 7962620 - DNA, 22 bp, Homo sapiens
cagggctggatcctccagactc

SEQ ID NO: 7962621 - DNA, 22 bp, Homo sapiens
cagggctggatcctccagactc

SEQ ID NO: 7962622 - DNA, 22 bp, Homo sapiens
taggtagtttcctgttgttggg

SEQ ID NO: 7962623 - DNA, 22 bp, Homo sapiens
tagtaaatctcagaaaaagatc

SEQ ID NO: 7962624 - DNA, 22 bp, Homo sapiens
tagtaaatctcagaaaaagatc

SEQ ID NO: 7962625 - DNA, 22 bp, Homo sapiens
tagtaaatctcagaaaaagatc

SEQ ID NO: 7962626 - DNA, 22 bp, Homo sapiens
taggtataggattctaggttgg

SEQ ID NO: 7962627 - DNA, 22 bp, Homo sapiens
tagtaaattaaaatattgactt

SEQ ID NO: 7962628 - DNA, 22 bp, Homo sapiens
tagtaaattaaaatattgactt

SEQ ID NO: 7962629 - DNA, 17 bp, Homo sapiens
tagtaaatgagtagagc

SEQ ID NO: 7962630 - DNA, 17 bp, Homo sapiens
tagtaaatgagtagagc

SEQ ID NO: 7962631 - DNA, 22 bp, Homo sapiens
tagtaaattaaaatattgactt

SEQ ID NO: 7962632 - DNA, 22 bp, Homo sapiens
tagtaaattaaaatattgactt

SEQ ID NO: 7962633 - DNA, 22 bp, Homo sapiens
tagtaaattaaaatattgactt

SEQ ID NO: 7962634 - DNA, 22 bp, Homo sapiens
tagtaaattaaaatattgactt

SEQ ID NO: 7962635 - DNA, 22 bp, Homo sapiens
tagtaacaacaactagcatttt

SEQ ID NO: 7962636 - DNA, 22 bp, Homo sapiens
tagtaacaacaactagcatttt

SEQ ID NO: 7962637 - DNA, 22 bp, Homo sapiens
tagtaataagttgtgctttgat

SEQ ID NO: 7962638 - DNA, 22 bp, Homo sapiens
tagtaactggttgaacaactgt

SEQ ID NO: 7962639 - DNA, 22 bp, Homo sapiens
tagtaactggttgaacaactgt

SEQ ID NO: 7962640 - DNA, 22 bp, Homo sapiens
tagtaacccacacaacagtaga

SEQ ID NO: 7962641 - DNA, 22 bp, Homo sapiens
tagtaactctacacacgacact

SEQ ID NO: 7962642 - DNA, 22 bp, Homo sapiens
taggtagtttcctgttgttggg

SEQ ID NO: 7962643 - DNA, 22 bp, Homo sapiens
cagggccactgcatgaggttca

SEQ ID NO: 7962644 - DNA, 20 bp, Homo sapiens
cagggccacgctccaaggca

SEQ ID NO: 7962645 - DNA, 20 bp, Homo sapiens
cagggccacgctccaaggca

SEQ ID NO: 7962646 - DNA, 22 bp, Homo sapiens
cagggccaccctctgctgggtg

SEQ ID NO: 7962647 - DNA, 22 bp, Homo sapiens
cagggccaccctctgctgggtg

SEQ ID NO: 7962648 - DNA, 22 bp, Homo sapiens
cagggccaccgtgtttgctgct

SEQ ID NO: 7962649 - DNA, 22 bp, Homo sapiens
cagggccaccgtgtttgctgct

SEQ ID NO: 7962650 - DNA, 22 bp, Homo sapiens
cagggccaagttggtgcctttt

SEQ ID NO: 7962651 - DNA, 22 bp, Homo sapiens
cagggccaagttggtgcctttt

SEQ ID NO: 7962652 - DNA, 22 bp, Homo sapiens
cagggccaagttggtgcctttt

SEQ ID NO: 7962653 - DNA, 21 bp, Homo sapiens
cagggccaatcctgacctcta

SEQ ID NO: 7962654 - DNA, 21 bp, Homo sapiens
cagggccaatcctgacctcta

SEQ ID NO: 7962655 - DNA, 21 bp, Homo sapiens
cagggccaatcctgacctcta

SEQ ID NO: 7962656 - DNA, 21 bp, Homo sapiens
cagggccaatcctgacctcta

SEQ ID NO: 7962657 - DNA, 22 bp, Homo sapiens
cagggccaccctctgctgggtg

SEQ ID NO: 7962658 - DNA, 22 bp, Homo sapiens
cagggccacacggaagggaaca

SEQ ID NO: 7962659 - DNA, 22 bp, Homo sapiens
tatgatgggaggaatggaattt

SEQ ID NO: 7962660 - DNA, 23 bp, Homo sapiens
tatgatcatgatattgcagggga

SEQ ID NO: 7962661 - DNA, 22 bp, Homo sapiens
tatgatctctgggtctggagct

SEQ ID NO: 7962662 - DNA, 22 bp, Homo sapiens
tatgatctttataacctatctt

SEQ ID NO: 7962663 - DNA, 22 bp, Homo sapiens
tatgatattctaaattgacacc

SEQ ID NO: 7962664 - DNA, 22 bp, Homo sapiens
tatgatattctaaattgacacc

SEQ ID NO: 7962665 - DNA, 22 bp, Homo sapiens
tatgatatgcactttatcagaa

SEQ ID NO: 7962666 - DNA, 22 bp, Homo sapiens
tatgaagatatatctgatctct

SEQ ID NO: 7962667 - DNA, 22 bp, Homo sapiens
tatgaagatatatctgatctct

SEQ ID NO: 7962668 - DNA, 22 bp, Homo sapiens
tatgaagatatatctgatctct

SEQ ID NO: 7962669 - DNA, 22 bp, Homo sapiens
tatgaagacaatgatagcatga

SEQ ID NO: 7962670 - DNA, 22 bp, Homo sapiens
tatgaagacaatgatagcatga

SEQ ID NO: 7962671 - DNA, 22 bp, Homo sapiens
tatgaagaagttctgtgaaatg

SEQ ID NO: 7962672 - DNA, 19 bp, Homo sapiens
tatgaagaatgtggcaaag

SEQ ID NO: 7962673 - DNA, 22 bp, Homo sapiens
tatgaagacaatgatagcatga

SEQ ID NO: 7962674 - DNA, 20 bp, Homo sapiens
tatgaagactcaagtagggc

SEQ ID NO: 7962675 - DNA, 22 bp, Homo sapiens
tatgaagactcatttattgggt

SEQ ID NO: 7962676 - DNA, 22 bp, Homo sapiens
tatgaagatatatctgatctct

SEQ ID NO: 7962677 - DNA, 22 bp, Homo sapiens
tatgaagaagttctgtgaaatg

SEQ ID NO: 7962678 - DNA, 22 bp, Homo sapiens
tatgaagaagacaaatgacact

SEQ ID NO: 7962679 - DNA, 22 bp, Homo sapiens
tatgaagaagacaaatgacact

SEQ ID NO: 7962680 - DNA, 22 bp, Homo sapiens
tatgaacttttgatgtgacatg

SEQ ID NO: 7962681 - DNA, 22 bp, Homo sapiens
tatgaagaagttctgtgaaatg

SEQ ID NO: 7962682 - DNA, 19 bp, Homo sapiens
tatgaagaatgtggcaaag

SEQ ID NO: 7962683 - DNA, 22 bp, Homo sapiens
tatgcaaagtcctaagaaagaa

SEQ ID NO: 7962684 - DNA, 22 bp, Homo sapiens
tatgcaaagtcctaagaaagaa

SEQ ID NO: 7962685 - DNA, 22 bp, Homo sapiens
tatgcaaatcattagatttcct

SEQ ID NO: 7962686 - DNA, 22 bp, Homo sapiens
tatgcaaatgactggtatgttt

SEQ ID NO: 7962687 - DNA, 22 bp, Homo sapiens
tatgcacaatatgatctatttg

SEQ ID NO: 7962688 - DNA, 22 bp, Homo sapiens
tatgcaattctcttaatattct

SEQ ID NO: 7962689 - DNA, 22 bp, Homo sapiens
tatgcaattctcttaatattct

SEQ ID NO: 7962690 - DNA, 22 bp, Homo sapiens
tatgcaaacagttcaggtgaca

SEQ ID NO: 7962691 - DNA, 22 bp, Homo sapiens
tatgcaaagccacccagggacg

SEQ ID NO: 7962692 - DNA, 22 bp, Homo sapiens
tatgcaaagtcctaagaaagaa

SEQ ID NO: 7962693 - DNA, 22 bp, Homo sapiens
tatgcaaagtcctaagaaagaa

SEQ ID NO: 7962694 - DNA, 22 bp, Homo sapiens
tatgatttgtagacatttgatt

SEQ ID NO: 7962695 - DNA, 22 bp, Homo sapiens
tatgatttgtagacatttgatt

SEQ ID NO: 7962696 - DNA, 22 bp, Homo sapiens
tatgcaaacagttcaggtgaca

SEQ ID NO: 7962697 - DNA, 22 bp, Homo sapiens
tatgatttgtagacatttgatt

SEQ ID NO: 7962698 - DNA, 22 bp, Homo sapiens
tatgatgtttgttcttgttcct

SEQ ID NO: 7962699 - DNA, 20 bp, Homo sapiens
tatgatgttgtttcaaggtg

SEQ ID NO: 7962700 - DNA, 22 bp, Homo sapiens
tatgattaatattcttaaaatt

SEQ ID NO: 7962701 - DNA, 22 bp, Homo sapiens
tatattgactttaaagaagcaa

SEQ ID NO: 7962702 - DNA, 22 bp, Homo sapiens
tatattgtagctgatgacaaat

SEQ ID NO: 7962703 - DNA, 22 bp, Homo sapiens
tatattgggacttcaggacttt

SEQ ID NO: 7962704 - DNA, 22 bp, Homo sapiens
tatattgtagctgatgacaaat

SEQ ID NO: 7962705 - DNA, 22 bp, Homo sapiens
tatattgtagctgatgacaaat

SEQ ID NO: 7962706 - DNA, 22 bp, Homo sapiens
tatattgtaggtgctatttgaa

SEQ ID NO: 7962707 - DNA, 22 bp, Homo sapiens
tatattcttaccagtgtatgta

SEQ ID NO: 7962708 - DNA, 22 bp, Homo sapiens
tatattgaaatgattcagccct

SEQ ID NO: 7962709 - DNA, 22 bp, Homo sapiens
tatattgaccagtacaattggt

SEQ ID NO: 7962710 - DNA, 22 bp, Homo sapiens
tatattgagatttgagcattgt

SEQ ID NO: 7962711 - DNA, 22 bp, Homo sapiens
tatattgaccagtacaattggt

SEQ ID NO: 7962712 - DNA, 22 bp, Homo sapiens
tatattgaccagtacaattggt

SEQ ID NO: 7962713 - DNA, 18 bp, Homo sapiens
tatattctgtgccctggt

SEQ ID NO: 7962714 - DNA, 22 bp, Homo sapiens
tatattctgattccatctgtgt

SEQ ID NO: 7962715 - DNA, 22 bp, Homo sapiens
tatattccagttcatctcttga

SEQ ID NO: 7962716 - DNA, 22 bp, Homo sapiens
tatattcattttaaagccatct

SEQ ID NO: 7962717 - DNA, 22 bp, Homo sapiens
tatattcattttaaagccatct

SEQ ID NO: 7962718 - DNA, 22 bp, Homo sapiens
tatattcattttaaagccatct

SEQ ID NO: 7962719 - DNA, 22 bp, Homo sapiens
tatattccagttcatctcttga

SEQ ID NO: 7962720 - DNA, 22 bp, Homo sapiens
tatattccagttcatctcttga

SEQ ID NO: 7962721 - DNA, 22 bp, Homo sapiens
tatgaactgctcttgtgttttg

SEQ ID NO: 7962722 - DNA, 23 bp, Homo sapiens
tatgaactgcattgctggtgtgt

SEQ ID NO: 7962723 - DNA, 22 bp, Homo sapiens
tatgaactagctgatttagttt

SEQ ID NO: 7962724 - DNA, 22 bp, Homo sapiens
tatgaactgtgagtgtgatggg

SEQ ID NO: 7962725 - DNA, 22 bp, Homo sapiens
tatgaactgtactgtactaagc

SEQ ID NO: 7962726 - DNA, 22 bp, Homo sapiens
tatgaactgtgagtgtgatggg

SEQ ID NO: 7962727 - DNA, 22 bp, Homo sapiens
tatgaactgtactgtactaagc

SEQ ID NO: 7962728 - DNA, 22 bp, Homo sapiens
tatgaactgtgagtgtgatggg

SEQ ID NO: 7962729 - DNA, 22 bp, Homo sapiens
tatgaactctggagtctgagtg

SEQ ID NO: 7962730 - DNA, 22 bp, Homo sapiens
tatgaactgtaaccctcaccgc

SEQ ID NO: 7962731 - DNA, 22 bp, Homo sapiens
tatgaagaaacctatcctctag

SEQ ID NO: 7962732 - DNA, 22 bp, Homo sapiens
tatgaacttttgatgtgacatg

SEQ ID NO: 7962733 - DNA, 22 bp, Homo sapiens
tatgaagaaacctatcctctag

SEQ ID NO: 7962734 - DNA, 22 bp, Homo sapiens
tatgaagaagacaaatgacact

SEQ ID NO: 7962735 - DNA, 22 bp, Homo sapiens
tatgaagaaatctttgaaaatc

SEQ ID NO: 7962736 - DNA, 22 bp, Homo sapiens
tatctgtatccccatctagcta

SEQ ID NO: 7962737 - DNA, 22 bp, Homo sapiens
tatctgtatccccatctagcta

SEQ ID NO: 7962738 - DNA, 22 bp, Homo sapiens
tatctgtaaaccaaggaggctt

SEQ ID NO: 7962739 - DNA, 23 bp, Homo sapiens
tatctgtatttgttcactgctgt

SEQ ID NO: 7962740 - DNA, 23 bp, Homo sapiens
tatctgtatttgttcactgctgt

SEQ ID NO: 7962741 - DNA, 22 bp, Homo sapiens
tatctgtattctgacagtcact

SEQ ID NO: 7962742 - DNA, 21 bp, Homo sapiens
tatgaacatgaccaatagtcc

SEQ ID NO: 7962743 - DNA, 21 bp, Homo sapiens
tatgaacatgaccaatagtcc

SEQ ID NO: 7962744 - DNA, 22 bp, Homo sapiens
tatgaacacttattggggaagg

SEQ ID NO: 7962745 - DNA, 22 bp, Homo sapiens
tatgaacatgttcattgactta

SEQ ID NO: 7962746 - DNA, 22 bp, Homo sapiens
tatgaacattttggtatatatg

SEQ ID NO: 7962747 - DNA, 22 bp, Homo sapiens
tatgaacattttggtatatatg

SEQ ID NO: 7962748 - DNA, 22 bp, Homo sapiens
tatgaacattgaagaggagccc

SEQ ID NO: 7962749 - DNA, 21 bp, Homo sapiens
tatgaacatgaccaatagtcc

SEQ ID NO: 7962750 - DNA, 21 bp, Homo sapiens
tatgaacatgaccaatagtcc

SEQ ID NO: 7962751 - DNA, 21 bp, Homo sapiens
tatgaacatgaccaatagtcc

SEQ ID NO: 7962752 - DNA, 22 bp, Homo sapiens
tatgtacatcttgagcaatgaa

SEQ ID NO: 7962753 - DNA, 22 bp, Homo sapiens
tatgtacatcgttgaattcaaa

SEQ ID NO: 7962754 - DNA, 22 bp, Homo sapiens
tatgtacatcttgagcaatgaa

SEQ ID NO: 7962755 - DNA, 22 bp, Homo sapiens
tatgtacatcttgagcaatgaa

SEQ ID NO: 7962756 - DNA, 22 bp, Homo sapiens
tatgtacatcttgagcaatgaa

SEQ ID NO: 7962757 - DNA, 22 bp, Homo sapiens
tatgtacatcttgagcaatgaa

SEQ ID NO: 7962758 - DNA, 22 bp, Homo sapiens
tatgtacatcttgagcaatgaa

SEQ ID NO: 7962759 - DNA, 22 bp, Homo sapiens
tatgtacatgatttcatttgct

SEQ ID NO: 7962760 - DNA, 22 bp, Homo sapiens
tatgtacatgatttcatttgct

SEQ ID NO: 7962761 - DNA, 22 bp, Homo sapiens
tatgtacatgatttcatttgct

SEQ ID NO: 7962762 - DNA, 22 bp, Homo sapiens
tatgtacatgatttcatttgct

SEQ ID NO: 7962763 - DNA, 22 bp, Homo sapiens
tatgtacatgatttcatttgct

SEQ ID NO: 7962764 - DNA, 22 bp, Homo sapiens
tatgtacatgatttcatttgct

SEQ ID NO: 7962765 - DNA, 22 bp, Homo sapiens
tatgtacatggagagcaattga

SEQ ID NO: 7962766 - DNA, 22 bp, Homo sapiens
tatgtacatggagagcaattga

SEQ ID NO: 7962767 - DNA, 22 bp, Homo sapiens
tatgtacatggagagcaattga

SEQ ID NO: 7962768 - DNA, 22 bp, Homo sapiens
tatgtacatgatttcatttgct

SEQ ID NO: 7962769 - DNA, 22 bp, Homo sapiens
tatgtacatggagagcaattga

SEQ ID NO: 7962770 - DNA, 22 bp, Homo sapiens
tatgtacatggagagcaattga

SEQ ID NO: 7962771 - DNA, 22 bp, Homo sapiens
cagtaaaagatggaaatagaat

SEQ ID NO: 7962772 - DNA, 22 bp, Homo sapiens
tatgtacatgttaaagggcaaa

SEQ ID NO: 7962773 - DNA, 22 bp, Homo sapiens
tatgtacatgttaaagggcaaa

SEQ ID NO: 7962774 - DNA, 22 bp, Homo sapiens
tatgtacatgttaaagggcaaa

SEQ ID NO: 7962775 - DNA, 22 bp, Homo sapiens
tatgtacatgttaaagggcaaa

SEQ ID NO: 7962776 - DNA, 22 bp, Homo sapiens
cagtaattccaagtgcttatac

SEQ ID NO: 7962777 - DNA, 22 bp, Homo sapiens
cagtacaatgttgaaaaggagt

SEQ ID NO: 7962778 - DNA, 22 bp, Homo sapiens
cagtacaatgttgaaaaggagt

SEQ ID NO: 7962779 - DNA, 22 bp, Homo sapiens
cagtacaattttacaaaggacg

SEQ ID NO: 7962780 - DNA, 22 bp, Homo sapiens
cagtacacaagctttcatgtat

SEQ ID NO: 7962781 - DNA, 22 bp, Homo sapiens
cagtacacaagctttcatgtat

SEQ ID NO: 7962782 - DNA, 22 bp, Homo sapiens
cagtacagaatctattcctgca

SEQ ID NO: 7962783 - DNA, 22 bp, Homo sapiens
cagtacagtaaagcaagctgaa

SEQ ID NO: 7962784 - DNA, 22 bp, Homo sapiens
cagtacagtaaagcaagctgaa

SEQ ID NO: 7962785 - DNA, 22 bp, Homo sapiens
cagtacaggctgccttgtccaa

SEQ ID NO: 7962786 - DNA, 22 bp, Homo sapiens
cagtaattccaagtgcttatac

SEQ ID NO: 7962787 - DNA, 22 bp, Homo sapiens
cagtaatattttactctaggcc

SEQ ID NO: 7962788 - DNA, 22 bp, Homo sapiens
cagtactgcttgtgggagcaga

SEQ ID NO: 7962789 - DNA, 22 bp, Homo sapiens
cagtactgcttgtgggagcaga

SEQ ID NO: 7962790 - DNA, 22 bp, Homo sapiens
cagtactaagactccacctagc

SEQ ID NO: 7962791 - DNA, 22 bp, Homo sapiens
cagtacatttcatatgattcta

SEQ ID NO: 7962792 - DNA, 22 bp, Homo sapiens
cagtactggctcattgtgctgt

SEQ ID NO: 7962793 - DNA, 22 bp, Homo sapiens
tatgtacatcgttgaattcaaa

SEQ ID NO: 7962794 - DNA, 22 bp, Homo sapiens
tatgtacatcgttgaattcaaa

SEQ ID NO: 7962795 - DNA, 22 bp, Homo sapiens
tatgtacatcgttgaattcaaa

SEQ ID NO: 7962796 - DNA, 22 bp, Homo sapiens
caggtggggggcttccgagcct

SEQ ID NO: 7962797 - DNA, 22 bp, Homo sapiens
tatgtacatcgttgaattcaaa

SEQ ID NO: 7962798 - DNA, 22 bp, Homo sapiens
tatgtacatcgttgaattcaaa

SEQ ID NO: 7962799 - DNA, 22 bp, Homo sapiens
caggtggggggcttccgagcct

SEQ ID NO: 7962800 - DNA, 22 bp, Homo sapiens
caggtggggggcttccgagcct

SEQ ID NO: 7962801 - DNA, 22 bp, Homo sapiens
caggtggggcgccctcaggcag

SEQ ID NO: 7962802 - DNA, 22 bp, Homo sapiens
caggtggggcagctgtgggagc

SEQ ID NO: 7962803 - DNA, 22 bp, Homo sapiens
caggtggggcagctgtgggagc

SEQ ID NO: 7962804 - DNA, 22 bp, Homo sapiens
caggtggggcagctgtgggagc

SEQ ID NO: 7962805 - DNA, 22 bp, Homo sapiens
caggtggggagagtgtggagca

SEQ ID NO: 7962806 - DNA, 22 bp, Homo sapiens
caggtggggcagctgtgggagc

SEQ ID NO: 7962807 - DNA, 22 bp, Homo sapiens
caggtggggcagctgtgggagc

SEQ ID NO: 7962808 - DNA, 22 bp, Homo sapiens
caggtggggcgccctcaggcag

SEQ ID NO: 7962809 - DNA, 22 bp, Homo sapiens
caggtggggcgccctcaggcag

SEQ ID NO: 7962810 - DNA, 22 bp, Homo sapiens
caggtggggcgccctcaggcag

SEQ ID NO: 7962811 - DNA, 22 bp, Homo sapiens
caggtggggagagtgtggagca

SEQ ID NO: 7962812 - DNA, 22 bp, Homo sapiens
caggtggggagagtgtggagca

SEQ ID NO: 7962813 - DNA, 22 bp, Homo sapiens
caggtggggagagtgtggagca

SEQ ID NO: 7962814 - DNA, 22 bp, Homo sapiens
caggtggggagagtgtggagca

SEQ ID NO: 7962815 - DNA, 22 bp, Homo sapiens
caggtgggcttgggagaacact

SEQ ID NO: 7962816 - DNA, 22 bp, Homo sapiens
caggtgggcttgggagaacact

SEQ ID NO: 7962817 - DNA, 22 bp, Homo sapiens
caggtggggagagtgtggagca

SEQ ID NO: 7962818 - DNA, 22 bp, Homo sapiens
caggtgggcttgggagaacact

SEQ ID NO: 7962819 - DNA, 22 bp, Homo sapiens
caggtgggcttgggagaacact

SEQ ID NO: 7962820 - DNA, 22 bp, Homo sapiens
caggtgggctgcctctccagct

SEQ ID NO: 7962821 - DNA, 22 bp, Homo sapiens
caggtgggctgcctctccagct

SEQ ID NO: 7962822 - DNA, 22 bp, Homo sapiens
caggtgggcgtggcgagaaggc

SEQ ID NO: 7962823 - DNA, 22 bp, Homo sapiens
caggtgggcgtggcgagaaggc

SEQ ID NO: 7962824 - DNA, 22 bp, Homo sapiens
caggtgggcgtggcgagaaggc

SEQ ID NO: 7962825 - DNA, 22 bp, Homo sapiens
caggtgggcgtggcgagaaggc

SEQ ID NO: 7962826 - DNA, 22 bp, Homo sapiens
caggtgggctgcctctccagct

SEQ ID NO: 7962827 - DNA, 22 bp, Homo sapiens
caggtgggcgtggcgagaaggc

SEQ ID NO: 7962828 - DNA, 22 bp, Homo sapiens
caggtggcttagtcccatttta

SEQ ID NO: 7962829 - DNA, 22 bp, Homo sapiens
tatgcacacatgtatgcatgtg

SEQ ID NO: 7962830 - DNA, 22 bp, Homo sapiens
caggtggcttattagggtcagt

SEQ ID NO: 7962831 - DNA, 22 bp, Homo sapiens
caggtggcttagtcccatttta

SEQ ID NO: 7962832 - DNA, 22 bp, Homo sapiens
tcaaatgctgcctttgtgtgcc

SEQ ID NO: 7962833 - DNA, 22 bp, Homo sapiens
tcaaatgctctttgcagagagg

SEQ ID NO: 7962834 - DNA, 22 bp, Homo sapiens
cagtgaaatcacaactttagtt

SEQ ID NO: 7962835 - DNA, 22 bp, Homo sapiens
cagtgaaatcacaactttagtt

SEQ ID NO: 7962836 - DNA, 17 bp, Homo sapiens
cagtgaagagacattaa

SEQ ID NO: 7962837 - DNA, 22 bp, Homo sapiens
tcaaatgccagtggtgtggatc

SEQ ID NO: 7962838 - DNA, 22 bp, Homo sapiens
cagtctttgatgcatcctagcc

SEQ ID NO: 7962839 - DNA, 22 bp, Homo sapiens
cagtctttgatgcatcctagcc

SEQ ID NO: 7962840 - DNA, 22 bp, Homo sapiens
cagtctttgttcccattactga

SEQ ID NO: 7962841 - DNA, 22 bp, Homo sapiens
cagtcttttgtatattagcaga

SEQ ID NO: 7962842 - DNA, 22 bp, Homo sapiens
tcaaattagtggaataataatg

SEQ ID NO: 7962843 - DNA, 22 bp, Homo sapiens
tcaaattagtggaataataatg

SEQ ID NO: 7962844 - DNA, 22 bp, Homo sapiens
tcaaattagtggaataataatg

SEQ ID NO: 7962845 - DNA, 22 bp, Homo sapiens
tcaaattagtggaataataatg

SEQ ID NO: 7962846 - DNA, 22 bp, Homo sapiens
tcaaattagtggaataataatg

SEQ ID NO: 7962847 - DNA, 22 bp, Homo sapiens
tcaaattagtggaataataatg

SEQ ID NO: 7962848 - DNA, 22 bp, Homo sapiens
tcaaatgtaatttattgtttta

SEQ ID NO: 7962849 - DNA, 22 bp, Homo sapiens
tcaaatgtaatttattgtttta

SEQ ID NO: 7962850 - DNA, 22 bp, Homo sapiens
tcaaatgtaatttattgtttta

SEQ ID NO: 7962851 - DNA, 22 bp, Homo sapiens
tcaaatgggtatgctttataat

SEQ ID NO: 7962852 - DNA, 22 bp, Homo sapiens
tcaaatgcttctactcctaaga

SEQ ID NO: 7962853 - DNA, 17 bp, Homo sapiens
tcaaatgtacagaacta

SEQ ID NO: 7962854 - DNA, 17 bp, Homo sapiens
tcaaatgtacagaacta

SEQ ID NO: 7962855 - DNA, 22 bp, Homo sapiens
tcaaattagtggaataataatg

SEQ ID NO: 7962856 - DNA, 22 bp, Homo sapiens
tcaaatgttccctgtactggcc

SEQ ID NO: 7962857 - DNA, 22 bp, Homo sapiens
tcaaatgtgtaaggtcaggaca

SEQ ID NO: 7962858 - DNA, 22 bp, Homo sapiens
tcaaatgttccctgtactggcc

SEQ ID NO: 7962859 - DNA, 22 bp, Homo sapiens
tcaaatgtgtaaggtcaggaca

SEQ ID NO: 7962860 - DNA, 22 bp, Homo sapiens
tcaaatgtgtaaggtcaggaca

SEQ ID NO: 7962861 - DNA, 22 bp, Homo sapiens
tcaaattatttaggatagtgct

SEQ ID NO: 7962862 - DNA, 22 bp, Homo sapiens
tcaaattatttaggatagtgct

SEQ ID NO: 7962863 - DNA, 22 bp, Homo sapiens
tcaaattcagtgtgacaacatt

SEQ ID NO: 7962864 - DNA, 22 bp, Homo sapiens
tcaaattcagtgtgacaacatt

SEQ ID NO: 7962865 - DNA, 19 bp, Homo sapiens
tcaaattcctaagttctgg

SEQ ID NO: 7962866 - DNA, 22 bp, Homo sapiens
tcaaattttaacatgcattaga

SEQ ID NO: 7962867 - DNA, 22 bp, Homo sapiens
tcaaattttaacatgcattaga

SEQ ID NO: 7962868 - DNA, 22 bp, Homo sapiens
tcaaattttaacatgcattaga

SEQ ID NO: 7962869 - DNA, 22 bp, Homo sapiens
tcaaattgtcatcttgataatg

SEQ ID NO: 7962870 - DNA, 22 bp, Homo sapiens
tcaaattctattctatactcag

SEQ ID NO: 7962871 - DNA, 22 bp, Homo sapiens
tcaaattttaacatgcattaga

SEQ ID NO: 7962872 - DNA, 22 bp, Homo sapiens
tcaaattgtcatcttgataatg

SEQ ID NO: 7962873 - DNA, 22 bp, Homo sapiens
cagtcttagccttccctcaccc

SEQ ID NO: 7962874 - DNA, 22 bp, Homo sapiens
cagtctgggactgagctccacc

SEQ ID NO: 7962875 - DNA, 22 bp, Homo sapiens
cagtctgggactgagctccacc

SEQ ID NO: 7962876 - DNA, 22 bp, Homo sapiens
cagtctgggactgagctccacc

SEQ ID NO: 7962877 - DNA, 22 bp, Homo sapiens
cagtctgtaatgggttttaaaa

SEQ ID NO: 7962878 - DNA, 22 bp, Homo sapiens
cagtctgggactgagctccacc

SEQ ID NO: 7962879 - DNA, 22 bp, Homo sapiens
cagtctggctcagcacaaaggg

SEQ ID NO: 7962880 - DNA, 22 bp, Homo sapiens
cagtctgggactgagctccacc

SEQ ID NO: 7962881 - DNA, 22 bp, Homo sapiens
cagtctggctcagcacaaaggg

SEQ ID NO: 7962882 - DNA, 22 bp, Homo sapiens
cagtctggctcagcacaaaggg

SEQ ID NO: 7962883 - DNA, 22 bp, Homo sapiens
cagtctggatctgtgctgctgt

SEQ ID NO: 7962884 - DNA, 22 bp, Homo sapiens
cagtctggatctgtgctgctgt

SEQ ID NO: 7962885 - DNA, 22 bp, Homo sapiens
cagtctggcacagcacactgaa

SEQ ID NO: 7962886 - DNA, 22 bp, Homo sapiens
cagtctggcacagcacactgaa

SEQ ID NO: 7962887 - DNA, 22 bp, Homo sapiens
cagtctggcacagcacactgaa

SEQ ID NO: 7962888 - DNA, 22 bp, Homo sapiens
cagtctggcacagcacactgaa

SEQ ID NO: 7962889 - DNA, 22 bp, Homo sapiens
cagtctctcagctttcagctgt

SEQ ID NO: 7962890 - DNA, 22 bp, Homo sapiens
cagtcctcagtgagtgatcctg

SEQ ID NO: 7962891 - DNA, 22 bp, Homo sapiens
cagtcctcagtgagtgatcctg

SEQ ID NO: 7962892 - DNA, 22 bp, Homo sapiens
cagtcctctcactcaggccttt

SEQ ID NO: 7962893 - DNA, 22 bp, Homo sapiens
cagtctctaaatcaatctgaat

SEQ ID NO: 7962894 - DNA, 22 bp, Homo sapiens
cagtctctctccttgcaggcgt

SEQ ID NO: 7962895 - DNA, 22 bp, Homo sapiens
cagtctctcagctttcagctgt

SEQ ID NO: 7962896 - DNA, 22 bp, Homo sapiens
cagtctggaggtcagctggctt

SEQ ID NO: 7962897 - DNA, 22 bp, Homo sapiens
cagtctggaggtcagctggctt

SEQ ID NO: 7962898 - DNA, 22 bp, Homo sapiens
cagtctggaggtcagctggctt

SEQ ID NO: 7962899 - DNA, 22 bp, Homo sapiens
cagtctggaggtcagctggctt

SEQ ID NO: 7962900 - DNA, 22 bp, Homo sapiens
cagtctggactcaggcatacct

SEQ ID NO: 7962901 - DNA, 22 bp, Homo sapiens
cagtctggactcaggcatacct

SEQ ID NO: 7962902 - DNA, 22 bp, Homo sapiens
cagtcccagggttggttcagct

SEQ ID NO: 7962903 - DNA, 22 bp, Homo sapiens
cagtcccagtttgagactctgg

SEQ ID NO: 7962904 - DNA, 22 bp, Homo sapiens
cagtcccagtttgagactctgg

SEQ ID NO: 7962905 - DNA, 22 bp, Homo sapiens
cagtcccagggttggttcagct

SEQ ID NO: 7962906 - DNA, 15 bp, Homo sapiens
cagtcccagggaccc

SEQ ID NO: 7962907 - DNA, 22 bp, Homo sapiens
cagtcccagggttggttcagct

SEQ ID NO: 7962908 - DNA, 22 bp, Homo sapiens
cagtcccagctgctcagaaggc

SEQ ID NO: 7962909 - DNA, 22 bp, Homo sapiens
cagtcccagctgctcagaaggc

SEQ ID NO: 7962910 - DNA, 22 bp, Homo sapiens
cagtcccagctgctcagaaggc

SEQ ID NO: 7962911 - DNA, 15 bp, Homo sapiens
cagtcccagggaccc

SEQ ID NO: 7962912 - DNA, 22 bp, Homo sapiens
cagtcccagctgctcagaaggc

SEQ ID NO: 7962913 - DNA, 22 bp, Homo sapiens
cagtcccatgagcccagaacat

SEQ ID NO: 7962914 - DNA, 22 bp, Homo sapiens
cagtcccatctcccaggtggct

SEQ ID NO: 7962915 - DNA, 22 bp, Homo sapiens
cagtcccatctcccaggtggct

SEQ ID NO: 7962916 - DNA, 22 bp, Homo sapiens
cagtcccatctcccaggtggct

SEQ ID NO: 7962917 - DNA, 22 bp, Homo sapiens
cagtcccatctcccaggtggct

SEQ ID NO: 7962918 - DNA, 22 bp, Homo sapiens
cagtcccatctcccaggtggct

SEQ ID NO: 7962919 - DNA, 22 bp, Homo sapiens
cagtcccatgagcccagaacat

SEQ ID NO: 7962920 - DNA, 22 bp, Homo sapiens
cagtcccatgagcccagaacat

SEQ ID NO: 7962921 - DNA, 22 bp, Homo sapiens
cagtcccatgagcccagaacat

SEQ ID NO: 7962922 - DNA, 22 bp, Homo sapiens
cagtccctgggggagtcaccag

SEQ ID NO: 7962923 - DNA, 22 bp, Homo sapiens
cagtccctagtggagctcacag

SEQ ID NO: 7962924 - DNA, 22 bp, Homo sapiens
cagtccctgggggagtcaccag

SEQ ID NO: 7962925 - DNA, 22 bp, Homo sapiens
cagtccctgggggagtcaccag

SEQ ID NO: 7962926 - DNA, 22 bp, Homo sapiens
cagtccctgggggagtcaccag

SEQ ID NO: 7962927 - DNA, 22 bp, Homo sapiens
cagtccctagtggagctcacag

SEQ ID NO: 7962928 - DNA, 22 bp, Homo sapiens
tattccagatgaaatcattcag

SEQ ID NO: 7962929 - DNA, 22 bp, Homo sapiens
tattccagatgaaatcattcag

SEQ ID NO: 7962930 - DNA, 22 bp, Homo sapiens
tattccagatgaaatcattcag

SEQ ID NO: 7962931 - DNA, 22 bp, Homo sapiens
tattccaattggttgtaaagaa

SEQ ID NO: 7962932 - DNA, 22 bp, Homo sapiens
tattccaattggttgtaaagaa

SEQ ID NO: 7962933 - DNA, 22 bp, Homo sapiens
tattccaccagagatgtgaatt

SEQ ID NO: 7962934 - DNA, 22 bp, Homo sapiens
tattccaacttcactattgtct

SEQ ID NO: 7962935 - DNA, 20 bp, Homo sapiens
tattccaagggtagagaaaa

SEQ ID NO: 7962936 - DNA, 22 bp, Homo sapiens
tattccaagtgcctagaagagt

SEQ ID NO: 7962937 - DNA, 22 bp, Homo sapiens
tattccaagtgcctagaagagt

SEQ ID NO: 7962938 - DNA, 22 bp, Homo sapiens
tattcccagcctctttctatct

SEQ ID NO: 7962939 - DNA, 22 bp, Homo sapiens
tattcccatgaagaggtagaga

SEQ ID NO: 7962940 - DNA, 22 bp, Homo sapiens
tattcccagttgtggtgagtag

SEQ ID NO: 7962941 - DNA, 22 bp, Homo sapiens
tattcccattccacttatcaag

SEQ ID NO: 7962942 - DNA, 22 bp, Homo sapiens
tattcccattccacttatcaag

SEQ ID NO: 7962943 - DNA, 22 bp, Homo sapiens
tattcccaccctaagtagtagg

SEQ ID NO: 7962944 - DNA, 22 bp, Homo sapiens
tattcccacagttgtctaccta

SEQ ID NO: 7962945 - DNA, 22 bp, Homo sapiens
tattccatgccagagtttattg

SEQ ID NO: 7962946 - DNA, 22 bp, Homo sapiens
tattccagtgtgatctttgtag

SEQ ID NO: 7962947 - DNA, 22 bp, Homo sapiens
tattccaggacaggtgtgctgt

SEQ ID NO: 7962948 - DNA, 22 bp, Homo sapiens
tattccaggacaggtgtgctgt

SEQ ID NO: 7962949 - DNA, 17 bp, Homo sapiens
tattccaggaaataaag

SEQ ID NO: 7962950 - DNA, 22 bp, Homo sapiens
tattccaggtattcttcaagag

SEQ ID NO: 7962951 - DNA, 22 bp, Homo sapiens
cagtagaattattataaaacat

SEQ ID NO: 7962952 - DNA, 22 bp, Homo sapiens
cagtagaattattataaaacat

SEQ ID NO: 7962953 - DNA, 22 bp, Homo sapiens
cagtagacacattaatatggaa

SEQ ID NO: 7962954 - DNA, 22 bp, Homo sapiens
cagtagaagcttgtttttcaga

SEQ ID NO: 7962955 - DNA, 22 bp, Homo sapiens
cagtagacagctgatgatgggc

SEQ ID NO: 7962956 - DNA, 22 bp, Homo sapiens
cagtagacacattaatatggaa

SEQ ID NO: 7962957 - DNA, 22 bp, Homo sapiens
cagtagaattattataaaacat

SEQ ID NO: 7962958 - DNA, 22 bp, Homo sapiens
cagtacttggtcaaggaagcag

SEQ ID NO: 7962959 - DNA, 22 bp, Homo sapiens
cagtactttgcatcattccact

SEQ ID NO: 7962960 - DNA, 22 bp, Homo sapiens
cagtagcaggcaggtgcttttg

SEQ ID NO: 7962961 - DNA, 22 bp, Homo sapiens
cagtagcaggcaggtgcttttg

SEQ ID NO: 7962962 - DNA, 22 bp, Homo sapiens
cagtagcaggcactcagcacgt

SEQ ID NO: 7962963 - DNA, 22 bp, Homo sapiens
cagtagcaggcactcagcacgt

SEQ ID NO: 7962964 - DNA, 20 bp, Homo sapiens
cagtagcaataattagaagc

SEQ ID NO: 7962965 - DNA, 22 bp, Homo sapiens
cagtagcactagatatgtgtgg

SEQ ID NO: 7962966 - DNA, 22 bp, Homo sapiens
cagtagcactctgtcagtgaag

SEQ ID NO: 7962967 - DNA, 22 bp, Homo sapiens
tattccaactgtcatagtcata

SEQ ID NO: 7962968 - DNA, 22 bp, Homo sapiens
cagtagcatgcttatcttttga

SEQ ID NO: 7962969 - DNA, 22 bp, Homo sapiens
cagtagcagggattattttagg

SEQ ID NO: 7962970 - DNA, 22 bp, Homo sapiens
tcaaaagaaacaccatgttcct

SEQ ID NO: 7962971 - DNA, 22 bp, Homo sapiens
tcaaaagaaacaccatgttcct

SEQ ID NO: 7962972 - DNA, 22 bp, Homo sapiens
tcaaaacctaggctctctgctt

SEQ ID NO: 7962973 - DNA, 22 bp, Homo sapiens
tattccctatttagtaattctg

SEQ ID NO: 7962974 - DNA, 22 bp, Homo sapiens
tattccctgatgtacactggca

SEQ ID NO: 7962975 - DNA, 22 bp, Homo sapiens
tattcctaaagtccctgtgctt

SEQ ID NO: 7962976 - DNA, 22 bp, Homo sapiens
tattccctgatgtacactggca

SEQ ID NO: 7962977 - DNA, 22 bp, Homo sapiens
tattcctaatacttgttttggg

SEQ ID NO: 7962978 - DNA, 22 bp, Homo sapiens
tcaaagcaatttcaccagtgcc

SEQ ID NO: 7962979 - DNA, 22 bp, Homo sapiens
tcaaagcacacttagtggtaga

SEQ ID NO: 7962980 - DNA, 22 bp, Homo sapiens
tcaaagcaatttcaccagtgcc

SEQ ID NO: 7962981 - DNA, 22 bp, Homo sapiens
tcaaagcaatttcaccagtgcc

SEQ ID NO: 7962982 - DNA, 22 bp, Homo sapiens
tcaaagcagcacattcgcaagc

SEQ ID NO: 7962983 - DNA, 19 bp, Homo sapiens
tcaaaggcaaggaggaact

SEQ ID NO: 7962984 - DNA, 22 bp, Homo sapiens
cagtcccagacccagaaggtgg

SEQ ID NO: 7962985 - DNA, 22 bp, Homo sapiens
tcaaaggagtttaagttactgg

SEQ ID NO: 7962986 - DNA, 23 bp, Homo sapiens
tcaaaggaggcatcgttctgcag

SEQ ID NO: 7962987 - DNA, 22 bp, Homo sapiens
tcaaaggataactgagggcagt

SEQ ID NO: 7962988 - DNA, 22 bp, Homo sapiens
tcacatgtcagtcttaaacaga

SEQ ID NO: 7962989 - DNA, 22 bp, Homo sapiens
tcacatgtcagtcttaaacaga

SEQ ID NO: 7962990 - DNA, 22 bp, Homo sapiens
tcacatgtcagtcttaaacaga

SEQ ID NO: 7962991 - DNA, 22 bp, Homo sapiens
tcacatgtcagaataagtgcat

SEQ ID NO: 7962992 - DNA, 22 bp, Homo sapiens
tcacatgtgtggcagtgcaagt

SEQ ID NO: 7962993 - DNA, 22 bp, Homo sapiens
tcacatgtgtggcagtgcaagt

SEQ ID NO: 7962994 - DNA, 22 bp, Homo sapiens
tcacatgtgtggcagtgcaagt

SEQ ID NO: 7962995 - DNA, 22 bp, Homo sapiens
tcacatgtcaagaagataattt

SEQ ID NO: 7962996 - DNA, 22 bp, Homo sapiens
tcacatgtcacaaaacactgcc

SEQ ID NO: 7962997 - DNA, 22 bp, Homo sapiens
tcacatgtcacaaaacactgcc

SEQ ID NO: 7962998 - DNA, 22 bp, Homo sapiens
tcacatgtcacaaaacactgcc

SEQ ID NO: 7962999 - DNA, 22 bp, Homo sapiens
tcacatgtcaaaaactacataa

SEQ ID NO: 7963000 - DNA, 22 bp, Homo sapiens
tcacatgtcaaaaactacataa

SEQ ID NO: 7963001 - DNA, 22 bp, Homo sapiens
tcacatgtcaaaaactacataa

SEQ ID NO: 7963002 - DNA, 18 bp, Homo sapiens
tcacattataatgtaaca

SEQ ID NO: 7963003 - DNA, 18 bp, Homo sapiens
tcacattataatgtaaca

SEQ ID NO: 7963004 - DNA, 22 bp, Homo sapiens
tcacattaggaagtaatgttgt

SEQ ID NO: 7963005 - DNA, 22 bp, Homo sapiens
tcacatgttaggtcgggcaagg

SEQ ID NO: 7963006 - DNA, 22 bp, Homo sapiens
tcacatgtgttttctcaccaac

SEQ ID NO: 7963007 - DNA, 22 bp, Homo sapiens
tcacatgtgttttctcaccaac

SEQ ID NO: 7963008 - DNA, 22 bp, Homo sapiens
tcacattcatggtgctaataaa

SEQ ID NO: 7963009 - DNA, 22 bp, Homo sapiens
tcacattctagaatgttatcgt

SEQ ID NO: 7963010 - DNA, 22 bp, Homo sapiens
tcacattcatggtgctaataaa

SEQ ID NO: 7963011 - DNA, 19 bp, Homo sapiens
tcacattcagccttgctga

SEQ ID NO: 7963012 - DNA, 19 bp, Homo sapiens
tcacattcagccttgctga

SEQ ID NO: 7963013 - DNA, 22 bp, Homo sapiens
tcacattctagaatgttatcgt

SEQ ID NO: 7963014 - DNA, 22 bp, Homo sapiens
tcacattctcagcatctataca

SEQ ID NO: 7963015 - DNA, 22 bp, Homo sapiens
tcactgcaacctccacctcctg

SEQ ID NO: 7963016 - DNA, 22 bp, Homo sapiens
tcactgcaacctctgcctcccg

SEQ ID NO: 7963017 - DNA, 22 bp, Homo sapiens
tcactgcaacctccacctcctg

SEQ ID NO: 7963018 - DNA, 22 bp, Homo sapiens
tcactgcaacctctgcctcccg

SEQ ID NO: 7963019 - DNA, 22 bp, Homo sapiens
tcactgcaacctccacctcctg

SEQ ID NO: 7963020 - DNA, 22 bp, Homo sapiens
tcactgcaacctccacctcctg

SEQ ID NO: 7963021 - DNA, 22 bp, Homo sapiens
tcactgcaacctccacctcctg

SEQ ID NO: 7963022 - DNA, 22 bp, Homo sapiens
tcactgcaacctccacctcctg

SEQ ID NO: 7963023 - DNA, 22 bp, Homo sapiens
tcactcctcattgctgcccatt

SEQ ID NO: 7963024 - DNA, 22 bp, Homo sapiens
tcacattcttccctgacttctt

SEQ ID NO: 7963025 - DNA, 22 bp, Homo sapiens
tcactcctcattgctgcccatt

SEQ ID NO: 7963026 - DNA, 22 bp, Homo sapiens
tcactgcaagctccacctcccg

SEQ ID NO: 7963027 - DNA, 22 bp, Homo sapiens
tcactgcaagctcctcctcctg

SEQ ID NO: 7963028 - DNA, 22 bp, Homo sapiens
tcactgcaagctcctcctcctg

SEQ ID NO: 7963029 - DNA, 21 bp, Homo sapiens
cagtggcacgatttcggctca

SEQ ID NO: 7963030 - DNA, 21 bp, Homo sapiens
cagtggcacgatttcggctca

SEQ ID NO: 7963031 - DNA, 22 bp, Homo sapiens
cagtggcacgatctcagctcac

SEQ ID NO: 7963032 - DNA, 22 bp, Homo sapiens
cagtggcacgatctcagctcac

SEQ ID NO: 7963033 - DNA, 22 bp, Homo sapiens
cagtggcacccacgggctgggc

SEQ ID NO: 7963034 - DNA, 22 bp, Homo sapiens
cagtggcacgatctcagctcac

SEQ ID NO: 7963035 - DNA, 22 bp, Homo sapiens
cagtggcacccacgggctgggc

SEQ ID NO: 7963036 - DNA, 22 bp, Homo sapiens
cagtggcacccacgggctgggc

SEQ ID NO: 7963037 - DNA, 22 bp, Homo sapiens
cagtggcacccacgggctgggc

SEQ ID NO: 7963038 - DNA, 22 bp, Homo sapiens
cagtggcacccacgggctgggc

SEQ ID NO: 7963039 - DNA, 22 bp, Homo sapiens
cagtggcaatgggacagagcac

SEQ ID NO: 7963040 - DNA, 22 bp, Homo sapiens
tcactgcaggtttttcaggagg

SEQ ID NO: 7963041 - DNA, 22 bp, Homo sapiens
cagtggcaatgggacagagcac

SEQ ID NO: 7963042 - DNA, 22 bp, Homo sapiens
cagtggcaatgggacagagcac

SEQ ID NO: 7963043 - DNA, 22 bp, Homo sapiens
cagtggcaatgggacagagcac

SEQ ID NO: 7963044 - DNA, 22 bp, Homo sapiens
cagtggcacatggaccttgtca

SEQ ID NO: 7963045 - DNA, 22 bp, Homo sapiens
cagtggcacccacgggctgggc

SEQ ID NO: 7963046 - DNA, 22 bp, Homo sapiens
cagtggcacatggaccttgtca

SEQ ID NO: 7963047 - DNA, 22 bp, Homo sapiens
tcactgcactccagcactcagg

SEQ ID NO: 7963048 - DNA, 22 bp, Homo sapiens
tcactgcactccagcctgggca

SEQ ID NO: 7963049 - DNA, 22 bp, Homo sapiens
tcactgcactccagcctgggtg

SEQ ID NO: 7963050 - DNA, 22 bp, Homo sapiens
tcactgcactccagcctggtga

SEQ ID NO: 7963051 - DNA, 21 bp, Homo sapiens
tcactgcaatgctaggagaaa

SEQ ID NO: 7963052 - DNA, 22 bp, Homo sapiens
tcactgcactccagcactcagg

SEQ ID NO: 7963053 - DNA, 22 bp, Homo sapiens
tcactgcagagacctctagtca

SEQ ID NO: 7963054 - DNA, 22 bp, Homo sapiens
tcactgcagcctctgcctcccg

SEQ ID NO: 7963055 - DNA, 22 bp, Homo sapiens
tcactgcagcctctgcctcccg

SEQ ID NO: 7963056 - DNA, 22 bp, Homo sapiens
tcactgcaggtttttcaggagg

SEQ ID NO: 7963057 - DNA, 17 bp, Homo sapiens
cagtggcagatcttctc

SEQ ID NO: 7963058 - DNA, 22 bp, Homo sapiens
cagtggcaggatttcagctcag

SEQ ID NO: 7963059 - DNA, 17 bp, Homo sapiens
cagtggcagatcttctc

SEQ ID NO: 7963060 - DNA, 17 bp, Homo sapiens
cagtggcagatcttctc

SEQ ID NO: 7963061 - DNA, 22 bp, Homo sapiens
cagtggcagatcaccaactgga

SEQ ID NO: 7963062 - DNA, 22 bp, Homo sapiens
cagtggcagatcaccaactgga

SEQ ID NO: 7963063 - DNA, 22 bp, Homo sapiens
cagtggcagatcaccaactgga

SEQ ID NO: 7963064 - DNA, 22 bp, Homo sapiens
cagtggcagagccgttgccatc

SEQ ID NO: 7963065 - DNA, 22 bp, Homo sapiens
cagtggcagagccgttgccatc

SEQ ID NO: 7963066 - DNA, 22 bp, Homo sapiens
cagtggcagagaacagagacct

SEQ ID NO: 7963067 - DNA, 22 bp, Homo sapiens
cagtggcagagaacagagacct

SEQ ID NO: 7963068 - DNA, 22 bp, Homo sapiens
cagtggcacttgtcatttctga

SEQ ID NO: 7963069 - DNA, 22 bp, Homo sapiens
cagtggcacttgtcatttctga

SEQ ID NO: 7963070 - DNA, 22 bp, Homo sapiens
cagtggcagagaacagagacct

SEQ ID NO: 7963071 - DNA, 22 bp, Homo sapiens
cagtggcagagaacagagacct

SEQ ID NO: 7963072 - DNA, 22 bp, Homo sapiens
cagtggcagagaacagagacct

SEQ ID NO: 7963073 - DNA, 22 bp, Homo sapiens
cagtggttgtcagcaacaatat

SEQ ID NO: 7963074 - DNA, 22 bp, Homo sapiens
cagtggttgcttgcatggctcc

SEQ ID NO: 7963075 - DNA, 22 bp, Homo sapiens
cagtggttggtagatacttgag

SEQ ID NO: 7963076 - DNA, 22 bp, Homo sapiens
cagtggttgcttgcatggctcc

SEQ ID NO: 7963077 - DNA, 22 bp, Homo sapiens
cagtggttggtagatacttgag

SEQ ID NO: 7963078 - DNA, 22 bp, Homo sapiens
cagtggtttaggtcaaggggag

SEQ ID NO: 7963079 - DNA, 22 bp, Homo sapiens
cagtggttggtagatacttgag

SEQ ID NO: 7963080 - DNA, 22 bp, Homo sapiens
cagtggttgtcagcaacaatat

SEQ ID NO: 7963081 - DNA, 21 bp, Homo sapiens
cagtggtttataaacaacaga

SEQ ID NO: 7963082 - DNA, 22 bp, Homo sapiens
cagtggtttaggtcaaggggag

SEQ ID NO: 7963083 - DNA, 22 bp, Homo sapiens
cagtgggtgaaagatggctaag

SEQ ID NO: 7963084 - DNA, 22 bp, Homo sapiens
cagtgggtgatgagtcctgggg

SEQ ID NO: 7963085 - DNA, 21 bp, Homo sapiens
cagtggttgctgaattagtgg

SEQ ID NO: 7963086 - DNA, 22 bp, Homo sapiens
cagtgggtgaaagatggctaag

SEQ ID NO: 7963087 - DNA, 22 bp, Homo sapiens
cagtggcaggatttcagctcag

SEQ ID NO: 7963088 - DNA, 22 bp, Homo sapiens
cagtggcaggatttcagctcag

SEQ ID NO: 7963089 - DNA, 22 bp, Homo sapiens
tcacactaagacaaaataattt

SEQ ID NO: 7963090 - DNA, 22 bp, Homo sapiens
tcacactaagacaaaataattt

SEQ ID NO: 7963091 - DNA, 22 bp, Homo sapiens
tcacacgatcaaaggtcaattg

SEQ ID NO: 7963092 - DNA, 22 bp, Homo sapiens
tcacacgatcaaaggtcaattg

SEQ ID NO: 7963093 - DNA, 22 bp, Homo sapiens
tcacaccagtttcctttcaatt

SEQ ID NO: 7963094 - DNA, 22 bp, Homo sapiens
tcacaccttgctggctgagtgc

SEQ ID NO: 7963095 - DNA, 22 bp, Homo sapiens
tcacactggcagtgctgaaggc

SEQ ID NO: 7963096 - DNA, 22 bp, Homo sapiens
tcacactggcagtgctgaaggc

SEQ ID NO: 7963097 - DNA, 23 bp, Homo sapiens
tcacactggatacacatgcaaga

SEQ ID NO: 7963098 - DNA, 23 bp, Homo sapiens
tcacactggatacacatgcaaga

SEQ ID NO: 7963099 - DNA, 22 bp, Homo sapiens
tcacactggcagtgctgaaggc

SEQ ID NO: 7963100 - DNA, 22 bp, Homo sapiens
tcacactctgcgggtgaccttt

SEQ ID NO: 7963101 - DNA, 22 bp, Homo sapiens
tcacactaggatgttgtttcta

SEQ ID NO: 7963102 - DNA, 23 bp, Homo sapiens
tcacactggatacacatgcaaga

SEQ ID NO: 7963103 - DNA, 23 bp, Homo sapiens
tcacactggatacacatgcaaga

SEQ ID NO: 7963104 - DNA, 19 bp, Homo sapiens
cagtggagattggaggagg

SEQ ID NO: 7963105 - DNA, 19 bp, Homo sapiens
cagtggagattggaggagg

SEQ ID NO: 7963106 - DNA, 19 bp, Homo sapiens
cagtggagattggaggagg

SEQ ID NO: 7963107 - DNA, 19 bp, Homo sapiens
cagtggagattggaggagg

SEQ ID NO: 7963108 - DNA, 22 bp, Homo sapiens
cagtggagaggcatgcttggca

SEQ ID NO: 7963109 - DNA, 22 bp, Homo sapiens
cagtgctgttgtaagctcattg

SEQ ID NO: 7963110 - DNA, 22 bp, Homo sapiens
cagtggagaggcatgcttggca

SEQ ID NO: 7963111 - DNA, 19 bp, Homo sapiens
cagtggagattggaggagg

SEQ ID NO: 7963112 - DNA, 19 bp, Homo sapiens
cagtggagattggaggagg

SEQ ID NO: 7963113 - DNA, 19 bp, Homo sapiens
cagtggagattggaggagg

SEQ ID NO: 7963114 - DNA, 22 bp, Homo sapiens
tcacactgtgaagagacaagca

SEQ ID NO: 7963115 - DNA, 22 bp, Homo sapiens
tcacactgtgaagagacaagca

SEQ ID NO: 7963116 - DNA, 22 bp, Homo sapiens
cagtgctgttgtaagctcattg

SEQ ID NO: 7963117 - DNA, 22 bp, Homo sapiens
cagtgctgttgtaagctcattg

SEQ ID NO: 7963118 - DNA, 22 bp, Homo sapiens
cagtgctgttgtaagctcattg

SEQ ID NO: 7963119 - DNA, 22 bp, Homo sapiens
cagtggcaaggacagtaataat

SEQ ID NO: 7963120 - DNA, 22 bp, Homo sapiens
cagtggcaagtccggtattgaa

SEQ ID NO: 7963121 - DNA, 22 bp, Homo sapiens
cagtggcaagtccggtattgaa

SEQ ID NO: 7963122 - DNA, 22 bp, Homo sapiens
cagtggcaagtccggtattgaa

SEQ ID NO: 7963123 - DNA, 22 bp, Homo sapiens
cagtggcaagtccggtattgaa

SEQ ID NO: 7963124 - DNA, 22 bp, Homo sapiens
cagtggcaagaacagtaataat

SEQ ID NO: 7963125 - DNA, 22 bp, Homo sapiens
cagtggcaaggacagtaataat

SEQ ID NO: 7963126 - DNA, 22 bp, Homo sapiens
cagtggcaagaacagtaataat

SEQ ID NO: 7963127 - DNA, 22 bp, Homo sapiens
cagtggattagccagagctgga

SEQ ID NO: 7963128 - DNA, 22 bp, Homo sapiens
cagtggattaaggagggcagct

SEQ ID NO: 7963129 - DNA, 22 bp, Homo sapiens
cagtggattagccagagctgga

SEQ ID NO: 7963130 - DNA, 22 bp, Homo sapiens
tcacatgtatatgcagcacagc

SEQ ID NO: 7963131 - DNA, 22 bp, Homo sapiens
tcacatgtatatgcagcacagc

SEQ ID NO: 7963132 - DNA, 22 bp, Homo sapiens
tcacatgtactgtctgtgacat

SEQ ID NO: 7963133 - DNA, 22 bp, Homo sapiens
tcacatgtatatgcagcacagc

SEQ ID NO: 7963134 - DNA, 22 bp, Homo sapiens
tcacatgtactgtctgtgacat

SEQ ID NO: 7963135 - DNA, 22 bp, Homo sapiens
cagtggcaatgggacagagcac

SEQ ID NO: 7963136 - DNA, 22 bp, Homo sapiens
cagtggcaatgggacagagcac

SEQ ID NO: 7963137 - DNA, 22 bp, Homo sapiens
cagtggcaatgggacagagcac

SEQ ID NO: 7963138 - DNA, 22 bp, Homo sapiens
cagtggaggccttgggaccttt

SEQ ID NO: 7963139 - DNA, 22 bp, Homo sapiens
cagtggaggccttgggaccttt

SEQ ID NO: 7963140 - DNA, 22 bp, Homo sapiens
cagtggaggccttgggaccttt

SEQ ID NO: 7963141 - DNA, 22 bp, Homo sapiens
cagtggaggccttgggaccttt

SEQ ID NO: 7963142 - DNA, 19 bp, Homo sapiens
cagtggagattggaggagg

SEQ ID NO: 7963143 - DNA, 22 bp, Homo sapiens
cagtggaggccttgggaccttt

SEQ ID NO: 7963144 - DNA, 22 bp, Homo sapiens
cagtggaggctcaagtgtgctt

SEQ ID NO: 7963145 - DNA, 22 bp, Homo sapiens
cagtggagtgggactggtctga

SEQ ID NO: 7963146 - DNA, 22 bp, Homo sapiens
cagtggagtgggactggtctga

SEQ ID NO: 7963147 - DNA, 22 bp, Homo sapiens
cagtggagtgggactggtctga

SEQ ID NO: 7963148 - DNA, 22 bp, Homo sapiens
cagtggaggctcaagtgtgctt

SEQ ID NO: 7963149 - DNA, 22 bp, Homo sapiens
cagtggaggctcaagtgtgctt

SEQ ID NO: 7963150 - DNA, 22 bp, Homo sapiens
cagtggaggctcaagtgtgctt

SEQ ID NO: 7963151 - DNA, 22 bp, Homo sapiens
cagtggagtgggactggtctga

SEQ ID NO: 7963152 - DNA, 22 bp, Homo sapiens
cagtgcagaggtgcaagcatgt

SEQ ID NO: 7963153 - DNA, 22 bp, Homo sapiens
cagtgcagaggtgcaagcatgt

SEQ ID NO: 7963154 - DNA, 22 bp, Homo sapiens
cagtgcaggtggcagaggacag

SEQ ID NO: 7963155 - DNA, 22 bp, Homo sapiens
cagtgcagaggccagggaggat

SEQ ID NO: 7963156 - DNA, 22 bp, Homo sapiens
cagtgcagaggccagggaggat

SEQ ID NO: 7963157 - DNA, 22 bp, Homo sapiens
cagtgcagaggtgcaagcatgt

SEQ ID NO: 7963158 - DNA, 22 bp, Homo sapiens
cagtgcagaggtgcaagcatgt

SEQ ID NO: 7963159 - DNA, 22 bp, Homo sapiens
cagtgcagaggtgcaagcatgt

SEQ ID NO: 7963160 - DNA, 22 bp, Homo sapiens
cagtgcaggtggcagaggacag

SEQ ID NO: 7963161 - DNA, 22 bp, Homo sapiens
cagtgcaggtggcagaggacag

SEQ ID NO: 7963162 - DNA, 22 bp, Homo sapiens
cagtgcaggtttagggctgggg

SEQ ID NO: 7963163 - DNA, 22 bp, Homo sapiens
cagtgcaggtttagggctgggg

SEQ ID NO: 7963164 - DNA, 22 bp, Homo sapiens
cagtgcaggtttagggctgggg

SEQ ID NO: 7963165 - DNA, 22 bp, Homo sapiens
cagtgcaggtttagggctgggg

SEQ ID NO: 7963166 - DNA, 22 bp, Homo sapiens
cagtgcaggtttagggctgggg

SEQ ID NO: 7963167 - DNA, 22 bp, Homo sapiens
cagtgcaggtggcagaggacag

SEQ ID NO: 7963168 - DNA, 22 bp, Homo sapiens
cagtgcaggtggcagaggacag

SEQ ID NO: 7963169 - DNA, 22 bp, Homo sapiens
cagtgcaggtggcagaggacag

SEQ ID NO: 7963170 - DNA, 22 bp, Homo sapiens
cagtgcaggtggcagaggacag

SEQ ID NO: 7963171 - DNA, 22 bp, Homo sapiens
cagtgcagttggtggcaggggt

SEQ ID NO: 7963172 - DNA, 22 bp, Homo sapiens
cagtgcagttggtggcaggggt

SEQ ID NO: 7963173 - DNA, 22 bp, Homo sapiens
cagtgcagttggtggcaggggt

SEQ ID NO: 7963174 - DNA, 22 bp, Homo sapiens
cagtgcagttggtggcaggggt

SEQ ID NO: 7963175 - DNA, 22 bp, Homo sapiens
cagtgcagttggtggcaggggt

SEQ ID NO: 7963176 - DNA, 22 bp, Homo sapiens
cagtgcagttggtggcaggggt

SEQ ID NO: 7963177 - DNA, 22 bp, Homo sapiens
cagtgcagttggtggcaggggt

SEQ ID NO: 7963178 - DNA, 22 bp, Homo sapiens
cagtgcagttggtggcaggggt

SEQ ID NO: 7963179 - DNA, 22 bp, Homo sapiens
cagtgcagttggtggcaggggt

SEQ ID NO: 7963180 - DNA, 22 bp, Homo sapiens
cagtgcagttggtggcaggggt

SEQ ID NO: 7963181 - DNA, 22 bp, Homo sapiens
cagtgcagttggtggcaggggt

SEQ ID NO: 7963182 - DNA, 22 bp, Homo sapiens
cagtgcaggtttagggctgggg

SEQ ID NO: 7963183 - DNA, 22 bp, Homo sapiens
cagtgcaggtttagggctgggg

SEQ ID NO: 7963184 - DNA, 22 bp, Homo sapiens
cagtgcagtcaaggaagaacca

SEQ ID NO: 7963185 - DNA, 22 bp, Homo sapiens
cagtgcaggtttagggctgggg

SEQ ID NO: 7963186 - DNA, 22 bp, Homo sapiens
cagtgcaggtttagggctgggg

SEQ ID NO: 7963187 - DNA, 22 bp, Homo sapiens
cagtgcagtcaaggaagaacca

SEQ ID NO: 7963188 - DNA, 22 bp, Homo sapiens
cagtgcagtcaaggaagaacca

SEQ ID NO: 7963189 - DNA, 22 bp, Homo sapiens
cagtgcagtcaaggaagaacca

SEQ ID NO: 7963190 - DNA, 22 bp, Homo sapiens
cagtgcagtcaaggaagaacca

SEQ ID NO: 7963191 - DNA, 22 bp, Homo sapiens
cagtgcagtcaaggaagaacca

SEQ ID NO: 7963192 - DNA, 22 bp, Homo sapiens
cagtgcagtcaaggaagaacca

SEQ ID NO: 7963193 - DNA, 22 bp, Homo sapiens
cagtgcagtttcccagatgctg

SEQ ID NO: 7963194 - DNA, 22 bp, Homo sapiens
cagtgcagtttcccagatgctg

SEQ ID NO: 7963195 - DNA, 22 bp, Homo sapiens
cagtgcagttggtggcaggggt

SEQ ID NO: 7963196 - DNA, 22 bp, Homo sapiens
cagtgcagtttcccagatgctg

SEQ ID NO: 7963197 - DNA, 22 bp, Homo sapiens
cagtgcagtttcccagatgctg

SEQ ID NO: 7963198 - DNA, 22 bp, Homo sapiens
cagtgcagtttcccagatgctg

SEQ ID NO: 7963199 - DNA, 22 bp, Homo sapiens
cagtgcagtttcccagatgctg

SEQ ID NO: 7963200 - DNA, 22 bp, Homo sapiens
cagtgcagtttcccagatgctg

SEQ ID NO: 7963201 - DNA, 22 bp, Homo sapiens
cagtgcagtttcccagatgctg

SEQ ID NO: 7963202 - DNA, 20 bp, Homo sapiens
tcacacatggtaagctatga

SEQ ID NO: 7963203 - DNA, 22 bp, Homo sapiens
tcacacatgtaagggctttgga

SEQ ID NO: 7963204 - DNA, 22 bp, Homo sapiens
cagtgcatagagagctcctgac

SEQ ID NO: 7963205 - DNA, 22 bp, Homo sapiens
cagtgcatagatcctgaggcct

SEQ ID NO: 7963206 - DNA, 22 bp, Homo sapiens
cagtgcatagatcctgaggcct

SEQ ID NO: 7963207 - DNA, 22 bp, Homo sapiens
tcacacatttctcaagtgtagg

SEQ ID NO: 7963208 - DNA, 22 bp, Homo sapiens
tcacacatttgaaggcctgtca

SEQ ID NO: 7963209 - DNA, 22 bp, Homo sapiens
tcacaccaggagcagtgccaga

SEQ ID NO: 7963210 - DNA, 16 bp, Homo sapiens
tcacacatttgttggt

SEQ ID NO: 7963211 - DNA, 22 bp, Homo sapiens
tcacacattctaggtatgttga

SEQ ID NO: 7963212 - DNA, 22 bp, Homo sapiens
tcacacattgttgcttaagttg

SEQ ID NO: 7963213 - DNA, 22 bp, Homo sapiens
tcacacatttctcaagtgtagg

SEQ ID NO: 7963214 - DNA, 22 bp, Homo sapiens
tttctattgatctaataaacat

SEQ ID NO: 7963215 - DNA, 22 bp, Homo sapiens
tttctattgatctaataaacat

SEQ ID NO: 7963216 - DNA, 22 bp, Homo sapiens
tttctattgatctaataaacat

SEQ ID NO: 7963217 - DNA, 22 bp, Homo sapiens
tttctattgatctaataaacat

SEQ ID NO: 7963218 - DNA, 22 bp, Homo sapiens
tttctattgatctaataaacat

SEQ ID NO: 7963219 - DNA, 22 bp, Homo sapiens
tttctattctggatctgtggca

SEQ ID NO: 7963220 - DNA, 22 bp, Homo sapiens
tttctattctggatctgtggca

SEQ ID NO: 7963221 - DNA, 22 bp, Homo sapiens
tttctattctggatctgtggca

SEQ ID NO: 7963222 - DNA, 20 bp, Homo sapiens
tttctatggggccagcacat

SEQ ID NO: 7963223 - DNA, 20 bp, Homo sapiens
tttctatggggccagcacat

SEQ ID NO: 7963224 - DNA, 22 bp, Homo sapiens
tttctatatgaggagctaaagt

SEQ ID NO: 7963225 - DNA, 22 bp, Homo sapiens
tttctatatgaggagctaaagt

SEQ ID NO: 7963226 - DNA, 22 bp, Homo sapiens
tttctattggcgtcactgttgt

SEQ ID NO: 7963227 - DNA, 22 bp, Homo sapiens
tttctattggcgtcactgttgt

SEQ ID NO: 7963228 - DNA, 22 bp, Homo sapiens
tttctattggcgtcactgttgt

SEQ ID NO: 7963229 - DNA, 22 bp, Homo sapiens
tttctattggcgtcactgttgt

SEQ ID NO: 7963230 - DNA, 22 bp, Homo sapiens
tttctattgatctaataaacat

SEQ ID NO: 7963231 - DNA, 22 bp, Homo sapiens
tttgaaatctaatcaaggaaca

SEQ ID NO: 7963232 - DNA, 22 bp, Homo sapiens
tttgaaatctaatcaaggaaca

SEQ ID NO: 7963233 - DNA, 22 bp, Homo sapiens
tttgaaatctaatcaaggaaca

SEQ ID NO: 7963234 - DNA, 22 bp, Homo sapiens
tttgaaatatgtgtcttttgaa

SEQ ID NO: 7963235 - DNA, 22 bp, Homo sapiens
tttgaaattaagatattgtcca

SEQ ID NO: 7963236 - DNA, 22 bp, Homo sapiens
tttgaaattaagatattgtcca

SEQ ID NO: 7963237 - DNA, 22 bp, Homo sapiens
tttgaaatgtatcagtataggt

SEQ ID NO: 7963238 - DNA, 22 bp, Homo sapiens
tttgaaatgtatcagtataggt

SEQ ID NO: 7963239 - DNA, 22 bp, Homo sapiens
tttgaaatatgaggcattatga

SEQ ID NO: 7963240 - DNA, 22 bp, Homo sapiens
tttgaaatatgaggcattatga

SEQ ID NO: 7963241 - DNA, 22 bp, Homo sapiens
tttgaaatatgtgatgagagag

SEQ ID NO: 7963242 - DNA, 22 bp, Homo sapiens
tttgaaatatgtgatgagagag

SEQ ID NO: 7963243 - DNA, 22 bp, Homo sapiens
tttgaaatatgtgatgagagag

SEQ ID NO: 7963244 - DNA, 22 bp, Homo sapiens
tttgaaatatgaggcattatga

SEQ ID NO: 7963245 - DNA, 22 bp, Homo sapiens
tttgaaatatgtgatgagagag

SEQ ID NO: 7963246 - DNA, 22 bp, Homo sapiens
tttctagagttcatcatggtaa

SEQ ID NO: 7963247 - DNA, 22 bp, Homo sapiens
tttctagatattccttgaagtg

SEQ ID NO: 7963248 - DNA, 22 bp, Homo sapiens
tttctagagttcatcatggtaa

SEQ ID NO: 7963249 - DNA, 22 bp, Homo sapiens
tttctagagtgggcatgtctta

SEQ ID NO: 7963250 - DNA, 22 bp, Homo sapiens
tttctagagttcatcatggtaa

SEQ ID NO: 7963251 - DNA, 22 bp, Homo sapiens
tttctagatcaaacttttatat

SEQ ID NO: 7963252 - DNA, 22 bp, Homo sapiens
tttctagatattcgcagataga

SEQ ID NO: 7963253 - DNA, 22 bp, Homo sapiens
tttctagatcaaacttttatat

SEQ ID NO: 7963254 - DNA, 22 bp, Homo sapiens
tttctagatgagttttgaagat

SEQ ID NO: 7963255 - DNA, 22 bp, Homo sapiens
tttctagatattcgcagataga

SEQ ID NO: 7963256 - DNA, 22 bp, Homo sapiens
tttctagacatttctatgtaca

SEQ ID NO: 7963257 - DNA, 22 bp, Homo sapiens
tttctagactcaaagaggatat

SEQ ID NO: 7963258 - DNA, 16 bp, Homo sapiens
tttctagagacgaggc

SEQ ID NO: 7963259 - DNA, 22 bp, Homo sapiens
tttctagagataactcaaccat

SEQ ID NO: 7963260 - DNA, 22 bp, Homo sapiens
tttctagacatttctatgtaca

SEQ ID NO: 7963261 - DNA, 22 bp, Homo sapiens
tttctaaggtgaggtagaaaat

SEQ ID NO: 7963262 - DNA, 22 bp, Homo sapiens
tttctagagtgggcatgtctta

SEQ ID NO: 7963263 - DNA, 22 bp, Homo sapiens
tttctagagtgggcatgtctta

SEQ ID NO: 7963264 - DNA, 22 bp, Homo sapiens
tttctagagtgggcatgtctta

SEQ ID NO: 7963265 - DNA, 22 bp, Homo sapiens
tttctagagtgggcatgtctta

SEQ ID NO: 7963266 - DNA, 22 bp, Homo sapiens
tttctagaggctccaggggagt

SEQ ID NO: 7963267 - DNA, 22 bp, Homo sapiens
tttctagctgtaggaagctgag

SEQ ID NO: 7963268 - DNA, 17 bp, Homo sapiens
tttctagattatcctct

SEQ ID NO: 7963269 - DNA, 17 bp, Homo sapiens
tttctagattatcctct

SEQ ID NO: 7963270 - DNA, 22 bp, Homo sapiens
tttctagatgcggggcttgtgc

SEQ ID NO: 7963271 - DNA, 22 bp, Homo sapiens
tttctagatgatacggtatgtg

SEQ ID NO: 7963272 - DNA, 22 bp, Homo sapiens
tttctagatgcggggcttgtgc

SEQ ID NO: 7963273 - DNA, 17 bp, Homo sapiens
tttctagattatcctct

SEQ ID NO: 7963274 - DNA, 22 bp, Homo sapiens
tttctagatgcttttgaaaatc

SEQ ID NO: 7963275 - DNA, 22 bp, Homo sapiens
tttctaggtcttccatactgcc

SEQ ID NO: 7963276 - DNA, 22 bp, Homo sapiens
tttctagggctcttgtcttctg

SEQ ID NO: 7963277 - DNA, 22 bp, Homo sapiens
tttctaggtcttccatactgcc

SEQ ID NO: 7963278 - DNA, 22 bp, Homo sapiens
tttctaggcacagtgtcttccc

SEQ ID NO: 7963279 - DNA, 22 bp, Homo sapiens
tttctaggacatgataggatat

SEQ ID NO: 7963280 - DNA, 22 bp, Homo sapiens
tttctaggacatgataggatat

SEQ ID NO: 7963281 - DNA, 22 bp, Homo sapiens
tttctaggacatgataggatat

SEQ ID NO: 7963282 - DNA, 22 bp, Homo sapiens
tttctaggaaaagatagaagga

SEQ ID NO: 7963283 - DNA, 22 bp, Homo sapiens
tttctagtggttaagatttaca

SEQ ID NO: 7963284 - DNA, 22 bp, Homo sapiens
tttctagttctaccacagtaat

SEQ ID NO: 7963285 - DNA, 22 bp, Homo sapiens
tttctagtggttaagatttaca

SEQ ID NO: 7963286 - DNA, 22 bp, Homo sapiens
tttctagttctaccacagtaat

SEQ ID NO: 7963287 - DNA, 22 bp, Homo sapiens
tttctagttgttcatgaaagga

SEQ ID NO: 7963288 - DNA, 19 bp, Homo sapiens
tttctagtttcagcttgtc

SEQ ID NO: 7963289 - DNA, 22 bp, Homo sapiens
tttctataaaaagtgctaggat

SEQ ID NO: 7963290 - DNA, 22 bp, Homo sapiens
tttctataaaaagtgctaggat

SEQ ID NO: 7963291 - DNA, 22 bp, Homo sapiens
tttctataactggactggattg

SEQ ID NO: 7963292 - DNA, 22 bp, Homo sapiens
tttctatatcttacctattgta

SEQ ID NO: 7963293 - DNA, 22 bp, Homo sapiens
tttctatatcttacctattgta

SEQ ID NO: 7963294 - DNA, 22 bp, Homo sapiens
tttctataatctaccatgccag

SEQ ID NO: 7963295 - DNA, 22 bp, Homo sapiens
tttctatagctttcttgggagt

SEQ ID NO: 7963296 - DNA, 22 bp, Homo sapiens
tttctagtaatcaatataaagt

SEQ ID NO: 7963297 - DNA, 22 bp, Homo sapiens
tttctaggtgttcacagagcat

SEQ ID NO: 7963298 - DNA, 22 bp, Homo sapiens
tttctagtatataactagatct

SEQ ID NO: 7963299 - DNA, 22 bp, Homo sapiens
tttctagtatataactagatct

SEQ ID NO: 7963300 - DNA, 22 bp, Homo sapiens
tttctaggtgttcacagagcat

SEQ ID NO: 7963301 - DNA, 22 bp, Homo sapiens
tttctaggtttacaatactgca

SEQ ID NO: 7963302 - DNA, 22 bp, Homo sapiens
tttctagtaaaagctaattacc

SEQ ID NO: 7963303 - DNA, 22 bp, Homo sapiens
tttctagtctcgatctcttaat

SEQ ID NO: 7963304 - DNA, 22 bp, Homo sapiens
tttctagtctcgatctcttaat

SEQ ID NO: 7963305 - DNA, 22 bp, Homo sapiens
tttctagtcagccatatctagt

SEQ ID NO: 7963306 - DNA, 22 bp, Homo sapiens
tttctagtcagccatatctagt

SEQ ID NO: 7963307 - DNA, 22 bp, Homo sapiens
tttctagtcagccatatctagt

SEQ ID NO: 7963308 - DNA, 22 bp, Homo sapiens
tttctagtcctcatgcatcatt

SEQ ID NO: 7963309 - DNA, 22 bp, Homo sapiens
tttgacatctaagaattcttac

SEQ ID NO: 7963310 - DNA, 22 bp, Homo sapiens
tttgacatctaagaattcttac

SEQ ID NO: 7963311 - DNA, 22 bp, Homo sapiens
tttgacatcactgacctgtttt

SEQ ID NO: 7963312 - DNA, 22 bp, Homo sapiens
tttgacatcaataccctagaat

SEQ ID NO: 7963313 - DNA, 22 bp, Homo sapiens
tttgacagtgctattaagaaac

SEQ ID NO: 7963314 - DNA, 22 bp, Homo sapiens
tttgacagcataatcctacacc

SEQ ID NO: 7963315 - DNA, 22 bp, Homo sapiens
tttgacaggactaacatatggc

SEQ ID NO: 7963316 - DNA, 22 bp, Homo sapiens
tttgacaggaattctctctagg

SEQ ID NO: 7963317 - DNA, 22 bp, Homo sapiens
tttgacaggactaacatatggc

SEQ ID NO: 7963318 - DNA, 22 bp, Homo sapiens
tttgacatgcaaagcactttag

SEQ ID NO: 7963319 - DNA, 22 bp, Homo sapiens
tttgacatgaagtagcttataa

SEQ ID NO: 7963320 - DNA, 22 bp, Homo sapiens
tttgacatgaagtagcttataa

SEQ ID NO: 7963321 - DNA, 22 bp, Homo sapiens
tttgacatgtgcttataacttt

SEQ ID NO: 7963322 - DNA, 22 bp, Homo sapiens
tttgacatgcaaagcactttag

SEQ ID NO: 7963323 - DNA, 22 bp, Homo sapiens
tttgacatggaataactcattt

SEQ ID NO: 7963324 - DNA, 22 bp, Homo sapiens
tttgacatgtgcttataacttt

SEQ ID NO: 7963325 - DNA, 22 bp, Homo sapiens
tttgacattaaggaacatatat

SEQ ID NO: 7963326 - DNA, 22 bp, Homo sapiens
tttgacattaaggaacatatat

SEQ ID NO: 7963327 - DNA, 22 bp, Homo sapiens
tttgacatgtgcttataacttt

SEQ ID NO: 7963328 - DNA, 22 bp, Homo sapiens
tttgacattatcctgttactgg

SEQ ID NO: 7963329 - DNA, 22 bp, Homo sapiens
tttgacattatcctgttactgg

SEQ ID NO: 7963330 - DNA, 22 bp, Homo sapiens
tttgacattatcctgttactgg

SEQ ID NO: 7963331 - DNA, 22 bp, Homo sapiens
tttgacattaaggaacatatat

SEQ ID NO: 7963332 - DNA, 22 bp, Homo sapiens
tttgacattgaaagcagaatcg

SEQ ID NO: 7963333 - DNA, 22 bp, Homo sapiens
tttgacattgaaagcagaatcg

SEQ ID NO: 7963334 - DNA, 22 bp, Homo sapiens
tttgacattgccaatttgctca

SEQ ID NO: 7963335 - DNA, 22 bp, Homo sapiens
tttgacattgaaagcagaatcg

SEQ ID NO: 7963336 - DNA, 22 bp, Homo sapiens
tttgacattgccaatttgctca

SEQ ID NO: 7963337 - DNA, 22 bp, Homo sapiens
tttgacattggcttattctgtt

SEQ ID NO: 7963338 - DNA, 22 bp, Homo sapiens
tttgacattgccaatttgctca

SEQ ID NO: 7963339 - DNA, 22 bp, Homo sapiens
tttgacattggcttattctgtt

SEQ ID NO: 7963340 - DNA, 22 bp, Homo sapiens
tttgagaaggtgacaaattcta

SEQ ID NO: 7963341 - DNA, 22 bp, Homo sapiens
tttgagaaggtgacaaattcta

SEQ ID NO: 7963342 - DNA, 22 bp, Homo sapiens
tttgagaaggtgacaaattcta

SEQ ID NO: 7963343 - DNA, 22 bp, Homo sapiens
tttgagaagtaattcaagacat

SEQ ID NO: 7963344 - DNA, 22 bp, Homo sapiens
tttgagaagtaattcaagacat

SEQ ID NO: 7963345 - DNA, 19 bp, Homo sapiens
tttgagaagttattatcta

SEQ ID NO: 7963346 - DNA, 19 bp, Homo sapiens
tttgagaagttattatcta

SEQ ID NO: 7963347 - DNA, 19 bp, Homo sapiens
tttgagaagttattatcta

SEQ ID NO: 7963348 - DNA, 22 bp, Homo sapiens
tttgaacatgctgcatgataat

SEQ ID NO: 7963349 - DNA, 22 bp, Homo sapiens
tttgaacatgctgcatgataat

SEQ ID NO: 7963350 - DNA, 22 bp, Homo sapiens
tttgaacatgctgcatgataat

SEQ ID NO: 7963351 - DNA, 22 bp, Homo sapiens
tttgaacatgctgcatgataat

SEQ ID NO: 7963352 - DNA, 22 bp, Homo sapiens
tttgaacattcaacagacccag

SEQ ID NO: 7963353 - DNA, 23 bp, Homo sapiens
tttgaacatttctagattacata

SEQ ID NO: 7963354 - DNA, 22 bp, Homo sapiens
tttgaacctgagcttctgcatg

SEQ ID NO: 7963355 - DNA, 22 bp, Homo sapiens
tttgaaccccgaccaaacactg

SEQ ID NO: 7963356 - DNA, 22 bp, Homo sapiens
tttgaacctgagcttctgcatg

SEQ ID NO: 7963357 - DNA, 22 bp, Homo sapiens
tttgaactacctctccttagca

SEQ ID NO: 7963358 - DNA, 22 bp, Homo sapiens
tttgaaattggctcattggttt

SEQ ID NO: 7963359 - DNA, 22 bp, Homo sapiens
tttgaaattggctcattggttt

SEQ ID NO: 7963360 - DNA, 22 bp, Homo sapiens
tttgaacaagagcttcacatta

SEQ ID NO: 7963361 - DNA, 22 bp, Homo sapiens
tttgaacaggagtatctatagt

SEQ ID NO: 7963362 - DNA, 22 bp, Homo sapiens
tttgaacagggaatgttccaca

SEQ ID NO: 7963363 - DNA, 22 bp, Homo sapiens
tttgaagacatttgaatacttt

SEQ ID NO: 7963364 - DNA, 22 bp, Homo sapiens
tttgaagaccttatctctaaat

SEQ ID NO: 7963365 - DNA, 22 bp, Homo sapiens
tttgaagaccttatctctaaat

SEQ ID NO: 7963366 - DNA, 22 bp, Homo sapiens
tttgaagactactgggagtgaa

SEQ ID NO: 7963367 - DNA, 22 bp, Homo sapiens
tttgaagactactgggagtgaa

SEQ ID NO: 7963368 - DNA, 22 bp, Homo sapiens
tttgaagactactgggagtgaa

SEQ ID NO: 7963369 - DNA, 22 bp, Homo sapiens
tttgaagacatattgttacata

SEQ ID NO: 7963370 - DNA, 22 bp, Homo sapiens
tttgaagacatattgttacata

SEQ ID NO: 7963371 - DNA, 22 bp, Homo sapiens
tttgaagacatattgttacata

SEQ ID NO: 7963372 - DNA, 22 bp, Homo sapiens
tttgaagacatattgttacata

SEQ ID NO: 7963373 - DNA, 22 bp, Homo sapiens
tttgaagaagctgacctatttt

SEQ ID NO: 7963374 - DNA, 22 bp, Homo sapiens
tttgaagaagctgacctatttt

SEQ ID NO: 7963375 - DNA, 22 bp, Homo sapiens
tttgaactgttctaggatttaa

SEQ ID NO: 7963376 - DNA, 23 bp, Homo sapiens
tttgaagaagtgaatatcatata

SEQ ID NO: 7963377 - DNA, 23 bp, Homo sapiens
tttgaagaagtgaatatcatata

SEQ ID NO: 7963378 - DNA, 23 bp, Homo sapiens
tttgaagaagtgaatatcatata

SEQ ID NO: 7963379 - DNA, 22 bp, Homo sapiens
tttgaagacagatcaatataag

SEQ ID NO: 7963380 - DNA, 22 bp, Homo sapiens
tttgtcatcagttattaatatg

SEQ ID NO: 7963381 - DNA, 19 bp, Homo sapiens
tttgtcatggtgagttgtt

SEQ ID NO: 7963382 - DNA, 22 bp, Homo sapiens
tttggtaaatgcaggttcttct

SEQ ID NO: 7963383 - DNA, 22 bp, Homo sapiens
tttggtaaccttgcattcttta

SEQ ID NO: 7963384 - DNA, 22 bp, Homo sapiens
tttgtcataactctgctgcaag

SEQ ID NO: 7963385 - DNA, 22 bp, Homo sapiens
tttgtcatatcacacaattttg

SEQ ID NO: 7963386 - DNA, 22 bp, Homo sapiens
tttgtcatatagactattgtga

SEQ ID NO: 7963387 - DNA, 22 bp, Homo sapiens
tttgtcatttccctgattaaag

SEQ ID NO: 7963388 - DNA, 22 bp, Homo sapiens
tttgtcatttccctgattaaag

SEQ ID NO: 7963389 - DNA, 21 bp, Homo sapiens
tttgtccacctgtgttcacca

SEQ ID NO: 7963390 - DNA, 21 bp, Homo sapiens
tttgtccacctgtgttcacca

SEQ ID NO: 7963391 - DNA, 22 bp, Homo sapiens
tttgtcattctgtgtatttaaa

SEQ ID NO: 7963392 - DNA, 22 bp, Homo sapiens
tttgtcatgttttgtaatgtct

SEQ ID NO: 7963393 - DNA, 22 bp, Homo sapiens
tttgtcatgttttgtaatgtct

SEQ ID NO: 7963394 - DNA, 22 bp, Homo sapiens
tttgtcctctccatgtacaata

SEQ ID NO: 7963395 - DNA, 22 bp, Homo sapiens
tttgtcctctccatgtacaata

SEQ ID NO: 7963396 - DNA, 22 bp, Homo sapiens
tttgtcctctccatgtacaata

SEQ ID NO: 7963397 - DNA, 22 bp, Homo sapiens
tttgtcctataatcctcttaca

SEQ ID NO: 7963398 - DNA, 20 bp, Homo sapiens
tttgtccagcgtctactctg

SEQ ID NO: 7963399 - DNA, 22 bp, Homo sapiens
tttgggcatatagctgttccct

SEQ ID NO: 7963400 - DNA, 22 bp, Homo sapiens
tttgggcagtgggcttagcggc

SEQ ID NO: 7963401 - DNA, 22 bp, Homo sapiens
tttgggcagtgggcttagcggc

SEQ ID NO: 7963402 - DNA, 22 bp, Homo sapiens
tttgggcagtagatgtatcact

SEQ ID NO: 7963403 - DNA, 22 bp, Homo sapiens
tttgggcagtcctggaatttgt

SEQ ID NO: 7963404 - DNA, 22 bp, Homo sapiens
tttgggcagtcctggaatttgt

SEQ ID NO: 7963405 - DNA, 22 bp, Homo sapiens
tttgggcaggcttttccctaga

SEQ ID NO: 7963406 - DNA, 22 bp, Homo sapiens
tttgggaaagtgtcttttgtat

SEQ ID NO: 7963407 - DNA, 22 bp, Homo sapiens
tttgggcagtagatgtatcact

SEQ ID NO: 7963408 - DNA, 22 bp, Homo sapiens
tttgggcaggcttttccctaga

SEQ ID NO: 7963409 - DNA, 22 bp, Homo sapiens
tttgggctcttgctgacctggg

SEQ ID NO: 7963410 - DNA, 22 bp, Homo sapiens
tttgggctcccacaggcttgtg

SEQ ID NO: 7963411 - DNA, 22 bp, Homo sapiens
tttgggctcccacaggcttgtg

SEQ ID NO: 7963412 - DNA, 22 bp, Homo sapiens
tttgggctcaatatttgggctc

SEQ ID NO: 7963413 - DNA, 22 bp, Homo sapiens
tttgggcattagtaagttaagc

SEQ ID NO: 7963414 - DNA, 22 bp, Homo sapiens
tttgggcattagtaagttaagc

SEQ ID NO: 7963415 - DNA, 22 bp, Homo sapiens
tttgggctcactatgctgaaga

SEQ ID NO: 7963416 - DNA, 22 bp, Homo sapiens
tttgggcatgttgtggccagct

SEQ ID NO: 7963417 - DNA, 22 bp, Homo sapiens
tttgggcatatagctgttccct

SEQ ID NO: 7963418 - DNA, 22 bp, Homo sapiens
tttgggcatatagctgttccct

SEQ ID NO: 7963419 - DNA, 22 bp, Homo sapiens
tttgggcatgttgtggccagct

SEQ ID NO: 7963420 - DNA, 22 bp, Homo sapiens
tttgggcattagaatattcttt

SEQ ID NO: 7963421 - DNA, 22 bp, Homo sapiens
tttgggcattagaatattcttt

SEQ ID NO: 7963422 - DNA, 21 bp, Homo sapiens
tttgggcttttactggacgtg

SEQ ID NO: 7963423 - DNA, 22 bp, Homo sapiens
tttgggctgtacaatttctgta

SEQ ID NO: 7963424 - DNA, 22 bp, Homo sapiens
tttgggctggtttgccatgccc

SEQ ID NO: 7963425 - DNA, 18 bp, Homo sapiens
tttgggctgatgttgggc

SEQ ID NO: 7963426 - DNA, 22 bp, Homo sapiens
tttgggctgactgccaagggcc

SEQ ID NO: 7963427 - DNA, 22 bp, Homo sapiens
tttgggctggaattttagtacc

SEQ ID NO: 7963428 - DNA, 22 bp, Homo sapiens
tttgggctggaattttagtacc

SEQ ID NO: 7963429 - DNA, 18 bp, Homo sapiens
tttgggctgatgttgggc

SEQ ID NO: 7963430 - DNA, 22 bp, Homo sapiens
tttgggctgagatgtgggccga

SEQ ID NO: 7963431 - DNA, 22 bp, Homo sapiens
tttggtaaatgcaggttcttct

SEQ ID NO: 7963432 - DNA, 22 bp, Homo sapiens
tttggggctcagcaggctgttt

SEQ ID NO: 7963433 - DNA, 22 bp, Homo sapiens
tttggggctcagcaggctgttt

SEQ ID NO: 7963434 - DNA, 22 bp, Homo sapiens
tttggcaggtggcagctctggg

SEQ ID NO: 7963435 - DNA, 21 bp, Homo sapiens
tttggcagtttcccaggaaat

SEQ ID NO: 7963436 - DNA, 22 bp, Homo sapiens
tttggcagtgaagccctctcat

SEQ ID NO: 7963437 - DNA, 17 bp, Homo sapiens
tttggcagtcttttaca

SEQ ID NO: 7963438 - DNA, 22 bp, Homo sapiens
tttggcatagctctttgttcct

SEQ ID NO: 7963439 - DNA, 22 bp, Homo sapiens
tttggcatgggctatttgcttt

SEQ ID NO: 7963440 - DNA, 20 bp, Homo sapiens
tttggcatcattttgggagc

SEQ ID NO: 7963441 - DNA, 22 bp, Homo sapiens
tttggccacttcatagatcatt

SEQ ID NO: 7963442 - DNA, 22 bp, Homo sapiens
tttggccacagatccttggggg

SEQ ID NO: 7963443 - DNA, 22 bp, Homo sapiens
tttggccacttcatagatcatt

SEQ ID NO: 7963444 - DNA, 22 bp, Homo sapiens
tttggccacttgggagtccagg

SEQ ID NO: 7963445 - DNA, 22 bp, Homo sapiens
tttggccacttgggagtccagg

SEQ ID NO: 7963446 - DNA, 23 bp, Homo sapiens
tttggcatgttaacttcacttac

SEQ ID NO: 7963447 - DNA, 22 bp, Homo sapiens
tttggcatgggctatttgcttt

SEQ ID NO: 7963448 - DNA, 22 bp, Homo sapiens
tttggccaagaaagttctgtgg

SEQ ID NO: 7963449 - DNA, 22 bp, Homo sapiens
tttggccaacaacatggaagct

SEQ ID NO: 7963450 - DNA, 22 bp, Homo sapiens
tttggcgtctctcaggagctca

SEQ ID NO: 7963451 - DNA, 22 bp, Homo sapiens
tttggcggggcaattctgaagc

SEQ ID NO: 7963452 - DNA, 22 bp, Homo sapiens
tttggctactgtacagaaagcc

SEQ ID NO: 7963453 - DNA, 22 bp, Homo sapiens
tttggctaaggggcttctcaac

SEQ ID NO: 7963454 - DNA, 22 bp, Homo sapiens
tttggccatgctcaagggtata

SEQ ID NO: 7963455 - DNA, 18 bp, Homo sapiens
tttggccatgacctggct

SEQ ID NO: 7963456 - DNA, 18 bp, Homo sapiens
tttggccatgacctggct

SEQ ID NO: 7963457 - DNA, 22 bp, Homo sapiens
tttggccatatctatactcagc

SEQ ID NO: 7963458 - DNA, 22 bp, Homo sapiens
tttggcttaacttacatgatat

SEQ ID NO: 7963459 - DNA, 23 bp, Homo sapiens
tttggctgggctgtgggcacacc

SEQ ID NO: 7963460 - DNA, 18 bp, Homo sapiens
tttggctgttcaagagca

SEQ ID NO: 7963461 - DNA, 22 bp, Homo sapiens
tttggctgagaagttgtgcttt

SEQ ID NO: 7963462 - DNA, 22 bp, Homo sapiens
tttggctcttcccgtaccataa

SEQ ID NO: 7963463 - DNA, 22 bp, Homo sapiens
tttggctcttcccgtaccataa

SEQ ID NO: 7963464 - DNA, 20 bp, Homo sapiens
tttggcttcaagtgcattgc

SEQ ID NO: 7963465 - DNA, 21 bp, Homo sapiens
tttggcttctctgctgcagcc

SEQ ID NO: 7963466 - DNA, 22 bp, Homo sapiens
tttggcttaacttacatgatat

SEQ ID NO: 7963467 - DNA, 22 bp, Homo sapiens
tttggcttgcactggcaccaac

SEQ ID NO: 7963468 - DNA, 22 bp, Homo sapiens
tttggctttagtgccttctgat

SEQ ID NO: 7963469 - DNA, 22 bp, Homo sapiens
tttggctcccacagattgcttt

SEQ ID NO: 7963470 - DNA, 22 bp, Homo sapiens
tttggctcatctcagtcctagg

SEQ ID NO: 7963471 - DNA, 22 bp, Homo sapiens
tttggctagccaagaaacaaaa

SEQ ID NO: 7963472 - DNA, 22 bp, Homo sapiens
tttggctctagtaaatataacc

SEQ ID NO: 7963473 - DNA, 22 bp, Homo sapiens
tttggctctgcgtcttcaccca

SEQ ID NO: 7963474 - DNA, 19 bp, Homo sapiens
tttggctctggtcagagag

SEQ ID NO: 7963475 - DNA, 22 bp, Homo sapiens
tttggctctgtgtctccaccca

SEQ ID NO: 7963476 - DNA, 22 bp, Homo sapiens
tttggctctgtgtcttcaccca

SEQ ID NO: 7963477 - DNA, 20 bp, Homo sapiens
tttgctgtgggtgtaagaat

SEQ ID NO: 7963478 - DNA, 20 bp, Homo sapiens
tttgctgtgggtgtaagaat

SEQ ID NO: 7963479 - DNA, 22 bp, Homo sapiens
tttgctgtgggatatccatgtg

SEQ ID NO: 7963480 - DNA, 22 bp, Homo sapiens
tttgctgtcagccgctattttc

SEQ ID NO: 7963481 - DNA, 22 bp, Homo sapiens
tttgctgtcagccgctattttc

SEQ ID NO: 7963482 - DNA, 22 bp, Homo sapiens
tttgctgtgaatccattactgt

SEQ ID NO: 7963483 - DNA, 22 bp, Homo sapiens
tttgctgtgcttacatatgtat

SEQ ID NO: 7963484 - DNA, 20 bp, Homo sapiens
tttgctgtgggtgtaagaat

SEQ ID NO: 7963485 - DNA, 22 bp, Homo sapiens
tttgcttaaaagcggagcaaga

SEQ ID NO: 7963486 - DNA, 22 bp, Homo sapiens
tttgcttaaagttctttctggt

SEQ ID NO: 7963487 - DNA, 22 bp, Homo sapiens
tttgcttaactggtagaatgcg

SEQ ID NO: 7963488 - DNA, 22 bp, Homo sapiens
tttgcttaactggtagaatgcg

SEQ ID NO: 7963489 - DNA, 21 bp, Homo sapiens
tttgcttcaattccagaagct

SEQ ID NO: 7963490 - DNA, 22 bp, Homo sapiens
tttgcttcacaagtatggttct

SEQ ID NO: 7963491 - DNA, 22 bp, Homo sapiens
tttgctgaactaaaattctgaa

SEQ ID NO: 7963492 - DNA, 22 bp, Homo sapiens
tttgctgaccccattctgagtc

SEQ ID NO: 7963493 - DNA, 21 bp, Homo sapiens
tttgctgaatgattccagggc

SEQ ID NO: 7963494 - DNA, 21 bp, Homo sapiens
tttgctgaatgattccagggc

SEQ ID NO: 7963495 - DNA, 22 bp, Homo sapiens
tttgctgaatagattgtaaact

SEQ ID NO: 7963496 - DNA, 22 bp, Homo sapiens
tttgctgaggtgaggtgaaggt

SEQ ID NO: 7963497 - DNA, 22 bp, Homo sapiens
tttgctgagttgaagtttgagg

SEQ ID NO: 7963498 - DNA, 19 bp, Homo sapiens
tttgctggttcaggaaaga

SEQ ID NO: 7963499 - DNA, 22 bp, Homo sapiens
tttgctgggctctgtgccagac

SEQ ID NO: 7963500 - DNA, 22 bp, Homo sapiens
tttgctgggctctgtgccagac

SEQ ID NO: 7963501 - DNA, 22 bp, Homo sapiens
tttgctgcctctcccagctccc

SEQ ID NO: 7963502 - DNA, 22 bp, Homo sapiens
tttgcattctagaaaaatttct

SEQ ID NO: 7963503 - DNA, 22 bp, Homo sapiens
tttgcattcctgcctgcattca

SEQ ID NO: 7963504 - DNA, 22 bp, Homo sapiens
tttgcattcctgcctgcattca

SEQ ID NO: 7963505 - DNA, 22 bp, Homo sapiens
tttgcattgcattaagtattct

SEQ ID NO: 7963506 - DNA, 22 bp, Homo sapiens
tttgcattgtttcaaaagtgaa

SEQ ID NO: 7963507 - DNA, 22 bp, Homo sapiens
tttgcattgtaatatttagttc

SEQ ID NO: 7963508 - DNA, 22 bp, Homo sapiens
tttgcattgcctctgacttatg

SEQ ID NO: 7963509 - DNA, 22 bp, Homo sapiens
tttgcattgtaatatttagttc

SEQ ID NO: 7963510 - DNA, 21 bp, Homo sapiens
tttgcattttacatgtgggga

SEQ ID NO: 7963511 - DNA, 21 bp, Homo sapiens
tttgcattttacatgtgggga

SEQ ID NO: 7963512 - DNA, 22 bp, Homo sapiens
tttgcatttgtttagaacctga

SEQ ID NO: 7963513 - DNA, 22 bp, Homo sapiens
tttgcatttgttcaagtattga

SEQ ID NO: 7963514 - DNA, 22 bp, Homo sapiens
tttgcatttataagttggtgga

SEQ ID NO: 7963515 - DNA, 22 bp, Homo sapiens
tttgcatttataagttggtgga

SEQ ID NO: 7963516 - DNA, 22 bp, Homo sapiens
tttgcatttctaatgagctccg

SEQ ID NO: 7963517 - DNA, 22 bp, Homo sapiens
tttgcatttccagagtagcaga

SEQ ID NO: 7963518 - DNA, 22 bp, Homo sapiens
tttgcatttctcgtaaggaaac

SEQ ID NO: 7963519 - DNA, 22 bp, Homo sapiens
tttgcatttctcgtaaggaaac

SEQ ID NO: 7963520 - DNA, 22 bp, Homo sapiens
tttgcattatctcacttatata

SEQ ID NO: 7963521 - DNA, 22 bp, Homo sapiens
tttgcattatctcacttatata

SEQ ID NO: 7963522 - DNA, 22 bp, Homo sapiens
tttgcattatatttatagaaga

SEQ ID NO: 7963523 - DNA, 22 bp, Homo sapiens
tttgcattatatttatagaaga

SEQ ID NO: 7963524 - DNA, 22 bp, Homo sapiens
tttgcattatctcacttatata

SEQ ID NO: 7963525 - DNA, 22 bp, Homo sapiens
tttgcatgggaggtagtaatca

SEQ ID NO: 7963526 - DNA, 22 bp, Homo sapiens
tttgcattacttgactttagtt

SEQ ID NO: 7963527 - DNA, 22 bp, Homo sapiens
tttgcataggatggacatttta

SEQ ID NO: 7963528 - DNA, 22 bp, Homo sapiens
tttgcataggatggacatttta

SEQ ID NO: 7963529 - DNA, 22 bp, Homo sapiens
tttgcataagtcatgtccagtg

SEQ ID NO: 7963530 - DNA, 22 bp, Homo sapiens
tttgcataaaggagcatttctc

SEQ ID NO: 7963531 - DNA, 22 bp, Homo sapiens
tttgcagttcatctgagaaaaa

SEQ ID NO: 7963532 - DNA, 22 bp, Homo sapiens
tttgcagttcatgttggaaaat

SEQ ID NO: 7963533 - DNA, 22 bp, Homo sapiens
tttgcagttccatccaggcaga

SEQ ID NO: 7963534 - DNA, 22 bp, Homo sapiens
tttgcagtgttcatcagtattt

SEQ ID NO: 7963535 - DNA, 22 bp, Homo sapiens
tttgcagtttcattgctgaaat

SEQ ID NO: 7963536 - DNA, 22 bp, Homo sapiens
tttgcagtttgttcagctcttt

SEQ ID NO: 7963537 - DNA, 22 bp, Homo sapiens
tttgcagtttcattgctgaaat

SEQ ID NO: 7963538 - DNA, 22 bp, Homo sapiens
tttgcagtttcattgctgaaat

SEQ ID NO: 7963539 - DNA, 22 bp, Homo sapiens
tttgcagtttcattgctgaaat

SEQ ID NO: 7963540 - DNA, 22 bp, Homo sapiens
tttgcagtgttcatcagtattt

SEQ ID NO: 7963541 - DNA, 22 bp, Homo sapiens
tttgcagtgtcagcttctgtgt

SEQ ID NO: 7963542 - DNA, 22 bp, Homo sapiens
tttgagcagcagatgcacttag

SEQ ID NO: 7963543 - DNA, 22 bp, Homo sapiens
tttgagctaagtaggtgtcaac

SEQ ID NO: 7963544 - DNA, 22 bp, Homo sapiens
tttgagctatgggcttggattt

SEQ ID NO: 7963545 - DNA, 22 bp, Homo sapiens
tttgagctatgggcttggattt

SEQ ID NO: 7963546 - DNA, 22 bp, Homo sapiens
tttgagcttgtagcattgctat

SEQ ID NO: 7963547 - DNA, 23 bp, Homo sapiens
tttgagctctagatggccctccc

SEQ ID NO: 7963548 - DNA, 17 bp, Homo sapiens
tttgagctggaccctgg

SEQ ID NO: 7963549 - DNA, 22 bp, Homo sapiens
tttgagctgggaggctgaagga

SEQ ID NO: 7963550 - DNA, 22 bp, Homo sapiens
tttgagcttgcatgagccttga

SEQ ID NO: 7963551 - DNA, 22 bp, Homo sapiens
tttgagatggagtcttgctctg

SEQ ID NO: 7963552 - DNA, 20 bp, Homo sapiens
tttgagaccagtctgcccaa

SEQ ID NO: 7963553 - DNA, 22 bp, Homo sapiens
tttgagatggagtcttgctctg

SEQ ID NO: 7963554 - DNA, 22 bp, Homo sapiens
tttgagatggagtcttgctctg

SEQ ID NO: 7963555 - DNA, 22 bp, Homo sapiens
tttgagcagaagggtgacatgc

SEQ ID NO: 7963556 - DNA, 20 bp, Homo sapiens
tttgagaccagtctgcccaa

SEQ ID NO: 7963557 - DNA, 20 bp, Homo sapiens
tttgagaccagtctgcccaa

SEQ ID NO: 7963558 - DNA, 20 bp, Homo sapiens
tttgagaccagtctgcccaa

SEQ ID NO: 7963559 - DNA, 20 bp, Homo sapiens
tttgagaccagtctgcccaa

SEQ ID NO: 7963560 - DNA, 21 bp, Homo sapiens
tttgagaattggtcagagtgc

SEQ ID NO: 7963561 - DNA, 22 bp, Homo sapiens
tttgagaatggtaagtggatcg

SEQ ID NO: 7963562 - DNA, 21 bp, Homo sapiens
tttgagaattggtcagagtgc

SEQ ID NO: 7963563 - DNA, 22 bp, Homo sapiens
tttgagaatggtaagtggatcg

SEQ ID NO: 7963564 - DNA, 18 bp, Homo sapiens
tttgagaatgcatgactg

SEQ ID NO: 7963565 - DNA, 22 bp, Homo sapiens
tttgtctgccttgctggactgt

SEQ ID NO: 7963566 - DNA, 20 bp, Homo sapiens
tttgtctgttaagtgtttct

SEQ ID NO: 7963567 - DNA, 22 bp, Homo sapiens
tttgtctgttattgttctcatg

SEQ ID NO: 7963568 - DNA, 20 bp, Homo sapiens
tttgtctgttaagtgtttct

SEQ ID NO: 7963569 - DNA, 20 bp, Homo sapiens
tttgtctgttaagtgtttct

SEQ ID NO: 7963570 - DNA, 22 bp, Homo sapiens
tttgtcttaaatcttgttactg

SEQ ID NO: 7963571 - DNA, 18 bp, Homo sapiens
tttgtcctgtggcagctg

SEQ ID NO: 7963572 - DNA, 22 bp, Homo sapiens
tttgtccttgaatcaattcaca

SEQ ID NO: 7963573 - DNA, 22 bp, Homo sapiens
tttgtcctgtagttacagtgga

SEQ ID NO: 7963574 - DNA, 22 bp, Homo sapiens
tttgtcctgtagttacagtgga

SEQ ID NO: 7963575 - DNA, 22 bp, Homo sapiens
tttgtctacaaaaagtgtacag

SEQ ID NO: 7963576 - DNA, 22 bp, Homo sapiens
tttgtctataaattactactgc

SEQ ID NO: 7963577 - DNA, 22 bp, Homo sapiens
tttgtctaattgcaaggcaagt

SEQ ID NO: 7963578 - DNA, 22 bp, Homo sapiens
tttgtcttcatccttcgagctg

SEQ ID NO: 7963579 - DNA, 22 bp, Homo sapiens
tttgtcttatccaatctctcag

SEQ ID NO: 7963580 - DNA, 22 bp, Homo sapiens
tttgtcttcatccttcgagctg

SEQ ID NO: 7963581 - DNA, 22 bp, Homo sapiens
tttgtcttgaggctggggaagt

SEQ ID NO: 7963582 - DNA, 22 bp, Homo sapiens
tttgtcttccccctttaatcag

SEQ ID NO: 7963583 - DNA, 22 bp, Homo sapiens
tttgtcttccccctttaatcag

SEQ ID NO: 7963584 - DNA, 22 bp, Homo sapiens
tttgtcttaaatcttgttactg

SEQ ID NO: 7963585 - DNA, 22 bp, Homo sapiens
tttgtcttaaatcttgttactg

SEQ ID NO: 7963586 - DNA, 22 bp, Homo sapiens
tttgtcttaaatcttgttactg

SEQ ID NO: 7963587 - DNA, 22 bp, Homo sapiens
tttgtctgttattgttctcatg

SEQ ID NO: 7963588 - DNA, 22 bp, Homo sapiens
tttgtcttatccaatctctcag

SEQ ID NO: 7963589 - DNA, 23 bp, Homo sapiens
tttgtgcagaagacaaagtggcc

SEQ ID NO: 7963590 - DNA, 19 bp, Homo sapiens
tttgtgcagcaacattaat

SEQ ID NO: 7963591 - DNA, 22 bp, Homo sapiens
tttgtgcaatttatgtactata

SEQ ID NO: 7963592 - DNA, 22 bp, Homo sapiens
tttgtgattaattttcaacctc

SEQ ID NO: 7963593 - DNA, 22 bp, Homo sapiens
tttgtgatctcctccctctaga

SEQ ID NO: 7963594 - DNA, 22 bp, Homo sapiens
tttgtgctaatgctagattact

SEQ ID NO: 7963595 - DNA, 22 bp, Homo sapiens
tttgtggaactctcttcttgca

SEQ ID NO: 7963596 - DNA, 22 bp, Homo sapiens
tttgtgctaatgctagattact

SEQ ID NO: 7963597 - DNA, 22 bp, Homo sapiens
tttgtggcaggagcggagaccg

SEQ ID NO: 7963598 - DNA, 22 bp, Homo sapiens
tttgtggaactctcttcttgca

SEQ ID NO: 7963599 - DNA, 21 bp, Homo sapiens
tttgtggaattctcactcttc

SEQ ID NO: 7963600 - DNA, 22 bp, Homo sapiens
tttgtgcagctaagaaaatggc

SEQ ID NO: 7963601 - DNA, 22 bp, Homo sapiens
tttgtgcaggtgtgtcagatcg

SEQ ID NO: 7963602 - DNA, 22 bp, Homo sapiens
ttttacagttccatgcaaagcg

SEQ ID NO: 7963603 - DNA, 22 bp, Homo sapiens
ttttacaggtgtgagccaccat

SEQ ID NO: 7963604 - DNA, 22 bp, Homo sapiens
ttttacagtcagtcaaactcag

SEQ ID NO: 7963605 - DNA, 22 bp, Homo sapiens
ttttacagtcagtcaaactcag

SEQ ID NO: 7963606 - DNA, 22 bp, Homo sapiens
ttttacagttccatgcaaagcg

SEQ ID NO: 7963607 - DNA, 22 bp, Homo sapiens
ttttacagttccatgcaaagcg

SEQ ID NO: 7963608 - DNA, 22 bp, Homo sapiens
ttttacagttccatgcaaagcg

SEQ ID NO: 7963609 - DNA, 22 bp, Homo sapiens
ttttacaggtgaaaaatgaaga

SEQ ID NO: 7963610 - DNA, 22 bp, Homo sapiens
ttttacaggtgaaaaatgaaga

SEQ ID NO: 7963611 - DNA, 22 bp, Homo sapiens
ttttacaggtgtgagccaccat

SEQ ID NO: 7963612 - DNA, 22 bp, Homo sapiens
ttttacaggtgaaaaatgaaga

SEQ ID NO: 7963613 - DNA, 22 bp, Homo sapiens
ttttacaggtgaaaaatgaaga

SEQ ID NO: 7963614 - DNA, 22 bp, Homo sapiens
ttttacaggtcataggtatagt

SEQ ID NO: 7963615 - DNA, 22 bp, Homo sapiens
ttttacaagctgagtcgttaaa

SEQ ID NO: 7963616 - DNA, 22 bp, Homo sapiens
ttttacacctcagatgagcaga

SEQ ID NO: 7963617 - DNA, 22 bp, Homo sapiens
ttttacacctcagatgagcaga

SEQ ID NO: 7963618 - DNA, 22 bp, Homo sapiens
ttttacacctcagatgagcaga

SEQ ID NO: 7963619 - DNA, 22 bp, Homo sapiens
ttttacacctgttaactctaag

SEQ ID NO: 7963620 - DNA, 21 bp, Homo sapiens
ttttacagatgaggggaaggg

SEQ ID NO: 7963621 - DNA, 21 bp, Homo sapiens
ttttacagatgaggggaaggg

SEQ ID NO: 7963622 - DNA, 22 bp, Homo sapiens
ttttacaggtcataggtatagt

SEQ ID NO: 7963623 - DNA, 22 bp, Homo sapiens
ttttacaggtcataggtatagt

SEQ ID NO: 7963624 - DNA, 22 bp, Homo sapiens
ttttaattttagcccttctggt

SEQ ID NO: 7963625 - DNA, 22 bp, Homo sapiens
ttttaattttagcccttctggt

SEQ ID NO: 7963626 - DNA, 22 bp, Homo sapiens
ttttaattttgcaaatctggtg

SEQ ID NO: 7963627 - DNA, 22 bp, Homo sapiens
ttttacaagctgagtcgttaaa

SEQ ID NO: 7963628 - DNA, 23 bp, Homo sapiens
ttttaatttggacataagaagat

SEQ ID NO: 7963629 - DNA, 23 bp, Homo sapiens
ttttaatttggacataagaagat

SEQ ID NO: 7963630 - DNA, 22 bp, Homo sapiens
tttgtgtaccttgtacatttgt

SEQ ID NO: 7963631 - DNA, 22 bp, Homo sapiens
tttgtgtagtctgttcccactg

SEQ ID NO: 7963632 - DNA, 22 bp, Homo sapiens
tttgtgtaccttgtacatttgt

SEQ ID NO: 7963633 - DNA, 22 bp, Homo sapiens
tttgtggcaggagcggagaccg

SEQ ID NO: 7963634 - DNA, 22 bp, Homo sapiens
tttgtgtcgtcactgtcttctc

SEQ ID NO: 7963635 - DNA, 23 bp, Homo sapiens
ttttaatttggacataagaagat

SEQ ID NO: 7963636 - DNA, 23 bp, Homo sapiens
ttttaatttggacataagaagat

SEQ ID NO: 7963637 - DNA, 23 bp, Homo sapiens
ttttaatttggacataagaagat

SEQ ID NO: 7963638 - DNA, 22 bp, Homo sapiens
ttttattgggagtcctctactg

SEQ ID NO: 7963639 - DNA, 22 bp, Homo sapiens
ttttattgggagtcctctactg

SEQ ID NO: 7963640 - DNA, 22 bp, Homo sapiens
ttttattgggagtcctctactg

SEQ ID NO: 7963641 - DNA, 22 bp, Homo sapiens
ttttattgggagtcctctactg

SEQ ID NO: 7963642 - DNA, 22 bp, Homo sapiens
ttttattgggagtcctctactg

SEQ ID NO: 7963643 - DNA, 22 bp, Homo sapiens
ttttattgggagtcctctactg

SEQ ID NO: 7963644 - DNA, 22 bp, Homo sapiens
ttttattgggagtcctctactg

SEQ ID NO: 7963645 - DNA, 22 bp, Homo sapiens
ttttattgggagtcctctactg

SEQ ID NO: 7963646 - DNA, 22 bp, Homo sapiens
ttttagaagtgcctatcctatg

SEQ ID NO: 7963647 - DNA, 22 bp, Homo sapiens
ttttagaagtgcctatcctatg

SEQ ID NO: 7963648 - DNA, 22 bp, Homo sapiens
ttttattgggagtcctctactg

SEQ ID NO: 7963649 - DNA, 22 bp, Homo sapiens
ttttattggtaatgataaaagt

SEQ ID NO: 7963650 - DNA, 22 bp, Homo sapiens
ttttattggtaatgataaaagt

SEQ ID NO: 7963651 - DNA, 22 bp, Homo sapiens
ttttattggtaatgataaaagt

SEQ ID NO: 7963652 - DNA, 22 bp, Homo sapiens
ttttattggtaatgataaaagt

SEQ ID NO: 7963653 - DNA, 22 bp, Homo sapiens
ttttattgggagtcctctactg

SEQ ID NO: 7963654 - DNA, 22 bp, Homo sapiens
ttttattggtaatgataaaagt

SEQ ID NO: 7963655 - DNA, 22 bp, Homo sapiens
ttttattggtaatgataaaagt

SEQ ID NO: 7963656 - DNA, 22 bp, Homo sapiens
ttttattggtaatgataaaagt

SEQ ID NO: 7963657 - DNA, 22 bp, Homo sapiens
ttttattggtaatgataaaagt

SEQ ID NO: 7963658 - DNA, 22 bp, Homo sapiens
ttttattggtaatgataaaagt

SEQ ID NO: 7963659 - DNA, 22 bp, Homo sapiens
ttttattggtaatgataaaagt

SEQ ID NO: 7963660 - DNA, 22 bp, Homo sapiens
ttttattggtaatgataaaagt

SEQ ID NO: 7963661 - DNA, 22 bp, Homo sapiens
ttttattggtaatgataaaagt

SEQ ID NO: 7963662 - DNA, 22 bp, Homo sapiens
ttttattggtaatgataaaagt

SEQ ID NO: 7963663 - DNA, 22 bp, Homo sapiens
ttttacttaattcttggtcatg

SEQ ID NO: 7963664 - DNA, 22 bp, Homo sapiens
ttttacttcattcctgacttca

SEQ ID NO: 7963665 - DNA, 22 bp, Homo sapiens
ttttacttaattcttggtcatg

SEQ ID NO: 7963666 - DNA, 22 bp, Homo sapiens
ttttacttaattcttggtcatg

SEQ ID NO: 7963667 - DNA, 22 bp, Homo sapiens
ttttaccactgggtgacatgga

SEQ ID NO: 7963668 - DNA, 22 bp, Homo sapiens
ttttacattgggaaatgcctct

SEQ ID NO: 7963669 - DNA, 22 bp, Homo sapiens
ttttacattgggaaatgcctct

SEQ ID NO: 7963670 - DNA, 22 bp, Homo sapiens
ttttactttggatacagtactt

SEQ ID NO: 7963671 - DNA, 22 bp, Homo sapiens
ttttagaaagatccctggcagg

SEQ ID NO: 7963672 - DNA, 22 bp, Homo sapiens
ttttagaaagatccctggcagg

SEQ ID NO: 7963673 - DNA, 22 bp, Homo sapiens
ttttagaaagatccctggcagg

SEQ ID NO: 7963674 - DNA, 22 bp, Homo sapiens
ttttagaaatactgatttagtg

SEQ ID NO: 7963675 - DNA, 22 bp, Homo sapiens
ttttagaaatactgatttagtg

SEQ ID NO: 7963676 - DNA, 22 bp, Homo sapiens
ttttagaaatactgatttagtg

SEQ ID NO: 7963677 - DNA, 22 bp, Homo sapiens
ttttagaaatactgatttagtg

SEQ ID NO: 7963678 - DNA, 22 bp, Homo sapiens
ttttagaaatactgatttagtg

SEQ ID NO: 7963679 - DNA, 22 bp, Homo sapiens
ttttagaaggaatgctatggtg

SEQ ID NO: 7963680 - DNA, 22 bp, Homo sapiens
ttttagaaggaatgctatggtg

SEQ ID NO: 7963681 - DNA, 22 bp, Homo sapiens
ttttagaagtgcctatcctatg

SEQ ID NO: 7963682 - DNA, 16 bp, Homo sapiens
ttttattgtgacagcc

SEQ ID NO: 7963683 - DNA, 16 bp, Homo sapiens
ttttattgtgacagcc

SEQ ID NO: 7963684 - DNA, 16 bp, Homo sapiens
ttttattgtgacagcc

SEQ ID NO: 7963685 - DNA, 22 bp, Homo sapiens
ttttattgtctgtattgcctat

SEQ ID NO: 7963686 - DNA, 22 bp, Homo sapiens
ttttattgtctgtattgcctat

SEQ ID NO: 7963687 - DNA, 22 bp, Homo sapiens
ttttattgtctgtattgcctat

SEQ ID NO: 7963688 - DNA, 16 bp, Homo sapiens
ttttattgtgacagcc

SEQ ID NO: 7963689 - DNA, 16 bp, Homo sapiens
ttttattgtgacagcc

SEQ ID NO: 7963690 - DNA, 16 bp, Homo sapiens
ttttattgtgacagcc

SEQ ID NO: 7963691 - DNA, 16 bp, Homo sapiens
ttttattgtgacagcc

SEQ ID NO: 7963692 - DNA, 16 bp, Homo sapiens
ttttattgtgacagcc

SEQ ID NO: 7963693 - DNA, 16 bp, Homo sapiens
ttttattgtgacagcc

SEQ ID NO: 7963694 - DNA, 22 bp, Homo sapiens
ttttcaattttgaggcagtggt

SEQ ID NO: 7963695 - DNA, 22 bp, Homo sapiens
ttttcacaagggtccaactagt

SEQ ID NO: 7963696 - DNA, 20 bp, Homo sapiens
ttttccactcctcaaaacag

SEQ ID NO: 7963697 - DNA, 22 bp, Homo sapiens
ttttcacacaaggtgataagtt

SEQ ID NO: 7963698 - DNA, 22 bp, Homo sapiens
ttttcacaagggtccaactagt

SEQ ID NO: 7963699 - DNA, 20 bp, Homo sapiens
ttttccagaaagtatcattg

SEQ ID NO: 7963700 - DNA, 22 bp, Homo sapiens
ttttattgtctgtattgcctat

SEQ ID NO: 7963701 - DNA, 22 bp, Homo sapiens
ttttattgtctgtattgcctat

SEQ ID NO: 7963702 - DNA, 22 bp, Homo sapiens
ttttattgtctgtattgcctat

SEQ ID NO: 7963703 - DNA, 22 bp, Homo sapiens
ttttattgtctgtattgcctat

SEQ ID NO: 7963704 - DNA, 22 bp, Homo sapiens
ttttattgtctgtattgcctat

SEQ ID NO: 7963705 - DNA, 22 bp, Homo sapiens
ttttattgtctgtattgcctat

SEQ ID NO: 7963706 - DNA, 22 bp, Homo sapiens
ttttattgtctgtattgcctat

SEQ ID NO: 7963707 - DNA, 22 bp, Homo sapiens
ttttattgtctgtattgcctat

SEQ ID NO: 7963708 - DNA, 22 bp, Homo sapiens
ttttattgtctcccagttctgg

SEQ ID NO: 7963709 - DNA, 22 bp, Homo sapiens
ttttattgtctcccagttctgg

SEQ ID NO: 7963710 - DNA, 22 bp, Homo sapiens
ttttattgtctcccagttctgg

SEQ ID NO: 7963711 - DNA, 22 bp, Homo sapiens
ttttattgtctcccagttctgg

SEQ ID NO: 7963712 - DNA, 22 bp, Homo sapiens
ttttattgtctcccagttctgg

SEQ ID NO: 7963713 - DNA, 22 bp, Homo sapiens
ttttattgtctcccagttctgg

SEQ ID NO: 7963714 - DNA, 22 bp, Homo sapiens
ttttattgtctcccagttctgg

SEQ ID NO: 7963715 - DNA, 22 bp, Homo sapiens
ttttattgtctcccagttctgg

SEQ ID NO: 7963716 - DNA, 22 bp, Homo sapiens
ttttattgtcaatgaagacaga

SEQ ID NO: 7963717 - DNA, 22 bp, Homo sapiens
ttttattgtcaatgaagacaga

SEQ ID NO: 7963718 - DNA, 22 bp, Homo sapiens
ttttattgtcaatgaagacaga

SEQ ID NO: 7963719 - DNA, 22 bp, Homo sapiens
ttttattgtcaatgaagacaga

SEQ ID NO: 7963720 - DNA, 22 bp, Homo sapiens
ttttattgtcaatgaagacaga

SEQ ID NO: 7963721 - DNA, 22 bp, Homo sapiens
ttttattgtcaatgaagacaga

SEQ ID NO: 7963722 - DNA, 22 bp, Homo sapiens
ttttattgtcaatgaagacaga

SEQ ID NO: 7963723 - DNA, 22 bp, Homo sapiens
ttttattgtcaatgaagacaga

SEQ ID NO: 7963724 - DNA, 22 bp, Homo sapiens
ttttattgtcaatgaagacaga

SEQ ID NO: 7963725 - DNA, 22 bp, Homo sapiens
ttttattgtctcccagttctgg

SEQ ID NO: 7963726 - DNA, 19 bp, Homo sapiens
ttttcccaccctttagaat

SEQ ID NO: 7963727 - DNA, 21 bp, Homo sapiens
ttttcccactgaaagctccca

SEQ ID NO: 7963728 - DNA, 19 bp, Homo sapiens
ttttcccaccctttagaat

SEQ ID NO: 7963729 - DNA, 21 bp, Homo sapiens
ttttcccactgaaagctccca

SEQ ID NO: 7963730 - DNA, 22 bp, Homo sapiens
ttttcccagagctgtcctcaag

SEQ ID NO: 7963731 - DNA, 22 bp, Homo sapiens
ttttccagcataggtacatata

SEQ ID NO: 7963732 - DNA, 22 bp, Homo sapiens
ttttccagcataggtacatata

SEQ ID NO: 7963733 - DNA, 23 bp, Homo sapiens
ttttccagaatcgactctgtaga

SEQ ID NO: 7963734 - DNA, 22 bp, Homo sapiens
ttttccagatggatactagaat

SEQ ID NO: 7963735 - DNA, 22 bp, Homo sapiens
ttttccagatggatactagaat

SEQ ID NO: 7963736 - DNA, 22 bp, Homo sapiens
ttttccagatgaattccacagt

SEQ ID NO: 7963737 - DNA, 22 bp, Homo sapiens
ttttccagagctgtctcttgca

SEQ ID NO: 7963738 - DNA, 20 bp, Homo sapiens
ttttccagaaagtatcattg

SEQ ID NO: 7963739 - DNA, 22 bp, Homo sapiens
ttttcctatatgcaaagaatgc

SEQ ID NO: 7963740 - DNA, 22 bp, Homo sapiens
ttttcctcaggaatgctaagct

SEQ ID NO: 7963741 - DNA, 22 bp, Homo sapiens
ttttcctcacctaactcaaggt

SEQ ID NO: 7963742 - DNA, 22 bp, Homo sapiens
ttttcctactgataaacagtta

SEQ ID NO: 7963743 - DNA, 22 bp, Homo sapiens
ttttcctactgataaacagtta

SEQ ID NO: 7963744 - DNA, 22 bp, Homo sapiens
ttttcctagtaggcctattaga

SEQ ID NO: 7963745 - DNA, 22 bp, Homo sapiens
ttttcctagtaggcctattaga

SEQ ID NO: 7963746 - DNA, 22 bp, Homo sapiens
ttttcccatctacaaagcaggg

SEQ ID NO: 7963747 - DNA, 22 bp, Homo sapiens
ttttcccatctacaaagcaggg

SEQ ID NO: 7963748 - DNA, 22 bp, Homo sapiens
ttttccttcacctcttgagcct

SEQ ID NO: 7963749 - DNA, 22 bp, Homo sapiens
ttttccttcacctcttgagcct

SEQ ID NO: 7963750 - DNA, 22 bp, Homo sapiens
ttttccttagcttctctgcgag

SEQ ID NO: 7963751 - DNA, 22 bp, Homo sapiens
ttttccttaacagagggagaaa

SEQ ID NO: 7963752 - DNA, 22 bp, Homo sapiens
ttttccttaacagagggagaaa

SEQ ID NO: 7963753 - DNA, 22 bp, Homo sapiens
ttttccttagcttctctgcgag

SEQ ID NO: 7963754 - DNA, 22 bp, Homo sapiens
ttttccttcacctcttgagcct

SEQ ID NO: 7963755 - DNA, 22 bp, Homo sapiens
ttttccttcacctcttgagcct

SEQ ID NO: 7963756 - DNA, 22 bp, Homo sapiens
ttttccttcacctcttgagcct

SEQ ID NO: 7963757 - DNA, 22 bp, Homo sapiens
ttttccttcacctcttgagcct

SEQ ID NO: 7963758 - DNA, 22 bp, Homo sapiens
ttttccttcatatcccttatgt

SEQ ID NO: 7963759 - DNA, 22 bp, Homo sapiens
ttttccttcatatcccttatgt

SEQ ID NO: 7963760 - DNA, 22 bp, Homo sapiens
ttttccttcatatcccttatgt

SEQ ID NO: 7963761 - DNA, 22 bp, Homo sapiens
ttttcctctgagctttgaataa

SEQ ID NO: 7963762 - DNA, 22 bp, Homo sapiens
ttttcctctgagctttgaataa

SEQ ID NO: 7963763 - DNA, 22 bp, Homo sapiens
ttttcctctgagctttgaataa

SEQ ID NO: 7963764 - DNA, 22 bp, Homo sapiens
ttttcctctgagctttgaataa

SEQ ID NO: 7963765 - DNA, 20 bp, Homo sapiens
ttttcctcgtgtttgttcta

SEQ ID NO: 7963766 - DNA, 20 bp, Homo sapiens
ttttcctcgtgtttgttcta

SEQ ID NO: 7963767 - DNA, 22 bp, Homo sapiens
ttttcctcaggaatgctaagct

SEQ ID NO: 7963768 - DNA, 20 bp, Homo sapiens
ttttcctcgtgtttgttcta

SEQ ID NO: 7963769 - DNA, 22 bp, Homo sapiens
ttttcctctgagctttgaataa

SEQ ID NO: 7963770 - DNA, 22 bp, Homo sapiens
ttttcctctgcagagcagttag

SEQ ID NO: 7963771 - DNA, 22 bp, Homo sapiens
ttttcctctgcaataaaagcag

SEQ ID NO: 7963772 - DNA, 22 bp, Homo sapiens
ttttcctctgtatgcgtgagat

SEQ ID NO: 7963773 - DNA, 22 bp, Homo sapiens
ttttcctctgcagagcagttag

SEQ ID NO: 7963774 - DNA, 22 bp, Homo sapiens
ttttcctctgtatgcgtgagat

SEQ ID NO: 7963775 - DNA, 22 bp, Homo sapiens
ttttcctctgcagagcagttag

SEQ ID NO: 7963776 - DNA, 19 bp, Homo sapiens
ttttggctggagtgatctg

SEQ ID NO: 7963777 - DNA, 22 bp, Homo sapiens
ttttggcttaaagagaatgtat

SEQ ID NO: 7963778 - DNA, 22 bp, Homo sapiens
ttttggcttaaagagaatgtat

SEQ ID NO: 7963779 - DNA, 22 bp, Homo sapiens
ttttggctgtagctggaaatct

SEQ ID NO: 7963780 - DNA, 22 bp, Homo sapiens
ttttggctgtagctggaaatct

SEQ ID NO: 7963781 - DNA, 22 bp, Homo sapiens
ttttggctctgtctgtatcttt

SEQ ID NO: 7963782 - DNA, 22 bp, Homo sapiens
ttttggctctgtctgtatcttt

SEQ ID NO: 7963783 - DNA, 19 bp, Homo sapiens
ttttccttctatatgtttc

SEQ ID NO: 7963784 - DNA, 19 bp, Homo sapiens
ttttccttctatatgtttc

SEQ ID NO: 7963785 - DNA, 22 bp, Homo sapiens
ttttggcttaaagagaatgtat

SEQ ID NO: 7963786 - DNA, 22 bp, Homo sapiens
ttttgggtgaatttgccagtta

SEQ ID NO: 7963787 - DNA, 22 bp, Homo sapiens
ttttggggagaacggttgctat

SEQ ID NO: 7963788 - DNA, 22 bp, Homo sapiens
ttttgggtatagaggtgttcat

SEQ ID NO: 7963789 - DNA, 22 bp, Homo sapiens
ttttgggtgaatttgccagtta

SEQ ID NO: 7963790 - DNA, 22 bp, Homo sapiens
ttttgggtggaagctgttatgg

SEQ ID NO: 7963791 - DNA, 22 bp, Homo sapiens
ttttgggtggaagctgttatgg

SEQ ID NO: 7963792 - DNA, 22 bp, Homo sapiens
ttttccttctagagcagatttc

SEQ ID NO: 7963793 - DNA, 22 bp, Homo sapiens
ttttccttctagagcagatttc

SEQ ID NO: 7963794 - DNA, 22 bp, Homo sapiens
ttttccttctagagcagatttc

SEQ ID NO: 7963795 - DNA, 22 bp, Homo sapiens
ttttccttctagagcagatttc

SEQ ID NO: 7963796 - DNA, 22 bp, Homo sapiens
ttttccttctagagcagatttc

SEQ ID NO: 7963797 - DNA, 22 bp, Homo sapiens
ttttccttctagagcagatttc

SEQ ID NO: 7963798 - DNA, 18 bp, Homo sapiens
ttttccttccaccttgaa

SEQ ID NO: 7963799 - DNA, 18 bp, Homo sapiens
ttttccttccaccttgaa

SEQ ID NO: 7963800 - DNA, 18 bp, Homo sapiens
ttttccttccaccttgaa

SEQ ID NO: 7963801 - DNA, 19 bp, Homo sapiens
ttttccttctatatgtttc

SEQ ID NO: 7963802 - DNA, 19 bp, Homo sapiens
ttttccttctatatgtttc

SEQ ID NO: 7963803 - DNA, 19 bp, Homo sapiens
ttttccttctatatgtttc

SEQ ID NO: 7963804 - DNA, 19 bp, Homo sapiens
ttttccttctatatgtttc

SEQ ID NO: 7963805 - DNA, 19 bp, Homo sapiens
ttttccttctatatgtttc

SEQ ID NO: 7963806 - DNA, 19 bp, Homo sapiens
ttttccttctatatgtttc

SEQ ID NO: 7963807 - DNA, 19 bp, Homo sapiens
ttttccttctatatgtttc

SEQ ID NO: 7963808 - DNA, 22 bp, Homo sapiens
ttttccttctagagcagatttc

SEQ ID NO: 7963809 - DNA, 19 bp, Homo sapiens
ttttccttctatatgtttc

SEQ ID NO: 7963810 - DNA, 22 bp, Homo sapiens
ttttccttctagagcagatttc

SEQ ID NO: 7963811 - DNA, 19 bp, Homo sapiens
ttttccttctatatgtttc

SEQ ID NO: 7963812 - DNA, 17 bp, Homo sapiens
ttttggtgagttgtttc

SEQ ID NO: 7963813 - DNA, 22 bp, Homo sapiens
ttttggtgattttactgaaggt

SEQ ID NO: 7963814 - DNA, 22 bp, Homo sapiens
ttttggtgattttactgaaggt

SEQ ID NO: 7963815 - DNA, 20 bp, Homo sapiens
ttttggtgaattccagaata

SEQ ID NO: 7963816 - DNA, 22 bp, Homo sapiens
ttttggtgcacctagctttttc

SEQ ID NO: 7963817 - DNA, 22 bp, Homo sapiens
ttttgtaagaaactgccaagcc

SEQ ID NO: 7963818 - DNA, 22 bp, Homo sapiens
ttttggtagccaacaaaatgtt

SEQ ID NO: 7963819 - DNA, 22 bp, Homo sapiens
ttttggtcagtgtactgggctg

SEQ ID NO: 7963820 - DNA, 22 bp, Homo sapiens
ttttggtcaggttggtctcgaa

SEQ ID NO: 7963821 - DNA, 22 bp, Homo sapiens
ttttggtctgtagagtgactct

SEQ ID NO: 7963822 - DNA, 21 bp, Homo sapiens
ttttggtcctggcttaggagc

SEQ ID NO: 7963823 - DNA, 22 bp, Homo sapiens
ttttggtctccaagccatgtgt

SEQ ID NO: 7963824 - DNA, 22 bp, Homo sapiens
ttttggtagaatcaacaatgta

SEQ ID NO: 7963825 - DNA, 22 bp, Homo sapiens
ttttggtacatgcaatagcaat

SEQ ID NO: 7963826 - DNA, 22 bp, Homo sapiens
ttttggcttttcctcagcaagc

SEQ ID NO: 7963827 - DNA, 22 bp, Homo sapiens
ttttggtaatgcctaacttcgt

SEQ ID NO: 7963828 - DNA, 22 bp, Homo sapiens
ttttggtaattaagtagatatt

SEQ ID NO: 7963829 - DNA, 22 bp, Homo sapiens
ttttgtgttgccatgttaagca

SEQ ID NO: 7963830 - DNA, 22 bp, Homo sapiens
ttttgtgttgccatgttaagca

SEQ ID NO: 7963831 - DNA, 22 bp, Homo sapiens
ttttgtgttgccatgttaagca

SEQ ID NO: 7963832 - DNA, 22 bp, Homo sapiens
ttttgtgtgtggtgatacaaag

SEQ ID NO: 7963833 - DNA, 22 bp, Homo sapiens
ttttgtgtgtggtgatacaaag

SEQ ID NO: 7963834 - DNA, 22 bp, Homo sapiens
ttttgtgtccttcacatcatgt

SEQ ID NO: 7963835 - DNA, 22 bp, Homo sapiens
ttttgtgtccttcacatcatgt

SEQ ID NO: 7963836 - DNA, 19 bp, Homo sapiens
ttttgtgtagctgctggtt

SEQ ID NO: 7963837 - DNA, 22 bp, Homo sapiens
ttttgtgatggcattacattta

SEQ ID NO: 7963838 - DNA, 22 bp, Homo sapiens
ttttgtgagctgagaaatgtat

SEQ ID NO: 7963839 - DNA, 22 bp, Homo sapiens
ttttgtgagctgagaaatgtat

SEQ ID NO: 7963840 - DNA, 22 bp, Homo sapiens
ttttgtgagcccataaatgcca

SEQ ID NO: 7963841 - DNA, 22 bp, Homo sapiens
ttttgtgagcccataaatgcca

SEQ ID NO: 7963842 - DNA, 22 bp, Homo sapiens
ttttgtgagctccttggaggta

SEQ ID NO: 7963843 - DNA, 22 bp, Homo sapiens
ttttgtgagctgagaaatgtat

SEQ ID NO: 7963844 - DNA, 22 bp, Homo sapiens
ttttgtgagctccttggaggta

SEQ ID NO: 7963845 - DNA, 22 bp, Homo sapiens
ttttgttgacctctcccacctt

SEQ ID NO: 7963846 - DNA, 22 bp, Homo sapiens
ttttgttggcttaagaaataca

SEQ ID NO: 7963847 - DNA, 22 bp, Homo sapiens
ttttgtgttgtaatgtcagcta

SEQ ID NO: 7963848 - DNA, 22 bp, Homo sapiens
ttttgtgttgtaatgtcagcta

SEQ ID NO: 7963849 - DNA, 17 bp, Homo sapiens
ttttgttcatcttcaaa

SEQ ID NO: 7963850 - DNA, 17 bp, Homo sapiens
ttttgttcatcttcaaa

SEQ ID NO: 7963851 - DNA, 22 bp, Homo sapiens
tttttgtagtcattagaagagg

SEQ ID NO: 7963852 - DNA, 22 bp, Homo sapiens
tttttgtagtcattagaagagg

SEQ ID NO: 7963853 - DNA, 22 bp, Homo sapiens
tttttgtatagaaatgaactaa

SEQ ID NO: 7963854 - DNA, 22 bp, Homo sapiens
tttttgtatagaaatgaactaa

SEQ ID NO: 7963855 - DNA, 22 bp, Homo sapiens
tttttgtatagaaatgaactaa

SEQ ID NO: 7963856 - DNA, 22 bp, Homo sapiens
ttttgtatagtcaaagacaaga

SEQ ID NO: 7963857 - DNA, 22 bp, Homo sapiens
ttttgtaagaaactgccaagcc

SEQ ID NO: 7963858 - DNA, 22 bp, Homo sapiens
ttttgtaatttcctgacgacta

SEQ ID NO: 7963859 - DNA, 22 bp, Homo sapiens
ttttgtatgagaagtgctttac

SEQ ID NO: 7963860 - DNA, 22 bp, Homo sapiens
ttttgtatcctccctttcactg

SEQ ID NO: 7963861 - DNA, 22 bp, Homo sapiens
ttttgtatgagaagtgctttac

SEQ ID NO: 7963862 - DNA, 22 bp, Homo sapiens
ttttgtatgagaagtgctttac

SEQ ID NO: 7963863 - DNA, 22 bp, Homo sapiens
ttttgtcacctgatttgcccac

SEQ ID NO: 7963864 - DNA, 22 bp, Homo sapiens
ttttgtcagtgagaacagagtt

SEQ ID NO: 7963865 - DNA, 22 bp, Homo sapiens
ttttgtatgagaagtgctttac

SEQ ID NO: 7963866 - DNA, 22 bp, Homo sapiens
ttttgtcagtgagaacagagtt

SEQ ID NO: 7963867 - DNA, 22 bp, Homo sapiens
ttttgtctaagaactttgcaaa

SEQ ID NO: 7963868 - DNA, 22 bp, Homo sapiens
ttttgtctaagaactttgcaaa

SEQ ID NO: 7963869 - DNA, 22 bp, Homo sapiens
ttttgtctaagaactttgcaaa

SEQ ID NO: 7963870 - DNA, 22 bp, Homo sapiens
ttttgtctaagaactttgcaaa

SEQ ID NO: 7963871 - DNA, 22 bp, Homo sapiens
ttttgtctaagaactttgcaaa

SEQ ID NO: 7963872 - DNA, 19 bp, Homo sapiens
ttttgtcttcccttagttt

SEQ ID NO: 7963873 - DNA, 19 bp, Homo sapiens
ttttgtcttcccttagttt

SEQ ID NO: 7963874 - DNA, 22 bp, Homo sapiens
ttttgtgaatagtttatctaag

SEQ ID NO: 7963875 - DNA, 22 bp, Homo sapiens
ttttgtgacacttcttgagaca

SEQ ID NO: 7963876 - DNA, 22 bp, Homo sapiens
ttttgtgaatagtttatctaag

SEQ ID NO: 7963877 - DNA, 22 bp, Homo sapiens
ttttgtgaatagtttatctaag

SEQ ID NO: 7963878 - DNA, 22 bp, Homo sapiens
ttttgtgacagaaagattaagt

SEQ ID NO: 7963879 - DNA, 22 bp, Homo sapiens
ttttgtgagatgcgtatgaatg

SEQ ID NO: 7963880 - DNA, 22 bp, Homo sapiens
ttttgtgagatgcgtatgaatg

SEQ ID NO: 7963881 - DNA, 22 bp, Homo sapiens
ttttttagttaggtcagaatgt

SEQ ID NO: 7963882 - DNA, 22 bp, Homo sapiens
ttttttagttaggtcagaatgt

SEQ ID NO: 7963883 - DNA, 22 bp, Homo sapiens
ttttttatagcaatgaacccac

SEQ ID NO: 7963884 - DNA, 22 bp, Homo sapiens
tttttgttctgattatactggt

SEQ ID NO: 7963885 - DNA, 22 bp, Homo sapiens
ttttttagttaggtcagaatgt

SEQ ID NO: 7963886 - DNA, 22 bp, Homo sapiens
ttttttatagcaatgaacccac

SEQ ID NO: 7963887 - DNA, 22 bp, Homo sapiens
ttttttatatcaactgaagtct

SEQ ID NO: 7963888 - DNA, 22 bp, Homo sapiens
ttttttatatcaactgaagtct

SEQ ID NO: 7963889 - DNA, 22 bp, Homo sapiens
ttttttatatcaactgaagtct

SEQ ID NO: 7963890 - DNA, 22 bp, Homo sapiens
ttttttatatcaactgaagtct

SEQ ID NO: 7963891 - DNA, 22 bp, Homo sapiens
ttttttatatcaactgaagtct

SEQ ID NO: 7963892 - DNA, 22 bp, Homo sapiens
ttttttatctatggtagtacca

SEQ ID NO: 7963893 - DNA, 22 bp, Homo sapiens
ttttttatctatggtagtacca

SEQ ID NO: 7963894 - DNA, 22 bp, Homo sapiens
ttttttatctatggtagtacca

SEQ ID NO: 7963895 - DNA, 22 bp, Homo sapiens
ttttttatctatggtagtacca

SEQ ID NO: 7963896 - DNA, 22 bp, Homo sapiens
ttttttatctatggtagtacca

SEQ ID NO: 7963897 - DNA, 22 bp, Homo sapiens
ttttttatctatggtagtacca

SEQ ID NO: 7963898 - DNA, 22 bp, Homo sapiens
ttttttccagcttctagaggcc

SEQ ID NO: 7963899 - DNA, 22 bp, Homo sapiens
ttttttccaacttaagacttca

SEQ ID NO: 7963900 - DNA, 22 bp, Homo sapiens
ttttttccaacttaagacttca

SEQ ID NO: 7963901 - DNA, 22 bp, Homo sapiens
ttttttcagcctgtctgtgcca

SEQ ID NO: 7963902 - DNA, 22 bp, Homo sapiens
ttttttccaacttaagacttca

SEQ ID NO: 7963903 - DNA, 22 bp, Homo sapiens
ttttttccaacttaagacttca

SEQ ID NO: 7963904 - DNA, 22 bp, Homo sapiens
ttttttccaacttaagacttca

SEQ ID NO: 7963905 - DNA, 22 bp, Homo sapiens
tttttgttcccagagaatttgt

SEQ ID NO: 7963906 - DNA, 22 bp, Homo sapiens
tttttgttcccagagaatttgt

SEQ ID NO: 7963907 - DNA, 22 bp, Homo sapiens
tttttgtgaaatctccagacat

SEQ ID NO: 7963908 - DNA, 22 bp, Homo sapiens
tttttgttcccagagaatttgt

SEQ ID NO: 7963909 - DNA, 22 bp, Homo sapiens
tttttgttcccagagaatttgt

SEQ ID NO: 7963910 - DNA, 22 bp, Homo sapiens
tttttgtgtgagcagggtgtta

SEQ ID NO: 7963911 - DNA, 22 bp, Homo sapiens
tttttgtgtgagcagggtgtta

SEQ ID NO: 7963912 - DNA, 22 bp, Homo sapiens
tttttgtgtgagcagggtgtta

SEQ ID NO: 7963913 - DNA, 22 bp, Homo sapiens
tttttgttcccagagaatttgt

SEQ ID NO: 7963914 - DNA, 22 bp, Homo sapiens
tttttgttcccagagaatttgt

SEQ ID NO: 7963915 - DNA, 22 bp, Homo sapiens
tttttgttcccagagaatttgt

SEQ ID NO: 7963916 - DNA, 22 bp, Homo sapiens
tttttgttctgattatactggt

SEQ ID NO: 7963917 - DNA, 22 bp, Homo sapiens
ttttttacagaatcattaatca

SEQ ID NO: 7963918 - DNA, 22 bp, Homo sapiens
tttttgttgcagagaggccact

SEQ ID NO: 7963919 - DNA, 22 bp, Homo sapiens
ttttttacagaatcattaatca

SEQ ID NO: 7963920 - DNA, 22 bp, Homo sapiens
ttttttacagaatcattaatca

SEQ ID NO: 7963921 - DNA, 22 bp, Homo sapiens
tttttgttgcagagaggccact

SEQ ID NO: 7963922 - DNA, 22 bp, Homo sapiens
tttttgttgcagagaggccact

SEQ ID NO: 7963923 - DNA, 22 bp, Homo sapiens
tttttgttctgattatactggt

SEQ ID NO: 7963924 - DNA, 22 bp, Homo sapiens
tttttgttctgattatactggt

SEQ ID NO: 7963925 - DNA, 22 bp, Homo sapiens
tttttgttctgattatactggt

SEQ ID NO: 7963926 - DNA, 22 bp, Homo sapiens
tttttgttctgattatactggt

SEQ ID NO: 7963927 - DNA, 22 bp, Homo sapiens
tttttgtgaaatctccagacat

SEQ ID NO: 7963928 - DNA, 22 bp, Homo sapiens
tttttgtctattcactgattca

SEQ ID NO: 7963929 - DNA, 22 bp, Homo sapiens
tttttgtatatgcttcgaggat

SEQ ID NO: 7963930 - DNA, 22 bp, Homo sapiens
tttttgtcatctatttctggtg

SEQ ID NO: 7963931 - DNA, 22 bp, Homo sapiens
tttttgtggtgtgagtggacat

SEQ ID NO: 7963932 - DNA, 22 bp, Homo sapiens
tttttgtggtgtgagtggacat

SEQ ID NO: 7963933 - DNA, 22 bp, Homo sapiens
tttttgtggtgtgagtggacat

SEQ ID NO: 7963934 - DNA, 22 bp, Homo sapiens
tttttgtggtgcagactaaagc

SEQ ID NO: 7963935 - DNA, 22 bp, Homo sapiens
tttttgtgtatcctgctccatg

SEQ ID NO: 7963936 - DNA, 22 bp, Homo sapiens
tttttgtgtatcctgctccatg

SEQ ID NO: 7963937 - DNA, 22 bp, Homo sapiens
tttttgtgtatcctgctccatg

SEQ ID NO: 7963938 - DNA, 22 bp, Homo sapiens
tttttgtgtatcctgctccatg

SEQ ID NO: 7963939 - DNA, 22 bp, Homo sapiens
tttttgtgatatgacactgtat

SEQ ID NO: 7963940 - DNA, 22 bp, Homo sapiens
tttttgtgatatgacactgtat

SEQ ID NO: 7963941 - DNA, 22 bp, Homo sapiens
tttttgtgaaatctccagacat

SEQ ID NO: 7963942 - DNA, 22 bp, Homo sapiens
tttttgtggtatattgcaacaa

SEQ ID NO: 7963943 - DNA, 22 bp, Homo sapiens
tttttgtgatatgacactgtat

SEQ ID NO: 7963944 - DNA, 22 bp, Homo sapiens
tttttgtggtgcagactaaagc

SEQ ID NO: 7963945 - DNA, 22 bp, Homo sapiens
tttttgtggtgcagactaaagc

SEQ ID NO: 7963946 - DNA, 22 bp, Homo sapiens
tttttgtggtgcagactaaagc

SEQ ID NO: 7963947 - DNA, 22 bp, Homo sapiens
tttttgtggtatattgcaacaa

SEQ ID NO: 7963948 - DNA, 22 bp, Homo sapiens
ttttttgcacactctgctaaat

SEQ ID NO: 7963949 - DNA, 22 bp, Homo sapiens
ttttttgtagcaagcgcagata

SEQ ID NO: 7963950 - DNA, 22 bp, Homo sapiens
ttttttgcacactctgctaaat

SEQ ID NO: 7963951 - DNA, 21 bp, Homo sapiens
ttttttcttgcgtgaggcctg

SEQ ID NO: 7963952 - DNA, 21 bp, Homo sapiens
ttttttcttgcgtgaggcctg

SEQ ID NO: 7963953 - DNA, 21 bp, Homo sapiens
ttttttcttgcgtgaggcctg

SEQ ID NO: 7963954 - DNA, 21 bp, Homo sapiens
ttttttcttgcgtgaggcctg

SEQ ID NO: 7963955 - DNA, 22 bp, Homo sapiens
ttttttccttcatgacttaaga

SEQ ID NO: 7963956 - DNA, 22 bp, Homo sapiens
ttttttcctgagccttgtggtc

SEQ ID NO: 7963957 - DNA, 22 bp, Homo sapiens
ttttttccttcatgacttaaga

SEQ ID NO: 7963958 - DNA, 22 bp, Homo sapiens
ttttttccttcatgacttaaga

SEQ ID NO: 7963959 - DNA, 22 bp, Homo sapiens
ttttttcctgagccttgtggtc

SEQ ID NO: 7963960 - DNA, 22 bp, Homo sapiens
ttttttcctgagccttgtggtc

SEQ ID NO: 7963961 - DNA, 22 bp, Homo sapiens
ttttttcctctgtgatggcaaa

SEQ ID NO: 7963962 - DNA, 22 bp, Homo sapiens
ttttttcctctgtgatggcaaa

SEQ ID NO: 7963963 - DNA, 22 bp, Homo sapiens
ttttttccagcttctagaggcc

SEQ ID NO: 7963964 - DNA, 22 bp, Homo sapiens
ttttttccagcttctagaggcc

SEQ ID NO: 7963965 - DNA, 22 bp, Homo sapiens
ttttttccagcttctagaggcc

SEQ ID NO: 7963966 - DNA, 22 bp, Homo sapiens
ttttttccagcttctagaggcc

SEQ ID NO: 7963967 - DNA, 22 bp, Homo sapiens
ttttttccagcttctagaggcc

SEQ ID NO: 7963968 - DNA, 22 bp, Homo sapiens
ttttttccaggaagccactgga

SEQ ID NO: 7963969 - DNA, 22 bp, Homo sapiens
ttttttccaggaagccactgga

SEQ ID NO: 7963970 - DNA, 22 bp, Homo sapiens
ttttttcctctgtgatggcaaa

SEQ ID NO: 7963971 - DNA, 22 bp, Homo sapiens
ttgagaaataagcatgtctaga

SEQ ID NO: 7963972 - DNA, 22 bp, Homo sapiens
ttgagaaataagcatgtctaga

SEQ ID NO: 7963973 - DNA, 16 bp, Homo sapiens
ttgagaaatgaagttt

SEQ ID NO: 7963974 - DNA, 22 bp, Homo sapiens
ttgagaaatacttttgtagcct

SEQ ID NO: 7963975 - DNA, 22 bp, Homo sapiens
ttgagaaatacttttgtagcct

SEQ ID NO: 7963976 - DNA, 22 bp, Homo sapiens
ttgagaaatgttttttaagctg

SEQ ID NO: 7963977 - DNA, 19 bp, Homo sapiens
ttgagaaatgggaaaagca

SEQ ID NO: 7963978 - DNA, 19 bp, Homo sapiens
ttgagaaatgggaaaagca

SEQ ID NO: 7963979 - DNA, 19 bp, Homo sapiens
ttgagaaatgggaaaagca

SEQ ID NO: 7963980 - DNA, 22 bp, Homo sapiens
ttgagaaatgttttttaagctg

SEQ ID NO: 7963981 - DNA, 22 bp, Homo sapiens
ttgagaaatgttttttaagctg

SEQ ID NO: 7963982 - DNA, 22 bp, Homo sapiens
ttgagaaaggggtcaatatctc

SEQ ID NO: 7963983 - DNA, 22 bp, Homo sapiens
ttgagaaaggggtcaatatctc

SEQ ID NO: 7963984 - DNA, 22 bp, Homo sapiens
ttgagaaaggggtcaatatctc

SEQ ID NO: 7963985 - DNA, 22 bp, Homo sapiens
ttgagaaactctgggttagaat

SEQ ID NO: 7963986 - DNA, 22 bp, Homo sapiens
ttgagaaaggggtcaatatctc

SEQ ID NO: 7963987 - DNA, 22 bp, Homo sapiens
ttgagaaaggtaagaacccaca

SEQ ID NO: 7963988 - DNA, 22 bp, Homo sapiens
ttgagaaaggtaagaacccaca

SEQ ID NO: 7963989 - DNA, 19 bp, Homo sapiens
ttgagaaagttgatttggg

SEQ ID NO: 7963990 - DNA, 19 bp, Homo sapiens
ttgagaaagttgatttggg

SEQ ID NO: 7963991 - DNA, 19 bp, Homo sapiens
ttgagaaagttgatttggg

SEQ ID NO: 7963992 - DNA, 22 bp, Homo sapiens
ttgagaaataagcatgtctaga

SEQ ID NO: 7963993 - DNA, 18 bp, Homo sapiens
ttgagaaataagcactaa

SEQ ID NO: 7963994 - DNA, 18 bp, Homo sapiens
ttgagaaataagcactaa

SEQ ID NO: 7963995 - DNA, 18 bp, Homo sapiens
ttgagaaataagcactaa

SEQ ID NO: 7963996 - DNA, 18 bp, Homo sapiens
ttgagaaataagcactaa

SEQ ID NO: 7963997 - DNA, 18 bp, Homo sapiens
ttgagaaataagcactaa

SEQ ID NO: 7963998 - DNA, 22 bp, Homo sapiens
ttgagagaggaaacatagtctc

SEQ ID NO: 7963999 - DNA, 22 bp, Homo sapiens
ttgagagaaaaaatttattggt

SEQ ID NO: 7964000 - DNA, 22 bp, Homo sapiens
ttgagactcgagtctctcagac

SEQ ID NO: 7964001 - DNA, 22 bp, Homo sapiens
ttgagactcctggtgtagaata

SEQ ID NO: 7964002 - DNA, 22 bp, Homo sapiens
ttgagacactttgggcatcact

SEQ ID NO: 7964003 - DNA, 22 bp, Homo sapiens
ttgagacacaaggcacagtaag

SEQ ID NO: 7964004 - DNA, 22 bp, Homo sapiens
ttgagaaggtggtcatttgcaa

SEQ ID NO: 7964005 - DNA, 22 bp, Homo sapiens
ttgagaaggtggtcatttgcaa

SEQ ID NO: 7964006 - DNA, 22 bp, Homo sapiens
ttgagaagaaatagtttgcaat

SEQ ID NO: 7964007 - DNA, 22 bp, Homo sapiens
ttgagaatgatgagattcttcc

SEQ ID NO: 7964008 - DNA, 22 bp, Homo sapiens
ttgagaataaattagcagacat

SEQ ID NO: 7964009 - DNA, 22 bp, Homo sapiens
ttgagaactctgtatgtccagc

SEQ ID NO: 7964010 - DNA, 22 bp, Homo sapiens
ttgagaactagcatggtctatc

SEQ ID NO: 7964011 - DNA, 22 bp, Homo sapiens
ttgagaactactttattattct

SEQ ID NO: 7964012 - DNA, 22 bp, Homo sapiens
ttgagaactactttattattct

SEQ ID NO: 7964013 - DNA, 23 bp, Homo sapiens
ttgagaacaggtgtgagaatggc

SEQ ID NO: 7964014 - DNA, 22 bp, Homo sapiens
ttgagaaccactgagttagata

SEQ ID NO: 7964015 - DNA, 22 bp, Homo sapiens
ttgagaacaggagtgttctttt

SEQ ID NO: 7964016 - DNA, 22 bp, Homo sapiens
ttgagaacaggagtgttctttt

SEQ ID NO: 7964017 - DNA, 22 bp, Homo sapiens
ttgagagtgccaagcatcctcc

SEQ ID NO: 7964018 - DNA, 22 bp, Homo sapiens
ttgagaggctgttgacattctg

SEQ ID NO: 7964019 - DNA, 22 bp, Homo sapiens
ttgagaggatggattagacaaa

SEQ ID NO: 7964020 - DNA, 22 bp, Homo sapiens
ttgagaggctgttgacattctg

SEQ ID NO: 7964021 - DNA, 22 bp, Homo sapiens
ttgagaggatggattagacaaa

SEQ ID NO: 7964022 - DNA, 22 bp, Homo sapiens
ttgagagaggaaacatagtctc

SEQ ID NO: 7964023 - DNA, 22 bp, Homo sapiens
ttgagaggctgttgacattctg

SEQ ID NO: 7964024 - DNA, 22 bp, Homo sapiens
ttgaggctgcacagtacaggct

SEQ ID NO: 7964025 - DNA, 22 bp, Homo sapiens
ttgaggccccatggatgagaac

SEQ ID NO: 7964026 - DNA, 22 bp, Homo sapiens
ttgaggcccggcaggccgagcg

SEQ ID NO: 7964027 - DNA, 22 bp, Homo sapiens
ttgaggcccggcaggccgagcg

SEQ ID NO: 7964028 - DNA, 22 bp, Homo sapiens
ttgaggcctgctggaaggtgtt

SEQ ID NO: 7964029 - DNA, 22 bp, Homo sapiens
ttgaggcctgctggaaggtgtt

SEQ ID NO: 7964030 - DNA, 22 bp, Homo sapiens
ttgaggctgcacagtacaggct

SEQ ID NO: 7964031 - DNA, 22 bp, Homo sapiens
ttgaggctgcacagtacaggct

SEQ ID NO: 7964032 - DNA, 22 bp, Homo sapiens
ttgaggcctgctggaaggtgtt

SEQ ID NO: 7964033 - DNA, 22 bp, Homo sapiens
ttgaggtagtacttattattgg

SEQ ID NO: 7964034 - DNA, 22 bp, Homo sapiens
ttgaggtagttctattgtgagt

SEQ ID NO: 7964035 - DNA, 22 bp, Homo sapiens
ttgaggtagttctattgtgagt

SEQ ID NO: 7964036 - DNA, 22 bp, Homo sapiens
ttgaggtatattcacatatatc

SEQ ID NO: 7964037 - DNA, 22 bp, Homo sapiens
ttgaggtatattcacatatatc

SEQ ID NO: 7964038 - DNA, 22 bp, Homo sapiens
ttgaggtaaagctactagttag

SEQ ID NO: 7964039 - DNA, 22 bp, Homo sapiens
ttgagggtctggatctgctgct

SEQ ID NO: 7964040 - DNA, 22 bp, Homo sapiens
ttgagggtctggatctgctgct

SEQ ID NO: 7964041 - DNA, 22 bp, Homo sapiens
ttgaggtacaatgggtcagtta

SEQ ID NO: 7964042 - DNA, 22 bp, Homo sapiens
ttgaggtaataaacagccattc

SEQ ID NO: 7964043 - DNA, 22 bp, Homo sapiens
ttgaggtaataaacagccattc

SEQ ID NO: 7964044 - DNA, 22 bp, Homo sapiens
ttgagggtctggatctgctgct

SEQ ID NO: 7964045 - DNA, 21 bp, Homo sapiens
ttgaggggtattgcttttctc

SEQ ID NO: 7964046 - DNA, 19 bp, Homo sapiens
ttgagggcattctggtgtt

SEQ ID NO: 7964047 - DNA, 19 bp, Homo sapiens
ttgaggggccaggggagat

SEQ ID NO: 7964048 - DNA, 19 bp, Homo sapiens
ttgaggggccaggggagat

SEQ ID NO: 7964049 - DNA, 22 bp, Homo sapiens
ttgagggatttacagaggtggg

SEQ ID NO: 7964050 - DNA, 22 bp, Homo sapiens
ttgaaaatatcacaggagcagc

SEQ ID NO: 7964051 - DNA, 19 bp, Homo sapiens
ttgaaaatatggatctgag

SEQ ID NO: 7964052 - DNA, 19 bp, Homo sapiens
ttgaaaatatggatctgag

SEQ ID NO: 7964053 - DNA, 20 bp, Homo sapiens
ttgaaaatgcattgtgcagt

SEQ ID NO: 7964054 - DNA, 20 bp, Homo sapiens
ttgaaaatgcattgtgcagt

SEQ ID NO: 7964055 - DNA, 20 bp, Homo sapiens
ttgaaaatgcattgtgcagt

SEQ ID NO: 7964056 - DNA, 22 bp, Homo sapiens
ttgaaaatatcacaggagcagc

SEQ ID NO: 7964057 - DNA, 22 bp, Homo sapiens
ttgaaaatatcacaggagcagc

SEQ ID NO: 7964058 - DNA, 22 bp, Homo sapiens
ttgaaaatatcacaggagcagc

SEQ ID NO: 7964059 - DNA, 22 bp, Homo sapiens
ttgaaaatatcacaggagcagc

SEQ ID NO: 7964060 - DNA, 22 bp, Homo sapiens
ttgaaaagttttgaaacactct

SEQ ID NO: 7964061 - DNA, 22 bp, Homo sapiens
ttgaaaagttttgaaacactct

SEQ ID NO: 7964062 - DNA, 22 bp, Homo sapiens
ttgaaaatatcacaggagcagc

SEQ ID NO: 7964063 - DNA, 22 bp, Homo sapiens
ttgaaaatggtaagcatgatat

SEQ ID NO: 7964064 - DNA, 22 bp, Homo sapiens
ttgaaaatggtaagcatgatat

SEQ ID NO: 7964065 - DNA, 22 bp, Homo sapiens
ttgaaacagacaagtaaatgtc

SEQ ID NO: 7964066 - DNA, 22 bp, Homo sapiens
ttgaaaatggtaagcatgatat

SEQ ID NO: 7964067 - DNA, 22 bp, Homo sapiens
ttgaaaatggtaagcatgatat

SEQ ID NO: 7964068 - DNA, 22 bp, Homo sapiens
ttgaaaatggtaagcatgatat

SEQ ID NO: 7964069 - DNA, 22 bp, Homo sapiens
ttgaaacagtagctcatagacc

SEQ ID NO: 7964070 - DNA, 22 bp, Homo sapiens
ttgaaacagacaagtaaatgtc

SEQ ID NO: 7964071 - DNA, 22 bp, Homo sapiens
ttgaaacagacaagtaaatgtc

SEQ ID NO: 7964072 - DNA, 22 bp, Homo sapiens
ttgaaacatatacaaagtggtg

SEQ ID NO: 7964073 - DNA, 22 bp, Homo sapiens
ttgaaacatatacaaagtggtg

SEQ ID NO: 7964074 - DNA, 22 bp, Homo sapiens
ttgaaacatatacaaagtggtg

SEQ ID NO: 7964075 - DNA, 22 bp, Homo sapiens
ttgaaaaaattggtagaggatg

SEQ ID NO: 7964076 - DNA, 22 bp, Homo sapiens
ttgaaaaaattggtagaggatg

SEQ ID NO: 7964077 - DNA, 22 bp, Homo sapiens
ttgaaaaaattggtagaggatg

SEQ ID NO: 7964078 - DNA, 22 bp, Homo sapiens
ttctttttggatagctgatgaa

SEQ ID NO: 7964079 - DNA, 22 bp, Homo sapiens
ttctttttggatagctgatgaa

SEQ ID NO: 7964080 - DNA, 22 bp, Homo sapiens
ttctttttggatagctgatgaa

SEQ ID NO: 7964081 - DNA, 22 bp, Homo sapiens
ttctttttggatagctgatgaa

SEQ ID NO: 7964082 - DNA, 22 bp, Homo sapiens
ttctttttggatagctgatgaa

SEQ ID NO: 7964083 - DNA, 22 bp, Homo sapiens
ttctttttatcttcccataaga

SEQ ID NO: 7964084 - DNA, 22 bp, Homo sapiens
ttctttggtgggagattgaggt

SEQ ID NO: 7964085 - DNA, 22 bp, Homo sapiens
ttctttttatcttcccataaga

SEQ ID NO: 7964086 - DNA, 22 bp, Homo sapiens
ttctttttatcttcccataaga

SEQ ID NO: 7964087 - DNA, 22 bp, Homo sapiens
ttgaaaacatttatattagaat

SEQ ID NO: 7964088 - DNA, 22 bp, Homo sapiens
ttgaaaagcaaatgatgggtag

SEQ ID NO: 7964089 - DNA, 17 bp, Homo sapiens
ttgaaaagtaagctccc

SEQ ID NO: 7964090 - DNA, 22 bp, Homo sapiens
ttgaaaagcaaatgatgggtag

SEQ ID NO: 7964091 - DNA, 22 bp, Homo sapiens
ttgaaaaccgtgggaggctgaa

SEQ ID NO: 7964092 - DNA, 23 bp, Homo sapiens
ttgaaaaatatagtcccattgtc

SEQ ID NO: 7964093 - DNA, 23 bp, Homo sapiens
ttgaaaaatatagtcccattgtc

SEQ ID NO: 7964094 - DNA, 22 bp, Homo sapiens
ttgaaaaaattggtagaggatg

SEQ ID NO: 7964095 - DNA, 22 bp, Homo sapiens
ttgaaaggaatacagaggccta

SEQ ID NO: 7964096 - DNA, 23 bp, Homo sapiens
ttgaaagattgctaagtaaaaat

SEQ ID NO: 7964097 - DNA, 23 bp, Homo sapiens
ttgaaagattgctaagtaaaaat

SEQ ID NO: 7964098 - DNA, 23 bp, Homo sapiens
ttgacagtaggtggttttcattg

SEQ ID NO: 7964099 - DNA, 22 bp, Homo sapiens
ttgacataagacttagagtatt

SEQ ID NO: 7964100 - DNA, 22 bp, Homo sapiens
ttgaaagatatgttaatctttc

SEQ ID NO: 7964101 - DNA, 22 bp, Homo sapiens
ttgaaagatatgttaatctttc

SEQ ID NO: 7964102 - DNA, 19 bp, Homo sapiens
ttgaaagattagctttcta

SEQ ID NO: 7964103 - DNA, 22 bp, Homo sapiens
ttgaccactgaatggttctgaa

SEQ ID NO: 7964104 - DNA, 22 bp, Homo sapiens
ttgaccactgaatggttctgaa

SEQ ID NO: 7964105 - DNA, 21 bp, Homo sapiens
ttgaccaagggtgcgtgctcc

SEQ ID NO: 7964106 - DNA, 17 bp, Homo sapiens
ttgaccaaaatgcagcc

SEQ ID NO: 7964107 - DNA, 22 bp, Homo sapiens
ttgaccactgaatggttctgaa

SEQ ID NO: 7964108 - DNA, 21 bp, Homo sapiens
ttgaccaagggtgcgtgctcc

SEQ ID NO: 7964109 - DNA, 22 bp, Homo sapiens
ttgacatcaaatagatatcttt

SEQ ID NO: 7964110 - DNA, 22 bp, Homo sapiens
ttgacataggatgtatcagtca

SEQ ID NO: 7964111 - DNA, 22 bp, Homo sapiens
ttgacatatagcataaggataa

SEQ ID NO: 7964112 - DNA, 17 bp, Homo sapiens
ttgaccaaaatgcagcc

SEQ ID NO: 7964113 - DNA, 22 bp, Homo sapiens
ttgagaaactaacggcttgagc

SEQ ID NO: 7964114 - DNA, 22 bp, Homo sapiens
ttgagaaactaacggcttgagc

SEQ ID NO: 7964115 - DNA, 22 bp, Homo sapiens
ttgagaaacctggcagtagaga

SEQ ID NO: 7964116 - DNA, 22 bp, Homo sapiens
ttgagaaactaacggcttgagc

SEQ ID NO: 7964117 - DNA, 22 bp, Homo sapiens
ttgaccatacctccaggcagtt

SEQ ID NO: 7964118 - DNA, 22 bp, Homo sapiens
ttgaccagttccccaaattgct

SEQ ID NO: 7964119 - DNA, 22 bp, Homo sapiens
ttgaccagtgcctgggaccccg

SEQ ID NO: 7964120 - DNA, 22 bp, Homo sapiens
ttgaccattatacactggcttg

SEQ ID NO: 7964121 - DNA, 22 bp, Homo sapiens
ttgacccaaggccctggaattg

SEQ ID NO: 7964122 - DNA, 22 bp, Homo sapiens
ttgaaacattacctgtatttcc

SEQ ID NO: 7964123 - DNA, 22 bp, Homo sapiens
ttgaaactcatcttagtgatgt

SEQ ID NO: 7964124 - DNA, 22 bp, Homo sapiens
ttgaaactatgaagacaaccat

SEQ ID NO: 7964125 - DNA, 22 bp, Homo sapiens
ttgaaactgcttattgaatttg

SEQ ID NO: 7964126 - DNA, 22 bp, Homo sapiens
ttgaaactgggaagcagggggt

SEQ ID NO: 7964127 - DNA, 22 bp, Homo sapiens
ttgaaagaactcttcagagata

SEQ ID NO: 7964128 - DNA, 22 bp, Homo sapiens
ttgaaagaactcttcagagata

SEQ ID NO: 7964129 - DNA, 22 bp, Homo sapiens
ttgaaacttttcttggagaaac

SEQ ID NO: 7964130 - DNA, 22 bp, Homo sapiens
ttcttctgttggcagagcatac

SEQ ID NO: 7964131 - DNA, 22 bp, Homo sapiens
ttcttcttaatgtcctgggaac

SEQ ID NO: 7964132 - DNA, 22 bp, Homo sapiens
ttcttcttcaagtgctgcattc

SEQ ID NO: 7964133 - DNA, 22 bp, Homo sapiens
ttcttcttcatttctgacgatg

SEQ ID NO: 7964134 - DNA, 22 bp, Homo sapiens
ttcttcttgaaactttaggttg

SEQ ID NO: 7964135 - DNA, 22 bp, Homo sapiens
ttcttcttctggctgcacctgg

SEQ ID NO: 7964136 - DNA, 22 bp, Homo sapiens
ttcttcttgaaactttaggttg

SEQ ID NO: 7964137 - DNA, 22 bp, Homo sapiens
ttcttcttctggctgcacctgg

SEQ ID NO: 7964138 - DNA, 22 bp, Homo sapiens
ttctttctcaacatgaatgttt

SEQ ID NO: 7964139 - DNA, 21 bp, Homo sapiens
ttcttcttggactgttttggc

SEQ ID NO: 7964140 - DNA, 21 bp, Homo sapiens
ttcttcttggactgttttggc

SEQ ID NO: 7964141 - DNA, 22 bp, Homo sapiens
ttctttctcactctttaggaag

SEQ ID NO: 7964142 - DNA, 22 bp, Homo sapiens
ttctttctcactctttaggaag

SEQ ID NO: 7964143 - DNA, 22 bp, Homo sapiens
ttctttctcagtgggcagatac

SEQ ID NO: 7964144 - DNA, 22 bp, Homo sapiens
ttctttctcagtgggcagatac

SEQ ID NO: 7964145 - DNA, 22 bp, Homo sapiens
ttctttctcagtgggcagatac

SEQ ID NO: 7964146 - DNA, 22 bp, Homo sapiens
ttctttctctactagcagagct

SEQ ID NO: 7964147 - DNA, 22 bp, Homo sapiens
ttctttcttagcaatctatggt

SEQ ID NO: 7964148 - DNA, 22 bp, Homo sapiens
ttcttctgattgccttctgcaa

SEQ ID NO: 7964149 - DNA, 22 bp, Homo sapiens
ttcttctgcctcccacctgata

SEQ ID NO: 7964150 - DNA, 22 bp, Homo sapiens
ttcttctgattgccttctgcaa

SEQ ID NO: 7964151 - DNA, 22 bp, Homo sapiens
ttcttctgagagaaaaagctca

SEQ ID NO: 7964152 - DNA, 22 bp, Homo sapiens
ttcttctgtgaggtgtgtgcct

SEQ ID NO: 7964153 - DNA, 22 bp, Homo sapiens
ttcttctgcctcccacctgata

SEQ ID NO: 7964154 - DNA, 22 bp, Homo sapiens
ttcttctgtgaggtgtgtgcct

SEQ ID NO: 7964155 - DNA, 22 bp, Homo sapiens
ttcttctgttggcagagcatac

SEQ ID NO: 7964156 - DNA, 22 bp, Homo sapiens
ttcttctgttggcagagcatac

SEQ ID NO: 7964157 - DNA, 22 bp, Homo sapiens
ttcttctgttgaaagggtagag

SEQ ID NO: 7964158 - DNA, 22 bp, Homo sapiens
ttcttctgttggcagagcatac

SEQ ID NO: 7964159 - DNA, 20 bp, Homo sapiens
ttcttctctagttatcttca

SEQ ID NO: 7964160 - DNA, 20 bp, Homo sapiens
ttcttctctagttatcttca

SEQ ID NO: 7964161 - DNA, 22 bp, Homo sapiens
ttcttctctcatagattaaggt

SEQ ID NO: 7964162 - DNA, 22 bp, Homo sapiens
ttcttctctcatagattaaggt

SEQ ID NO: 7964163 - DNA, 22 bp, Homo sapiens
ttcttctctcatagattaaggt

SEQ ID NO: 7964164 - DNA, 20 bp, Homo sapiens
ttcttctctagttatcttca

SEQ ID NO: 7964165 - DNA, 22 bp, Homo sapiens
ttcttctgacactgatgctgta

SEQ ID NO: 7964166 - DNA, 22 bp, Homo sapiens
ttcttctgaaacataatcaata

SEQ ID NO: 7964167 - DNA, 22 bp, Homo sapiens
ttcttctgaaacataatcaata

SEQ ID NO: 7964168 - DNA, 22 bp, Homo sapiens
ttcttctgaaacataatcaata

SEQ ID NO: 7964169 - DNA, 22 bp, Homo sapiens
ttcttctgaaacagtgacagac

SEQ ID NO: 7964170 - DNA, 22 bp, Homo sapiens
ttcttctgaaacagtgacagac

SEQ ID NO: 7964171 - DNA, 22 bp, Homo sapiens
ttcttctgaaacagtgacagac

SEQ ID NO: 7964172 - DNA, 22 bp, Homo sapiens
ttctttctttgtagtcctgaac

SEQ ID NO: 7964173 - DNA, 22 bp, Homo sapiens
ttctttcttggggaacacactc

SEQ ID NO: 7964174 - DNA, 19 bp, Homo sapiens
ttctttgagttcttctgag

SEQ ID NO: 7964175 - DNA, 22 bp, Homo sapiens
ttctttctttgtagtcctgaac

SEQ ID NO: 7964176 - DNA, 22 bp, Homo sapiens
ttctttctttgtagtcctgaac

SEQ ID NO: 7964177 - DNA, 22 bp, Homo sapiens
ttctttgaccaaacagttttcc

SEQ ID NO: 7964178 - DNA, 22 bp, Homo sapiens
ttctttggaataagtcaagctg

SEQ ID NO: 7964179 - DNA, 22 bp, Homo sapiens
ttctttggaataagtcaagctg

SEQ ID NO: 7964180 - DNA, 22 bp, Homo sapiens
ttctttgcccatgtttcctaag

SEQ ID NO: 7964181 - DNA, 22 bp, Homo sapiens
ttctttgcccatgtttcctaag

SEQ ID NO: 7964182 - DNA, 22 bp, Homo sapiens
ttctttgcccatgtttcctaag

SEQ ID NO: 7964183 - DNA, 23 bp, Homo sapiens
ttctttggaattgggctgcaagg

SEQ ID NO: 7964184 - DNA, 22 bp, Homo sapiens
ttctttggaataagtcaagctg

SEQ ID NO: 7964185 - DNA, 23 bp, Homo sapiens
ttctttggaattgggctgcaagg

SEQ ID NO: 7964186 - DNA, 23 bp, Homo sapiens
ttctttggaattgggctgcaagg

SEQ ID NO: 7964187 - DNA, 22 bp, Homo sapiens
ttctttggaataagtcaagctg

SEQ ID NO: 7964188 - DNA, 22 bp, Homo sapiens
ttctttggcatttcctgtatgt

SEQ ID NO: 7964189 - DNA, 22 bp, Homo sapiens
ttctttggcatttcctgtatgt

SEQ ID NO: 7964190 - DNA, 22 bp, Homo sapiens
ttctttggcatttcctgtatgt

SEQ ID NO: 7964191 - DNA, 23 bp, Homo sapiens
ttctttggaattgggctgcaagg

SEQ ID NO: 7964192 - DNA, 22 bp, Homo sapiens
ttctttgggcaattgctggccc

SEQ ID NO: 7964193 - DNA, 22 bp, Homo sapiens
ttctttgggcaattgctggccc

SEQ ID NO: 7964194 - DNA, 22 bp, Homo sapiens
ttctttgggcaattgctggccc

SEQ ID NO: 7964195 - DNA, 22 bp, Homo sapiens
ttctttgggattgtagctgtct

SEQ ID NO: 7964196 - DNA, 22 bp, Homo sapiens
ttctttgggattgtagctgtct

SEQ ID NO: 7964197 - DNA, 22 bp, Homo sapiens
ttctttgggattgtagctgtct

SEQ ID NO: 7964198 - DNA, 22 bp, Homo sapiens
ttctttgggattgtagctgtct

SEQ ID NO: 7964199 - DNA, 22 bp, Homo sapiens
ttctttggcttacgtctggcct

SEQ ID NO: 7964200 - DNA, 22 bp, Homo sapiens
ttctttgggattgtagctgtct

SEQ ID NO: 7964201 - DNA, 22 bp, Homo sapiens
ttctttggcttacgtctggcct

SEQ ID NO: 7964202 - DNA, 22 bp, Homo sapiens
ttctttggcttacgtctggcct

SEQ ID NO: 7964203 - DNA, 22 bp, Homo sapiens
ttctttggcttacgtctggcct

SEQ ID NO: 7964204 - DNA, 22 bp, Homo sapiens
ttctttggctgccagtctggag

SEQ ID NO: 7964205 - DNA, 22 bp, Homo sapiens
ttctttggctgccagtctggag

SEQ ID NO: 7964206 - DNA, 22 bp, Homo sapiens
ttctttggctgccagtctggag

SEQ ID NO: 7964207 - DNA, 22 bp, Homo sapiens
ttctttggcatttcctgtatgt

SEQ ID NO: 7964208 - DNA, 22 bp, Homo sapiens
ttctttggctgccagtctggag

SEQ ID NO: 7964209 - DNA, 22 bp, Homo sapiens
ttctttggggaatattctggtt

SEQ ID NO: 7964210 - DNA, 22 bp, Homo sapiens
ttctttggggaatattctggtt

SEQ ID NO: 7964211 - DNA, 22 bp, Homo sapiens
ttctttggggtctccagcatag

SEQ ID NO: 7964212 - DNA, 22 bp, Homo sapiens
ttctttggggtctccagcatag

SEQ ID NO: 7964213 - DNA, 22 bp, Homo sapiens
ttctttggggtctccagcatag

SEQ ID NO: 7964214 - DNA, 22 bp, Homo sapiens
ttctttggtgggagattgaggt

SEQ ID NO: 7964215 - DNA, 22 bp, Homo sapiens
ttctttggggtctccagcatag

SEQ ID NO: 7964216 - DNA, 22 bp, Homo sapiens
ttctttgggctcagagagggag

SEQ ID NO: 7964217 - DNA, 22 bp, Homo sapiens
ttctttgggctcagagagggag

SEQ ID NO: 7964218 - DNA, 22 bp, Homo sapiens
ttctttgggcaattgctggccc

SEQ ID NO: 7964219 - DNA, 22 bp, Homo sapiens
ttctttgggcaattgctggccc

SEQ ID NO: 7964220 - DNA, 22 bp, Homo sapiens
ttctttgggctcagagagggag

SEQ ID NO: 7964221 - DNA, 22 bp, Homo sapiens
ttctttgggctcagagagggag

SEQ ID NO: 7964222 - DNA, 22 bp, Homo sapiens
ttctttggggaatattctggtt

SEQ ID NO: 7964223 - DNA, 22 bp, Homo sapiens
ttctttggggaatattctggtt

SEQ ID NO: 7964224 - DNA, 22 bp, Homo sapiens
ttcttctacagtgattaatagt

SEQ ID NO: 7964225 - DNA, 23 bp, Homo sapiens
ttcttctaaggagggccaccatt

SEQ ID NO: 7964226 - DNA, 19 bp, Homo sapiens
ttcttctacctctaccact

SEQ ID NO: 7964227 - DNA, 22 bp, Homo sapiens
ttcttctagagttcagaagcca

SEQ ID NO: 7964228 - DNA, 22 bp, Homo sapiens
ttcttccttggtttcctggata

SEQ ID NO: 7964229 - DNA, 22 bp, Homo sapiens
ttcttccttggtttcctggata

SEQ ID NO: 7964230 - DNA, 22 bp, Homo sapiens
ttcttccttggtttcctggata

SEQ ID NO: 7964231 - DNA, 22 bp, Homo sapiens
ttcttccttggtttcctggata

SEQ ID NO: 7964232 - DNA, 22 bp, Homo sapiens
ttcttccttggtttcctggata

SEQ ID NO: 7964233 - DNA, 22 bp, Homo sapiens
ttcttcctctgtaaaaggtgac

SEQ ID NO: 7964234 - DNA, 22 bp, Homo sapiens
ttcttcctctgtaaaaggtgac

SEQ ID NO: 7964235 - DNA, 22 bp, Homo sapiens
ttcttctccgaggagggctggt

SEQ ID NO: 7964236 - DNA, 22 bp, Homo sapiens
ttcttctcctaaggagagtcct

SEQ ID NO: 7964237 - DNA, 22 bp, Homo sapiens
ttcttctcctaaggagagtcct

SEQ ID NO: 7964238 - DNA, 22 bp, Homo sapiens
ttcttctcctaaggagagtcct

SEQ ID NO: 7964239 - DNA, 22 bp, Homo sapiens
ttcttctcctaaggagagtcct

SEQ ID NO: 7964240 - DNA, 22 bp, Homo sapiens
ttcttctcggctgtcagatagt

SEQ ID NO: 7964241 - DNA, 22 bp, Homo sapiens
ttcttctcggctgtcagatagt

SEQ ID NO: 7964242 - DNA, 22 bp, Homo sapiens
ttcttctcggctgtcagatagt

SEQ ID NO: 7964243 - DNA, 22 bp, Homo sapiens
ttcttctcggctgtcagatagt

SEQ ID NO: 7964244 - DNA, 23 bp, Homo sapiens
ttcttctcaattagttgattcag

SEQ ID NO: 7964245 - DNA, 22 bp, Homo sapiens
ttcttctccgaggagggctggt

SEQ ID NO: 7964246 - DNA, 22 bp, Homo sapiens
ttcttctcagggtcccacatgg

SEQ ID NO: 7964247 - DNA, 22 bp, Homo sapiens
ttcttctcagggtcccacatgg

SEQ ID NO: 7964248 - DNA, 22 bp, Homo sapiens
ttcttcagatcctacaagtctg

SEQ ID NO: 7964249 - DNA, 22 bp, Homo sapiens
ttcttcagagagtagaagcaag

SEQ ID NO: 7964250 - DNA, 22 bp, Homo sapiens
ttcttcagagagtagaagcaag

SEQ ID NO: 7964251 - DNA, 22 bp, Homo sapiens
ttcttcagagagtagaagcaag

SEQ ID NO: 7964252 - DNA, 22 bp, Homo sapiens
ttcttcagcccatatcttccag

SEQ ID NO: 7964253 - DNA, 23 bp, Homo sapiens
ttcttcagccttatagccctggg

SEQ ID NO: 7964254 - DNA, 22 bp, Homo sapiens
ttcttcctcagcagggctgcct

SEQ ID NO: 7964255 - DNA, 22 bp, Homo sapiens
ttcttcctcacactctcaccca

SEQ ID NO: 7964256 - DNA, 22 bp, Homo sapiens
ttctgggcacacaggccctggt

SEQ ID NO: 7964257 - DNA, 22 bp, Homo sapiens
ttctgggatgtgaatggtttaa

SEQ ID NO: 7964258 - DNA, 22 bp, Homo sapiens
ttctgggcacacaggccctggt

SEQ ID NO: 7964259 - DNA, 22 bp, Homo sapiens
ttctgggcacacaggccctggt

SEQ ID NO: 7964260 - DNA, 22 bp, Homo sapiens
ttctgggcacacaggccctggt

SEQ ID NO: 7964261 - DNA, 19 bp, Homo sapiens
ttctgggaggggctgactg

SEQ ID NO: 7964262 - DNA, 22 bp, Homo sapiens
ttctgggacattgcaggtattc

SEQ ID NO: 7964263 - DNA, 22 bp, Homo sapiens
ttctgggagaatctaaatggtt

SEQ ID NO: 7964264 - DNA, 22 bp, Homo sapiens
ttctgggagagaaagggccttg

SEQ ID NO: 7964265 - DNA, 22 bp, Homo sapiens
ttctgggaggctggctgtcata

SEQ ID NO: 7964266 - DNA, 22 bp, Homo sapiens
ttctgggaggcctttgtgtctg

SEQ ID NO: 7964267 - DNA, 22 bp, Homo sapiens
ttctgggagattcatatgaaaa

SEQ ID NO: 7964268 - DNA, 22 bp, Homo sapiens
ttctgggaggatgggaaatcat

SEQ ID NO: 7964269 - DNA, 22 bp, Homo sapiens
ttctggataggggtatggagct

SEQ ID NO: 7964270 - DNA, 22 bp, Homo sapiens
ttctggagtttgaagatcaggt

SEQ ID NO: 7964271 - DNA, 22 bp, Homo sapiens
ttctggagtttgaagatcaggt

SEQ ID NO: 7964272 - DNA, 22 bp, Homo sapiens
ttctggagttgtgacctcaggg

SEQ ID NO: 7964273 - DNA, 22 bp, Homo sapiens
ttctggagttcaggtccctaaa

SEQ ID NO: 7964274 - DNA, 22 bp, Homo sapiens
ttctggagtttgaagatcaggt

SEQ ID NO: 7964275 - DNA, 22 bp, Homo sapiens
ttctggagtttgaagatcaggt

SEQ ID NO: 7964276 - DNA, 22 bp, Homo sapiens
ttctggagttgtgacctcaggg

SEQ ID NO: 7964277 - DNA, 22 bp, Homo sapiens
ttctggatcagcatcatgagat

SEQ ID NO: 7964278 - DNA, 22 bp, Homo sapiens
ttctggatcagcatcatgagat

SEQ ID NO: 7964279 - DNA, 22 bp, Homo sapiens
ttctggatcagcatcatgagat

SEQ ID NO: 7964280 - DNA, 22 bp, Homo sapiens
ttctggatatgggagagggagc

SEQ ID NO: 7964281 - DNA, 22 bp, Homo sapiens
ttctggatatggattttggtga

SEQ ID NO: 7964282 - DNA, 22 bp, Homo sapiens
ttctggctttcttgtcaggatg

SEQ ID NO: 7964283 - DNA, 22 bp, Homo sapiens
ttctggatataacattcagtcc

SEQ ID NO: 7964284 - DNA, 22 bp, Homo sapiens
ttctggatgatccatttacaga

SEQ ID NO: 7964285 - DNA, 22 bp, Homo sapiens
ttctggatctgagggggaagat

SEQ ID NO: 7964286 - DNA, 22 bp, Homo sapiens
ttctgggacatctggacagttt

SEQ ID NO: 7964287 - DNA, 22 bp, Homo sapiens
ttctgggacatctggacagttt

SEQ ID NO: 7964288 - DNA, 22 bp, Homo sapiens
ttctgggacattgcaggtattc

SEQ ID NO: 7964289 - DNA, 22 bp, Homo sapiens
ttctgggacattgcaggtattc

SEQ ID NO: 7964290 - DNA, 22 bp, Homo sapiens
ttctggctttggagaggatagc

SEQ ID NO: 7964291 - DNA, 22 bp, Homo sapiens
ttctggcttttcatgttccagt

SEQ ID NO: 7964292 - DNA, 22 bp, Homo sapiens
ttctggcttttcatgttccagt

SEQ ID NO: 7964293 - DNA, 22 bp, Homo sapiens
ttctggcttttcatgttccagt

SEQ ID NO: 7964294 - DNA, 22 bp, Homo sapiens
ttctggcttttcatgttccagt

SEQ ID NO: 7964295 - DNA, 20 bp, Homo sapiens
ttctgggaattgggtagctg

SEQ ID NO: 7964296 - DNA, 22 bp, Homo sapiens
ttctggagtattcctggcacct

SEQ ID NO: 7964297 - DNA, 22 bp, Homo sapiens
ttctggaggttattaggagtct

SEQ ID NO: 7964298 - DNA, 22 bp, Homo sapiens
ttctggaggttattaggagtct

SEQ ID NO: 7964299 - DNA, 19 bp, Homo sapiens
ttctggaggttaccctgag

SEQ ID NO: 7964300 - DNA, 22 bp, Homo sapiens
ttctggagggcctgatcacaca

SEQ ID NO: 7964301 - DNA, 22 bp, Homo sapiens
ttctggaggtgtgaccattagc

SEQ ID NO: 7964302 - DNA, 22 bp, Homo sapiens
ttctggagggcctgatcacaca

SEQ ID NO: 7964303 - DNA, 22 bp, Homo sapiens
ttctggaggtgtgaccattagc

SEQ ID NO: 7964304 - DNA, 22 bp, Homo sapiens
ttctggaggctctaagggacaa

SEQ ID NO: 7964305 - DNA, 22 bp, Homo sapiens
ttctggagggcatgctgctgcc

SEQ ID NO: 7964306 - DNA, 22 bp, Homo sapiens
ttctggaggctctaagggacaa

SEQ ID NO: 7964307 - DNA, 22 bp, Homo sapiens
ttctggagggcatgctgctgcc

SEQ ID NO: 7964308 - DNA, 22 bp, Homo sapiens
ttctggagggcatgctgctgcc

SEQ ID NO: 7964309 - DNA, 22 bp, Homo sapiens
ttctggagggcctgatcacaca

SEQ ID NO: 7964310 - DNA, 22 bp, Homo sapiens
ttctggagggcctgatcacaca

SEQ ID NO: 7964311 - DNA, 22 bp, Homo sapiens
ttctggagtattcctggcacct

SEQ ID NO: 7964312 - DNA, 22 bp, Homo sapiens
ttctggagtattcctggcagcc

SEQ ID NO: 7964313 - DNA, 22 bp, Homo sapiens
ttctggagtcccacagccaggg

SEQ ID NO: 7964314 - DNA, 22 bp, Homo sapiens
ttctggagtcccacagccaggg

SEQ ID NO: 7964315 - DNA, 22 bp, Homo sapiens
ttctggagtcccacagccaggg

SEQ ID NO: 7964316 - DNA, 22 bp, Homo sapiens
ttctggagtcattggggctgat

SEQ ID NO: 7964317 - DNA, 22 bp, Homo sapiens
ttctggagtcttcaattttaga

SEQ ID NO: 7964318 - DNA, 22 bp, Homo sapiens
ttctggagtgataaaacaccac

SEQ ID NO: 7964319 - DNA, 22 bp, Homo sapiens
ttctggagtgataaaacaccac

SEQ ID NO: 7964320 - DNA, 22 bp, Homo sapiens
ttctggagtgtattgggtctgc

SEQ ID NO: 7964321 - DNA, 22 bp, Homo sapiens
ttctggagtgtggaccgctgtt

SEQ ID NO: 7964322 - DNA, 22 bp, Homo sapiens
ttctggagttcaggtccctaaa

SEQ ID NO: 7964323 - DNA, 22 bp, Homo sapiens
ttctggagtgtggaccgctgtt

SEQ ID NO: 7964324 - DNA, 22 bp, Homo sapiens
ttctccagaggtggctagagtt

SEQ ID NO: 7964325 - DNA, 22 bp, Homo sapiens
ttctcagatccatcagaagtcc

SEQ ID NO: 7964326 - DNA, 22 bp, Homo sapiens
ttctccagagtttctctcactg

SEQ ID NO: 7964327 - DNA, 22 bp, Homo sapiens
ttctccagaggtggctagagtt

SEQ ID NO: 7964328 - DNA, 22 bp, Homo sapiens
ttctcagatccatcagaagtcc

SEQ ID NO: 7964329 - DNA, 22 bp, Homo sapiens
ttctcagatatttgtatggaac

SEQ ID NO: 7964330 - DNA, 22 bp, Homo sapiens
ttctcagatccatcagaagtcc

SEQ ID NO: 7964331 - DNA, 22 bp, Homo sapiens
ttctcagatatttactgagcat

SEQ ID NO: 7964332 - DNA, 22 bp, Homo sapiens
ttctcagatatttactgagcat

SEQ ID NO: 7964333 - DNA, 22 bp, Homo sapiens
ttctcagatatttgtatggaac

SEQ ID NO: 7964334 - DNA, 22 bp, Homo sapiens
ttctcagatatttactgagcat

SEQ ID NO: 7964335 - DNA, 22 bp, Homo sapiens
ttctcagatatttgtatggaac

SEQ ID NO: 7964336 - DNA, 22 bp, Homo sapiens
ttctcagaggctgctaagtgca

SEQ ID NO: 7964337 - DNA, 22 bp, Homo sapiens
ttctcagaggagtcgggagctg

SEQ ID NO: 7964338 - DNA, 22 bp, Homo sapiens
ttctcagaggctgctaagtgca

SEQ ID NO: 7964339 - DNA, 21 bp, Homo sapiens
ttctcagagtctattacagtt

SEQ ID NO: 7964340 - DNA, 21 bp, Homo sapiens
ttctcagagtctattacagtt

SEQ ID NO: 7964341 - DNA, 21 bp, Homo sapiens
ttctcagagtctattacagtt

SEQ ID NO: 7964342 - DNA, 22 bp, Homo sapiens
ttctcagagtgaccaagtcttt

SEQ ID NO: 7964343 - DNA, 21 bp, Homo sapiens
ttctcagagtctattacagtt

SEQ ID NO: 7964344 - DNA, 22 bp, Homo sapiens
ttctcagagtgaccaagtcttt

SEQ ID NO: 7964345 - DNA, 22 bp, Homo sapiens
ttctcagatatttactgagcat

SEQ ID NO: 7964346 - DNA, 22 bp, Homo sapiens
ttctcagagtgaccaagtcttt

SEQ ID NO: 7964347 - DNA, 22 bp, Homo sapiens
ttctcagacttccagcaccagc

SEQ ID NO: 7964348 - DNA, 22 bp, Homo sapiens
ttctcagaattgactgggagca

SEQ ID NO: 7964349 - DNA, 22 bp, Homo sapiens
ttctcagacttccagcaccagc

SEQ ID NO: 7964350 - DNA, 22 bp, Homo sapiens
ttctcagacttccagcaccagc

SEQ ID NO: 7964351 - DNA, 22 bp, Homo sapiens
ttctcagacttccagcaccagc

SEQ ID NO: 7964352 - DNA, 22 bp, Homo sapiens
ttctcagagcactgctgacaaa

SEQ ID NO: 7964353 - DNA, 22 bp, Homo sapiens
ttctcagagcactgctgacaaa

SEQ ID NO: 7964354 - DNA, 18 bp, Homo sapiens
ttctcagactttggaagt

SEQ ID NO: 7964355 - DNA, 22 bp, Homo sapiens
ttctcagagcactgctgacaaa

SEQ ID NO: 7964356 - DNA, 22 bp, Homo sapiens
ttctcagaggagtcgggagctg

SEQ ID NO: 7964357 - DNA, 22 bp, Homo sapiens
ttctcagaggagtcgggagctg

SEQ ID NO: 7964358 - DNA, 19 bp, Homo sapiens
ttctcagagcttgcagcac

SEQ ID NO: 7964359 - DNA, 19 bp, Homo sapiens
ttctcagagcttgcagcac

SEQ ID NO: 7964360 - DNA, 19 bp, Homo sapiens
ttctcagagcttgcagcac

SEQ ID NO: 7964361 - DNA, 19 bp, Homo sapiens
ttctcagagcttgcagcac

SEQ ID NO: 7964362 - DNA, 22 bp, Homo sapiens
ttctcagagctcactgtagtaa

SEQ ID NO: 7964363 - DNA, 22 bp, Homo sapiens
ttctcagagctcactgtagtaa

SEQ ID NO: 7964364 - DNA, 22 bp, Homo sapiens
ttctcagagctcactgtagtaa

SEQ ID NO: 7964365 - DNA, 22 bp, Homo sapiens
ttctccaggcttgggccaggtc

SEQ ID NO: 7964366 - DNA, 22 bp, Homo sapiens
ttctccaggcttgggccaggtc

SEQ ID NO: 7964367 - DNA, 19 bp, Homo sapiens
ttctccagggacttaggga

SEQ ID NO: 7964368 - DNA, 22 bp, Homo sapiens
ttctccaggcttgggccaggtc

SEQ ID NO: 7964369 - DNA, 22 bp, Homo sapiens
ttctccaggcttgggccaggtc

SEQ ID NO: 7964370 - DNA, 19 bp, Homo sapiens
ttctccagggacttaggga

SEQ ID NO: 7964371 - DNA, 22 bp, Homo sapiens
ttctccaggggagggttctcca

SEQ ID NO: 7964372 - DNA, 21 bp, Homo sapiens
ttctccagggggagctctctc

SEQ ID NO: 7964373 - DNA, 21 bp, Homo sapiens
ttctccagggggagctctctc

SEQ ID NO: 7964374 - DNA, 22 bp, Homo sapiens
ttctccaggggagggttctcca

SEQ ID NO: 7964375 - DNA, 19 bp, Homo sapiens
ttctccaggctgcagaggg

SEQ ID NO: 7964376 - DNA, 19 bp, Homo sapiens
ttctccaggctgcagaggg

SEQ ID NO: 7964377 - DNA, 19 bp, Homo sapiens
ttctccaggctgcagaggg

SEQ ID NO: 7964378 - DNA, 19 bp, Homo sapiens
ttctccaggctgcagaggg

SEQ ID NO: 7964379 - DNA, 22 bp, Homo sapiens
ttctccaggccgcgcagggggc

SEQ ID NO: 7964380 - DNA, 22 bp, Homo sapiens
ttctccaggccgcgcagggggc

SEQ ID NO: 7964381 - DNA, 22 bp, Homo sapiens
ttctccaggccgcgcagggggc

SEQ ID NO: 7964382 - DNA, 21 bp, Homo sapiens
ttctccaggcaaccatttcag

SEQ ID NO: 7964383 - DNA, 22 bp, Homo sapiens
ttctccagctcatcagggaggg

SEQ ID NO: 7964384 - DNA, 21 bp, Homo sapiens
ttctccaggcaaccatttcag

SEQ ID NO: 7964385 - DNA, 22 bp, Homo sapiens
ttctccagctcatcagggaggg

SEQ ID NO: 7964386 - DNA, 22 bp, Homo sapiens
ttctccagctcatcagggaggg

SEQ ID NO: 7964387 - DNA, 21 bp, Homo sapiens
ttctccaggcaaccatttcag

SEQ ID NO: 7964388 - DNA, 19 bp, Homo sapiens
ttctccagcctgacctgag

SEQ ID NO: 7964389 - DNA, 19 bp, Homo sapiens
ttctccagcctgacctgag

SEQ ID NO: 7964390 - DNA, 19 bp, Homo sapiens
ttctccagcctgacctgag

SEQ ID NO: 7964391 - DNA, 19 bp, Homo sapiens
ttctccagcctgacctgag

SEQ ID NO: 7964392 - DNA, 22 bp, Homo sapiens
ttctccagcacattttctttga

SEQ ID NO: 7964393 - DNA, 22 bp, Homo sapiens
ttctccagcacattttctttga

SEQ ID NO: 7964394 - DNA, 22 bp, Homo sapiens
ttctccagagtttctctcactg

SEQ ID NO: 7964395 - DNA, 22 bp, Homo sapiens
ttctccagagtttctctcactg

SEQ ID NO: 7964396 - DNA, 22 bp, Homo sapiens
ttctccagcctattggcctatc

SEQ ID NO: 7964397 - DNA, 22 bp, Homo sapiens
ttctccagcctattggcctatc

SEQ ID NO: 7964398 - DNA, 19 bp, Homo sapiens
ttctccagcctgacctgag

SEQ ID NO: 7964399 - DNA, 22 bp, Homo sapiens
ttctccagcctattggcctatc

SEQ ID NO: 7964400 - DNA, 22 bp, Homo sapiens
ttctcactatgtatgtagattg

SEQ ID NO: 7964401 - DNA, 22 bp, Homo sapiens
ttctcacgttattggctgagag

SEQ ID NO: 7964402 - DNA, 22 bp, Homo sapiens
ttctcacattcagaacttttat

SEQ ID NO: 7964403 - DNA, 22 bp, Homo sapiens
ttctcacagtacctaacatgta

SEQ ID NO: 7964404 - DNA, 22 bp, Homo sapiens
ttctcagaaaagcaagctttct

SEQ ID NO: 7964405 - DNA, 22 bp, Homo sapiens
ttctcagaaaatgtagagaaaa

SEQ ID NO: 7964406 - DNA, 22 bp, Homo sapiens
ttctcagaattgactgggagca

SEQ ID NO: 7964407 - DNA, 22 bp, Homo sapiens
ttctcagaaaatgtagagaaaa

SEQ ID NO: 7964408 - DNA, 22 bp, Homo sapiens
ttctcagaattgactgggagca

SEQ ID NO: 7964409 - DNA, 22 bp, Homo sapiens
ttctcacaggatttcttttagt

SEQ ID NO: 7964410 - DNA, 22 bp, Homo sapiens
ttctcacaggctggaatgatga

SEQ ID NO: 7964411 - DNA, 22 bp, Homo sapiens
ttctcacactttccactgaggt

SEQ ID NO: 7964412 - DNA, 22 bp, Homo sapiens
ttctcacaggaagtaggacttt

SEQ ID NO: 7964413 - DNA, 22 bp, Homo sapiens
ttctcacactttccactgaggt

SEQ ID NO: 7964414 - DNA, 22 bp, Homo sapiens
ttctcacaattcttgtatttgc

SEQ ID NO: 7964415 - DNA, 22 bp, Homo sapiens
ttctcaaggacaaaatgacatg

SEQ ID NO: 7964416 - DNA, 22 bp, Homo sapiens
ttctcaagtgagtggtaaatga

SEQ ID NO: 7964417 - DNA, 22 bp, Homo sapiens
ttctcaaggacaaaatgacatg

SEQ ID NO: 7964418 - DNA, 22 bp, Homo sapiens
ttctcaaggacaaaatgacatg

SEQ ID NO: 7964419 - DNA, 22 bp, Homo sapiens
ttctcacaaatccatccaggag

SEQ ID NO: 7964420 - DNA, 22 bp, Homo sapiens
ttctatattggaagtgagaaat

SEQ ID NO: 7964421 - DNA, 22 bp, Homo sapiens
ttctaagaaatggaaaacgatt

SEQ ID NO: 7964422 - DNA, 22 bp, Homo sapiens
ttctaacttaacactcctgtga

SEQ ID NO: 7964423 - DNA, 22 bp, Homo sapiens
ttctaagaaatggaaaacgatt

SEQ ID NO: 7964424 - DNA, 22 bp, Homo sapiens
ttctaactttcaaggtcctttc

SEQ ID NO: 7964425 - DNA, 22 bp, Homo sapiens
ttctaacttaacactcctgtga

SEQ ID NO: 7964426 - DNA, 22 bp, Homo sapiens
ttctatattgttaaaggttata

SEQ ID NO: 7964427 - DNA, 22 bp, Homo sapiens
ttctatcatacttgaatacatt

SEQ ID NO: 7964428 - DNA, 22 bp, Homo sapiens
ttctatcatacttgaatacatt

SEQ ID NO: 7964429 - DNA, 22 bp, Homo sapiens
ttctatgaaggtaagatgtacg

SEQ ID NO: 7964430 - DNA, 22 bp, Homo sapiens
ttctatgaaggtaagatgtacg

SEQ ID NO: 7964431 - DNA, 22 bp, Homo sapiens
ttctatgaaggtaagatgtacg

SEQ ID NO: 7964432 - DNA, 22 bp, Homo sapiens
ttctatgaaggtaagatgtacg

SEQ ID NO: 7964433 - DNA, 19 bp, Homo sapiens
ttctatgattaacatgaga

SEQ ID NO: 7964434 - DNA, 22 bp, Homo sapiens
ttctcaactctcaagagaagct

SEQ ID NO: 7964435 - DNA, 22 bp, Homo sapiens
ttctcaaggacaaaatgacatg

SEQ ID NO: 7964436 - DNA, 22 bp, Homo sapiens
ttctcaaagggtggtttgcaaa

SEQ ID NO: 7964437 - DNA, 22 bp, Homo sapiens
ttctcaaagaaagctgtcatta

SEQ ID NO: 7964438 - DNA, 22 bp, Homo sapiens
ttctatgattcatttagaagtt

SEQ ID NO: 7964439 - DNA, 22 bp, Homo sapiens
ttctcaaagaaagctgtcatta

SEQ ID NO: 7964440 - DNA, 22 bp, Homo sapiens
ttctcaaagaaagctgtcatta

SEQ ID NO: 7964441 - DNA, 19 bp, Homo sapiens
ttctatgattaacatgaga

SEQ ID NO: 7964442 - DNA, 22 bp, Homo sapiens
ttctatgattcatttagaagtt

SEQ ID NO: 7964443 - DNA, 19 bp, Homo sapiens
ttctatgattaacatgaga

SEQ ID NO: 7964444 - DNA, 20 bp, Homo sapiens
ttcgctgggagtggccaggc

SEQ ID NO: 7964445 - DNA, 22 bp, Homo sapiens
ttcgggctcgcccagatcagtg

SEQ ID NO: 7964446 - DNA, 22 bp, Homo sapiens
ttcgggctcgcccagatcagtg

SEQ ID NO: 7964447 - DNA, 22 bp, Homo sapiens
ttcgggctcgcccagatcagtg

SEQ ID NO: 7964448 - DNA, 22 bp, Homo sapiens
ttcgtgtggagatgtttctgca

SEQ ID NO: 7964449 - DNA, 22 bp, Homo sapiens
ttcgtcttttcttactatggtt

SEQ ID NO: 7964450 - DNA, 22 bp, Homo sapiens
ttctaaaaccaattctgcttct

SEQ ID NO: 7964451 - DNA, 22 bp, Homo sapiens
ttctaaaaccaattctgcttct

SEQ ID NO: 7964452 - DNA, 22 bp, Homo sapiens
ttctaaaaccaattctgcttct

SEQ ID NO: 7964453 - DNA, 22 bp, Homo sapiens
ttcgttttctaggaccaacaga

SEQ ID NO: 7964454 - DNA, 22 bp, Homo sapiens
ttctaaaataagtttatctggt

SEQ ID NO: 7964455 - DNA, 22 bp, Homo sapiens
ttctaaaataagtttatctggt

SEQ ID NO: 7964456 - DNA, 22 bp, Homo sapiens
ttctaaaataagtttatctggt

SEQ ID NO: 7964457 - DNA, 22 bp, Homo sapiens
ttctaaaataagtttatctggt

SEQ ID NO: 7964458 - DNA, 22 bp, Homo sapiens
ttctaaaataagtttatctggt

SEQ ID NO: 7964459 - DNA, 22 bp, Homo sapiens
ttctaaaataagtttatctggt

SEQ ID NO: 7964460 - DNA, 22 bp, Homo sapiens
ttctaaaataagtttatctggt

SEQ ID NO: 7964461 - DNA, 22 bp, Homo sapiens
ttctaaacggcttcacaggaat

SEQ ID NO: 7964462 - DNA, 22 bp, Homo sapiens
ttctaaattttggaagatgcag

SEQ ID NO: 7964463 - DNA, 22 bp, Homo sapiens
ttctaaattttggaagatgcag

SEQ ID NO: 7964464 - DNA, 22 bp, Homo sapiens
ttctaactcaaagcttctttca

SEQ ID NO: 7964465 - DNA, 22 bp, Homo sapiens
ttctaactaaagtctttgtttt

SEQ ID NO: 7964466 - DNA, 20 bp, Homo sapiens
ttctaactactctccctttg

SEQ ID NO: 7964467 - DNA, 22 bp, Homo sapiens
ttctaactctgttatgtgtttc

SEQ ID NO: 7964468 - DNA, 22 bp, Homo sapiens
ttctaactcaaagcttctttca

SEQ ID NO: 7964469 - DNA, 22 bp, Homo sapiens
ttctaaagtgcaatctgacaga

SEQ ID NO: 7964470 - DNA, 22 bp, Homo sapiens
ttctaaagtgcaatctgacaga

SEQ ID NO: 7964471 - DNA, 22 bp, Homo sapiens
ttctaaatggggatcctttctg

SEQ ID NO: 7964472 - DNA, 22 bp, Homo sapiens
ttctaaatggggatcctttctg

SEQ ID NO: 7964473 - DNA, 22 bp, Homo sapiens
ttctaaatggggatcctttctg

SEQ ID NO: 7964474 - DNA, 22 bp, Homo sapiens
ttctaaagcctgtcctatcaga

SEQ ID NO: 7964475 - DNA, 22 bp, Homo sapiens
ttctaaagtgcaatctgacaga

SEQ ID NO: 7964476 - DNA, 22 bp, Homo sapiens
ttctaaattttggaagatgcag

SEQ ID NO: 7964477 - DNA, 22 bp, Homo sapiens
ttctaaattttggaagatgcag

SEQ ID NO: 7964478 - DNA, 18 bp, Homo sapiens
ttctaaattctgttttta

SEQ ID NO: 7964479 - DNA, 22 bp, Homo sapiens
ttctaaatgtaaatagtatgat

SEQ ID NO: 7964480 - DNA, 22 bp, Homo sapiens
ttctaaatgtaaatagtatgat

SEQ ID NO: 7964481 - DNA, 22 bp, Homo sapiens
ttctaaatggggatcctttctg

SEQ ID NO: 7964482 - DNA, 21 bp, Homo sapiens
ttcctttttatggcttagtgg

SEQ ID NO: 7964483 - DNA, 21 bp, Homo sapiens
ttcctttttatggcttagtgg

SEQ ID NO: 7964484 - DNA, 21 bp, Homo sapiens
ttcctttttatggcttagtgg

SEQ ID NO: 7964485 - DNA, 22 bp, Homo sapiens
ttcctttagtgtcatatacttt

SEQ ID NO: 7964486 - DNA, 22 bp, Homo sapiens
ttccttgtttcaagccatccac

SEQ ID NO: 7964487 - DNA, 22 bp, Homo sapiens
ttccttgtttgtagctctggga

SEQ ID NO: 7964488 - DNA, 22 bp, Homo sapiens
ttcctttagggaaatcgtctca

SEQ ID NO: 7964489 - DNA, 22 bp, Homo sapiens
ttcctttagtgtcatatacttt

SEQ ID NO: 7964490 - DNA, 22 bp, Homo sapiens
ttcctttagtgtcatatacttt

SEQ ID NO: 7964491 - DNA, 20 bp, Homo sapiens
ttcgctgggagtggccaggc

SEQ ID NO: 7964492 - DNA, 20 bp, Homo sapiens
ttcgctgggagtggccaggc

SEQ ID NO: 7964493 - DNA, 20 bp, Homo sapiens
ttcgctgggagtggccaggc

SEQ ID NO: 7964494 - DNA, 20 bp, Homo sapiens
ttcgctgggagtggccaggc

SEQ ID NO: 7964495 - DNA, 22 bp, Homo sapiens
ttcgagtctttgtttggatagt

SEQ ID NO: 7964496 - DNA, 22 bp, Homo sapiens
ttcgatgtattttttcacagga

SEQ ID NO: 7964497 - DNA, 22 bp, Homo sapiens
ttccctcttttccaacagttgt

SEQ ID NO: 7964498 - DNA, 22 bp, Homo sapiens
ttccctctctccagggctgcct

SEQ ID NO: 7964499 - DNA, 22 bp, Homo sapiens
ttccctctgcgcattgaatttc

SEQ ID NO: 7964500 - DNA, 22 bp, Homo sapiens
ttccctctttcactgtgatttt

SEQ ID NO: 7964501 - DNA, 22 bp, Homo sapiens
ttccctgaagacctcatgtgac

SEQ ID NO: 7964502 - DNA, 22 bp, Homo sapiens
ttccctgatcacgtgtcaggag

SEQ ID NO: 7964503 - DNA, 22 bp, Homo sapiens
ttccctgcaacctttccctggg

SEQ ID NO: 7964504 - DNA, 22 bp, Homo sapiens
ttccttgtttcaagccatccac

SEQ ID NO: 7964505 - DNA, 22 bp, Homo sapiens
ttccttgttgaaaatgtctgca

SEQ ID NO: 7964506 - DNA, 22 bp, Homo sapiens
ttccttgttgaaaatgtctgca

SEQ ID NO: 7964507 - DNA, 22 bp, Homo sapiens
ttccttgttctacatccctgcc

SEQ ID NO: 7964508 - DNA, 22 bp, Homo sapiens
ttccttgttgaaaatgtctgca

SEQ ID NO: 7964509 - DNA, 22 bp, Homo sapiens
ttccctgcaacctttccctggg

SEQ ID NO: 7964510 - DNA, 22 bp, Homo sapiens
ttccttgttgaaaatgtctgca

SEQ ID NO: 7964511 - DNA, 22 bp, Homo sapiens
ttccctcccccagcctggcagg

SEQ ID NO: 7964512 - DNA, 22 bp, Homo sapiens
ttccctcccccagcctggcagg

SEQ ID NO: 7964513 - DNA, 22 bp, Homo sapiens
ttccctccctggctgccatttc

SEQ ID NO: 7964514 - DNA, 22 bp, Homo sapiens
ttccctccatttcattttataa

SEQ ID NO: 7964515 - DNA, 22 bp, Homo sapiens
ttccctccatttcattttataa

SEQ ID NO: 7964516 - DNA, 22 bp, Homo sapiens
ttccctcctatgcccactgaaa

SEQ ID NO: 7964517 - DNA, 22 bp, Homo sapiens
ttccctcctatgcccactgaaa

SEQ ID NO: 7964518 - DNA, 22 bp, Homo sapiens
ttccctcctatgcccactgaaa

SEQ ID NO: 7964519 - DNA, 22 bp, Homo sapiens
ttccctctgcgcattgaatttc

SEQ ID NO: 7964520 - DNA, 22 bp, Homo sapiens
ttccctctgcgcattgaatttc

SEQ ID NO: 7964521 - DNA, 22 bp, Homo sapiens
ttccctctctccagggctgcct

SEQ ID NO: 7964522 - DNA, 22 bp, Homo sapiens
ttccctctgcgcattgaatttc

SEQ ID NO: 7964523 - DNA, 22 bp, Homo sapiens
ttccctctctccagggctgcct

SEQ ID NO: 7964524 - DNA, 22 bp, Homo sapiens
ttccctctcctactcaggaaag

SEQ ID NO: 7964525 - DNA, 22 bp, Homo sapiens
ttccctctctagctttccccaa

SEQ ID NO: 7964526 - DNA, 22 bp, Homo sapiens
ttccctctcacttaaagcttgg

SEQ ID NO: 7964527 - DNA, 22 bp, Homo sapiens
ttccctctccaggagccctgag

SEQ ID NO: 7964528 - DNA, 22 bp, Homo sapiens
ttccctctccaggagccctgag

SEQ ID NO: 7964529 - DNA, 22 bp, Homo sapiens
ttccctctccaggagccctgag

SEQ ID NO: 7964530 - DNA, 22 bp, Homo sapiens
ttctgattgctgatgaggccca

SEQ ID NO: 7964531 - DNA, 22 bp, Homo sapiens
ttctgattgctgatgaggccca

SEQ ID NO: 7964532 - DNA, 22 bp, Homo sapiens
ttctgattgctgatgaggccca

SEQ ID NO: 7964533 - DNA, 22 bp, Homo sapiens
ttctgattgttggaggatgctt

SEQ ID NO: 7964534 - DNA, 22 bp, Homo sapiens
ttctgattgttggaggatgctt

SEQ ID NO: 7964535 - DNA, 22 bp, Homo sapiens
ttctgattgctgatgaggccca

SEQ ID NO: 7964536 - DNA, 22 bp, Homo sapiens
ttctgattgctgatgaggccca

SEQ ID NO: 7964537 - DNA, 22 bp, Homo sapiens
ttctgattcatgatccagttct

SEQ ID NO: 7964538 - DNA, 22 bp, Homo sapiens
ttctgattcatgatccagttct

SEQ ID NO: 7964539 - DNA, 22 bp, Homo sapiens
ttctgatggtggaatgcttcag

SEQ ID NO: 7964540 - DNA, 22 bp, Homo sapiens
ttctgatactggaatcgatgcc

SEQ ID NO: 7964541 - DNA, 22 bp, Homo sapiens
ttctgatgatggcggctggagc

SEQ ID NO: 7964542 - DNA, 22 bp, Homo sapiens
ttctgatgatggcggctggagc

SEQ ID NO: 7964543 - DNA, 22 bp, Homo sapiens
ttctgaggtccatgcagtactg

SEQ ID NO: 7964544 - DNA, 22 bp, Homo sapiens
ttctgagggctaatgtactgta

SEQ ID NO: 7964545 - DNA, 22 bp, Homo sapiens
ttctgaggccattaccaataaa

SEQ ID NO: 7964546 - DNA, 22 bp, Homo sapiens
ttctgagggaaccttgttcttg

SEQ ID NO: 7964547 - DNA, 22 bp, Homo sapiens
ttctgagggaggttctctggga

SEQ ID NO: 7964548 - DNA, 22 bp, Homo sapiens
ttctgagggaaccttgttcttg

SEQ ID NO: 7964549 - DNA, 22 bp, Homo sapiens
ttctgagtctcctgtcgacagt

SEQ ID NO: 7964550 - DNA, 20 bp, Homo sapiens
ttctctttgggtccagagaa

SEQ ID NO: 7964551 - DNA, 20 bp, Homo sapiens
ttctctttgggtccagagaa

SEQ ID NO: 7964552 - DNA, 22 bp, Homo sapiens
ttctgagctgcaacactaacat

SEQ ID NO: 7964553 - DNA, 22 bp, Homo sapiens
ttctcttttagaggctccatga

SEQ ID NO: 7964554 - DNA, 22 bp, Homo sapiens
ttctgagctgcaacactaacat

SEQ ID NO: 7964555 - DNA, 22 bp, Homo sapiens
ttctcttttagaggctccatga

SEQ ID NO: 7964556 - DNA, 22 bp, Homo sapiens
ttctgaggccattaccaataaa

SEQ ID NO: 7964557 - DNA, 22 bp, Homo sapiens
ttctgaggcatagaggatgaga

SEQ ID NO: 7964558 - DNA, 22 bp, Homo sapiens
ttctgaggcatagaggatgaga

SEQ ID NO: 7964559 - DNA, 22 bp, Homo sapiens
ttctgaggcactggctctccca

SEQ ID NO: 7964560 - DNA, 22 bp, Homo sapiens
ttctgaggcactggctctccca

SEQ ID NO: 7964561 - DNA, 22 bp, Homo sapiens
ttctgaggaggagcaaaaactc

SEQ ID NO: 7964562 - DNA, 22 bp, Homo sapiens
ttctctttatgtatttagtggg

SEQ ID NO: 7964563 - DNA, 22 bp, Homo sapiens
ttctctttatgtatttagtggg

SEQ ID NO: 7964564 - DNA, 22 bp, Homo sapiens
ttctctttatgtatttagtggg

SEQ ID NO: 7964565 - DNA, 23 bp, Homo sapiens
ttctctttagatttacattactc

SEQ ID NO: 7964566 - DNA, 22 bp, Homo sapiens
ttctctttctacagtgtgattg

SEQ ID NO: 7964567 - DNA, 22 bp, Homo sapiens
ttctctttctacagtgtgattg

SEQ ID NO: 7964568 - DNA, 22 bp, Homo sapiens
ttctctttatgtatttagtggg

SEQ ID NO: 7964569 - DNA, 22 bp, Homo sapiens
ttctctttgacattattcaggt

SEQ ID NO: 7964570 - DNA, 22 bp, Homo sapiens
ttctctttgacattattcaggt

SEQ ID NO: 7964571 - DNA, 22 bp, Homo sapiens
ttctctttctgctgggctggaa

SEQ ID NO: 7964572 - DNA, 22 bp, Homo sapiens
ttctgcattcaaattatgtgag

SEQ ID NO: 7964573 - DNA, 22 bp, Homo sapiens
ttctgcattatacacaacctaa

SEQ ID NO: 7964574 - DNA, 22 bp, Homo sapiens
ttctgcattatacacaacctaa

SEQ ID NO: 7964575 - DNA, 22 bp, Homo sapiens
ttctgcagcatgaggctggagc

SEQ ID NO: 7964576 - DNA, 22 bp, Homo sapiens
ttctgcagcatgaggctggagc

SEQ ID NO: 7964577 - DNA, 22 bp, Homo sapiens
ttctgcagatcaacttgactgc

SEQ ID NO: 7964578 - DNA, 22 bp, Homo sapiens
ttctgcagcatgaggctggagc

SEQ ID NO: 7964579 - DNA, 22 bp, Homo sapiens
ttctgcagcatgaggctggagc

SEQ ID NO: 7964580 - DNA, 22 bp, Homo sapiens
ttctgcagatcaacttgactgc

SEQ ID NO: 7964581 - DNA, 22 bp, Homo sapiens
ttctgcagcatgaggctggagc

SEQ ID NO: 7964582 - DNA, 22 bp, Homo sapiens
ttctgcagatcaacttgactgc

SEQ ID NO: 7964583 - DNA, 22 bp, Homo sapiens
ttctgcaccgttacagcaagag

SEQ ID NO: 7964584 - DNA, 22 bp, Homo sapiens
ttctgcaccgttacagcaagag

SEQ ID NO: 7964585 - DNA, 22 bp, Homo sapiens
ttctgcacattttagcaaagta

SEQ ID NO: 7964586 - DNA, 22 bp, Homo sapiens
ttctgcacattttagcaaagta

SEQ ID NO: 7964587 - DNA, 22 bp, Homo sapiens
ttctgcacattttagcaaagta

SEQ ID NO: 7964588 - DNA, 22 bp, Homo sapiens
ttctgcaccaagcatagtgctg

SEQ ID NO: 7964589 - DNA, 22 bp, Homo sapiens
ttctgcaccaagcatagtgctg

SEQ ID NO: 7964590 - DNA, 22 bp, Homo sapiens
ttctgcacagtcactcctggct

SEQ ID NO: 7964591 - DNA, 22 bp, Homo sapiens
ttctgcacagtcactcctggct

SEQ ID NO: 7964592 - DNA, 22 bp, Homo sapiens
ttctgcacaaattttaggttat

SEQ ID NO: 7964593 - DNA, 22 bp, Homo sapiens
ttctgcacaaattttaggttat

SEQ ID NO: 7964594 - DNA, 22 bp, Homo sapiens
ttctgcacagctggtgttggca

SEQ ID NO: 7964595 - DNA, 22 bp, Homo sapiens
ttctgcacagctggtgttggca

SEQ ID NO: 7964596 - DNA, 22 bp, Homo sapiens
ttctgccacgagcagtttcttc

SEQ ID NO: 7964597 - DNA, 22 bp, Homo sapiens
ttctgcatttctaataagttcc

SEQ ID NO: 7964598 - DNA, 22 bp, Homo sapiens
ttctgccaaaggctttgttttg

SEQ ID NO: 7964599 - DNA, 22 bp, Homo sapiens
ttctgccagggaattctgctta

SEQ ID NO: 7964600 - DNA, 22 bp, Homo sapiens
ttctgcattggagtctattctt

SEQ ID NO: 7964601 - DNA, 22 bp, Homo sapiens
ttctgcatttaaaatattacta

SEQ ID NO: 7964602 - DNA, 20 bp, Homo sapiens
ttctggaggctacaagtctg

SEQ ID NO: 7964603 - DNA, 20 bp, Homo sapiens
ttctggaggctacaagtctg

SEQ ID NO: 7964604 - DNA, 20 bp, Homo sapiens
ttctggaggctacaagtctg

SEQ ID NO: 7964605 - DNA, 22 bp, Homo sapiens
ttctggaggcgggcgacctcgc

SEQ ID NO: 7964606 - DNA, 22 bp, Homo sapiens
ttctggaggcgggcgacctcgc

SEQ ID NO: 7964607 - DNA, 22 bp, Homo sapiens
ttctggaggctccagggaagaa

SEQ ID NO: 7964608 - DNA, 22 bp, Homo sapiens
ttctggaggctccagggaagaa

SEQ ID NO: 7964609 - DNA, 20 bp, Homo sapiens
ttctggaggctacaagtctg

SEQ ID NO: 7964610 - DNA, 20 bp, Homo sapiens
ttctggaggctacaagtctg

SEQ ID NO: 7964611 - DNA, 22 bp, Homo sapiens
ttctggaggagaaagggtgggc

SEQ ID NO: 7964612 - DNA, 22 bp, Homo sapiens
ttctggaggagaaagggtgggc

SEQ ID NO: 7964613 - DNA, 22 bp, Homo sapiens
ttctggaggagaaagggtgggc

SEQ ID NO: 7964614 - DNA, 22 bp, Homo sapiens
ttctggaggccagctgccacct

SEQ ID NO: 7964615 - DNA, 22 bp, Homo sapiens
ttctggaggccccttccttctc

SEQ ID NO: 7964616 - DNA, 22 bp, Homo sapiens
ttctggaggacaactgttttca

SEQ ID NO: 7964617 - DNA, 22 bp, Homo sapiens
ttctggagcttggcttgtatgt

SEQ ID NO: 7964618 - DNA, 22 bp, Homo sapiens
ttctgcctgatgtagtcatacc

SEQ ID NO: 7964619 - DNA, 22 bp, Homo sapiens
ttctgcctgatgtagtcatacc

SEQ ID NO: 7964620 - DNA, 20 bp, Homo sapiens
ttctgcctagggttagcctg

SEQ ID NO: 7964621 - DNA, 22 bp, Homo sapiens
ttctgcccttgccagacaagta

SEQ ID NO: 7964622 - DNA, 22 bp, Homo sapiens
ttctgcccttgccagacaagta

SEQ ID NO: 7964623 - DNA, 22 bp, Homo sapiens
ttctccatttaacttccttatg

SEQ ID NO: 7964624 - DNA, 22 bp, Homo sapiens
ttctccatttaacttccttatg

SEQ ID NO: 7964625 - DNA, 22 bp, Homo sapiens
ttctccatttaacttccttatg

SEQ ID NO: 7964626 - DNA, 22 bp, Homo sapiens
ttctccagtttctcccttcagt

SEQ ID NO: 7964627 - DNA, 22 bp, Homo sapiens
ttctccagttatattatgttaa

SEQ ID NO: 7964628 - DNA, 22 bp, Homo sapiens
ttctccagttatattatgttaa

SEQ ID NO: 7964629 - DNA, 22 bp, Homo sapiens
ttctccagttatattatgttaa

SEQ ID NO: 7964630 - DNA, 22 bp, Homo sapiens
ttctccagtttctcccttcagt

SEQ ID NO: 7964631 - DNA, 22 bp, Homo sapiens
ttctccagtttctcccttcagt

SEQ ID NO: 7964632 - DNA, 20 bp, Homo sapiens
ttctccagtgcggtagccat

SEQ ID NO: 7964633 - DNA, 20 bp, Homo sapiens
ttctccagtgcggtagccat

SEQ ID NO: 7964634 - DNA, 22 bp, Homo sapiens
ttctccagttatattatgttaa

SEQ ID NO: 7964635 - DNA, 21 bp, Homo sapiens
ttctccagggggagctctctc

SEQ ID NO: 7964636 - DNA, 22 bp, Homo sapiens
ttctccagtcactgacttcgag

SEQ ID NO: 7964637 - DNA, 22 bp, Homo sapiens
ttctccagtcactgacttcgag

SEQ ID NO: 7964638 - DNA, 21 bp, Homo sapiens
ttctccagggggagctctctc

SEQ ID NO: 7964639 - DNA, 21 bp, Homo sapiens
ttctccagggggagctctctc

SEQ ID NO: 7964640 - DNA, 21 bp, Homo sapiens
ttctccagggggagctctctc

SEQ ID NO: 7964641 - DNA, 21 bp, Homo sapiens
ttctccagggggagctctctc

SEQ ID NO: 7964642 - DNA, 22 bp, Homo sapiens
ttctcccatctcagtcttacat

SEQ ID NO: 7964643 - DNA, 22 bp, Homo sapiens
ttctcccagaccaaaggcagca

SEQ ID NO: 7964644 - DNA, 22 bp, Homo sapiens
ttctcccactccgtgcttcagt

SEQ ID NO: 7964645 - DNA, 22 bp, Homo sapiens
ttctcccactccgtgcttcagt

SEQ ID NO: 7964646 - DNA, 21 bp, Homo sapiens
ttctccccagcgaatcctcgg

SEQ ID NO: 7964647 - DNA, 21 bp, Homo sapiens
ttctccccagcgaatcctcgg

SEQ ID NO: 7964648 - DNA, 22 bp, Homo sapiens
ttctccccaactccatcaacac

SEQ ID NO: 7964649 - DNA, 22 bp, Homo sapiens
ttctccccaactccatcaacac

SEQ ID NO: 7964650 - DNA, 22 bp, Homo sapiens
ttctccctgccaaagctgcctc

SEQ ID NO: 7964651 - DNA, 22 bp, Homo sapiens
ttctcccctttagggcctacgg

SEQ ID NO: 7964652 - DNA, 22 bp, Homo sapiens
ttctcccctgaccctgatgagg

SEQ ID NO: 7964653 - DNA, 22 bp, Homo sapiens
ttctcccctctgaaatggggct

SEQ ID NO: 7964654 - DNA, 22 bp, Homo sapiens
ttctccccgtctctctgaggcc

SEQ ID NO: 7964655 - DNA, 22 bp, Homo sapiens
ttctccctggtatttacttagt

SEQ ID NO: 7964656 - DNA, 22 bp, Homo sapiens
ttctccctgccaaagctgcctc

SEQ ID NO: 7964657 - DNA, 22 bp, Homo sapiens
ttctccctgtcctatcaagact

SEQ ID NO: 7964658 - DNA, 22 bp, Homo sapiens
ttctccctgtcctatcaagact

SEQ ID NO: 7964659 - DNA, 22 bp, Homo sapiens
ttctccctgtcctatcaagact

SEQ ID NO: 7964660 - DNA, 22 bp, Homo sapiens
ttctccgctaagttctctgcag

SEQ ID NO: 7964661 - DNA, 22 bp, Homo sapiens
ttctccgctaagttctctgcag

SEQ ID NO: 7964662 - DNA, 22 bp, Homo sapiens
ttctccgctaagttctctgcag

SEQ ID NO: 7964663 - DNA, 22 bp, Homo sapiens
ttctcctaggatcaggggtcct

SEQ ID NO: 7964664 - DNA, 22 bp, Homo sapiens
ttctcctacttaaggccttcca

SEQ ID NO: 7964665 - DNA, 22 bp, Homo sapiens
ttctcctaggatcaggggtcct

SEQ ID NO: 7964666 - DNA, 22 bp, Homo sapiens
ttctcctcagcaaggcagcttt

SEQ ID NO: 7964667 - DNA, 21 bp, Homo sapiens
ttctcctaggctgaggcggga

SEQ ID NO: 7964668 - DNA, 21 bp, Homo sapiens
ttctcctccaagttgctcctg

SEQ ID NO: 7964669 - DNA, 22 bp, Homo sapiens
ttctcctcagcaaggcagcttt

SEQ ID NO: 7964670 - DNA, 17 bp, Homo sapiens
ttctcctctgtgtcctt

SEQ ID NO: 7964671 - DNA, 17 bp, Homo sapiens
ttctcctctgtgtcctt

SEQ ID NO: 7964672 - DNA, 22 bp, Homo sapiens
ttctcctctacatagactgtgc

SEQ ID NO: 7964673 - DNA, 21 bp, Homo sapiens
ttctcctccaagttgctcctg

SEQ ID NO: 7964674 - DNA, 22 bp, Homo sapiens
ttctcctcagcaaggcagcttt

SEQ ID NO: 7964675 - DNA, 21 bp, Homo sapiens
ttctcctccaagttgctcctg

SEQ ID NO: 7964676 - DNA, 22 bp, Homo sapiens
ttctcctctacatagactgtgc

SEQ ID NO: 7964677 - DNA, 21 bp, Homo sapiens
ttctcctccaagttgctcctg

SEQ ID NO: 7964678 - DNA, 18 bp, Homo sapiens
ttctctggtggatgttat

SEQ ID NO: 7964679 - DNA, 22 bp, Homo sapiens
ttctcctctgttggccttccct

SEQ ID NO: 7964680 - DNA, 22 bp, Homo sapiens
ttctcctctgttaccttgcaaa

SEQ ID NO: 7964681 - DNA, 22 bp, Homo sapiens
ttctcctctgttaccttgcaaa

SEQ ID NO: 7964682 - DNA, 22 bp, Homo sapiens
ttctcttcccactttctgtatt

SEQ ID NO: 7964683 - DNA, 22 bp, Homo sapiens
ttctcttcccactttctgtatt

SEQ ID NO: 7964684 - DNA, 22 bp, Homo sapiens
ttctcttcccactttctgtatt

SEQ ID NO: 7964685 - DNA, 17 bp, Homo sapiens
ttctcttcctggatagt

SEQ ID NO: 7964686 - DNA, 17 bp, Homo sapiens
ttctcttcctggatagt

SEQ ID NO: 7964687 - DNA, 22 bp, Homo sapiens
ttctcttcccactttctgtatt

SEQ ID NO: 7964688 - DNA, 22 bp, Homo sapiens
ttctcttcatctcagtaaatgt

SEQ ID NO: 7964689 - DNA, 22 bp, Homo sapiens
ttctcttcacagggatcatcct

SEQ ID NO: 7964690 - DNA, 22 bp, Homo sapiens
ttctcttcccactttctgtatt

SEQ ID NO: 7964691 - DNA, 22 bp, Homo sapiens
ttctcttccagccgggcttgca

SEQ ID NO: 7964692 - DNA, 22 bp, Homo sapiens
ttctcttcatctcagtaaatgt

SEQ ID NO: 7964693 - DNA, 22 bp, Homo sapiens
ttctcttccagccgggcttgca

SEQ ID NO: 7964694 - DNA, 23 bp, Homo sapiens
ttctctttagatttacattactc

SEQ ID NO: 7964695 - DNA, 23 bp, Homo sapiens
ttctctttagatttacattactc

SEQ ID NO: 7964696 - DNA, 22 bp, Homo sapiens
ttctcttgagctggtcatgttt

SEQ ID NO: 7964697 - DNA, 22 bp, Homo sapiens
ttctcttgtgccaagttgttgc

SEQ ID NO: 7964698 - DNA, 17 bp, Homo sapiens
ttctcttcctggatagt

SEQ ID NO: 7964699 - DNA, 17 bp, Homo sapiens
ttctcttcctggatagt

SEQ ID NO: 7964700 - DNA, 22 bp, Homo sapiens
ttctcttctgttcagtgcccaa

SEQ ID NO: 7964701 - DNA, 22 bp, Homo sapiens
ttctcttctgttcagtgcccaa

SEQ ID NO: 7964702 - DNA, 22 bp, Homo sapiens
ttctcttctgttcagtgcccaa

SEQ ID NO: 7964703 - DNA, 22 bp, Homo sapiens
ttctcttcacagggatcatcct

SEQ ID NO: 7964704 - DNA, 22 bp, Homo sapiens
ttctcttattctggatatgcag

SEQ ID NO: 7964705 - DNA, 22 bp, Homo sapiens
ttctcttatctggcattattgg

SEQ ID NO: 7964706 - DNA, 22 bp, Homo sapiens
ttctcttacattttctcagcct

SEQ ID NO: 7964707 - DNA, 22 bp, Homo sapiens
ttctcttagcactttgtgttac

SEQ ID NO: 7964708 - DNA, 22 bp, Homo sapiens
ttctctgttttcccctcgatgt

SEQ ID NO: 7964709 - DNA, 22 bp, Homo sapiens
ttctctgttttcccctcgatgt

SEQ ID NO: 7964710 - DNA, 22 bp, Homo sapiens
ttctcttagctgtaaagtcaat

SEQ ID NO: 7964711 - DNA, 22 bp, Homo sapiens
ttctcttagctgtaaagtcaat

SEQ ID NO: 7964712 - DNA, 19 bp, Homo sapiens
ttctctgtgctagactctg

SEQ ID NO: 7964713 - DNA, 19 bp, Homo sapiens
ttctctgtgctagactctg

SEQ ID NO: 7964714 - DNA, 22 bp, Homo sapiens
ttctctggtttgctgtttctga

SEQ ID NO: 7964715 - DNA, 22 bp, Homo sapiens
ttctctggtttgctgtttctga

SEQ ID NO: 7964716 - DNA, 22 bp, Homo sapiens
ttctctggtttgctgtttctga

SEQ ID NO: 7964717 - DNA, 22 bp, Homo sapiens
ttctctgtagttgcctggtgga

SEQ ID NO: 7964718 - DNA, 22 bp, Homo sapiens
ttctctgtgagggtgctggatt

SEQ ID NO: 7964719 - DNA, 22 bp, Homo sapiens
ttctctgtgagggtgctggatt

SEQ ID NO: 7964720 - DNA, 22 bp, Homo sapiens
ttctctgtagttgcctggtgga

SEQ ID NO: 7964721 - DNA, 22 bp, Homo sapiens
ttctctgtagttgcctggtgga

SEQ ID NO: 7964722 - DNA, 22 bp, Homo sapiens
ttatgcatgagataaaaattgg

SEQ ID NO: 7964723 - DNA, 20 bp, Homo sapiens
ttatgcaggtcatctcaact

SEQ ID NO: 7964724 - DNA, 22 bp, Homo sapiens
ttatgctagttgaaataacaca

SEQ ID NO: 7964725 - DNA, 22 bp, Homo sapiens
ttatgctagtatagtccttaga

SEQ ID NO: 7964726 - DNA, 22 bp, Homo sapiens
ttatgctaagtggaataagcca

SEQ ID NO: 7964727 - DNA, 22 bp, Homo sapiens
ttatgctaagtgcaacaagcca

SEQ ID NO: 7964728 - DNA, 22 bp, Homo sapiens
ttatgctaagtgaaataagcca

SEQ ID NO: 7964729 - DNA, 22 bp, Homo sapiens
ttatgctaacctcatcttctcc

SEQ ID NO: 7964730 - DNA, 22 bp, Homo sapiens
ttatgctaacctcatcttctcc

SEQ ID NO: 7964731 - DNA, 22 bp, Homo sapiens
ttatgctaagtgaaataagcca

SEQ ID NO: 7964732 - DNA, 22 bp, Homo sapiens
ttatgctaaatgaatcaagtca

SEQ ID NO: 7964733 - DNA, 22 bp, Homo sapiens
ttatgcaggtacatgctgaaaa

SEQ ID NO: 7964734 - DNA, 22 bp, Homo sapiens
ttatggaagtgcaaattgtgtg

SEQ ID NO: 7964735 - DNA, 22 bp, Homo sapiens
ttatggaagtgcaaattgtgtg

SEQ ID NO: 7964736 - DNA, 22 bp, Homo sapiens
ttatggaataacctttctgaaa

SEQ ID NO: 7964737 - DNA, 22 bp, Homo sapiens
ttatggaaatgaaattttattg

SEQ ID NO: 7964738 - DNA, 22 bp, Homo sapiens
ttatggaaaatacaattataag

SEQ ID NO: 7964739 - DNA, 22 bp, Homo sapiens
ttatggaaaatacaattataag

SEQ ID NO: 7964740 - DNA, 23 bp, Homo sapiens
ttatgctttggcactcttgttag

SEQ ID NO: 7964741 - DNA, 22 bp, Homo sapiens
ttatgcttttagaatttagcat

SEQ ID NO: 7964742 - DNA, 22 bp, Homo sapiens
ttatggaaaactccagagagta

SEQ ID NO: 7964743 - DNA, 22 bp, Homo sapiens
ttatggaaaactccagagagta

SEQ ID NO: 7964744 - DNA, 22 bp, Homo sapiens
ttatgcttgcagatttaagggt

SEQ ID NO: 7964745 - DNA, 22 bp, Homo sapiens
ttatgctagttgaaataacaca

SEQ ID NO: 7964746 - DNA, 22 bp, Homo sapiens
ttatgctaagtggaataagcca

SEQ ID NO: 7964747 - DNA, 22 bp, Homo sapiens
ttatgctagttgaaataacaca

SEQ ID NO: 7964748 - DNA, 22 bp, Homo sapiens
ttatgctgttaggaaaatcaaa

SEQ ID NO: 7964749 - DNA, 20 bp, Homo sapiens
ttatgtgtacctgtgctccc

SEQ ID NO: 7964750 - DNA, 22 bp, Homo sapiens
ttatgtgtacctcaatctgagg

SEQ ID NO: 7964751 - DNA, 22 bp, Homo sapiens
ttatgtgcttcaactgagccta

SEQ ID NO: 7964752 - DNA, 22 bp, Homo sapiens
ttatgtcttaagtatgctaatt

SEQ ID NO: 7964753 - DNA, 22 bp, Homo sapiens
ttatgtgccactttttgaagat

SEQ ID NO: 7964754 - DNA, 22 bp, Homo sapiens
ttatgtgtataattacaggaag

SEQ ID NO: 7964755 - DNA, 22 bp, Homo sapiens
ttatgttatgaatggatgatct

SEQ ID NO: 7964756 - DNA, 22 bp, Homo sapiens
ttatgtgtgtacatgcatatgt

SEQ ID NO: 7964757 - DNA, 22 bp, Homo sapiens
ttatgtgtgtgtatacatacaa

SEQ ID NO: 7964758 - DNA, 22 bp, Homo sapiens
ttatgtgtgtgtatacatacaa

SEQ ID NO: 7964759 - DNA, 21 bp, Homo sapiens
ttatggagaaggaaagtaagg

SEQ ID NO: 7964760 - DNA, 22 bp, Homo sapiens
ttatggaatttgcaaaaggtta

SEQ ID NO: 7964761 - DNA, 22 bp, Homo sapiens
ttatggaatggagaaagtctgc

SEQ ID NO: 7964762 - DNA, 22 bp, Homo sapiens
ttatggaatttgcaaaaggtta

SEQ ID NO: 7964763 - DNA, 22 bp, Homo sapiens
ttatggaatacttatgctgcag

SEQ ID NO: 7964764 - DNA, 22 bp, Homo sapiens
ttatggaatggagaaagtctgc

SEQ ID NO: 7964765 - DNA, 22 bp, Homo sapiens
ttatggaatggagaaagtctgc

SEQ ID NO: 7964766 - DNA, 22 bp, Homo sapiens
ttatggagactttcagaagcgg

SEQ ID NO: 7964767 - DNA, 22 bp, Homo sapiens
ttatggagcagacagctggtca

SEQ ID NO: 7964768 - DNA, 22 bp, Homo sapiens
ttatggagcagacagctggtca

SEQ ID NO: 7964769 - DNA, 23 bp, Homo sapiens
ttatggagtgccagacatttggc

SEQ ID NO: 7964770 - DNA, 22 bp, Homo sapiens
ttatggagtgcttacctgccag

SEQ ID NO: 7964771 - DNA, 22 bp, Homo sapiens
ttatggatacaaagctagctaa

SEQ ID NO: 7964772 - DNA, 22 bp, Homo sapiens
ttatgtctcaaccgggcacggt

SEQ ID NO: 7964773 - DNA, 22 bp, Homo sapiens
ttatgtctgtgaattggcaagc

SEQ ID NO: 7964774 - DNA, 22 bp, Homo sapiens
ttatgtctgtgaattggcaagc

SEQ ID NO: 7964775 - DNA, 22 bp, Homo sapiens
ttatacactgcagaaccagcat

SEQ ID NO: 7964776 - DNA, 22 bp, Homo sapiens
ttatacacgtttatggagctac

SEQ ID NO: 7964777 - DNA, 22 bp, Homo sapiens
ttatacaccatcactgccttgg

SEQ ID NO: 7964778 - DNA, 22 bp, Homo sapiens
ttatacaccatcactgccttgg

SEQ ID NO: 7964779 - DNA, 22 bp, Homo sapiens
ttatacagcattgctagtgatg

SEQ ID NO: 7964780 - DNA, 22 bp, Homo sapiens
ttatacagcattgctagtgatg

SEQ ID NO: 7964781 - DNA, 22 bp, Homo sapiens
ttatacagcattgctagtgatg

SEQ ID NO: 7964782 - DNA, 22 bp, Homo sapiens
ttatacagcattgctagtgatg

SEQ ID NO: 7964783 - DNA, 22 bp, Homo sapiens
ttatacacaattcttttactac

SEQ ID NO: 7964784 - DNA, 22 bp, Homo sapiens
ttatacacaattcttttactac

SEQ ID NO: 7964785 - DNA, 22 bp, Homo sapiens
ttatacacaattcttttactac

SEQ ID NO: 7964786 - DNA, 22 bp, Homo sapiens
ttatacacaattcttttactac

SEQ ID NO: 7964787 - DNA, 22 bp, Homo sapiens
ttataattctggcataggctgt

SEQ ID NO: 7964788 - DNA, 22 bp, Homo sapiens
ttataattctggcataggctgt

SEQ ID NO: 7964789 - DNA, 22 bp, Homo sapiens
ttatacaggagattccttactt

SEQ ID NO: 7964790 - DNA, 22 bp, Homo sapiens
ttatacagcattgctagtgatg

SEQ ID NO: 7964791 - DNA, 22 bp, Homo sapiens
ttatacagtttatacttagaat

SEQ ID NO: 7964792 - DNA, 22 bp, Homo sapiens
ttatacagggagtttccctgca

SEQ ID NO: 7964793 - DNA, 22 bp, Homo sapiens
ttatacagtttatacttagaat

SEQ ID NO: 7964794 - DNA, 20 bp, Homo sapiens
ttatgcaagcatcaatattg

SEQ ID NO: 7964795 - DNA, 23 bp, Homo sapiens
ttatgcaagcttcctggtctcag

SEQ ID NO: 7964796 - DNA, 22 bp, Homo sapiens
ttatgcaaggacttattacagt

SEQ ID NO: 7964797 - DNA, 22 bp, Homo sapiens
ttatgcaaggacttattacagt

SEQ ID NO: 7964798 - DNA, 22 bp, Homo sapiens
ttatgcagaggcatgctcactc

SEQ ID NO: 7964799 - DNA, 22 bp, Homo sapiens
ttagttcatagaatgtaacagg

SEQ ID NO: 7964800 - DNA, 22 bp, Homo sapiens
ttagttcactgctatatcatca

SEQ ID NO: 7964801 - DNA, 22 bp, Homo sapiens
ttagttagagccctatgttagg

SEQ ID NO: 7964802 - DNA, 22 bp, Homo sapiens
ttagttctcatgaattttaagt

SEQ ID NO: 7964803 - DNA, 22 bp, Homo sapiens
ttataattctggcataggctgt

SEQ ID NO: 7964804 - DNA, 22 bp, Homo sapiens
ttataattctggcataggctgt

SEQ ID NO: 7964805 - DNA, 22 bp, Homo sapiens
ttataagagtatatagtgtact

SEQ ID NO: 7964806 - DNA, 22 bp, Homo sapiens
ttataaggtgccctgtgtccag

SEQ ID NO: 7964807 - DNA, 22 bp, Homo sapiens
ttataactttggatatgacaag

SEQ ID NO: 7964808 - DNA, 22 bp, Homo sapiens
ttagtttataattcatttctgt

SEQ ID NO: 7964809 - DNA, 17 bp, Homo sapiens
ttagtgtatctgttttg

SEQ ID NO: 7964810 - DNA, 22 bp, Homo sapiens
ttagtgtacttagtgctctaag

SEQ ID NO: 7964811 - DNA, 23 bp, Homo sapiens
ttagtgtaaggcaggcacagttg

SEQ ID NO: 7964812 - DNA, 22 bp, Homo sapiens
ttagtgtaaattgtgcttgaga

SEQ ID NO: 7964813 - DNA, 17 bp, Homo sapiens
ttagtgtatctgttttg

SEQ ID NO: 7964814 - DNA, 18 bp, Homo sapiens
ttagtgtaataccattgc

SEQ ID NO: 7964815 - DNA, 22 bp, Homo sapiens
ttagtgtattttcaaatgtaga

SEQ ID NO: 7964816 - DNA, 22 bp, Homo sapiens
ttagtgtattttcaaatgtaga

SEQ ID NO: 7964817 - DNA, 22 bp, Homo sapiens
ttagtgcttgttttaaaaatat

SEQ ID NO: 7964818 - DNA, 22 bp, Homo sapiens
ttagtgcttctgtccaaatata

SEQ ID NO: 7964819 - DNA, 22 bp, Homo sapiens
ttagtgctcatccagatggggg

SEQ ID NO: 7964820 - DNA, 22 bp, Homo sapiens
ttagtggtactcagggagggaa

SEQ ID NO: 7964821 - DNA, 22 bp, Homo sapiens
ttagtggggatgtatgggaggc

SEQ ID NO: 7964822 - DNA, 22 bp, Homo sapiens
ttagtggggatgtatgggaggc

SEQ ID NO: 7964823 - DNA, 22 bp, Homo sapiens
ttagtgggatattggctattca

SEQ ID NO: 7964824 - DNA, 22 bp, Homo sapiens
ttagtggtaaggatgaaatttc

SEQ ID NO: 7964825 - DNA, 22 bp, Homo sapiens
ttagtgggatattggctattca

SEQ ID NO: 7964826 - DNA, 22 bp, Homo sapiens
ttagtggggatgtatgggaggc

SEQ ID NO: 7964827 - DNA, 22 bp, Homo sapiens
ttagtgttagggcctgttacct

SEQ ID NO: 7964828 - DNA, 22 bp, Homo sapiens
ttagtgtttaaaggtttcagag

SEQ ID NO: 7964829 - DNA, 22 bp, Homo sapiens
ttagtgtttaaaggtttcagag

SEQ ID NO: 7964830 - DNA, 22 bp, Homo sapiens
ttagttaattgactatgttgca

SEQ ID NO: 7964831 - DNA, 22 bp, Homo sapiens
ttagtgtctggctatatttaaa

SEQ ID NO: 7964832 - DNA, 22 bp, Homo sapiens
ttagtgtctttcaaaaggttta

SEQ ID NO: 7964833 - DNA, 22 bp, Homo sapiens
ttagtgtctggctatatttaaa

SEQ ID NO: 7964834 - DNA, 22 bp, Homo sapiens
ttagtgtgtccagttctgaaaa

SEQ ID NO: 7964835 - DNA, 22 bp, Homo sapiens
ttagtgtgcatggatctgtgga

SEQ ID NO: 7964836 - DNA, 22 bp, Homo sapiens
ttagtgtgtccagttctgaaaa

SEQ ID NO: 7964837 - DNA, 22 bp, Homo sapiens
tcctctgctccatctttactgt

SEQ ID NO: 7964838 - DNA, 21 bp, Homo sapiens
tcctctgctctcataccacaa

SEQ ID NO: 7964839 - DNA, 22 bp, Homo sapiens
tcctctgctccatctttactgt

SEQ ID NO: 7964840 - DNA, 22 bp, Homo sapiens
tcctctgctgttctggttcttt

SEQ ID NO: 7964841 - DNA, 21 bp, Homo sapiens
tcctctgctctcataccacaa

SEQ ID NO: 7964842 - DNA, 22 bp, Homo sapiens
tcctctggatataagcctcacc

SEQ ID NO: 7964843 - DNA, 22 bp, Homo sapiens
tcctctggatataagcctcacc

SEQ ID NO: 7964844 - DNA, 22 bp, Homo sapiens
tcctctggatataagcctcacc

SEQ ID NO: 7964845 - DNA, 22 bp, Homo sapiens
tcctctggatataagcctcacc

SEQ ID NO: 7964846 - DNA, 22 bp, Homo sapiens
tcctctggatataagcctcacc

SEQ ID NO: 7964847 - DNA, 22 bp, Homo sapiens
tcctctggatataagcctcacc

SEQ ID NO: 7964848 - DNA, 22 bp, Homo sapiens
tcctctggatataagcctcacc

SEQ ID NO: 7964849 - DNA, 22 bp, Homo sapiens
tcctctggctctttccctagga

SEQ ID NO: 7964850 - DNA, 22 bp, Homo sapiens
tcctctggccttggaatccttt

SEQ ID NO: 7964851 - DNA, 22 bp, Homo sapiens
tcctctggccttggaatccttt

SEQ ID NO: 7964852 - DNA, 22 bp, Homo sapiens
tcctctggctctttccctagga

SEQ ID NO: 7964853 - DNA, 22 bp, Homo sapiens
tcctctggctctttccctagga

SEQ ID NO: 7964854 - DNA, 22 bp, Homo sapiens
tcctctggcccagctgcctctg

SEQ ID NO: 7964855 - DNA, 22 bp, Homo sapiens
tcctctggcccagctgcctctg

SEQ ID NO: 7964856 - DNA, 22 bp, Homo sapiens
tcctctggcccagctgcctctg

SEQ ID NO: 7964857 - DNA, 22 bp, Homo sapiens
tcctctggatataagcctcacc

SEQ ID NO: 7964858 - DNA, 22 bp, Homo sapiens
tcctctggcccagctgcctctg

SEQ ID NO: 7964859 - DNA, 23 bp, Homo sapiens
tcctccttttgcttgtgcttccc

SEQ ID NO: 7964860 - DNA, 23 bp, Homo sapiens
tcctccttttgcttgtgcttccc

SEQ ID NO: 7964861 - DNA, 22 bp, Homo sapiens
tcctcctttccccgctggagcc

SEQ ID NO: 7964862 - DNA, 22 bp, Homo sapiens
tcctccttgttttgtctctgct

SEQ ID NO: 7964863 - DNA, 22 bp, Homo sapiens
tcctccttgttttcctgtttac

SEQ ID NO: 7964864 - DNA, 22 bp, Homo sapiens
tcctccttgttttgtctctgct

SEQ ID NO: 7964865 - DNA, 20 bp, Homo sapiens
tcctctaattttaagctgta

SEQ ID NO: 7964866 - DNA, 21 bp, Homo sapiens
tcctctactgagccatgcaga

SEQ ID NO: 7964867 - DNA, 23 bp, Homo sapiens
tcctcgcaggagggagatgatgc

SEQ ID NO: 7964868 - DNA, 23 bp, Homo sapiens
tcctcgcaggagggagatgatgc

SEQ ID NO: 7964869 - DNA, 22 bp, Homo sapiens
tcctcgatgggcaggaagatct

SEQ ID NO: 7964870 - DNA, 20 bp, Homo sapiens
tcctctaattttaagctgta

SEQ ID NO: 7964871 - DNA, 22 bp, Homo sapiens
tcctctccagcaaactggctat

SEQ ID NO: 7964872 - DNA, 22 bp, Homo sapiens
tcctctccagcaaactggctat

SEQ ID NO: 7964873 - DNA, 22 bp, Homo sapiens
tcctctccagcaaactggctat

SEQ ID NO: 7964874 - DNA, 22 bp, Homo sapiens
tcctctccagcaaactggctat

SEQ ID NO: 7964875 - DNA, 22 bp, Homo sapiens
tcctctccagcaaactggctat

SEQ ID NO: 7964876 - DNA, 22 bp, Homo sapiens
tcctctgccccagatgaaattt

SEQ ID NO: 7964877 - DNA, 22 bp, Homo sapiens
tcctctgccccagatgaaattt

SEQ ID NO: 7964878 - DNA, 22 bp, Homo sapiens
tcctctgctcagcattcctcac

SEQ ID NO: 7964879 - DNA, 22 bp, Homo sapiens
tcctccttgtattctatttcac

SEQ ID NO: 7964880 - DNA, 22 bp, Homo sapiens
tcctccttgttcttttgcctac

SEQ ID NO: 7964881 - DNA, 20 bp, Homo sapiens
tcctccttgcagagcccaga

SEQ ID NO: 7964882 - DNA, 20 bp, Homo sapiens
tcctccttgcagagcccaga

SEQ ID NO: 7964883 - DNA, 21 bp, Homo sapiens
tcctccttcaagtcctggcct

SEQ ID NO: 7964884 - DNA, 22 bp, Homo sapiens
tcctccttcgggactgcttgac

SEQ ID NO: 7964885 - DNA, 22 bp, Homo sapiens
tcctccttcgggactgcttgac

SEQ ID NO: 7964886 - DNA, 19 bp, Homo sapiens
tcctccttacttcctcttg

SEQ ID NO: 7964887 - DNA, 19 bp, Homo sapiens
tcctccttacttcctcttg

SEQ ID NO: 7964888 - DNA, 19 bp, Homo sapiens
tcctccttacttcctcttg

SEQ ID NO: 7964889 - DNA, 22 bp, Homo sapiens
tcctcctgtttctcaggcctgg

SEQ ID NO: 7964890 - DNA, 19 bp, Homo sapiens
tcctccttacttcctcttg

SEQ ID NO: 7964891 - DNA, 19 bp, Homo sapiens
tcctccttacttcctcttg

SEQ ID NO: 7964892 - DNA, 22 bp, Homo sapiens
tcctcctgtttctcaggcctgg

SEQ ID NO: 7964893 - DNA, 21 bp, Homo sapiens
tcctcctggccaggcggcccc

SEQ ID NO: 7964894 - DNA, 21 bp, Homo sapiens
tcctcctgtagagggtcctgg

SEQ ID NO: 7964895 - DNA, 21 bp, Homo sapiens
tcctcctgtagagggtcctgg

SEQ ID NO: 7964896 - DNA, 21 bp, Homo sapiens
tcctcctgtagagggtcctgg

SEQ ID NO: 7964897 - DNA, 21 bp, Homo sapiens
tcctcctggccaggcggcccc

SEQ ID NO: 7964898 - DNA, 21 bp, Homo sapiens
tcctcctgtagagggtcctgg

SEQ ID NO: 7964899 - DNA, 21 bp, Homo sapiens
tcctcctgtagagggtcctgg

SEQ ID NO: 7964900 - DNA, 22 bp, Homo sapiens
tcctcctgtctaccagttcctg

SEQ ID NO: 7964901 - DNA, 22 bp, Homo sapiens
tcctcctgtctaccagttcctg

SEQ ID NO: 7964902 - DNA, 22 bp, Homo sapiens
tcctcctgtctaccagttcctg

SEQ ID NO: 7964903 - DNA, 22 bp, Homo sapiens
tcctcctgtctaccagttcctg

SEQ ID NO: 7964904 - DNA, 22 bp, Homo sapiens
tcctcctgtttctcaggcctgg

SEQ ID NO: 7964905 - DNA, 22 bp, Homo sapiens
tcctcctgtttctcaggcctgg

SEQ ID NO: 7964906 - DNA, 22 bp, Homo sapiens
tcctcctgtttctcaggcctgg

SEQ ID NO: 7964907 - DNA, 22 bp, Homo sapiens
tcctcctgtttctcaggcctgg

SEQ ID NO: 7964908 - DNA, 22 bp, Homo sapiens
ttatttatatctctgcagttta

SEQ ID NO: 7964909 - DNA, 22 bp, Homo sapiens
ttatttatatctctgcagttta

SEQ ID NO: 7964910 - DNA, 22 bp, Homo sapiens
ttatttatatctctgcagttta

SEQ ID NO: 7964911 - DNA, 22 bp, Homo sapiens
ttatttatatctctgcagttta

SEQ ID NO: 7964912 - DNA, 22 bp, Homo sapiens
ttatttatatctctgcagttta

SEQ ID NO: 7964913 - DNA, 22 bp, Homo sapiens
ttatttatggcactgttggtgg

SEQ ID NO: 7964914 - DNA, 22 bp, Homo sapiens
ttatttgtggcatatgagacga

SEQ ID NO: 7964915 - DNA, 22 bp, Homo sapiens
ttatttgtggcatatgagacga

SEQ ID NO: 7964916 - DNA, 22 bp, Homo sapiens
ttatttgtggcatccatgttgg

SEQ ID NO: 7964917 - DNA, 22 bp, Homo sapiens
ttatttgtggcatatgagacga

SEQ ID NO: 7964918 - DNA, 22 bp, Homo sapiens
ttatttgtggcatatgagacga

SEQ ID NO: 7964919 - DNA, 22 bp, Homo sapiens
ttatttgtggcatccatgttgg

SEQ ID NO: 7964920 - DNA, 22 bp, Homo sapiens
ttatttgtggcatccatgttgg

SEQ ID NO: 7964921 - DNA, 20 bp, Homo sapiens
ttatttgtttactttggtcc

SEQ ID NO: 7964922 - DNA, 22 bp, Homo sapiens
ttatttgttttctgagaagtat

SEQ ID NO: 7964923 - DNA, 20 bp, Homo sapiens
ttatttgtttactttggtcc

SEQ ID NO: 7964924 - DNA, 20 bp, Homo sapiens
ttatttgtttactttggtcc

SEQ ID NO: 7964925 - DNA, 18 bp, Homo sapiens
ttatttgttacagcacat

SEQ ID NO: 7964926 - DNA, 18 bp, Homo sapiens
ttatttgttacagcacat

SEQ ID NO: 7964927 - DNA, 18 bp, Homo sapiens
ttatttgttacagcacat

SEQ ID NO: 7964928 - DNA, 22 bp, Homo sapiens
ttatttaattttctcactcaga

SEQ ID NO: 7964929 - DNA, 22 bp, Homo sapiens
ttatttaattttctcactcaga

SEQ ID NO: 7964930 - DNA, 22 bp, Homo sapiens
ttatttaattttctcactcaga

SEQ ID NO: 7964931 - DNA, 22 bp, Homo sapiens
ttatttaatgtgatctgaagag

SEQ ID NO: 7964932 - DNA, 22 bp, Homo sapiens
ttatttaatgtgatctgaagag

SEQ ID NO: 7964933 - DNA, 22 bp, Homo sapiens
ttatttaatgtgatctgaagag

SEQ ID NO: 7964934 - DNA, 22 bp, Homo sapiens
ttatttaatgtgatctgaagag

SEQ ID NO: 7964935 - DNA, 22 bp, Homo sapiens
ttatttaggaggaaactgaggt

SEQ ID NO: 7964936 - DNA, 22 bp, Homo sapiens
ttatttagtctagatgaatttt

SEQ ID NO: 7964937 - DNA, 22 bp, Homo sapiens
ttatttagtctagatgaatttt

SEQ ID NO: 7964938 - DNA, 22 bp, Homo sapiens
ttatttagtctagatgaatttt

SEQ ID NO: 7964939 - DNA, 22 bp, Homo sapiens
ttatttacaactcttctcttcc

SEQ ID NO: 7964940 - DNA, 22 bp, Homo sapiens
ttatttacaactcttctcttcc

SEQ ID NO: 7964941 - DNA, 22 bp, Homo sapiens
ttatttacaactcttctcttcc

SEQ ID NO: 7964942 - DNA, 22 bp, Homo sapiens
ttatttaattttctcactcaga

SEQ ID NO: 7964943 - DNA, 22 bp, Homo sapiens
ttatttaattttctcactcaga

SEQ ID NO: 7964944 - DNA, 22 bp, Homo sapiens
ttatttacaactcttctcttcc

SEQ ID NO: 7964945 - DNA, 22 bp, Homo sapiens
ttatttacaactcttctcttcc

SEQ ID NO: 7964946 - DNA, 22 bp, Homo sapiens
ttatttacaactcttctcttcc

SEQ ID NO: 7964947 - DNA, 22 bp, Homo sapiens
ttatttaatgtgatctgaagag

SEQ ID NO: 7964948 - DNA, 22 bp, Homo sapiens
ttatttaatgtgatctgaagag

SEQ ID NO: 7964949 - DNA, 22 bp, Homo sapiens
ttatttaatgtgatctgaagag

SEQ ID NO: 7964950 - DNA, 22 bp, Homo sapiens
ttatttaaaatgtaggttggga

SEQ ID NO: 7964951 - DNA, 22 bp, Homo sapiens
ttatttaatgtgatctgaagag

SEQ ID NO: 7964952 - DNA, 22 bp, Homo sapiens
ttatttaaaatgtaggttggga

SEQ ID NO: 7964953 - DNA, 22 bp, Homo sapiens
ttatttaaaagtggtaagattc

SEQ ID NO: 7964954 - DNA, 22 bp, Homo sapiens
ttatttaaaagtggtaagattc

SEQ ID NO: 7964955 - DNA, 22 bp, Homo sapiens
ttatttaaaagtggtaagattc

SEQ ID NO: 7964956 - DNA, 22 bp, Homo sapiens
ttatttaaaagtggtaagattc

SEQ ID NO: 7964957 - DNA, 22 bp, Homo sapiens
ttatttaaaagtggtaagattc

SEQ ID NO: 7964958 - DNA, 22 bp, Homo sapiens
ttatttaaaagtggtaagattc

SEQ ID NO: 7964959 - DNA, 22 bp, Homo sapiens
ttatttaaaagtggtaagattc

SEQ ID NO: 7964960 - DNA, 22 bp, Homo sapiens
ttattgtttgggtataatttga

SEQ ID NO: 7964961 - DNA, 22 bp, Homo sapiens
ttattgtttgggtataatttga

SEQ ID NO: 7964962 - DNA, 22 bp, Homo sapiens
ttattgtttgggtataatttga

SEQ ID NO: 7964963 - DNA, 22 bp, Homo sapiens
ttattgtttgggtataatttga

SEQ ID NO: 7964964 - DNA, 22 bp, Homo sapiens
ttattgtttgggtataatttga

SEQ ID NO: 7964965 - DNA, 22 bp, Homo sapiens
ttattgtttgggtataatttga

SEQ ID NO: 7964966 - DNA, 22 bp, Homo sapiens
ttattgtttgggtataatttga

SEQ ID NO: 7964967 - DNA, 22 bp, Homo sapiens
ttattgtttgggtataatttga

SEQ ID NO: 7964968 - DNA, 22 bp, Homo sapiens
ttattgtttactagtttgcaga

SEQ ID NO: 7964969 - DNA, 22 bp, Homo sapiens
ttattgtttactagtttgcaga

SEQ ID NO: 7964970 - DNA, 22 bp, Homo sapiens
ttattgtttactagtttgcaga

SEQ ID NO: 7964971 - DNA, 22 bp, Homo sapiens
ttattgtttgggtataatttga

SEQ ID NO: 7964972 - DNA, 22 bp, Homo sapiens
ttattgtttgggtataatttga

SEQ ID NO: 7964973 - DNA, 22 bp, Homo sapiens
ttattgtttgggtataatttga

SEQ ID NO: 7964974 - DNA, 22 bp, Homo sapiens
ttattgtttgggtataatttga

SEQ ID NO: 7964975 - DNA, 22 bp, Homo sapiens
ttattgtttgggtataatttga

SEQ ID NO: 7964976 - DNA, 22 bp, Homo sapiens
ttattgtttgggtataatttga

SEQ ID NO: 7964977 - DNA, 22 bp, Homo sapiens
ttattgttagtgagactgtaga

SEQ ID NO: 7964978 - DNA, 22 bp, Homo sapiens
ttattgttagtgagactgtaga

SEQ ID NO: 7964979 - DNA, 22 bp, Homo sapiens
ttattaaaatgcggatttggct

SEQ ID NO: 7964980 - DNA, 22 bp, Homo sapiens
ttattaaaatgcggatttggct

SEQ ID NO: 7964981 - DNA, 22 bp, Homo sapiens
ttattaaaatgcggatttggct

SEQ ID NO: 7964982 - DNA, 22 bp, Homo sapiens
ttattgttagtgagactgtaga

SEQ ID NO: 7964983 - DNA, 22 bp, Homo sapiens
ttattgttagtgagactgtaga

SEQ ID NO: 7964984 - DNA, 22 bp, Homo sapiens
ttattgtttaaagccatgtaaa

SEQ ID NO: 7964985 - DNA, 22 bp, Homo sapiens
ttattgttagtgagactgtaga

SEQ ID NO: 7964986 - DNA, 22 bp, Homo sapiens
ttatgttttaagtgtgtatctt

SEQ ID NO: 7964987 - DNA, 22 bp, Homo sapiens
ttatgtttgagtatatgactca

SEQ ID NO: 7964988 - DNA, 22 bp, Homo sapiens
ttatgttttaagtgtgtatctt

SEQ ID NO: 7964989 - DNA, 22 bp, Homo sapiens
ttatgttttaagtgtgtatctt

SEQ ID NO: 7964990 - DNA, 22 bp, Homo sapiens
ttatgttttatggctatatcat

SEQ ID NO: 7964991 - DNA, 22 bp, Homo sapiens
ttatgttttatggctatatcat

SEQ ID NO: 7964992 - DNA, 22 bp, Homo sapiens
ttatgtgtgtgtatacatacaa

SEQ ID NO: 7964993 - DNA, 22 bp, Homo sapiens
ttatgttatgctatttcagata

SEQ ID NO: 7964994 - DNA, 22 bp, Homo sapiens
ttatgttgggaaaagtcagatt

SEQ ID NO: 7964995 - DNA, 22 bp, Homo sapiens
ttatgttgggaaaagtcagatt

SEQ ID NO: 7964996 - DNA, 22 bp, Homo sapiens
ttattttaccttcctctgagct

SEQ ID NO: 7964997 - DNA, 22 bp, Homo sapiens
ttattttaccttcctctgagct

SEQ ID NO: 7964998 - DNA, 22 bp, Homo sapiens
ttattttaccttcctctgagct

SEQ ID NO: 7964999 - DNA, 22 bp, Homo sapiens
ttattttaccttcctctgagct

SEQ ID NO: 7965000 - DNA, 22 bp, Homo sapiens
ttattttaccttcctctgagct

SEQ ID NO: 7965001 - DNA, 22 bp, Homo sapiens
ttattttcagctaggaaagcca

SEQ ID NO: 7965002 - DNA, 22 bp, Homo sapiens
ttattttcagctaggaaagcca

SEQ ID NO: 7965003 - DNA, 22 bp, Homo sapiens
ttattttcagctaggaaagcca

SEQ ID NO: 7965004 - DNA, 22 bp, Homo sapiens
ttattttcagctaggaaagcca

SEQ ID NO: 7965005 - DNA, 22 bp, Homo sapiens
ttattttctcctcagaaagtgg

SEQ ID NO: 7965006 - DNA, 22 bp, Homo sapiens
ttattttctcctcagaaagtgg

SEQ ID NO: 7965007 - DNA, 22 bp, Homo sapiens
ttattttctcctcagaaagtgg

SEQ ID NO: 7965008 - DNA, 22 bp, Homo sapiens
ttattttcagctaggaaagcca

SEQ ID NO: 7965009 - DNA, 22 bp, Homo sapiens
ttattttctcctcagaaagtgg

SEQ ID NO: 7965010 - DNA, 22 bp, Homo sapiens
ttattttgccacaggtgacctt

SEQ ID NO: 7965011 - DNA, 22 bp, Homo sapiens
ttattttgagagaatgtgtgct

SEQ ID NO: 7965012 - DNA, 22 bp, Homo sapiens
ttattttggtaaatgtttgcct

SEQ ID NO: 7965013 - DNA, 22 bp, Homo sapiens
ttattttggtaaatgtttgcct

SEQ ID NO: 7965014 - DNA, 22 bp, Homo sapiens
ttattttgccacaggtgacctt

SEQ ID NO: 7965015 - DNA, 22 bp, Homo sapiens
ttattttgagagaatgtgtgct

SEQ ID NO: 7965016 - DNA, 22 bp, Homo sapiens
ttattttctcctcagaaagtgg

SEQ ID NO: 7965017 - DNA, 22 bp, Homo sapiens
ttattttctcctcagaaagtgg

SEQ ID NO: 7965018 - DNA, 22 bp, Homo sapiens
ttattttgagagaatgtgtgct

SEQ ID NO: 7965019 - DNA, 22 bp, Homo sapiens
ttattttctcctcagaaagtgg

SEQ ID NO: 7965020 - DNA, 22 bp, Homo sapiens
ttattttctcctcagaaagtgg

SEQ ID NO: 7965021 - DNA, 22 bp, Homo sapiens
ttattttgagagaatgtgtgct

SEQ ID NO: 7965022 - DNA, 23 bp, Homo sapiens
ttcaaaactggaaaatcagatgc

SEQ ID NO: 7965023 - DNA, 22 bp, Homo sapiens
ttattttgtagctctgatcttt

SEQ ID NO: 7965024 - DNA, 23 bp, Homo sapiens
ttcaaaactggaaaatcagatgc

SEQ ID NO: 7965025 - DNA, 22 bp, Homo sapiens
ttattttggtaaatgtttgcct

SEQ ID NO: 7965026 - DNA, 23 bp, Homo sapiens
ttcaaaactggaaaatcagatgc

SEQ ID NO: 7965027 - DNA, 23 bp, Homo sapiens
ttcaaaactggaaaatcagatgc

SEQ ID NO: 7965028 - DNA, 22 bp, Homo sapiens
ttcaaaagactcagatgtagcg

SEQ ID NO: 7965029 - DNA, 22 bp, Homo sapiens
ttattttgtagctctgatcttt

SEQ ID NO: 7965030 - DNA, 22 bp, Homo sapiens
ttattttgtagctctgatcttt

SEQ ID NO: 7965031 - DNA, 22 bp, Homo sapiens
ttattttgtagctctgatcttt

SEQ ID NO: 7965032 - DNA, 22 bp, Homo sapiens
ttattttggtaaatgtttgcct

SEQ ID NO: 7965033 - DNA, 22 bp, Homo sapiens
ttattttggtaaatgtttgcct

SEQ ID NO: 7965034 - DNA, 22 bp, Homo sapiens
ttattttggtaaatgtttgcct

SEQ ID NO: 7965035 - DNA, 22 bp, Homo sapiens
ttcaaaagcggtccaggaagat

SEQ ID NO: 7965036 - DNA, 22 bp, Homo sapiens
ttcaaaagcggtccaggaagat

SEQ ID NO: 7965037 - DNA, 21 bp, Homo sapiens
ttcaaaatggtgtgtttgtct

SEQ ID NO: 7965038 - DNA, 22 bp, Homo sapiens
ttcaaaattgttctaagctctg

SEQ ID NO: 7965039 - DNA, 22 bp, Homo sapiens
ttcaaaattgttctaagctctg

SEQ ID NO: 7965040 - DNA, 22 bp, Homo sapiens
ttcaaaattgttctaagctctg

SEQ ID NO: 7965041 - DNA, 22 bp, Homo sapiens
ttcaaaattgttctaagctctg

SEQ ID NO: 7965042 - DNA, 22 bp, Homo sapiens
ttcaaacaaaactctttcctat

SEQ ID NO: 7965043 - DNA, 22 bp, Homo sapiens
ttcaaacaaaactctttcctat

SEQ ID NO: 7965044 - DNA, 22 bp, Homo sapiens
ttcaaacaaaactctttcctat

SEQ ID NO: 7965045 - DNA, 22 bp, Homo sapiens
ttcaaacaactcatttatgcaa

SEQ ID NO: 7965046 - DNA, 22 bp, Homo sapiens
ttcaaacaactcatttatgcaa

SEQ ID NO: 7965047 - DNA, 22 bp, Homo sapiens
ttcaaacaaaactgttcccata

SEQ ID NO: 7965048 - DNA, 22 bp, Homo sapiens
ttcaagaaggtacatttacatc

SEQ ID NO: 7965049 - DNA, 22 bp, Homo sapiens
ttcaagataataggaatgaaaa

SEQ ID NO: 7965050 - DNA, 22 bp, Homo sapiens
ttcaagataataggaatgaaaa

SEQ ID NO: 7965051 - DNA, 17 bp, Homo sapiens
ttcaagatattgaaatg

SEQ ID NO: 7965052 - DNA, 21 bp, Homo sapiens
ttcaagatatttaaaaggtgg

SEQ ID NO: 7965053 - DNA, 22 bp, Homo sapiens
ttcaagatccagcacaacagtg

SEQ ID NO: 7965054 - DNA, 22 bp, Homo sapiens
ttcaagatccagcacaacagtg

SEQ ID NO: 7965055 - DNA, 22 bp, Homo sapiens
ttcaagaggcttaattctggat

SEQ ID NO: 7965056 - DNA, 22 bp, Homo sapiens
ttcaagaggcttaattctggat

SEQ ID NO: 7965057 - DNA, 18 bp, Homo sapiens
ttcaagagtttctctagg

SEQ ID NO: 7965058 - DNA, 18 bp, Homo sapiens
ttcaagagtttctctagg

SEQ ID NO: 7965059 - DNA, 22 bp, Homo sapiens
ttcaagaatcttcctgaccact

SEQ ID NO: 7965060 - DNA, 23 bp, Homo sapiens
ttcaagagccatgctcttcttat

SEQ ID NO: 7965061 - DNA, 22 bp, Homo sapiens
ttcaagactgcgactaatgccc

SEQ ID NO: 7965062 - DNA, 22 bp, Homo sapiens
ttcaagcagagatatttcaaga

SEQ ID NO: 7965063 - DNA, 22 bp, Homo sapiens
ttcaagcagagatatttcaaga

SEQ ID NO: 7965064 - DNA, 22 bp, Homo sapiens
ttcaagcagggattggtgatgg

SEQ ID NO: 7965065 - DNA, 22 bp, Homo sapiens
ttcaagcaccaaattagtaggc

SEQ ID NO: 7965066 - DNA, 22 bp, Homo sapiens
ttcaagatgtcttcacaatagt

SEQ ID NO: 7965067 - DNA, 22 bp, Homo sapiens
ttcaagatgtcttcacaatagt

SEQ ID NO: 7965068 - DNA, 22 bp, Homo sapiens
ttcaaggcagagtgtagttaaa

SEQ ID NO: 7965069 - DNA, 22 bp, Homo sapiens
ttcaaggcagagtgtagttaaa

SEQ ID NO: 7965070 - DNA, 22 bp, Homo sapiens
ttcaagggaaaacacagtgaat

SEQ ID NO: 7965071 - DNA, 22 bp, Homo sapiens
ttcaaggctaaggaagggaagg

SEQ ID NO: 7965072 - DNA, 22 bp, Homo sapiens
ttcaagcagttaagcagtctcc

SEQ ID NO: 7965073 - DNA, 22 bp, Homo sapiens
ttcaagcagttaagcagtctcc

SEQ ID NO: 7965074 - DNA, 22 bp, Homo sapiens
ttcaagatcttccaaaggatac

SEQ ID NO: 7965075 - DNA, 22 bp, Homo sapiens
ttcaagatgacccagtcacacg

SEQ ID NO: 7965076 - DNA, 22 bp, Homo sapiens
ttcaagatgacccagtcacacg

SEQ ID NO: 7965077 - DNA, 21 bp, Homo sapiens
ttcaagatatttaaaaggtgg

SEQ ID NO: 7965078 - DNA, 22 bp, Homo sapiens
ttcaagatcgagtttaaagtga

SEQ ID NO: 7965079 - DNA, 22 bp, Homo sapiens
ttcaagatctgggttttcagct

SEQ ID NO: 7965080 - DNA, 22 bp, Homo sapiens
ttcaagatgcacagtggcattc

SEQ ID NO: 7965081 - DNA, 22 bp, Homo sapiens
ttcaagatgcacagtggcattc

SEQ ID NO: 7965082 - DNA, 22 bp, Homo sapiens
ttcaagatggctgcaaatactt

SEQ ID NO: 7965083 - DNA, 22 bp, Homo sapiens
ttcaagatggctgcaaatactt

SEQ ID NO: 7965084 - DNA, 22 bp, Homo sapiens
ttcagaatgtgaccttatttgg

SEQ ID NO: 7965085 - DNA, 19 bp, Homo sapiens
ttcagaattgggaggtgat

SEQ ID NO: 7965086 - DNA, 19 bp, Homo sapiens
ttcagaattgggaggtgat

SEQ ID NO: 7965087 - DNA, 16 bp, Homo sapiens
ttcagaatttgtagaa

SEQ ID NO: 7965088 - DNA, 16 bp, Homo sapiens
ttcagaatttgtagaa

SEQ ID NO: 7965089 - DNA, 22 bp, Homo sapiens
ttcagaatgtactgatagaaca

SEQ ID NO: 7965090 - DNA, 22 bp, Homo sapiens
ttcagaatgtgaccttatttgg

SEQ ID NO: 7965091 - DNA, 22 bp, Homo sapiens
ttcagaatgtgaccttatttgg

SEQ ID NO: 7965092 - DNA, 22 bp, Homo sapiens
ttcagaatgtgaccttatttgg

SEQ ID NO: 7965093 - DNA, 22 bp, Homo sapiens
ttcagacaaatttgaggaagct

SEQ ID NO: 7965094 - DNA, 22 bp, Homo sapiens
ttcagacaaatttgaggaagct

SEQ ID NO: 7965095 - DNA, 22 bp, Homo sapiens
ttcagacaataagagtcatctc

SEQ ID NO: 7965096 - DNA, 22 bp, Homo sapiens
ttcagacacagcgctgggaaat

SEQ ID NO: 7965097 - DNA, 22 bp, Homo sapiens
ttcagacacagcgctgggaaat

SEQ ID NO: 7965098 - DNA, 19 bp, Homo sapiens
ttcagacagactaggtata

SEQ ID NO: 7965099 - DNA, 22 bp, Homo sapiens
ttcagacagtaagaaagaggtt

SEQ ID NO: 7965100 - DNA, 22 bp, Homo sapiens
ttcagacagttttcagattcat

SEQ ID NO: 7965101 - DNA, 22 bp, Homo sapiens
ttcagacaggcagctgggctgg

SEQ ID NO: 7965102 - DNA, 22 bp, Homo sapiens
ttcagacagtaagaaagaggtt

SEQ ID NO: 7965103 - DNA, 22 bp, Homo sapiens
ttcagaatgctatttctgaaat

SEQ ID NO: 7965104 - DNA, 22 bp, Homo sapiens
ttcagaatgctatttctgaaat

SEQ ID NO: 7965105 - DNA, 22 bp, Homo sapiens
ttcagaatgtactgatagaaca

SEQ ID NO: 7965106 - DNA, 22 bp, Homo sapiens
ttcagaatgtactgatagaaca

SEQ ID NO: 7965107 - DNA, 22 bp, Homo sapiens
ttcagaatgctatttctgaaat

SEQ ID NO: 7965108 - DNA, 22 bp, Homo sapiens
ttcagaatgctatttctgaaat

SEQ ID NO: 7965109 - DNA, 22 bp, Homo sapiens
ttcagaatgatttcagcgagca

SEQ ID NO: 7965110 - DNA, 22 bp, Homo sapiens
ttcagaatgatttcagcgagca

SEQ ID NO: 7965111 - DNA, 22 bp, Homo sapiens
ttcagaatgattacattctggt

SEQ ID NO: 7965112 - DNA, 22 bp, Homo sapiens
ttcagaatgattacattctggt

SEQ ID NO: 7965113 - DNA, 22 bp, Homo sapiens
ttcagaatgagaatggatgggt

SEQ ID NO: 7965114 - DNA, 22 bp, Homo sapiens
ttcagaatgacttatgtaaggc

SEQ ID NO: 7965115 - DNA, 22 bp, Homo sapiens
ttcagaatgagaatggatgggt

SEQ ID NO: 7965116 - DNA, 22 bp, Homo sapiens
ttcagaatgacttatgtaaggc

SEQ ID NO: 7965117 - DNA, 22 bp, Homo sapiens
ttcagaatgacttatgtaaggc

SEQ ID NO: 7965118 - DNA, 22 bp, Homo sapiens
ttcagaatctatgtgccagctc

SEQ ID NO: 7965119 - DNA, 22 bp, Homo sapiens
ttcagaatctatgtgccagctc

SEQ ID NO: 7965120 - DNA, 22 bp, Homo sapiens
ttcagaatctatgtgccagctc

SEQ ID NO: 7965121 - DNA, 22 bp, Homo sapiens
ttcatacaatgggatattatga

SEQ ID NO: 7965122 - DNA, 22 bp, Homo sapiens
ttcagacatgcaggctgaggct

SEQ ID NO: 7965123 - DNA, 22 bp, Homo sapiens
ttcagacattgctctccaccca

SEQ ID NO: 7965124 - DNA, 22 bp, Homo sapiens
ttcatacagtggctgcactcca

SEQ ID NO: 7965125 - DNA, 23 bp, Homo sapiens
ttcatacagaaacatcacttcat

SEQ ID NO: 7965126 - DNA, 22 bp, Homo sapiens
ttcatacacgaaaatgcatgca

SEQ ID NO: 7965127 - DNA, 22 bp, Homo sapiens
ttcatacacgaaaatgcatgca

SEQ ID NO: 7965128 - DNA, 22 bp, Homo sapiens
ttcatacacgaaaatgcatgca

SEQ ID NO: 7965129 - DNA, 23 bp, Homo sapiens
ttcatacagaaacatcacttcat

SEQ ID NO: 7965130 - DNA, 22 bp, Homo sapiens
ttcatacatgagactagatgca

SEQ ID NO: 7965131 - DNA, 22 bp, Homo sapiens
ttcatacatgtgtactgttcca

SEQ ID NO: 7965132 - DNA, 22 bp, Homo sapiens
ttcatacatgtgtactgttcca

SEQ ID NO: 7965133 - DNA, 22 bp, Homo sapiens
ttcatacatgtgtactgttcca

SEQ ID NO: 7965134 - DNA, 22 bp, Homo sapiens
ttcatacatgagactagatgca

SEQ ID NO: 7965135 - DNA, 22 bp, Homo sapiens
ttcatacatttttactaacagc

SEQ ID NO: 7965136 - DNA, 22 bp, Homo sapiens
ttcatacatttttactaacagc

SEQ ID NO: 7965137 - DNA, 22 bp, Homo sapiens
ttcatacatttttactaacagc

SEQ ID NO: 7965138 - DNA, 22 bp, Homo sapiens
ttcatacatgagactagatgca

SEQ ID NO: 7965139 - DNA, 22 bp, Homo sapiens
ttcatacatttttactaacagc

SEQ ID NO: 7965140 - DNA, 22 bp, Homo sapiens
ttcatacatttttactaacagc

SEQ ID NO: 7965141 - DNA, 22 bp, Homo sapiens
ttcatacatttttactaacagc

SEQ ID NO: 7965142 - DNA, 22 bp, Homo sapiens
ttcatagagcagctcactgaat

SEQ ID NO: 7965143 - DNA, 22 bp, Homo sapiens
ttcatagaagcagaaagtaaac

SEQ ID NO: 7965144 - DNA, 22 bp, Homo sapiens
ttcatagaagcagaaagtaaac

SEQ ID NO: 7965145 - DNA, 22 bp, Homo sapiens
ttcatactgtgtttccaagttt

SEQ ID NO: 7965146 - DNA, 22 bp, Homo sapiens
ttcatactgtgtttccaagttt

SEQ ID NO: 7965147 - DNA, 22 bp, Homo sapiens
ttcatattatgatttgaaatgc

SEQ ID NO: 7965148 - DNA, 22 bp, Homo sapiens
ttcatattcaaatactctgctt

SEQ ID NO: 7965149 - DNA, 22 bp, Homo sapiens
ttcatattcaaatactctgctt

SEQ ID NO: 7965150 - DNA, 22 bp, Homo sapiens
ttcatattatgatttgaaatgc

SEQ ID NO: 7965151 - DNA, 22 bp, Homo sapiens
ttcatattatgatttgaaatgc

SEQ ID NO: 7965152 - DNA, 22 bp, Homo sapiens
ttcatattatgatttgaaatgc

SEQ ID NO: 7965153 - DNA, 22 bp, Homo sapiens
ttcatatgtgaactcagtgatg

SEQ ID NO: 7965154 - DNA, 22 bp, Homo sapiens
ttcatatatatgcactacgtac

SEQ ID NO: 7965155 - DNA, 22 bp, Homo sapiens
ttcatatatatgcactacgtac

SEQ ID NO: 7965156 - DNA, 22 bp, Homo sapiens
ttcatatatatgcactacgtac

SEQ ID NO: 7965157 - DNA, 22 bp, Homo sapiens
ttcatataaatggaatcagaat

SEQ ID NO: 7965158 - DNA, 22 bp, Homo sapiens
ttcatataaatggaatcagaat

SEQ ID NO: 7965159 - DNA, 22 bp, Homo sapiens
ttcatcaatgtgtttaataatg

SEQ ID NO: 7965160 - DNA, 22 bp, Homo sapiens
ttcatcaaaaggctgaggggaa

SEQ ID NO: 7965161 - DNA, 22 bp, Homo sapiens
ttcatcaccttggtagcactcc

SEQ ID NO: 7965162 - DNA, 22 bp, Homo sapiens
ttcatcaccttggtagcactcc

SEQ ID NO: 7965163 - DNA, 20 bp, Homo sapiens
ttcatcagcaaagcacagca

SEQ ID NO: 7965164 - DNA, 20 bp, Homo sapiens
ttcatcagcaaagcacagca

SEQ ID NO: 7965165 - DNA, 22 bp, Homo sapiens
ttcatatttgaaacagaagtta

SEQ ID NO: 7965166 - DNA, 22 bp, Homo sapiens
ttcatattcaaatactctgctt

SEQ ID NO: 7965167 - DNA, 22 bp, Homo sapiens
ttcatattgcttccgtggagtg

SEQ ID NO: 7965168 - DNA, 22 bp, Homo sapiens
ttcatagtgtttccttccagtg

SEQ ID NO: 7965169 - DNA, 22 bp, Homo sapiens
ttcatagtgtttccttccagtg

SEQ ID NO: 7965170 - DNA, 22 bp, Homo sapiens
ttcatataaatggaatcagaat

SEQ ID NO: 7965171 - DNA, 22 bp, Homo sapiens
ttcatataaatggaatcagaat

SEQ ID NO: 7965172 - DNA, 22 bp, Homo sapiens
ttcatagttcagcaaaagagaa

SEQ ID NO: 7965173 - DNA, 22 bp, Homo sapiens
ttcatagttcagcaaaagagaa

SEQ ID NO: 7965174 - DNA, 22 bp, Homo sapiens
ttcatagtgcttaatttgataa

SEQ ID NO: 7965175 - DNA, 22 bp, Homo sapiens
ttcatagtgcttaatttgataa

SEQ ID NO: 7965176 - DNA, 22 bp, Homo sapiens
ttcatagtgattgttcagatag

SEQ ID NO: 7965177 - DNA, 22 bp, Homo sapiens
ttcatagtgacatgcattctgg

SEQ ID NO: 7965178 - DNA, 22 bp, Homo sapiens
ttcatagtgtttccttccagtg

SEQ ID NO: 7965179 - DNA, 22 bp, Homo sapiens
ttcatagtgtttccttccagtg

SEQ ID NO: 7965180 - DNA, 22 bp, Homo sapiens
ttcatagatctcaattttgagg

SEQ ID NO: 7965181 - DNA, 22 bp, Homo sapiens
ttcatagtaacagtaactatgg

SEQ ID NO: 7965182 - DNA, 22 bp, Homo sapiens
ttcatagtgacatgcattctgg

SEQ ID NO: 7965183 - DNA, 22 bp, Homo sapiens
ttcatagtaacagtaactatgg

SEQ ID NO: 7965184 - DNA, 22 bp, Homo sapiens
ttcatagtaacagtaactatgg

SEQ ID NO: 7965185 - DNA, 22 bp, Homo sapiens
ttcataggcagcactggctcct

SEQ ID NO: 7965186 - DNA, 23 bp, Homo sapiens
ttcagaagaaatgagtacaggag

SEQ ID NO: 7965187 - DNA, 22 bp, Homo sapiens
ttcagaagagacactgtgacag

SEQ ID NO: 7965188 - DNA, 22 bp, Homo sapiens
ttcagaactgtctgtccttttc

SEQ ID NO: 7965189 - DNA, 17 bp, Homo sapiens
ttcagaagcattttggc

SEQ ID NO: 7965190 - DNA, 17 bp, Homo sapiens
ttcagaagcattttggc

SEQ ID NO: 7965191 - DNA, 22 bp, Homo sapiens
ttcagaaggattttaacacatg

SEQ ID NO: 7965192 - DNA, 22 bp, Homo sapiens
ttcagaaggatgacaccagttg

SEQ ID NO: 7965193 - DNA, 22 bp, Homo sapiens
ttcagaagtagctaagcagtca

SEQ ID NO: 7965194 - DNA, 22 bp, Homo sapiens
ttcagaagtagctaagcagtca

SEQ ID NO: 7965195 - DNA, 22 bp, Homo sapiens
ttcagaagtagctaagcagtca

SEQ ID NO: 7965196 - DNA, 22 bp, Homo sapiens
ttcagaaggattttaacacatg

SEQ ID NO: 7965197 - DNA, 22 bp, Homo sapiens
ttcagaaggtaggaatgtccct

SEQ ID NO: 7965198 - DNA, 22 bp, Homo sapiens
ttcagaaggtaggaatgtccct

SEQ ID NO: 7965199 - DNA, 22 bp, Homo sapiens
ttcagaaggtgcagcctgggcc

SEQ ID NO: 7965200 - DNA, 22 bp, Homo sapiens
ttcagaatattattttaaaggc

SEQ ID NO: 7965201 - DNA, 22 bp, Homo sapiens
ttcagaatatttgttttacatg

SEQ ID NO: 7965202 - DNA, 22 bp, Homo sapiens
ttcagaatatttgttttacatg

SEQ ID NO: 7965203 - DNA, 22 bp, Homo sapiens
ttcagaatatttgttttacatg

SEQ ID NO: 7965204 - DNA, 22 bp, Homo sapiens
ttcagaatattattttaaaggc

SEQ ID NO: 7965205 - DNA, 22 bp, Homo sapiens
ttcagaatatccgtttaagttt

SEQ ID NO: 7965206 - DNA, 22 bp, Homo sapiens
ttcagaatatccgtttaagttt

SEQ ID NO: 7965207 - DNA, 22 bp, Homo sapiens
ttcagaataatgtgttagagaa

SEQ ID NO: 7965208 - DNA, 22 bp, Homo sapiens
ttcagaataatgtgttagagaa

SEQ ID NO: 7965209 - DNA, 22 bp, Homo sapiens
ttcagaataactttttattgaa

SEQ ID NO: 7965210 - DNA, 22 bp, Homo sapiens
ttcagaataactttttattgaa

SEQ ID NO: 7965211 - DNA, 22 bp, Homo sapiens
ttcagaagttttcaaaactaag

SEQ ID NO: 7965212 - DNA, 22 bp, Homo sapiens
ttcagaagttttcaaaactaag

SEQ ID NO: 7965213 - DNA, 21 bp, Homo sapiens
ttcagaagttgagggcaggtt

SEQ ID NO: 7965214 - DNA, 22 bp, Homo sapiens
ttcactgtcctgcaactctaga

SEQ ID NO: 7965215 - DNA, 22 bp, Homo sapiens
ttcactgtcctgcaactctaga

SEQ ID NO: 7965216 - DNA, 22 bp, Homo sapiens
ttcactgtcctgcaactctaga

SEQ ID NO: 7965217 - DNA, 22 bp, Homo sapiens
ttcactgtgaactcatattcag

SEQ ID NO: 7965218 - DNA, 22 bp, Homo sapiens
ttcactgtgaactcatattcag

SEQ ID NO: 7965219 - DNA, 22 bp, Homo sapiens
ttcactgtgaactcatattcag

SEQ ID NO: 7965220 - DNA, 22 bp, Homo sapiens
ttcactgtgatgtttaagagaa

SEQ ID NO: 7965221 - DNA, 22 bp, Homo sapiens
ttcactgtgatggtgcagaggc

SEQ ID NO: 7965222 - DNA, 22 bp, Homo sapiens
ttcactgtgatgtttaagagaa

SEQ ID NO: 7965223 - DNA, 22 bp, Homo sapiens
ttcactgttatgaagctctggg

SEQ ID NO: 7965224 - DNA, 22 bp, Homo sapiens
ttcactgttatgaagctctggg

SEQ ID NO: 7965225 - DNA, 22 bp, Homo sapiens
ttcagaaataaaatatcccaac

SEQ ID NO: 7965226 - DNA, 22 bp, Homo sapiens
ttcagaaataaaatatcccaac

SEQ ID NO: 7965227 - DNA, 20 bp, Homo sapiens
ttcagaaataaggaatgagg

SEQ ID NO: 7965228 - DNA, 20 bp, Homo sapiens
ttcagaaataaggaatgagg

SEQ ID NO: 7965229 - DNA, 22 bp, Homo sapiens
ttcagaaatccctcttctaccc

SEQ ID NO: 7965230 - DNA, 22 bp, Homo sapiens
ttcagaaatgtcagccatcaga

SEQ ID NO: 7965231 - DNA, 22 bp, Homo sapiens
ttcagaaatgaatattggtatt

SEQ ID NO: 7965232 - DNA, 22 bp, Homo sapiens
ttcagaaatgaatattggtatt

SEQ ID NO: 7965233 - DNA, 22 bp, Homo sapiens
ttcagaaatgaatattggtatt

SEQ ID NO: 7965234 - DNA, 22 bp, Homo sapiens
ttcagaaatgaatattggtatt

SEQ ID NO: 7965235 - DNA, 22 bp, Homo sapiens
ttcagaaatgaatattggtatt

SEQ ID NO: 7965236 - DNA, 22 bp, Homo sapiens
ttcagaacaaccatggttagat

SEQ ID NO: 7965237 - DNA, 22 bp, Homo sapiens
ttcagaaattcatggagttcag

SEQ ID NO: 7965238 - DNA, 22 bp, Homo sapiens
ttcagaaatcgagtttcatgtc

SEQ ID NO: 7965239 - DNA, 22 bp, Homo sapiens
ttcagaaatccctcttctaccc

SEQ ID NO: 7965240 - DNA, 22 bp, Homo sapiens
ttcagaaatcgagtttcatgtc

SEQ ID NO: 7965241 - DNA, 22 bp, Homo sapiens
ttcagaaatccctcttctaccc

SEQ ID NO: 7965242 - DNA, 22 bp, Homo sapiens
ttcaatcattccaacactttaa

SEQ ID NO: 7965243 - DNA, 22 bp, Homo sapiens
ttcaatcattgcaaagtaatgg

SEQ ID NO: 7965244 - DNA, 22 bp, Homo sapiens
ttcaatcattgcaaagtaatgg

SEQ ID NO: 7965245 - DNA, 17 bp, Homo sapiens
ttcaatgattaatgcat

SEQ ID NO: 7965246 - DNA, 22 bp, Homo sapiens
ttcaatgatttttagggatcat

SEQ ID NO: 7965247 - DNA, 22 bp, Homo sapiens
ttcactgtatgagagggcttga

SEQ ID NO: 7965248 - DNA, 22 bp, Homo sapiens
ttcactgtactgactgtcttat

SEQ ID NO: 7965249 - DNA, 22 bp, Homo sapiens
ttcactgtactttggcaatgct

SEQ ID NO: 7965250 - DNA, 22 bp, Homo sapiens
ttcaatatctctaagaatgagg

SEQ ID NO: 7965251 - DNA, 22 bp, Homo sapiens
ttcaatatgatattagctgtgg

SEQ ID NO: 7965252 - DNA, 22 bp, Homo sapiens
ttcaatatgatattagctgtgg

SEQ ID NO: 7965253 - DNA, 22 bp, Homo sapiens
ttcaatatgatattagctgtgg

SEQ ID NO: 7965254 - DNA, 22 bp, Homo sapiens
ttcaatcattagaatctcaggc

SEQ ID NO: 7965255 - DNA, 22 bp, Homo sapiens
ttcaatcattagaatctcaggc

SEQ ID NO: 7965256 - DNA, 22 bp, Homo sapiens
ttcaagtagaaagtattgatga

SEQ ID NO: 7965257 - DNA, 22 bp, Homo sapiens
ttcaagtagaaagtattgatga

SEQ ID NO: 7965258 - DNA, 22 bp, Homo sapiens
ttcaagtagaaagtattgatga

SEQ ID NO: 7965259 - DNA, 22 bp, Homo sapiens
ttcaagtactgtagatttcagg

SEQ ID NO: 7965260 - DNA, 22 bp, Homo sapiens
ttcaagtacattgtgttttcct

SEQ ID NO: 7965261 - DNA, 22 bp, Homo sapiens
ttcaagtaatgctactcctatg

SEQ ID NO: 7965262 - DNA, 22 bp, Homo sapiens
ttcaagtaacacaaatgcaccc

SEQ ID NO: 7965263 - DNA, 22 bp, Homo sapiens
ttcaagtaaatcactttttgtc

SEQ ID NO: 7965264 - DNA, 22 bp, Homo sapiens
ttcaaggtaagtatgagaaagc

SEQ ID NO: 7965265 - DNA, 22 bp, Homo sapiens
ttcaaggttcagggagaaattg

SEQ ID NO: 7965266 - DNA, 22 bp, Homo sapiens
ttcaaggtcaactatgggattc

SEQ ID NO: 7965267 - DNA, 19 bp, Homo sapiens
ttcaagtaaactattatta

SEQ ID NO: 7965268 - DNA, 19 bp, Homo sapiens
ttcaagtaaactattatta

SEQ ID NO: 7965269 - DNA, 22 bp, Homo sapiens
ttcaagtcaatttttgaatgac

SEQ ID NO: 7965270 - DNA, 22 bp, Homo sapiens
ttcaagtcatgttaactgcttc

SEQ ID NO: 7965271 - DNA, 22 bp, Homo sapiens
ttcaagtagtcacacatgatat

SEQ ID NO: 7965272 - DNA, 22 bp, Homo sapiens
ttcaagtaggccagctgcatgg

SEQ ID NO: 7965273 - DNA, 22 bp, Homo sapiens
ttcaatatctctaagaatgagg

SEQ ID NO: 7965274 - DNA, 22 bp, Homo sapiens
ttcaatatctctaagaatgagg

SEQ ID NO: 7965275 - DNA, 22 bp, Homo sapiens
ttcaatatctctaagaatgagg

SEQ ID NO: 7965276 - DNA, 21 bp, Homo sapiens
ttcaagtctctaggacttctc

SEQ ID NO: 7965277 - DNA, 22 bp, Homo sapiens
ttcaatatcattgtttagtctc

SEQ ID NO: 7965278 - DNA, 22 bp, Homo sapiens
ttcccagtgattgaacatccct

SEQ ID NO: 7965279 - DNA, 22 bp, Homo sapiens
ttcccagtgaggaagcaatgca

SEQ ID NO: 7965280 - DNA, 22 bp, Homo sapiens
ttcccagtgattaaggcagtgg

SEQ ID NO: 7965281 - DNA, 22 bp, Homo sapiens
ttcccaggtaattctgaggcag

SEQ ID NO: 7965282 - DNA, 22 bp, Homo sapiens
ttcccaggtaattctgaggcag

SEQ ID NO: 7965283 - DNA, 21 bp, Homo sapiens
ttcccatcttttctgagtctg

SEQ ID NO: 7965284 - DNA, 22 bp, Homo sapiens
ttcccatcgtctccttcacctt

SEQ ID NO: 7965285 - DNA, 21 bp, Homo sapiens
ttcccatcttttctgagtctg

SEQ ID NO: 7965286 - DNA, 22 bp, Homo sapiens
ttcccatagtgaccgatgctga

SEQ ID NO: 7965287 - DNA, 22 bp, Homo sapiens
ttccccaggctggagtgcagtg

SEQ ID NO: 7965288 - DNA, 22 bp, Homo sapiens
ttccccaggcggctttttcagc

SEQ ID NO: 7965289 - DNA, 22 bp, Homo sapiens
ttcccatttgtggtagtgaatt

SEQ ID NO: 7965290 - DNA, 21 bp, Homo sapiens
ttcccagcacctagcacaggt

SEQ ID NO: 7965291 - DNA, 19 bp, Homo sapiens
ttcccaggaaaggggtgca

SEQ ID NO: 7965292 - DNA, 22 bp, Homo sapiens
ttcccagattggagggcagggg

SEQ ID NO: 7965293 - DNA, 22 bp, Homo sapiens
ttcccagattggagggcagggg

SEQ ID NO: 7965294 - DNA, 21 bp, Homo sapiens
ttcccagcacctagcacaggt

SEQ ID NO: 7965295 - DNA, 22 bp, Homo sapiens
ttcccaggactctgggtgtctt

SEQ ID NO: 7965296 - DNA, 22 bp, Homo sapiens
ttcccaggactctgggtgtctt

SEQ ID NO: 7965297 - DNA, 19 bp, Homo sapiens
ttcccaggaaaggggtgca

SEQ ID NO: 7965298 - DNA, 22 bp, Homo sapiens
ttcccaggctgtgctaccagag

SEQ ID NO: 7965299 - DNA, 22 bp, Homo sapiens
ttccccagggaagctcctgcgc

SEQ ID NO: 7965300 - DNA, 22 bp, Homo sapiens
ttccccaggctggagtgcagtg

SEQ ID NO: 7965301 - DNA, 22 bp, Homo sapiens
ttccccagggaagctcctgcgc

SEQ ID NO: 7965302 - DNA, 22 bp, Homo sapiens
ttcccctctcagatctggccta

SEQ ID NO: 7965303 - DNA, 22 bp, Homo sapiens
ttccccaggtgattctcatggc

SEQ ID NO: 7965304 - DNA, 22 bp, Homo sapiens
ttccccagtaacatacatgtga

SEQ ID NO: 7965305 - DNA, 22 bp, Homo sapiens
ttccccttgataatgcagtaag

SEQ ID NO: 7965306 - DNA, 22 bp, Homo sapiens
ttcccctgtcacagtggttctc

SEQ ID NO: 7965307 - DNA, 22 bp, Homo sapiens
ttcccctgtcacagtggttctc

SEQ ID NO: 7965308 - DNA, 17 bp, Homo sapiens
ttcccctgaccaagcct

SEQ ID NO: 7965309 - DNA, 22 bp, Homo sapiens
ttccattggtaaaatgagagtg

SEQ ID NO: 7965310 - DNA, 22 bp, Homo sapiens
ttccattgtttctgtcttcact

SEQ ID NO: 7965311 - DNA, 22 bp, Homo sapiens
ttccattgagtacctggagaca

SEQ ID NO: 7965312 - DNA, 22 bp, Homo sapiens
ttccattgagtacctggagaca

SEQ ID NO: 7965313 - DNA, 22 bp, Homo sapiens
ttccatgtactgggttttgtat

SEQ ID NO: 7965314 - DNA, 22 bp, Homo sapiens
ttcccagaatgaatggatggag

SEQ ID NO: 7965315 - DNA, 22 bp, Homo sapiens
ttcccagaattgttgggaactg

SEQ ID NO: 7965316 - DNA, 22 bp, Homo sapiens
ttcccagaattgttgggaactg

SEQ ID NO: 7965317 - DNA, 22 bp, Homo sapiens
ttcccagaattgttgggaactg

SEQ ID NO: 7965318 - DNA, 22 bp, Homo sapiens
ttcccagacctgtaggatcaga

SEQ ID NO: 7965319 - DNA, 22 bp, Homo sapiens
ttcccagactccacactgaggc

SEQ ID NO: 7965320 - DNA, 22 bp, Homo sapiens
ttcccagacctgtaggatcaga

SEQ ID NO: 7965321 - DNA, 22 bp, Homo sapiens
ttcccagagataagacgtctta

SEQ ID NO: 7965322 - DNA, 22 bp, Homo sapiens
ttcccagagataagacgtctta

SEQ ID NO: 7965323 - DNA, 22 bp, Homo sapiens
ttcccagagaaggatgaaaaag

SEQ ID NO: 7965324 - DNA, 22 bp, Homo sapiens
ttcccagagaaggatgaaaaag

SEQ ID NO: 7965325 - DNA, 22 bp, Homo sapiens
ttcccagagaaggatgaaaaag

SEQ ID NO: 7965326 - DNA, 22 bp, Homo sapiens
ttcccagactccacactgaggc

SEQ ID NO: 7965327 - DNA, 22 bp, Homo sapiens
ttcccagactccacactgaggc

SEQ ID NO: 7965328 - DNA, 22 bp, Homo sapiens
ttcccagaggagatttgcttat

SEQ ID NO: 7965329 - DNA, 22 bp, Homo sapiens
ttcccagaggcaaagtctggat

SEQ ID NO: 7965330 - DNA, 22 bp, Homo sapiens
ttcccagaggcaaagtctggat

SEQ ID NO: 7965331 - DNA, 22 bp, Homo sapiens
ttcccagaggagatttgcttat

SEQ ID NO: 7965332 - DNA, 22 bp, Homo sapiens
ttcccagaggagatttgcttat

SEQ ID NO: 7965333 - DNA, 19 bp, Homo sapiens
ttcccagagccatgagtga

SEQ ID NO: 7965334 - DNA, 19 bp, Homo sapiens
ttcccagagccatgagtga

SEQ ID NO: 7965335 - DNA, 19 bp, Homo sapiens
ttcccagagccatgagtga

SEQ ID NO: 7965336 - DNA, 22 bp, Homo sapiens
ttccatattagactatgtgggg

SEQ ID NO: 7965337 - DNA, 22 bp, Homo sapiens
ttccatccatgtcccgtttctg

SEQ ID NO: 7965338 - DNA, 22 bp, Homo sapiens
ttccatccatatcttgttgagg

SEQ ID NO: 7965339 - DNA, 22 bp, Homo sapiens
ttccatccatgtcccgtttctg

SEQ ID NO: 7965340 - DNA, 22 bp, Homo sapiens
ttccatcacatcactgaagaca

SEQ ID NO: 7965341 - DNA, 22 bp, Homo sapiens
ttccatcattaacaccacaagg

SEQ ID NO: 7965342 - DNA, 22 bp, Homo sapiens
ttccatcctaataaaagaagtt

SEQ ID NO: 7965343 - DNA, 22 bp, Homo sapiens
ttccatctttcagctttgttgg

SEQ ID NO: 7965344 - DNA, 22 bp, Homo sapiens
ttccatctttcagctttgttgg

SEQ ID NO: 7965345 - DNA, 22 bp, Homo sapiens
ttccatctgagagctgtgaaga

SEQ ID NO: 7965346 - DNA, 22 bp, Homo sapiens
ttccatctgagagctgtgaaga

SEQ ID NO: 7965347 - DNA, 22 bp, Homo sapiens
ttccatctgctaggtaaatgaa

SEQ ID NO: 7965348 - DNA, 22 bp, Homo sapiens
ttccatgaagggcagcctctca

SEQ ID NO: 7965349 - DNA, 22 bp, Homo sapiens
ttccatgaagggcagcctctca

SEQ ID NO: 7965350 - DNA, 22 bp, Homo sapiens
ttccatgagtagcagtatttcc

SEQ ID NO: 7965351 - DNA, 22 bp, Homo sapiens
ttccatgcctctatttagaatt

SEQ ID NO: 7965352 - DNA, 22 bp, Homo sapiens
ttccatgctaagacacgcaggg

SEQ ID NO: 7965353 - DNA, 22 bp, Homo sapiens
ttccatgcctagaacaggattc

SEQ ID NO: 7965354 - DNA, 22 bp, Homo sapiens
ttccatacgactgaggtctcgg

SEQ ID NO: 7965355 - DNA, 20 bp, Homo sapiens
ttccatagcaccctgtgggt

SEQ ID NO: 7965356 - DNA, 22 bp, Homo sapiens
ttccatatgtatatagctgtta

SEQ ID NO: 7965357 - DNA, 22 bp, Homo sapiens
ttccatatgaaaaagctgttgc

SEQ ID NO: 7965358 - DNA, 22 bp, Homo sapiens
ttccataatcaccttattcttt

SEQ ID NO: 7965359 - DNA, 22 bp, Homo sapiens
ttccataatgagattcccagcc

SEQ ID NO: 7965360 - DNA, 22 bp, Homo sapiens
ttccataactgaccgaatgcat

SEQ ID NO: 7965361 - DNA, 22 bp, Homo sapiens
ttccaatatttacaatgcatta

SEQ ID NO: 7965362 - DNA, 22 bp, Homo sapiens
ttccaatatttacaatgcatta

SEQ ID NO: 7965363 - DNA, 22 bp, Homo sapiens
ttccaatccaaacttcaccttt

SEQ ID NO: 7965364 - DNA, 22 bp, Homo sapiens
ttccaatatttacaatgcatta

SEQ ID NO: 7965365 - DNA, 22 bp, Homo sapiens
ttccaatggaatcatgtcttga

SEQ ID NO: 7965366 - DNA, 22 bp, Homo sapiens
ttccaattgtgagattttttaa

SEQ ID NO: 7965367 - DNA, 21 bp, Homo sapiens
ttccagttttaattaaattgt

SEQ ID NO: 7965368 - DNA, 22 bp, Homo sapiens
ttccaagtgcccatatttcatc

SEQ ID NO: 7965369 - DNA, 22 bp, Homo sapiens
ttccaagtgcccatatttcatc

SEQ ID NO: 7965370 - DNA, 22 bp, Homo sapiens
ttccaagtgcccatatttcatc

SEQ ID NO: 7965371 - DNA, 22 bp, Homo sapiens
ttccaagtgcccatatttcatc

SEQ ID NO: 7965372 - DNA, 22 bp, Homo sapiens
ttccaagtgaaagtagctttgt

SEQ ID NO: 7965373 - DNA, 22 bp, Homo sapiens
ttccaagtctaagttataaatc

SEQ ID NO: 7965374 - DNA, 23 bp, Homo sapiens
ttccaagtgctttacttaatcct

SEQ ID NO: 7965375 - DNA, 22 bp, Homo sapiens
ttccaagtgtcagatcagattt

SEQ ID NO: 7965376 - DNA, 22 bp, Homo sapiens
ttccaagtgttgagattagagg

SEQ ID NO: 7965377 - DNA, 22 bp, Homo sapiens
ttccaataaaatgttatttgca

SEQ ID NO: 7965378 - DNA, 22 bp, Homo sapiens
ttccaataaaatgttatttgca

SEQ ID NO: 7965379 - DNA, 23 bp, Homo sapiens
ttccaaggggatgtctccaagtg

SEQ ID NO: 7965380 - DNA, 20 bp, Homo sapiens
ttccaaggtctatgcttctt

SEQ ID NO: 7965381 - DNA, 22 bp, Homo sapiens
ttccaaggtgttctgctggttt

SEQ ID NO: 7965382 - DNA, 22 bp, Homo sapiens
ttccaaggtgggactggggtgc

SEQ ID NO: 7965383 - DNA, 22 bp, Homo sapiens
ttccaaggtttctccagcctcc

SEQ ID NO: 7965384 - DNA, 22 bp, Homo sapiens
ttccaaggttagtttttagggt

SEQ ID NO: 7965385 - DNA, 22 bp, Homo sapiens
ttccaaggttactggtggttta

SEQ ID NO: 7965386 - DNA, 22 bp, Homo sapiens
ttccaagggaatgtttatgagt

SEQ ID NO: 7965387 - DNA, 22 bp, Homo sapiens
ttccaaggctgtcctcactttg

SEQ ID NO: 7965388 - DNA, 22 bp, Homo sapiens
ttccaaggctgtcctcactttg

SEQ ID NO: 7965389 - DNA, 23 bp, Homo sapiens
ttccaaggggatgtctccaagtg

SEQ ID NO: 7965390 - DNA, 22 bp, Homo sapiens
ttccaagggaatgtttatgagt

SEQ ID NO: 7965391 - DNA, 23 bp, Homo sapiens
ttccaaggggatgtctccaagtg

SEQ ID NO: 7965392 - DNA, 22 bp, Homo sapiens
ttccaaggctctcttcccacaa

SEQ ID NO: 7965393 - DNA, 22 bp, Homo sapiens
ttccaaggctgctatttgtttc

SEQ ID NO: 7965394 - DNA, 22 bp, Homo sapiens
ttccaaggctaggttgtaaagg

SEQ ID NO: 7965395 - DNA, 22 bp, Homo sapiens
ttccaaggctgtaaaattggtt

SEQ ID NO: 7965396 - DNA, 19 bp, Homo sapiens
ttccaaaatcaggatttga

SEQ ID NO: 7965397 - DNA, 19 bp, Homo sapiens
ttccaaaatcaggatttga

SEQ ID NO: 7965398 - DNA, 22 bp, Homo sapiens
ttccaaaacagtatggcatgtg

SEQ ID NO: 7965399 - DNA, 22 bp, Homo sapiens
ttccaaaacaatattctgtgaa

SEQ ID NO: 7965400 - DNA, 21 bp, Homo sapiens
ttcatcagccagaaatcaagc

SEQ ID NO: 7965401 - DNA, 21 bp, Homo sapiens
ttcatcagccagaaatcaagc

SEQ ID NO: 7965402 - DNA, 22 bp, Homo sapiens
ttcatcaggcatcatgctcaag

SEQ ID NO: 7965403 - DNA, 21 bp, Homo sapiens
ttcatcagccagaaatcaagc

SEQ ID NO: 7965404 - DNA, 22 bp, Homo sapiens
ttccaaaacaatattctgtgaa

SEQ ID NO: 7965405 - DNA, 22 bp, Homo sapiens
ttccaaaacaatattctgtgaa

SEQ ID NO: 7965406 - DNA, 22 bp, Homo sapiens
ttccaaaacaatattctgtgaa

SEQ ID NO: 7965407 - DNA, 22 bp, Homo sapiens
ttcatcaggcatcatgctcaag

SEQ ID NO: 7965408 - DNA, 22 bp, Homo sapiens
ttccaagaaacaagtgatgcag

SEQ ID NO: 7965409 - DNA, 22 bp, Homo sapiens
ttccaagacacctttagtcact

SEQ ID NO: 7965410 - DNA, 22 bp, Homo sapiens
ttccaagaagtcaacaggtagt

SEQ ID NO: 7965411 - DNA, 22 bp, Homo sapiens
ttccaacaatgtgttattgttc

SEQ ID NO: 7965412 - DNA, 20 bp, Homo sapiens
ttccaactcacatctctaca

SEQ ID NO: 7965413 - DNA, 20 bp, Homo sapiens
ttccaactcacatctctaca

SEQ ID NO: 7965414 - DNA, 20 bp, Homo sapiens
ttccaactcacatctctaca

SEQ ID NO: 7965415 - DNA, 22 bp, Homo sapiens
ttccaacaatgtgttattgttc

SEQ ID NO: 7965416 - DNA, 19 bp, Homo sapiens
ttccaaaatcaggatttga

SEQ ID NO: 7965417 - DNA, 17 bp, Homo sapiens
ttccaaggagcatttga

SEQ ID NO: 7965418 - DNA, 22 bp, Homo sapiens
ttccaaggagtgaacttcaaat

SEQ ID NO: 7965419 - DNA, 22 bp, Homo sapiens
ttccaaggagtgaacttcaaat

SEQ ID NO: 7965420 - DNA, 22 bp, Homo sapiens
ttccaaggattgaaatgtagtc

SEQ ID NO: 7965421 - DNA, 22 bp, Homo sapiens
ttccaagagtcagctgatccca

SEQ ID NO: 7965422 - DNA, 22 bp, Homo sapiens
ttccaaggagaacactctgtag

SEQ ID NO: 7965423 - DNA, 22 bp, Homo sapiens
ttccaaggagaacactctgtag

SEQ ID NO: 7965424 - DNA, 22 bp, Homo sapiens
ttccaaggagagctcgacctca

SEQ ID NO: 7965425 - DNA, 22 bp, Homo sapiens
ttccaagagctttaattgttga

SEQ ID NO: 7965426 - DNA, 22 bp, Homo sapiens
ttccaagagcctttcttctaga

SEQ ID NO: 7965427 - DNA, 22 bp, Homo sapiens
ttccaagacttggccagcaggg

SEQ ID NO: 7965428 - DNA, 22 bp, Homo sapiens
ttccaagacttggccagcaggg

SEQ ID NO: 7965429 - DNA, 22 bp, Homo sapiens
ttccaaggccaggccctgaggt

SEQ ID NO: 7965430 - DNA, 22 bp, Homo sapiens
ttccaaggccagacagggcagt

SEQ ID NO: 7965431 - DNA, 22 bp, Homo sapiens
ttccaaggcccagcagagagga

SEQ ID NO: 7965432 - DNA, 22 bp, Homo sapiens
ttccaaggcccagcagagagga

SEQ ID NO: 7965433 - DNA, 22 bp, Homo sapiens
ttccaaggctaggttgtaaagg

SEQ ID NO: 7965434 - DNA, 22 bp, Homo sapiens
ttccaaggcgcgccggcgccac

SEQ ID NO: 7965435 - DNA, 22 bp, Homo sapiens
ttccaaggcccagcagagagga

SEQ ID NO: 7965436 - DNA, 22 bp, Homo sapiens
ttccaaggcgatggcgcagaac

SEQ ID NO: 7965437 - DNA, 22 bp, Homo sapiens
ttccaaggcatgttctcaagta

SEQ ID NO: 7965438 - DNA, 22 bp, Homo sapiens
ttccaaggcagttttctctctg

SEQ ID NO: 7965439 - DNA, 22 bp, Homo sapiens
ttccaaggcatgttctcaagta

SEQ ID NO: 7965440 - DNA, 22 bp, Homo sapiens
ttccaaggccagacagggcagt

SEQ ID NO: 7965441 - DNA, 19 bp, Homo sapiens
ttccaaggcatttctttgc

SEQ ID NO: 7965442 - DNA, 22 bp, Homo sapiens
ttccaaggcaacagcctaggct

SEQ ID NO: 7965443 - DNA, 22 bp, Homo sapiens
ttccaaggcatgttctcaagta

SEQ ID NO: 7965444 - DNA, 22 bp, Homo sapiens
ttccaaggcagttttctctctg

SEQ ID NO: 7965445 - DNA, 22 bp, Homo sapiens
ttccaaggcaacagcctaggct

SEQ ID NO: 7965446 - DNA, 22 bp, Homo sapiens
ttccaaggcaacagcctaggct

SEQ ID NO: 7965447 - DNA, 22 bp, Homo sapiens
ttggggagaaatgaaatgaagt

SEQ ID NO: 7965448 - DNA, 22 bp, Homo sapiens
ttggggagaaatgaaatgaagt

SEQ ID NO: 7965449 - DNA, 22 bp, Homo sapiens
ttggggagaaatgaaatgaagt

SEQ ID NO: 7965450 - DNA, 22 bp, Homo sapiens
ttggggagaaatgaaatgaagt

SEQ ID NO: 7965451 - DNA, 22 bp, Homo sapiens
ttggggagaaatgaaatgaagt

SEQ ID NO: 7965452 - DNA, 22 bp, Homo sapiens
ttggggagttaatgccaaagat

SEQ ID NO: 7965453 - DNA, 22 bp, Homo sapiens
ttggggagttaatgccaaagat

SEQ ID NO: 7965454 - DNA, 22 bp, Homo sapiens
ttggggaggttgccacattcca

SEQ ID NO: 7965455 - DNA, 22 bp, Homo sapiens
ttggggagttaatgccaaagat

SEQ ID NO: 7965456 - DNA, 22 bp, Homo sapiens
ttggggagttaatgccaaagat

SEQ ID NO: 7965457 - DNA, 22 bp, Homo sapiens
ttggggcacctccccagcattt

SEQ ID NO: 7965458 - DNA, 22 bp, Homo sapiens
ttggggcacctccccagcattt

SEQ ID NO: 7965459 - DNA, 22 bp, Homo sapiens
ttggggcacctccccagcattt

SEQ ID NO: 7965460 - DNA, 22 bp, Homo sapiens
ttggggcagagaggatacggca

SEQ ID NO: 7965461 - DNA, 22 bp, Homo sapiens
ttggggcagttattctgtgccc

SEQ ID NO: 7965462 - DNA, 22 bp, Homo sapiens
ttggggaagctttgaaatactt

SEQ ID NO: 7965463 - DNA, 22 bp, Homo sapiens
ttggggaagagttgactttgga

SEQ ID NO: 7965464 - DNA, 22 bp, Homo sapiens
ttggggaagctttgaaatactt

SEQ ID NO: 7965465 - DNA, 22 bp, Homo sapiens
ttggggaagctttgaaatactt

SEQ ID NO: 7965466 - DNA, 22 bp, Homo sapiens
ttggggaaggcttccctgtacc

SEQ ID NO: 7965467 - DNA, 22 bp, Homo sapiens
ttgggctggtctttgtttggtc

SEQ ID NO: 7965468 - DNA, 22 bp, Homo sapiens
ttgggcttgtctgggaaactgc

SEQ ID NO: 7965469 - DNA, 22 bp, Homo sapiens
ttgggctggcccttgtctctgg

SEQ ID NO: 7965470 - DNA, 22 bp, Homo sapiens
ttgggctggcccttgtctctgg

SEQ ID NO: 7965471 - DNA, 22 bp, Homo sapiens
ttgggctggcccttgtctctgg

SEQ ID NO: 7965472 - DNA, 23 bp, Homo sapiens
ttgggctggctctcgatgcctct

SEQ ID NO: 7965473 - DNA, 23 bp, Homo sapiens
ttgggctggctctcgatgcctct

SEQ ID NO: 7965474 - DNA, 22 bp, Homo sapiens
ttgggctgggcaagaatcaatg

SEQ ID NO: 7965475 - DNA, 22 bp, Homo sapiens
ttgggctgggcaagaatcaatg

SEQ ID NO: 7965476 - DNA, 22 bp, Homo sapiens
ttgggctggtctttgtttggtc

SEQ ID NO: 7965477 - DNA, 22 bp, Homo sapiens
ttgggctggcagaggtggtctt

SEQ ID NO: 7965478 - DNA, 22 bp, Homo sapiens
ttgggctggcagaggtggtctt

SEQ ID NO: 7965479 - DNA, 22 bp, Homo sapiens
ttgggctggcagaggtggtctt

SEQ ID NO: 7965480 - DNA, 22 bp, Homo sapiens
ttgggctggcccttgtctctgg

SEQ ID NO: 7965481 - DNA, 22 bp, Homo sapiens
ttgggctggcagaggtggtctt

SEQ ID NO: 7965482 - DNA, 22 bp, Homo sapiens
ttgggctgaaccctgcagctga

SEQ ID NO: 7965483 - DNA, 22 bp, Homo sapiens
ttgggctcctgttgatcctgtc

SEQ ID NO: 7965484 - DNA, 22 bp, Homo sapiens
ttgggctgaaccctgcagctga

SEQ ID NO: 7965485 - DNA, 22 bp, Homo sapiens
ttgggctcaggagtttgagacc

SEQ ID NO: 7965486 - DNA, 23 bp, Homo sapiens
ttgggctcagtggcaggaagagt

SEQ ID NO: 7965487 - DNA, 23 bp, Homo sapiens
ttgggctcagtggcaggaagagt

SEQ ID NO: 7965488 - DNA, 22 bp, Homo sapiens
ttgggctcaggagtttgagacc

SEQ ID NO: 7965489 - DNA, 22 bp, Homo sapiens
ttgggctcaggagtttgagacc

SEQ ID NO: 7965490 - DNA, 22 bp, Homo sapiens
ttgggctcaggagtttgagacc

SEQ ID NO: 7965491 - DNA, 22 bp, Homo sapiens
ttgggctcaggagtttgagacc

SEQ ID NO: 7965492 - DNA, 22 bp, Homo sapiens
ttgggctatgttatataatgtt

SEQ ID NO: 7965493 - DNA, 21 bp, Homo sapiens
ttgggccttttctggtagctt

SEQ ID NO: 7965494 - DNA, 21 bp, Homo sapiens
ttgggccttttctggtagctt

SEQ ID NO: 7965495 - DNA, 22 bp, Homo sapiens
ttgggctcaggagtttgagacc

SEQ ID NO: 7965496 - DNA, 22 bp, Homo sapiens
ttgggctgatctgtggaagaag

SEQ ID NO: 7965497 - DNA, 22 bp, Homo sapiens
ttgggctgatctgtggaagaag

SEQ ID NO: 7965498 - DNA, 22 bp, Homo sapiens
ttgggctgcagcaattattagt

SEQ ID NO: 7965499 - DNA, 22 bp, Homo sapiens
ttgggctgatctgtggaagaag

SEQ ID NO: 7965500 - DNA, 22 bp, Homo sapiens
ttgggctgatctgtggaagaag

SEQ ID NO: 7965501 - DNA, 22 bp, Homo sapiens
ttgggctgatctgtggaagaag

SEQ ID NO: 7965502 - DNA, 22 bp, Homo sapiens
ttgggctggataagtctttgtt

SEQ ID NO: 7965503 - DNA, 22 bp, Homo sapiens
ttgggctggataagtctttgtt

SEQ ID NO: 7965504 - DNA, 22 bp, Homo sapiens
ttgggctggataagtctttgtt

SEQ ID NO: 7965505 - DNA, 22 bp, Homo sapiens
ttgggctggcagaggtggtctt

SEQ ID NO: 7965506 - DNA, 22 bp, Homo sapiens
ttgggctggagatgatctgctg

SEQ ID NO: 7965507 - DNA, 22 bp, Homo sapiens
ttgggctggagatgatctgctg

SEQ ID NO: 7965508 - DNA, 22 bp, Homo sapiens
ttgggctggagatgatctgctg

SEQ ID NO: 7965509 - DNA, 22 bp, Homo sapiens
ttgggctgcagcaattattagt

SEQ ID NO: 7965510 - DNA, 22 bp, Homo sapiens
ttgggctgaagtagagggcaga

SEQ ID NO: 7965511 - DNA, 22 bp, Homo sapiens
ttgggctgaaccctgcagctga

SEQ ID NO: 7965512 - DNA, 22 bp, Homo sapiens
ttgggctgaagtagagggcaga

SEQ ID NO: 7965513 - DNA, 22 bp, Homo sapiens
ttgggctgaagtagagggcaga

SEQ ID NO: 7965514 - DNA, 22 bp, Homo sapiens
ttgggctgaaccctgcagctga

SEQ ID NO: 7965515 - DNA, 22 bp, Homo sapiens
ttgggctgaggagggcgtggcc

SEQ ID NO: 7965516 - DNA, 22 bp, Homo sapiens
ttgggctgaggagggcgtggcc

SEQ ID NO: 7965517 - DNA, 22 bp, Homo sapiens
ttgggctgaggagggcgtggcc

SEQ ID NO: 7965518 - DNA, 22 bp, Homo sapiens
ttgggctgaagtagagggcaga

SEQ ID NO: 7965519 - DNA, 22 bp, Homo sapiens
ttgggaaatatggattgttatt

SEQ ID NO: 7965520 - DNA, 23 bp, Homo sapiens
ttgggaaatagttaagacatgag

SEQ ID NO: 7965521 - DNA, 23 bp, Homo sapiens
ttgggaaatagttaagacatgag

SEQ ID NO: 7965522 - DNA, 22 bp, Homo sapiens
ttgggaaatatggattgttatt

SEQ ID NO: 7965523 - DNA, 22 bp, Homo sapiens
ttgggaaattactctgctagga

SEQ ID NO: 7965524 - DNA, 22 bp, Homo sapiens
ttgggaaattactctgctagga

SEQ ID NO: 7965525 - DNA, 22 bp, Homo sapiens
ttgggaaattactctgctagga

SEQ ID NO: 7965526 - DNA, 23 bp, Homo sapiens
ttgggaaatagttaagacatgag

SEQ ID NO: 7965527 - DNA, 22 bp, Homo sapiens
ttgggaaagccacaaattggag

SEQ ID NO: 7965528 - DNA, 22 bp, Homo sapiens
ttgggaaagggattatgagtag

SEQ ID NO: 7965529 - DNA, 22 bp, Homo sapiens
ttgggaaagaatgagaaggtga

SEQ ID NO: 7965530 - DNA, 22 bp, Homo sapiens
ttgggaaacagtatagctaaca

SEQ ID NO: 7965531 - DNA, 22 bp, Homo sapiens
ttgggaaagaatgagaaggtga

SEQ ID NO: 7965532 - DNA, 18 bp, Homo sapiens
ttggctttgagaactggt

SEQ ID NO: 7965533 - DNA, 18 bp, Homo sapiens
ttggctttgagaactggt

SEQ ID NO: 7965534 - DNA, 18 bp, Homo sapiens
ttggctttgagaactggt

SEQ ID NO: 7965535 - DNA, 22 bp, Homo sapiens
ttgggaaacagtatagctaaca

SEQ ID NO: 7965536 - DNA, 22 bp, Homo sapiens
ttggcttttatgcagcttaggt

SEQ ID NO: 7965537 - DNA, 22 bp, Homo sapiens
ttggcttttatgcagcttaggt

SEQ ID NO: 7965538 - DNA, 22 bp, Homo sapiens
ttggctttagcccaaatgactg

SEQ ID NO: 7965539 - DNA, 22 bp, Homo sapiens
ttggctttagacctgagactgt

SEQ ID NO: 7965540 - DNA, 22 bp, Homo sapiens
ttggctttagacctgagactgt

SEQ ID NO: 7965541 - DNA, 22 bp, Homo sapiens
ttggctttagacctgagactgt

SEQ ID NO: 7965542 - DNA, 22 bp, Homo sapiens
ttggctttacaagcagtggcac

SEQ ID NO: 7965543 - DNA, 22 bp, Homo sapiens
ttggctttctctgtatctgaat

SEQ ID NO: 7965544 - DNA, 22 bp, Homo sapiens
ttggctttcaggctggaaatct

SEQ ID NO: 7965545 - DNA, 22 bp, Homo sapiens
ttggctttcaggctggaaatct

SEQ ID NO: 7965546 - DNA, 22 bp, Homo sapiens
ttggctttcagaatccctatct

SEQ ID NO: 7965547 - DNA, 22 bp, Homo sapiens
ttggcttgatgactggcagtgt

SEQ ID NO: 7965548 - DNA, 22 bp, Homo sapiens
ttggcttcttttctagacagaa

SEQ ID NO: 7965549 - DNA, 22 bp, Homo sapiens
ttggcttcttttctagacagaa

SEQ ID NO: 7965550 - DNA, 18 bp, Homo sapiens
ttggcttctttccttcct

SEQ ID NO: 7965551 - DNA, 22 bp, Homo sapiens
ttggcttcttttctagacagaa

SEQ ID NO: 7965552 - DNA, 22 bp, Homo sapiens
ttggcttctttagtcagtttgg

SEQ ID NO: 7965553 - DNA, 22 bp, Homo sapiens
ttggcttctgttttggctctgt

SEQ ID NO: 7965554 - DNA, 22 bp, Homo sapiens
ttggcttctgatgtattcctga

SEQ ID NO: 7965555 - DNA, 22 bp, Homo sapiens
ttggcttctgttttggctctgt

SEQ ID NO: 7965556 - DNA, 22 bp, Homo sapiens
ttggcttcttataatgcaatag

SEQ ID NO: 7965557 - DNA, 22 bp, Homo sapiens
ttggcttcttgtgaaatctgag

SEQ ID NO: 7965558 - DNA, 22 bp, Homo sapiens
ttggcttcttcgcacagcagta

SEQ ID NO: 7965559 - DNA, 22 bp, Homo sapiens
ttggcttcttcgcacagcagta

SEQ ID NO: 7965560 - DNA, 22 bp, Homo sapiens
ttggcttcttcgcacagcagta

SEQ ID NO: 7965561 - DNA, 22 bp, Homo sapiens
ttggcttcattgatctcacttt

SEQ ID NO: 7965562 - DNA, 22 bp, Homo sapiens
ttggcttcattgatctcacttt

SEQ ID NO: 7965563 - DNA, 22 bp, Homo sapiens
ttggcttcaatgtcagagacag

SEQ ID NO: 7965564 - DNA, 22 bp, Homo sapiens
ttggcttccaggatctcagcag

SEQ ID NO: 7965565 - DNA, 22 bp, Homo sapiens
ttggcttcaatgtcagagacag

SEQ ID NO: 7965566 - DNA, 22 bp, Homo sapiens
ttggcttcccagagcttacgct

SEQ ID NO: 7965567 - DNA, 22 bp, Homo sapiens
ttggcttccaggatctcagcag

SEQ ID NO: 7965568 - DNA, 22 bp, Homo sapiens
ttggcttccaggggcttttaca

SEQ ID NO: 7965569 - DNA, 22 bp, Homo sapiens
ttggccctggggccagcttcga

SEQ ID NO: 7965570 - DNA, 22 bp, Homo sapiens
ttggccctggggccagcttcga

SEQ ID NO: 7965571 - DNA, 22 bp, Homo sapiens
ttggccctgaggttatcatcta

SEQ ID NO: 7965572 - DNA, 22 bp, Homo sapiens
ttggccctggcacacccccacg

SEQ ID NO: 7965573 - DNA, 22 bp, Homo sapiens
ttggccctagatgattaagttg

SEQ ID NO: 7965574 - DNA, 22 bp, Homo sapiens
ttggccctccacctggctgtgc

SEQ ID NO: 7965575 - DNA, 22 bp, Homo sapiens
ttggccctgaggaggcagctgc

SEQ ID NO: 7965576 - DNA, 22 bp, Homo sapiens
ttggccctgaggaggcagctgc

SEQ ID NO: 7965577 - DNA, 22 bp, Homo sapiens
ttggcctcatggacagctcatc

SEQ ID NO: 7965578 - DNA, 22 bp, Homo sapiens
ttggccctggggccagcttcga

SEQ ID NO: 7965579 - DNA, 17 bp, Homo sapiens
ttggcctcttgacattt

SEQ ID NO: 7965580 - DNA, 22 bp, Homo sapiens
ttggcctccacattttccaggt

SEQ ID NO: 7965581 - DNA, 22 bp, Homo sapiens
ttggcctccacattttccaggt

SEQ ID NO: 7965582 - DNA, 22 bp, Homo sapiens
ttggccctttatgggatgggca

SEQ ID NO: 7965583 - DNA, 22 bp, Homo sapiens
ttggccctttatgggatgggca

SEQ ID NO: 7965584 - DNA, 22 bp, Homo sapiens
ttggccttctctgacactgccc

SEQ ID NO: 7965585 - DNA, 22 bp, Homo sapiens
ttggccttctcttcccggtcct

SEQ ID NO: 7965586 - DNA, 19 bp, Homo sapiens
ttggccttgtttcatatct

SEQ ID NO: 7965587 - DNA, 22 bp, Homo sapiens
ttggccttgtctggtcttctcc

SEQ ID NO: 7965588 - DNA, 22 bp, Homo sapiens
ttggccttgtcacttcattact

SEQ ID NO: 7965589 - DNA, 22 bp, Homo sapiens
ttggccttgtacatcatattaa

SEQ ID NO: 7965590 - DNA, 17 bp, Homo sapiens
ttggccttctagcctct

SEQ ID NO: 7965591 - DNA, 22 bp, Homo sapiens
ttggccttagcttcttcttaaa

SEQ ID NO: 7965592 - DNA, 22 bp, Homo sapiens
ttggccttccctacctgggcca

SEQ ID NO: 7965593 - DNA, 22 bp, Homo sapiens
ttggccttacgcatggtcggca

SEQ ID NO: 7965594 - DNA, 22 bp, Homo sapiens
ttggcctctcccatactgtcca

SEQ ID NO: 7965595 - DNA, 22 bp, Homo sapiens
ttggcctgctccagagaggcca

SEQ ID NO: 7965596 - DNA, 22 bp, Homo sapiens
ttggcccagcatgcgggtctgt

SEQ ID NO: 7965597 - DNA, 22 bp, Homo sapiens
ttggcccagactcggggactga

SEQ ID NO: 7965598 - DNA, 20 bp, Homo sapiens
ttggcagcagctcagccacc

SEQ ID NO: 7965599 - DNA, 22 bp, Homo sapiens
ttggcccagactcggggactga

SEQ ID NO: 7965600 - DNA, 22 bp, Homo sapiens
ttggcccagggtcagcggcgct

SEQ ID NO: 7965601 - DNA, 22 bp, Homo sapiens
ttggcccagcatgcgggtctgt

SEQ ID NO: 7965602 - DNA, 22 bp, Homo sapiens
ttggccctagatgattaagttg

SEQ ID NO: 7965603 - DNA, 22 bp, Homo sapiens
ttggccctagactctaagtccg

SEQ ID NO: 7965604 - DNA, 20 bp, Homo sapiens
ttggcagcagctcagccacc

SEQ ID NO: 7965605 - DNA, 22 bp, Homo sapiens
ttggcagcagagtgtggtgctc

SEQ ID NO: 7965606 - DNA, 22 bp, Homo sapiens
ttggcagcacggggaacgtctg

SEQ ID NO: 7965607 - DNA, 22 bp, Homo sapiens
ttggcagcaagaggctcttctg

SEQ ID NO: 7965608 - DNA, 22 bp, Homo sapiens
ttggcagatggattcaacatta

SEQ ID NO: 7965609 - DNA, 22 bp, Homo sapiens
ttggcagagggaccagcctaca

SEQ ID NO: 7965610 - DNA, 22 bp, Homo sapiens
ttggcagagccccagccttgga

SEQ ID NO: 7965611 - DNA, 22 bp, Homo sapiens
ttggcagagccccagccttgga

SEQ ID NO: 7965612 - DNA, 22 bp, Homo sapiens
ttggcagactgggtcctgggga

SEQ ID NO: 7965613 - DNA, 22 bp, Homo sapiens
ttggcagagagtatgctgaaga

SEQ ID NO: 7965614 - DNA, 22 bp, Homo sapiens
ttggcagaggggtttctggtgg

SEQ ID NO: 7965615 - DNA, 22 bp, Homo sapiens
ttggcagaggggccacctgccc

SEQ ID NO: 7965616 - DNA, 22 bp, Homo sapiens
ttggcagaggggccacctgccc

SEQ ID NO: 7965617 - DNA, 22 bp, Homo sapiens
ttggcagatgaacacaactgga

SEQ ID NO: 7965618 - DNA, 22 bp, Homo sapiens
ttggcagaggtctcgttgtggc

SEQ ID NO: 7965619 - DNA, 22 bp, Homo sapiens
ttggctaacctgggttatcagc

SEQ ID NO: 7965620 - DNA, 22 bp, Homo sapiens
ttggctaacacgcgttttgttc

SEQ ID NO: 7965621 - DNA, 22 bp, Homo sapiens
ttggctcaaaacttagattcca

SEQ ID NO: 7965622 - DNA, 22 bp, Homo sapiens
ttggctcaaaacttagattcca

SEQ ID NO: 7965623 - DNA, 22 bp, Homo sapiens
ttggctatgcttgtgttcagtt

SEQ ID NO: 7965624 - DNA, 22 bp, Homo sapiens
ttggctcacaaggacggttgct

SEQ ID NO: 7965625 - DNA, 22 bp, Homo sapiens
ttggctcacaaggacggttgct

SEQ ID NO: 7965626 - DNA, 21 bp, Homo sapiens
ttggcctttgtctcagacact

SEQ ID NO: 7965627 - DNA, 22 bp, Homo sapiens
ttggcctttggactctgggact

SEQ ID NO: 7965628 - DNA, 22 bp, Homo sapiens
ttggcctttattctgtacttct

SEQ ID NO: 7965629 - DNA, 22 bp, Homo sapiens
ttggcctttaaactggactttc

SEQ ID NO: 7965630 - DNA, 22 bp, Homo sapiens
ttggctcagctgggactgttga

SEQ ID NO: 7965631 - DNA, 22 bp, Homo sapiens
ttggctcaggacccctgtgact

SEQ ID NO: 7965632 - DNA, 22 bp, Homo sapiens
ttggctcaggacccctgtgact

SEQ ID NO: 7965633 - DNA, 22 bp, Homo sapiens
ttggctcaggctttcattgtaa

SEQ ID NO: 7965634 - DNA, 22 bp, Homo sapiens
ttggctcagcatcttggtgcca

SEQ ID NO: 7965635 - DNA, 20 bp, Homo sapiens
ttggctcagatttttatggg

SEQ ID NO: 7965636 - DNA, 22 bp, Homo sapiens
ttggctcagcatcttggtgcca

SEQ ID NO: 7965637 - DNA, 22 bp, Homo sapiens
ttggctcagctgggactgttga

SEQ ID NO: 7965638 - DNA, 22 bp, Homo sapiens
ttggctcagctgggactgttga

SEQ ID NO: 7965639 - DNA, 22 bp, Homo sapiens
ttggctcacctgtctacccaga

SEQ ID NO: 7965640 - DNA, 22 bp, Homo sapiens
ttggctcacctgtctacccaga

SEQ ID NO: 7965641 - DNA, 20 bp, Homo sapiens
ttggctcagatttttatggg

SEQ ID NO: 7965642 - DNA, 22 bp, Homo sapiens
ttggctcacctggagcctgttg

SEQ ID NO: 7965643 - DNA, 20 bp, Homo sapiens
ttggctcagatttttatggg

SEQ ID NO: 7965644 - DNA, 22 bp, Homo sapiens
ttggctcacatgattatggagg

SEQ ID NO: 7965645 - DNA, 22 bp, Homo sapiens
ttggctcacctggagcctgttg

SEQ ID NO: 7965646 - DNA, 22 bp, Homo sapiens
ttggctcacctggagcctgttg

SEQ ID NO: 7965647 - DNA, 22 bp, Homo sapiens
ttggctcacatgattatggagg

SEQ ID NO: 7965648 - DNA, 22 bp, Homo sapiens
ttggctcacaaggacggttgct

SEQ ID NO: 7965649 - DNA, 22 bp, Homo sapiens
ttggctcacatgattatggagg

SEQ ID NO: 7965650 - DNA, 22 bp, Homo sapiens
ttggctggtttcaagaaggcat

SEQ ID NO: 7965651 - DNA, 22 bp, Homo sapiens
ttggctggtttcaagaaggcat

SEQ ID NO: 7965652 - DNA, 22 bp, Homo sapiens
ttggctggtttcaagaaggcat

SEQ ID NO: 7965653 - DNA, 22 bp, Homo sapiens
ttggctggtttcaagaaggcat

SEQ ID NO: 7965654 - DNA, 22 bp, Homo sapiens
ttggctggttttgagtatgtgc

SEQ ID NO: 7965655 - DNA, 22 bp, Homo sapiens
ttggctggtttcaagaaggcat

SEQ ID NO: 7965656 - DNA, 22 bp, Homo sapiens
ttggctggttttgagtatgtgc

SEQ ID NO: 7965657 - DNA, 22 bp, Homo sapiens
ttggctgtatgtacatctgtta

SEQ ID NO: 7965658 - DNA, 22 bp, Homo sapiens
ttggctgtatgtacatctgtta

SEQ ID NO: 7965659 - DNA, 22 bp, Homo sapiens
ttggctggttttgagtatgtgc

SEQ ID NO: 7965660 - DNA, 22 bp, Homo sapiens
ttggctgtgaaagcttctcaaa

SEQ ID NO: 7965661 - DNA, 22 bp, Homo sapiens
ttggctgtgaaagcttctcaaa

SEQ ID NO: 7965662 - DNA, 22 bp, Homo sapiens
ttggctgtatgtacatctgtta

SEQ ID NO: 7965663 - DNA, 22 bp, Homo sapiens
ttggctgtcactgtcagttcag

SEQ ID NO: 7965664 - DNA, 22 bp, Homo sapiens
ttggctggtaagccaaatgaaa

SEQ ID NO: 7965665 - DNA, 22 bp, Homo sapiens
ttggctggtaagccaaatgaaa

SEQ ID NO: 7965666 - DNA, 22 bp, Homo sapiens
ttggctggtttcaagaaggcat

SEQ ID NO: 7965667 - DNA, 22 bp, Homo sapiens
ttggctgggcacagtgtctcat

SEQ ID NO: 7965668 - DNA, 22 bp, Homo sapiens
ttggctgggcacagtgtctcat

SEQ ID NO: 7965669 - DNA, 22 bp, Homo sapiens
ttggctggtaagccaaatgaaa

SEQ ID NO: 7965670 - DNA, 22 bp, Homo sapiens
ttggctggcttctcgacttgtt

SEQ ID NO: 7965671 - DNA, 22 bp, Homo sapiens
ttggctggctacctgggccgag

SEQ ID NO: 7965672 - DNA, 22 bp, Homo sapiens
ttggctgggcacagtgtctcat

SEQ ID NO: 7965673 - DNA, 22 bp, Homo sapiens
ttggctggcttctcgacttgtt

SEQ ID NO: 7965674 - DNA, 22 bp, Homo sapiens
ttggctgctttactctgacggg

SEQ ID NO: 7965675 - DNA, 22 bp, Homo sapiens
ttggctgctggtctttggatat

SEQ ID NO: 7965676 - DNA, 22 bp, Homo sapiens
ttggctcatgctgttttgtgca

SEQ ID NO: 7965677 - DNA, 22 bp, Homo sapiens
ttggctcattaaagatgataat

SEQ ID NO: 7965678 - DNA, 22 bp, Homo sapiens
ttggctcccactaactccagca

SEQ ID NO: 7965679 - DNA, 22 bp, Homo sapiens
ttggctcccactaactccagca

SEQ ID NO: 7965680 - DNA, 22 bp, Homo sapiens
ttggctcccactaactccagca

SEQ ID NO: 7965681 - DNA, 22 bp, Homo sapiens
ttggctcctgttcctctgtctg

SEQ ID NO: 7965682 - DNA, 20 bp, Homo sapiens
ttggctcatgcaacacctac

SEQ ID NO: 7965683 - DNA, 20 bp, Homo sapiens
ttggctcatgcaacacctac

SEQ ID NO: 7965684 - DNA, 20 bp, Homo sapiens
ttggctcatgcaacacctac

SEQ ID NO: 7965685 - DNA, 22 bp, Homo sapiens
ttggctcatgctgttttgtgca

SEQ ID NO: 7965686 - DNA, 22 bp, Homo sapiens
ttggctcattaaagatgataat

SEQ ID NO: 7965687 - DNA, 22 bp, Homo sapiens
ttggctcaggctttcattgtaa

SEQ ID NO: 7965688 - DNA, 22 bp, Homo sapiens
ttggctcagtgtgagggagatg

SEQ ID NO: 7965689 - DNA, 22 bp, Homo sapiens
ttggctcaggctttcattgtaa

SEQ ID NO: 7965690 - DNA, 22 bp, Homo sapiens
ttggctcagtgtgagggagatg

SEQ ID NO: 7965691 - DNA, 22 bp, Homo sapiens
ttggctcagtgtgagggagatg

SEQ ID NO: 7965692 - DNA, 22 bp, Homo sapiens
ttgtgctctgtgttatttaagg

SEQ ID NO: 7965693 - DNA, 22 bp, Homo sapiens
ttgtgctctgtgttatttaagg

SEQ ID NO: 7965694 - DNA, 22 bp, Homo sapiens
ttgtgctctgtgttatttaagg

SEQ ID NO: 7965695 - DNA, 22 bp, Homo sapiens
ttgtgctctgtgttatttaagg

SEQ ID NO: 7965696 - DNA, 22 bp, Homo sapiens
ttgtgctctgtgttatttaagg

SEQ ID NO: 7965697 - DNA, 22 bp, Homo sapiens
ttgtgctctgtgttatttaagg

SEQ ID NO: 7965698 - DNA, 22 bp, Homo sapiens
ttgtgctgcgtaggacgtggac

SEQ ID NO: 7965699 - DNA, 22 bp, Homo sapiens
ttgtgctgagcttctagctgtg

SEQ ID NO: 7965700 - DNA, 22 bp, Homo sapiens
ttgtgctctgtgttatttaagg

SEQ ID NO: 7965701 - DNA, 22 bp, Homo sapiens
ttgtgctctgtgttatttaagg

SEQ ID NO: 7965702 - DNA, 22 bp, Homo sapiens
ttgtgctgactgcgcccagctc

SEQ ID NO: 7965703 - DNA, 22 bp, Homo sapiens
ttgtgctcttattgtgcaggga

SEQ ID NO: 7965704 - DNA, 22 bp, Homo sapiens
ttgtgctcctatgagaatctaa

SEQ ID NO: 7965705 - DNA, 22 bp, Homo sapiens
ttgtgctcctatgagaatctaa

SEQ ID NO: 7965706 - DNA, 22 bp, Homo sapiens
ttgtgctcctgtgagaatctag

SEQ ID NO: 7965707 - DNA, 22 bp, Homo sapiens
ttgtgctcctgtgagaatctag

SEQ ID NO: 7965708 - DNA, 22 bp, Homo sapiens
ttgtgctcctgtgagaatctag

SEQ ID NO: 7965709 - DNA, 22 bp, Homo sapiens
ttgtggaagccctatgagagac

SEQ ID NO: 7965710 - DNA, 22 bp, Homo sapiens
ttgtggaaatacagactccaag

SEQ ID NO: 7965711 - DNA, 22 bp, Homo sapiens
ttgtggaagccctatgagagac

SEQ ID NO: 7965712 - DNA, 22 bp, Homo sapiens
ttgtgcttaagcaagctttctt

SEQ ID NO: 7965713 - DNA, 22 bp, Homo sapiens
ttgtgctttggaacagaatcct

SEQ ID NO: 7965714 - DNA, 22 bp, Homo sapiens
ttgtgctgtgagaatgctcatt

SEQ ID NO: 7965715 - DNA, 22 bp, Homo sapiens
ttgtgctgtatcatatttgtat

SEQ ID NO: 7965716 - DNA, 22 bp, Homo sapiens
ttgtgctgcgtaggacgtggac

SEQ ID NO: 7965717 - DNA, 22 bp, Homo sapiens
ttgtgctgctgacttaagatat

SEQ ID NO: 7965718 - DNA, 22 bp, Homo sapiens
ttgttctatggtgaggcagcca

SEQ ID NO: 7965719 - DNA, 22 bp, Homo sapiens
ttgttctatggtgaggcagcca

SEQ ID NO: 7965720 - DNA, 22 bp, Homo sapiens
ttgttcttacttaagagtgaat

SEQ ID NO: 7965721 - DNA, 22 bp, Homo sapiens
ttgttcttacttaagagtgaat

SEQ ID NO: 7965722 - DNA, 22 bp, Homo sapiens
ttgttctatggggtgaagtcta

SEQ ID NO: 7965723 - DNA, 23 bp, Homo sapiens
ttgttctatcaacctagacttag

SEQ ID NO: 7965724 - DNA, 22 bp, Homo sapiens
ttgttctagcctcctgttttga

SEQ ID NO: 7965725 - DNA, 22 bp, Homo sapiens
ttgttcctttccatttctgagt

SEQ ID NO: 7965726 - DNA, 22 bp, Homo sapiens
ttgttcatcgtccttgctctgt

SEQ ID NO: 7965727 - DNA, 21 bp, Homo sapiens
ttgttcctatctgcctcctgc

SEQ ID NO: 7965728 - DNA, 19 bp, Homo sapiens
ttgttcattgtgtgtcctt

SEQ ID NO: 7965729 - DNA, 22 bp, Homo sapiens
ttgttcattagcgcttgggcac

SEQ ID NO: 7965730 - DNA, 20 bp, Homo sapiens
ttgttcattgagctgttttc

SEQ ID NO: 7965731 - DNA, 22 bp, Homo sapiens
ttgttatttacaacaatcctat

SEQ ID NO: 7965732 - DNA, 22 bp, Homo sapiens
ttgttatttaggtctgggttag

SEQ ID NO: 7965733 - DNA, 22 bp, Homo sapiens
ttgttcatcaggtgacacatac

SEQ ID NO: 7965734 - DNA, 22 bp, Homo sapiens
ttgttcatcaggtgacacatac

SEQ ID NO: 7965735 - DNA, 22 bp, Homo sapiens
ttgttcatccaacacaaggttg

SEQ ID NO: 7965736 - DNA, 22 bp, Homo sapiens
ttgttcataaagacagttcaga

SEQ ID NO: 7965737 - DNA, 22 bp, Homo sapiens
ttgttcatcaggtgacacatac

SEQ ID NO: 7965738 - DNA, 22 bp, Homo sapiens
ttgttcactatgaagaggttgg

SEQ ID NO: 7965739 - DNA, 22 bp, Homo sapiens
ttgtgagatgatttgaaagtgt

SEQ ID NO: 7965740 - DNA, 22 bp, Homo sapiens
ttgtgagagtttaccttgacca

SEQ ID NO: 7965741 - DNA, 22 bp, Homo sapiens
ttgtgagatgtctactgaagaa

SEQ ID NO: 7965742 - DNA, 22 bp, Homo sapiens
ttgtgagatgtctactgaagaa

SEQ ID NO: 7965743 - DNA, 22 bp, Homo sapiens
ttgtgagatgatttgaaagtgt

SEQ ID NO: 7965744 - DNA, 22 bp, Homo sapiens
ttgtgagtagtgccgcaataaa

SEQ ID NO: 7965745 - DNA, 22 bp, Homo sapiens
ttgtgagtagtgccgcaataaa

SEQ ID NO: 7965746 - DNA, 22 bp, Homo sapiens
ttgtgagacacaaatcaatgca

SEQ ID NO: 7965747 - DNA, 23 bp, Homo sapiens
ttgtgagaccttggaagaagtat

SEQ ID NO: 7965748 - DNA, 22 bp, Homo sapiens
ttgtgagactcgtaagagaagg

SEQ ID NO: 7965749 - DNA, 22 bp, Homo sapiens
ttgtgagactcgtaagagaagg

SEQ ID NO: 7965750 - DNA, 22 bp, Homo sapiens
ttgtgagagaaaatgtgtatat

SEQ ID NO: 7965751 - DNA, 22 bp, Homo sapiens
ttgtgagagaaaatgtgtatat

SEQ ID NO: 7965752 - DNA, 22 bp, Homo sapiens
ttgtgagagccaaacatgtaag

SEQ ID NO: 7965753 - DNA, 22 bp, Homo sapiens
ttgtgagagtttaccttgacca

SEQ ID NO: 7965754 - DNA, 22 bp, Homo sapiens
ttgtgagagccaaacatgtaag

SEQ ID NO: 7965755 - DNA, 22 bp, Homo sapiens
ttgtgatactgagcttggcatt

SEQ ID NO: 7965756 - DNA, 22 bp, Homo sapiens
ttgtgataacagaattcactct

SEQ ID NO: 7965757 - DNA, 22 bp, Homo sapiens
ttgtgataaaacattagacatt

SEQ ID NO: 7965758 - DNA, 22 bp, Homo sapiens
ttgtgcaagaagccagcaccaa

SEQ ID NO: 7965759 - DNA, 22 bp, Homo sapiens
ttgtgcaagaagccagcaccaa

SEQ ID NO: 7965760 - DNA, 22 bp, Homo sapiens
ttgtgcaagaattggaaagcaa

SEQ ID NO: 7965761 - DNA, 22 bp, Homo sapiens
ttgtgcagagttgcctttattt

SEQ ID NO: 7965762 - DNA, 22 bp, Homo sapiens
ttgtgcatattaggtacatgct

SEQ ID NO: 7965763 - DNA, 19 bp, Homo sapiens
ttgtgcatatgcagtgcat

SEQ ID NO: 7965764 - DNA, 22 bp, Homo sapiens
ttgtgcatgcatacgtatgtgt

SEQ ID NO: 7965765 - DNA, 22 bp, Homo sapiens
ttgtgcatggagaaggcagggc

SEQ ID NO: 7965766 - DNA, 22 bp, Homo sapiens
ttgtgcattgcagcagtgcttt

SEQ ID NO: 7965767 - DNA, 22 bp, Homo sapiens
ttgtgcatggctactttttatg

SEQ ID NO: 7965768 - DNA, 22 bp, Homo sapiens
ttgtgcatttctctgagtgtgt

SEQ ID NO: 7965769 - DNA, 22 bp, Homo sapiens
ttgtgctaagtgctatgaaggc

SEQ ID NO: 7965770 - DNA, 22 bp, Homo sapiens
ttgtgcctggcttgtattcaca

SEQ ID NO: 7965771 - DNA, 22 bp, Homo sapiens
ttgtgctcctatgagaatctaa

SEQ ID NO: 7965772 - DNA, 22 bp, Homo sapiens
ttgtgcccgggcccgggcctct

SEQ ID NO: 7965773 - DNA, 22 bp, Homo sapiens
ttgtgccctcaaagggtgcgtc

SEQ ID NO: 7965774 - DNA, 22 bp, Homo sapiens
ttgtgcccagaagaaagtgatt

SEQ ID NO: 7965775 - DNA, 22 bp, Homo sapiens
ttgtattaaaatgtgtttctgt

SEQ ID NO: 7965776 - DNA, 22 bp, Homo sapiens
ttgtattaaaatgtgtttctgt

SEQ ID NO: 7965777 - DNA, 22 bp, Homo sapiens
ttgtattaattgaaatgaatgc

SEQ ID NO: 7965778 - DNA, 22 bp, Homo sapiens
ttgtattaattgaaatgaatgc

SEQ ID NO: 7965779 - DNA, 22 bp, Homo sapiens
ttgtattagtaagtcagctgct

SEQ ID NO: 7965780 - DNA, 22 bp, Homo sapiens
ttgtattagctgtaaattttct

SEQ ID NO: 7965781 - DNA, 22 bp, Homo sapiens
ttgtattagctgtaaattttct

SEQ ID NO: 7965782 - DNA, 22 bp, Homo sapiens
ttgtattagctgtaaattttct

SEQ ID NO: 7965783 - DNA, 22 bp, Homo sapiens
ttgtattagctgtaaattttct

SEQ ID NO: 7965784 - DNA, 22 bp, Homo sapiens
ttgtatttcctataacctttct

SEQ ID NO: 7965785 - DNA, 22 bp, Homo sapiens
ttgtatttatattgaatagctt

SEQ ID NO: 7965786 - DNA, 22 bp, Homo sapiens
ttgtatttcctataacctttct

SEQ ID NO: 7965787 - DNA, 22 bp, Homo sapiens
ttgtatttcctataacctttct

SEQ ID NO: 7965788 - DNA, 22 bp, Homo sapiens
ttgtatttatattgaatagctt

SEQ ID NO: 7965789 - DNA, 22 bp, Homo sapiens
ttgtattggcaaagaacttgag

SEQ ID NO: 7965790 - DNA, 22 bp, Homo sapiens
ttgtatttatattgaatagctt

SEQ ID NO: 7965791 - DNA, 22 bp, Homo sapiens
ttgtatttatattgaatagctt

SEQ ID NO: 7965792 - DNA, 22 bp, Homo sapiens
ttgtattcttccttagcagtac

SEQ ID NO: 7965793 - DNA, 20 bp, Homo sapiens
ttgtattccttgaatcaggt

SEQ ID NO: 7965794 - DNA, 22 bp, Homo sapiens
ttgtattcctgggtcaaggaga

SEQ ID NO: 7965795 - DNA, 22 bp, Homo sapiens
ttgtatcagtgcctataaaatg

SEQ ID NO: 7965796 - DNA, 22 bp, Homo sapiens
ttgtatcagtgcctataaaatg

SEQ ID NO: 7965797 - DNA, 22 bp, Homo sapiens
ttgtatcactccaccagctgag

SEQ ID NO: 7965798 - DNA, 20 bp, Homo sapiens
ttgtatcagtgtctcccaaa

SEQ ID NO: 7965799 - DNA, 22 bp, Homo sapiens
ttgtatcagttagctattgctg

SEQ ID NO: 7965800 - DNA, 23 bp, Homo sapiens
ttgtatctctggaaattcttcaa

SEQ ID NO: 7965801 - DNA, 22 bp, Homo sapiens
ttgtatgaatgtatcctaattt

SEQ ID NO: 7965802 - DNA, 22 bp, Homo sapiens
ttgtatgagctccaggaactca

SEQ ID NO: 7965803 - DNA, 22 bp, Homo sapiens
ttgtatgaggatagcaagaagc

SEQ ID NO: 7965804 - DNA, 22 bp, Homo sapiens
ttgtatgatcaaaagaaatgta

SEQ ID NO: 7965805 - DNA, 22 bp, Homo sapiens
ttgtatgagtatggtgtatagg

SEQ ID NO: 7965806 - DNA, 22 bp, Homo sapiens
ttgtatgatcccatttagtgaa

SEQ ID NO: 7965807 - DNA, 22 bp, Homo sapiens
ttgtatgatcaaaagaaatgta

SEQ ID NO: 7965808 - DNA, 22 bp, Homo sapiens
ttgtatatattcttaaagatgt

SEQ ID NO: 7965809 - DNA, 22 bp, Homo sapiens
ttgtatatattcttaaagatgt

SEQ ID NO: 7965810 - DNA, 22 bp, Homo sapiens
ttgtatatattcttaaagatgt

SEQ ID NO: 7965811 - DNA, 22 bp, Homo sapiens
ttgtatagcccagagagtgaga

SEQ ID NO: 7965812 - DNA, 22 bp, Homo sapiens
ttgtatagcccagagagtgaga

SEQ ID NO: 7965813 - DNA, 22 bp, Homo sapiens
ttgtatacattatcctgtttca

SEQ ID NO: 7965814 - DNA, 22 bp, Homo sapiens
ttgtatagcccagagagtgaga

SEQ ID NO: 7965815 - DNA, 22 bp, Homo sapiens
ttgtagctgaaagtaaagaagt

SEQ ID NO: 7965816 - DNA, 22 bp, Homo sapiens
ttgtagctaggtttttgtagaa

SEQ ID NO: 7965817 - DNA, 22 bp, Homo sapiens
ttgtagcaagcttgtaagttca

SEQ ID NO: 7965818 - DNA, 22 bp, Homo sapiens
ttgtagattggagagtgtgtga

SEQ ID NO: 7965819 - DNA, 22 bp, Homo sapiens
ttgtagaatttggatctcggca

SEQ ID NO: 7965820 - DNA, 22 bp, Homo sapiens
ttgtagaatttggatctcggca

SEQ ID NO: 7965821 - DNA, 22 bp, Homo sapiens
ttgtagaatcattatttctagt

SEQ ID NO: 7965822 - DNA, 22 bp, Homo sapiens
ttgtagagtacacaacacttgg

SEQ ID NO: 7965823 - DNA, 22 bp, Homo sapiens
ttgtagaggaaagggaatggat

SEQ ID NO: 7965824 - DNA, 22 bp, Homo sapiens
ttgtagatataaattttattgt

SEQ ID NO: 7965825 - DNA, 22 bp, Homo sapiens
ttgtagatgtgtttttatctca

SEQ ID NO: 7965826 - DNA, 22 bp, Homo sapiens
ttgtagatggcttatttctgtg

SEQ ID NO: 7965827 - DNA, 22 bp, Homo sapiens
ttgtagaaaattagatgcatgg

SEQ ID NO: 7965828 - DNA, 22 bp, Homo sapiens
ttgtagaaaattctcttggata

SEQ ID NO: 7965829 - DNA, 22 bp, Homo sapiens
ttgtagaaaattctcttggata

SEQ ID NO: 7965830 - DNA, 22 bp, Homo sapiens
ttgtagaacatgcagcacaatg

SEQ ID NO: 7965831 - DNA, 22 bp, Homo sapiens
ttgtagaacatgcagcacaatg

SEQ ID NO: 7965832 - DNA, 22 bp, Homo sapiens
ttgtagaatcattatttctagt

SEQ ID NO: 7965833 - DNA, 22 bp, Homo sapiens
ttgtactgtggatctgtatttg

SEQ ID NO: 7965834 - DNA, 22 bp, Homo sapiens
ttgtacttacattttaaagcta

SEQ ID NO: 7965835 - DNA, 22 bp, Homo sapiens
ttgtacttacattttaaagcta

SEQ ID NO: 7965836 - DNA, 22 bp, Homo sapiens
ttggggtcccacaggctgcctg

SEQ ID NO: 7965837 - DNA, 22 bp, Homo sapiens
ttggggtcccacaggctgcctg

SEQ ID NO: 7965838 - DNA, 22 bp, Homo sapiens
ttggggggttgaggagtagata

SEQ ID NO: 7965839 - DNA, 22 bp, Homo sapiens
ttggggggttgaggagtagata

SEQ ID NO: 7965840 - DNA, 22 bp, Homo sapiens
ttggggggttgaggagtagata

SEQ ID NO: 7965841 - DNA, 18 bp, Homo sapiens
ttggggtgaggccaggaa

SEQ ID NO: 7965842 - DNA, 18 bp, Homo sapiens
ttggggtgaggccaggaa

SEQ ID NO: 7965843 - DNA, 22 bp, Homo sapiens
ttgtactggttttgaaatgagc

SEQ ID NO: 7965844 - DNA, 18 bp, Homo sapiens
ttggggtgaggccaggaa

SEQ ID NO: 7965845 - DNA, 18 bp, Homo sapiens
ttggggtgaggccaggaa

SEQ ID NO: 7965846 - DNA, 22 bp, Homo sapiens
ttggggtcccacaggctgcctg

SEQ ID NO: 7965847 - DNA, 19 bp, Homo sapiens
ttggggtgaatgccagaca

SEQ ID NO: 7965848 - DNA, 22 bp, Homo sapiens
ttgggggcatattgagtagtgg

SEQ ID NO: 7965849 - DNA, 22 bp, Homo sapiens
ttgggggcatattgagtagtgg

SEQ ID NO: 7965850 - DNA, 22 bp, Homo sapiens
ttgggggcatattgagtagtgg

SEQ ID NO: 7965851 - DNA, 22 bp, Homo sapiens
ttgggggcatattgagtagtgg

SEQ ID NO: 7965852 - DNA, 22 bp, Homo sapiens
ttgggggcagagggagcatctg

SEQ ID NO: 7965853 - DNA, 22 bp, Homo sapiens
ttgggggcagagggagcatctg

SEQ ID NO: 7965854 - DNA, 22 bp, Homo sapiens
ttgggggcagagggagcatctg

SEQ ID NO: 7965855 - DNA, 22 bp, Homo sapiens
ttggggcatgattagattatga

SEQ ID NO: 7965856 - DNA, 22 bp, Homo sapiens
ttgggggaagaggatagacagt

SEQ ID NO: 7965857 - DNA, 22 bp, Homo sapiens
ttggggctctgaaaaagatgta

SEQ ID NO: 7965858 - DNA, 22 bp, Homo sapiens
ttggggcagttattctgtgccc

SEQ ID NO: 7965859 - DNA, 20 bp, Homo sapiens
ttggggcatccaccgaatgg

SEQ ID NO: 7965860 - DNA, 20 bp, Homo sapiens
ttggggcatccaccgaatgg

SEQ ID NO: 7965861 - DNA, 22 bp, Homo sapiens
ttgaggtcttgagtactgggga

SEQ ID NO: 7965862 - DNA, 22 bp, Homo sapiens
ttgaggtctttgagcaaacgca

SEQ ID NO: 7965863 - DNA, 22 bp, Homo sapiens
ttgagtaccttggattacaggt

SEQ ID NO: 7965864 - DNA, 22 bp, Homo sapiens
ttgagtacaaactcagcctgag

SEQ ID NO: 7965865 - DNA, 22 bp, Homo sapiens
ttgagtaccttggattacaggt

SEQ ID NO: 7965866 - DNA, 22 bp, Homo sapiens
ttgagtactcattttggtgctg

SEQ ID NO: 7965867 - DNA, 22 bp, Homo sapiens
ttgagtactccgggtgcacttg

SEQ ID NO: 7965868 - DNA, 22 bp, Homo sapiens
ttgagtcagtaattccatttct

SEQ ID NO: 7965869 - DNA, 22 bp, Homo sapiens
ttgagtcagtaattccatttct

SEQ ID NO: 7965870 - DNA, 22 bp, Homo sapiens
ttgagtactggctgtgtgccag

SEQ ID NO: 7965871 - DNA, 22 bp, Homo sapiens
ttgcatttcactttcagtaggc

SEQ ID NO: 7965872 - DNA, 22 bp, Homo sapiens
ttgcatttcccattgagtaatg

SEQ ID NO: 7965873 - DNA, 22 bp, Homo sapiens
ttgcatttcactttcagtaggc

SEQ ID NO: 7965874 - DNA, 22 bp, Homo sapiens
ttgcatttcactttcagtaggc

SEQ ID NO: 7965875 - DNA, 19 bp, Homo sapiens
ttgcatttcatgtttgatt

SEQ ID NO: 7965876 - DNA, 22 bp, Homo sapiens
ttgcatttcactttcagtaggc

SEQ ID NO: 7965877 - DNA, 22 bp, Homo sapiens
ttgcatttgacaaattatttaa

SEQ ID NO: 7965878 - DNA, 22 bp, Homo sapiens
ttgcatttgacaaattatttaa

SEQ ID NO: 7965879 - DNA, 22 bp, Homo sapiens
ttgcatttcctgtactgtttga

SEQ ID NO: 7965880 - DNA, 22 bp, Homo sapiens
ttgcatttcccattgagtaatg

SEQ ID NO: 7965881 - DNA, 22 bp, Homo sapiens
ttgcatttgctcatttgatatg

SEQ ID NO: 7965882 - DNA, 22 bp, Homo sapiens
ttgcatttgatcttgggttctc

SEQ ID NO: 7965883 - DNA, 22 bp, Homo sapiens
ttgcatttgagaaagttctcct

SEQ ID NO: 7965884 - DNA, 22 bp, Homo sapiens
ttgcatttgagaaagttctcct

SEQ ID NO: 7965885 - DNA, 22 bp, Homo sapiens
ttgcatttgagaaagttctcct

SEQ ID NO: 7965886 - DNA, 22 bp, Homo sapiens
ttgcatttgacaaattatttaa

SEQ ID NO: 7965887 - DNA, 22 bp, Homo sapiens
ttgaggtattgatattttatga

SEQ ID NO: 7965888 - DNA, 22 bp, Homo sapiens
ttgaggtattgatattttatga

SEQ ID NO: 7965889 - DNA, 20 bp, Homo sapiens
ttgaggtcaaggactaggcc

SEQ ID NO: 7965890 - DNA, 22 bp, Homo sapiens
ttgaggtcaaagaagtgagtgg

SEQ ID NO: 7965891 - DNA, 22 bp, Homo sapiens
ttgaggtcaaagaagtgagtgg

SEQ ID NO: 7965892 - DNA, 22 bp, Homo sapiens
ttgaggtcccaaacccactgag

SEQ ID NO: 7965893 - DNA, 22 bp, Homo sapiens
ttgaggtccagtctccacccac

SEQ ID NO: 7965894 - DNA, 22 bp, Homo sapiens
ttgaggtccaggtgtgggcagg

SEQ ID NO: 7965895 - DNA, 22 bp, Homo sapiens
ttgaggtcatctgaagtactag

SEQ ID NO: 7965896 - DNA, 22 bp, Homo sapiens
ttgaggtcatatatatttggca

SEQ ID NO: 7965897 - DNA, 22 bp, Homo sapiens
ttgaggtcaattctgtttcctg

SEQ ID NO: 7965898 - DNA, 22 bp, Homo sapiens
ttgaggtcaagtaaccactgga

SEQ ID NO: 7965899 - DNA, 22 bp, Homo sapiens
ttgaggtccccagtacccactg

SEQ ID NO: 7965900 - DNA, 22 bp, Homo sapiens
ttgaggtctgagactgtgcagg

SEQ ID NO: 7965901 - DNA, 22 bp, Homo sapiens
ttgaggtctctacagaagagtg

SEQ ID NO: 7965902 - DNA, 22 bp, Homo sapiens
ttgaggtctctacagaagagtg

SEQ ID NO: 7965903 - DNA, 23 bp, Homo sapiens
ttgaggtcggctctctgagcctg

SEQ ID NO: 7965904 - DNA, 22 bp, Homo sapiens
ttgaggtccctgccttgccttc

SEQ ID NO: 7965905 - DNA, 22 bp, Homo sapiens
ttgaggtccaggtgtgggcagg

SEQ ID NO: 7965906 - DNA, 22 bp, Homo sapiens
ttgaggtccccagtacccactg

SEQ ID NO: 7965907 - DNA, 22 bp, Homo sapiens
ttgaggtcttgagtactgggga

SEQ ID NO: 7965908 - DNA, 22 bp, Homo sapiens
ttgaggtcttcattcttgggca

SEQ ID NO: 7965909 - DNA, 22 bp, Homo sapiens
ttgaggtcttcaggatcaggct

SEQ ID NO: 7965910 - DNA, 22 bp, Homo sapiens
ttgaggtcttcattcttgggca

SEQ ID NO: 7965911 - DNA, 22 bp, Homo sapiens
ttgaggtcttcagctgacacct

SEQ ID NO: 7965912 - DNA, 22 bp, Homo sapiens
ttgaggtctgtgtaggcagcaa

SEQ ID NO: 7965913 - DNA, 22 bp, Homo sapiens
ttgaggtctgtgataaaagtca

SEQ ID NO: 7965914 - DNA, 22 bp, Homo sapiens
ttgaggtctggcagtagcgttg

SEQ ID NO: 7965915 - DNA, 22 bp, Homo sapiens
ttgcatttttagatgcttctgt

SEQ ID NO: 7965916 - DNA, 22 bp, Homo sapiens
ttgcattttggttgtaaatatg

SEQ ID NO: 7965917 - DNA, 22 bp, Homo sapiens
ttgcatttttacaagtagccag

SEQ ID NO: 7965918 - DNA, 22 bp, Homo sapiens
ttgcatttttagatgcttctgt

SEQ ID NO: 7965919 - DNA, 22 bp, Homo sapiens
ttgcatttttagatgcttctgt

SEQ ID NO: 7965920 - DNA, 22 bp, Homo sapiens
ttgcatttggttctgcctggta

SEQ ID NO: 7965921 - DNA, 22 bp, Homo sapiens
ttgcatttggttctgcctggta

SEQ ID NO: 7965922 - DNA, 22 bp, Homo sapiens
ttgcatttgtttgagtagaatg

SEQ ID NO: 7965923 - DNA, 22 bp, Homo sapiens
ttgcattttggttgtaaatatg

SEQ ID NO: 7965924 - DNA, 21 bp, Homo sapiens
ttgcattttaagtttactgct

SEQ ID NO: 7965925 - DNA, 22 bp, Homo sapiens
ttgccatcccttacctcagtca

SEQ ID NO: 7965926 - DNA, 22 bp, Homo sapiens
ttgccagggtcaggatgagatc

SEQ ID NO: 7965927 - DNA, 22 bp, Homo sapiens
ttgccagggtcaggatgagatc

SEQ ID NO: 7965928 - DNA, 22 bp, Homo sapiens
ttgccagtgccagcccaggcag

SEQ ID NO: 7965929 - DNA, 22 bp, Homo sapiens
ttgccaggggacatctggagcc

SEQ ID NO: 7965930 - DNA, 22 bp, Homo sapiens
ttgccaggggacatctggagcc

SEQ ID NO: 7965931 - DNA, 22 bp, Homo sapiens
ttgccaggggacatctggagcc

SEQ ID NO: 7965932 - DNA, 22 bp, Homo sapiens
ttgccagggtcaggatgagatc

SEQ ID NO: 7965933 - DNA, 22 bp, Homo sapiens
ttgccagggaacagggagaggc

SEQ ID NO: 7965934 - DNA, 22 bp, Homo sapiens
ttgccagggaacagggagaggc

SEQ ID NO: 7965935 - DNA, 22 bp, Homo sapiens
ttgccagggccagtgggggtgt

SEQ ID NO: 7965936 - DNA, 22 bp, Homo sapiens
ttgccagggccagtgggggtgt

SEQ ID NO: 7965937 - DNA, 22 bp, Homo sapiens
ttgccagggctttggtggcatc

SEQ ID NO: 7965938 - DNA, 22 bp, Homo sapiens
ttgccagggctttggtggcatc

SEQ ID NO: 7965939 - DNA, 22 bp, Homo sapiens
ttgccagggctttggtggcatc

SEQ ID NO: 7965940 - DNA, 22 bp, Homo sapiens
ttgccagggctttggtggcatc

SEQ ID NO: 7965941 - DNA, 22 bp, Homo sapiens
ttgccaggagctcatctgaggg

SEQ ID NO: 7965942 - DNA, 22 bp, Homo sapiens
ttgccaggagctcatctgaggg

SEQ ID NO: 7965943 - DNA, 22 bp, Homo sapiens
ttgccaggagctcatctgaggg

SEQ ID NO: 7965944 - DNA, 22 bp, Homo sapiens
ttgccaggctctggttccagcc

SEQ ID NO: 7965945 - DNA, 22 bp, Homo sapiens
ttgccaggctctggttccagcc

SEQ ID NO: 7965946 - DNA, 22 bp, Homo sapiens
ttgccaggcttgtttctaggct

SEQ ID NO: 7965947 - DNA, 22 bp, Homo sapiens
ttgccagggaacagggagaggc

SEQ ID NO: 7965948 - DNA, 22 bp, Homo sapiens
ttgccagggaacagggagaggc

SEQ ID NO: 7965949 - DNA, 22 bp, Homo sapiens
ttgccaggagacatctggagcc

SEQ ID NO: 7965950 - DNA, 22 bp, Homo sapiens
ttgccaggagacatctggagcc

SEQ ID NO: 7965951 - DNA, 22 bp, Homo sapiens
ttgccaggagacatctggagcc

SEQ ID NO: 7965952 - DNA, 22 bp, Homo sapiens
ttgccaggagagccacttgcag

SEQ ID NO: 7965953 - DNA, 22 bp, Homo sapiens
ttgccaggagagccacttgcag

SEQ ID NO: 7965954 - DNA, 22 bp, Homo sapiens
ttgccaggagacaaagtgggcc

SEQ ID NO: 7965955 - DNA, 22 bp, Homo sapiens
ttgccaggagacaaagtgggcc

SEQ ID NO: 7965956 - DNA, 22 bp, Homo sapiens
ttgctaaaaatggaattatagg

SEQ ID NO: 7965957 - DNA, 22 bp, Homo sapiens
ttgctaaaaatggaattatagg

SEQ ID NO: 7965958 - DNA, 22 bp, Homo sapiens
ttgcggctgcagcagagaatag

SEQ ID NO: 7965959 - DNA, 22 bp, Homo sapiens
ttgctaaaaatggaattatagg

SEQ ID NO: 7965960 - DNA, 22 bp, Homo sapiens
ttgctaaaggattttgtattta

SEQ ID NO: 7965961 - DNA, 22 bp, Homo sapiens
ttgctaaatccctataatattc

SEQ ID NO: 7965962 - DNA, 22 bp, Homo sapiens
ttgctaaaggattttgtattta

SEQ ID NO: 7965963 - DNA, 22 bp, Homo sapiens
ttgctaatagaagatttgggaa

SEQ ID NO: 7965964 - DNA, 22 bp, Homo sapiens
ttgctaagttatagagtatctt

SEQ ID NO: 7965965 - DNA, 22 bp, Homo sapiens
ttgctaacgctcaccctttgcc

SEQ ID NO: 7965966 - DNA, 22 bp, Homo sapiens
ttgctaaatgtttgtttccaga

SEQ ID NO: 7965967 - DNA, 22 bp, Homo sapiens
ttgctaaatgtgttatatctgt

SEQ ID NO: 7965968 - DNA, 22 bp, Homo sapiens
ttgctaaatccctataatattc

SEQ ID NO: 7965969 - DNA, 22 bp, Homo sapiens
ttgctagctggtgtatgcattg

SEQ ID NO: 7965970 - DNA, 22 bp, Homo sapiens
ttgctacatggtttcaaagctg

SEQ ID NO: 7965971 - DNA, 22 bp, Homo sapiens
ttgctaatcatatttcatcact

SEQ ID NO: 7965972 - DNA, 22 bp, Homo sapiens
ttgctaatgccctagaagtatt

SEQ ID NO: 7965973 - DNA, 22 bp, Homo sapiens
ttgctaatcatatttcatcact

SEQ ID NO: 7965974 - DNA, 22 bp, Homo sapiens
ttgctaatgccctagaagtatt

SEQ ID NO: 7965975 - DNA, 22 bp, Homo sapiens
ttgctaatttaactaccttgtt

SEQ ID NO: 7965976 - DNA, 22 bp, Homo sapiens
ttgcttcagagggagacacttt

SEQ ID NO: 7965977 - DNA, 22 bp, Homo sapiens
ttgctcatactcatgttgtgat

SEQ ID NO: 7965978 - DNA, 22 bp, Homo sapiens
ttgctcagtggcagggctggta

SEQ ID NO: 7965979 - DNA, 22 bp, Homo sapiens
ttgcttcagtagctctttaaag

SEQ ID NO: 7965980 - DNA, 19 bp, Homo sapiens
ttgcttcaggctgtgtgct

SEQ ID NO: 7965981 - DNA, 22 bp, Homo sapiens
ttgctcaggctggtgtgcagtg

SEQ ID NO: 7965982 - DNA, 22 bp, Homo sapiens
ttgctcaggcttagagctacta

SEQ ID NO: 7965983 - DNA, 22 bp, Homo sapiens
ttgctcaggctggtgtgcagtg

SEQ ID NO: 7965984 - DNA, 22 bp, Homo sapiens
ttgctcagcactggagccagct

SEQ ID NO: 7965985 - DNA, 22 bp, Homo sapiens
ttgctcagcactggagccagct

SEQ ID NO: 7965986 - DNA, 22 bp, Homo sapiens
ttgctcagcactggagccagct

SEQ ID NO: 7965987 - DNA, 22 bp, Homo sapiens
ttgcttcatcagagtaaacaag

SEQ ID NO: 7965988 - DNA, 22 bp, Homo sapiens
ttgcttcatcagagtaaacaag

SEQ ID NO: 7965989 - DNA, 22 bp, Homo sapiens
ttgcttcattaagttctcacag

SEQ ID NO: 7965990 - DNA, 22 bp, Homo sapiens
ttgcttcctctagtttcttgaa

SEQ ID NO: 7965991 - DNA, 22 bp, Homo sapiens
ttgcttcctcctagccacttgc

SEQ ID NO: 7965992 - DNA, 22 bp, Homo sapiens
ttgcttcattttaaataaagac

SEQ ID NO: 7965993 - DNA, 22 bp, Homo sapiens
ttgccatcccttacctcagtca

SEQ ID NO: 7965994 - DNA, 22 bp, Homo sapiens
ttgccattatcatttatgatac

SEQ ID NO: 7965995 - DNA, 23 bp, Homo sapiens
ttgccattccaaataatttccta

SEQ ID NO: 7965996 - DNA, 22 bp, Homo sapiens
ttgcccagagtcacccagctca

SEQ ID NO: 7965997 - DNA, 22 bp, Homo sapiens
ttgcctcaagattttttattga

SEQ ID NO: 7965998 - DNA, 22 bp, Homo sapiens
ttgcccagagtcacccagctca

SEQ ID NO: 7965999 - DNA, 22 bp, Homo sapiens
ttgcccagagctgcctgttaca

SEQ ID NO: 7966000 - DNA, 22 bp, Homo sapiens
ttgcctgctacggtcttcactg

SEQ ID NO: 7966001 - DNA, 22 bp, Homo sapiens
ttgcctccttttaaggaaatca

SEQ ID NO: 7966002 - DNA, 22 bp, Homo sapiens
ttgcctgattagtctcagattg

SEQ ID NO: 7966003 - DNA, 22 bp, Homo sapiens
ttgcctcccagcatgggcagct

SEQ ID NO: 7966004 - DNA, 22 bp, Homo sapiens
ttgcctcccagcatgggcagct

SEQ ID NO: 7966005 - DNA, 22 bp, Homo sapiens
ttgcctccttttaaggaaatca

SEQ ID NO: 7966006 - DNA, 22 bp, Homo sapiens
ttgcctcaagattttttattga

SEQ ID NO: 7966007 - DNA, 22 bp, Homo sapiens
ttgcctcattttctggtgaaat

SEQ ID NO: 7966008 - DNA, 17 bp, Homo sapiens
ttgccttaagtatgtgc

SEQ ID NO: 7966009 - DNA, 22 bp, Homo sapiens
ttgccttatagtgctctgcatt

SEQ ID NO: 7966010 - DNA, 22 bp, Homo sapiens
ttgccttcctgcccagcttctg

SEQ ID NO: 7966011 - DNA, 22 bp, Homo sapiens
ttgccttgttattctctcagaa

SEQ ID NO: 7966012 - DNA, 22 bp, Homo sapiens
ttgccttgttattctctcagaa

SEQ ID NO: 7966013 - DNA, 22 bp, Homo sapiens
ttgcctttaagtataactgctg

SEQ ID NO: 7966014 - DNA, 22 bp, Homo sapiens
ttgcctttaacccctgaaaggc

SEQ ID NO: 7966015 - DNA, 22 bp, Homo sapiens
ttgcctttcccctctggaagca

SEQ ID NO: 7966016 - DNA, 22 bp, Homo sapiens
ttgcctttgacggtgcagcagt

SEQ ID NO: 7966017 - DNA, 22 bp, Homo sapiens
ttgcgcgcggctaggtctcggt

SEQ ID NO: 7966018 - DNA, 22 bp, Homo sapiens
ttgccttttgctctgggggcag

SEQ ID NO: 7966019 - DNA, 22 bp, Homo sapiens
ttgcctttaacccctgaaaggc

SEQ ID NO: 7966020 - DNA, 22 bp, Homo sapiens
ttgcctttaagtataactgctg

SEQ ID NO: 7966021 - DNA, 22 bp, Homo sapiens
ttgcctttcccctctggaagca

SEQ ID NO: 7966022 - DNA, 17 bp, Homo sapiens
ttgcctttatggtcact

SEQ ID NO: 7966023 - DNA, 22 bp, Homo sapiens
ttgcctttcccatgtctaggag

SEQ ID NO: 7966024 - DNA, 22 bp, Homo sapiens
ttgcctggagggacatggagac

SEQ ID NO: 7966025 - DNA, 22 bp, Homo sapiens
ttgcctggactctgctggtatt

SEQ ID NO: 7966026 - DNA, 22 bp, Homo sapiens
ttgcctggagggacatggagac

SEQ ID NO: 7966027 - DNA, 22 bp, Homo sapiens
ttgcctggactctgctggtatt

SEQ ID NO: 7966028 - DNA, 22 bp, Homo sapiens
ttgcctggattctaccacagaa

SEQ ID NO: 7966029 - DNA, 22 bp, Homo sapiens
ttgcctggcttgtagatggggg

SEQ ID NO: 7966030 - DNA, 22 bp, Homo sapiens
ttgcctggtcctgtgggtgctg

SEQ ID NO: 7966031 - DNA, 22 bp, Homo sapiens
ttgcctggtcctgtgggtgctg

SEQ ID NO: 7966032 - DNA, 22 bp, Homo sapiens
ttgcctgggctagtaagccaga

SEQ ID NO: 7966033 - DNA, 22 bp, Homo sapiens
ttgcctgggcaacatagaactc

SEQ ID NO: 7966034 - DNA, 22 bp, Homo sapiens
ttggaacaggattcaattaaag

SEQ ID NO: 7966035 - DNA, 22 bp, Homo sapiens
ttggaacaggattcaattaaag

SEQ ID NO: 7966036 - DNA, 22 bp, Homo sapiens
ttggaacagaaacagacaaata

SEQ ID NO: 7966037 - DNA, 22 bp, Homo sapiens
ttggaacagaaacagacaaata

SEQ ID NO: 7966038 - DNA, 22 bp, Homo sapiens
ttggaacatgccggggtccagg

SEQ ID NO: 7966039 - DNA, 22 bp, Homo sapiens
ttggaacatgccggggtccagg

SEQ ID NO: 7966040 - DNA, 22 bp, Homo sapiens
ttggaacatccaggacagatat

SEQ ID NO: 7966041 - DNA, 22 bp, Homo sapiens
ttggaacagtgtgaaaaggtta

SEQ ID NO: 7966042 - DNA, 22 bp, Homo sapiens
ttggaacagtgtgaaaaggtta

SEQ ID NO: 7966043 - DNA, 22 bp, Homo sapiens
ttggaagacaatgctgattctc

SEQ ID NO: 7966044 - DNA, 22 bp, Homo sapiens
ttggaagacaatgctgattctc

SEQ ID NO: 7966045 - DNA, 22 bp, Homo sapiens
ttggaagacaatgctgattctc

SEQ ID NO: 7966046 - DNA, 22 bp, Homo sapiens
ttggaactgatggccttcatcc

SEQ ID NO: 7966047 - DNA, 22 bp, Homo sapiens
ttggaagaaatatcaatagtgt

SEQ ID NO: 7966048 - DNA, 22 bp, Homo sapiens
ttggaagaaatatcaatagtgt

SEQ ID NO: 7966049 - DNA, 22 bp, Homo sapiens
ttggaagacaatgctgattctc

SEQ ID NO: 7966050 - DNA, 22 bp, Homo sapiens
ttggaagacagtgaaacagcac

SEQ ID NO: 7966051 - DNA, 22 bp, Homo sapiens
ttggaagacagccgtctttatt

SEQ ID NO: 7966052 - DNA, 22 bp, Homo sapiens
ttggaagacagccgtctttatt

SEQ ID NO: 7966053 - DNA, 22 bp, Homo sapiens
ttggaagacagccgtctttatt

SEQ ID NO: 7966054 - DNA, 22 bp, Homo sapiens
ttggaagacagccgtctttatt

SEQ ID NO: 7966055 - DNA, 22 bp, Homo sapiens
ttggaagaaatatcaatagtgt

SEQ ID NO: 7966056 - DNA, 22 bp, Homo sapiens
ttggaagaaatatcaatagtgt

SEQ ID NO: 7966057 - DNA, 22 bp, Homo sapiens
ttggaactggatttcatgtagc

SEQ ID NO: 7966058 - DNA, 22 bp, Homo sapiens
ttggaacttaaccctgataggt

SEQ ID NO: 7966059 - DNA, 22 bp, Homo sapiens
ttgctttagggcaaatatttca

SEQ ID NO: 7966060 - DNA, 22 bp, Homo sapiens
ttgctttagggcaaatatttca

SEQ ID NO: 7966061 - DNA, 22 bp, Homo sapiens
ttgctttaggatttaagtggca

SEQ ID NO: 7966062 - DNA, 22 bp, Homo sapiens
ttgctttaggtatagaatccat

SEQ ID NO: 7966063 - DNA, 22 bp, Homo sapiens
ttgctttaggtatagaatccat

SEQ ID NO: 7966064 - DNA, 22 bp, Homo sapiens
ttgctttaggtatagaatccat

SEQ ID NO: 7966065 - DNA, 22 bp, Homo sapiens
ttgctttagggcaaatatttca

SEQ ID NO: 7966066 - DNA, 22 bp, Homo sapiens
ttgctttatattcaagagagga

SEQ ID NO: 7966067 - DNA, 22 bp, Homo sapiens
ttgctttatattcaagagagga

SEQ ID NO: 7966068 - DNA, 22 bp, Homo sapiens
ttgctttatattcaagagagga

SEQ ID NO: 7966069 - DNA, 20 bp, Homo sapiens
ttgctttatcagacatgata

SEQ ID NO: 7966070 - DNA, 20 bp, Homo sapiens
ttgctttatcagacatgata

SEQ ID NO: 7966071 - DNA, 22 bp, Homo sapiens
ttgctttatctaagcatggcca

SEQ ID NO: 7966072 - DNA, 22 bp, Homo sapiens
ttgctttatctcttatgcctca

SEQ ID NO: 7966073 - DNA, 22 bp, Homo sapiens
ttgctttatctcttatgcctca

SEQ ID NO: 7966074 - DNA, 22 bp, Homo sapiens
ttgctttatctaagcatggcca

SEQ ID NO: 7966075 - DNA, 22 bp, Homo sapiens
ttgctttatgtgtatgacttga

SEQ ID NO: 7966076 - DNA, 22 bp, Homo sapiens
ttgctttatgtgtatgacttga

SEQ ID NO: 7966077 - DNA, 22 bp, Homo sapiens
ttgctttattcacatctatatt

SEQ ID NO: 7966078 - DNA, 22 bp, Homo sapiens
ttgctttattcacatctatatt

SEQ ID NO: 7966079 - DNA, 22 bp, Homo sapiens
ttgctttattcacatctatatt

SEQ ID NO: 7966080 - DNA, 22 bp, Homo sapiens
ttgctttattcacatctatatt

SEQ ID NO: 7966081 - DNA, 22 bp, Homo sapiens
ttgctttatgtgtatgacttga

SEQ ID NO: 7966082 - DNA, 22 bp, Homo sapiens
ttgctttattcctagcccttgt

SEQ ID NO: 7966083 - DNA, 22 bp, Homo sapiens
ttgctttattcacatctatatt

SEQ ID NO: 7966084 - DNA, 22 bp, Homo sapiens
ttggaacacagcagctgatttt

SEQ ID NO: 7966085 - DNA, 22 bp, Homo sapiens
ttgctttattcctagcccttgt

SEQ ID NO: 7966086 - DNA, 23 bp, Homo sapiens
ttggaacacagtaaatgcacaat

SEQ ID NO: 7966087 - DNA, 23 bp, Homo sapiens
ttggaacacagtaaatgcacaat

SEQ ID NO: 7966088 - DNA, 22 bp, Homo sapiens
ttggaacactagaatctgtact

SEQ ID NO: 7966089 - DNA, 22 bp, Homo sapiens
ttgctttacaaaaattgatggt

SEQ ID NO: 7966090 - DNA, 22 bp, Homo sapiens
ttgctttacatgttctggtaaa

SEQ ID NO: 7966091 - DNA, 22 bp, Homo sapiens
ttgctttacaaaaattgatggt

SEQ ID NO: 7966092 - DNA, 22 bp, Homo sapiens
ttgctttacaaaaattgatggt

SEQ ID NO: 7966093 - DNA, 22 bp, Homo sapiens
ttgctttacctgtggtatattt

SEQ ID NO: 7966094 - DNA, 22 bp, Homo sapiens
ttgctttacctgtggtatattt

SEQ ID NO: 7966095 - DNA, 22 bp, Homo sapiens
ttgctttaccatttgatctcta

SEQ ID NO: 7966096 - DNA, 22 bp, Homo sapiens
ttgctttaccatttgatctcta

SEQ ID NO: 7966097 - DNA, 22 bp, Homo sapiens
ttgctttacatgttctggtaaa

SEQ ID NO: 7966098 - DNA, 22 bp, Homo sapiens
ttgctttagaatctgcttctgg

SEQ ID NO: 7966099 - DNA, 22 bp, Homo sapiens
ttgctttaggatttaagtggca

SEQ ID NO: 7966100 - DNA, 22 bp, Homo sapiens
ttgctttagaatctgcttctgg

SEQ ID NO: 7966101 - DNA, 22 bp, Homo sapiens
ttgctttactttgccattcgtt

SEQ ID NO: 7966102 - DNA, 22 bp, Homo sapiens
ttgctttacggcaaggccccag

SEQ ID NO: 7966103 - DNA, 22 bp, Homo sapiens
ttgctttacggcaaggccccag

SEQ ID NO: 7966104 - DNA, 22 bp, Homo sapiens
ttgctttactttgccattcgtt

SEQ ID NO: 7966105 - DNA, 22 bp, Homo sapiens
ttgctttactttgccattcgtt

SEQ ID NO: 7966106 - DNA, 22 bp, Homo sapiens
ttgctttaaggtatctggagaa

SEQ ID NO: 7966107 - DNA, 15 bp, Homo sapiens
ttgctttaagacatg

SEQ ID NO: 7966108 - DNA, 22 bp, Homo sapiens
ttgctttaaggtatctggagaa

SEQ ID NO: 7966109 - DNA, 22 bp, Homo sapiens
ttgctttaatgagattttgcca

SEQ ID NO: 7966110 - DNA, 22 bp, Homo sapiens
ttgctttaatgagattttgcca

SEQ ID NO: 7966111 - DNA, 22 bp, Homo sapiens
ttgctttaatgagattttgcca

SEQ ID NO: 7966112 - DNA, 22 bp, Homo sapiens
ttgctttacaaaaattgatggt

SEQ ID NO: 7966113 - DNA, 15 bp, Homo sapiens
ttgctttaagacatg

SEQ ID NO: 7966114 - DNA, 22 bp, Homo sapiens
ttgctttaactagtaaatgggg

SEQ ID NO: 7966115 - DNA, 22 bp, Homo sapiens
ttgctttaactagtaaatgggg

SEQ ID NO: 7966116 - DNA, 22 bp, Homo sapiens
ttgctttaactagtaaatgggg

SEQ ID NO: 7966117 - DNA, 22 bp, Homo sapiens
ttgctttaaaatggctaagtct

SEQ ID NO: 7966118 - DNA, 22 bp, Homo sapiens
ttgctttaaaatggctaagtct

SEQ ID NO: 7966119 - DNA, 22 bp, Homo sapiens
ttgcttcttagatattcctctc

SEQ ID NO: 7966120 - DNA, 22 bp, Homo sapiens
ttgcttcttagatattcctctc

SEQ ID NO: 7966121 - DNA, 22 bp, Homo sapiens
ttgcttcttagatattcctctc

SEQ ID NO: 7966122 - DNA, 22 bp, Homo sapiens
ttgcttcttagatattcctctc

SEQ ID NO: 7966123 - DNA, 22 bp, Homo sapiens
ttgcttcttagatattcctctc

SEQ ID NO: 7966124 - DNA, 18 bp, Homo sapiens
ttgcttcttttctctagg

SEQ ID NO: 7966125 - DNA, 18 bp, Homo sapiens
ttgcttcttttctctagg

SEQ ID NO: 7966126 - DNA, 21 bp, Homo sapiens
ttgcttgaaccaaaaggcata

SEQ ID NO: 7966127 - DNA, 22 bp, Homo sapiens
ttgcttgactttgtgtacctgt

SEQ ID NO: 7966128 - DNA, 22 bp, Homo sapiens
ttgcttgaacccaggaagtgga

SEQ ID NO: 7966129 - DNA, 22 bp, Homo sapiens
ttgcttgatgcttatatacttg

SEQ ID NO: 7966130 - DNA, 23 bp, Homo sapiens
ttgcttgagcccaggaagtggag

SEQ ID NO: 7966131 - DNA, 22 bp, Homo sapiens
ttgcttgattctgcaaaagcat

SEQ ID NO: 7966132 - DNA, 22 bp, Homo sapiens
ttgcttgccctgcagcatactt

SEQ ID NO: 7966133 - DNA, 22 bp, Homo sapiens
ttgcttgctatccagatcagtc

SEQ ID NO: 7966134 - DNA, 22 bp, Homo sapiens
ttgcttgctatccagatcagtc

SEQ ID NO: 7966135 - DNA, 23 bp, Homo sapiens
ttgcttgcctttagtcaggacca

SEQ ID NO: 7966136 - DNA, 23 bp, Homo sapiens
ttgcttgcctttagtcaggacca

SEQ ID NO: 7966137 - DNA, 22 bp, Homo sapiens
ttgcttctaagtataaatatga

SEQ ID NO: 7966138 - DNA, 22 bp, Homo sapiens
ttgcttctggaactttctgttc

SEQ ID NO: 7966139 - DNA, 22 bp, Homo sapiens
ttgcttctggaactttctgttc

SEQ ID NO: 7966140 - DNA, 22 bp, Homo sapiens
ttgcttctggaactttctgttc

SEQ ID NO: 7966141 - DNA, 23 bp, Homo sapiens
ttgcttctgtgcaattcagtact

SEQ ID NO: 7966142 - DNA, 22 bp, Homo sapiens
ttgcttctggaactttctgttc

SEQ ID NO: 7966143 - DNA, 23 bp, Homo sapiens
ttgcttctgtgcaattcagtact

SEQ ID NO: 7966144 - DNA, 23 bp, Homo sapiens
ttgcttctgtgcaattcagtact

SEQ ID NO: 7966145 - DNA, 23 bp, Homo sapiens
ttgcttctgtgcaattcagtact

SEQ ID NO: 7966146 - DNA, 23 bp, Homo sapiens
ttgcttctgtgcaattcagtact

SEQ ID NO: 7966147 - DNA, 22 bp, Homo sapiens
ttggaatcctgagatgagaatt

SEQ ID NO: 7966148 - DNA, 22 bp, Homo sapiens
ttggaatctgcaatttaacaaa

SEQ ID NO: 7966149 - DNA, 22 bp, Homo sapiens
ttggaatcctgcctctgctact

SEQ ID NO: 7966150 - DNA, 22 bp, Homo sapiens
ttggaatcctgagatgagaatt

SEQ ID NO: 7966151 - DNA, 22 bp, Homo sapiens
ttggaatcattcttaaaggtct

SEQ ID NO: 7966152 - DNA, 22 bp, Homo sapiens
ttggaatcctgagatgagaatt

SEQ ID NO: 7966153 - DNA, 22 bp, Homo sapiens
ttggaatcactcacataagtct

SEQ ID NO: 7966154 - DNA, 22 bp, Homo sapiens
ttggaatatcatgcagaataaa

SEQ ID NO: 7966155 - DNA, 22 bp, Homo sapiens
ttggaatagggaggctggcata

SEQ ID NO: 7966156 - DNA, 22 bp, Homo sapiens
ttggaatagggaatcaaagttt

SEQ ID NO: 7966157 - DNA, 22 bp, Homo sapiens
ttggaataaaaacaactcacag

SEQ ID NO: 7966158 - DNA, 22 bp, Homo sapiens
ttggaatcattcttaaaggtct

SEQ ID NO: 7966159 - DNA, 20 bp, Homo sapiens
ttggaatcacctggagaggt

SEQ ID NO: 7966160 - DNA, 20 bp, Homo sapiens
ttggaatcacctggagaggt

SEQ ID NO: 7966161 - DNA, 22 bp, Homo sapiens
ttggaagacattaaagagagtg

SEQ ID NO: 7966162 - DNA, 22 bp, Homo sapiens
ttggaagacattaaagagagtg

SEQ ID NO: 7966163 - DNA, 22 bp, Homo sapiens
ttggaagacagtgaaacagcac

SEQ ID NO: 7966164 - DNA, 22 bp, Homo sapiens
ttggaagacagtgaaacagcac

SEQ ID NO: 7966165 - DNA, 22 bp, Homo sapiens
ttggaagaccagaggccttgtc

SEQ ID NO: 7966166 - DNA, 22 bp, Homo sapiens
ttggaagaccagaggccttgtc

SEQ ID NO: 7966167 - DNA, 22 bp, Homo sapiens
ttggaagagagccacagttaat

SEQ ID NO: 7966168 - DNA, 22 bp, Homo sapiens
ttggaagagagccacagttaat

SEQ ID NO: 7966169 - DNA, 22 bp, Homo sapiens
ttggaagagagccacagttaat

SEQ ID NO: 7966170 - DNA, 22 bp, Homo sapiens
ttggaagagagccacagttaat

SEQ ID NO: 7966171 - DNA, 22 bp, Homo sapiens
ttggaagtaatgaagaggtggg

SEQ ID NO: 7966172 - DNA, 22 bp, Homo sapiens
ttggaagttaaataaggttcaa

SEQ ID NO: 7966173 - DNA, 22 bp, Homo sapiens
ttggaagttcttagccttttca

SEQ ID NO: 7966174 - DNA, 22 bp, Homo sapiens
ttggaagaggaaaatgagccta

SEQ ID NO: 7966175 - DNA, 22 bp, Homo sapiens
ttggaagaggaaaatgagccta

SEQ ID NO: 7966176 - DNA, 22 bp, Homo sapiens
ttggaagagtagagttgaataa

SEQ ID NO: 7966177 - DNA, 22 bp, Homo sapiens
ttggaagagtagagttgaataa

SEQ ID NO: 7966178 - DNA, 21 bp, Homo sapiens
ttggaagataatgcttatgat

SEQ ID NO: 7966179 - DNA, 22 bp, Homo sapiens
ttggaagtaatgaagaggtggg

SEQ ID NO: 7966180 - DNA, 22 bp, Homo sapiens
ttggaagagtagagttgaataa

SEQ ID NO: 7966181 - DNA, 21 bp, Homo sapiens
ttggaagataatgcttatgat

SEQ ID NO: 7966182 - DNA, 22 bp, Homo sapiens
ttggaggcaatgggaaggaggc

SEQ ID NO: 7966183 - DNA, 22 bp, Homo sapiens
ttggaggatgtcggcatattta

SEQ ID NO: 7966184 - DNA, 22 bp, Homo sapiens
ttggaggcaatgggaaggaggc

SEQ ID NO: 7966185 - DNA, 22 bp, Homo sapiens
ttggaggcaatgggaaggaggc

SEQ ID NO: 7966186 - DNA, 18 bp, Homo sapiens
ttggaggatgtccatgaa

SEQ ID NO: 7966187 - DNA, 22 bp, Homo sapiens
ttggaggatggagttagcatct

SEQ ID NO: 7966188 - DNA, 18 bp, Homo sapiens
ttggaggatgtccatgaa

SEQ ID NO: 7966189 - DNA, 19 bp, Homo sapiens
ttggatgctaccaggtacc

SEQ ID NO: 7966190 - DNA, 22 bp, Homo sapiens
ttggatgggcattaggaaagtc

SEQ ID NO: 7966191 - DNA, 22 bp, Homo sapiens
ttggatgggcattaggaaagtc

SEQ ID NO: 7966192 - DNA, 22 bp, Homo sapiens
ttggagggacagatggctaggc

SEQ ID NO: 7966193 - DNA, 22 bp, Homo sapiens
ttggaggattgctctcagccca

SEQ ID NO: 7966194 - DNA, 21 bp, Homo sapiens
ttggatgtatttatgttttag

SEQ ID NO: 7966195 - DNA, 22 bp, Homo sapiens
ttggaattaatatttgtataca

SEQ ID NO: 7966196 - DNA, 22 bp, Homo sapiens
ttggaattcaagttgtagctta

SEQ ID NO: 7966197 - DNA, 22 bp, Homo sapiens
ttggaggatgcaatgagggagt

SEQ ID NO: 7966198 - DNA, 22 bp, Homo sapiens
ttggaatgttttaatataaatt

SEQ ID NO: 7966199 - DNA, 22 bp, Homo sapiens
ttggaattaaaaggagaacttc

SEQ ID NO: 7966200 - DNA, 21 bp, Homo sapiens
ttggaatcttaggagtgtggg

SEQ ID NO: 7966201 - DNA, 21 bp, Homo sapiens
ttggaatcttaggagtgtggg

SEQ ID NO: 7966202 - DNA, 21 bp, Homo sapiens
ttggaatctcttcatctctgc

SEQ ID NO: 7966203 - DNA, 22 bp, Homo sapiens
ttggcacctccctaggaagaag

SEQ ID NO: 7966204 - DNA, 22 bp, Homo sapiens
ttggcactattcactccatggg

SEQ ID NO: 7966205 - DNA, 22 bp, Homo sapiens
ttggcactattcactccatggg

SEQ ID NO: 7966206 - DNA, 22 bp, Homo sapiens
ttggcacagctccatggctttg

SEQ ID NO: 7966207 - DNA, 22 bp, Homo sapiens
ttggcacagtaatctctcttca

SEQ ID NO: 7966208 - DNA, 22 bp, Homo sapiens
ttggcacacagtaagccctaag

SEQ ID NO: 7966209 - DNA, 22 bp, Homo sapiens
ttggcacaaatttctgaaataa

SEQ ID NO: 7966210 - DNA, 22 bp, Homo sapiens
ttggcaatttaaatagcaggag

SEQ ID NO: 7966211 - DNA, 22 bp, Homo sapiens
ttggcacagaaaaactcactgt

SEQ ID NO: 7966212 - DNA, 22 bp, Homo sapiens
ttggcacagagctgcagcctgg

SEQ ID NO: 7966213 - DNA, 22 bp, Homo sapiens
ttggcacagagctgcagcctgg

SEQ ID NO: 7966214 - DNA, 22 bp, Homo sapiens
ttggcaatgtctaaacacattt

SEQ ID NO: 7966215 - DNA, 22 bp, Homo sapiens
ttggcaattcaccaaggctcgc

SEQ ID NO: 7966216 - DNA, 22 bp, Homo sapiens
ttggcaatttaaatagcaggag

SEQ ID NO: 7966217 - DNA, 22 bp, Homo sapiens
ttggcaattagttatatctgca

SEQ ID NO: 7966218 - DNA, 22 bp, Homo sapiens
ttggcaacacatggaaaaattt

SEQ ID NO: 7966219 - DNA, 22 bp, Homo sapiens
ttggcaaaggactcaaagcagg

SEQ ID NO: 7966220 - DNA, 22 bp, Homo sapiens
ttggcaaaggactcaaagcagg

SEQ ID NO: 7966221 - DNA, 22 bp, Homo sapiens
ttggattcctgggaaccatgca

SEQ ID NO: 7966222 - DNA, 22 bp, Homo sapiens
ttggatgtttgaaatcacgtac

SEQ ID NO: 7966223 - DNA, 22 bp, Homo sapiens
ttggattacatgaaatgcagaa

SEQ ID NO: 7966224 - DNA, 22 bp, Homo sapiens
ttggatttgtctaccagggaat

SEQ ID NO: 7966225 - DNA, 22 bp, Homo sapiens
ttggcactgtgcctggcacatt

SEQ ID NO: 7966226 - DNA, 22 bp, Homo sapiens
ttggcacttcacgagacagcta

SEQ ID NO: 7966227 - DNA, 22 bp, Homo sapiens
ttggcactttctcagcagcctg

SEQ ID NO: 7966228 - DNA, 22 bp, Homo sapiens
ttggcacttcacgagacagcta

SEQ ID NO: 7966229 - DNA, 22 bp, Homo sapiens
ttggcacttttaggcagtaccg

SEQ ID NO: 7966230 - DNA, 22 bp, Homo sapiens
ttggcactttgaatgagctcag

SEQ ID NO: 7966231 - DNA, 22 bp, Homo sapiens
ttggcactttctcagcagcctg

SEQ ID NO: 7966232 - DNA, 22 bp, Homo sapiens
ttggcagaatgggcagcttgag

SEQ ID NO: 7966233 - DNA, 22 bp, Homo sapiens
ttggcagaattaaccactgaag

SEQ ID NO: 7966234 - DNA, 22 bp, Homo sapiens
ttggcagaatgggcagcttgag

SEQ ID NO: 7966235 - DNA, 22 bp, Homo sapiens
ttggcagactgggtcctgggga

SEQ ID NO: 7966236 - DNA, 22 bp, Homo sapiens
ttggcagactgacaatctgttt

SEQ ID NO: 7966237 - DNA, 22 bp, Homo sapiens
ttggcagactgacaatctgttt

SEQ ID NO: 7966238 - DNA, 22 bp, Homo sapiens
ttggcactcaactgtcgttgtt

SEQ ID NO: 7966239 - DNA, 22 bp, Homo sapiens
ttggcactcaaagccctctgca

SEQ ID NO: 7966240 - DNA, 22 bp, Homo sapiens
ttggcactcaaagccctctgca

SEQ ID NO: 7966241 - DNA, 22 bp, Homo sapiens
ttggcactcagcaagtgttaat

SEQ ID NO: 7966242 - DNA, 22 bp, Homo sapiens
ttggcactcaaaattttatcgg

SEQ ID NO: 7966243 - DNA, 22 bp, Homo sapiens
ttggcactcaaaattttatcgg

SEQ ID NO: 7966244 - DNA, 22 bp, Homo sapiens
ttggcactcaaaatagatggtt

SEQ ID NO: 7966245 - DNA, 22 bp, Homo sapiens
ttggcactattgacattttggg

SEQ ID NO: 7966246 - DNA, 22 bp, Homo sapiens
ttggcactgcattgaccacacc

SEQ ID NO: 7966247 - DNA, 22 bp, Homo sapiens
ttggcactgcagatgaattgca

SEQ ID NO: 7966248 - DNA, 22 bp, Homo sapiens
ttggcactgaccaaagaagtcc

SEQ ID NO: 7966249 - DNA, 22 bp, Homo sapiens
ttggcactcatcctggttgttt

SEQ ID NO: 7966250 - DNA, 22 bp, Homo sapiens
ttggcactcatcctggttgttt

SEQ ID NO: 7966251 - DNA, 22 bp, Homo sapiens
ttggcactctccctgcactggt

SEQ ID NO: 7966252 - DNA, 22 bp, Homo sapiens
tttctaaaatagattttatggt

SEQ ID NO: 7966253 - DNA, 22 bp, Homo sapiens
tttctaaaatagattttatggt

SEQ ID NO: 7966254 - DNA, 22 bp, Homo sapiens
tttctaaaatagattttatggt

SEQ ID NO: 7966255 - DNA, 22 bp, Homo sapiens
tttctaaaatagattttatggt

SEQ ID NO: 7966256 - DNA, 22 bp, Homo sapiens
tttctaaactggattcagcctg

SEQ ID NO: 7966257 - DNA, 22 bp, Homo sapiens
tttctaaactggattcagcctg

SEQ ID NO: 7966258 - DNA, 22 bp, Homo sapiens
tttctaaagggtagatttggcc

SEQ ID NO: 7966259 - DNA, 22 bp, Homo sapiens
tttctaaactggattcagcctg

SEQ ID NO: 7966260 - DNA, 22 bp, Homo sapiens
tttctaaactggattcagcctg

SEQ ID NO: 7966261 - DNA, 22 bp, Homo sapiens
tttctaaacaaagggagtttgg

SEQ ID NO: 7966262 - DNA, 22 bp, Homo sapiens
tttctaaacaaagggagtttgg

SEQ ID NO: 7966263 - DNA, 22 bp, Homo sapiens
tttccttttataaggcttgagg

SEQ ID NO: 7966264 - DNA, 22 bp, Homo sapiens
tttccttttaagcagtcggcct

SEQ ID NO: 7966265 - DNA, 22 bp, Homo sapiens
tttcctttgtgcaggccttggg

SEQ ID NO: 7966266 - DNA, 22 bp, Homo sapiens
tttcctttgtgcaggccttggg

SEQ ID NO: 7966267 - DNA, 22 bp, Homo sapiens
tttcctttgtgcaggccttggg

SEQ ID NO: 7966268 - DNA, 22 bp, Homo sapiens
tttccttttaagcagtcggcct

SEQ ID NO: 7966269 - DNA, 22 bp, Homo sapiens
tttccttttggctaggtgtgaa

SEQ ID NO: 7966270 - DNA, 22 bp, Homo sapiens
tttccttttggctaggtgtgaa

SEQ ID NO: 7966271 - DNA, 22 bp, Homo sapiens
tttccttttggctaggtgtgaa

SEQ ID NO: 7966272 - DNA, 22 bp, Homo sapiens
tttccttttataaggcttgagg

SEQ ID NO: 7966273 - DNA, 22 bp, Homo sapiens
tttctaacagcaaatgtttatc

SEQ ID NO: 7966274 - DNA, 22 bp, Homo sapiens
tttctaaatggtggctgcattg

SEQ ID NO: 7966275 - DNA, 22 bp, Homo sapiens
tttctaacagcaaatgtttatc

SEQ ID NO: 7966276 - DNA, 22 bp, Homo sapiens
tttctaaagggtagatttggcc

SEQ ID NO: 7966277 - DNA, 22 bp, Homo sapiens
tttctaaatggtggctgcattg

SEQ ID NO: 7966278 - DNA, 22 bp, Homo sapiens
tttctaaatggtggctgcattg

SEQ ID NO: 7966279 - DNA, 22 bp, Homo sapiens
tttctaagaaagtaatggttat

SEQ ID NO: 7966280 - DNA, 22 bp, Homo sapiens
tttctaacgtagacagggaggt

SEQ ID NO: 7966281 - DNA, 22 bp, Homo sapiens
tttctaagaaagtaatggttat

SEQ ID NO: 7966282 - DNA, 22 bp, Homo sapiens
tttctaacgtagacagggaggt

SEQ ID NO: 7966283 - DNA, 22 bp, Homo sapiens
tttctaacagcaaatgtttatc

SEQ ID NO: 7966284 - DNA, 22 bp, Homo sapiens
tttctaagaatattgctcttaa

SEQ ID NO: 7966285 - DNA, 22 bp, Homo sapiens
tttctaagacatttgtcatctt

SEQ ID NO: 7966286 - DNA, 22 bp, Homo sapiens
tttctaagaatattgctcttaa

SEQ ID NO: 7966287 - DNA, 22 bp, Homo sapiens
tttctaagacatttgtcatctt

SEQ ID NO: 7966288 - DNA, 22 bp, Homo sapiens
tttctaagcttagtatgaggca

SEQ ID NO: 7966289 - DNA, 22 bp, Homo sapiens
tttctaagcttagtatgaggca

SEQ ID NO: 7966290 - DNA, 19 bp, Homo sapiens
tttctaagctaaatgcttc

SEQ ID NO: 7966291 - DNA, 22 bp, Homo sapiens
tttctaaggaaagtacctggga

SEQ ID NO: 7966292 - DNA, 22 bp, Homo sapiens
tttctaaggaaagtacctggga

SEQ ID NO: 7966293 - DNA, 22 bp, Homo sapiens
tttctaagatgtggtttcaagg

SEQ ID NO: 7966294 - DNA, 19 bp, Homo sapiens
tttctaagctaaatgcttc

SEQ ID NO: 7966295 - DNA, 22 bp, Homo sapiens
tttctaaggctaggtcttaagg

SEQ ID NO: 7966296 - DNA, 22 bp, Homo sapiens
tttctaaggtgaggtagaaaat

SEQ ID NO: 7966297 - DNA, 22 bp, Homo sapiens
tttctaaggtgaggtagaaaat

SEQ ID NO: 7966298 - DNA, 21 bp, Homo sapiens
tttctaaggaggaagaaaaga

SEQ ID NO: 7966299 - DNA, 22 bp, Homo sapiens
tttctaaggccagagactgctg

SEQ ID NO: 7966300 - DNA, 22 bp, Homo sapiens
tttctaaggccagagactgctg

SEQ ID NO: 7966301 - DNA, 22 bp, Homo sapiens
tttccatatttaatcaaaataa

SEQ ID NO: 7966302 - DNA, 22 bp, Homo sapiens
tttccatgttatcttgcagact

SEQ ID NO: 7966303 - DNA, 22 bp, Homo sapiens
tttccagtgggccccttgaaat

SEQ ID NO: 7966304 - DNA, 22 bp, Homo sapiens
tttccagtgggccccttgaaat

SEQ ID NO: 7966305 - DNA, 22 bp, Homo sapiens
tttccagtgcatggcaaatgct

SEQ ID NO: 7966306 - DNA, 22 bp, Homo sapiens
tttccagttgtcctatcacctg

SEQ ID NO: 7966307 - DNA, 22 bp, Homo sapiens
tttccagttgttctagaaagct

SEQ ID NO: 7966308 - DNA, 22 bp, Homo sapiens
tttccagttgttctagaaagct

SEQ ID NO: 7966309 - DNA, 22 bp, Homo sapiens
tttcccaaagcctggggtgagt

SEQ ID NO: 7966310 - DNA, 22 bp, Homo sapiens
tttcccaacagtctctctcaaa

SEQ ID NO: 7966311 - DNA, 22 bp, Homo sapiens
tttcccaagaccatagatggaa

SEQ ID NO: 7966312 - DNA, 22 bp, Homo sapiens
tttcccaacagtctctctcaaa

SEQ ID NO: 7966313 - DNA, 22 bp, Homo sapiens
tttcccaagaaaaataattgga

SEQ ID NO: 7966314 - DNA, 22 bp, Homo sapiens
tttcccaattgagaggttctgt

SEQ ID NO: 7966315 - DNA, 22 bp, Homo sapiens
tttcccacacagtccactgcag

SEQ ID NO: 7966316 - DNA, 22 bp, Homo sapiens
tttcccaagtgtaaacatggca

SEQ ID NO: 7966317 - DNA, 22 bp, Homo sapiens
tttcccaatgagtccttgagca

SEQ ID NO: 7966318 - DNA, 22 bp, Homo sapiens
tttcccaagtgtaaacatggca

SEQ ID NO: 7966319 - DNA, 22 bp, Homo sapiens
tttcccaagtgaagtgaagcca

SEQ ID NO: 7966320 - DNA, 22 bp, Homo sapiens
tttccttcttagcggtgttctt

SEQ ID NO: 7966321 - DNA, 22 bp, Homo sapiens
tttccttgcacattggtttcca

SEQ ID NO: 7966322 - DNA, 23 bp, Homo sapiens
tttcccaccctctctcattgctg

SEQ ID NO: 7966323 - DNA, 23 bp, Homo sapiens
tttcccaccctctctcattgctg

SEQ ID NO: 7966324 - DNA, 23 bp, Homo sapiens
tttcccaccctctctcattgctg

SEQ ID NO: 7966325 - DNA, 22 bp, Homo sapiens
tttcccagaggtatgaataagt

SEQ ID NO: 7966326 - DNA, 22 bp, Homo sapiens
tttccttgcacattggtttcca

SEQ ID NO: 7966327 - DNA, 22 bp, Homo sapiens
tttccttgcacattggtttcca

SEQ ID NO: 7966328 - DNA, 22 bp, Homo sapiens
tttccttgcacattggtttcca

SEQ ID NO: 7966329 - DNA, 22 bp, Homo sapiens
tttcctttgagggtcctacact

SEQ ID NO: 7966330 - DNA, 22 bp, Homo sapiens
tttcctttctggtttggtcata

SEQ ID NO: 7966331 - DNA, 22 bp, Homo sapiens
tttcctttgagggtcctacact

SEQ ID NO: 7966332 - DNA, 22 bp, Homo sapiens
tttcctttgggagcatgaattt

SEQ ID NO: 7966333 - DNA, 22 bp, Homo sapiens
tttcctttgggagcatgaattt

SEQ ID NO: 7966334 - DNA, 22 bp, Homo sapiens
tttcctttgggagcatgaattt

SEQ ID NO: 7966335 - DNA, 22 bp, Homo sapiens
tttcctttgggagcatgaattt

SEQ ID NO: 7966336 - DNA, 22 bp, Homo sapiens
tttcctttgggcacccgagctc

SEQ ID NO: 7966337 - DNA, 22 bp, Homo sapiens
tttcctttgggagcatgaattt

SEQ ID NO: 7966338 - DNA, 22 bp, Homo sapiens
tttcctttgggagcatgaattt

SEQ ID NO: 7966339 - DNA, 22 bp, Homo sapiens
tttcctttgcccaatacatgtc

SEQ ID NO: 7966340 - DNA, 22 bp, Homo sapiens
tttcctttgcccaatacatgtc

SEQ ID NO: 7966341 - DNA, 22 bp, Homo sapiens
tttcctttgcccaatacatgtc

SEQ ID NO: 7966342 - DNA, 22 bp, Homo sapiens
tttcctttgcccaatacatgtc

SEQ ID NO: 7966343 - DNA, 22 bp, Homo sapiens
tttcctttgcccaatacatgtc

SEQ ID NO: 7966344 - DNA, 22 bp, Homo sapiens
tttcctttgcccaatacatgtc

SEQ ID NO: 7966345 - DNA, 22 bp, Homo sapiens
tttcctttgagggtcctacact

SEQ ID NO: 7966346 - DNA, 22 bp, Homo sapiens
tttcctttgagggtcctacact

SEQ ID NO: 7966347 - DNA, 22 bp, Homo sapiens
tttccagatgctaggttgaaag

SEQ ID NO: 7966348 - DNA, 22 bp, Homo sapiens
tttccagattaagataccactt

SEQ ID NO: 7966349 - DNA, 22 bp, Homo sapiens
tttccaggaagtaaggataatc

SEQ ID NO: 7966350 - DNA, 22 bp, Homo sapiens
tttccaggagaaagagagcctt

SEQ ID NO: 7966351 - DNA, 22 bp, Homo sapiens
tttccaggcagaggagttgtga

SEQ ID NO: 7966352 - DNA, 22 bp, Homo sapiens
tttccaggagaaagagagcctt

SEQ ID NO: 7966353 - DNA, 22 bp, Homo sapiens
tttccaaataaggtcacattct

SEQ ID NO: 7966354 - DNA, 22 bp, Homo sapiens
tttccaaataaggtcacattct

SEQ ID NO: 7966355 - DNA, 22 bp, Homo sapiens
tttccaaataaggtcacattct

SEQ ID NO: 7966356 - DNA, 22 bp, Homo sapiens
tttccagagctgagaaggcttg

SEQ ID NO: 7966357 - DNA, 22 bp, Homo sapiens
tttccagagctgagaaggcttg

SEQ ID NO: 7966358 - DNA, 22 bp, Homo sapiens
tttccaaataaggtcacactca

SEQ ID NO: 7966359 - DNA, 22 bp, Homo sapiens
tttccaaataaggtcacactca

SEQ ID NO: 7966360 - DNA, 22 bp, Homo sapiens
tttcatcttccttggcataggt

SEQ ID NO: 7966361 - DNA, 22 bp, Homo sapiens
tttccaaataaggtcacactca

SEQ ID NO: 7966362 - DNA, 22 bp, Homo sapiens
tttccaaataaggtcacattct

SEQ ID NO: 7966363 - DNA, 22 bp, Homo sapiens
tttccaaataaggtcacattct

SEQ ID NO: 7966364 - DNA, 22 bp, Homo sapiens
tttccaaataaggtcacattct

SEQ ID NO: 7966365 - DNA, 22 bp, Homo sapiens
tttcatcttatttgtctacatc

SEQ ID NO: 7966366 - DNA, 22 bp, Homo sapiens
tttcatcttatttgtctacatc

SEQ ID NO: 7966367 - DNA, 22 bp, Homo sapiens
tttcatcttcccagagaccttg

SEQ ID NO: 7966368 - DNA, 17 bp, Homo sapiens
tttcatctgggaccacc

SEQ ID NO: 7966369 - DNA, 22 bp, Homo sapiens
tttcatctgtgctgccaagact

SEQ ID NO: 7966370 - DNA, 22 bp, Homo sapiens
tttcatctgtgctgccaagact

SEQ ID NO: 7966371 - DNA, 22 bp, Homo sapiens
tttccagggctctgtagaagaa

SEQ ID NO: 7966372 - DNA, 18 bp, Homo sapiens
tttccagggattaggtgg

SEQ ID NO: 7966373 - DNA, 22 bp, Homo sapiens
tttccagggctctgtagaagaa

SEQ ID NO: 7966374 - DNA, 22 bp, Homo sapiens
tttccaggtatcaagcttcagg

SEQ ID NO: 7966375 - DNA, 22 bp, Homo sapiens
tttccaggtatcaagcttcagg

SEQ ID NO: 7966376 - DNA, 22 bp, Homo sapiens
tttccaggcagaggagttgtga

SEQ ID NO: 7966377 - DNA, 22 bp, Homo sapiens
tttccagggaggaatgtggggt

SEQ ID NO: 7966378 - DNA, 22 bp, Homo sapiens
tttccaggtgcatagaaaacag

SEQ ID NO: 7966379 - DNA, 22 bp, Homo sapiens
tttccaggtgcatagaaaacag

SEQ ID NO: 7966380 - DNA, 23 bp, Homo sapiens
tttccaggtgaccgtcagaatta

SEQ ID NO: 7966381 - DNA, 23 bp, Homo sapiens
tttccaggtgaccgtcagaatta

SEQ ID NO: 7966382 - DNA, 22 bp, Homo sapiens
tttccaggtattaatactgtat

SEQ ID NO: 7966383 - DNA, 22 bp, Homo sapiens
tttccagtgaattagtctgttt

SEQ ID NO: 7966384 - DNA, 22 bp, Homo sapiens
tttccagtgaattagtctgttt

SEQ ID NO: 7966385 - DNA, 22 bp, Homo sapiens
tttccagtgagcaaatgtagaa

SEQ ID NO: 7966386 - DNA, 22 bp, Homo sapiens
tttccagtgatggggtctggct

SEQ ID NO: 7966387 - DNA, 22 bp, Homo sapiens
tttccagtgatggggtctggct

SEQ ID NO: 7966388 - DNA, 22 bp, Homo sapiens
tttccagtgattgctgctctca

SEQ ID NO: 7966389 - DNA, 22 bp, Homo sapiens
tttccagtccctggatttaacc

SEQ ID NO: 7966390 - DNA, 22 bp, Homo sapiens
tttccagtcaccactagatcag

SEQ ID NO: 7966391 - DNA, 22 bp, Homo sapiens
tttccagtcaccactagatcag

SEQ ID NO: 7966392 - DNA, 22 bp, Homo sapiens
tttccagtaagtggcaaggagc

SEQ ID NO: 7966393 - DNA, 22 bp, Homo sapiens
tttccagtaagtggcaaggagc

SEQ ID NO: 7966394 - DNA, 22 bp, Homo sapiens
tttccagtccctggatttaacc

SEQ ID NO: 7966395 - DNA, 22 bp, Homo sapiens
tttccagtctcagccctgtaac

SEQ ID NO: 7966396 - DNA, 22 bp, Homo sapiens
tttccagtgaaattttgaatgt

SEQ ID NO: 7966397 - DNA, 22 bp, Homo sapiens
tttccagtctctgcctccaagg

SEQ ID NO: 7966398 - DNA, 22 bp, Homo sapiens
tttcatagtcaagtgtgtatga

SEQ ID NO: 7966399 - DNA, 22 bp, Homo sapiens
tttcatagtcaagtgtgtatga

SEQ ID NO: 7966400 - DNA, 22 bp, Homo sapiens
tttcataccatatccacacatc

SEQ ID NO: 7966401 - DNA, 22 bp, Homo sapiens
tttcatattattccttgagtct

SEQ ID NO: 7966402 - DNA, 22 bp, Homo sapiens
tttcatattattccttgagtct

SEQ ID NO: 7966403 - DNA, 22 bp, Homo sapiens
tttcatattgtccagtcagcgc

SEQ ID NO: 7966404 - DNA, 22 bp, Homo sapiens
tttcatatgggcattggcaata

SEQ ID NO: 7966405 - DNA, 22 bp, Homo sapiens
tttcatatgggcattggcaata

SEQ ID NO: 7966406 - DNA, 23 bp, Homo sapiens
tttcatatggtgtggatgaagaa

SEQ ID NO: 7966407 - DNA, 22 bp, Homo sapiens
tttcatcaccccaaatctatgg

SEQ ID NO: 7966408 - DNA, 22 bp, Homo sapiens
tttcatcaccccaaatctatgg

SEQ ID NO: 7966409 - DNA, 22 bp, Homo sapiens
tttcatcatgttggcagattgg

SEQ ID NO: 7966410 - DNA, 22 bp, Homo sapiens
tttcatcatcaaaatagtgagg

SEQ ID NO: 7966411 - DNA, 22 bp, Homo sapiens
tttcatcatcaaaatagtgagg

SEQ ID NO: 7966412 - DNA, 22 bp, Homo sapiens
tttcatctaacactacataggg

SEQ ID NO: 7966413 - DNA, 22 bp, Homo sapiens
tttcatctaacactacataggg

SEQ ID NO: 7966414 - DNA, 22 bp, Homo sapiens
tttcatctatttgctttgtgaa

SEQ ID NO: 7966415 - DNA, 22 bp, Homo sapiens
tttcatctctctaaaagacagt

SEQ ID NO: 7966416 - DNA, 22 bp, Homo sapiens
tttcatctctctaaaagacagt

SEQ ID NO: 7966417 - DNA, 22 bp, Homo sapiens
tttcatctctctaaaagacagt

SEQ ID NO: 7966418 - DNA, 22 bp, Homo sapiens
tttcataatactgtacatgaaa

SEQ ID NO: 7966419 - DNA, 22 bp, Homo sapiens
tttcataatactgtacatgaaa

SEQ ID NO: 7966420 - DNA, 22 bp, Homo sapiens
tttcataatactgtacatgaaa

SEQ ID NO: 7966421 - DNA, 22 bp, Homo sapiens
tttcataagggtttctagactt

SEQ ID NO: 7966422 - DNA, 22 bp, Homo sapiens
tttcataagggtttctagactt

SEQ ID NO: 7966423 - DNA, 22 bp, Homo sapiens
tttcataacctcaagctacagt

SEQ ID NO: 7966424 - DNA, 22 bp, Homo sapiens
tttcataacctcaagctacagt

SEQ ID NO: 7966425 - DNA, 22 bp, Homo sapiens
tttcataacctcaagctacagt

SEQ ID NO: 7966426 - DNA, 22 bp, Homo sapiens
tttcataacctcaagctacagt

SEQ ID NO: 7966427 - DNA, 22 bp, Homo sapiens
tttcataatatccagagatttt

SEQ ID NO: 7966428 - DNA, 22 bp, Homo sapiens
tttcataatatccagagatttt

SEQ ID NO: 7966429 - DNA, 22 bp, Homo sapiens
tttcataatatccagagatttt

SEQ ID NO: 7966430 - DNA, 22 bp, Homo sapiens
tttcataatagtgcagtttgtt

SEQ ID NO: 7966431 - DNA, 22 bp, Homo sapiens
tttcataatatccagagatttt

SEQ ID NO: 7966432 - DNA, 22 bp, Homo sapiens
tttcataatagtgcagtttgtt

SEQ ID NO: 7966433 - DNA, 22 bp, Homo sapiens
tttcataatagtgcagtttgtt

SEQ ID NO: 7966434 - DNA, 22 bp, Homo sapiens
tttcataatctgtcaagtgggg

SEQ ID NO: 7966435 - DNA, 22 bp, Homo sapiens
tttcataatgtcacagtcaaaa

SEQ ID NO: 7966436 - DNA, 22 bp, Homo sapiens
tttcataatgtcacagtcaaaa

SEQ ID NO: 7966437 - DNA, 22 bp, Homo sapiens
tttcataatctgtcaagtgggg

SEQ ID NO: 7966438 - DNA, 22 bp, Homo sapiens
tttcataatctgtcaagtgggg

SEQ ID NO: 7966439 - DNA, 22 bp, Homo sapiens
tttcacaggggcaacctccatg

SEQ ID NO: 7966440 - DNA, 22 bp, Homo sapiens
tttcacatcatgggatggaagc

SEQ ID NO: 7966441 - DNA, 22 bp, Homo sapiens
tttcacatcatgggatggaagc

SEQ ID NO: 7966442 - DNA, 22 bp, Homo sapiens
tttcacatcccgcgcgccctta

SEQ ID NO: 7966443 - DNA, 22 bp, Homo sapiens
tttcacatcctgaagccccact

SEQ ID NO: 7966444 - DNA, 20 bp, Homo sapiens
tttcacatctgtccctttaa

SEQ ID NO: 7966445 - DNA, 20 bp, Homo sapiens
tttcacatctgtccctttaa

SEQ ID NO: 7966446 - DNA, 20 bp, Homo sapiens
tttcacatctgtccctttaa

SEQ ID NO: 7966447 - DNA, 20 bp, Homo sapiens
tttcacatctgtccctttaa

SEQ ID NO: 7966448 - DNA, 20 bp, Homo sapiens
tttcacatctgtccctttaa

SEQ ID NO: 7966449 - DNA, 22 bp, Homo sapiens
tttcacatgcagcagggaagtg

SEQ ID NO: 7966450 - DNA, 22 bp, Homo sapiens
tttcacatgcagcagggaagtg

SEQ ID NO: 7966451 - DNA, 22 bp, Homo sapiens
tttcacatgcagcagggaagtg

SEQ ID NO: 7966452 - DNA, 22 bp, Homo sapiens
tttcacatgcagcagggaagtg

SEQ ID NO: 7966453 - DNA, 22 bp, Homo sapiens
tttcacatggaagctctcgaga

SEQ ID NO: 7966454 - DNA, 22 bp, Homo sapiens
tttcacatggaagctctcgaga

SEQ ID NO: 7966455 - DNA, 22 bp, Homo sapiens
tttcacatggactttttgttct

SEQ ID NO: 7966456 - DNA, 22 bp, Homo sapiens
tttcacatggactttttgttct

SEQ ID NO: 7966457 - DNA, 22 bp, Homo sapiens
tttcacatggactttttgttct

SEQ ID NO: 7966458 - DNA, 22 bp, Homo sapiens
tttcacatggactttttgttct

SEQ ID NO: 7966459 - DNA, 22 bp, Homo sapiens
tttcacatgtgctgttgtcaat

SEQ ID NO: 7966460 - DNA, 22 bp, Homo sapiens
tttcacatgtgctgttgtcaat

SEQ ID NO: 7966461 - DNA, 22 bp, Homo sapiens
tttcacatgtatataggcatta

SEQ ID NO: 7966462 - DNA, 22 bp, Homo sapiens
tttcacatgtggaatgccaggt

SEQ ID NO: 7966463 - DNA, 22 bp, Homo sapiens
tttcacatggtactgcctgttt

SEQ ID NO: 7966464 - DNA, 22 bp, Homo sapiens
tttcacatggtactgcctgttt

SEQ ID NO: 7966465 - DNA, 22 bp, Homo sapiens
tttcacatggtactgcctgttt

SEQ ID NO: 7966466 - DNA, 22 bp, Homo sapiens
tttcacatggtactgcctgttt

SEQ ID NO: 7966467 - DNA, 22 bp, Homo sapiens
tttcacatggtactgcctgttt

SEQ ID NO: 7966468 - DNA, 22 bp, Homo sapiens
tttcacatgtatataggcatta

SEQ ID NO: 7966469 - DNA, 22 bp, Homo sapiens
tttcacatgtatataggcatta

SEQ ID NO: 7966470 - DNA, 22 bp, Homo sapiens
tttcacatgtatataggcatta

SEQ ID NO: 7966471 - DNA, 22 bp, Homo sapiens
tttcacatgtatataggcatta

SEQ ID NO: 7966472 - DNA, 22 bp, Homo sapiens
tttcacatgtatataggcatta

SEQ ID NO: 7966473 - DNA, 22 bp, Homo sapiens
tttcacatatggttgttgattg

SEQ ID NO: 7966474 - DNA, 22 bp, Homo sapiens
tttcacatatggttgttgattg

SEQ ID NO: 7966475 - DNA, 22 bp, Homo sapiens
tttcacatatggttgttgattg

SEQ ID NO: 7966476 - DNA, 22 bp, Homo sapiens
tttcacatcagaggtagattag

SEQ ID NO: 7966477 - DNA, 22 bp, Homo sapiens
tttcacatatggttgttgattg

SEQ ID NO: 7966478 - DNA, 22 bp, Homo sapiens
tttcacatcagaggtagattag

SEQ ID NO: 7966479 - DNA, 22 bp, Homo sapiens
tttcacatcagaggtagattag

SEQ ID NO: 7966480 - DNA, 22 bp, Homo sapiens
tttcacatcagaggtagattag

SEQ ID NO: 7966481 - DNA, 22 bp, Homo sapiens
tttcacatcatgggatggaagc

SEQ ID NO: 7966482 - DNA, 22 bp, Homo sapiens
tttcacatatggttgttgattg

SEQ ID NO: 7966483 - DNA, 22 bp, Homo sapiens
tttcacatatcaactctatcct

SEQ ID NO: 7966484 - DNA, 22 bp, Homo sapiens
tttcacaggccttttgtagccc

SEQ ID NO: 7966485 - DNA, 22 bp, Homo sapiens
tttcacaggagtcctttctata

SEQ ID NO: 7966486 - DNA, 22 bp, Homo sapiens
tttcacaggagtcctttctata

SEQ ID NO: 7966487 - DNA, 22 bp, Homo sapiens
tttcacaatcaaatggtgaaat

SEQ ID NO: 7966488 - DNA, 20 bp, Homo sapiens
tttcacaatgaacatgtctc

SEQ ID NO: 7966489 - DNA, 22 bp, Homo sapiens
tttcacatttgttttaagaagt

SEQ ID NO: 7966490 - DNA, 22 bp, Homo sapiens
tttcacatttgttttaagaagt

SEQ ID NO: 7966491 - DNA, 22 bp, Homo sapiens
tttcacatttgttttaagaagt

SEQ ID NO: 7966492 - DNA, 22 bp, Homo sapiens
tttcacatttaggcgtgaattg

SEQ ID NO: 7966493 - DNA, 22 bp, Homo sapiens
tttcacatttgttttaagaagt

SEQ ID NO: 7966494 - DNA, 22 bp, Homo sapiens
tttcacatttaggcgtgaattg

SEQ ID NO: 7966495 - DNA, 22 bp, Homo sapiens
tttcacatttaggcgtgaattg

SEQ ID NO: 7966496 - DNA, 22 bp, Homo sapiens
tttcacatttaggcgtgaattg

SEQ ID NO: 7966497 - DNA, 23 bp, Homo sapiens
tttcacatttactgttagatggc

SEQ ID NO: 7966498 - DNA, 22 bp, Homo sapiens
tttcagtgtatcttccaaaagc

SEQ ID NO: 7966499 - DNA, 22 bp, Homo sapiens
tttcagtgtatcttccaaaagc

SEQ ID NO: 7966500 - DNA, 22 bp, Homo sapiens
tttcagtgtaaggtttccagga

SEQ ID NO: 7966501 - DNA, 20 bp, Homo sapiens
tttcagtggtttgtgcctag

SEQ ID NO: 7966502 - DNA, 22 bp, Homo sapiens
tttcacatttgttttaagaagt

SEQ ID NO: 7966503 - DNA, 22 bp, Homo sapiens
tttcacatttgttttaagaagt

SEQ ID NO: 7966504 - DNA, 22 bp, Homo sapiens
tttcagtggcatcgattaccct

SEQ ID NO: 7966505 - DNA, 22 bp, Homo sapiens
tttcagtgggtttatttcatgt

SEQ ID NO: 7966506 - DNA, 22 bp, Homo sapiens
tttcagtttccagctttgtcat

SEQ ID NO: 7966507 - DNA, 22 bp, Homo sapiens
tttcagtgtgagtgtcttattt

SEQ ID NO: 7966508 - DNA, 22 bp, Homo sapiens
tttcagtttgaaggaaaggcca

SEQ ID NO: 7966509 - DNA, 22 bp, Homo sapiens
tttcagtttgaaggaaaggcca

SEQ ID NO: 7966510 - DNA, 21 bp, Homo sapiens
tttcagtgtatgacagtgaaa

SEQ ID NO: 7966511 - DNA, 21 bp, Homo sapiens
tttcagtgtatgacagtgaaa

SEQ ID NO: 7966512 - DNA, 22 bp, Homo sapiens
tttcagtgtatcttccaaaagc

SEQ ID NO: 7966513 - DNA, 22 bp, Homo sapiens
tttcagtgtcagtaatgcagca

SEQ ID NO: 7966514 - DNA, 22 bp, Homo sapiens
tttcagtgtcagtaatgcagca

SEQ ID NO: 7966515 - DNA, 22 bp, Homo sapiens
tttcagtttttgctcgatgtat

SEQ ID NO: 7966516 - DNA, 22 bp, Homo sapiens
tttcagtttttgctcgatgtat

SEQ ID NO: 7966517 - DNA, 22 bp, Homo sapiens
tttcagtttgtcggccttggac

SEQ ID NO: 7966518 - DNA, 22 bp, Homo sapiens
tttcagttttataactttggcc

SEQ ID NO: 7966519 - DNA, 22 bp, Homo sapiens
tttcataaacagtagaagacta

SEQ ID NO: 7966520 - DNA, 22 bp, Homo sapiens
tttcataaacagtagaagacta

SEQ ID NO: 7966521 - DNA, 22 bp, Homo sapiens
tttcacattggcttctatttct

SEQ ID NO: 7966522 - DNA, 22 bp, Homo sapiens
tttcacattggcttctatttct

SEQ ID NO: 7966523 - DNA, 23 bp, Homo sapiens
tttcacatttactgttagatggc

SEQ ID NO: 7966524 - DNA, 23 bp, Homo sapiens
tttcacatttactgttagatggc

SEQ ID NO: 7966525 - DNA, 22 bp, Homo sapiens
tttcacattggcttctatttct

SEQ ID NO: 7966526 - DNA, 22 bp, Homo sapiens
tttcacattggcttctatttct

SEQ ID NO: 7966527 - DNA, 22 bp, Homo sapiens
tttcacattggcttctatttct

SEQ ID NO: 7966528 - DNA, 22 bp, Homo sapiens
tttcacattggcttctatttct

SEQ ID NO: 7966529 - DNA, 22 bp, Homo sapiens
tttcacattggcttctatttct

SEQ ID NO: 7966530 - DNA, 22 bp, Homo sapiens
tttcacattcttctgaatctac

SEQ ID NO: 7966531 - DNA, 22 bp, Homo sapiens
tttcacattctctggttatcga

SEQ ID NO: 7966532 - DNA, 22 bp, Homo sapiens
tttcacattctctggttatcga

SEQ ID NO: 7966533 - DNA, 22 bp, Homo sapiens
tttcacattctctggttatcga

SEQ ID NO: 7966534 - DNA, 22 bp, Homo sapiens
tttcacattcagatatagactt

SEQ ID NO: 7966535 - DNA, 22 bp, Homo sapiens
tttcacattcttctgaatctac

SEQ ID NO: 7966536 - DNA, 22 bp, Homo sapiens
tttcacattcttctgaatctac

SEQ ID NO: 7966537 - DNA, 22 bp, Homo sapiens
tttcacattcttctgaatctac

SEQ ID NO: 7966538 - DNA, 22 bp, Homo sapiens
tttcacattcttctgaatctac

SEQ ID NO: 7966539 - DNA, 22 bp, Homo sapiens
tttcacattagatatgtcattt

SEQ ID NO: 7966540 - DNA, 22 bp, Homo sapiens
tttcacattagatatgtcattt

SEQ ID NO: 7966541 - DNA, 23 bp, Homo sapiens
tttcacattaatgtttagcagga

SEQ ID NO: 7966542 - DNA, 23 bp, Homo sapiens
tttcacattaatgtttagcagga

SEQ ID NO: 7966543 - DNA, 23 bp, Homo sapiens
tttcacattaatgtttagcagga

SEQ ID NO: 7966544 - DNA, 23 bp, Homo sapiens
tttcacattaatgtttagcagga

SEQ ID NO: 7966545 - DNA, 22 bp, Homo sapiens
tttcacattagatatgtcattt

SEQ ID NO: 7966546 - DNA, 22 bp, Homo sapiens
tttcacattagatatgtcattt

SEQ ID NO: 7966547 - DNA, 22 bp, Homo sapiens
tttcacattagatatgtcattt

SEQ ID NO: 7966548 - DNA, 22 bp, Homo sapiens
tttcacattagatatgtcattt

SEQ ID NO: 7966549 - DNA, 22 bp, Homo sapiens
tttcacattagatatgtcattt

SEQ ID NO: 7966550 - DNA, 22 bp, Homo sapiens
tttcacattcagatatagactt

SEQ ID NO: 7966551 - DNA, 22 bp, Homo sapiens
tttcacattcagatatagactt

SEQ ID NO: 7966552 - DNA, 22 bp, Homo sapiens
tttcacattcagatatagactt

SEQ ID NO: 7966553 - DNA, 22 bp, Homo sapiens
tttcacattcagatatagactt

SEQ ID NO: 7966554 - DNA, 22 bp, Homo sapiens
tttcaataacaaagctcatttt

SEQ ID NO: 7966555 - DNA, 22 bp, Homo sapiens
tttcaatgacacaaaagagaaa

SEQ ID NO: 7966556 - DNA, 22 bp, Homo sapiens
tttcaatgacacaaaagagaaa

SEQ ID NO: 7966557 - DNA, 22 bp, Homo sapiens
tttcaataacaaagctcatttt

SEQ ID NO: 7966558 - DNA, 22 bp, Homo sapiens
tttcaagtttagtgtgttcaaa

SEQ ID NO: 7966559 - DNA, 22 bp, Homo sapiens
tttcaagtttagtgtgttcaaa

SEQ ID NO: 7966560 - DNA, 22 bp, Homo sapiens
tttcaagtttagtgtgttcaaa

SEQ ID NO: 7966561 - DNA, 20 bp, Homo sapiens
tttcaagttgtaaggtatca

SEQ ID NO: 7966562 - DNA, 20 bp, Homo sapiens
tttcaagttgtaaggtatca

SEQ ID NO: 7966563 - DNA, 22 bp, Homo sapiens
tttcaagttgttgcattaaatg

SEQ ID NO: 7966564 - DNA, 22 bp, Homo sapiens
tttcaagttgtttatatccaga

SEQ ID NO: 7966565 - DNA, 22 bp, Homo sapiens
tttcaagtgactatggtttttg

SEQ ID NO: 7966566 - DNA, 22 bp, Homo sapiens
tttcaagtgactatggtttttg

SEQ ID NO: 7966567 - DNA, 22 bp, Homo sapiens
tttcaagtgactatggtttttg

SEQ ID NO: 7966568 - DNA, 22 bp, Homo sapiens
tttcaagtggggacatttgaga

SEQ ID NO: 7966569 - DNA, 22 bp, Homo sapiens
tttcaagtgtcctgattaatgg

SEQ ID NO: 7966570 - DNA, 22 bp, Homo sapiens
tttcaagttctgttcctaaact

SEQ ID NO: 7966571 - DNA, 22 bp, Homo sapiens
tttcaagttctgttcctaaact

SEQ ID NO: 7966572 - DNA, 22 bp, Homo sapiens
tttcaagttcccagttttgtgg

SEQ ID NO: 7966573 - DNA, 22 bp, Homo sapiens
tttcaagttaaatggggtcttt

SEQ ID NO: 7966574 - DNA, 22 bp, Homo sapiens
tttcacaactgcttatttgaga

SEQ ID NO: 7966575 - DNA, 22 bp, Homo sapiens
tttcacaactgcttatttgaga

SEQ ID NO: 7966576 - DNA, 22 bp, Homo sapiens
tttcacaagacagctactgttg

SEQ ID NO: 7966577 - DNA, 22 bp, Homo sapiens
tttcacaagacagctactgttg

SEQ ID NO: 7966578 - DNA, 22 bp, Homo sapiens
tttcacaagacagctactgttg

SEQ ID NO: 7966579 - DNA, 22 bp, Homo sapiens
tttcacaatcaaatggtgaaat

SEQ ID NO: 7966580 - DNA, 22 bp, Homo sapiens
tttcacaagtttcaggattctg

SEQ ID NO: 7966581 - DNA, 22 bp, Homo sapiens
tttcacaagacagctactgttg

SEQ ID NO: 7966582 - DNA, 18 bp, Homo sapiens
tttcacaacctccagagg

SEQ ID NO: 7966583 - DNA, 19 bp, Homo sapiens
tttcaatggcttagagaaa

SEQ ID NO: 7966584 - DNA, 18 bp, Homo sapiens
tttcacaacctccagagg

SEQ ID NO: 7966585 - DNA, 22 bp, Homo sapiens
tttcaatgacacaaaagagaaa

SEQ ID NO: 7966586 - DNA, 22 bp, Homo sapiens
tttcacaacgttgtggtgagag

SEQ ID NO: 7966587 - DNA, 22 bp, Homo sapiens
tttcacaactgcttatttgaga

SEQ ID NO: 7966588 - DNA, 22 bp, Homo sapiens
tttcacaacgttgtggtgagag

SEQ ID NO: 7966589 - DNA, 22 bp, Homo sapiens
tttcaaggatgttatataaatg

SEQ ID NO: 7966590 - DNA, 22 bp, Homo sapiens
tttcaaggccttctggttcagt

SEQ ID NO: 7966591 - DNA, 22 bp, Homo sapiens
tttcaaggatgttatataaatg

SEQ ID NO: 7966592 - DNA, 23 bp, Homo sapiens
tttcaaggtgtctgtaccactga

SEQ ID NO: 7966593 - DNA, 22 bp, Homo sapiens
tttcaaggtgcaggagggtttt

SEQ ID NO: 7966594 - DNA, 17 bp, Homo sapiens
tttcaaggttacgttcc

SEQ ID NO: 7966595 - DNA, 22 bp, Homo sapiens
tttcaagtaagatacatttcag

SEQ ID NO: 7966596 - DNA, 22 bp, Homo sapiens
tttcaagggaatatgaaattca

SEQ ID NO: 7966597 - DNA, 20 bp, Homo sapiens
tttcaagtcagcaattctca

SEQ ID NO: 7966598 - DNA, 22 bp, Homo sapiens
tttcaagtagagggatcgctag

SEQ ID NO: 7966599 - DNA, 22 bp, Homo sapiens
tttcaagtactgtaaacatgct

SEQ ID NO: 7966600 - DNA, 22 bp, Homo sapiens
tttcaagtcattctataatatc

SEQ ID NO: 7966601 - DNA, 22 bp, Homo sapiens
tttatttatccttctggattgc

SEQ ID NO: 7966602 - DNA, 23 bp, Homo sapiens
tttatttatttaggctgagggat

SEQ ID NO: 7966603 - DNA, 22 bp, Homo sapiens
tttatttatccttctggattgc

SEQ ID NO: 7966604 - DNA, 23 bp, Homo sapiens
tttatttatttaggctgagggat

SEQ ID NO: 7966605 - DNA, 21 bp, Homo sapiens
tttatttatataggacacatg

SEQ ID NO: 7966606 - DNA, 21 bp, Homo sapiens
tttatttatataggacacatg

SEQ ID NO: 7966607 - DNA, 22 bp, Homo sapiens
tttatttatccttctggattgc

SEQ ID NO: 7966608 - DNA, 21 bp, Homo sapiens
tttatttatataggacacatg

SEQ ID NO: 7966609 - DNA, 21 bp, Homo sapiens
tttatttatataggacacatg

SEQ ID NO: 7966610 - DNA, 22 bp, Homo sapiens
tttatttataagccacttgctg

SEQ ID NO: 7966611 - DNA, 22 bp, Homo sapiens
tttatttataagccacttgctg

SEQ ID NO: 7966612 - DNA, 21 bp, Homo sapiens
tttatttatataggacacatg

SEQ ID NO: 7966613 - DNA, 22 bp, Homo sapiens
tttatttataagccacttgctg

SEQ ID NO: 7966614 - DNA, 22 bp, Homo sapiens
tttatttataagccacttgctg

SEQ ID NO: 7966615 - DNA, 22 bp, Homo sapiens
tttaggaatattttctttcagg

SEQ ID NO: 7966616 - DNA, 22 bp, Homo sapiens
tttaggaatagctgacaatctt

SEQ ID NO: 7966617 - DNA, 22 bp, Homo sapiens
tttaggaatagctgacaatctt

SEQ ID NO: 7966618 - DNA, 22 bp, Homo sapiens
tttaggaatagctgacaatctt

SEQ ID NO: 7966619 - DNA, 22 bp, Homo sapiens
tttaggagtcaaatgttttagg

SEQ ID NO: 7966620 - DNA, 18 bp, Homo sapiens
tttaggaattccaagaga

SEQ ID NO: 7966621 - DNA, 22 bp, Homo sapiens
tttaggataactccagttttcc

SEQ ID NO: 7966622 - DNA, 22 bp, Homo sapiens
tttaggatcaatgagaaagtct

SEQ ID NO: 7966623 - DNA, 22 bp, Homo sapiens
tttaggatgctctattctgact

SEQ ID NO: 7966624 - DNA, 22 bp, Homo sapiens
tttaggcaaactcattgtcaga

SEQ ID NO: 7966625 - DNA, 22 bp, Homo sapiens
tttaggcaagaactcactgaga

SEQ ID NO: 7966626 - DNA, 22 bp, Homo sapiens
tttaggcaagggcaagattatc

SEQ ID NO: 7966627 - DNA, 18 bp, Homo sapiens
tttaggaaatatgtgcct

SEQ ID NO: 7966628 - DNA, 22 bp, Homo sapiens
tttaggaaatactgtcctatga

SEQ ID NO: 7966629 - DNA, 22 bp, Homo sapiens
tttaggaaatacaaggtagcct

SEQ ID NO: 7966630 - DNA, 22 bp, Homo sapiens
tttaggaaatacaaggtagcct

SEQ ID NO: 7966631 - DNA, 22 bp, Homo sapiens
tttagctttacctcatagattt

SEQ ID NO: 7966632 - DNA, 22 bp, Homo sapiens
tttaggaagacttgaatgagta

SEQ ID NO: 7966633 - DNA, 22 bp, Homo sapiens
tttaggaagagttgagtaaatt

SEQ ID NO: 7966634 - DNA, 22 bp, Homo sapiens
tttaggaagtttcagataggaa

SEQ ID NO: 7966635 - DNA, 21 bp, Homo sapiens
tttaggaagtttaaggcaggt

SEQ ID NO: 7966636 - DNA, 22 bp, Homo sapiens
tttagccaactatatgactagt

SEQ ID NO: 7966637 - DNA, 21 bp, Homo sapiens
tttagcatttacatatttcca

SEQ ID NO: 7966638 - DNA, 22 bp, Homo sapiens
tttagcattaagcttttcaaat

SEQ ID NO: 7966639 - DNA, 22 bp, Homo sapiens
tttagcattaagcttttcaaat

SEQ ID NO: 7966640 - DNA, 22 bp, Homo sapiens
tttagcattaagcttttcaaat

SEQ ID NO: 7966641 - DNA, 22 bp, Homo sapiens
tttagcattactaaaatgaaaa

SEQ ID NO: 7966642 - DNA, 22 bp, Homo sapiens
tttagcatgttcctttcataga

SEQ ID NO: 7966643 - DNA, 22 bp, Homo sapiens
tttagcatgttcctttcataga

SEQ ID NO: 7966644 - DNA, 22 bp, Homo sapiens
tttacagctgctggcaagcttg

SEQ ID NO: 7966645 - DNA, 22 bp, Homo sapiens
tttacagcttctatactatgtg

SEQ ID NO: 7966646 - DNA, 22 bp, Homo sapiens
tttagctggcagttacagatgt

SEQ ID NO: 7966647 - DNA, 22 bp, Homo sapiens
tttagctagcctgtgtgtactt

SEQ ID NO: 7966648 - DNA, 19 bp, Homo sapiens
tttagcttacgtttcattg

SEQ ID NO: 7966649 - DNA, 22 bp, Homo sapiens
tttagcttcagttctagcttct

SEQ ID NO: 7966650 - DNA, 22 bp, Homo sapiens
tttagcttcagttctagcttct

SEQ ID NO: 7966651 - DNA, 22 bp, Homo sapiens
tttagcttcatcttcaagctgg

SEQ ID NO: 7966652 - DNA, 22 bp, Homo sapiens
tttagcttcagttctagcttct

SEQ ID NO: 7966653 - DNA, 22 bp, Homo sapiens
tttagcttgaaagttttggagg

SEQ ID NO: 7966654 - DNA, 22 bp, Homo sapiens
tttagcttgaatcttgtttaaa

SEQ ID NO: 7966655 - DNA, 22 bp, Homo sapiens
tttagcttcttcagcttgttca

SEQ ID NO: 7966656 - DNA, 22 bp, Homo sapiens
tttatcttctgcagttctggct

SEQ ID NO: 7966657 - DNA, 22 bp, Homo sapiens
tttatctgttgtacctgcattg

SEQ ID NO: 7966658 - DNA, 22 bp, Homo sapiens
tttatctgttgtacatttatgc

SEQ ID NO: 7966659 - DNA, 22 bp, Homo sapiens
tttatctgttgtacatttatgc

SEQ ID NO: 7966660 - DNA, 22 bp, Homo sapiens
tttatctttaggactttgcaga

SEQ ID NO: 7966661 - DNA, 22 bp, Homo sapiens
tttatctttaggactttgcaga

SEQ ID NO: 7966662 - DNA, 22 bp, Homo sapiens
tttatctttaggactttgcaga

SEQ ID NO: 7966663 - DNA, 22 bp, Homo sapiens
tttatctttaggactttgcaga

SEQ ID NO: 7966664 - DNA, 22 bp, Homo sapiens
tttatctgtgggagttgtttgg

SEQ ID NO: 7966665 - DNA, 20 bp, Homo sapiens
tttatctgtgggagtggaga

SEQ ID NO: 7966666 - DNA, 20 bp, Homo sapiens
tttatctgtgggagtggaga

SEQ ID NO: 7966667 - DNA, 20 bp, Homo sapiens
tttatctgtgggagtggaga

SEQ ID NO: 7966668 - DNA, 22 bp, Homo sapiens
tttatctgtggtaaataacatt

SEQ ID NO: 7966669 - DNA, 22 bp, Homo sapiens
tttatctgttcctcttggaggc

SEQ ID NO: 7966670 - DNA, 22 bp, Homo sapiens
tttatctgttcctcttggaggc

SEQ ID NO: 7966671 - DNA, 22 bp, Homo sapiens
tttatctgtggtaaataacatt

SEQ ID NO: 7966672 - DNA, 22 bp, Homo sapiens
tttatctgtggtaaataacatt

SEQ ID NO: 7966673 - DNA, 22 bp, Homo sapiens
tttatctgtagagcttcaccta

SEQ ID NO: 7966674 - DNA, 22 bp, Homo sapiens
tttatctgtatatctcaagtgt

SEQ ID NO: 7966675 - DNA, 22 bp, Homo sapiens
tttatctgtatatctcaagtgt

SEQ ID NO: 7966676 - DNA, 22 bp, Homo sapiens
tttatctggactgtgatataaa

SEQ ID NO: 7966677 - DNA, 22 bp, Homo sapiens
tttatctggactgtgatataaa

SEQ ID NO: 7966678 - DNA, 22 bp, Homo sapiens
tttatctgctatctgctgtgct

SEQ ID NO: 7966679 - DNA, 18 bp, Homo sapiens
tttagtggtgcatttgac

SEQ ID NO: 7966680 - DNA, 22 bp, Homo sapiens
tttagtgtaagcataaagaaca

SEQ ID NO: 7966681 - DNA, 22 bp, Homo sapiens
tttaggcagaacatggactttg

SEQ ID NO: 7966682 - DNA, 22 bp, Homo sapiens
tttagtgctttgctattcatgg

SEQ ID NO: 7966683 - DNA, 22 bp, Homo sapiens
tttaggcagctacatactaact

SEQ ID NO: 7966684 - DNA, 22 bp, Homo sapiens
tttagtgtagcattcagagtca

SEQ ID NO: 7966685 - DNA, 22 bp, Homo sapiens
tttagtgtaattctgccttttg

SEQ ID NO: 7966686 - DNA, 22 bp, Homo sapiens
tttagtgtagcattcagagtca

SEQ ID NO: 7966687 - DNA, 22 bp, Homo sapiens
tttagtgtaagcataaagaaca

SEQ ID NO: 7966688 - DNA, 22 bp, Homo sapiens
tttagtgtaagcataaagaaca

SEQ ID NO: 7966689 - DNA, 22 bp, Homo sapiens
tttagtgtaattctgccttttg

SEQ ID NO: 7966690 - DNA, 22 bp, Homo sapiens
tttagtgtgacagtccccagta

SEQ ID NO: 7966691 - DNA, 22 bp, Homo sapiens
tttagtgtgacagtccccagta

SEQ ID NO: 7966692 - DNA, 22 bp, Homo sapiens
tttagtgtggcactgatgttca

SEQ ID NO: 7966693 - DNA, 22 bp, Homo sapiens
tttagtgtgacagtccccagta

SEQ ID NO: 7966694 - DNA, 22 bp, Homo sapiens
tttagtgtgacagtccccagta

SEQ ID NO: 7966695 - DNA, 22 bp, Homo sapiens
tttagtgtagcctaagcagaat

SEQ ID NO: 7966696 - DNA, 22 bp, Homo sapiens
tttagtgtagcctaagcagaat

SEQ ID NO: 7966697 - DNA, 22 bp, Homo sapiens
tttagtgtagcattcagagtca

SEQ ID NO: 7966698 - DNA, 22 bp, Homo sapiens
tttagtgtagcattcagagtca

SEQ ID NO: 7966699 - DNA, 22 bp, Homo sapiens
tttagtgtagcctaagcagaat

SEQ ID NO: 7966700 - DNA, 22 bp, Homo sapiens
tttagtgtagcctaagcagaat

SEQ ID NO: 7966701 - DNA, 22 bp, Homo sapiens
tttagtgtggcactgatgttca

SEQ ID NO: 7966702 - DNA, 22 bp, Homo sapiens
tttagtgtttgcgtgtactcct

SEQ ID NO: 7966703 - DNA, 22 bp, Homo sapiens
tttagtgtggcactgatgttca

SEQ ID NO: 7966704 - DNA, 22 bp, Homo sapiens
tttagtgtttgcgtgtactcct

SEQ ID NO: 7966705 - DNA, 22 bp, Homo sapiens
tttagttattgcacagaattag

SEQ ID NO: 7966706 - DNA, 22 bp, Homo sapiens
tttagtgtttgcgtgtactcct

SEQ ID NO: 7966707 - DNA, 22 bp, Homo sapiens
tttatctgcattctgaccatct

SEQ ID NO: 7966708 - DNA, 22 bp, Homo sapiens
tttatctgctatctgctgtgct

SEQ ID NO: 7966709 - DNA, 22 bp, Homo sapiens
tttattgggtgcagtgcccaca

SEQ ID NO: 7966710 - DNA, 22 bp, Homo sapiens
tttattgggtgcagtgcccaca

SEQ ID NO: 7966711 - DNA, 22 bp, Homo sapiens
tttattgtcaatctattcccag

SEQ ID NO: 7966712 - DNA, 22 bp, Homo sapiens
tttattgtcaatctattcccag

SEQ ID NO: 7966713 - DNA, 22 bp, Homo sapiens
tttattgtcaatctattcccag

SEQ ID NO: 7966714 - DNA, 22 bp, Homo sapiens
tttattgtcaatctattcccag

SEQ ID NO: 7966715 - DNA, 22 bp, Homo sapiens
tttattgtctatgaactgcttg

SEQ ID NO: 7966716 - DNA, 22 bp, Homo sapiens
tttattgtctatgaactgcttg

SEQ ID NO: 7966717 - DNA, 22 bp, Homo sapiens
tttattgtctatgaactgcttg

SEQ ID NO: 7966718 - DNA, 22 bp, Homo sapiens
tttattgtctatgaactgcttg

SEQ ID NO: 7966719 - DNA, 22 bp, Homo sapiens
tttattgtctatgaactgcttg

SEQ ID NO: 7966720 - DNA, 20 bp, Homo sapiens
tttattggcctttcaggaac

SEQ ID NO: 7966721 - DNA, 20 bp, Homo sapiens
tttattggcctttcaggaac

SEQ ID NO: 7966722 - DNA, 22 bp, Homo sapiens
tttattgggcctggaggatcta

SEQ ID NO: 7966723 - DNA, 22 bp, Homo sapiens
tttattgggtgcagtgcccaca

SEQ ID NO: 7966724 - DNA, 22 bp, Homo sapiens
tttattgggcctggaggatcta

SEQ ID NO: 7966725 - DNA, 22 bp, Homo sapiens
tttattgggcctggaggatcta

SEQ ID NO: 7966726 - DNA, 22 bp, Homo sapiens
tttattgtgttgaaactgaatt

SEQ ID NO: 7966727 - DNA, 22 bp, Homo sapiens
tttattgtcttcgtggtgccta

SEQ ID NO: 7966728 - DNA, 22 bp, Homo sapiens
tttattgtgttgaaactgaatt

SEQ ID NO: 7966729 - DNA, 22 bp, Homo sapiens
tttattgtgttgaaactgaatt

SEQ ID NO: 7966730 - DNA, 22 bp, Homo sapiens
tttattgtgttgaaactgaatt

SEQ ID NO: 7966731 - DNA, 22 bp, Homo sapiens
tttattgtcttcgtggtgccta

SEQ ID NO: 7966732 - DNA, 22 bp, Homo sapiens
tttattgtcttcgtggtgccta

SEQ ID NO: 7966733 - DNA, 22 bp, Homo sapiens
tttattgtcttcgtggtgccta

SEQ ID NO: 7966734 - DNA, 22 bp, Homo sapiens
tttattgtctatgaactgcttg

SEQ ID NO: 7966735 - DNA, 16 bp, Homo sapiens
tttatttactagtgtt

SEQ ID NO: 7966736 - DNA, 16 bp, Homo sapiens
tttatttactagtgtt

SEQ ID NO: 7966737 - DNA, 22 bp, Homo sapiens
tttattgtgttgaaactgaatt

SEQ ID NO: 7966738 - DNA, 16 bp, Homo sapiens
tttatttactagtgtt

SEQ ID NO: 7966739 - DNA, 22 bp, Homo sapiens
tttatttataagccacttgctg

SEQ ID NO: 7966740 - DNA, 22 bp, Homo sapiens
tttatttataagccacttgctg

SEQ ID NO: 7966741 - DNA, 22 bp, Homo sapiens
tttatttataagccacttgctg

SEQ ID NO: 7966742 - DNA, 22 bp, Homo sapiens
tttattgctggccacctgtagc

SEQ ID NO: 7966743 - DNA, 22 bp, Homo sapiens
tttattgctgtgttagggacag

SEQ ID NO: 7966744 - DNA, 22 bp, Homo sapiens
tttattgctgtgttagggacag

SEQ ID NO: 7966745 - DNA, 22 bp, Homo sapiens
tttattggaacacagccatgac

SEQ ID NO: 7966746 - DNA, 22 bp, Homo sapiens
tttattggaacacagccatgac

SEQ ID NO: 7966747 - DNA, 22 bp, Homo sapiens
tttattggaacacagccatgac

SEQ ID NO: 7966748 - DNA, 22 bp, Homo sapiens
tttattggaacacagccatgac

SEQ ID NO: 7966749 - DNA, 22 bp, Homo sapiens
tttattgctcagcagttagttg

SEQ ID NO: 7966750 - DNA, 22 bp, Homo sapiens
tttattgctagcccttggtcca

SEQ ID NO: 7966751 - DNA, 22 bp, Homo sapiens
tttattgctggccacctgtagc

SEQ ID NO: 7966752 - DNA, 22 bp, Homo sapiens
tttattggatggatggatggat

SEQ ID NO: 7966753 - DNA, 22 bp, Homo sapiens
tttattggatatttacaagata

SEQ ID NO: 7966754 - DNA, 22 bp, Homo sapiens
tttattggatatttacaagata

SEQ ID NO: 7966755 - DNA, 22 bp, Homo sapiens
tttattggatggatggatggat

SEQ ID NO: 7966756 - DNA, 22 bp, Homo sapiens
tttattggatatttacaagata

SEQ ID NO: 7966757 - DNA, 22 bp, Homo sapiens
tttattggatatttacaagata

SEQ ID NO: 7966758 - DNA, 22 bp, Homo sapiens
tttattggatatttacaagata

SEQ ID NO: 7966759 - DNA, 22 bp, Homo sapiens
tttattggatatttacaagata

SEQ ID NO: 7966760 - DNA, 22 bp, Homo sapiens
tttattggatggatggatggat

SEQ ID NO: 7966761 - DNA, 22 bp, Homo sapiens
tttattggatggatggatggat

SEQ ID NO: 7966762 - DNA, 20 bp, Homo sapiens
tttattggcctttcaggaac

SEQ ID NO: 7966763 - DNA, 20 bp, Homo sapiens
tttattggcctttcaggaac

SEQ ID NO: 7966764 - DNA, 22 bp, Homo sapiens
tttattggatgggtcagctcta

SEQ ID NO: 7966765 - DNA, 22 bp, Homo sapiens
tttattggatgggtcagctcta

SEQ ID NO: 7966766 - DNA, 22 bp, Homo sapiens
tttattggaacacagccatgac

SEQ ID NO: 7966767 - DNA, 22 bp, Homo sapiens
tttatgttatgggtaggatcaa

SEQ ID NO: 7966768 - DNA, 22 bp, Homo sapiens
tttatgttcctcttgagctttc

SEQ ID NO: 7966769 - DNA, 22 bp, Homo sapiens
tttatgtcactttgaaagagag

SEQ ID NO: 7966770 - DNA, 21 bp, Homo sapiens
tttatgtacttcatagagtag

SEQ ID NO: 7966771 - DNA, 22 bp, Homo sapiens
tttatgtagttacggactatca

SEQ ID NO: 7966772 - DNA, 22 bp, Homo sapiens
tttatgtagttacggactatca

SEQ ID NO: 7966773 - DNA, 22 bp, Homo sapiens
tttatgtttgcattttcaaaga

SEQ ID NO: 7966774 - DNA, 22 bp, Homo sapiens
tttattgccctgtagtacagga

SEQ ID NO: 7966775 - DNA, 22 bp, Homo sapiens
tttattgccctgtagtacagga

SEQ ID NO: 7966776 - DNA, 22 bp, Homo sapiens
tttattgccctgtagtacagga

SEQ ID NO: 7966777 - DNA, 22 bp, Homo sapiens
tttatgtttgacaatgatctgg

SEQ ID NO: 7966778 - DNA, 22 bp, Homo sapiens
tttatgttcctcttgagctttc

SEQ ID NO: 7966779 - DNA, 22 bp, Homo sapiens
tttatgtttgacaatgatctgg

SEQ ID NO: 7966780 - DNA, 22 bp, Homo sapiens
tttatgtttgacaatgatctgg

SEQ ID NO: 7966781 - DNA, 22 bp, Homo sapiens
tttatgtttgacaatgatctgg

SEQ ID NO: 7966782 - DNA, 22 bp, Homo sapiens
tttatgtttgacaatgatctgg

SEQ ID NO: 7966783 - DNA, 22 bp, Homo sapiens
tttatgtttgacaatgatctgg

SEQ ID NO: 7966784 - DNA, 22 bp, Homo sapiens
tttatgtttgcattttcaaaga

SEQ ID NO: 7966785 - DNA, 22 bp, Homo sapiens
tttatctttggatcttcagaaa

SEQ ID NO: 7966786 - DNA, 22 bp, Homo sapiens
tttatctttggatcttcagaaa

SEQ ID NO: 7966787 - DNA, 22 bp, Homo sapiens
tttatgaaccactctacacctt

SEQ ID NO: 7966788 - DNA, 22 bp, Homo sapiens
tttatgaaccactctacacctt

SEQ ID NO: 7966789 - DNA, 22 bp, Homo sapiens
tttatgaaccactctacacctt

SEQ ID NO: 7966790 - DNA, 22 bp, Homo sapiens
tttatctttggatcttcagaaa

SEQ ID NO: 7966791 - DNA, 22 bp, Homo sapiens
tttatgaactacagatataact

SEQ ID NO: 7966792 - DNA, 22 bp, Homo sapiens
tttatgaactacagatataact

SEQ ID NO: 7966793 - DNA, 22 bp, Homo sapiens
tttatgaactacagatataact

SEQ ID NO: 7966794 - DNA, 22 bp, Homo sapiens
tttatgacaagcattactgatt

SEQ ID NO: 7966795 - DNA, 22 bp, Homo sapiens
tttatgaactacagatataact

SEQ ID NO: 7966796 - DNA, 22 bp, Homo sapiens
tttatgacaagcattactgatt

SEQ ID NO: 7966797 - DNA, 22 bp, Homo sapiens
tttatgagcaccttggcccaga

SEQ ID NO: 7966798 - DNA, 22 bp, Homo sapiens
tttatgagcctcaaatctgagt

SEQ ID NO: 7966799 - DNA, 22 bp, Homo sapiens
tttatgacccaagaagatacca

SEQ ID NO: 7966800 - DNA, 22 bp, Homo sapiens
tttatgacattacaatatcaag

SEQ ID NO: 7966801 - DNA, 22 bp, Homo sapiens
tttatgacccaagaagatacca

SEQ ID NO: 7966802 - DNA, 22 bp, Homo sapiens
tttatgacttctaatctgaagc

SEQ ID NO: 7966803 - DNA, 22 bp, Homo sapiens
tttatgtacatatccacaagga

SEQ ID NO: 7966804 - DNA, 22 bp, Homo sapiens
tttatgtacatatccacaagga

SEQ ID NO: 7966805 - DNA, 22 bp, Homo sapiens
tttatgtaatttcataggtgtg

SEQ ID NO: 7966806 - DNA, 22 bp, Homo sapiens
tttatgtaatttcataggtgtg

SEQ ID NO: 7966807 - DNA, 21 bp, Homo sapiens
tttatgtacttcatagagtag

SEQ ID NO: 7966808 - DNA, 21 bp, Homo sapiens
tttatgtacttcatagagtag

SEQ ID NO: 7966809 - DNA, 21 bp, Homo sapiens
tttatgtacttcatagagtag

SEQ ID NO: 7966810 - DNA, 21 bp, Homo sapiens
tttatgtacttcatagagtag

SEQ ID NO: 7966811 - DNA, 22 bp, Homo sapiens
tttaaattatagttaatgtctg

SEQ ID NO: 7966812 - DNA, 22 bp, Homo sapiens
tttaaattatagttaatgtctg

SEQ ID NO: 7966813 - DNA, 22 bp, Homo sapiens
ttgtttaaaatgtagcaagaaa

SEQ ID NO: 7966814 - DNA, 22 bp, Homo sapiens
ttgtttaaaatgtagcaagaaa

SEQ ID NO: 7966815 - DNA, 22 bp, Homo sapiens
ttgtttaaaatgtagcaagaaa

SEQ ID NO: 7966816 - DNA, 22 bp, Homo sapiens
ttgtttaaaatgtagcaagaaa

SEQ ID NO: 7966817 - DNA, 22 bp, Homo sapiens
tttaaattatagttaatgtctg

SEQ ID NO: 7966818 - DNA, 22 bp, Homo sapiens
tttaaattatagttaatgtctg

SEQ ID NO: 7966819 - DNA, 22 bp, Homo sapiens
tttaaattatagttaatgtctg

SEQ ID NO: 7966820 - DNA, 22 bp, Homo sapiens
tttaacagatgtgaaattttca

SEQ ID NO: 7966821 - DNA, 22 bp, Homo sapiens
tttaaattatagttaatgtctg

SEQ ID NO: 7966822 - DNA, 22 bp, Homo sapiens
tttaacatgtaattgctgcttt

SEQ ID NO: 7966823 - DNA, 22 bp, Homo sapiens
tttaacatgtaattgctgcttt

SEQ ID NO: 7966824 - DNA, 22 bp, Homo sapiens
tttaacagatgtgaaattttca

SEQ ID NO: 7966825 - DNA, 22 bp, Homo sapiens
tttaacagatgtgaaattttca

SEQ ID NO: 7966826 - DNA, 22 bp, Homo sapiens
tttaacaggtaaagtaaatgtg

SEQ ID NO: 7966827 - DNA, 22 bp, Homo sapiens
tttaacaggtaaagtaaatgtg

SEQ ID NO: 7966828 - DNA, 22 bp, Homo sapiens
tttaacaggtaaagtaaatgtg

SEQ ID NO: 7966829 - DNA, 22 bp, Homo sapiens
tttaacatgttcaagaaacata

SEQ ID NO: 7966830 - DNA, 22 bp, Homo sapiens
tttaacatgttcaagaaacata

SEQ ID NO: 7966831 - DNA, 22 bp, Homo sapiens
tttaacatgtgaattttggaag

SEQ ID NO: 7966832 - DNA, 22 bp, Homo sapiens
tttaacatgttcaagaaacata

SEQ ID NO: 7966833 - DNA, 22 bp, Homo sapiens
tttaacatgttcaagaaacata

SEQ ID NO: 7966834 - DNA, 22 bp, Homo sapiens
tttaacatgttcaagaaacata

SEQ ID NO: 7966835 - DNA, 23 bp, Homo sapiens
tttaacatttgaacatgtggcca

SEQ ID NO: 7966836 - DNA, 23 bp, Homo sapiens
tttaacatttgaacatgtggcca

SEQ ID NO: 7966837 - DNA, 22 bp, Homo sapiens
tttaacatgttcaagaaacata

SEQ ID NO: 7966838 - DNA, 22 bp, Homo sapiens
tttaacatgttcaagaaacata

SEQ ID NO: 7966839 - DNA, 22 bp, Homo sapiens
tttaacctctaatttagttctc

SEQ ID NO: 7966840 - DNA, 22 bp, Homo sapiens
tttaacctgtcaatttgcatgc

SEQ ID NO: 7966841 - DNA, 23 bp, Homo sapiens
tttaaccttggtcaagaatttcc

SEQ ID NO: 7966842 - DNA, 22 bp, Homo sapiens
tttaactcatttctggcagttt

SEQ ID NO: 7966843 - DNA, 22 bp, Homo sapiens
tttaactcctagtgtgtattag

SEQ ID NO: 7966844 - DNA, 22 bp, Homo sapiens
tttaaccagaaaggtactcatc

SEQ ID NO: 7966845 - DNA, 22 bp, Homo sapiens
tttaaccagtttacaaagaatt

SEQ ID NO: 7966846 - DNA, 22 bp, Homo sapiens
tttaaccagtttacaaagaatt

SEQ ID NO: 7966847 - DNA, 23 bp, Homo sapiens
tttaactttccaataattcattg

SEQ ID NO: 7966848 - DNA, 22 bp, Homo sapiens
tttaagaagttatgttataaat

SEQ ID NO: 7966849 - DNA, 22 bp, Homo sapiens
tttaaccagaaaggtactcatc

SEQ ID NO: 7966850 - DNA, 22 bp, Homo sapiens
tttaactctgagagtaactgag

SEQ ID NO: 7966851 - DNA, 22 bp, Homo sapiens
tttaactctgagagtaactgag

SEQ ID NO: 7966852 - DNA, 22 bp, Homo sapiens
tttaactctctagaaaatggct

SEQ ID NO: 7966853 - DNA, 22 bp, Homo sapiens
tttaactctctagaaaatggct

SEQ ID NO: 7966854 - DNA, 22 bp, Homo sapiens
tttaactctgtcattctcttta

SEQ ID NO: 7966855 - DNA, 22 bp, Homo sapiens
ttgtttaaaagaaatcatagaa

SEQ ID NO: 7966856 - DNA, 22 bp, Homo sapiens
ttgtttaaaagaaatcatagaa

SEQ ID NO: 7966857 - DNA, 22 bp, Homo sapiens
ttgtttaaaagaaatcatagaa

SEQ ID NO: 7966858 - DNA, 22 bp, Homo sapiens
ttgttgttataggtggtacaag

SEQ ID NO: 7966859 - DNA, 22 bp, Homo sapiens
ttgttgtttccaggatactgtg

SEQ ID NO: 7966860 - DNA, 22 bp, Homo sapiens
ttgttgtttccaggatactgtg

SEQ ID NO: 7966861 - DNA, 22 bp, Homo sapiens
ttgttgttggagccaatatgca

SEQ ID NO: 7966862 - DNA, 22 bp, Homo sapiens
ttgttgggcatgcagtggctgt

SEQ ID NO: 7966863 - DNA, 22 bp, Homo sapiens
ttgttgggcatgcagtggctgt

SEQ ID NO: 7966864 - DNA, 22 bp, Homo sapiens
ttgttgctcttgttgccacatg

SEQ ID NO: 7966865 - DNA, 22 bp, Homo sapiens
ttgttgcataaagtaggaaata

SEQ ID NO: 7966866 - DNA, 22 bp, Homo sapiens
ttgttgcatttcaagtatgaga

SEQ ID NO: 7966867 - DNA, 22 bp, Homo sapiens
ttgttgtcattgtagaggattt

SEQ ID NO: 7966868 - DNA, 22 bp, Homo sapiens
ttgttgtcattgtagaggattt

SEQ ID NO: 7966869 - DNA, 22 bp, Homo sapiens
ttgttgtcattgtagaggattt

SEQ ID NO: 7966870 - DNA, 22 bp, Homo sapiens
ttgttgtcattgtagaggattt

SEQ ID NO: 7966871 - DNA, 22 bp, Homo sapiens
ttgttgtcattgtagaggattt

SEQ ID NO: 7966872 - DNA, 22 bp, Homo sapiens
ttgttgtcattgtagaggattt

SEQ ID NO: 7966873 - DNA, 22 bp, Homo sapiens
ttgttggtgaatagggtggaat

SEQ ID NO: 7966874 - DNA, 22 bp, Homo sapiens
ttgttggtggaattgatgctag

SEQ ID NO: 7966875 - DNA, 22 bp, Homo sapiens
ttgttggtggaattgatgctag

SEQ ID NO: 7966876 - DNA, 22 bp, Homo sapiens
ttgttgaattagttgactgtgt

SEQ ID NO: 7966877 - DNA, 21 bp, Homo sapiens
ttgttgagagttagaacatgg

SEQ ID NO: 7966878 - DNA, 22 bp, Homo sapiens
ttgttctttatcctggaagcct

SEQ ID NO: 7966879 - DNA, 22 bp, Homo sapiens
ttgttcttgtctttgccttcac

SEQ ID NO: 7966880 - DNA, 22 bp, Homo sapiens
ttgttcttgtctttgccttcac

SEQ ID NO: 7966881 - DNA, 22 bp, Homo sapiens
ttgttcttttgcttagacagat

SEQ ID NO: 7966882 - DNA, 22 bp, Homo sapiens
ttgttcttttgcttagacagat

SEQ ID NO: 7966883 - DNA, 22 bp, Homo sapiens
ttgttcttttgcttagacagat

SEQ ID NO: 7966884 - DNA, 22 bp, Homo sapiens
ttgttcttttgcttagacagat

SEQ ID NO: 7966885 - DNA, 22 bp, Homo sapiens
ttgttcttggagcaggcagaga

SEQ ID NO: 7966886 - DNA, 23 bp, Homo sapiens
ttgttcttggatcttcctgaagc

SEQ ID NO: 7966887 - DNA, 22 bp, Homo sapiens
ttgttcttggagcaggcagaga

SEQ ID NO: 7966888 - DNA, 22 bp, Homo sapiens
ttgttcttggagcaggcagaga

SEQ ID NO: 7966889 - DNA, 22 bp, Homo sapiens
ttgttcttgccaagacatgaag

SEQ ID NO: 7966890 - DNA, 22 bp, Homo sapiens
ttgttcttccatcatccctcag

SEQ ID NO: 7966891 - DNA, 22 bp, Homo sapiens
ttgttcttctctagagaagtgg

SEQ ID NO: 7966892 - DNA, 22 bp, Homo sapiens
ttgttcttctctagagaagtgg

SEQ ID NO: 7966893 - DNA, 21 bp, Homo sapiens
ttgttcttccagaagcaaagt

SEQ ID NO: 7966894 - DNA, 22 bp, Homo sapiens
ttgttcttagtatgcattgttt

SEQ ID NO: 7966895 - DNA, 22 bp, Homo sapiens
ttgttcttagtatgcattgttt

SEQ ID NO: 7966896 - DNA, 21 bp, Homo sapiens
ttgttcttccagaagcaaagt

SEQ ID NO: 7966897 - DNA, 22 bp, Homo sapiens
ttgttcttagtatgcattgttt

SEQ ID NO: 7966898 - DNA, 22 bp, Homo sapiens
ttgttcttacttaagagtgaat

SEQ ID NO: 7966899 - DNA, 22 bp, Homo sapiens
ttgttcttacttaagagtgaat

SEQ ID NO: 7966900 - DNA, 22 bp, Homo sapiens
ttgttcttagtatgcattgttt

SEQ ID NO: 7966901 - DNA, 22 bp, Homo sapiens
tttacacattattttcagtgtg

SEQ ID NO: 7966902 - DNA, 22 bp, Homo sapiens
tttacacattattttcagtgtg

SEQ ID NO: 7966903 - DNA, 22 bp, Homo sapiens
tttacacattattttcagtgtg

SEQ ID NO: 7966904 - DNA, 22 bp, Homo sapiens
tttacaagtttacagaatgatg

SEQ ID NO: 7966905 - DNA, 22 bp, Homo sapiens
tttacaagtttacagaatgatg

SEQ ID NO: 7966906 - DNA, 22 bp, Homo sapiens
tttacaagtttacagaatgatg

SEQ ID NO: 7966907 - DNA, 19 bp, Homo sapiens
tttacaagttctttgtatg

SEQ ID NO: 7966908 - DNA, 19 bp, Homo sapiens
tttacaagttctttgtatg

SEQ ID NO: 7966909 - DNA, 19 bp, Homo sapiens
tttacaagttctttgtatg

SEQ ID NO: 7966910 - DNA, 22 bp, Homo sapiens
tttacaagtttacagaatgatg

SEQ ID NO: 7966911 - DNA, 22 bp, Homo sapiens
tttacactgccattctgaatac

SEQ ID NO: 7966912 - DNA, 22 bp, Homo sapiens
tttacactgacagcacataagg

SEQ ID NO: 7966913 - DNA, 22 bp, Homo sapiens
tttacacattattttcagtgtg

SEQ ID NO: 7966914 - DNA, 22 bp, Homo sapiens
tttacacattattttcagtgtg

SEQ ID NO: 7966915 - DNA, 22 bp, Homo sapiens
tttacaccaaaatgacacagag

SEQ ID NO: 7966916 - DNA, 22 bp, Homo sapiens
tttacactcctggaaatgatat

SEQ ID NO: 7966917 - DNA, 22 bp, Homo sapiens
tttacactcctggaaatgatat

SEQ ID NO: 7966918 - DNA, 22 bp, Homo sapiens
tttaagactcttgtagtacaca

SEQ ID NO: 7966919 - DNA, 22 bp, Homo sapiens
tttaagagcatttgcaatttat

SEQ ID NO: 7966920 - DNA, 22 bp, Homo sapiens
tttaagagcctgtacaaatatt

SEQ ID NO: 7966921 - DNA, 22 bp, Homo sapiens
tttaagagcatttgcaatttat

SEQ ID NO: 7966922 - DNA, 20 bp, Homo sapiens
tttaagaagtttctgaggaa

SEQ ID NO: 7966923 - DNA, 22 bp, Homo sapiens
tttaagaagttatgttataaat

SEQ ID NO: 7966924 - DNA, 22 bp, Homo sapiens
tttaagaagttatgttataaat

SEQ ID NO: 7966925 - DNA, 22 bp, Homo sapiens
tttaagatcatttgtattatcc

SEQ ID NO: 7966926 - DNA, 22 bp, Homo sapiens
tttacaagtcagggactgttct

SEQ ID NO: 7966927 - DNA, 22 bp, Homo sapiens
tttaagatctatcccattttgt

SEQ ID NO: 7966928 - DNA, 22 bp, Homo sapiens
tttacaagtcagggactgttct

SEQ ID NO: 7966929 - DNA, 22 bp, Homo sapiens
tttaagagctagtatgtcattt

SEQ ID NO: 7966930 - DNA, 22 bp, Homo sapiens
tttaagagctagtatgtcattt

SEQ ID NO: 7966931 - DNA, 22 bp, Homo sapiens
tttaagagcctgtacaaatatt

SEQ ID NO: 7966932 - DNA, 22 bp, Homo sapiens
tttaagagttaaactttgacct

SEQ ID NO: 7966933 - DNA, 22 bp, Homo sapiens
tttaagagctagtatgtcattt

SEQ ID NO: 7966934 - DNA, 22 bp, Homo sapiens
tttacagcattgctgaaagttc

SEQ ID NO: 7966935 - DNA, 22 bp, Homo sapiens
tttacagcaacagtgcagaggt

SEQ ID NO: 7966936 - DNA, 22 bp, Homo sapiens
tttacagattctgggtattagg

SEQ ID NO: 7966937 - DNA, 22 bp, Homo sapiens
tttacagcagcatgatttataa

SEQ ID NO: 7966938 - DNA, 22 bp, Homo sapiens
tttacagcaacagtgcagaggt

SEQ ID NO: 7966939 - DNA, 22 bp, Homo sapiens
tttacagcactgaagccagggg

SEQ ID NO: 7966940 - DNA, 22 bp, Homo sapiens
tttacagatgtggaaagtgagc

SEQ ID NO: 7966941 - DNA, 22 bp, Homo sapiens
tttacagatgtggaaagtgagc

SEQ ID NO: 7966942 - DNA, 22 bp, Homo sapiens
tttacagatgtggaaagtgagc

SEQ ID NO: 7966943 - DNA, 22 bp, Homo sapiens
tttacagatgaggatactgagg

SEQ ID NO: 7966944 - DNA, 22 bp, Homo sapiens
tttacagatgaggatactgagg

SEQ ID NO: 7966945 - DNA, 22 bp, Homo sapiens
tttacagatgaggatactgagg

SEQ ID NO: 7966946 - DNA, 22 bp, Homo sapiens
tttacagatgaggatactgagg

SEQ ID NO: 7966947 - DNA, 22 bp, Homo sapiens
tttacagatgaggatactgagg

SEQ ID NO: 7966948 - DNA, 22 bp, Homo sapiens
tttacagatgaggatactgagg

SEQ ID NO: 7966949 - DNA, 22 bp, Homo sapiens
tttacagatgaggatactgagg

SEQ ID NO: 7966950 - DNA, 22 bp, Homo sapiens
tttacagatgaggaaactgaga

SEQ ID NO: 7966951 - DNA, 22 bp, Homo sapiens
tttacagatgaggaaactgaga

SEQ ID NO: 7966952 - DNA, 22 bp, Homo sapiens
tttacagatgaggaaactgaga

SEQ ID NO: 7966953 - DNA, 22 bp, Homo sapiens
tttacagatgaggaaactgaga

SEQ ID NO: 7966954 - DNA, 22 bp, Homo sapiens
tttacagatgaggaaactgaga

SEQ ID NO: 7966955 - DNA, 22 bp, Homo sapiens
tttacagagaatgtacataaag

SEQ ID NO: 7966956 - DNA, 22 bp, Homo sapiens
tttacagagaatgtacataaag

SEQ ID NO: 7966957 - DNA, 22 bp, Homo sapiens
tttacagagaatgtacataaag

SEQ ID NO: 7966958 - DNA, 22 bp, Homo sapiens
tttacagagaatgtacataaag

SEQ ID NO: 7966959 - DNA, 22 bp, Homo sapiens
tttacagacaacttaatagggg

SEQ ID NO: 7966960 - DNA, 22 bp, Homo sapiens
tttacagacaacttaatagggg

SEQ ID NO: 7966961 - DNA, 22 bp, Homo sapiens
tttacagagaatgtacataaag

SEQ ID NO: 7966962 - DNA, 22 bp, Homo sapiens
tttacagagagagaactggact

SEQ ID NO: 7966963 - DNA, 22 bp, Homo sapiens
tttacagatctgttgatttgtt

SEQ ID NO: 7966964 - DNA, 22 bp, Homo sapiens
tttacagaggtgtcctgcattg

SEQ ID NO: 7966965 - DNA, 22 bp, Homo sapiens
tttacagagagagaactggact

SEQ ID NO: 7966966 - DNA, 22 bp, Homo sapiens
tttacacttgaggaaactgagg

SEQ ID NO: 7966967 - DNA, 22 bp, Homo sapiens
tttacacttgaggaaactgagg

SEQ ID NO: 7966968 - DNA, 22 bp, Homo sapiens
tttacagaagagaaggatgctt

SEQ ID NO: 7966969 - DNA, 22 bp, Homo sapiens
tttacacttgaggaaactgagg

SEQ ID NO: 7966970 - DNA, 22 bp, Homo sapiens
tttacacttattatgaagcttt

SEQ ID NO: 7966971 - DNA, 22 bp, Homo sapiens
tttacagaatgttgaatttggg

SEQ ID NO: 7966972 - DNA, 22 bp, Homo sapiens
tttacagaatgtcaatttctat

SEQ ID NO: 7966973 - DNA, 22 bp, Homo sapiens
tttacagaatgttgaatttggg

SEQ ID NO: 7966974 - DNA, 22 bp, Homo sapiens
tttacagaatgtcaatttctat

SEQ ID NO: 7966975 - DNA, 22 bp, Homo sapiens
gcgcaccacctccaggtggccg

SEQ ID NO: 7966976 - DNA, 22 bp, Homo sapiens
gcgcaccacctccaggtggccg

SEQ ID NO: 7966977 - DNA, 22 bp, Homo sapiens
gcgcaccacctccaggtggccg

SEQ ID NO: 7966978 - DNA, 22 bp, Homo sapiens
gcgatttggttacagaagggca

SEQ ID NO: 7966979 - DNA, 22 bp, Homo sapiens
gcgcactgggcgcacgcgtagg

SEQ ID NO: 7966980 - DNA, 22 bp, Homo sapiens
gcgcagagtagcagagtgctga

SEQ ID NO: 7966981 - DNA, 22 bp, Homo sapiens
gcgcagagtagcagagtgctga

SEQ ID NO: 7966982 - DNA, 22 bp, Homo sapiens
gcgcagctcagtgagggaactt

SEQ ID NO: 7966983 - DNA, 22 bp, Homo sapiens
gcgcagagtagcagagtgctga

SEQ ID NO: 7966984 - DNA, 22 bp, Homo sapiens
caaacattccgcttctcccagg

SEQ ID NO: 7966985 - DNA, 22 bp, Homo sapiens
caaacattgcactttctgctat

SEQ ID NO: 7966986 - DNA, 22 bp, Homo sapiens
caaacattccgcttctcccagg

SEQ ID NO: 7966987 - DNA, 22 bp, Homo sapiens
gcgagtgccgagagggcagggc

SEQ ID NO: 7966988 - DNA, 22 bp, Homo sapiens
gcgagtgccgagagggcagggc

SEQ ID NO: 7966989 - DNA, 22 bp, Homo sapiens
gcgagtgccgagagggcagggc

SEQ ID NO: 7966990 - DNA, 22 bp, Homo sapiens
gcgagggcacgcggttgaaggc

SEQ ID NO: 7966991 - DNA, 22 bp, Homo sapiens
gcgagtagatgatgaaagtgag

SEQ ID NO: 7966992 - DNA, 22 bp, Homo sapiens
gcgagtcgccgctgcagcccta

SEQ ID NO: 7966993 - DNA, 22 bp, Homo sapiens
gcgagggcacgcggttgaaggc

SEQ ID NO: 7966994 - DNA, 22 bp, Homo sapiens
gcgagggcacgcggttgaaggc

SEQ ID NO: 7966995 - DNA, 22 bp, Homo sapiens
gcgaggaggggtgctgggcccc

SEQ ID NO: 7966996 - DNA, 22 bp, Homo sapiens
caaactgagcatcagaaagttt

SEQ ID NO: 7966997 - DNA, 22 bp, Homo sapiens
caaactgagcatcagaaagttt

SEQ ID NO: 7966998 - DNA, 22 bp, Homo sapiens
caaactgaacacgaaagtcttt

SEQ ID NO: 7966999 - DNA, 22 bp, Homo sapiens
caaactctcccactcactctga

SEQ ID NO: 7967000 - DNA, 22 bp, Homo sapiens
caaactattgttcacaagacaa

SEQ ID NO: 7967001 - DNA, 22 bp, Homo sapiens
caaactctgtaggacagttcaa

SEQ ID NO: 7967002 - DNA, 22 bp, Homo sapiens
caaactattgttcacaagacaa

SEQ ID NO: 7967003 - DNA, 22 bp, Homo sapiens
caaactatttacaatggaatca

SEQ ID NO: 7967004 - DNA, 23 bp, Homo sapiens
caaacctgtttctctcacctgtc

SEQ ID NO: 7967005 - DNA, 23 bp, Homo sapiens
caaacctgttctccccacatgca

SEQ ID NO: 7967006 - DNA, 22 bp, Homo sapiens
caaacctgttagaggtcatcgt

SEQ ID NO: 7967007 - DNA, 22 bp, Homo sapiens
caaacctgttagaggtcatcgt

SEQ ID NO: 7967008 - DNA, 22 bp, Homo sapiens
caaacctgttagaggtcatcgt

SEQ ID NO: 7967009 - DNA, 22 bp, Homo sapiens
caaaccttgttccagtcaactc

SEQ ID NO: 7967010 - DNA, 22 bp, Homo sapiens
caaactattgttcacaagacaa

SEQ ID NO: 7967011 - DNA, 23 bp, Homo sapiens
caaacctgttctccccacatgca

SEQ ID NO: 7967012 - DNA, 22 bp, Homo sapiens
caaacattgcactttctgctat

SEQ ID NO: 7967013 - DNA, 22 bp, Homo sapiens
caaaccattaagcatgttgagt

SEQ ID NO: 7967014 - DNA, 22 bp, Homo sapiens
caaacctgtccttttgtctcct

SEQ ID NO: 7967015 - DNA, 22 bp, Homo sapiens
caaacctgctgctattttatcc

SEQ ID NO: 7967016 - DNA, 22 bp, Homo sapiens
caaacctgagaacatgtgctgt

SEQ ID NO: 7967017 - DNA, 22 bp, Homo sapiens
caaacctgactggggatgggcg

SEQ ID NO: 7967018 - DNA, 22 bp, Homo sapiens
caaaccggaaagtgtgaggaca

SEQ ID NO: 7967019 - DNA, 22 bp, Homo sapiens
gctcaggagctgacagcctcaa

SEQ ID NO: 7967020 - DNA, 22 bp, Homo sapiens
gctcaggagctgacagcctcaa

SEQ ID NO: 7967021 - DNA, 22 bp, Homo sapiens
gctcaggatcagccacctcttt

SEQ ID NO: 7967022 - DNA, 22 bp, Homo sapiens
gctcaggagctgacagcctcaa

SEQ ID NO: 7967023 - DNA, 22 bp, Homo sapiens
gctcaggagctgacagcctcaa

SEQ ID NO: 7967024 - DNA, 22 bp, Homo sapiens
gctcaggagctgacagcctcaa

SEQ ID NO: 7967025 - DNA, 22 bp, Homo sapiens
gctcaggagctcttggtggcgc

SEQ ID NO: 7967026 - DNA, 22 bp, Homo sapiens
gctcaggatcagccacctcttt

SEQ ID NO: 7967027 - DNA, 22 bp, Homo sapiens
gctcaggatcagccacctcttt

SEQ ID NO: 7967028 - DNA, 22 bp, Homo sapiens
gctcaggaaatagtttagtgtt

SEQ ID NO: 7967029 - DNA, 22 bp, Homo sapiens
gctcaggatcagccacctcttt

SEQ ID NO: 7967030 - DNA, 22 bp, Homo sapiens
gctcaggatcccaggggtgtgc

SEQ ID NO: 7967031 - DNA, 22 bp, Homo sapiens
gctcaggatttcatccatgtgt

SEQ ID NO: 7967032 - DNA, 22 bp, Homo sapiens
gctcaggcaaatttctggtgaa

SEQ ID NO: 7967033 - DNA, 22 bp, Homo sapiens
gctcaggcaaatttctggtgaa

SEQ ID NO: 7967034 - DNA, 22 bp, Homo sapiens
caaaggcaacatatacttgttt

SEQ ID NO: 7967035 - DNA, 22 bp, Homo sapiens
caaaggcacacatacctttctg

SEQ ID NO: 7967036 - DNA, 22 bp, Homo sapiens
caaaggcaatcttgttctctgg

SEQ ID NO: 7967037 - DNA, 22 bp, Homo sapiens
caaaggtattctcattttggaa

SEQ ID NO: 7967038 - DNA, 22 bp, Homo sapiens
caaaggcaggccccctgtgcag

SEQ ID NO: 7967039 - DNA, 22 bp, Homo sapiens
caaaggcacacatacctttctg

SEQ ID NO: 7967040 - DNA, 22 bp, Homo sapiens
gctcaggcaccatatgatgtgt

SEQ ID NO: 7967041 - DNA, 22 bp, Homo sapiens
gctcaggcaggagtgcagtggc

SEQ ID NO: 7967042 - DNA, 22 bp, Homo sapiens
gctcaggcaaatttctggtgaa

SEQ ID NO: 7967043 - DNA, 22 bp, Homo sapiens
gctcaggcaggagtgcagtggc

SEQ ID NO: 7967044 - DNA, 22 bp, Homo sapiens
caaactttgcaaaacttacagt

SEQ ID NO: 7967045 - DNA, 22 bp, Homo sapiens
caaacttttcctggaaaagatt

SEQ ID NO: 7967046 - DNA, 22 bp, Homo sapiens
caaacttttcctggaaaagatt

SEQ ID NO: 7967047 - DNA, 22 bp, Homo sapiens
caaacttttgaggagttcagga

SEQ ID NO: 7967048 - DNA, 22 bp, Homo sapiens
caaactttcagttataacatga

SEQ ID NO: 7967049 - DNA, 22 bp, Homo sapiens
caaactttcagttataacatga

SEQ ID NO: 7967050 - DNA, 22 bp, Homo sapiens
caaactttgcaaaacttacagt

SEQ ID NO: 7967051 - DNA, 22 bp, Homo sapiens
caaactttgcaaaacttacagt

SEQ ID NO: 7967052 - DNA, 22 bp, Homo sapiens
gctcagcttgggagcgcccggt

SEQ ID NO: 7967053 - DNA, 22 bp, Homo sapiens
gctcagcttgggagcgcccggt

SEQ ID NO: 7967054 - DNA, 22 bp, Homo sapiens
caaacttttgaggagttcagga

SEQ ID NO: 7967055 - DNA, 22 bp, Homo sapiens
gctcaggaaaacagtctagtaa

SEQ ID NO: 7967056 - DNA, 22 bp, Homo sapiens
gctcaggaaacagcagggcttg

SEQ ID NO: 7967057 - DNA, 22 bp, Homo sapiens
gctcaggaaacagcagggcttg

SEQ ID NO: 7967058 - DNA, 22 bp, Homo sapiens
gctcaggaaacagcagggcttg

SEQ ID NO: 7967059 - DNA, 22 bp, Homo sapiens
gctcaggaaatagtttagtgtt

SEQ ID NO: 7967060 - DNA, 22 bp, Homo sapiens
gctcaggaaggctcaaccagga

SEQ ID NO: 7967061 - DNA, 22 bp, Homo sapiens
gctcaggaaggctcaaccagga

SEQ ID NO: 7967062 - DNA, 22 bp, Homo sapiens
gctcaggaaggctcaaccagga

SEQ ID NO: 7967063 - DNA, 22 bp, Homo sapiens
gctcaggacccaggtgtgacct

SEQ ID NO: 7967064 - DNA, 22 bp, Homo sapiens
gctcaggacccaggtgtgacct

SEQ ID NO: 7967065 - DNA, 22 bp, Homo sapiens
gctcaggaccgaggggtgggaa

SEQ ID NO: 7967066 - DNA, 22 bp, Homo sapiens
gctcaggaccgaggggtgggaa

SEQ ID NO: 7967067 - DNA, 22 bp, Homo sapiens
gctcaggactggaggagcgggg

SEQ ID NO: 7967068 - DNA, 22 bp, Homo sapiens
caaaaaacacagatgtctgtgt

SEQ ID NO: 7967069 - DNA, 22 bp, Homo sapiens
caaaaaacacagatgtctgtgt

SEQ ID NO: 7967070 - DNA, 22 bp, Homo sapiens
caaaaaacacctgtgtgagtat

SEQ ID NO: 7967071 - DNA, 22 bp, Homo sapiens
caaaaaacacctgtgtgagtat

SEQ ID NO: 7967072 - DNA, 22 bp, Homo sapiens
caaaaaacacctgtgtgagtat

SEQ ID NO: 7967073 - DNA, 22 bp, Homo sapiens
caaaaaacacctgtgtgagtat

SEQ ID NO: 7967074 - DNA, 22 bp, Homo sapiens
caaaaaacacctgtgtgagtat

SEQ ID NO: 7967075 - DNA, 22 bp, Homo sapiens
caaaaaacacctgtgtgagtat

SEQ ID NO: 7967076 - DNA, 22 bp, Homo sapiens
caaaaaacacctgtgtgagtat

SEQ ID NO: 7967077 - DNA, 22 bp, Homo sapiens
gcctgtgcctcagcctgcagcc

SEQ ID NO: 7967078 - DNA, 22 bp, Homo sapiens
attttttagaacctggcctgat

SEQ ID NO: 7967079 - DNA, 22 bp, Homo sapiens
attttttagaacctggcctgat

SEQ ID NO: 7967080 - DNA, 22 bp, Homo sapiens
attttttagaacctggcctgat

SEQ ID NO: 7967081 - DNA, 22 bp, Homo sapiens
caaaaaacacagatgtctgtgt

SEQ ID NO: 7967082 - DNA, 22 bp, Homo sapiens
caaaaagcttaggtaacaagcc

SEQ ID NO: 7967083 - DNA, 22 bp, Homo sapiens
caaaaagcttaggtaacaagcc

SEQ ID NO: 7967084 - DNA, 22 bp, Homo sapiens
caaaaagcttaggtaacaagcc

SEQ ID NO: 7967085 - DNA, 22 bp, Homo sapiens
caaaaagcttaggtaacaagcc

SEQ ID NO: 7967086 - DNA, 22 bp, Homo sapiens
caaaaagcttaggtaacaagcc

SEQ ID NO: 7967087 - DNA, 22 bp, Homo sapiens
caaaaagcttaggtaacaagcc

SEQ ID NO: 7967088 - DNA, 22 bp, Homo sapiens
caaaacattcagagagctcact

SEQ ID NO: 7967089 - DNA, 22 bp, Homo sapiens
caaaacattcagagagctcact

SEQ ID NO: 7967090 - DNA, 22 bp, Homo sapiens
caaaacattcagagagctcact

SEQ ID NO: 7967091 - DNA, 22 bp, Homo sapiens
caaaaagcttaggtaacaagcc

SEQ ID NO: 7967092 - DNA, 22 bp, Homo sapiens
caaaaactgcaattacttttac

SEQ ID NO: 7967093 - DNA, 22 bp, Homo sapiens
caaaaactgcaattacttttac

SEQ ID NO: 7967094 - DNA, 22 bp, Homo sapiens
caaaaactgcaattacttttac

SEQ ID NO: 7967095 - DNA, 22 bp, Homo sapiens
gcgagcctctggagtcctctgg

SEQ ID NO: 7967096 - DNA, 22 bp, Homo sapiens
gcgagcagacagctgtcctgga

SEQ ID NO: 7967097 - DNA, 22 bp, Homo sapiens
gcgagcagacccccatcttctc

SEQ ID NO: 7967098 - DNA, 19 bp, Homo sapiens
gcgaggaagtcactgtggc

SEQ ID NO: 7967099 - DNA, 19 bp, Homo sapiens
gcgaggaagtcactgtggt

SEQ ID NO: 7967100 - DNA, 19 bp, Homo sapiens
gcgaggaagtcactgtggc

SEQ ID NO: 7967101 - DNA, 19 bp, Homo sapiens
gcgaggaagtcactgtggt

SEQ ID NO: 7967102 - DNA, 22 bp, Homo sapiens
caaaagaagctcttggggctag

SEQ ID NO: 7967103 - DNA, 22 bp, Homo sapiens
gcgagatatgatagcacaaggg

SEQ ID NO: 7967104 - DNA, 21 bp, Homo sapiens
caaaacttaggtgacttagga

SEQ ID NO: 7967105 - DNA, 21 bp, Homo sapiens
caaaacttaggtgacttagga

SEQ ID NO: 7967106 - DNA, 22 bp, Homo sapiens
caaaactgtctagagagagaag

SEQ ID NO: 7967107 - DNA, 22 bp, Homo sapiens
caaaaccaagaacattcatttc

SEQ ID NO: 7967108 - DNA, 22 bp, Homo sapiens
caaaaccaagaacattcatttc

SEQ ID NO: 7967109 - DNA, 22 bp, Homo sapiens
caaaacctaaacagactgtcca

SEQ ID NO: 7967110 - DNA, 22 bp, Homo sapiens
caaaacctaaacagactgtcca

SEQ ID NO: 7967111 - DNA, 22 bp, Homo sapiens
caaaaccaagaacattcatttc

SEQ ID NO: 7967112 - DNA, 22 bp, Homo sapiens
caaaactgtctagagagagaag

SEQ ID NO: 7967113 - DNA, 22 bp, Homo sapiens
caaaactatcaggctcaaagct

SEQ ID NO: 7967114 - DNA, 22 bp, Homo sapiens
caaaactatcaggctcaaagct

SEQ ID NO: 7967115 - DNA, 22 bp, Homo sapiens
caaaacattctctgcagcaggg

SEQ ID NO: 7967116 - DNA, 22 bp, Homo sapiens
caaaaccaagaacattcatttc

SEQ ID NO: 7967117 - DNA, 22 bp, Homo sapiens
caaaacattctctgcagcaggg

SEQ ID NO: 7967118 - DNA, 22 bp, Homo sapiens
caaaacattcagagagctcact

SEQ ID NO: 7967119 - DNA, 22 bp, Homo sapiens
caaaacattcagagagctcact

SEQ ID NO: 7967120 - DNA, 22 bp, Homo sapiens
gcctgggagtgcacagtgaggt

SEQ ID NO: 7967121 - DNA, 22 bp, Homo sapiens
gcctgggagtgcacagtgaggt

SEQ ID NO: 7967122 - DNA, 22 bp, Homo sapiens
gcctgggagtgcacagtgaggt

SEQ ID NO: 7967123 - DNA, 22 bp, Homo sapiens
gcctgggagggcagcagtgtgg

SEQ ID NO: 7967124 - DNA, 22 bp, Homo sapiens
gcctgggagtgcacagtgaggt

SEQ ID NO: 7967125 - DNA, 22 bp, Homo sapiens
gcctgggagggcagcagtgtgg

SEQ ID NO: 7967126 - DNA, 18 bp, Homo sapiens
gcctgggaggaggaaatg

SEQ ID NO: 7967127 - DNA, 22 bp, Homo sapiens
gcctgggagggcagcagtgtgg

SEQ ID NO: 7967128 - DNA, 22 bp, Homo sapiens
gcctgggagggcagcagtgtgg

SEQ ID NO: 7967129 - DNA, 22 bp, Homo sapiens
gcctgggagtgcacagtgaggt

SEQ ID NO: 7967130 - DNA, 22 bp, Homo sapiens
gcctgggagtgcacagtgaggt

SEQ ID NO: 7967131 - DNA, 22 bp, Homo sapiens
gcctgggagtgcacagtgaggt

SEQ ID NO: 7967132 - DNA, 22 bp, Homo sapiens
gcctgtccactaaacagccaag

SEQ ID NO: 7967133 - DNA, 22 bp, Homo sapiens
gcctgtccactaaacagccaag

SEQ ID NO: 7967134 - DNA, 22 bp, Homo sapiens
gcctgggatagaggcaatgcat

SEQ ID NO: 7967135 - DNA, 23 bp, Homo sapiens
gcctgggagttgcgatctgcccg

SEQ ID NO: 7967136 - DNA, 19 bp, Homo sapiens
gcctgtccagtagcatttt

SEQ ID NO: 7967137 - DNA, 19 bp, Homo sapiens
gcctgtccagtagcatttt

SEQ ID NO: 7967138 - DNA, 22 bp, Homo sapiens
gcctgtccactaaacagccaag

SEQ ID NO: 7967139 - DNA, 22 bp, Homo sapiens
gcctgtcccgcaccggagcccg

SEQ ID NO: 7967140 - DNA, 22 bp, Homo sapiens
gcctgtccccaggagagtccgg

SEQ ID NO: 7967141 - DNA, 22 bp, Homo sapiens
gcctgtcccgcaccggagcccg

SEQ ID NO: 7967142 - DNA, 22 bp, Homo sapiens
gcctgtgacccagggcccagga

SEQ ID NO: 7967143 - DNA, 22 bp, Homo sapiens
gcctgtctgcgtcacgcttatt

SEQ ID NO: 7967144 - DNA, 22 bp, Homo sapiens
gcctgtctgcagggctgtcatt

SEQ ID NO: 7967145 - DNA, 22 bp, Homo sapiens
gcctgtgatgcccccataagta

SEQ ID NO: 7967146 - DNA, 22 bp, Homo sapiens
gcctgtgatgcccccataagta

SEQ ID NO: 7967147 - DNA, 22 bp, Homo sapiens
gcctgtgcatagcagcggactc

SEQ ID NO: 7967148 - DNA, 22 bp, Homo sapiens
gcctgtgacccctccatctgct

SEQ ID NO: 7967149 - DNA, 22 bp, Homo sapiens
gcctgtgactcgtcttgggcca

SEQ ID NO: 7967150 - DNA, 23 bp, Homo sapiens
gcctgtgcctatgcccagctctg

SEQ ID NO: 7967151 - DNA, 23 bp, Homo sapiens
gcctgtgcctatgcccagctctg

SEQ ID NO: 7967152 - DNA, 23 bp, Homo sapiens
gcctgtgcctatgcccagctctg

SEQ ID NO: 7967153 - DNA, 22 bp, Homo sapiens
gcctgtgcctcaattttctact

SEQ ID NO: 7967154 - DNA, 22 bp, Homo sapiens
gcctgtgcctcagcctgcagcc

SEQ ID NO: 7967155 - DNA, 22 bp, Homo sapiens
gcctgtgcctcagcctgcagcc

SEQ ID NO: 7967156 - DNA, 22 bp, Homo sapiens
gcctgtgcctcagcctgcagcc

SEQ ID NO: 7967157 - DNA, 22 bp, Homo sapiens
gcctgtcctgctaatgacacgt

SEQ ID NO: 7967158 - DNA, 20 bp, Homo sapiens
gcctgtcctgagtgtcatgg

SEQ ID NO: 7967159 - DNA, 20 bp, Homo sapiens
gcctgtcctgagtgtcatgg

SEQ ID NO: 7967160 - DNA, 22 bp, Homo sapiens
gcctgtcctcccctgcgctgag

SEQ ID NO: 7967161 - DNA, 22 bp, Homo sapiens
gcctgtcctatacaggcggctg

SEQ ID NO: 7967162 - DNA, 22 bp, Homo sapiens
gcctgtcctcccctgcgctgag

SEQ ID NO: 7967163 - DNA, 22 bp, Homo sapiens
gcctgtcctggatgctctgcaa

SEQ ID NO: 7967164 - DNA, 22 bp, Homo sapiens
gcctgtccttgtgaggtcccag

SEQ ID NO: 7967165 - DNA, 22 bp, Homo sapiens
gcctgtccttgtgaggtcccag

SEQ ID NO: 7967166 - DNA, 22 bp, Homo sapiens
gcctgtccttgtgaggtcccag

SEQ ID NO: 7967167 - DNA, 22 bp, Homo sapiens
gcctgtctgcagggctgtcatt

SEQ ID NO: 7967168 - DNA, 22 bp, Homo sapiens
atttctcagggctgaggaggag

SEQ ID NO: 7967169 - DNA, 22 bp, Homo sapiens
atttctcaggactccatgggcg

SEQ ID NO: 7967170 - DNA, 22 bp, Homo sapiens
atttctcagtaatctcagcaat

SEQ ID NO: 7967171 - DNA, 22 bp, Homo sapiens
atttctcagtaatctcagcaat

SEQ ID NO: 7967172 - DNA, 22 bp, Homo sapiens
atttctcactgagcagataaaa

SEQ ID NO: 7967173 - DNA, 22 bp, Homo sapiens
atttctcactgagcagataaaa

SEQ ID NO: 7967174 - DNA, 22 bp, Homo sapiens
atttctcactgagcagataaaa

SEQ ID NO: 7967175 - DNA, 22 bp, Homo sapiens
atttctcactgagcagataaaa

SEQ ID NO: 7967176 - DNA, 22 bp, Homo sapiens
atttctcactgagcagataaaa

SEQ ID NO: 7967177 - DNA, 22 bp, Homo sapiens
atttctcagaccagagaggtgt

SEQ ID NO: 7967178 - DNA, 22 bp, Homo sapiens
atttctcactgagcagataaaa

SEQ ID NO: 7967179 - DNA, 22 bp, Homo sapiens
atttctcaaccaggtcaaaaag

SEQ ID NO: 7967180 - DNA, 22 bp, Homo sapiens
atttctcaaccaggtcaaaaag

SEQ ID NO: 7967181 - DNA, 22 bp, Homo sapiens
atttctcacaaagttgcttatc

SEQ ID NO: 7967182 - DNA, 22 bp, Homo sapiens
atttctcacaaagttgcttatc

SEQ ID NO: 7967183 - DNA, 22 bp, Homo sapiens
atttctcacaaagttgcttatc

SEQ ID NO: 7967184 - DNA, 22 bp, Homo sapiens
atttctcaagtaaatgagtcat

SEQ ID NO: 7967185 - DNA, 22 bp, Homo sapiens
atttctcaaccaggtcaaaaag

SEQ ID NO: 7967186 - DNA, 22 bp, Homo sapiens
atttctcactcacagtccatgt

SEQ ID NO: 7967187 - DNA, 22 bp, Homo sapiens
atttctcactgagcagataaaa

SEQ ID NO: 7967188 - DNA, 22 bp, Homo sapiens
atttctcactcacagtccatgt

SEQ ID NO: 7967189 - DNA, 22 bp, Homo sapiens
gcctccacttttgctggcttct

SEQ ID NO: 7967190 - DNA, 22 bp, Homo sapiens
gcctccacttttgctggcttct

SEQ ID NO: 7967191 - DNA, 21 bp, Homo sapiens
gcctccagccagatggcctcc

SEQ ID NO: 7967192 - DNA, 21 bp, Homo sapiens
gcctccagccagatggcctcc

SEQ ID NO: 7967193 - DNA, 22 bp, Homo sapiens
gcctccagcccacgcaggcctg

SEQ ID NO: 7967194 - DNA, 22 bp, Homo sapiens
gcctccagcccacgcaggcctg

SEQ ID NO: 7967195 - DNA, 22 bp, Homo sapiens
gcctccagcccacgcaggcctg

SEQ ID NO: 7967196 - DNA, 22 bp, Homo sapiens
gcctccagcccacgcaggcctg

SEQ ID NO: 7967197 - DNA, 22 bp, Homo sapiens
gcctccagcccacgcaggcctg

SEQ ID NO: 7967198 - DNA, 22 bp, Homo sapiens
atttctcagtaggtgcacagtg

SEQ ID NO: 7967199 - DNA, 22 bp, Homo sapiens
atttctcagtgaaatgacaggc

SEQ ID NO: 7967200 - DNA, 22 bp, Homo sapiens
atttctcagtgaaatgacaggc

SEQ ID NO: 7967201 - DNA, 22 bp, Homo sapiens
atttctcagtaggtgcacagtg

SEQ ID NO: 7967202 - DNA, 22 bp, Homo sapiens
atttctcagtaggtgcacagtg

SEQ ID NO: 7967203 - DNA, 22 bp, Homo sapiens
atttctcagtgaaatgacaggc

SEQ ID NO: 7967204 - DNA, 22 bp, Homo sapiens
atttctcagtgaaatgacaggc

SEQ ID NO: 7967205 - DNA, 22 bp, Homo sapiens
atttctcagtgaaatgacaggc

SEQ ID NO: 7967206 - DNA, 22 bp, Homo sapiens
atttctcagtgaaatgacaggc

SEQ ID NO: 7967207 - DNA, 22 bp, Homo sapiens
atttctcagtgaaatgacaggc

SEQ ID NO: 7967208 - DNA, 22 bp, Homo sapiens
atttctcagtgtacattatgtt

SEQ ID NO: 7967209 - DNA, 21 bp, Homo sapiens
gcctcaccatgtcaagccagg

SEQ ID NO: 7967210 - DNA, 22 bp, Homo sapiens
atttctcagtgtacattatgtt

SEQ ID NO: 7967211 - DNA, 22 bp, Homo sapiens
gcctccagctggggcatttcag

SEQ ID NO: 7967212 - DNA, 22 bp, Homo sapiens
gcctccagctggggcatttcag

SEQ ID NO: 7967213 - DNA, 22 bp, Homo sapiens
gcctccagcccacgcaggcctg

SEQ ID NO: 7967214 - DNA, 22 bp, Homo sapiens
gcctccagggtagaggaggaag

SEQ ID NO: 7967215 - DNA, 22 bp, Homo sapiens
gcctccagggtagaggaggaag

SEQ ID NO: 7967216 - DNA, 22 bp, Homo sapiens
gcctccagctggggcatttcag

SEQ ID NO: 7967217 - DNA, 22 bp, Homo sapiens
gcctccagggtagaggaggaag

SEQ ID NO: 7967218 - DNA, 22 bp, Homo sapiens
gcctccagtttttttctgaact

SEQ ID NO: 7967219 - DNA, 22 bp, Homo sapiens
gcctccagtttttttctgaact

SEQ ID NO: 7967220 - DNA, 22 bp, Homo sapiens
gcctccagtttttttctgaact

SEQ ID NO: 7967221 - DNA, 22 bp, Homo sapiens
gcctccagtttttttctgaact

SEQ ID NO: 7967222 - DNA, 22 bp, Homo sapiens
gcctccccaggggtgtcatgag

SEQ ID NO: 7967223 - DNA, 22 bp, Homo sapiens
gcctccccaagcagcagggatt

SEQ ID NO: 7967224 - DNA, 22 bp, Homo sapiens
gcctccccaagcagcagggatt

SEQ ID NO: 7967225 - DNA, 22 bp, Homo sapiens
gcctccccaagcagcagggatt

SEQ ID NO: 7967226 - DNA, 22 bp, Homo sapiens
gcctccccaagcagcagggatt

SEQ ID NO: 7967227 - DNA, 22 bp, Homo sapiens
gcctccccaagcagcagggatt

SEQ ID NO: 7967228 - DNA, 22 bp, Homo sapiens
gcctccccaaagtgctgacagc

SEQ ID NO: 7967229 - DNA, 22 bp, Homo sapiens
gcctccccaaagtgctgacagc

SEQ ID NO: 7967230 - DNA, 22 bp, Homo sapiens
gcctccccaaagtgctgacagc

SEQ ID NO: 7967231 - DNA, 22 bp, Homo sapiens
gcctccccaaagtgctgacagc

SEQ ID NO: 7967232 - DNA, 22 bp, Homo sapiens
gcctccccaaagtgctgacagc

SEQ ID NO: 7967233 - DNA, 22 bp, Homo sapiens
gcctccccaaagtgctgacagc

SEQ ID NO: 7967234 - DNA, 22 bp, Homo sapiens
gcctctcctggagaaggcaggg

SEQ ID NO: 7967235 - DNA, 22 bp, Homo sapiens
gcctctcctcttaataccatta

SEQ ID NO: 7967236 - DNA, 22 bp, Homo sapiens
gcctctccgagccactgcctct

SEQ ID NO: 7967237 - DNA, 22 bp, Homo sapiens
gcctctctccttggcttgcagt

SEQ ID NO: 7967238 - DNA, 22 bp, Homo sapiens
gcctctctcgggcttgtagcgg

SEQ ID NO: 7967239 - DNA, 22 bp, Homo sapiens
gcctctctcgggcttgtagcgg

SEQ ID NO: 7967240 - DNA, 22 bp, Homo sapiens
gcctctctccttggcttgcagt

SEQ ID NO: 7967241 - DNA, 21 bp, Homo sapiens
gcctctccaaatcctgccttc

SEQ ID NO: 7967242 - DNA, 22 bp, Homo sapiens
gcctctagggctgttgggaatt

SEQ ID NO: 7967243 - DNA, 21 bp, Homo sapiens
gcctctccaaatcctgccttc

SEQ ID NO: 7967244 - DNA, 21 bp, Homo sapiens
gcctctccaaatcctgccttc

SEQ ID NO: 7967245 - DNA, 22 bp, Homo sapiens
gcctcgaggctgagaaggcaca

SEQ ID NO: 7967246 - DNA, 22 bp, Homo sapiens
gcctccccaggggtgtcatgag

SEQ ID NO: 7967247 - DNA, 22 bp, Homo sapiens
gcctctccgagccactgcctct

SEQ ID NO: 7967248 - DNA, 22 bp, Homo sapiens
gcctctccgagccactgcctct

SEQ ID NO: 7967249 - DNA, 22 bp, Homo sapiens
gcctctccgagccactgcctct

SEQ ID NO: 7967250 - DNA, 22 bp, Homo sapiens
gcctctccgagccactgcctct

SEQ ID NO: 7967251 - DNA, 22 bp, Homo sapiens
gcctctccgagccactgcctct

SEQ ID NO: 7967252 - DNA, 21 bp, Homo sapiens
gcctctccaaatcctgccttc

SEQ ID NO: 7967253 - DNA, 21 bp, Homo sapiens
gcctctccaaatcctgccttc

SEQ ID NO: 7967254 - DNA, 18 bp, Homo sapiens
gcctgcctagagcttgcc

SEQ ID NO: 7967255 - DNA, 18 bp, Homo sapiens
gcctgcctagagcttgcc

SEQ ID NO: 7967256 - DNA, 18 bp, Homo sapiens
gcctgcctagagcttgcc

SEQ ID NO: 7967257 - DNA, 22 bp, Homo sapiens
gcctctctgggctgccgaggct

SEQ ID NO: 7967258 - DNA, 22 bp, Homo sapiens
gcctctctgggctgccgaggct

SEQ ID NO: 7967259 - DNA, 22 bp, Homo sapiens
gcctctctcgggcttgtagcgg

SEQ ID NO: 7967260 - DNA, 22 bp, Homo sapiens
gcctctctctacccagtatgat

SEQ ID NO: 7967261 - DNA, 22 bp, Homo sapiens
gcctgctgaacctcatgcagtc

SEQ ID NO: 7967262 - DNA, 22 bp, Homo sapiens
gcctgctgagggaagttgggca

SEQ ID NO: 7967263 - DNA, 22 bp, Homo sapiens
gcctgctgaagccagagtgtgt

SEQ ID NO: 7967264 - DNA, 22 bp, Homo sapiens
gcctgctctggaatccatgtaa

SEQ ID NO: 7967265 - DNA, 22 bp, Homo sapiens
gcctgctctggaatccatgtaa

SEQ ID NO: 7967266 - DNA, 22 bp, Homo sapiens
gcctgctgaacctcatgcagtc

SEQ ID NO: 7967267 - DNA, 22 bp, Homo sapiens
gcctgctgaacctcatgcagtc

SEQ ID NO: 7967268 - DNA, 22 bp, Homo sapiens
gcctgctgaacctcatgcagtc

SEQ ID NO: 7967269 - DNA, 22 bp, Homo sapiens
gcctgctgaacctcatgcagtc

SEQ ID NO: 7967270 - DNA, 22 bp, Homo sapiens
gcctgctgaacctcatgcagtc

SEQ ID NO: 7967271 - DNA, 22 bp, Homo sapiens
gcctgctgaacctcatgcagtc

SEQ ID NO: 7967272 - DNA, 22 bp, Homo sapiens
gcctgctggaggagcctcaggg

SEQ ID NO: 7967273 - DNA, 22 bp, Homo sapiens
gcctgctggacattggccggcc

SEQ ID NO: 7967274 - DNA, 22 bp, Homo sapiens
gcctgctggacattggccggcc

SEQ ID NO: 7967275 - DNA, 22 bp, Homo sapiens
gcctgctggacattggccggcc

SEQ ID NO: 7967276 - DNA, 21 bp, Homo sapiens
gcctgctgcctgtggccggtc

SEQ ID NO: 7967277 - DNA, 22 bp, Homo sapiens
gcctgctgccagaggcaaacac

SEQ ID NO: 7967278 - DNA, 21 bp, Homo sapiens
gcctgctgcctgtggccggtc

SEQ ID NO: 7967279 - DNA, 21 bp, Homo sapiens
gcctgctgcctgtggccggtc

SEQ ID NO: 7967280 - DNA, 22 bp, Homo sapiens
gcctgctgcatccaggctattg

SEQ ID NO: 7967281 - DNA, 22 bp, Homo sapiens
gcctgctgcatccaggctattg

SEQ ID NO: 7967282 - DNA, 22 bp, Homo sapiens
gcctgctgcatccaggctattg

SEQ ID NO: 7967283 - DNA, 22 bp, Homo sapiens
gcctgctgccaccctggctccg

SEQ ID NO: 7967284 - DNA, 22 bp, Homo sapiens
gcctgctgccaccctggctccg

SEQ ID NO: 7967285 - DNA, 22 bp, Homo sapiens
gcctgctgccaccctggctccg

SEQ ID NO: 7967286 - DNA, 22 bp, Homo sapiens
gcctgctgccaccctggctccg

SEQ ID NO: 7967287 - DNA, 22 bp, Homo sapiens
gcctgctgccaccctggctccg

SEQ ID NO: 7967288 - DNA, 22 bp, Homo sapiens
gcctgctggatgtggccaggcc

SEQ ID NO: 7967289 - DNA, 22 bp, Homo sapiens
gcctgctggatgtggccaggcc

SEQ ID NO: 7967290 - DNA, 22 bp, Homo sapiens
gcctgctggatgtggccaggcc

SEQ ID NO: 7967291 - DNA, 22 bp, Homo sapiens
gcctgctggatgtggccaggcc

SEQ ID NO: 7967292 - DNA, 22 bp, Homo sapiens
gcctgctggctgtccattgcag

SEQ ID NO: 7967293 - DNA, 22 bp, Homo sapiens
gcctgctggctgtccattgcag

SEQ ID NO: 7967294 - DNA, 22 bp, Homo sapiens
gcctgctggctgtccattgcag

SEQ ID NO: 7967295 - DNA, 22 bp, Homo sapiens
gcctgctggatcaagcttatgc

SEQ ID NO: 7967296 - DNA, 22 bp, Homo sapiens
gcctgctggatgtggccaggcc

SEQ ID NO: 7967297 - DNA, 22 bp, Homo sapiens
gcctgctggatcaagcttatgc

SEQ ID NO: 7967298 - DNA, 22 bp, Homo sapiens
gcctgctggaggagcctcaggg

SEQ ID NO: 7967299 - DNA, 22 bp, Homo sapiens
gcctgctggaggagcctcaggg

SEQ ID NO: 7967300 - DNA, 22 bp, Homo sapiens
gcctgctggaggagcctcaggg

SEQ ID NO: 7967301 - DNA, 22 bp, Homo sapiens
gcctgctggaggagcctcaggg

SEQ ID NO: 7967302 - DNA, 22 bp, Homo sapiens
gcctgctggaggagcctcaggg

SEQ ID NO: 7967303 - DNA, 22 bp, Homo sapiens
gcctgggagagggatagtgcag

SEQ ID NO: 7967304 - DNA, 22 bp, Homo sapiens
gcctgggagagggatagtgcag

SEQ ID NO: 7967305 - DNA, 22 bp, Homo sapiens
gcctgggagattaattaggaag

SEQ ID NO: 7967306 - DNA, 22 bp, Homo sapiens
gcctgggagatgcgttgtggcc

SEQ ID NO: 7967307 - DNA, 22 bp, Homo sapiens
gcctgggagatgcgttgtggcc

SEQ ID NO: 7967308 - DNA, 22 bp, Homo sapiens
gcctgggagcacatcggggtcc

SEQ ID NO: 7967309 - DNA, 22 bp, Homo sapiens
gcctgggagcacatcggggtcc

SEQ ID NO: 7967310 - DNA, 22 bp, Homo sapiens
gcctgggagcacatcggggtcc

SEQ ID NO: 7967311 - DNA, 22 bp, Homo sapiens
gcctgggagcacatcggggtcc

SEQ ID NO: 7967312 - DNA, 22 bp, Homo sapiens
gcctggctgaggcctctgctaa

SEQ ID NO: 7967313 - DNA, 22 bp, Homo sapiens
gcctggctgaggcctctgctaa

SEQ ID NO: 7967314 - DNA, 22 bp, Homo sapiens
gcctggctgaggtggggaggca

SEQ ID NO: 7967315 - DNA, 22 bp, Homo sapiens
gcctggctgaggcctctgctaa

SEQ ID NO: 7967316 - DNA, 22 bp, Homo sapiens
gcctggctgaggtggggaggca

SEQ ID NO: 7967317 - DNA, 22 bp, Homo sapiens
gcctgggagagggatagtgcag

SEQ ID NO: 7967318 - DNA, 22 bp, Homo sapiens
gcctggctgaggcctctgctaa

SEQ ID NO: 7967319 - DNA, 22 bp, Homo sapiens
gcctggctctgagtttctctcc

SEQ ID NO: 7967320 - DNA, 22 bp, Homo sapiens
gcctggagctctccacttgggg

SEQ ID NO: 7967321 - DNA, 22 bp, Homo sapiens
gcctggaggaatgtagctgagg

SEQ ID NO: 7967322 - DNA, 22 bp, Homo sapiens
gcctggagctctccacttgggg

SEQ ID NO: 7967323 - DNA, 22 bp, Homo sapiens
gcctggagctctccacttgggg

SEQ ID NO: 7967324 - DNA, 22 bp, Homo sapiens
gcctggagctcatgtgggcatt

SEQ ID NO: 7967325 - DNA, 22 bp, Homo sapiens
gcctggagctcatgtgggcatt

SEQ ID NO: 7967326 - DNA, 22 bp, Homo sapiens
gcctggagctcatgtgggcatt

SEQ ID NO: 7967327 - DNA, 22 bp, Homo sapiens
gcctggagctcggctgagggcg

SEQ ID NO: 7967328 - DNA, 22 bp, Homo sapiens
gcctggagctcggctgagggcg

SEQ ID NO: 7967329 - DNA, 22 bp, Homo sapiens
gcctggagctcggctgagggcg

SEQ ID NO: 7967330 - DNA, 22 bp, Homo sapiens
gcctggagctcggctgagggcg

SEQ ID NO: 7967331 - DNA, 22 bp, Homo sapiens
gcctggagctcggctgagggcg

SEQ ID NO: 7967332 - DNA, 22 bp, Homo sapiens
gcctggagctctccacttgggg

SEQ ID NO: 7967333 - DNA, 22 bp, Homo sapiens
gcctggagctctccacttgggg

SEQ ID NO: 7967334 - DNA, 22 bp, Homo sapiens
gcctggagctctccacttgggg

SEQ ID NO: 7967335 - DNA, 22 bp, Homo sapiens
gcctggagctcggctgagggcg

SEQ ID NO: 7967336 - DNA, 22 bp, Homo sapiens
gcctggagctcggctgagggcg

SEQ ID NO: 7967337 - DNA, 22 bp, Homo sapiens
gcctggagctcggctgagggcg

SEQ ID NO: 7967338 - DNA, 22 bp, Homo sapiens
gcctggagctcggctgagggcg

SEQ ID NO: 7967339 - DNA, 22 bp, Homo sapiens
gcctggagctactggacactga

SEQ ID NO: 7967340 - DNA, 22 bp, Homo sapiens
gcctggagctactggacactga

SEQ ID NO: 7967341 - DNA, 22 bp, Homo sapiens
gcctggagctactggacactga

SEQ ID NO: 7967342 - DNA, 22 bp, Homo sapiens
gcctggagctactggacactga

SEQ ID NO: 7967343 - DNA, 22 bp, Homo sapiens
gcctggagctactggacactga

SEQ ID NO: 7967344 - DNA, 22 bp, Homo sapiens
gcctggagctactggacactga

SEQ ID NO: 7967345 - DNA, 22 bp, Homo sapiens
gcctggagctcatgtgggcatt

SEQ ID NO: 7967346 - DNA, 22 bp, Homo sapiens
gcctggagctcatgtgggcatt

SEQ ID NO: 7967347 - DNA, 22 bp, Homo sapiens
gcctggagctcatgtgggcatt

SEQ ID NO: 7967348 - DNA, 22 bp, Homo sapiens
gcctggagctcatgtgggcatt

SEQ ID NO: 7967349 - DNA, 22 bp, Homo sapiens
gcctggagctcatgtgggcatt

SEQ ID NO: 7967350 - DNA, 22 bp, Homo sapiens
gcctggagctactggacactga

SEQ ID NO: 7967351 - DNA, 22 bp, Homo sapiens
atttattggatgcttacttggg

SEQ ID NO: 7967352 - DNA, 22 bp, Homo sapiens
atttattggatgcttacttggg

SEQ ID NO: 7967353 - DNA, 22 bp, Homo sapiens
atttattggatgcttacttggg

SEQ ID NO: 7967354 - DNA, 22 bp, Homo sapiens
atttattggatgcttacttggg

SEQ ID NO: 7967355 - DNA, 22 bp, Homo sapiens
atttattggatgcttacttggg

SEQ ID NO: 7967356 - DNA, 22 bp, Homo sapiens
atttattggatgcttacttggg

SEQ ID NO: 7967357 - DNA, 22 bp, Homo sapiens
atttattggatgcttacttggg

SEQ ID NO: 7967358 - DNA, 22 bp, Homo sapiens
atttattggatgcttacttggg

SEQ ID NO: 7967359 - DNA, 22 bp, Homo sapiens
atttattggtttgcatggtgaa

SEQ ID NO: 7967360 - DNA, 22 bp, Homo sapiens
atttattggatgcttacttggg

SEQ ID NO: 7967361 - DNA, 22 bp, Homo sapiens
atttattgagcctttcctatgt

SEQ ID NO: 7967362 - DNA, 22 bp, Homo sapiens
atttattggatgcttacttggg

SEQ ID NO: 7967363 - DNA, 22 bp, Homo sapiens
atttattgagcctttcctatgt

SEQ ID NO: 7967364 - DNA, 22 bp, Homo sapiens
atttattgagcctttcctatgt

SEQ ID NO: 7967365 - DNA, 22 bp, Homo sapiens
gccaggcattctagaagtagtg

SEQ ID NO: 7967366 - DNA, 22 bp, Homo sapiens
gccaggcattctagaagtagtg

SEQ ID NO: 7967367 - DNA, 22 bp, Homo sapiens
atttattggtttgcatggtgaa

SEQ ID NO: 7967368 - DNA, 22 bp, Homo sapiens
gccaggcatttattgattgaat

SEQ ID NO: 7967369 - DNA, 22 bp, Homo sapiens
gccaggcatttattgattgaat

SEQ ID NO: 7967370 - DNA, 22 bp, Homo sapiens
gccaggcattctagaagtagtg

SEQ ID NO: 7967371 - DNA, 22 bp, Homo sapiens
gccaggcattctagaagtagtg

SEQ ID NO: 7967372 - DNA, 22 bp, Homo sapiens
gccaggcatttgttaggtgctg

SEQ ID NO: 7967373 - DNA, 22 bp, Homo sapiens
gccaggcatttgttaggtgctg

SEQ ID NO: 7967374 - DNA, 22 bp, Homo sapiens
gccaggcatttgttaggtgctg

SEQ ID NO: 7967375 - DNA, 22 bp, Homo sapiens
gccaggcatttgttaggtgctg

SEQ ID NO: 7967376 - DNA, 22 bp, Homo sapiens
gccaggccactcccgggtcctg

SEQ ID NO: 7967377 - DNA, 22 bp, Homo sapiens
gccaggccactcccgggtcctg

SEQ ID NO: 7967378 - DNA, 22 bp, Homo sapiens
gccaggcatttgttaggtgctg

SEQ ID NO: 7967379 - DNA, 22 bp, Homo sapiens
atttattgagagggaggggaat

SEQ ID NO: 7967380 - DNA, 22 bp, Homo sapiens
atttattgagagggaggggaat

SEQ ID NO: 7967381 - DNA, 22 bp, Homo sapiens
atttattgagagggaggggaat

SEQ ID NO: 7967382 - DNA, 22 bp, Homo sapiens
atttattgagagggaggggaat

SEQ ID NO: 7967383 - DNA, 22 bp, Homo sapiens
atttattgagagggaggggaat

SEQ ID NO: 7967384 - DNA, 22 bp, Homo sapiens
atttattgagagggaggggaat

SEQ ID NO: 7967385 - DNA, 22 bp, Homo sapiens
atttattgagagggaggggaat

SEQ ID NO: 7967386 - DNA, 22 bp, Homo sapiens
atttattgagagggaggggaat

SEQ ID NO: 7967387 - DNA, 22 bp, Homo sapiens
atttattgagcctttcctatgt

SEQ ID NO: 7967388 - DNA, 22 bp, Homo sapiens
atttattgagcctttcctatgt

SEQ ID NO: 7967389 - DNA, 22 bp, Homo sapiens
atttattgagcctttcctatgt

SEQ ID NO: 7967390 - DNA, 22 bp, Homo sapiens
atttattgagcctttcctatgt

SEQ ID NO: 7967391 - DNA, 22 bp, Homo sapiens
atttattgagcctttcctatgt

SEQ ID NO: 7967392 - DNA, 22 bp, Homo sapiens
atttattgagcctttcctatgt

SEQ ID NO: 7967393 - DNA, 22 bp, Homo sapiens
atttattgagcctttcctatgt

SEQ ID NO: 7967394 - DNA, 22 bp, Homo sapiens
atttattgagagggaggggaat

SEQ ID NO: 7967395 - DNA, 22 bp, Homo sapiens
atttattgagcctttcctatgt

SEQ ID NO: 7967396 - DNA, 22 bp, Homo sapiens
atttattgagacttaacaaccc

SEQ ID NO: 7967397 - DNA, 22 bp, Homo sapiens
atttattgagacttaacaaccc

SEQ ID NO: 7967398 - DNA, 22 bp, Homo sapiens
atttattgagacttaacaaccc

SEQ ID NO: 7967399 - DNA, 22 bp, Homo sapiens
atttattgagacttaacaaccc

SEQ ID NO: 7967400 - DNA, 22 bp, Homo sapiens
atttattgagacttaacaaccc

SEQ ID NO: 7967401 - DNA, 22 bp, Homo sapiens
atttattgagacttaacaaccc

SEQ ID NO: 7967402 - DNA, 22 bp, Homo sapiens
atttattgagacttaacaaccc

SEQ ID NO: 7967403 - DNA, 22 bp, Homo sapiens
atttattgagacttaacaaccc

SEQ ID NO: 7967404 - DNA, 22 bp, Homo sapiens
atttattgagacttaacaaccc

SEQ ID NO: 7967405 - DNA, 22 bp, Homo sapiens
atttattatgggatttggctca

SEQ ID NO: 7967406 - DNA, 22 bp, Homo sapiens
atttattatgggatttggctca

SEQ ID NO: 7967407 - DNA, 22 bp, Homo sapiens
atttattatgggatttggcaca

SEQ ID NO: 7967408 - DNA, 22 bp, Homo sapiens
atttagaagctaatttttcaga

SEQ ID NO: 7967409 - DNA, 21 bp, Homo sapiens
atttagaaggaaattttgcaa

SEQ ID NO: 7967410 - DNA, 19 bp, Homo sapiens
gccaggcctggacctgcag

SEQ ID NO: 7967411 - DNA, 19 bp, Homo sapiens
gccaggcctggacctgcag

SEQ ID NO: 7967412 - DNA, 19 bp, Homo sapiens
gccaggcctggacctgcag

SEQ ID NO: 7967413 - DNA, 19 bp, Homo sapiens
gccaggcctggacctgcag

SEQ ID NO: 7967414 - DNA, 19 bp, Homo sapiens
gccaggcctggacctgcag

SEQ ID NO: 7967415 - DNA, 22 bp, Homo sapiens
gccaggcctgcaagtgctggtg

SEQ ID NO: 7967416 - DNA, 22 bp, Homo sapiens
gccaggcctgcaagtgctggtg

SEQ ID NO: 7967417 - DNA, 22 bp, Homo sapiens
gccaggcatttgttaggtgctg

SEQ ID NO: 7967418 - DNA, 22 bp, Homo sapiens
atttcacaaaccatcctgattt

SEQ ID NO: 7967419 - DNA, 22 bp, Homo sapiens
atttcacaaaccatcctgattt

SEQ ID NO: 7967420 - DNA, 22 bp, Homo sapiens
atttcacaaaccatcctgattt

SEQ ID NO: 7967421 - DNA, 22 bp, Homo sapiens
gccaggccactcccgggtcctg

SEQ ID NO: 7967422 - DNA, 22 bp, Homo sapiens
gccaggccactcccgggtcctg

SEQ ID NO: 7967423 - DNA, 22 bp, Homo sapiens
gccaggccactcccgggtcctg

SEQ ID NO: 7967424 - DNA, 22 bp, Homo sapiens
gccaggccctgggcacttcgtg

SEQ ID NO: 7967425 - DNA, 22 bp, Homo sapiens
gccaggcctgcaagtgctggtg

SEQ ID NO: 7967426 - DNA, 22 bp, Homo sapiens
gccaggcctgcaagtgctggtg

SEQ ID NO: 7967427 - DNA, 22 bp, Homo sapiens
gccaggcctgcaagtgctggtg

SEQ ID NO: 7967428 - DNA, 22 bp, Homo sapiens
gccaggcctgcaagtgctggtg

SEQ ID NO: 7967429 - DNA, 22 bp, Homo sapiens
gccaggcctgcaagtgctggtg

SEQ ID NO: 7967430 - DNA, 22 bp, Homo sapiens
gccaggccctgggcacttcgtg

SEQ ID NO: 7967431 - DNA, 22 bp, Homo sapiens
gccaggcctgcaagtgctggtg

SEQ ID NO: 7967432 - DNA, 21 bp, Homo sapiens
atttcagagcacacaagtaaa

SEQ ID NO: 7967433 - DNA, 21 bp, Homo sapiens
atttcagagcacacaagtaaa

SEQ ID NO: 7967434 - DNA, 22 bp, Homo sapiens
atttcagagctttgcagctaat

SEQ ID NO: 7967435 - DNA, 21 bp, Homo sapiens
atttcagagcacacaagtaaa

SEQ ID NO: 7967436 - DNA, 21 bp, Homo sapiens
atttcagagcacacaagtaaa

SEQ ID NO: 7967437 - DNA, 22 bp, Homo sapiens
atttcagagaatgaacctaatc

SEQ ID NO: 7967438 - DNA, 21 bp, Homo sapiens
atttcagagcacacaagtaaa

SEQ ID NO: 7967439 - DNA, 22 bp, Homo sapiens
atttcagaatgtcctaatttag

SEQ ID NO: 7967440 - DNA, 22 bp, Homo sapiens
atttcagaatgtcctaatttag

SEQ ID NO: 7967441 - DNA, 22 bp, Homo sapiens
atttcagaatgtcctaatttag

SEQ ID NO: 7967442 - DNA, 22 bp, Homo sapiens
atttcagagaatgaacctaatc

SEQ ID NO: 7967443 - DNA, 22 bp, Homo sapiens
atttcagactgtgttggaaaat

SEQ ID NO: 7967444 - DNA, 22 bp, Homo sapiens
atttcagactgtgttggaaaat

SEQ ID NO: 7967445 - DNA, 22 bp, Homo sapiens
atttcagattcagaaatgtagg

SEQ ID NO: 7967446 - DNA, 22 bp, Homo sapiens
atttcagattcagaaatgtagg

SEQ ID NO: 7967447 - DNA, 22 bp, Homo sapiens
atttcagattcagaaatgtagg

SEQ ID NO: 7967448 - DNA, 22 bp, Homo sapiens
atttcagattcgagaggaagtg

SEQ ID NO: 7967449 - DNA, 22 bp, Homo sapiens
atttcagattcgagaggaagtg

SEQ ID NO: 7967450 - DNA, 22 bp, Homo sapiens
atttcagatgaccaaatggaaa

SEQ ID NO: 7967451 - DNA, 22 bp, Homo sapiens
atttcagagtgagagtgctcaa

SEQ ID NO: 7967452 - DNA, 22 bp, Homo sapiens
atttcagatgaccaaatggaaa

SEQ ID NO: 7967453 - DNA, 22 bp, Homo sapiens
atttcagagtagatcgttattt

SEQ ID NO: 7967454 - DNA, 22 bp, Homo sapiens
atttcagagtgagagtgctcaa

SEQ ID NO: 7967455 - DNA, 22 bp, Homo sapiens
atttccttcccagatttggttc

SEQ ID NO: 7967456 - DNA, 22 bp, Homo sapiens
atttccttcggacagtttgggt

SEQ ID NO: 7967457 - DNA, 22 bp, Homo sapiens
atttcatgtgaagaagagataa

SEQ ID NO: 7967458 - DNA, 22 bp, Homo sapiens
atttcatgtgaagaagagataa

SEQ ID NO: 7967459 - DNA, 22 bp, Homo sapiens
atttcatgtaaatggaatgata

SEQ ID NO: 7967460 - DNA, 22 bp, Homo sapiens
atttcatgtgaagaagagataa

SEQ ID NO: 7967461 - DNA, 22 bp, Homo sapiens
atttcatgtgaagaagagataa

SEQ ID NO: 7967462 - DNA, 22 bp, Homo sapiens
atttccttcggacagtttgggt

SEQ ID NO: 7967463 - DNA, 22 bp, Homo sapiens
atttccttgcaacttaggcatg

SEQ ID NO: 7967464 - DNA, 22 bp, Homo sapiens
atttccttgcaacttaggcatg

SEQ ID NO: 7967465 - DNA, 22 bp, Homo sapiens
atttcctagggtagatgtcaca

SEQ ID NO: 7967466 - DNA, 22 bp, Homo sapiens
atttccttgcaagtttctgtaa

SEQ ID NO: 7967467 - DNA, 22 bp, Homo sapiens
atttccttgcaagtttctgtaa

SEQ ID NO: 7967468 - DNA, 22 bp, Homo sapiens
atttccttgcaagtttctgtaa

SEQ ID NO: 7967469 - DNA, 16 bp, Homo sapiens
atttccttgtgagttt

SEQ ID NO: 7967470 - DNA, 22 bp, Homo sapiens
atttcctttgcaaagactgtgc

SEQ ID NO: 7967471 - DNA, 16 bp, Homo sapiens
atttccttgtgagttt

SEQ ID NO: 7967472 - DNA, 22 bp, Homo sapiens
atttcctttgcaaagactgtgc

SEQ ID NO: 7967473 - DNA, 22 bp, Homo sapiens
atttctagcctctgaagtagga

SEQ ID NO: 7967474 - DNA, 22 bp, Homo sapiens
atttctagcctctgaagtagga

SEQ ID NO: 7967475 - DNA, 22 bp, Homo sapiens
atttctagcaaaggctctgcta

SEQ ID NO: 7967476 - DNA, 22 bp, Homo sapiens
atttctaggtagagaagcttag

SEQ ID NO: 7967477 - DNA, 22 bp, Homo sapiens
atttctagcagggcaggaaaga

SEQ ID NO: 7967478 - DNA, 23 bp, Homo sapiens
atttctaggggattttctggtgc

SEQ ID NO: 7967479 - DNA, 22 bp, Homo sapiens
atttctagatatggagagtggt

SEQ ID NO: 7967480 - DNA, 22 bp, Homo sapiens
atttctagatatggagagtggt

SEQ ID NO: 7967481 - DNA, 22 bp, Homo sapiens
atttctagacttagaactctta

SEQ ID NO: 7967482 - DNA, 22 bp, Homo sapiens
atttctagaggcagcttctagg

SEQ ID NO: 7967483 - DNA, 22 bp, Homo sapiens
atttctagacttagaactctta

SEQ ID NO: 7967484 - DNA, 22 bp, Homo sapiens
atttctataggaggacagtatt

SEQ ID NO: 7967485 - DNA, 22 bp, Homo sapiens
atttctaggttcacatgtgttt

SEQ ID NO: 7967486 - DNA, 22 bp, Homo sapiens
atttctagtccttgtgtagtca

SEQ ID NO: 7967487 - DNA, 18 bp, Homo sapiens
atttctactactataaag

SEQ ID NO: 7967488 - DNA, 22 bp, Homo sapiens
atttctactgtgagaaacatga

SEQ ID NO: 7967489 - DNA, 22 bp, Homo sapiens
atttctactgtgagaaacatga

SEQ ID NO: 7967490 - DNA, 22 bp, Homo sapiens
atttctacagtacacatgcatt

SEQ ID NO: 7967491 - DNA, 22 bp, Homo sapiens
atttctacattgagttttagca

SEQ ID NO: 7967492 - DNA, 22 bp, Homo sapiens
atttctaaagagggtggtttgg

SEQ ID NO: 7967493 - DNA, 22 bp, Homo sapiens
atttctaaagagggtggtttgg

SEQ ID NO: 7967494 - DNA, 22 bp, Homo sapiens
atttctacagtacacatgcatt

SEQ ID NO: 7967495 - DNA, 22 bp, Homo sapiens
atttcctttgcaaagactgtgc

SEQ ID NO: 7967496 - DNA, 22 bp, Homo sapiens
atttcctttgcaaagactgtgc

SEQ ID NO: 7967497 - DNA, 22 bp, Homo sapiens
atttcagggagtcatttacaca

SEQ ID NO: 7967498 - DNA, 22 bp, Homo sapiens
atttcaggaatctgtatgaaag

SEQ ID NO: 7967499 - DNA, 22 bp, Homo sapiens
atttcagcagcccatgtttgga

SEQ ID NO: 7967500 - DNA, 22 bp, Homo sapiens
atttcagcagcccatgtttgga

SEQ ID NO: 7967501 - DNA, 22 bp, Homo sapiens
atttcaggtacctgtgggatcc

SEQ ID NO: 7967502 - DNA, 22 bp, Homo sapiens
atttcagtattatacaactgct

SEQ ID NO: 7967503 - DNA, 22 bp, Homo sapiens
atttcagtagtccttacttgta

SEQ ID NO: 7967504 - DNA, 22 bp, Homo sapiens
atttcagtagtccttacttgta

SEQ ID NO: 7967505 - DNA, 22 bp, Homo sapiens
atttcagtagaaaatcttgatt

SEQ ID NO: 7967506 - DNA, 22 bp, Homo sapiens
atttcagtattatacaactgct

SEQ ID NO: 7967507 - DNA, 22 bp, Homo sapiens
atttcagtagaaaatcttgatt

SEQ ID NO: 7967508 - DNA, 22 bp, Homo sapiens
atttcagtgagaaagcaatcaa

SEQ ID NO: 7967509 - DNA, 22 bp, Homo sapiens
atttcagtgttggttagcaagc

SEQ ID NO: 7967510 - DNA, 22 bp, Homo sapiens
atttcagtgttggttagcaagc

SEQ ID NO: 7967511 - DNA, 22 bp, Homo sapiens
atttcagtgtcttcttctccct

SEQ ID NO: 7967512 - DNA, 22 bp, Homo sapiens
atttcagtgagaaagcaatcaa

SEQ ID NO: 7967513 - DNA, 20 bp, Homo sapiens
atttcagtgtttgcaatttc

SEQ ID NO: 7967514 - DNA, 22 bp, Homo sapiens
atttcagtgttggttagcaagc

SEQ ID NO: 7967515 - DNA, 22 bp, Homo sapiens
atttcatatgtatcacctagcc

SEQ ID NO: 7967516 - DNA, 22 bp, Homo sapiens
atttcatccagagtcctattag

SEQ ID NO: 7967517 - DNA, 22 bp, Homo sapiens
atttcatccattaagagtactc

SEQ ID NO: 7967518 - DNA, 22 bp, Homo sapiens
atttcatctctggaacataact

SEQ ID NO: 7967519 - DNA, 22 bp, Homo sapiens
atttcatagattgtaaatccct

SEQ ID NO: 7967520 - DNA, 22 bp, Homo sapiens
atttcatatgtatcacctagcc

SEQ ID NO: 7967521 - DNA, 22 bp, Homo sapiens
atttcatactaaggctcaaaaa

SEQ ID NO: 7967522 - DNA, 22 bp, Homo sapiens
atttcatactaaggctcaaaaa

SEQ ID NO: 7967523 - DNA, 20 bp, Homo sapiens
atttcagtgtttgcaatttc

SEQ ID NO: 7967524 - DNA, 22 bp, Homo sapiens
atttcagtgttttaagagttca

SEQ ID NO: 7967525 - DNA, 21 bp, Homo sapiens
atttcatggtgcttttaagaa

SEQ ID NO: 7967526 - DNA, 21 bp, Homo sapiens
atttcatggtgcttttaagaa

SEQ ID NO: 7967527 - DNA, 21 bp, Homo sapiens
atttcatggtgcttttaagaa

SEQ ID NO: 7967528 - DNA, 22 bp, Homo sapiens
atttcatggtacatcgtgactt

SEQ ID NO: 7967529 - DNA, 22 bp, Homo sapiens
atttcatggcagactttaaccc

SEQ ID NO: 7967530 - DNA, 21 bp, Homo sapiens
atttcatggtgcttttaagaa

SEQ ID NO: 7967531 - DNA, 22 bp, Homo sapiens
atttcatggcagactttaaccc

SEQ ID NO: 7967532 - DNA, 16 bp, Homo sapiens
atttcatgggcagtga

SEQ ID NO: 7967533 - DNA, 22 bp, Homo sapiens
atttcatggacatctttggagg

SEQ ID NO: 7967534 - DNA, 22 bp, Homo sapiens
atttcatgagttattatagtgg

SEQ ID NO: 7967535 - DNA, 22 bp, Homo sapiens
atttcatgcagaaggaagttgg

SEQ ID NO: 7967536 - DNA, 22 bp, Homo sapiens
atttcatgagttattatagtgg

SEQ ID NO: 7967537 - DNA, 22 bp, Homo sapiens
atttcatgagttattatagtgg

SEQ ID NO: 7967538 - DNA, 22 bp, Homo sapiens
atttcatgagttattatagtgg

SEQ ID NO: 7967539 - DNA, 22 bp, Homo sapiens
atttcatgagctaatggatctc

SEQ ID NO: 7967540 - DNA, 22 bp, Homo sapiens
atttcatctctggaacataact

SEQ ID NO: 7967541 - DNA, 22 bp, Homo sapiens
atttcatgaattccagaagctt

SEQ ID NO: 7967542 - DNA, 22 bp, Homo sapiens
atttcatgaatgctgctgttga

SEQ ID NO: 7967543 - DNA, 22 bp, Homo sapiens
atttcatgaaacattccccttg

SEQ ID NO: 7967544 - DNA, 22 bp, Homo sapiens
attgcttttcagacaatgaggc

SEQ ID NO: 7967545 - DNA, 22 bp, Homo sapiens
attgcttttcagacaatgaggc

SEQ ID NO: 7967546 - DNA, 22 bp, Homo sapiens
attgcttttccttaacacatgc

SEQ ID NO: 7967547 - DNA, 22 bp, Homo sapiens
attgcttttccttaacacatgc

SEQ ID NO: 7967548 - DNA, 22 bp, Homo sapiens
attgcttttccttaacacatgc

SEQ ID NO: 7967549 - DNA, 22 bp, Homo sapiens
attgcttttccttaacacatgc

SEQ ID NO: 7967550 - DNA, 22 bp, Homo sapiens
attgcttttgagctagaatttt

SEQ ID NO: 7967551 - DNA, 22 bp, Homo sapiens
attgcttttgagctagaatttt

SEQ ID NO: 7967552 - DNA, 22 bp, Homo sapiens
attgcttttgagctagaatttt

SEQ ID NO: 7967553 - DNA, 18 bp, Homo sapiens
attgcttttgtaccaacc

SEQ ID NO: 7967554 - DNA, 18 bp, Homo sapiens
attgcttttgtaccaacc

SEQ ID NO: 7967555 - DNA, 18 bp, Homo sapiens
attgcttttgtaccaacc

SEQ ID NO: 7967556 - DNA, 22 bp, Homo sapiens
attgcttttagtgaaattatat

SEQ ID NO: 7967557 - DNA, 22 bp, Homo sapiens
attgcttttagtgaaattatat

SEQ ID NO: 7967558 - DNA, 22 bp, Homo sapiens
attgcttttagtgaaattatat

SEQ ID NO: 7967559 - DNA, 22 bp, Homo sapiens
attgcttttaagcaccacctaa

SEQ ID NO: 7967560 - DNA, 22 bp, Homo sapiens
attgcttttaagcaccacctaa

SEQ ID NO: 7967561 - DNA, 22 bp, Homo sapiens
attgctttgtacatgcctagca

SEQ ID NO: 7967562 - DNA, 22 bp, Homo sapiens
attgctttctttggggaactgt

SEQ ID NO: 7967563 - DNA, 22 bp, Homo sapiens
attgcttcaactgttcaatggg

SEQ ID NO: 7967564 - DNA, 22 bp, Homo sapiens
attgcttatctatctttaagtc

SEQ ID NO: 7967565 - DNA, 22 bp, Homo sapiens
attgctttagaaagaaaaatat

SEQ ID NO: 7967566 - DNA, 22 bp, Homo sapiens
attggaaagttcttaagggata

SEQ ID NO: 7967567 - DNA, 21 bp, Homo sapiens
attggaaaaggtagttggctt

SEQ ID NO: 7967568 - DNA, 22 bp, Homo sapiens
attggaaagtgtctagtgtggt

SEQ ID NO: 7967569 - DNA, 22 bp, Homo sapiens
attggaaagtgtctagtgtggt

SEQ ID NO: 7967570 - DNA, 22 bp, Homo sapiens
attggaaagtgtctagtgtggt

SEQ ID NO: 7967571 - DNA, 22 bp, Homo sapiens
attggaaatacagtagaaaaat

SEQ ID NO: 7967572 - DNA, 22 bp, Homo sapiens
attggaaatacagtagaaaaat

SEQ ID NO: 7967573 - DNA, 22 bp, Homo sapiens
attggaaatacagtagaaaaat

SEQ ID NO: 7967574 - DNA, 22 bp, Homo sapiens
attggaaatactgagagataaa

SEQ ID NO: 7967575 - DNA, 22 bp, Homo sapiens
attggagacagatgggctccag

SEQ ID NO: 7967576 - DNA, 19 bp, Homo sapiens
attggagcagaaaggtggt

SEQ ID NO: 7967577 - DNA, 22 bp, Homo sapiens
attggagccccagaagcaaggt

SEQ ID NO: 7967578 - DNA, 22 bp, Homo sapiens
attggacttagaaataaagtta

SEQ ID NO: 7967579 - DNA, 22 bp, Homo sapiens
attggaagtatttcatcaaaag

SEQ ID NO: 7967580 - DNA, 22 bp, Homo sapiens
attggaatggctttgcatgtcc

SEQ ID NO: 7967581 - DNA, 22 bp, Homo sapiens
attggaaatgctacaagttaga

SEQ ID NO: 7967582 - DNA, 22 bp, Homo sapiens
attggaaatgctacaagttaga

SEQ ID NO: 7967583 - DNA, 22 bp, Homo sapiens
attggaaatgctacaagttaga

SEQ ID NO: 7967584 - DNA, 22 bp, Homo sapiens
attggaaatgctacaagttaga

SEQ ID NO: 7967585 - DNA, 22 bp, Homo sapiens
attggaaataggccttgtacag

SEQ ID NO: 7967586 - DNA, 22 bp, Homo sapiens
atttaatgtcgagctattgtag

SEQ ID NO: 7967587 - DNA, 22 bp, Homo sapiens
atttaatgtcgagctattgtag

SEQ ID NO: 7967588 - DNA, 22 bp, Homo sapiens
atttaatgtcgagctattgtag

SEQ ID NO: 7967589 - DNA, 22 bp, Homo sapiens
atttaattaatcatggtgaatt

SEQ ID NO: 7967590 - DNA, 22 bp, Homo sapiens
atttaatttacatttgacagag

SEQ ID NO: 7967591 - DNA, 22 bp, Homo sapiens
atttaatttacatttgacagag

SEQ ID NO: 7967592 - DNA, 22 bp, Homo sapiens
atttaatttacatttgacagag

SEQ ID NO: 7967593 - DNA, 22 bp, Homo sapiens
atttaatttacatttgacagag

SEQ ID NO: 7967594 - DNA, 22 bp, Homo sapiens
atttaaattttctgatggagag

SEQ ID NO: 7967595 - DNA, 22 bp, Homo sapiens
atttaatgtcgagctattgtag

SEQ ID NO: 7967596 - DNA, 22 bp, Homo sapiens
atttaaattttctgatggagag

SEQ ID NO: 7967597 - DNA, 22 bp, Homo sapiens
attggcactgcacatgattgct

SEQ ID NO: 7967598 - DNA, 22 bp, Homo sapiens
attggcagaaacagcagggcca

SEQ ID NO: 7967599 - DNA, 22 bp, Homo sapiens
attggcaagtgaatttaacagc

SEQ ID NO: 7967600 - DNA, 22 bp, Homo sapiens
attggcaatagagaataaattg

SEQ ID NO: 7967601 - DNA, 22 bp, Homo sapiens
attggcaatagagaataaattg

SEQ ID NO: 7967602 - DNA, 22 bp, Homo sapiens
atttaattttctcaacagtgct

SEQ ID NO: 7967603 - DNA, 22 bp, Homo sapiens
atttaattttctcaacagtgct

SEQ ID NO: 7967604 - DNA, 21 bp, Homo sapiens
atttacaaaacagtcccttcc

SEQ ID NO: 7967605 - DNA, 21 bp, Homo sapiens
atttacaaaacagtcccttcc

SEQ ID NO: 7967606 - DNA, 21 bp, Homo sapiens
atttacaaaacagtcccttcc

SEQ ID NO: 7967607 - DNA, 22 bp, Homo sapiens
atttaatttgtgtctttagctg

SEQ ID NO: 7967608 - DNA, 22 bp, Homo sapiens
atttaatttatagatgtggata

SEQ ID NO: 7967609 - DNA, 22 bp, Homo sapiens
atttaatttggagagagaaacc

SEQ ID NO: 7967610 - DNA, 22 bp, Homo sapiens
atttaatttggagagagaaacc

SEQ ID NO: 7967611 - DNA, 22 bp, Homo sapiens
atttaatttggagagagaaacc

SEQ ID NO: 7967612 - DNA, 22 bp, Homo sapiens
atttacagaaacttaatcatag

SEQ ID NO: 7967613 - DNA, 22 bp, Homo sapiens
atttacagaaacttaatcatag

SEQ ID NO: 7967614 - DNA, 22 bp, Homo sapiens
atttacagaaacttaatcatag

SEQ ID NO: 7967615 - DNA, 22 bp, Homo sapiens
atttacagaagcatgtaatagc

SEQ ID NO: 7967616 - DNA, 22 bp, Homo sapiens
atttacagaagcatgtaatagc

SEQ ID NO: 7967617 - DNA, 22 bp, Homo sapiens
atttacagaagcatgtaatagc

SEQ ID NO: 7967618 - DNA, 22 bp, Homo sapiens
atttacagaaacttaatcatag

SEQ ID NO: 7967619 - DNA, 22 bp, Homo sapiens
atttacagaaacttaatcatag

SEQ ID NO: 7967620 - DNA, 22 bp, Homo sapiens
atttacagaaacttaatcatag

SEQ ID NO: 7967621 - DNA, 22 bp, Homo sapiens
atttacagaaacttaatcatag

SEQ ID NO: 7967622 - DNA, 22 bp, Homo sapiens
atttacacttggtttactagag

SEQ ID NO: 7967623 - DNA, 22 bp, Homo sapiens
atttacacttggtttactagag

SEQ ID NO: 7967624 - DNA, 22 bp, Homo sapiens
atttacacttggtttactagag

SEQ ID NO: 7967625 - DNA, 22 bp, Homo sapiens
atttacactggttctcagagct

SEQ ID NO: 7967626 - DNA, 22 bp, Homo sapiens
atttacacattcataagatttc

SEQ ID NO: 7967627 - DNA, 22 bp, Homo sapiens
gccaggaggcttaactggacag

SEQ ID NO: 7967628 - DNA, 22 bp, Homo sapiens
gccaggaggcttaactggacag

SEQ ID NO: 7967629 - DNA, 22 bp, Homo sapiens
gccaggaggcttaactggacag

SEQ ID NO: 7967630 - DNA, 22 bp, Homo sapiens
gccaggaggcttaactggacag

SEQ ID NO: 7967631 - DNA, 22 bp, Homo sapiens
gccagctggctgcaggtcccag

SEQ ID NO: 7967632 - DNA, 22 bp, Homo sapiens
gccagctggctgcaggtcccag

SEQ ID NO: 7967633 - DNA, 22 bp, Homo sapiens
gccagctggctgcaggtcccag

SEQ ID NO: 7967634 - DNA, 22 bp, Homo sapiens
gccagctggctgcaggtcccag

SEQ ID NO: 7967635 - DNA, 22 bp, Homo sapiens
gccagctggctgcaggtcccag

SEQ ID NO: 7967636 - DNA, 22 bp, Homo sapiens
atttacagaagcatgtaatagc

SEQ ID NO: 7967637 - DNA, 22 bp, Homo sapiens
gccagctggagtgagagtgggc

SEQ ID NO: 7967638 - DNA, 19 bp, Homo sapiens
gccaggagggctctggctg

SEQ ID NO: 7967639 - DNA, 19 bp, Homo sapiens
gccaggagggctctggctg

SEQ ID NO: 7967640 - DNA, 19 bp, Homo sapiens
gccaggagggctctggctg

SEQ ID NO: 7967641 - DNA, 22 bp, Homo sapiens
gccaggagggaaaggacaattt

SEQ ID NO: 7967642 - DNA, 22 bp, Homo sapiens
gccaggaggcttaactggacag

SEQ ID NO: 7967643 - DNA, 22 bp, Homo sapiens
atttagaaattccaaaagtatt

SEQ ID NO: 7967644 - DNA, 22 bp, Homo sapiens
atttagaaattccaaaagtatt

SEQ ID NO: 7967645 - DNA, 22 bp, Homo sapiens
atttagaaattccaaaagtatt

SEQ ID NO: 7967646 - DNA, 22 bp, Homo sapiens
atttagaaattccaaaagtatt

SEQ ID NO: 7967647 - DNA, 22 bp, Homo sapiens
atttactggaaaaactatgagc

SEQ ID NO: 7967648 - DNA, 22 bp, Homo sapiens
atttactgcttgacacattggt

SEQ ID NO: 7967649 - DNA, 22 bp, Homo sapiens
atttactggaaaaactatgagc

SEQ ID NO: 7967650 - DNA, 22 bp, Homo sapiens
atttactgcttgacacattggt

SEQ ID NO: 7967651 - DNA, 22 bp, Homo sapiens
atttactgcttgacacattggt

SEQ ID NO: 7967652 - DNA, 19 bp, Homo sapiens
atttactgcctaaaatctc

SEQ ID NO: 7967653 - DNA, 22 bp, Homo sapiens
atttactgaggtaaataaactg

SEQ ID NO: 7967654 - DNA, 19 bp, Homo sapiens
atttactgcctaaaatctc

SEQ ID NO: 7967655 - DNA, 22 bp, Homo sapiens
atttactgagcagctaccatgt

SEQ ID NO: 7967656 - DNA, 22 bp, Homo sapiens
atttactcgtgtctccagtgct

SEQ ID NO: 7967657 - DNA, 22 bp, Homo sapiens
atttactctggctggaatacaa

SEQ ID NO: 7967658 - DNA, 22 bp, Homo sapiens
atttactgagcagctaccatgt

SEQ ID NO: 7967659 - DNA, 22 bp, Homo sapiens
atttactgaggtaaataaactg

SEQ ID NO: 7967660 - DNA, 22 bp, Homo sapiens
atttagaaattccaaaagtatt

SEQ ID NO: 7967661 - DNA, 22 bp, Homo sapiens
atttagaaattccaaaagtatt

SEQ ID NO: 7967662 - DNA, 22 bp, Homo sapiens
atttagaaattccaaaagtatt

SEQ ID NO: 7967663 - DNA, 22 bp, Homo sapiens
atttagaaattccaaaagtatt

SEQ ID NO: 7967664 - DNA, 22 bp, Homo sapiens
atttagaaattccaaaagtatt

SEQ ID NO: 7967665 - DNA, 22 bp, Homo sapiens
atttagaaccccttccaacctg

SEQ ID NO: 7967666 - DNA, 22 bp, Homo sapiens
atttagaaccccttccaacctg

SEQ ID NO: 7967667 - DNA, 22 bp, Homo sapiens
atttagaaccccttccaacctg

SEQ ID NO: 7967668 - DNA, 22 bp, Homo sapiens
atttagaaccccttccaacctg

SEQ ID NO: 7967669 - DNA, 22 bp, Homo sapiens
atttagaactttgtttgccaat

SEQ ID NO: 7967670 - DNA, 22 bp, Homo sapiens
atttagaactttgtttgccaat

SEQ ID NO: 7967671 - DNA, 22 bp, Homo sapiens
atttagaagctaatttttcaga

SEQ ID NO: 7967672 - DNA, 22 bp, Homo sapiens
atttagaactttgtttgccaat

SEQ ID NO: 7967673 - DNA, 22 bp, Homo sapiens
atttagaactttgtttgccaat

SEQ ID NO: 7967674 - DNA, 22 bp, Homo sapiens
atttagaactttgtttgccaat

SEQ ID NO: 7967675 - DNA, 22 bp, Homo sapiens
atttagaactttgtttgccaat

SEQ ID NO: 7967676 - DNA, 22 bp, Homo sapiens
gccaggaggtcagcccctcaac

SEQ ID NO: 7967677 - DNA, 22 bp, Homo sapiens
gccaggaggtcagcccctcaac

SEQ ID NO: 7967678 - DNA, 22 bp, Homo sapiens
gccaggaggtcagcccctcaac

SEQ ID NO: 7967679 - DNA, 20 bp, Homo sapiens
gccaggagggtgtgatgagc

SEQ ID NO: 7967680 - DNA, 20 bp, Homo sapiens
gccaggagggtgtgatgagc

SEQ ID NO: 7967681 - DNA, 22 bp, Homo sapiens
gccaggaggggagagtgtgtca

SEQ ID NO: 7967682 - DNA, 22 bp, Homo sapiens
gccaggaggggagagtgtgtca

SEQ ID NO: 7967683 - DNA, 20 bp, Homo sapiens
gccaggagggtgtgatgagc

SEQ ID NO: 7967684 - DNA, 20 bp, Homo sapiens
gccaggagggtgtgatgagc

SEQ ID NO: 7967685 - DNA, 22 bp, Homo sapiens
gccaggagtgtcccactcattt

SEQ ID NO: 7967686 - DNA, 22 bp, Homo sapiens
gccaggagtgtcccactcattt

SEQ ID NO: 7967687 - DNA, 22 bp, Homo sapiens
gccaggagtgtcccactcattt

SEQ ID NO: 7967688 - DNA, 22 bp, Homo sapiens
gccaggagtgtgtggctatgtt

SEQ ID NO: 7967689 - DNA, 22 bp, Homo sapiens
gccaggagtgtgtggctatgtt

SEQ ID NO: 7967690 - DNA, 22 bp, Homo sapiens
atttactagggctgtttaagta

SEQ ID NO: 7967691 - DNA, 22 bp, Homo sapiens
gccaggagtgtgtggctatgtt

SEQ ID NO: 7967692 - DNA, 22 bp, Homo sapiens
atttactactgctatctagaag

SEQ ID NO: 7967693 - DNA, 22 bp, Homo sapiens
atttactactgctatctagaag

SEQ ID NO: 7967694 - DNA, 22 bp, Homo sapiens
atttactactgctatctagaag

SEQ ID NO: 7967695 - DNA, 22 bp, Homo sapiens
attcttcagaatatctggcact

SEQ ID NO: 7967696 - DNA, 22 bp, Homo sapiens
attcttcagaatatctggcact

SEQ ID NO: 7967697 - DNA, 22 bp, Homo sapiens
attgaaaaatgactattgctta

SEQ ID NO: 7967698 - DNA, 22 bp, Homo sapiens
attgaaaaatgactattgctta

SEQ ID NO: 7967699 - DNA, 22 bp, Homo sapiens
attgaaaaatgactattgctta

SEQ ID NO: 7967700 - DNA, 22 bp, Homo sapiens
attgaaattgatgaaattcttg

SEQ ID NO: 7967701 - DNA, 22 bp, Homo sapiens
attgaaattgatgaaattcttg

SEQ ID NO: 7967702 - DNA, 22 bp, Homo sapiens
attgaacagaaaaactcagaga

SEQ ID NO: 7967703 - DNA, 23 bp, Homo sapiens
attgaacagagagaaaaacatcc

SEQ ID NO: 7967704 - DNA, 22 bp, Homo sapiens
attgaacagaaaccatcagagt

SEQ ID NO: 7967705 - DNA, 22 bp, Homo sapiens
attgaactctgcaggagctgcc

SEQ ID NO: 7967706 - DNA, 22 bp, Homo sapiens
attgaactgaatcctggattgc

SEQ ID NO: 7967707 - DNA, 22 bp, Homo sapiens
attgaactaaataagcagtcat

SEQ ID NO: 7967708 - DNA, 22 bp, Homo sapiens
attgacaaatctgaacatacgg

SEQ ID NO: 7967709 - DNA, 22 bp, Homo sapiens
attgacaaatctgaacatacgg

SEQ ID NO: 7967710 - DNA, 23 bp, Homo sapiens
attgaatgtgcttttctacttag

SEQ ID NO: 7967711 - DNA, 22 bp, Homo sapiens
attgacaaaaacaggtggttga

SEQ ID NO: 7967712 - DNA, 23 bp, Homo sapiens
attgaatgtgcttttctacttag

SEQ ID NO: 7967713 - DNA, 22 bp, Homo sapiens
attgacaaaaacaggtggttga

SEQ ID NO: 7967714 - DNA, 22 bp, Homo sapiens
attgaatgcttgctaacacttt

SEQ ID NO: 7967715 - DNA, 22 bp, Homo sapiens
attgaatgtcctttagtaaaaa

SEQ ID NO: 7967716 - DNA, 22 bp, Homo sapiens
attgaatagctgcttgttgtat

SEQ ID NO: 7967717 - DNA, 22 bp, Homo sapiens
attgaatgtctactatgtgcaa

SEQ ID NO: 7967718 - DNA, 22 bp, Homo sapiens
attgaatagatgcattatacta

SEQ ID NO: 7967719 - DNA, 22 bp, Homo sapiens
attgaatagatgcattatacta

SEQ ID NO: 7967720 - DNA, 22 bp, Homo sapiens
attgaagcatacacaatgagga

SEQ ID NO: 7967721 - DNA, 22 bp, Homo sapiens
attgaagggcattagtcatcag

SEQ ID NO: 7967722 - DNA, 22 bp, Homo sapiens
attgaatagatgcattatacta

SEQ ID NO: 7967723 - DNA, 22 bp, Homo sapiens
attgaatagatgcattatacta

SEQ ID NO: 7967724 - DNA, 22 bp, Homo sapiens
attgaatagatgcattatacta

SEQ ID NO: 7967725 - DNA, 22 bp, Homo sapiens
attgaagattaaatgcttcctt

SEQ ID NO: 7967726 - DNA, 22 bp, Homo sapiens
attgaagattctgacatcagaa

SEQ ID NO: 7967727 - DNA, 22 bp, Homo sapiens
attgaagatcagggaaagattc

SEQ ID NO: 7967728 - DNA, 22 bp, Homo sapiens
attgaagatcagggaaagattc

SEQ ID NO: 7967729 - DNA, 22 bp, Homo sapiens
attgaagaaacccaaataatgg

SEQ ID NO: 7967730 - DNA, 22 bp, Homo sapiens
attgaagaaacccaaataatgg

SEQ ID NO: 7967731 - DNA, 22 bp, Homo sapiens
attgaagagaagctaaatagag

SEQ ID NO: 7967732 - DNA, 22 bp, Homo sapiens
attgaactgtctttgaagaaat

SEQ ID NO: 7967733 - DNA, 22 bp, Homo sapiens
attgaacttaacagtaagtggc

SEQ ID NO: 7967734 - DNA, 22 bp, Homo sapiens
attgaactgttggagaggtttt

SEQ ID NO: 7967735 - DNA, 22 bp, Homo sapiens
attgacagcaggggctgtcact

SEQ ID NO: 7967736 - DNA, 22 bp, Homo sapiens
attgacagagctttcaccatga

SEQ ID NO: 7967737 - DNA, 22 bp, Homo sapiens
attgacaatgtatttgtatctg

SEQ ID NO: 7967738 - DNA, 22 bp, Homo sapiens
attgacaattctatgcagagca

SEQ ID NO: 7967739 - DNA, 22 bp, Homo sapiens
attgacaattctatgcagagca

SEQ ID NO: 7967740 - DNA, 22 bp, Homo sapiens
attgacaaatggatgttgacat

SEQ ID NO: 7967741 - DNA, 22 bp, Homo sapiens
attgacaagaaagatattttta

SEQ ID NO: 7967742 - DNA, 22 bp, Homo sapiens
attgacaagacaatggctctta

SEQ ID NO: 7967743 - DNA, 22 bp, Homo sapiens
attgacaagtgagctgggctgc

SEQ ID NO: 7967744 - DNA, 22 bp, Homo sapiens
attgacaatctactatgttctg

SEQ ID NO: 7967745 - DNA, 22 bp, Homo sapiens
attgacaagcagtatgtcttag

SEQ ID NO: 7967746 - DNA, 22 bp, Homo sapiens
attgcacttcagcctgggtgac

SEQ ID NO: 7967747 - DNA, 22 bp, Homo sapiens
attgcacttcagcctgggtgac

SEQ ID NO: 7967748 - DNA, 22 bp, Homo sapiens
attgcacttcagcctgggtgac

SEQ ID NO: 7967749 - DNA, 22 bp, Homo sapiens
attgcacttcagcctgggtgac

SEQ ID NO: 7967750 - DNA, 22 bp, Homo sapiens
attgcacttcagcctgggtgac

SEQ ID NO: 7967751 - DNA, 22 bp, Homo sapiens
attgctggatgagctcttggat

SEQ ID NO: 7967752 - DNA, 22 bp, Homo sapiens
attgacatgtaggctacaagga

SEQ ID NO: 7967753 - DNA, 22 bp, Homo sapiens
attgacatgtaggctacaagga

SEQ ID NO: 7967754 - DNA, 22 bp, Homo sapiens
attgacattaactatattagcc

SEQ ID NO: 7967755 - DNA, 22 bp, Homo sapiens
attgctggcccagatgctttag

SEQ ID NO: 7967756 - DNA, 22 bp, Homo sapiens
attgctggctgccatcttgccc

SEQ ID NO: 7967757 - DNA, 22 bp, Homo sapiens
attgctgggaggatgtgtgttc

SEQ ID NO: 7967758 - DNA, 22 bp, Homo sapiens
attgctggcatcagtgacaata

SEQ ID NO: 7967759 - DNA, 22 bp, Homo sapiens
attgctggatgagctcttggat

SEQ ID NO: 7967760 - DNA, 22 bp, Homo sapiens
attgctgtaaattatcttatta

SEQ ID NO: 7967761 - DNA, 22 bp, Homo sapiens
attgctgtacacttctagatct

SEQ ID NO: 7967762 - DNA, 22 bp, Homo sapiens
attgctgtgtctggggcagatg

SEQ ID NO: 7967763 - DNA, 22 bp, Homo sapiens
attgctgtggaaatataagatg

SEQ ID NO: 7967764 - DNA, 22 bp, Homo sapiens
attgcttacagctatttctgta

SEQ ID NO: 7967765 - DNA, 22 bp, Homo sapiens
attgctgtttaggcaagtgtat

SEQ ID NO: 7967766 - DNA, 22 bp, Homo sapiens
attcttcaaagagtgtcaaagt

SEQ ID NO: 7967767 - DNA, 22 bp, Homo sapiens
attcttcaaagagtgtcaaagt

SEQ ID NO: 7967768 - DNA, 22 bp, Homo sapiens
attcttatttaaatagagtctg

SEQ ID NO: 7967769 - DNA, 22 bp, Homo sapiens
attcttattatagtaaaacagt

SEQ ID NO: 7967770 - DNA, 22 bp, Homo sapiens
attcttcacaaatatatagaag

SEQ ID NO: 7967771 - DNA, 22 bp, Homo sapiens
attcttcacactaaccctgtga

SEQ ID NO: 7967772 - DNA, 22 bp, Homo sapiens
attcttcacataagtgctgtac

SEQ ID NO: 7967773 - DNA, 22 bp, Homo sapiens
attcttcacctgagtcagtcta

SEQ ID NO: 7967774 - DNA, 22 bp, Homo sapiens
attcttattaaatagccagaag

SEQ ID NO: 7967775 - DNA, 22 bp, Homo sapiens
attcttattatagtaaaacagt

SEQ ID NO: 7967776 - DNA, 22 bp, Homo sapiens
attcttattatagtaaaacagt

SEQ ID NO: 7967777 - DNA, 22 bp, Homo sapiens
attcttattatagtaaaacagt

SEQ ID NO: 7967778 - DNA, 22 bp, Homo sapiens
attcttacaaagcagagtctgt

SEQ ID NO: 7967779 - DNA, 22 bp, Homo sapiens
attcttactccatagaatgaat

SEQ ID NO: 7967780 - DNA, 22 bp, Homo sapiens
attcttacaaatgaaactgcaa

SEQ ID NO: 7967781 - DNA, 22 bp, Homo sapiens
attcttaattgccatgctgtat

SEQ ID NO: 7967782 - DNA, 22 bp, Homo sapiens
attcttaattgccatgctgtat

SEQ ID NO: 7967783 - DNA, 22 bp, Homo sapiens
attcttaattgccatgctgtat

SEQ ID NO: 7967784 - DNA, 22 bp, Homo sapiens
attcttacaaagcagagtctgt

SEQ ID NO: 7967785 - DNA, 22 bp, Homo sapiens
attctgtgttaggatagatggt

SEQ ID NO: 7967786 - DNA, 22 bp, Homo sapiens
attcttaattccaaagactgag

SEQ ID NO: 7967787 - DNA, 22 bp, Homo sapiens
attcttaattgccatgctgtat

SEQ ID NO: 7967788 - DNA, 22 bp, Homo sapiens
attcttaattccaaagactgag

SEQ ID NO: 7967789 - DNA, 22 bp, Homo sapiens
attcttaattccaaagactgag

SEQ ID NO: 7967790 - DNA, 22 bp, Homo sapiens
attcttaattccaaagactgag

SEQ ID NO: 7967791 - DNA, 22 bp, Homo sapiens
attctaggcttgaaacatgaag

SEQ ID NO: 7967792 - DNA, 22 bp, Homo sapiens
attctatagacagaaggtcaat

SEQ ID NO: 7967793 - DNA, 22 bp, Homo sapiens
attctatagacagaaggtcaat

SEQ ID NO: 7967794 - DNA, 22 bp, Homo sapiens
attctatcaagctgtcttcttt

SEQ ID NO: 7967795 - DNA, 22 bp, Homo sapiens
attctattaatatttctaggaa

SEQ ID NO: 7967796 - DNA, 22 bp, Homo sapiens
attctattaatatttctaggaa

SEQ ID NO: 7967797 - DNA, 22 bp, Homo sapiens
attctattaatatttctaggaa

SEQ ID NO: 7967798 - DNA, 22 bp, Homo sapiens
attctattttttaagaagtagt

SEQ ID NO: 7967799 - DNA, 22 bp, Homo sapiens
attctattttttaagaagtagt

SEQ ID NO: 7967800 - DNA, 22 bp, Homo sapiens
attctattttttaagaagtagt

SEQ ID NO: 7967801 - DNA, 22 bp, Homo sapiens
attctattttttaagaagtagt

SEQ ID NO: 7967802 - DNA, 22 bp, Homo sapiens
attctattttttaagaagtagt

SEQ ID NO: 7967803 - DNA, 22 bp, Homo sapiens
attctcaaaacataacttcact

SEQ ID NO: 7967804 - DNA, 22 bp, Homo sapiens
attctcaaacaagtggtttgat

SEQ ID NO: 7967805 - DNA, 22 bp, Homo sapiens
attctagtgtttccattacaag

SEQ ID NO: 7967806 - DNA, 22 bp, Homo sapiens
attctaggacttgagagctaag

SEQ ID NO: 7967807 - DNA, 22 bp, Homo sapiens
attctagatgctgtaagtagca

SEQ ID NO: 7967808 - DNA, 22 bp, Homo sapiens
attctagatgctgtaagtagca

SEQ ID NO: 7967809 - DNA, 22 bp, Homo sapiens
attctagccaaccatctgagat

SEQ ID NO: 7967810 - DNA, 22 bp, Homo sapiens
attctagccattgtattcttcc

SEQ ID NO: 7967811 - DNA, 22 bp, Homo sapiens
attctagataagaaaagggctg

SEQ ID NO: 7967812 - DNA, 22 bp, Homo sapiens
attctagataagaaaagggctg

SEQ ID NO: 7967813 - DNA, 22 bp, Homo sapiens
attctagataagaaaagggctg

SEQ ID NO: 7967814 - DNA, 22 bp, Homo sapiens
attctagatacctaggggattt

SEQ ID NO: 7967815 - DNA, 17 bp, Homo sapiens
attctagatgaggtgct

SEQ ID NO: 7967816 - DNA, 17 bp, Homo sapiens
attctagatgaggtgct

SEQ ID NO: 7967817 - DNA, 22 bp, Homo sapiens
attctagacatctgcagttgtt

SEQ ID NO: 7967818 - DNA, 22 bp, Homo sapiens
attctagagtttcaatccaagg

SEQ ID NO: 7967819 - DNA, 22 bp, Homo sapiens
attctagagtttcaatccaagg

SEQ ID NO: 7967820 - DNA, 22 bp, Homo sapiens
attctagacatctgcagttgtt

SEQ ID NO: 7967821 - DNA, 22 bp, Homo sapiens
attctagagcagtgattctcat

SEQ ID NO: 7967822 - DNA, 21 bp, Homo sapiens
attctagacaacactgaaatc

SEQ ID NO: 7967823 - DNA, 22 bp, Homo sapiens
attctcagctttcaaatagaca

SEQ ID NO: 7967824 - DNA, 22 bp, Homo sapiens
attctcagctttcaaatagaca

SEQ ID NO: 7967825 - DNA, 21 bp, Homo sapiens
attctcaggcccatcctcagg

SEQ ID NO: 7967826 - DNA, 22 bp, Homo sapiens
attctcagatcttagaggaata

SEQ ID NO: 7967827 - DNA, 22 bp, Homo sapiens
attctcaattttgccaaagggt

SEQ ID NO: 7967828 - DNA, 20 bp, Homo sapiens
attctcacatggctccgggc

SEQ ID NO: 7967829 - DNA, 22 bp, Homo sapiens
attctcaagctggctgggagca

SEQ ID NO: 7967830 - DNA, 22 bp, Homo sapiens
attctcaactactgcgagagct

SEQ ID NO: 7967831 - DNA, 22 bp, Homo sapiens
attctcaatggctactttcata

SEQ ID NO: 7967832 - DNA, 22 bp, Homo sapiens
attctcaatggctactttcata

SEQ ID NO: 7967833 - DNA, 22 bp, Homo sapiens
attctcaatggctactttcata

SEQ ID NO: 7967834 - DNA, 22 bp, Homo sapiens
attctcaaagccagagtcaacg

SEQ ID NO: 7967835 - DNA, 22 bp, Homo sapiens
attctcagggagtattttctat

SEQ ID NO: 7967836 - DNA, 21 bp, Homo sapiens
attctcaggcccatcctcagg

SEQ ID NO: 7967837 - DNA, 22 bp, Homo sapiens
attctggaagcaagcttttaaa

SEQ ID NO: 7967838 - DNA, 22 bp, Homo sapiens
attctgtcatttcaagaaaaac

SEQ ID NO: 7967839 - DNA, 22 bp, Homo sapiens
attctggaattctaagattctg

SEQ ID NO: 7967840 - DNA, 22 bp, Homo sapiens
attctggaattctaagattctg

SEQ ID NO: 7967841 - DNA, 22 bp, Homo sapiens
attctgtctttttatacatcta

SEQ ID NO: 7967842 - DNA, 22 bp, Homo sapiens
attctgtctaagctggctacgt

SEQ ID NO: 7967843 - DNA, 21 bp, Homo sapiens
attctgtcatcccagctactt

SEQ ID NO: 7967844 - DNA, 22 bp, Homo sapiens
attctgtgatagttgatcctta

SEQ ID NO: 7967845 - DNA, 22 bp, Homo sapiens
attctgtctttttaaaataata

SEQ ID NO: 7967846 - DNA, 22 bp, Homo sapiens
attctgtctttttaaaataata

SEQ ID NO: 7967847 - DNA, 22 bp, Homo sapiens
attctacacaacatgatgatgg

SEQ ID NO: 7967848 - DNA, 22 bp, Homo sapiens
attctacacaacatgatgatgg

SEQ ID NO: 7967849 - DNA, 22 bp, Homo sapiens
attctacacctctctcatttag

SEQ ID NO: 7967850 - DNA, 22 bp, Homo sapiens
attctacacctctctcatttag

SEQ ID NO: 7967851 - DNA, 22 bp, Homo sapiens
attctacacctctctcatttag

SEQ ID NO: 7967852 - DNA, 22 bp, Homo sapiens
attctacacctctctcatttag

SEQ ID NO: 7967853 - DNA, 22 bp, Homo sapiens
attctacagatgaaagcggctg

SEQ ID NO: 7967854 - DNA, 22 bp, Homo sapiens
attctacaggactggcaatccc

SEQ ID NO: 7967855 - DNA, 22 bp, Homo sapiens
attctacaggactggcaatccc

SEQ ID NO: 7967856 - DNA, 22 bp, Homo sapiens
attctacaggactggcaatccc

SEQ ID NO: 7967857 - DNA, 22 bp, Homo sapiens
attctacatgatagaagggaga

SEQ ID NO: 7967858 - DNA, 22 bp, Homo sapiens
attctacatgatagaagggaga

SEQ ID NO: 7967859 - DNA, 22 bp, Homo sapiens
attctacatttggagtgatgtc

SEQ ID NO: 7967860 - DNA, 22 bp, Homo sapiens
attctacagggtacgttgggga

SEQ ID NO: 7967861 - DNA, 22 bp, Homo sapiens
attctacatgatagaagggaga

SEQ ID NO: 7967862 - DNA, 22 bp, Homo sapiens
attctacatttggagtgatgtc

SEQ ID NO: 7967863 - DNA, 22 bp, Homo sapiens
attctactcattgatctatata

SEQ ID NO: 7967864 - DNA, 22 bp, Homo sapiens
attctagaaaccagggaggcat

SEQ ID NO: 7967865 - DNA, 22 bp, Homo sapiens
attctagaaaccagggaggcat

SEQ ID NO: 7967866 - DNA, 22 bp, Homo sapiens
attctactgcttggaatatctt

SEQ ID NO: 7967867 - DNA, 22 bp, Homo sapiens
attctactttgtgtaattatct

SEQ ID NO: 7967868 - DNA, 21 bp, Homo sapiens
attctagacaacactgaaatc

SEQ ID NO: 7967869 - DNA, 21 bp, Homo sapiens
attctagacaacactgaaatc

SEQ ID NO: 7967870 - DNA, 21 bp, Homo sapiens
attctagacaacactgaaatc

SEQ ID NO: 7967871 - DNA, 22 bp, Homo sapiens
attctagaaggcaaagcaaggg

SEQ ID NO: 7967872 - DNA, 21 bp, Homo sapiens
attctagacaacactgaaatc

SEQ ID NO: 7967873 - DNA, 21 bp, Homo sapiens
attctagacaacactgaaatc

SEQ ID NO: 7967874 - DNA, 22 bp, Homo sapiens
attctagaatttaaatttgcca

SEQ ID NO: 7967875 - DNA, 22 bp, Homo sapiens
attctagaaggcaaagcaaggg

SEQ ID NO: 7967876 - DNA, 22 bp, Homo sapiens
attctagaaggcaaagcaaggg

SEQ ID NO: 7967877 - DNA, 22 bp, Homo sapiens
attctagaacagaggtttctaa

SEQ ID NO: 7967878 - DNA, 18 bp, Homo sapiens
attctagaagatgccttg

SEQ ID NO: 7967879 - DNA, 18 bp, Homo sapiens
attctagaagatgccttg

SEQ ID NO: 7967880 - DNA, 22 bp, Homo sapiens
gcagcagggagcaggggtgtca

SEQ ID NO: 7967881 - DNA, 22 bp, Homo sapiens
gcagcagggagcaggggtgtca

SEQ ID NO: 7967882 - DNA, 22 bp, Homo sapiens
gcagcagggagcaggggtgtca

SEQ ID NO: 7967883 - DNA, 22 bp, Homo sapiens
gcagcaggcttttcataccttg

SEQ ID NO: 7967884 - DNA, 22 bp, Homo sapiens
gcagcaggcttttcataccttg

SEQ ID NO: 7967885 - DNA, 22 bp, Homo sapiens
gcagcaggcttttcataccttg

SEQ ID NO: 7967886 - DNA, 22 bp, Homo sapiens
gcagcagggtgccagctttgca

SEQ ID NO: 7967887 - DNA, 22 bp, Homo sapiens
gcagcagggtgccagctttgca

SEQ ID NO: 7967888 - DNA, 22 bp, Homo sapiens
gcagcagggagcaggggtgtca

SEQ ID NO: 7967889 - DNA, 22 bp, Homo sapiens
gcagcagggagcaggggtgtca

SEQ ID NO: 7967890 - DNA, 22 bp, Homo sapiens
gcagcagggagcaggggtgtca

SEQ ID NO: 7967891 - DNA, 22 bp, Homo sapiens
gcagcaggtccgcatcatcatc

SEQ ID NO: 7967892 - DNA, 22 bp, Homo sapiens
gcagcaggtccgcatcatcatc

SEQ ID NO: 7967893 - DNA, 22 bp, Homo sapiens
gcagcagggtgccagctttgca

SEQ ID NO: 7967894 - DNA, 22 bp, Homo sapiens
gcagcagggtgccagctttgca

SEQ ID NO: 7967895 - DNA, 22 bp, Homo sapiens
gcagcagggtgccagctttgca

SEQ ID NO: 7967896 - DNA, 22 bp, Homo sapiens
attctacacaaagcaagaagac

SEQ ID NO: 7967897 - DNA, 22 bp, Homo sapiens
attctacacaaagcaagaagac

SEQ ID NO: 7967898 - DNA, 22 bp, Homo sapiens
attctacacaaagcaagaagac

SEQ ID NO: 7967899 - DNA, 22 bp, Homo sapiens
attcctttggactcctccttgc

SEQ ID NO: 7967900 - DNA, 22 bp, Homo sapiens
attccttgtttcactgaaaagg

SEQ ID NO: 7967901 - DNA, 22 bp, Homo sapiens
attccttgtttcactgaaaagg

SEQ ID NO: 7967902 - DNA, 22 bp, Homo sapiens
attcctttggactcctccttgc

SEQ ID NO: 7967903 - DNA, 22 bp, Homo sapiens
attcctcatttgttgagaacca

SEQ ID NO: 7967904 - DNA, 22 bp, Homo sapiens
attcctcattatttactgagga

SEQ ID NO: 7967905 - DNA, 20 bp, Homo sapiens
attcctcagccccagcctca

SEQ ID NO: 7967906 - DNA, 22 bp, Homo sapiens
attcctaaggaaggctggcaag

SEQ ID NO: 7967907 - DNA, 22 bp, Homo sapiens
attcctaaagtaatacactaga

SEQ ID NO: 7967908 - DNA, 22 bp, Homo sapiens
attcctaaagtaatacactaga

SEQ ID NO: 7967909 - DNA, 22 bp, Homo sapiens
attcctcaaaggtagcccatta

SEQ ID NO: 7967910 - DNA, 16 bp, Homo sapiens
gcagaggaaaggggag

SEQ ID NO: 7967911 - DNA, 16 bp, Homo sapiens
gcagaggaaaggggag

SEQ ID NO: 7967912 - DNA, 16 bp, Homo sapiens
gcagaggaaaggggag

SEQ ID NO: 7967913 - DNA, 22 bp, Homo sapiens
attccactttatgtctgtatga

SEQ ID NO: 7967914 - DNA, 20 bp, Homo sapiens
attccacttgtttgaggtac

SEQ ID NO: 7967915 - DNA, 22 bp, Homo sapiens
gcagagcttctgtccttcagga

SEQ ID NO: 7967916 - DNA, 22 bp, Homo sapiens
gcagagcttctgtccttcagga

SEQ ID NO: 7967917 - DNA, 22 bp, Homo sapiens
attccctttgacgatccctagg

SEQ ID NO: 7967918 - DNA, 22 bp, Homo sapiens
attccctttgacgatccctagg

SEQ ID NO: 7967919 - DNA, 20 bp, Homo sapiens
attcccttctccctgtttga

SEQ ID NO: 7967920 - DNA, 20 bp, Homo sapiens
attcccttctccctgtttga

SEQ ID NO: 7967921 - DNA, 22 bp, Homo sapiens
attcctaaagtaatacactaga

SEQ ID NO: 7967922 - DNA, 20 bp, Homo sapiens
attcccttctccctgtttga

SEQ ID NO: 7967923 - DNA, 22 bp, Homo sapiens
attccctgaaattgtgctttca

SEQ ID NO: 7967924 - DNA, 21 bp, Homo sapiens
attccacttttccttcaggga

SEQ ID NO: 7967925 - DNA, 22 bp, Homo sapiens
attccttctaaaacgctgccct

SEQ ID NO: 7967926 - DNA, 22 bp, Homo sapiens
attcctgtcccttcattgttga

SEQ ID NO: 7967927 - DNA, 22 bp, Homo sapiens
attcctgtgtatgtcttgctgc

SEQ ID NO: 7967928 - DNA, 22 bp, Homo sapiens
gcagcaggcacttaccgttgct

SEQ ID NO: 7967929 - DNA, 22 bp, Homo sapiens
gcagcaggcatggccgccctgg

SEQ ID NO: 7967930 - DNA, 22 bp, Homo sapiens
gcagcaggcttttcataccttg

SEQ ID NO: 7967931 - DNA, 22 bp, Homo sapiens
gcagcaggcttttcataccttg

SEQ ID NO: 7967932 - DNA, 22 bp, Homo sapiens
gcagcaggcatggccgccctgg

SEQ ID NO: 7967933 - DNA, 22 bp, Homo sapiens
gcagcaggcatggccgccctgg

SEQ ID NO: 7967934 - DNA, 22 bp, Homo sapiens
gcagcaggcatggccgccctgg

SEQ ID NO: 7967935 - DNA, 22 bp, Homo sapiens
attcctggtggcagaaacatga

SEQ ID NO: 7967936 - DNA, 22 bp, Homo sapiens
attcctgataaatgctgctctg

SEQ ID NO: 7967937 - DNA, 22 bp, Homo sapiens
attcctgattaacgacctttca

SEQ ID NO: 7967938 - DNA, 22 bp, Homo sapiens
attcctgagacttatctgtttc

SEQ ID NO: 7967939 - DNA, 23 bp, Homo sapiens
attcctgaggctccttatgcacc

SEQ ID NO: 7967940 - DNA, 23 bp, Homo sapiens
attcctgaggctccttatgcacc

SEQ ID NO: 7967941 - DNA, 22 bp, Homo sapiens
attcctgaagaaggtatgttgc

SEQ ID NO: 7967942 - DNA, 22 bp, Homo sapiens
attcctgactgctagtcattca

SEQ ID NO: 7967943 - DNA, 22 bp, Homo sapiens
attcctcatttgttgagaacca

SEQ ID NO: 7967944 - DNA, 22 bp, Homo sapiens
attcctgactgttagagtttgc

SEQ ID NO: 7967945 - DNA, 22 bp, Homo sapiens
attcctgaagaaggtatgttgc

SEQ ID NO: 7967946 - DNA, 22 bp, Homo sapiens
attcctgactgctagtcattca

SEQ ID NO: 7967947 - DNA, 22 bp, Homo sapiens
attcctgactgttagagtttgc

SEQ ID NO: 7967948 - DNA, 22 bp, Homo sapiens
attcctgagacttatctgtttc

SEQ ID NO: 7967949 - DNA, 22 bp, Homo sapiens
attcagttagccacagctattc

SEQ ID NO: 7967950 - DNA, 22 bp, Homo sapiens
attcagttagatcatcctaatt

SEQ ID NO: 7967951 - DNA, 22 bp, Homo sapiens
attcagttaaaaactgtacttc

SEQ ID NO: 7967952 - DNA, 22 bp, Homo sapiens
attcagttaagggtcttgagat

SEQ ID NO: 7967953 - DNA, 22 bp, Homo sapiens
attcagttactctagacacttc

SEQ ID NO: 7967954 - DNA, 22 bp, Homo sapiens
attcagttactctagacacttc

SEQ ID NO: 7967955 - DNA, 22 bp, Homo sapiens
attcagtgtagttattatcttt

SEQ ID NO: 7967956 - DNA, 22 bp, Homo sapiens
attcagtgggtgctcagcacaa

SEQ ID NO: 7967957 - DNA, 22 bp, Homo sapiens
attcagtgtagttattatcttt

SEQ ID NO: 7967958 - DNA, 22 bp, Homo sapiens
attcagtgtagttattatcttt

SEQ ID NO: 7967959 - DNA, 22 bp, Homo sapiens
attcagtgtatcaatgaatgct

SEQ ID NO: 7967960 - DNA, 22 bp, Homo sapiens
attcagtgtctactccattgcc

SEQ ID NO: 7967961 - DNA, 22 bp, Homo sapiens
attcagtgtctactccattgcc

SEQ ID NO: 7967962 - DNA, 22 bp, Homo sapiens
attcagtgtatcaatgaatgct

SEQ ID NO: 7967963 - DNA, 22 bp, Homo sapiens
attcagtgtatcaatgaatgct

SEQ ID NO: 7967964 - DNA, 19 bp, Homo sapiens
attcagtgtctctgacttc

SEQ ID NO: 7967965 - DNA, 19 bp, Homo sapiens
attcagtgtctctgacttc

SEQ ID NO: 7967966 - DNA, 19 bp, Homo sapiens
attcagtgtctctgacttc

SEQ ID NO: 7967967 - DNA, 22 bp, Homo sapiens
attcagtgtttgcagcaacttt

SEQ ID NO: 7967968 - DNA, 22 bp, Homo sapiens
attcagtgtttgcagcaacttt

SEQ ID NO: 7967969 - DNA, 22 bp, Homo sapiens
attcagtgtttgcagcaacttt

SEQ ID NO: 7967970 - DNA, 22 bp, Homo sapiens
attcagtgtttgcagcaacttt

SEQ ID NO: 7967971 - DNA, 22 bp, Homo sapiens
attcagtgtgaggttttcaagt

SEQ ID NO: 7967972 - DNA, 22 bp, Homo sapiens
attcagtgtggacccatttaaa

SEQ ID NO: 7967973 - DNA, 22 bp, Homo sapiens
attcagtgtcttgatctgggaa

SEQ ID NO: 7967974 - DNA, 22 bp, Homo sapiens
attcagtgtgaggttttcaagt

SEQ ID NO: 7967975 - DNA, 21 bp, Homo sapiens
gcagagctggaaccaggaccc

SEQ ID NO: 7967976 - DNA, 21 bp, Homo sapiens
gcagagctggaaccaggaccc

SEQ ID NO: 7967977 - DNA, 21 bp, Homo sapiens
gcagagctggaaccaggaccc

SEQ ID NO: 7967978 - DNA, 22 bp, Homo sapiens
gcagagctgcagcgaggcctgg

SEQ ID NO: 7967979 - DNA, 21 bp, Homo sapiens
gcagagctggaaccaggaccc

SEQ ID NO: 7967980 - DNA, 22 bp, Homo sapiens
gcagagctgggatatgaaccca

SEQ ID NO: 7967981 - DNA, 22 bp, Homo sapiens
gcagagctgttaatggagctga

SEQ ID NO: 7967982 - DNA, 22 bp, Homo sapiens
gcagagctgttaatggagctga

SEQ ID NO: 7967983 - DNA, 22 bp, Homo sapiens
gcagagctgttaatggagctga

SEQ ID NO: 7967984 - DNA, 22 bp, Homo sapiens
gcagagctgttaatggagctga

SEQ ID NO: 7967985 - DNA, 20 bp, Homo sapiens
gcagagctgttctgtgggga

SEQ ID NO: 7967986 - DNA, 20 bp, Homo sapiens
gcagagctgttctgtgggga

SEQ ID NO: 7967987 - DNA, 20 bp, Homo sapiens
gcagagctgttctgtgggga

SEQ ID NO: 7967988 - DNA, 22 bp, Homo sapiens
gcagagctggtacttgagcctg

SEQ ID NO: 7967989 - DNA, 22 bp, Homo sapiens
gcagagctgggtctgtatccaa

SEQ ID NO: 7967990 - DNA, 22 bp, Homo sapiens
gcagagctgggtctgtatccaa

SEQ ID NO: 7967991 - DNA, 22 bp, Homo sapiens
attattggtacaccgtagtcat

SEQ ID NO: 7967992 - DNA, 22 bp, Homo sapiens
attattgtactttcaataaggt

SEQ ID NO: 7967993 - DNA, 22 bp, Homo sapiens
attattggtacaccgtagtcat

SEQ ID NO: 7967994 - DNA, 22 bp, Homo sapiens
attattgtactttcaataaggt

SEQ ID NO: 7967995 - DNA, 22 bp, Homo sapiens
attattgtactttcaataaggt

SEQ ID NO: 7967996 - DNA, 22 bp, Homo sapiens
attattggacacttcttctgca

SEQ ID NO: 7967997 - DNA, 22 bp, Homo sapiens
attattggacacttcttctgca

SEQ ID NO: 7967998 - DNA, 22 bp, Homo sapiens
attattgtactttcaataaggt

SEQ ID NO: 7967999 - DNA, 22 bp, Homo sapiens
attattgtactttcaataaggt

SEQ ID NO: 7968000 - DNA, 22 bp, Homo sapiens
attattgtgataggtgtcagtg

SEQ ID NO: 7968001 - DNA, 22 bp, Homo sapiens
attattgtgataggtgtcagtg

SEQ ID NO: 7968002 - DNA, 22 bp, Homo sapiens
attattgtgtaaaatgaggctt

SEQ ID NO: 7968003 - DNA, 22 bp, Homo sapiens
attattgtgtaaaatgaggctt

SEQ ID NO: 7968004 - DNA, 22 bp, Homo sapiens
attattgtgtaaaatgaggctt

SEQ ID NO: 7968005 - DNA, 22 bp, Homo sapiens
attattgtcatcttaatcttaa

SEQ ID NO: 7968006 - DNA, 22 bp, Homo sapiens
attattgtcatcttaatcttaa

SEQ ID NO: 7968007 - DNA, 22 bp, Homo sapiens
attattgtgataggtgtcagtg

SEQ ID NO: 7968008 - DNA, 22 bp, Homo sapiens
attattgtgataggtgtcagtg

SEQ ID NO: 7968009 - DNA, 22 bp, Homo sapiens
attattgtcatcttaatcttaa

SEQ ID NO: 7968010 - DNA, 22 bp, Homo sapiens
attattgtcatcttaatcttaa

SEQ ID NO: 7968011 - DNA, 22 bp, Homo sapiens
attatttacagtgtgctcgaag

SEQ ID NO: 7968012 - DNA, 22 bp, Homo sapiens
attatttagaaatcgattgaaa

SEQ ID NO: 7968013 - DNA, 22 bp, Homo sapiens
attatttacagtgtgctcgaag

SEQ ID NO: 7968014 - DNA, 22 bp, Homo sapiens
attatttagaaatcgattgaaa

SEQ ID NO: 7968015 - DNA, 22 bp, Homo sapiens
attattgttgcggctgttaccg

SEQ ID NO: 7968016 - DNA, 22 bp, Homo sapiens
attattgttgcggctgttaccg

SEQ ID NO: 7968017 - DNA, 22 bp, Homo sapiens
attattgttgcggctgttaccg

SEQ ID NO: 7968018 - DNA, 22 bp, Homo sapiens
attattgtgtaaaatgaggctt

SEQ ID NO: 7968019 - DNA, 22 bp, Homo sapiens
attattgttagtgacagggtga

SEQ ID NO: 7968020 - DNA, 22 bp, Homo sapiens
attattgttagtgacagggtga

SEQ ID NO: 7968021 - DNA, 22 bp, Homo sapiens
attattgttagtgacagggtga

SEQ ID NO: 7968022 - DNA, 22 bp, Homo sapiens
attattgttagtgacagggtga

SEQ ID NO: 7968023 - DNA, 22 bp, Homo sapiens
attattgttttaatagtagaga

SEQ ID NO: 7968024 - DNA, 22 bp, Homo sapiens
attattgttttaatagtagaga

SEQ ID NO: 7968025 - DNA, 22 bp, Homo sapiens
attattgttttaatagtagaga

SEQ ID NO: 7968026 - DNA, 22 bp, Homo sapiens
attattgttttaatagtagaga

SEQ ID NO: 7968027 - DNA, 22 bp, Homo sapiens
attattgttttaatagtagaga

SEQ ID NO: 7968028 - DNA, 22 bp, Homo sapiens
attatttatcctcttggtctat

SEQ ID NO: 7968029 - DNA, 22 bp, Homo sapiens
attatttatcctcttggtctat

SEQ ID NO: 7968030 - DNA, 22 bp, Homo sapiens
attatttagaaatcgattgaaa

SEQ ID NO: 7968031 - DNA, 22 bp, Homo sapiens
attatttagaaatcgattgaaa

SEQ ID NO: 7968032 - DNA, 22 bp, Homo sapiens
attatttatcctcttggtctat

SEQ ID NO: 7968033 - DNA, 22 bp, Homo sapiens
attatttatcctcttggtctat

SEQ ID NO: 7968034 - DNA, 22 bp, Homo sapiens
attatttatcctcttggtctat

SEQ ID NO: 7968035 - DNA, 22 bp, Homo sapiens
attcagactgtctaaatggttt

SEQ ID NO: 7968036 - DNA, 22 bp, Homo sapiens
attcagagattgttattcagac

SEQ ID NO: 7968037 - DNA, 21 bp, Homo sapiens
attcagagtaattcatcttta

SEQ ID NO: 7968038 - DNA, 21 bp, Homo sapiens
attcagagtaattcatcttta

SEQ ID NO: 7968039 - DNA, 22 bp, Homo sapiens
attcagtcaaaaatgatggaga

SEQ ID NO: 7968040 - DNA, 22 bp, Homo sapiens
attcagtgattcatttgtacaa

SEQ ID NO: 7968041 - DNA, 22 bp, Homo sapiens
attcagtgattcatttgtacaa

SEQ ID NO: 7968042 - DNA, 22 bp, Homo sapiens
attcagtgagtgtttaccggaa

SEQ ID NO: 7968043 - DNA, 22 bp, Homo sapiens
attcagtgattcatttgtacaa

SEQ ID NO: 7968044 - DNA, 22 bp, Homo sapiens
attcagtgacctaattacttac

SEQ ID NO: 7968045 - DNA, 22 bp, Homo sapiens
attcagtgacctaattacttac

SEQ ID NO: 7968046 - DNA, 22 bp, Homo sapiens
attcagtgacctaattacttac

SEQ ID NO: 7968047 - DNA, 22 bp, Homo sapiens
attcagtgccaaggagaacttg

SEQ ID NO: 7968048 - DNA, 22 bp, Homo sapiens
attcagtgctgtaatacgctaa

SEQ ID NO: 7968049 - DNA, 22 bp, Homo sapiens
attcagtgccaaggagaacttg

SEQ ID NO: 7968050 - DNA, 22 bp, Homo sapiens
attcagtgccaaggagaacttg

SEQ ID NO: 7968051 - DNA, 22 bp, Homo sapiens
attcagtgccaaggagaacttg

SEQ ID NO: 7968052 - DNA, 22 bp, Homo sapiens
attcagtggatatcttcacttt

SEQ ID NO: 7968053 - DNA, 22 bp, Homo sapiens
attcagtggatatcttcacttt

SEQ ID NO: 7968054 - DNA, 22 bp, Homo sapiens
attcagtgggtgctcagcacaa

SEQ ID NO: 7968055 - DNA, 22 bp, Homo sapiens
attcagtggatatcttcacttt

SEQ ID NO: 7968056 - DNA, 22 bp, Homo sapiens
attcagtgggtgctcagcacaa

SEQ ID NO: 7968057 - DNA, 22 bp, Homo sapiens
atgtgtttttattctggcatgt

SEQ ID NO: 7968058 - DNA, 22 bp, Homo sapiens
atgtgttttggtggatcattca

SEQ ID NO: 7968059 - DNA, 22 bp, Homo sapiens
atgtgttttggtggatcattca

SEQ ID NO: 7968060 - DNA, 22 bp, Homo sapiens
atgtgtttgtcctgcagaaata

SEQ ID NO: 7968061 - DNA, 22 bp, Homo sapiens
atgtgttttggtaatttctgct

SEQ ID NO: 7968062 - DNA, 22 bp, Homo sapiens
atgttaaaaaccagtacagttg

SEQ ID NO: 7968063 - DNA, 20 bp, Homo sapiens
atgtttctctgtcgtgattt

SEQ ID NO: 7968064 - DNA, 22 bp, Homo sapiens
atgttaaaaaccagtacagttg

SEQ ID NO: 7968065 - DNA, 22 bp, Homo sapiens
atgttaaaaaccagtacagttg

SEQ ID NO: 7968066 - DNA, 22 bp, Homo sapiens
atgttaaaaaccagtacagttg

SEQ ID NO: 7968067 - DNA, 22 bp, Homo sapiens
atgtgtttgtacctttaaatat

SEQ ID NO: 7968068 - DNA, 22 bp, Homo sapiens
atgtgtttgtcctgcagaaata

SEQ ID NO: 7968069 - DNA, 22 bp, Homo sapiens
atgtgtttgtacctttaaatat

SEQ ID NO: 7968070 - DNA, 22 bp, Homo sapiens
atgtgtttgtcctgcagaaata

SEQ ID NO: 7968071 - DNA, 22 bp, Homo sapiens
atgtgtttataattactcaatc

SEQ ID NO: 7968072 - DNA, 22 bp, Homo sapiens
atgtgtttataattactcaatc

SEQ ID NO: 7968073 - DNA, 22 bp, Homo sapiens
atgtgtgtgtgcgcgcgcagga

SEQ ID NO: 7968074 - DNA, 22 bp, Homo sapiens
atgtgtgtgtgcgcgcgcagga

SEQ ID NO: 7968075 - DNA, 22 bp, Homo sapiens
atgtgtgtgtgcgcgcgcagga

SEQ ID NO: 7968076 - DNA, 22 bp, Homo sapiens
atgtgtgtgtgcgcgcgcagga

SEQ ID NO: 7968077 - DNA, 22 bp, Homo sapiens
atgtgtgtgtttaatcctcaaa

SEQ ID NO: 7968078 - DNA, 22 bp, Homo sapiens
atgtgtgtgtttaatcctcaaa

SEQ ID NO: 7968079 - DNA, 22 bp, Homo sapiens
atgtgtgtgtatatacacacat

SEQ ID NO: 7968080 - DNA, 22 bp, Homo sapiens
atgtgtgtgtatatacacacat

SEQ ID NO: 7968081 - DNA, 22 bp, Homo sapiens
atgtgtgtgtatatacacacat

SEQ ID NO: 7968082 - DNA, 22 bp, Homo sapiens
atgtgtgtgtatatacacacat

SEQ ID NO: 7968083 - DNA, 22 bp, Homo sapiens
atgtgtgtgtgcgcgcgcagga

SEQ ID NO: 7968084 - DNA, 22 bp, Homo sapiens
atgtgtgtgtatatacacacat

SEQ ID NO: 7968085 - DNA, 22 bp, Homo sapiens
atgtgtgtgtatatacacacat

SEQ ID NO: 7968086 - DNA, 22 bp, Homo sapiens
atgtgtgtgtttaatcctcaaa

SEQ ID NO: 7968087 - DNA, 22 bp, Homo sapiens
atgtgtgtgtttaatcctcaaa

SEQ ID NO: 7968088 - DNA, 22 bp, Homo sapiens
atgtgtgtgtttaatcctcaaa

SEQ ID NO: 7968089 - DNA, 22 bp, Homo sapiens
atgtgtgtgtttaatcctcaaa

SEQ ID NO: 7968090 - DNA, 22 bp, Homo sapiens
atgtgttaatgtcaaccagaaa

SEQ ID NO: 7968091 - DNA, 22 bp, Homo sapiens
atgtgttaatgagcaatgacct

SEQ ID NO: 7968092 - DNA, 22 bp, Homo sapiens
atgtgttaattggagcagcagg

SEQ ID NO: 7968093 - DNA, 22 bp, Homo sapiens
atgtgttcgctagattgctgtt

SEQ ID NO: 7968094 - DNA, 22 bp, Homo sapiens
atgtgttctgaggcagatgact

SEQ ID NO: 7968095 - DNA, 22 bp, Homo sapiens
atgtgttgcagaagattaagct

SEQ ID NO: 7968096 - DNA, 22 bp, Homo sapiens
atgtgttcacgtgcacatgtgc

SEQ ID NO: 7968097 - DNA, 22 bp, Homo sapiens
atgtgttcgctagattgctgtt

SEQ ID NO: 7968098 - DNA, 22 bp, Homo sapiens
atgttttccccaaatgatcttc

SEQ ID NO: 7968099 - DNA, 22 bp, Homo sapiens
atgttttccccaaatgatcttc

SEQ ID NO: 7968100 - DNA, 22 bp, Homo sapiens
atgttttccccaaatgatcttc

SEQ ID NO: 7968101 - DNA, 22 bp, Homo sapiens
atgttttccccaaatgatcttc

SEQ ID NO: 7968102 - DNA, 22 bp, Homo sapiens
atgttttcctgggagagcactc

SEQ ID NO: 7968103 - DNA, 22 bp, Homo sapiens
atgttttcaaagtaaacttgta

SEQ ID NO: 7968104 - DNA, 22 bp, Homo sapiens
atgttttccattgccatggaaa

SEQ ID NO: 7968105 - DNA, 22 bp, Homo sapiens
atgttttattaccaacttgtac

SEQ ID NO: 7968106 - DNA, 22 bp, Homo sapiens
atgttttattaccaacttgtac

SEQ ID NO: 7968107 - DNA, 22 bp, Homo sapiens
atgttttattaccaacttgtac

SEQ ID NO: 7968108 - DNA, 22 bp, Homo sapiens
atgttttattaccaacttgtac

SEQ ID NO: 7968109 - DNA, 22 bp, Homo sapiens
atgttttattaccaacttgtac

SEQ ID NO: 7968110 - DNA, 22 bp, Homo sapiens
atgttttcaaagtaaacttgta

SEQ ID NO: 7968111 - DNA, 22 bp, Homo sapiens
atgttttcaaagtaaacttgta

SEQ ID NO: 7968112 - DNA, 22 bp, Homo sapiens
atgttttctagagtttaaaatc

SEQ ID NO: 7968113 - DNA, 22 bp, Homo sapiens
atgttttctagagtttaaaatc

SEQ ID NO: 7968114 - DNA, 22 bp, Homo sapiens
atgttttctagagtttaaaatc

SEQ ID NO: 7968115 - DNA, 22 bp, Homo sapiens
atgttttctagagtttaaaatc

SEQ ID NO: 7968116 - DNA, 22 bp, Homo sapiens
atgttttcctgggagagcactc

SEQ ID NO: 7968117 - DNA, 22 bp, Homo sapiens
atgttttctagagtttaaaatc

SEQ ID NO: 7968118 - DNA, 22 bp, Homo sapiens
atgttttctagagtttaaaatc

SEQ ID NO: 7968119 - DNA, 22 bp, Homo sapiens
atgttttgctggatgttggcta

SEQ ID NO: 7968120 - DNA, 22 bp, Homo sapiens
atgtttttaaatagacttacag

SEQ ID NO: 7968121 - DNA, 22 bp, Homo sapiens
atgttttgattggttaggtctg

SEQ ID NO: 7968122 - DNA, 22 bp, Homo sapiens
atgttttgattggttaggtctg

SEQ ID NO: 7968123 - DNA, 22 bp, Homo sapiens
atgttttctccatgttatgctt

SEQ ID NO: 7968124 - DNA, 22 bp, Homo sapiens
atgttttctttcagacttccct

SEQ ID NO: 7968125 - DNA, 22 bp, Homo sapiens
atgttttctccatgttatgctt

SEQ ID NO: 7968126 - DNA, 22 bp, Homo sapiens
atgttttatattttgcagcagt

SEQ ID NO: 7968127 - DNA, 22 bp, Homo sapiens
atgttttatattttgcagcagt

SEQ ID NO: 7968128 - DNA, 22 bp, Homo sapiens
atgttttatattttgcagcagt

SEQ ID NO: 7968129 - DNA, 22 bp, Homo sapiens
atgttttatattttgcagcagt

SEQ ID NO: 7968130 - DNA, 20 bp, Homo sapiens
atgttttataaaagaacggg

SEQ ID NO: 7968131 - DNA, 20 bp, Homo sapiens
atgttttataaaagaacggg

SEQ ID NO: 7968132 - DNA, 20 bp, Homo sapiens
atgttttataaaagaacggg

SEQ ID NO: 7968133 - DNA, 20 bp, Homo sapiens
atgttttataaaagaacggg

SEQ ID NO: 7968134 - DNA, 22 bp, Homo sapiens
atgttttaccctttgcacaaac

SEQ ID NO: 7968135 - DNA, 22 bp, Homo sapiens
atgtttctgaagtttacagata

SEQ ID NO: 7968136 - DNA, 22 bp, Homo sapiens
atgtttctgaagtttacagata

SEQ ID NO: 7968137 - DNA, 22 bp, Homo sapiens
atgtttctgaagtttacagata

SEQ ID NO: 7968138 - DNA, 22 bp, Homo sapiens
atgttttaccctttgcacaaac

SEQ ID NO: 7968139 - DNA, 22 bp, Homo sapiens
atgtttctgaagtttacagata

SEQ ID NO: 7968140 - DNA, 22 bp, Homo sapiens
atgttttatgcttcagatgagg

SEQ ID NO: 7968141 - DNA, 23 bp, Homo sapiens
atgttttatgtctctagctgcca

SEQ ID NO: 7968142 - DNA, 23 bp, Homo sapiens
atgttttatgtctctagctgcca

SEQ ID NO: 7968143 - DNA, 22 bp, Homo sapiens
atgttttatgttccactcaagg

SEQ ID NO: 7968144 - DNA, 22 bp, Homo sapiens
atgttttatgttccactcaagg

SEQ ID NO: 7968145 - DNA, 22 bp, Homo sapiens
atgttttatgttccactcaagg

SEQ ID NO: 7968146 - DNA, 19 bp, Homo sapiens
atgttttatgctgatggga

SEQ ID NO: 7968147 - DNA, 22 bp, Homo sapiens
atgttttatattttgcagcagt

SEQ ID NO: 7968148 - DNA, 22 bp, Homo sapiens
atgttttatgcttcagatgagg

SEQ ID NO: 7968149 - DNA, 22 bp, Homo sapiens
atgttttatgcttcagatgagg

SEQ ID NO: 7968150 - DNA, 22 bp, Homo sapiens
atgttttatgcttcagatgagg

SEQ ID NO: 7968151 - DNA, 22 bp, Homo sapiens
attaaatgttccttaaattata

SEQ ID NO: 7968152 - DNA, 22 bp, Homo sapiens
attaaatgttccttaaattata

SEQ ID NO: 7968153 - DNA, 22 bp, Homo sapiens
attaaatgttccttaaattata

SEQ ID NO: 7968154 - DNA, 22 bp, Homo sapiens
attaaatggtggtcattcattt

SEQ ID NO: 7968155 - DNA, 22 bp, Homo sapiens
attaaatggtggtcattcattt

SEQ ID NO: 7968156 - DNA, 22 bp, Homo sapiens
attaaatggtggtcattcattt

SEQ ID NO: 7968157 - DNA, 22 bp, Homo sapiens
attaaatgatggcatgtcttat

SEQ ID NO: 7968158 - DNA, 22 bp, Homo sapiens
attaaatgatggcatgtcttat

SEQ ID NO: 7968159 - DNA, 22 bp, Homo sapiens
attaaatgatggcatgtcttat

SEQ ID NO: 7968160 - DNA, 22 bp, Homo sapiens
attaaatggtggtcattcattt

SEQ ID NO: 7968161 - DNA, 22 bp, Homo sapiens
attaaatgatggcatgtcttat

SEQ ID NO: 7968162 - DNA, 22 bp, Homo sapiens
attaaatactgcaggctaagca

SEQ ID NO: 7968163 - DNA, 22 bp, Homo sapiens
attaaatactgcaggctaagca

SEQ ID NO: 7968164 - DNA, 22 bp, Homo sapiens
attaaaattccaaggtatgcca

SEQ ID NO: 7968165 - DNA, 22 bp, Homo sapiens
attaaaattccaaggtatgcca

SEQ ID NO: 7968166 - DNA, 22 bp, Homo sapiens
attaaaattccaaggtatgcca

SEQ ID NO: 7968167 - DNA, 22 bp, Homo sapiens
attaaaattccaaggtatgcca

SEQ ID NO: 7968168 - DNA, 22 bp, Homo sapiens
attaaaagcttcccaagagtta

SEQ ID NO: 7968169 - DNA, 22 bp, Homo sapiens
attaaaagcttcccaagagtta

SEQ ID NO: 7968170 - DNA, 22 bp, Homo sapiens
attaaaagcttcccaagagtta

SEQ ID NO: 7968171 - DNA, 22 bp, Homo sapiens
attaaaagcttcccaagagtta

SEQ ID NO: 7968172 - DNA, 22 bp, Homo sapiens
attaaaattccaaggtatgcca

SEQ ID NO: 7968173 - DNA, 22 bp, Homo sapiens
attaaaattccaaggtatgcca

SEQ ID NO: 7968174 - DNA, 22 bp, Homo sapiens
attaaaattccaaggtatgcca

SEQ ID NO: 7968175 - DNA, 22 bp, Homo sapiens
attaaatactgcaggctaagca

SEQ ID NO: 7968176 - DNA, 22 bp, Homo sapiens
atgtttttaaatagacttacag

SEQ ID NO: 7968177 - DNA, 22 bp, Homo sapiens
atgtttttaaatagacttacag

SEQ ID NO: 7968178 - DNA, 22 bp, Homo sapiens
atgtttttcataccagtgttgg

SEQ ID NO: 7968179 - DNA, 22 bp, Homo sapiens
atgtttttaaatagacttacag

SEQ ID NO: 7968180 - DNA, 22 bp, Homo sapiens
atgtttttaaatagacttacag

SEQ ID NO: 7968181 - DNA, 22 bp, Homo sapiens
atgtttttcataccagtgttgg

SEQ ID NO: 7968182 - DNA, 22 bp, Homo sapiens
atgtttttcataccagtgttgg

SEQ ID NO: 7968183 - DNA, 22 bp, Homo sapiens
atgtttttgagatacaaacaga

SEQ ID NO: 7968184 - DNA, 22 bp, Homo sapiens
atgtttttgagatacaaacaga

SEQ ID NO: 7968185 - DNA, 22 bp, Homo sapiens
atgtttttgagatacaaacaga

SEQ ID NO: 7968186 - DNA, 22 bp, Homo sapiens
atgtttttcataccagtgttgg

SEQ ID NO: 7968187 - DNA, 22 bp, Homo sapiens
atgtttttgagatacaaacaga

SEQ ID NO: 7968188 - DNA, 22 bp, Homo sapiens
atgtttttgagatacaaacaga

SEQ ID NO: 7968189 - DNA, 22 bp, Homo sapiens
atgtttttgagatacaaacaga

SEQ ID NO: 7968190 - DNA, 22 bp, Homo sapiens
attaaaagagataatgtgtgtt

SEQ ID NO: 7968191 - DNA, 22 bp, Homo sapiens
attaaaagcttcccaagagtta

SEQ ID NO: 7968192 - DNA, 22 bp, Homo sapiens
atgtttttggcttcaagtttct

SEQ ID NO: 7968193 - DNA, 22 bp, Homo sapiens
atgtttttggcttcaagtttct

SEQ ID NO: 7968194 - DNA, 22 bp, Homo sapiens
attaaaactaaaatgcctgatt

SEQ ID NO: 7968195 - DNA, 22 bp, Homo sapiens
atgtttttggcttcaagtttct

SEQ ID NO: 7968196 - DNA, 22 bp, Homo sapiens
atgtttttggaaatgggaacat

SEQ ID NO: 7968197 - DNA, 22 bp, Homo sapiens
atgtttttggaaatgggaacat

SEQ ID NO: 7968198 - DNA, 22 bp, Homo sapiens
atgtttttggcttcaagtttct

SEQ ID NO: 7968199 - DNA, 22 bp, Homo sapiens
atgtttttggaaatgggaacat

SEQ ID NO: 7968200 - DNA, 22 bp, Homo sapiens
atgtttttggaaatgggaacat

SEQ ID NO: 7968201 - DNA, 22 bp, Homo sapiens
atgtttttgagatacaaacaga

SEQ ID NO: 7968202 - DNA, 22 bp, Homo sapiens
atgtttttgagatacaaacaga

SEQ ID NO: 7968203 - DNA, 22 bp, Homo sapiens
atgtttttgagatacaaacaga

SEQ ID NO: 7968204 - DNA, 22 bp, Homo sapiens
atgtttttgagatacaaacaga

SEQ ID NO: 7968205 - DNA, 22 bp, Homo sapiens
attaaatgttggcatattttgt

SEQ ID NO: 7968206 - DNA, 22 bp, Homo sapiens
attaaatgttggcatattttgt

SEQ ID NO: 7968207 - DNA, 22 bp, Homo sapiens
attaaatgttggcatattttgt

SEQ ID NO: 7968208 - DNA, 22 bp, Homo sapiens
attaaatgttggcatattttgt

SEQ ID NO: 7968209 - DNA, 22 bp, Homo sapiens
attaaatgttggcatattttgt

SEQ ID NO: 7968210 - DNA, 22 bp, Homo sapiens
attaaatgttggacgtatacat

SEQ ID NO: 7968211 - DNA, 22 bp, Homo sapiens
attaaatgttggacgtatacat

SEQ ID NO: 7968212 - DNA, 22 bp, Homo sapiens
attaaatgttggacgtatacat

SEQ ID NO: 7968213 - DNA, 22 bp, Homo sapiens
attaaatgttccttaaattata

SEQ ID NO: 7968214 - DNA, 22 bp, Homo sapiens
attaaatgttccttaaattata

SEQ ID NO: 7968215 - DNA, 22 bp, Homo sapiens
attaaatgttccttaaattata

SEQ ID NO: 7968216 - DNA, 22 bp, Homo sapiens
attaaatgttccttaaattata

SEQ ID NO: 7968217 - DNA, 22 bp, Homo sapiens
attaaattaagtggctaattta

SEQ ID NO: 7968218 - DNA, 22 bp, Homo sapiens
attaaattaagtggctaattta

SEQ ID NO: 7968219 - DNA, 22 bp, Homo sapiens
attaaattaagtggctaattta

SEQ ID NO: 7968220 - DNA, 22 bp, Homo sapiens
attaaattagcaaactgtgaaa

SEQ ID NO: 7968221 - DNA, 22 bp, Homo sapiens
attaaattagcaaactgtgaaa

SEQ ID NO: 7968222 - DNA, 22 bp, Homo sapiens
attaaattagcaaactgtgaaa

SEQ ID NO: 7968223 - DNA, 22 bp, Homo sapiens
attaaattagcaaactgtgaaa

SEQ ID NO: 7968224 - DNA, 22 bp, Homo sapiens
gatgaggcaagccagaggactg

SEQ ID NO: 7968225 - DNA, 22 bp, Homo sapiens
attaaattagcaaactgtgaaa

SEQ ID NO: 7968226 - DNA, 18 bp, Homo sapiens
gatgaggctgtctgagaa

SEQ ID NO: 7968227 - DNA, 18 bp, Homo sapiens
gatgaggctgtctgagaa

SEQ ID NO: 7968228 - DNA, 22 bp, Homo sapiens
gatgagggcctggtggctgtgc

SEQ ID NO: 7968229 - DNA, 22 bp, Homo sapiens
gatgaggctgtgtctgcacaag

SEQ ID NO: 7968230 - DNA, 21 bp, Homo sapiens
gatgagttttctgtgatgttc

SEQ ID NO: 7968231 - DNA, 22 bp, Homo sapiens
gatgagtcactgcaggtgctgg

SEQ ID NO: 7968232 - DNA, 22 bp, Homo sapiens
gatgagttctttctattctatt

SEQ ID NO: 7968233 - DNA, 22 bp, Homo sapiens
attaatatgagaaagtggcaga

SEQ ID NO: 7968234 - DNA, 22 bp, Homo sapiens
attaatattggttcattagctg

SEQ ID NO: 7968235 - DNA, 22 bp, Homo sapiens
attaatattggttcattagctg

SEQ ID NO: 7968236 - DNA, 22 bp, Homo sapiens
attaatattggttcattagctg

SEQ ID NO: 7968237 - DNA, 22 bp, Homo sapiens
attaatatcctgctggctaaat

SEQ ID NO: 7968238 - DNA, 22 bp, Homo sapiens
attaatatacactgttagcatg

SEQ ID NO: 7968239 - DNA, 22 bp, Homo sapiens
attaatatacactgttagcatg

SEQ ID NO: 7968240 - DNA, 22 bp, Homo sapiens
attaagctccaagttgctctga

SEQ ID NO: 7968241 - DNA, 22 bp, Homo sapiens
attaagatgtgggaaaatttaa

SEQ ID NO: 7968242 - DNA, 22 bp, Homo sapiens
attaatatacactgttagcatg

SEQ ID NO: 7968243 - DNA, 22 bp, Homo sapiens
gatgatctgcaagaactacatg

SEQ ID NO: 7968244 - DNA, 22 bp, Homo sapiens
gatgatcatctgtaaagttaga

SEQ ID NO: 7968245 - DNA, 22 bp, Homo sapiens
attaagatgtgggaaaatttaa

SEQ ID NO: 7968246 - DNA, 22 bp, Homo sapiens
attaagatcattgtagaagatt

SEQ ID NO: 7968247 - DNA, 22 bp, Homo sapiens
attaagatcattgtagaagatt

SEQ ID NO: 7968248 - DNA, 22 bp, Homo sapiens
gatgatggacaaagcattggtg

SEQ ID NO: 7968249 - DNA, 22 bp, Homo sapiens
attaatattggttcattagctg

SEQ ID NO: 7968250 - DNA, 22 bp, Homo sapiens
attaatatttgcaccttctgtc

SEQ ID NO: 7968251 - DNA, 22 bp, Homo sapiens
attaatcatttctgcattatct

SEQ ID NO: 7968252 - DNA, 22 bp, Homo sapiens
attaatcatttctgcattatct

SEQ ID NO: 7968253 - DNA, 20 bp, Homo sapiens
attaatgaatacattttgat

SEQ ID NO: 7968254 - DNA, 20 bp, Homo sapiens
attaatgaatacattttgat

SEQ ID NO: 7968255 - DNA, 22 bp, Homo sapiens
attaatgacgcagataataatt

SEQ ID NO: 7968256 - DNA, 22 bp, Homo sapiens
attaatgacgcagataataatt

SEQ ID NO: 7968257 - DNA, 22 bp, Homo sapiens
attaatgacgcagataataatt

SEQ ID NO: 7968258 - DNA, 22 bp, Homo sapiens
attaattttacctttgtaaaca

SEQ ID NO: 7968259 - DNA, 22 bp, Homo sapiens
attaatttccaggcactgtgct

SEQ ID NO: 7968260 - DNA, 22 bp, Homo sapiens
attaattttacctttgtaaaca

SEQ ID NO: 7968261 - DNA, 22 bp, Homo sapiens
attaattttacctttgtaaaca

SEQ ID NO: 7968262 - DNA, 22 bp, Homo sapiens
attaatttccaggcactgtgct

SEQ ID NO: 7968263 - DNA, 22 bp, Homo sapiens
attaatttccaggcactgtgct

SEQ ID NO: 7968264 - DNA, 22 bp, Homo sapiens
attaattgggaacttgttgaaa

SEQ ID NO: 7968265 - DNA, 22 bp, Homo sapiens
attaatgtgtagccaacttaat

SEQ ID NO: 7968266 - DNA, 22 bp, Homo sapiens
attaatgtctaccagttgtgtg

SEQ ID NO: 7968267 - DNA, 22 bp, Homo sapiens
attaatgtctgaggagtggggc

SEQ ID NO: 7968268 - DNA, 22 bp, Homo sapiens
attaatgtgtagccaacttaat

SEQ ID NO: 7968269 - DNA, 22 bp, Homo sapiens
attacaaaagaagggagaaggt

SEQ ID NO: 7968270 - DNA, 22 bp, Homo sapiens
attacaaaagaagggagaaggt

SEQ ID NO: 7968271 - DNA, 22 bp, Homo sapiens
attacaaaagaagggagaaggt

SEQ ID NO: 7968272 - DNA, 22 bp, Homo sapiens
attaatttttctgacagccaca

SEQ ID NO: 7968273 - DNA, 22 bp, Homo sapiens
attacaaaagaagggagaaggt

SEQ ID NO: 7968274 - DNA, 22 bp, Homo sapiens
attacaaaagaagggagaaggt

SEQ ID NO: 7968275 - DNA, 22 bp, Homo sapiens
attacaaaagaagggagaaggt

SEQ ID NO: 7968276 - DNA, 22 bp, Homo sapiens
attacaaaagaagggagaaggt

SEQ ID NO: 7968277 - DNA, 22 bp, Homo sapiens
attacaagatgcatccatattt

SEQ ID NO: 7968278 - DNA, 22 bp, Homo sapiens
attacaactacataatctcaga

SEQ ID NO: 7968279 - DNA, 22 bp, Homo sapiens
attacaagtttcagtgttttgc

SEQ ID NO: 7968280 - DNA, 22 bp, Homo sapiens
attacaagtagactaactttca

SEQ ID NO: 7968281 - DNA, 22 bp, Homo sapiens
attacaagggtctgactggagg

SEQ ID NO: 7968282 - DNA, 22 bp, Homo sapiens
attacaagtagactaactttca

SEQ ID NO: 7968283 - DNA, 22 bp, Homo sapiens
attacaataatacatgctcatt

SEQ ID NO: 7968284 - DNA, 22 bp, Homo sapiens
attacaataaggtttatttgta

SEQ ID NO: 7968285 - DNA, 22 bp, Homo sapiens
attacaataaggtttatttgta

SEQ ID NO: 7968286 - DNA, 22 bp, Homo sapiens
attacaataaggtttatttgta

SEQ ID NO: 7968287 - DNA, 22 bp, Homo sapiens
attacaataatacatgctcatt

SEQ ID NO: 7968288 - DNA, 22 bp, Homo sapiens
gcaactttcaagcaccatgggg

SEQ ID NO: 7968289 - DNA, 22 bp, Homo sapiens
gcaactttcaagcaccatgggg

SEQ ID NO: 7968290 - DNA, 22 bp, Homo sapiens
gcaactttagggccagcaagta

SEQ ID NO: 7968291 - DNA, 21 bp, Homo sapiens
gcaacttatcgcattctgcag

SEQ ID NO: 7968292 - DNA, 22 bp, Homo sapiens
gcaaggctgtgcactttgcatt

SEQ ID NO: 7968293 - DNA, 22 bp, Homo sapiens
gcaaggctgggagatgaggcct

SEQ ID NO: 7968294 - DNA, 22 bp, Homo sapiens
gcaaggctggtggtggtgaagt

SEQ ID NO: 7968295 - DNA, 22 bp, Homo sapiens
gcaaggctgcccacttcaaaag

SEQ ID NO: 7968296 - DNA, 22 bp, Homo sapiens
gcaaggctgggagatgaggcct

SEQ ID NO: 7968297 - DNA, 22 bp, Homo sapiens
gcaaggctgctgccacccatct

SEQ ID NO: 7968298 - DNA, 22 bp, Homo sapiens
gcaaggctgctgccacccatct

SEQ ID NO: 7968299 - DNA, 22 bp, Homo sapiens
gcaaggctgacctctctagact

SEQ ID NO: 7968300 - DNA, 22 bp, Homo sapiens
gcaaggctgacctctctagact

SEQ ID NO: 7968301 - DNA, 22 bp, Homo sapiens
gcaaggctgagcacatttgcat

SEQ ID NO: 7968302 - DNA, 22 bp, Homo sapiens
gcaaggctgacctctctagact

SEQ ID NO: 7968303 - DNA, 22 bp, Homo sapiens
gcaagaaaaaggcttcatgaac

SEQ ID NO: 7968304 - DNA, 22 bp, Homo sapiens
attagagctgttagtgaagtgc

SEQ ID NO: 7968305 - DNA, 22 bp, Homo sapiens
attattaaaatgtgtttctctt

SEQ ID NO: 7968306 - DNA, 22 bp, Homo sapiens
attattaaagctacatcaagga

SEQ ID NO: 7968307 - DNA, 22 bp, Homo sapiens
attattaaagctacatcaagga

SEQ ID NO: 7968308 - DNA, 22 bp, Homo sapiens
attattaaagctacatcaagga

SEQ ID NO: 7968309 - DNA, 20 bp, Homo sapiens
attagagctacatggctaca

SEQ ID NO: 7968310 - DNA, 22 bp, Homo sapiens
attagagcagtgtattatgata

SEQ ID NO: 7968311 - DNA, 22 bp, Homo sapiens
attagagcagtaattgtggcag

SEQ ID NO: 7968312 - DNA, 22 bp, Homo sapiens
attagagaaatgttgccaagat

SEQ ID NO: 7968313 - DNA, 22 bp, Homo sapiens
attagagagagcatattactgg

SEQ ID NO: 7968314 - DNA, 22 bp, Homo sapiens
attattcaatcatattaaaagt

SEQ ID NO: 7968315 - DNA, 22 bp, Homo sapiens
attattcaatcatattaaaagt

SEQ ID NO: 7968316 - DNA, 22 bp, Homo sapiens
attattcaatcatattaaaagt

SEQ ID NO: 7968317 - DNA, 22 bp, Homo sapiens
attattcaacacttgagaaatt

SEQ ID NO: 7968318 - DNA, 22 bp, Homo sapiens
attattcaatgttatttcagtg

SEQ ID NO: 7968319 - DNA, 22 bp, Homo sapiens
attattcaatcatattaaaagt

SEQ ID NO: 7968320 - DNA, 22 bp, Homo sapiens
attattcagtcttgtaaggagt

SEQ ID NO: 7968321 - DNA, 22 bp, Homo sapiens
attattcaatgttatttcagtg

SEQ ID NO: 7968322 - DNA, 22 bp, Homo sapiens
attattctctggaggaaagatt

SEQ ID NO: 7968323 - DNA, 22 bp, Homo sapiens
attattctctggaggaaagatt

SEQ ID NO: 7968324 - DNA, 22 bp, Homo sapiens
attattctctggaggaaagatt

SEQ ID NO: 7968325 - DNA, 20 bp, Homo sapiens
attattcatacatgtgtgac

SEQ ID NO: 7968326 - DNA, 20 bp, Homo sapiens
attattcatacatgtgtgac

SEQ ID NO: 7968327 - DNA, 22 bp, Homo sapiens
attattcagtcttgtaaggagt

SEQ ID NO: 7968328 - DNA, 22 bp, Homo sapiens
attattcttatgtcatcatggc

SEQ ID NO: 7968329 - DNA, 22 bp, Homo sapiens
attattcttaatgcagggatta

SEQ ID NO: 7968330 - DNA, 22 bp, Homo sapiens
attattcttgaggtgtttattg

SEQ ID NO: 7968331 - DNA, 22 bp, Homo sapiens
attattctttgataaatggcag

SEQ ID NO: 7968332 - DNA, 22 bp, Homo sapiens
attattctttgataaatggcag

SEQ ID NO: 7968333 - DNA, 22 bp, Homo sapiens
attattcttgaggtgtttattg

SEQ ID NO: 7968334 - DNA, 22 bp, Homo sapiens
attattgcaatttgacattcag

SEQ ID NO: 7968335 - DNA, 22 bp, Homo sapiens
attagaattatgcttgctaatg

SEQ ID NO: 7968336 - DNA, 22 bp, Homo sapiens
attagaatgcagggttcattgt

SEQ ID NO: 7968337 - DNA, 22 bp, Homo sapiens
attagaatgcagggttcattgt

SEQ ID NO: 7968338 - DNA, 22 bp, Homo sapiens
attagacatcatatgattcagc

SEQ ID NO: 7968339 - DNA, 23 bp, Homo sapiens
attagacactttgggttgtcttc

SEQ ID NO: 7968340 - DNA, 22 bp, Homo sapiens
attagacatcatatgattcagc

SEQ ID NO: 7968341 - DNA, 22 bp, Homo sapiens
attagaattatgcttgctaatg

SEQ ID NO: 7968342 - DNA, 23 bp, Homo sapiens
attagacactttgggttgtcttc

SEQ ID NO: 7968343 - DNA, 22 bp, Homo sapiens
attagaattatgcttgctaatg

SEQ ID NO: 7968344 - DNA, 22 bp, Homo sapiens
attagaattatgcttgctaatg

SEQ ID NO: 7968345 - DNA, 22 bp, Homo sapiens
attagaagatagtgatttctgc

SEQ ID NO: 7968346 - DNA, 22 bp, Homo sapiens
attagaagaggctgacgaatgt

SEQ ID NO: 7968347 - DNA, 21 bp, Homo sapiens
attagaaggtatttagggcct

SEQ ID NO: 7968348 - DNA, 22 bp, Homo sapiens
attagaagcgtgaatcctttca

SEQ ID NO: 7968349 - DNA, 22 bp, Homo sapiens
attagaatgaagtataggattt

SEQ ID NO: 7968350 - DNA, 22 bp, Homo sapiens
attagaatgaagtataggattt

SEQ ID NO: 7968351 - DNA, 22 bp, Homo sapiens
gcaataaaatgtaatgattggg

SEQ ID NO: 7968352 - DNA, 22 bp, Homo sapiens
gcaagtttagctaactggccca

SEQ ID NO: 7968353 - DNA, 21 bp, Homo sapiens
gcaagtgtttctgacagtggc

SEQ ID NO: 7968354 - DNA, 22 bp, Homo sapiens
gcaagttatttccatttaaagc

SEQ ID NO: 7968355 - DNA, 22 bp, Homo sapiens
gcaagttggagactcatgagaa

SEQ ID NO: 7968356 - DNA, 22 bp, Homo sapiens
gcaagttggagactcatgagaa

SEQ ID NO: 7968357 - DNA, 17 bp, Homo sapiens
gcaagggatgggagatt

SEQ ID NO: 7968358 - DNA, 21 bp, Homo sapiens
gcaaggcttttgtgtttccca

SEQ ID NO: 7968359 - DNA, 22 bp, Homo sapiens
gcaagggtgtgaaccaatgaga

SEQ ID NO: 7968360 - DNA, 17 bp, Homo sapiens
gcaagggatgggagatt

SEQ ID NO: 7968361 - DNA, 22 bp, Homo sapiens
gcaaggctgttgctgctgcaag

SEQ ID NO: 7968362 - DNA, 22 bp, Homo sapiens
gcaaggctttgtgaattttaaa

SEQ ID NO: 7968363 - DNA, 22 bp, Homo sapiens
gcaaggctgtgcactttgcatt

SEQ ID NO: 7968364 - DNA, 22 bp, Homo sapiens
gcaaggctgttgctgctgcaag

SEQ ID NO: 7968365 - DNA, 22 bp, Homo sapiens
gcaagtagtgggaaagaagatg

SEQ ID NO: 7968366 - DNA, 22 bp, Homo sapiens
gcaagtcctttgcatgcaggga

SEQ ID NO: 7968367 - DNA, 19 bp, Homo sapiens
gcaaggttcactcccagag

SEQ ID NO: 7968368 - DNA, 22 bp, Homo sapiens
gcaaggtgttttaacaggaaaa

SEQ ID NO: 7968369 - DNA, 22 bp, Homo sapiens
gcaaggtgttttataggcagga

SEQ ID NO: 7968370 - DNA, 20 bp, Homo sapiens
gcaagtgaaaactatgggtg

SEQ ID NO: 7968371 - DNA, 22 bp, Homo sapiens
gcaagtgtctgaggttttgtat

SEQ ID NO: 7968372 - DNA, 21 bp, Homo sapiens
gcaagtgtttctgacagtggc

SEQ ID NO: 7968373 - DNA, 22 bp, Homo sapiens
atgagttaggggcctgagtgga

SEQ ID NO: 7968374 - DNA, 22 bp, Homo sapiens
atgagttgaagctacaagaggc

SEQ ID NO: 7968375 - DNA, 22 bp, Homo sapiens
atgagttcccaggtgatttgtg

SEQ ID NO: 7968376 - DNA, 22 bp, Homo sapiens
atgagttcattgcatttgacag

SEQ ID NO: 7968377 - DNA, 22 bp, Homo sapiens
atgagtgtttagaaaacactgg

SEQ ID NO: 7968378 - DNA, 22 bp, Homo sapiens
atgagtgatacagcaagctctc

SEQ ID NO: 7968379 - DNA, 22 bp, Homo sapiens
atgagtgatacagcaagctctc

SEQ ID NO: 7968380 - DNA, 22 bp, Homo sapiens
atgagtgatgggtacattggct

SEQ ID NO: 7968381 - DNA, 22 bp, Homo sapiens
atgagtgcaacagatcagcatg

SEQ ID NO: 7968382 - DNA, 22 bp, Homo sapiens
atgatacaagcaaaactaatca

SEQ ID NO: 7968383 - DNA, 23 bp, Homo sapiens
atgataatgccattaactttgat

SEQ ID NO: 7968384 - DNA, 22 bp, Homo sapiens
atgatacaagcaaaactaatca

SEQ ID NO: 7968385 - DNA, 22 bp, Homo sapiens
atgatacaagcaaaactaatca

SEQ ID NO: 7968386 - DNA, 22 bp, Homo sapiens
atgataagaacacagtatgggg

SEQ ID NO: 7968387 - DNA, 23 bp, Homo sapiens
atgataatgccattaactttgat

SEQ ID NO: 7968388 - DNA, 22 bp, Homo sapiens
atgataagccatgtcgtggtca

SEQ ID NO: 7968389 - DNA, 20 bp, Homo sapiens
atgagtttaaacattcagag

SEQ ID NO: 7968390 - DNA, 22 bp, Homo sapiens
atgcaaaagtaactgtgatttt

SEQ ID NO: 7968391 - DNA, 22 bp, Homo sapiens
atgcaaaagactatttgttgct

SEQ ID NO: 7968392 - DNA, 22 bp, Homo sapiens
atgcaaaagtaactgtgatttt

SEQ ID NO: 7968393 - DNA, 22 bp, Homo sapiens
atgcaaaagtaactgtgatttt

SEQ ID NO: 7968394 - DNA, 22 bp, Homo sapiens
atgcaaaagtaactgtgatttt

SEQ ID NO: 7968395 - DNA, 22 bp, Homo sapiens
atgcaaaagtaattgcaatttt

SEQ ID NO: 7968396 - DNA, 22 bp, Homo sapiens
atgcaaaagtaattgcaatttt

SEQ ID NO: 7968397 - DNA, 22 bp, Homo sapiens
atgcaaaagtaattgcaatttt

SEQ ID NO: 7968398 - DNA, 22 bp, Homo sapiens
atgcaaaagtaattgcaatttt

SEQ ID NO: 7968399 - DNA, 22 bp, Homo sapiens
atgcaaaagtaactgtgatttt

SEQ ID NO: 7968400 - DNA, 22 bp, Homo sapiens
atgcaaaagtaactgtgatttt

SEQ ID NO: 7968401 - DNA, 22 bp, Homo sapiens
atgcaaaaactgcacttacgct

SEQ ID NO: 7968402 - DNA, 22 bp, Homo sapiens
atgcaaaaactgcacttacgct

SEQ ID NO: 7968403 - DNA, 22 bp, Homo sapiens
atgcaaaagactatttgttgct

SEQ ID NO: 7968404 - DNA, 22 bp, Homo sapiens
atgcaaaagactatttgttgct

SEQ ID NO: 7968405 - DNA, 22 bp, Homo sapiens
atgcaaaagactatttgttgct

SEQ ID NO: 7968406 - DNA, 22 bp, Homo sapiens
atgattttttctaacacagtcg

SEQ ID NO: 7968407 - DNA, 22 bp, Homo sapiens
atgcaaaaactgcacttacgct

SEQ ID NO: 7968408 - DNA, 20 bp, Homo sapiens
atgattttgcactaacttca

SEQ ID NO: 7968409 - DNA, 20 bp, Homo sapiens
atgattttgcactaacttca

SEQ ID NO: 7968410 - DNA, 22 bp, Homo sapiens
atgattcagcaattttatatct

SEQ ID NO: 7968411 - DNA, 22 bp, Homo sapiens
atgattttttctaacacagtcg

SEQ ID NO: 7968412 - DNA, 22 bp, Homo sapiens
atgattttttctaacacagtcg

SEQ ID NO: 7968413 - DNA, 22 bp, Homo sapiens
atgatttttcagcagaggatct

SEQ ID NO: 7968414 - DNA, 22 bp, Homo sapiens
atgatttttcagcagaggatct

SEQ ID NO: 7968415 - DNA, 22 bp, Homo sapiens
atgatttttcagcagaggatct

SEQ ID NO: 7968416 - DNA, 20 bp, Homo sapiens
atgattttgcactaacttca

SEQ ID NO: 7968417 - DNA, 22 bp, Homo sapiens
atgaggttcagtgtttatttcc

SEQ ID NO: 7968418 - DNA, 22 bp, Homo sapiens
atgaggtggtcttcagtaggtc

SEQ ID NO: 7968419 - DNA, 22 bp, Homo sapiens
atgaggtgttcgctggcctttt

SEQ ID NO: 7968420 - DNA, 22 bp, Homo sapiens
atgagtacattgggatcaaaga

SEQ ID NO: 7968421 - DNA, 19 bp, Homo sapiens
atgagtacacttgtacatt

SEQ ID NO: 7968422 - DNA, 20 bp, Homo sapiens
atgagtctacacactggctt

SEQ ID NO: 7968423 - DNA, 22 bp, Homo sapiens
atgaggtattcgtaatatttcc

SEQ ID NO: 7968424 - DNA, 22 bp, Homo sapiens
atgaggtcacagtgtttggcat

SEQ ID NO: 7968425 - DNA, 22 bp, Homo sapiens
atgaggtattcgtaatatttcc

SEQ ID NO: 7968426 - DNA, 22 bp, Homo sapiens
atgaggtcatcttgaagtaggg

SEQ ID NO: 7968427 - DNA, 22 bp, Homo sapiens
atgaggtcatcctggagtaagg

SEQ ID NO: 7968428 - DNA, 23 bp, Homo sapiens
atgaggtcagccataagacggaa

SEQ ID NO: 7968429 - DNA, 22 bp, Homo sapiens
atgaggtgggagaatcacttga

SEQ ID NO: 7968430 - DNA, 22 bp, Homo sapiens
atgaggtgatggacatattaac

SEQ ID NO: 7968431 - DNA, 22 bp, Homo sapiens
atgaggtgatggacatattaac

SEQ ID NO: 7968432 - DNA, 22 bp, Homo sapiens
atgaggtgatggacatattaac

SEQ ID NO: 7968433 - DNA, 22 bp, Homo sapiens
atgaggtcttattgcagtagtt

SEQ ID NO: 7968434 - DNA, 22 bp, Homo sapiens
atgaggtctggcaatcagaaac

SEQ ID NO: 7968435 - DNA, 22 bp, Homo sapiens
atgaggtccagggaagttaaat

SEQ ID NO: 7968436 - DNA, 22 bp, Homo sapiens
atgaggtcattcttggattaca

SEQ ID NO: 7968437 - DNA, 17 bp, Homo sapiens
atgaggtcattaagata

SEQ ID NO: 7968438 - DNA, 22 bp, Homo sapiens
gaaagcagtaaatgggtcccat

SEQ ID NO: 7968439 - DNA, 22 bp, Homo sapiens
gaaagcagtaaatgggtcccat

SEQ ID NO: 7968440 - DNA, 22 bp, Homo sapiens
atgaggccacagttatagattt

SEQ ID NO: 7968441 - DNA, 23 bp, Homo sapiens
atgaggtaaagatcagctttaaa

SEQ ID NO: 7968442 - DNA, 22 bp, Homo sapiens
atgaggccaccttctacatttc

SEQ ID NO: 7968443 - DNA, 22 bp, Homo sapiens
gaaagcactgtgagatcttgtt

SEQ ID NO: 7968444 - DNA, 22 bp, Homo sapiens
gaaagcactgtgagatcttgtt

SEQ ID NO: 7968445 - DNA, 22 bp, Homo sapiens
gaaagcagatgaaattgcaaca

SEQ ID NO: 7968446 - DNA, 22 bp, Homo sapiens
gaaagcagatgaaattgcaaca

SEQ ID NO: 7968447 - DNA, 22 bp, Homo sapiens
gaaagcagatgaaattgcaaca

SEQ ID NO: 7968448 - DNA, 22 bp, Homo sapiens
gaaagcagctaagtcttatgat

SEQ ID NO: 7968449 - DNA, 22 bp, Homo sapiens
gaaagcagctaagtcttatgat

SEQ ID NO: 7968450 - DNA, 22 bp, Homo sapiens
gaaagcagctaagtcttatgat

SEQ ID NO: 7968451 - DNA, 22 bp, Homo sapiens
gaaagcagtaaatgggtcccat

SEQ ID NO: 7968452 - DNA, 22 bp, Homo sapiens
atgaggtactagtatatacgta

SEQ ID NO: 7968453 - DNA, 22 bp, Homo sapiens
atgaggtactagtatatacgta

SEQ ID NO: 7968454 - DNA, 22 bp, Homo sapiens
atgaggtaacagcttatcaaca

SEQ ID NO: 7968455 - DNA, 22 bp, Homo sapiens
atgaggtagtattagaaggaga

SEQ ID NO: 7968456 - DNA, 22 bp, Homo sapiens
atgaggtatctcatttcctgaa

SEQ ID NO: 7968457 - DNA, 19 bp, Homo sapiens
atgaggtagcagctggtgc

SEQ ID NO: 7968458 - DNA, 21 bp, Homo sapiens
atgaagcaagggtcacacgtg

SEQ ID NO: 7968459 - DNA, 22 bp, Homo sapiens
atgaagcagactcaggtggtgc

SEQ ID NO: 7968460 - DNA, 22 bp, Homo sapiens
atgaagcagaatttcccactct

SEQ ID NO: 7968461 - DNA, 19 bp, Homo sapiens
atgaagattggtaaattca

SEQ ID NO: 7968462 - DNA, 22 bp, Homo sapiens
atgaagatttcccagagacatg

SEQ ID NO: 7968463 - DNA, 22 bp, Homo sapiens
atgaagatttcccagagacatg

SEQ ID NO: 7968464 - DNA, 22 bp, Homo sapiens
atgaagatttcccagagacatg

SEQ ID NO: 7968465 - DNA, 22 bp, Homo sapiens
atgaagcaacagccctcctatt

SEQ ID NO: 7968466 - DNA, 22 bp, Homo sapiens
atgaagagttctgttttggaca

SEQ ID NO: 7968467 - DNA, 22 bp, Homo sapiens
atgaagagtaagaggacctttt

SEQ ID NO: 7968468 - DNA, 22 bp, Homo sapiens
atgaagagttctgttttggaca

SEQ ID NO: 7968469 - DNA, 22 bp, Homo sapiens
atgaagataagaccaggctgga

SEQ ID NO: 7968470 - DNA, 22 bp, Homo sapiens
atgaagagttctgttttggaca

SEQ ID NO: 7968471 - DNA, 22 bp, Homo sapiens
atgaagagtaagaggacctttt

SEQ ID NO: 7968472 - DNA, 22 bp, Homo sapiens
atgaagataatagcattggttg

SEQ ID NO: 7968473 - DNA, 22 bp, Homo sapiens
atgaagatggttcaactggcct

SEQ ID NO: 7968474 - DNA, 22 bp, Homo sapiens
atgaagatacaggcagggccat

SEQ ID NO: 7968475 - DNA, 22 bp, Homo sapiens
atgaagatattcttgttttctg

SEQ ID NO: 7968476 - DNA, 22 bp, Homo sapiens
atgaagatattcttgttttctg

SEQ ID NO: 7968477 - DNA, 22 bp, Homo sapiens
atgaggcagcccttcccttctc

SEQ ID NO: 7968478 - DNA, 22 bp, Homo sapiens
atgaggcagctgacagctgttc

SEQ ID NO: 7968479 - DNA, 22 bp, Homo sapiens
atgaggcagctgacagctgttc

SEQ ID NO: 7968480 - DNA, 22 bp, Homo sapiens
atgaggcagcccttcccttctc

SEQ ID NO: 7968481 - DNA, 22 bp, Homo sapiens
atgaggcagcacatgggattgt

SEQ ID NO: 7968482 - DNA, 22 bp, Homo sapiens
atgaggcagcacatgggattgt

SEQ ID NO: 7968483 - DNA, 22 bp, Homo sapiens
atgaggcagatgttgcatgagg

SEQ ID NO: 7968484 - DNA, 22 bp, Homo sapiens
atgaggcagatgttgcatgagg

SEQ ID NO: 7968485 - DNA, 22 bp, Homo sapiens
atgaggcagatgttgcatgagg

SEQ ID NO: 7968486 - DNA, 22 bp, Homo sapiens
atgaggcagagggctgtgccag

SEQ ID NO: 7968487 - DNA, 22 bp, Homo sapiens
atgaggcagagggctgtgccag

SEQ ID NO: 7968488 - DNA, 22 bp, Homo sapiens
atgaagcagcgttgtagagtga

SEQ ID NO: 7968489 - DNA, 22 bp, Homo sapiens
atgaagcagcgttgtagagtga

SEQ ID NO: 7968490 - DNA, 22 bp, Homo sapiens
atgagcttcccagacaggatgg

SEQ ID NO: 7968491 - DNA, 19 bp, Homo sapiens
atgaggaactgaggctcag

SEQ ID NO: 7968492 - DNA, 19 bp, Homo sapiens
atgaggaactgaggctcag

SEQ ID NO: 7968493 - DNA, 22 bp, Homo sapiens
atgaagcagactcaggtggtgc

SEQ ID NO: 7968494 - DNA, 22 bp, Homo sapiens
atgaagcagatttattactcac

SEQ ID NO: 7968495 - DNA, 22 bp, Homo sapiens
atgaagcagcctcttccctctg

SEQ ID NO: 7968496 - DNA, 22 bp, Homo sapiens
atgaagcagcgttgtagagtga

SEQ ID NO: 7968497 - DNA, 22 bp, Homo sapiens
atgaagcagcctcttccctctg

SEQ ID NO: 7968498 - DNA, 22 bp, Homo sapiens
atgaggcagctggctttctccc

SEQ ID NO: 7968499 - DNA, 22 bp, Homo sapiens
atgaggcaggaaaggcgtatct

SEQ ID NO: 7968500 - DNA, 22 bp, Homo sapiens
atgaggcagctggctttctccc

SEQ ID NO: 7968501 - DNA, 22 bp, Homo sapiens
atgaggcagctgctggagaacg

SEQ ID NO: 7968502 - DNA, 22 bp, Homo sapiens
atgaggcaggagcggggaccct

SEQ ID NO: 7968503 - DNA, 22 bp, Homo sapiens
atgaggcaggagcggggaccct

SEQ ID NO: 7968504 - DNA, 22 bp, Homo sapiens
atgaggcaggagcggggaccct

SEQ ID NO: 7968505 - DNA, 22 bp, Homo sapiens
atgaggcaggagtgcagtggca

SEQ ID NO: 7968506 - DNA, 22 bp, Homo sapiens
atgaggcaggagtgcagtggca

SEQ ID NO: 7968507 - DNA, 22 bp, Homo sapiens
atgaggcaggagtgcagtggca

SEQ ID NO: 7968508 - DNA, 22 bp, Homo sapiens
atgaggcagtctggcctgaggg

SEQ ID NO: 7968509 - DNA, 18 bp, Homo sapiens
gaaagatgaacttttttc

SEQ ID NO: 7968510 - DNA, 22 bp, Homo sapiens
atgaggcagtacacacaaagcc

SEQ ID NO: 7968511 - DNA, 22 bp, Homo sapiens
atgaggcagtacacacaaagcc

SEQ ID NO: 7968512 - DNA, 22 bp, Homo sapiens
atgaggcaggtggaggctgcca

SEQ ID NO: 7968513 - DNA, 22 bp, Homo sapiens
atgaggcaggtggaggctgcca

SEQ ID NO: 7968514 - DNA, 22 bp, Homo sapiens
atgaggcaggtggaggctgcca

SEQ ID NO: 7968515 - DNA, 22 bp, Homo sapiens
atgaggcaggtggaggctgcca

SEQ ID NO: 7968516 - DNA, 22 bp, Homo sapiens
atgaggcaggtggaggctgcca

SEQ ID NO: 7968517 - DNA, 22 bp, Homo sapiens
atgaggcaggatattaactttt

SEQ ID NO: 7968518 - DNA, 22 bp, Homo sapiens
atgaggcaggattaagctatca

SEQ ID NO: 7968519 - DNA, 22 bp, Homo sapiens
atgaggcaggatattaactttt

SEQ ID NO: 7968520 - DNA, 22 bp, Homo sapiens
gaaagcacagttctgaccatgt

SEQ ID NO: 7968521 - DNA, 22 bp, Homo sapiens
gaaagcacatactataaatcac

SEQ ID NO: 7968522 - DNA, 22 bp, Homo sapiens
gaaagcacgatagtagcaaaag

SEQ ID NO: 7968523 - DNA, 22 bp, Homo sapiens
gaaagcacgatagtagcaaaag

SEQ ID NO: 7968524 - DNA, 22 bp, Homo sapiens
gaaagcacgatagtagcaaaag

SEQ ID NO: 7968525 - DNA, 22 bp, Homo sapiens
gaaagcacagttctgaccatgt

SEQ ID NO: 7968526 - DNA, 22 bp, Homo sapiens
gaaagcacagttcatgagacaa

SEQ ID NO: 7968527 - DNA, 22 bp, Homo sapiens
gaaagcacaggctcaggaacag

SEQ ID NO: 7968528 - DNA, 21 bp, Homo sapiens
gaaagcacagaaaggactctt

SEQ ID NO: 7968529 - DNA, 21 bp, Homo sapiens
gaaagcacagaaaggactctt

SEQ ID NO: 7968530 - DNA, 22 bp, Homo sapiens
gaaagcaatttgtgtaatctgt

SEQ ID NO: 7968531 - DNA, 22 bp, Homo sapiens
gaaagcaatttgtgtaatctgt

SEQ ID NO: 7968532 - DNA, 22 bp, Homo sapiens
gaaagcaatttgtgtaatctgt

SEQ ID NO: 7968533 - DNA, 22 bp, Homo sapiens
gaaagcaatttgtgtaatctgt

SEQ ID NO: 7968534 - DNA, 22 bp, Homo sapiens
gaaagcaatttgtgtaatctgt

SEQ ID NO: 7968535 - DNA, 22 bp, Homo sapiens
gaaagcaatttgtgtaatctgt

SEQ ID NO: 7968536 - DNA, 20 bp, Homo sapiens
gaaagattgtaagaggcaga

SEQ ID NO: 7968537 - DNA, 20 bp, Homo sapiens
gaaagattgtaagaggcaga

SEQ ID NO: 7968538 - DNA, 19 bp, Homo sapiens
gaaagatttcagttgagga

SEQ ID NO: 7968539 - DNA, 22 bp, Homo sapiens
gaaagatatttattggcaacag

SEQ ID NO: 7968540 - DNA, 22 bp, Homo sapiens
gaaagcaagttgactgcagaat

SEQ ID NO: 7968541 - DNA, 22 bp, Homo sapiens
gaaagcaagttgactgcagaat

SEQ ID NO: 7968542 - DNA, 22 bp, Homo sapiens
gaaagcaagttgactgcagaat

SEQ ID NO: 7968543 - DNA, 22 bp, Homo sapiens
gaaagcaagttgactgcagaat

SEQ ID NO: 7968544 - DNA, 19 bp, Homo sapiens
gaaagatttcagttgagga

SEQ ID NO: 7968545 - DNA, 22 bp, Homo sapiens
gaaagcaagttgactgcagaat

SEQ ID NO: 7968546 - DNA, 22 bp, Homo sapiens
atgcaaataaagcaactataca

SEQ ID NO: 7968547 - DNA, 22 bp, Homo sapiens
atgcaaataaagcaactataca

SEQ ID NO: 7968548 - DNA, 22 bp, Homo sapiens
atgcaaataaagcaactataca

SEQ ID NO: 7968549 - DNA, 22 bp, Homo sapiens
atgcaaataaagcaactataca

SEQ ID NO: 7968550 - DNA, 22 bp, Homo sapiens
atgcaaataaagcaactataca

SEQ ID NO: 7968551 - DNA, 22 bp, Homo sapiens
atgcaaagcacacacagaatcc

SEQ ID NO: 7968552 - DNA, 22 bp, Homo sapiens
atgcaaagcaccacactaagat

SEQ ID NO: 7968553 - DNA, 23 bp, Homo sapiens
atgcaaagtgctgtcatgtagac

SEQ ID NO: 7968554 - DNA, 22 bp, Homo sapiens
atgcaaatattaatggtatgac

SEQ ID NO: 7968555 - DNA, 22 bp, Homo sapiens
atgcaaataagtgcaggcgtgg

SEQ ID NO: 7968556 - DNA, 20 bp, Homo sapiens
atgcaaatcccaaaatcagg

SEQ ID NO: 7968557 - DNA, 20 bp, Homo sapiens
atgcaaatcccaaaatcagg

SEQ ID NO: 7968558 - DNA, 20 bp, Homo sapiens
atgcaaatcccaaaatcagg

SEQ ID NO: 7968559 - DNA, 22 bp, Homo sapiens
atgcaaatgaacatgttgctag

SEQ ID NO: 7968560 - DNA, 22 bp, Homo sapiens
atgcacagtaatgagctggttg

SEQ ID NO: 7968561 - DNA, 22 bp, Homo sapiens
atgcacagtacaaactggaaac

SEQ ID NO: 7968562 - DNA, 20 bp, Homo sapiens
atgcaaactcacaaaatacc

SEQ ID NO: 7968563 - DNA, 20 bp, Homo sapiens
atgcaaactcacaaaatacc

SEQ ID NO: 7968564 - DNA, 20 bp, Homo sapiens
atgcaaactcacaaaatacc

SEQ ID NO: 7968565 - DNA, 22 bp, Homo sapiens
atgcaaacatgtttcctctaag

SEQ ID NO: 7968566 - DNA, 22 bp, Homo sapiens
atgcaaaattaccattctgttc

SEQ ID NO: 7968567 - DNA, 22 bp, Homo sapiens
atgcaaaattaccattctgttc

SEQ ID NO: 7968568 - DNA, 22 bp, Homo sapiens
atgcaaaataaggcagaaacat

SEQ ID NO: 7968569 - DNA, 22 bp, Homo sapiens
atgcaaaattaccattctgttc

SEQ ID NO: 7968570 - DNA, 22 bp, Homo sapiens
atgcaaaattaccattctgttc

SEQ ID NO: 7968571 - DNA, 22 bp, Homo sapiens
atgcaaaattaccattctgttc

SEQ ID NO: 7968572 - DNA, 22 bp, Homo sapiens
atgcaaaataaggcagaaacat

SEQ ID NO: 7968573 - DNA, 22 bp, Homo sapiens
atgcaaaagtagttgcagtttt

SEQ ID NO: 7968574 - DNA, 22 bp, Homo sapiens
atgcaaaataaggcagaaacat

SEQ ID NO: 7968575 - DNA, 22 bp, Homo sapiens
atgcaaaataaggcagaaacat

SEQ ID NO: 7968576 - DNA, 22 bp, Homo sapiens
atgcaaaataaggcagaaacat

SEQ ID NO: 7968577 - DNA, 22 bp, Homo sapiens
atgcaaaataaggcagaaacat

SEQ ID NO: 7968578 - DNA, 22 bp, Homo sapiens
atgcaaaataaggcagaaacat

SEQ ID NO: 7968579 - DNA, 22 bp, Homo sapiens
atgcaaaagtaattgcaatttt

SEQ ID NO: 7968580 - DNA, 22 bp, Homo sapiens
atgcaaaagtaattgcaatttt

SEQ ID NO: 7968581 - DNA, 22 bp, Homo sapiens
atgcaaaagtagttgcagtttt

SEQ ID NO: 7968582 - DNA, 22 bp, Homo sapiens
atgcaaaagtagttgcagtttt

SEQ ID NO: 7968583 - DNA, 22 bp, Homo sapiens
atgcaaaagtagttgcagtttt

SEQ ID NO: 7968584 - DNA, 22 bp, Homo sapiens
atgcaaaagtagttgcagtttt

SEQ ID NO: 7968585 - DNA, 22 bp, Homo sapiens
atgcagatatgcaaactgtagt

SEQ ID NO: 7968586 - DNA, 22 bp, Homo sapiens
atgcagataagaatcaggtttg

SEQ ID NO: 7968587 - DNA, 22 bp, Homo sapiens
atgcagataagaatcaggtttg

SEQ ID NO: 7968588 - DNA, 22 bp, Homo sapiens
atgcagataagaatcaggtttg

SEQ ID NO: 7968589 - DNA, 22 bp, Homo sapiens
atgcagatagtcccctactcag

SEQ ID NO: 7968590 - DNA, 15 bp, Homo sapiens
atgcagatagtctac

SEQ ID NO: 7968591 - DNA, 22 bp, Homo sapiens
atgcagatggtggatggagaaa

SEQ ID NO: 7968592 - DNA, 22 bp, Homo sapiens
atgcagatgggtgccaaagtct

SEQ ID NO: 7968593 - DNA, 22 bp, Homo sapiens
atgcagatatgcaaactgtagt

SEQ ID NO: 7968594 - DNA, 22 bp, Homo sapiens
atgcagatgggtgccaaagtct

SEQ ID NO: 7968595 - DNA, 22 bp, Homo sapiens
atgcagatgttcctactgtgtt

SEQ ID NO: 7968596 - DNA, 22 bp, Homo sapiens
atgcagatggtggatggagaaa

SEQ ID NO: 7968597 - DNA, 22 bp, Homo sapiens
atgcagatggtggatggagaaa

SEQ ID NO: 7968598 - DNA, 22 bp, Homo sapiens
atgcagcagccccttgaggtgc

SEQ ID NO: 7968599 - DNA, 22 bp, Homo sapiens
atgcagcactgatctttagcca

SEQ ID NO: 7968600 - DNA, 18 bp, Homo sapiens
atgcagcaatcagaaata

SEQ ID NO: 7968601 - DNA, 22 bp, Homo sapiens
atgcagatttctttgctgcacc

SEQ ID NO: 7968602 - DNA, 22 bp, Homo sapiens
atgcagatttaattagtatagg

SEQ ID NO: 7968603 - DNA, 22 bp, Homo sapiens
atgcagatgttcctactgtgtt

SEQ ID NO: 7968604 - DNA, 22 bp, Homo sapiens
atgcagatgttcctactgtgtt

SEQ ID NO: 7968605 - DNA, 22 bp, Homo sapiens
atgcagatgtttggttcattgt

SEQ ID NO: 7968606 - DNA, 22 bp, Homo sapiens
atgcagatctgtgaaaggaata

SEQ ID NO: 7968607 - DNA, 22 bp, Homo sapiens
atgcagatttaattagtatagg

SEQ ID NO: 7968608 - DNA, 22 bp, Homo sapiens
atgcagaattgctaagtatctg

SEQ ID NO: 7968609 - DNA, 22 bp, Homo sapiens
atgcagaattgctaagtatctg

SEQ ID NO: 7968610 - DNA, 21 bp, Homo sapiens
atgcagagaactccagggaag

SEQ ID NO: 7968611 - DNA, 21 bp, Homo sapiens
atgcagagaactccagggaag

SEQ ID NO: 7968612 - DNA, 23 bp, Homo sapiens
atgcagagaataacaaatgccat

SEQ ID NO: 7968613 - DNA, 23 bp, Homo sapiens
atgcagagaataacaaatgccat

SEQ ID NO: 7968614 - DNA, 19 bp, Homo sapiens
atgcagagaatggcagtag

SEQ ID NO: 7968615 - DNA, 19 bp, Homo sapiens
atgcagagaatggcagtag

SEQ ID NO: 7968616 - DNA, 22 bp, Homo sapiens
atgcagagacagatgtggcatg

SEQ ID NO: 7968617 - DNA, 22 bp, Homo sapiens
atgcagagacagatgtggcatg

SEQ ID NO: 7968618 - DNA, 22 bp, Homo sapiens
atgcagagcttccagtggcctg

SEQ ID NO: 7968619 - DNA, 22 bp, Homo sapiens
atgcagagcttccagtggcctg

SEQ ID NO: 7968620 - DNA, 22 bp, Homo sapiens
atgcagaaggagccatgcttgc

SEQ ID NO: 7968621 - DNA, 22 bp, Homo sapiens
atgcagaaggagccatgcttgc

SEQ ID NO: 7968622 - DNA, 22 bp, Homo sapiens
atgcagaatgagttcacgatct

SEQ ID NO: 7968623 - DNA, 22 bp, Homo sapiens
atgcagaagcagaacttacaca

SEQ ID NO: 7968624 - DNA, 22 bp, Homo sapiens
atgcagaaggagccatgcttgc

SEQ ID NO: 7968625 - DNA, 22 bp, Homo sapiens
atgcagaagactgaaaagctga

SEQ ID NO: 7968626 - DNA, 22 bp, Homo sapiens
atgcagaacgtttgtgaaactt

SEQ ID NO: 7968627 - DNA, 22 bp, Homo sapiens
atgcagaacgtttgtgaaactt

SEQ ID NO: 7968628 - DNA, 22 bp, Homo sapiens
atgcagaagaaaccatggcttc

SEQ ID NO: 7968629 - DNA, 22 bp, Homo sapiens
atgcagaagaaaccatggcttc

SEQ ID NO: 7968630 - DNA, 22 bp, Homo sapiens
atgcacagtatgtagggtctat

SEQ ID NO: 7968631 - DNA, 19 bp, Homo sapiens
atgcacagtcatttgtaag

SEQ ID NO: 7968632 - DNA, 22 bp, Homo sapiens
atgcacttcaagcatctctctg

SEQ ID NO: 7968633 - DNA, 22 bp, Homo sapiens
atgcatatgccgtagaataagt

SEQ ID NO: 7968634 - DNA, 22 bp, Homo sapiens
atgcatatgccgtagaataagt

SEQ ID NO: 7968635 - DNA, 22 bp, Homo sapiens
atgcatatgcatggacactcag

SEQ ID NO: 7968636 - DNA, 22 bp, Homo sapiens
atgcatctatgacttagacatt

SEQ ID NO: 7968637 - DNA, 22 bp, Homo sapiens
atgcatctatgacttagacatt

SEQ ID NO: 7968638 - DNA, 21 bp, Homo sapiens
atgcatctatcttctactcca

SEQ ID NO: 7968639 - DNA, 22 bp, Homo sapiens
atgcatctatgacttagacatt

SEQ ID NO: 7968640 - DNA, 22 bp, Homo sapiens
atgcatctattcccaagggcag

SEQ ID NO: 7968641 - DNA, 19 bp, Homo sapiens
atgcatctgcattgacagg

SEQ ID NO: 7968642 - DNA, 20 bp, Homo sapiens
atgcatctggtatctttcct

SEQ ID NO: 7968643 - DNA, 22 bp, Homo sapiens
atgcatctgtagtgttatatga

SEQ ID NO: 7968644 - DNA, 22 bp, Homo sapiens
atgcatcttatcaaaaattata

SEQ ID NO: 7968645 - DNA, 22 bp, Homo sapiens
atgcatgcattgtttatcatgg

SEQ ID NO: 7968646 - DNA, 20 bp, Homo sapiens
atgcatgcatgcacatgcac

SEQ ID NO: 7968647 - DNA, 22 bp, Homo sapiens
atgcatgcatgtaccccacctt

SEQ ID NO: 7968648 - DNA, 22 bp, Homo sapiens
atgcatgcttcttatagtactt

SEQ ID NO: 7968649 - DNA, 22 bp, Homo sapiens
atgcatgcacacactgcattgc

SEQ ID NO: 7968650 - DNA, 22 bp, Homo sapiens
atgcatgcatgagtgtgtacct

SEQ ID NO: 7968651 - DNA, 20 bp, Homo sapiens
atgcatgcatgcacatgcac

SEQ ID NO: 7968652 - DNA, 22 bp, Homo sapiens
atgcatgcaagtgcacatatgc

SEQ ID NO: 7968653 - DNA, 22 bp, Homo sapiens
atgcatgcatgagtgtgtacct

SEQ ID NO: 7968654 - DNA, 22 bp, Homo sapiens
atgcatcttatcaaaaattata

SEQ ID NO: 7968655 - DNA, 22 bp, Homo sapiens
atgcatcttttcaaggtatttc

SEQ ID NO: 7968656 - DNA, 22 bp, Homo sapiens
atgcatgatcctgagcaaccca

SEQ ID NO: 7968657 - DNA, 22 bp, Homo sapiens
atgcatgcaagtgcacatatgc

SEQ ID NO: 7968658 - DNA, 22 bp, Homo sapiens
atgcaggaagagccctggagct

SEQ ID NO: 7968659 - DNA, 22 bp, Homo sapiens
atgcaggaagagccctggagct

SEQ ID NO: 7968660 - DNA, 22 bp, Homo sapiens
atgcaggacataagcatcgaca

SEQ ID NO: 7968661 - DNA, 20 bp, Homo sapiens
atgcagctggagttggggtg

SEQ ID NO: 7968662 - DNA, 22 bp, Homo sapiens
atgcagctgtcagggagaacat

SEQ ID NO: 7968663 - DNA, 22 bp, Homo sapiens
atgcagctgctcttcctctatt

SEQ ID NO: 7968664 - DNA, 22 bp, Homo sapiens
atgcagctgctgacagctttca

SEQ ID NO: 7968665 - DNA, 22 bp, Homo sapiens
atgcagcttcaggattatgatg

SEQ ID NO: 7968666 - DNA, 19 bp, Homo sapiens
atgcagctcctgcctcctt

SEQ ID NO: 7968667 - DNA, 22 bp, Homo sapiens
atgcagctgacattttcatgtt

SEQ ID NO: 7968668 - DNA, 22 bp, Homo sapiens
atgcagctgacattttcatgtt

SEQ ID NO: 7968669 - DNA, 22 bp, Homo sapiens
atgcagctgagggtagtggagc

SEQ ID NO: 7968670 - DNA, 22 bp, Homo sapiens
atgcagccccctggtgcccggg

SEQ ID NO: 7968671 - DNA, 20 bp, Homo sapiens
atgcagcattgttgtggcaa

SEQ ID NO: 7968672 - DNA, 22 bp, Homo sapiens
atgcagcagtttacaaagcaat

SEQ ID NO: 7968673 - DNA, 20 bp, Homo sapiens
atgcagcattgttgtggcaa

SEQ ID NO: 7968674 - DNA, 22 bp, Homo sapiens
atgcagcagctacttgggaagg

SEQ ID NO: 7968675 - DNA, 22 bp, Homo sapiens
atgcagcagctacttgggaagg

SEQ ID NO: 7968676 - DNA, 22 bp, Homo sapiens
atgcagcagtttacaaagcaat

SEQ ID NO: 7968677 - DNA, 22 bp, Homo sapiens
atgcattcatgaagattgcaca

SEQ ID NO: 7968678 - DNA, 22 bp, Homo sapiens
atgcattcagcggaatgcttag

SEQ ID NO: 7968679 - DNA, 22 bp, Homo sapiens
atgcatgtttaaggggcatgca

SEQ ID NO: 7968680 - DNA, 22 bp, Homo sapiens
atgcatgtttatagggtgcttc

SEQ ID NO: 7968681 - DNA, 22 bp, Homo sapiens
atgcatgtttatagggtgcttc

SEQ ID NO: 7968682 - DNA, 22 bp, Homo sapiens
atgcattatcaattgatgtagg

SEQ ID NO: 7968683 - DNA, 21 bp, Homo sapiens
atgcatgttacagtatatgcc

SEQ ID NO: 7968684 - DNA, 22 bp, Homo sapiens
atgcatgtgtgagagcaagagg

SEQ ID NO: 7968685 - DNA, 22 bp, Homo sapiens
atgcatgtgcatggctctatct

SEQ ID NO: 7968686 - DNA, 22 bp, Homo sapiens
atgcatgtctgccagttgctta

SEQ ID NO: 7968687 - DNA, 22 bp, Homo sapiens
atgcatgtattcatgtgtgaca

SEQ ID NO: 7968688 - DNA, 22 bp, Homo sapiens
atgcatgtaacagtgttatgaa

SEQ ID NO: 7968689 - DNA, 21 bp, Homo sapiens
atgcatggatttcagtgagag

SEQ ID NO: 7968690 - DNA, 22 bp, Homo sapiens
atgcatgtatatattacactca

SEQ ID NO: 7968691 - DNA, 22 bp, Homo sapiens
atgcatgtattatctagatgag

SEQ ID NO: 7968692 - DNA, 22 bp, Homo sapiens
atgcattctggaaagtagcaat

SEQ ID NO: 7968693 - DNA, 22 bp, Homo sapiens
atgcattctggaaagtagcaat

SEQ ID NO: 7968694 - DNA, 22 bp, Homo sapiens
atgcattctagcctggacaaca

SEQ ID NO: 7968695 - DNA, 22 bp, Homo sapiens
atgcattgaggatgacatgagt

SEQ ID NO: 7968696 - DNA, 22 bp, Homo sapiens
gacactgaccccaagctgtcct

SEQ ID NO: 7968697 - DNA, 22 bp, Homo sapiens
gacactctttcctcttctggaa

SEQ ID NO: 7968698 - DNA, 22 bp, Homo sapiens
atgcatttatgtgtgtacattg

SEQ ID NO: 7968699 - DNA, 22 bp, Homo sapiens
atgcatttgacgggatatattt

SEQ ID NO: 7968700 - DNA, 22 bp, Homo sapiens
atgcatttgacgggatatattt

SEQ ID NO: 7968701 - DNA, 19 bp, Homo sapiens
atgcattgtttgaagttga

SEQ ID NO: 7968702 - DNA, 22 bp, Homo sapiens
atgcatttatgtgtgtacattg

SEQ ID NO: 7968703 - DNA, 22 bp, Homo sapiens
atgcatttatgtgtgtacattg

SEQ ID NO: 7968704 - DNA, 22 bp, Homo sapiens
atgcatttatgtgtgtacattg

SEQ ID NO: 7968705 - DNA, 22 bp, Homo sapiens
atgaaatgtattcagatatgta

SEQ ID NO: 7968706 - DNA, 22 bp, Homo sapiens
atgaaatgtctggatctttttc

SEQ ID NO: 7968707 - DNA, 22 bp, Homo sapiens
atgaaatgtattcagatatgta

SEQ ID NO: 7968708 - DNA, 22 bp, Homo sapiens
atgaaatgtctggatctttttc

SEQ ID NO: 7968709 - DNA, 22 bp, Homo sapiens
atgaaatgtgaatgcttttcat

SEQ ID NO: 7968710 - DNA, 22 bp, Homo sapiens
atgaaatgtatgagtctgggtt

SEQ ID NO: 7968711 - DNA, 22 bp, Homo sapiens
atgaaatgtaagtagagagttt

SEQ ID NO: 7968712 - DNA, 22 bp, Homo sapiens
atgaaatgtaagtagagagttt

SEQ ID NO: 7968713 - DNA, 22 bp, Homo sapiens
atgaaatgtatgagtctgggtt

SEQ ID NO: 7968714 - DNA, 22 bp, Homo sapiens
atgaaatgtatgagtctgggtt

SEQ ID NO: 7968715 - DNA, 22 bp, Homo sapiens
atgaaatgtattcagatatgta

SEQ ID NO: 7968716 - DNA, 22 bp, Homo sapiens
atgaaatgtattcagatatgta

SEQ ID NO: 7968717 - DNA, 23 bp, Homo sapiens
atgaaatgctggctcagggaggt

SEQ ID NO: 7968718 - DNA, 22 bp, Homo sapiens
atgaaatgctgagaggtgcttc

SEQ ID NO: 7968719 - DNA, 23 bp, Homo sapiens
atgaaatgctggctcagggaggt

SEQ ID NO: 7968720 - DNA, 22 bp, Homo sapiens
atgaaatggtggttttccattt

SEQ ID NO: 7968721 - DNA, 22 bp, Homo sapiens
atgaaatggtggttttccattt

SEQ ID NO: 7968722 - DNA, 22 bp, Homo sapiens
atgaaatgattgaaatctttac

SEQ ID NO: 7968723 - DNA, 22 bp, Homo sapiens
atgaaatgattgaaatctttac

SEQ ID NO: 7968724 - DNA, 22 bp, Homo sapiens
atgaaatgctgagaggtgcttc

SEQ ID NO: 7968725 - DNA, 22 bp, Homo sapiens
atgaaatgctgagaggtgcttc

SEQ ID NO: 7968726 - DNA, 22 bp, Homo sapiens
atgaaatgaagttggcctggct

SEQ ID NO: 7968727 - DNA, 22 bp, Homo sapiens
atgaaatatttcagagcagagt

SEQ ID NO: 7968728 - DNA, 22 bp, Homo sapiens
atgaaatattctttggtaagaa

SEQ ID NO: 7968729 - DNA, 22 bp, Homo sapiens
atgaaatatcttgaagaaattc

SEQ ID NO: 7968730 - DNA, 22 bp, Homo sapiens
atgaaatattctttggtaagaa

SEQ ID NO: 7968731 - DNA, 23 bp, Homo sapiens
atgaaatgatactttattcactg

SEQ ID NO: 7968732 - DNA, 22 bp, Homo sapiens
atgaaatgattgaaatctttac

SEQ ID NO: 7968733 - DNA, 22 bp, Homo sapiens
atgaaatgattgaaatctttac

SEQ ID NO: 7968734 - DNA, 22 bp, Homo sapiens
atgaaatgagtcaatgcgacta

SEQ ID NO: 7968735 - DNA, 22 bp, Homo sapiens
atgaaatatcttgaagaaattc

SEQ ID NO: 7968736 - DNA, 22 bp, Homo sapiens
atgaaatatcttgaagaaattc

SEQ ID NO: 7968737 - DNA, 22 bp, Homo sapiens
atgaaatatcttgaagaaattc

SEQ ID NO: 7968738 - DNA, 22 bp, Homo sapiens
atgaaatatcttgaagaaattc

SEQ ID NO: 7968739 - DNA, 22 bp, Homo sapiens
atgaaatatcttgaagaaattc

SEQ ID NO: 7968740 - DNA, 22 bp, Homo sapiens
atgaaatatcttgaagaaattc

SEQ ID NO: 7968741 - DNA, 22 bp, Homo sapiens
atgaaatatcttgaagaaattc

SEQ ID NO: 7968742 - DNA, 22 bp, Homo sapiens
atgaaatatcttgaagaaattc

SEQ ID NO: 7968743 - DNA, 22 bp, Homo sapiens
atgaaatatcttgaagaaattc

SEQ ID NO: 7968744 - DNA, 22 bp, Homo sapiens
atgaaatatcttgaagaaattc

SEQ ID NO: 7968745 - DNA, 22 bp, Homo sapiens
atgaaatatcttgaagaaattc

SEQ ID NO: 7968746 - DNA, 22 bp, Homo sapiens
atgaaatatcttgaagaaattc

SEQ ID NO: 7968747 - DNA, 22 bp, Homo sapiens
ctttggtgtcatgtttctgcgg

SEQ ID NO: 7968748 - DNA, 20 bp, Homo sapiens
ctttggtgggggtagcccag

SEQ ID NO: 7968749 - DNA, 22 bp, Homo sapiens
atgaaattaatcaacacataca

SEQ ID NO: 7968750 - DNA, 22 bp, Homo sapiens
ctttggtctgtccatcctgcct

SEQ ID NO: 7968751 - DNA, 22 bp, Homo sapiens
atgaaattaatcaacacataca

SEQ ID NO: 7968752 - DNA, 22 bp, Homo sapiens
cttttattttgaattaagggct

SEQ ID NO: 7968753 - DNA, 22 bp, Homo sapiens
cttttattttgaattaagggct

SEQ ID NO: 7968754 - DNA, 22 bp, Homo sapiens
cttttactgtgaaaagaaactg

SEQ ID NO: 7968755 - DNA, 22 bp, Homo sapiens
cttttattttgaattaagggct

SEQ ID NO: 7968756 - DNA, 22 bp, Homo sapiens
cttttattttgaattaagggct

SEQ ID NO: 7968757 - DNA, 22 bp, Homo sapiens
cttttattttgaattaagggct

SEQ ID NO: 7968758 - DNA, 22 bp, Homo sapiens
cttttcaggctacattatggga

SEQ ID NO: 7968759 - DNA, 22 bp, Homo sapiens
cttttcagagctgagatcaccg

SEQ ID NO: 7968760 - DNA, 22 bp, Homo sapiens
cttttcagagctgagatcaccg

SEQ ID NO: 7968761 - DNA, 22 bp, Homo sapiens
cttttcagagctgagatcaccg

SEQ ID NO: 7968762 - DNA, 19 bp, Homo sapiens
cttttcatcaacagccaat

SEQ ID NO: 7968763 - DNA, 22 bp, Homo sapiens
cttttcaggctacattatggga

SEQ ID NO: 7968764 - DNA, 22 bp, Homo sapiens
cttttcagagctgagatcaccg

SEQ ID NO: 7968765 - DNA, 22 bp, Homo sapiens
cttttcacaggaggataagccc

SEQ ID NO: 7968766 - DNA, 22 bp, Homo sapiens
cttttcagagctgagatcaccg

SEQ ID NO: 7968767 - DNA, 19 bp, Homo sapiens
cttttcaagccatcagttt

SEQ ID NO: 7968768 - DNA, 19 bp, Homo sapiens
cttttcaagccatcagttt

SEQ ID NO: 7968769 - DNA, 19 bp, Homo sapiens
cttttcaagccatcagttt

SEQ ID NO: 7968770 - DNA, 22 bp, Homo sapiens
cttttcaaacgctgatgtcagt

SEQ ID NO: 7968771 - DNA, 22 bp, Homo sapiens
cttttcaaacgctgatgtcagt

SEQ ID NO: 7968772 - DNA, 22 bp, Homo sapiens
cttttcaaacgctgatgtcagt

SEQ ID NO: 7968773 - DNA, 22 bp, Homo sapiens
cttttcaaacgctgatgtcagt

SEQ ID NO: 7968774 - DNA, 22 bp, Homo sapiens
cttttcaaacgctgatgtcagt

SEQ ID NO: 7968775 - DNA, 22 bp, Homo sapiens
cttttattttgaattaagggct

SEQ ID NO: 7968776 - DNA, 22 bp, Homo sapiens
cttttcatgagtctgttatggg

SEQ ID NO: 7968777 - DNA, 22 bp, Homo sapiens
cttttcatgagtctgttatggg

SEQ ID NO: 7968778 - DNA, 23 bp, Homo sapiens
cttttcattgccttagcgcagag

SEQ ID NO: 7968779 - DNA, 22 bp, Homo sapiens
cttttcatgccagcccatcaca

SEQ ID NO: 7968780 - DNA, 22 bp, Homo sapiens
cttttcatgccagcccatcaca

SEQ ID NO: 7968781 - DNA, 22 bp, Homo sapiens
cttttcatgccagcccatcaca

SEQ ID NO: 7968782 - DNA, 22 bp, Homo sapiens
atctttttgacatggtgatggt

SEQ ID NO: 7968783 - DNA, 22 bp, Homo sapiens
atctttttgacatggtgatggt

SEQ ID NO: 7968784 - DNA, 22 bp, Homo sapiens
atctttttgacatggtgatggt

SEQ ID NO: 7968785 - DNA, 22 bp, Homo sapiens
atctttttatctgtttggaaca

SEQ ID NO: 7968786 - DNA, 22 bp, Homo sapiens
atctttttatctgtttggaaca

SEQ ID NO: 7968787 - DNA, 22 bp, Homo sapiens
atctttttatctgtttggaaca

SEQ ID NO: 7968788 - DNA, 22 bp, Homo sapiens
atctttttatctgtttggaaca

SEQ ID NO: 7968789 - DNA, 22 bp, Homo sapiens
atctttttactaacactgctta

SEQ ID NO: 7968790 - DNA, 22 bp, Homo sapiens
atctttttactaacactgctta

SEQ ID NO: 7968791 - DNA, 22 bp, Homo sapiens
atctttttactaacactgctta

SEQ ID NO: 7968792 - DNA, 22 bp, Homo sapiens
atctttttactaacactgctta

SEQ ID NO: 7968793 - DNA, 22 bp, Homo sapiens
atctttttactaacactgctta

SEQ ID NO: 7968794 - DNA, 22 bp, Homo sapiens
atgaaaacggaccagagctatt

SEQ ID NO: 7968795 - DNA, 22 bp, Homo sapiens
atgaaaacggaccagagctatt

SEQ ID NO: 7968796 - DNA, 22 bp, Homo sapiens
atgaaaacggaccagagctatt

SEQ ID NO: 7968797 - DNA, 22 bp, Homo sapiens
atgaaaactttagcctcattag

SEQ ID NO: 7968798 - DNA, 22 bp, Homo sapiens
atgaaaactttagcctcattag

SEQ ID NO: 7968799 - DNA, 22 bp, Homo sapiens
atcttttttgtcttggtcactg

SEQ ID NO: 7968800 - DNA, 22 bp, Homo sapiens
atgaaaacagcctcctgtgata

SEQ ID NO: 7968801 - DNA, 22 bp, Homo sapiens
atcttttttgtcttggtcactg

SEQ ID NO: 7968802 - DNA, 22 bp, Homo sapiens
atcttttttgtcttggtcactg

SEQ ID NO: 7968803 - DNA, 22 bp, Homo sapiens
atcttttttgtcttggtcactg

SEQ ID NO: 7968804 - DNA, 22 bp, Homo sapiens
atctttgggcaatgatgaggga

SEQ ID NO: 7968805 - DNA, 22 bp, Homo sapiens
atctttgttgctctcatttctg

SEQ ID NO: 7968806 - DNA, 22 bp, Homo sapiens
atctttgggatcctgatttact

SEQ ID NO: 7968807 - DNA, 22 bp, Homo sapiens
atctttgtttgtctctgaggtg

SEQ ID NO: 7968808 - DNA, 22 bp, Homo sapiens
atcttttctgtttgctatgtct

SEQ ID NO: 7968809 - DNA, 22 bp, Homo sapiens
atcttttctgtttgctatgtct

SEQ ID NO: 7968810 - DNA, 22 bp, Homo sapiens
atcttttactacaaatcaggtg

SEQ ID NO: 7968811 - DNA, 22 bp, Homo sapiens
atcttttactacaaatcaggtg

SEQ ID NO: 7968812 - DNA, 22 bp, Homo sapiens
atctttgggcaatgatgaggga

SEQ ID NO: 7968813 - DNA, 22 bp, Homo sapiens
atcttggattgactggctctgc

SEQ ID NO: 7968814 - DNA, 22 bp, Homo sapiens
atcttggattggagaaagaagt

SEQ ID NO: 7968815 - DNA, 22 bp, Homo sapiens
atcttggattgactggctctgc

SEQ ID NO: 7968816 - DNA, 22 bp, Homo sapiens
atcttggactacagaagagagg

SEQ ID NO: 7968817 - DNA, 22 bp, Homo sapiens
atcttggactacagaagagagg

SEQ ID NO: 7968818 - DNA, 22 bp, Homo sapiens
atcttgcttgctgggcattttc

SEQ ID NO: 7968819 - DNA, 22 bp, Homo sapiens
atcttgctgctacaaagtgccc

SEQ ID NO: 7968820 - DNA, 22 bp, Homo sapiens
atcttgctgctacaaagtgccc

SEQ ID NO: 7968821 - DNA, 22 bp, Homo sapiens
atcttgcaatgacctatttagg

SEQ ID NO: 7968822 - DNA, 22 bp, Homo sapiens
atcttgcactcctttctcctag

SEQ ID NO: 7968823 - DNA, 22 bp, Homo sapiens
atcttgcatttgctaaaatgca

SEQ ID NO: 7968824 - DNA, 22 bp, Homo sapiens
atcttgcatttgctaaaatgca

SEQ ID NO: 7968825 - DNA, 22 bp, Homo sapiens
atcttgcatttgctaaaatgca

SEQ ID NO: 7968826 - DNA, 22 bp, Homo sapiens
atcttgattccattatctttgt

SEQ ID NO: 7968827 - DNA, 22 bp, Homo sapiens
atcttgatcaaggctatcatga

SEQ ID NO: 7968828 - DNA, 18 bp, Homo sapiens
cttgttcttctcttggcg

SEQ ID NO: 7968829 - DNA, 18 bp, Homo sapiens
cttgttcttctcttggcg

SEQ ID NO: 7968830 - DNA, 18 bp, Homo sapiens
cttgttcttctcttggcg

SEQ ID NO: 7968831 - DNA, 18 bp, Homo sapiens
cttgttcttctcttggcg

SEQ ID NO: 7968832 - DNA, 22 bp, Homo sapiens
cttgtttaataataccttagca

SEQ ID NO: 7968833 - DNA, 22 bp, Homo sapiens
cttgtttaagccgctgttaagc

SEQ ID NO: 7968834 - DNA, 22 bp, Homo sapiens
cttgtttaaataagatagcagt

SEQ ID NO: 7968835 - DNA, 22 bp, Homo sapiens
cttgttgttatggctggtggag

SEQ ID NO: 7968836 - DNA, 20 bp, Homo sapiens
cttgttgattctaggaatga

SEQ ID NO: 7968837 - DNA, 22 bp, Homo sapiens
atgaaatatcttgaagaaattc

SEQ ID NO: 7968838 - DNA, 22 bp, Homo sapiens
atgaaatatcttgaagaaattc

SEQ ID NO: 7968839 - DNA, 22 bp, Homo sapiens
atgaaataaatacccacacata

SEQ ID NO: 7968840 - DNA, 22 bp, Homo sapiens
atgaaatatcttgaagaaattc

SEQ ID NO: 7968841 - DNA, 22 bp, Homo sapiens
atgaaacatgagaaatggagag

SEQ ID NO: 7968842 - DNA, 22 bp, Homo sapiens
atgaaagtttgcattcctcagt

SEQ ID NO: 7968843 - DNA, 22 bp, Homo sapiens
atgaaacagtgtgtatagcaaa

SEQ ID NO: 7968844 - DNA, 22 bp, Homo sapiens
cttgtttattatgcactgtaga

SEQ ID NO: 7968845 - DNA, 22 bp, Homo sapiens
cttgtttattatgcactgtaga

SEQ ID NO: 7968846 - DNA, 22 bp, Homo sapiens
cttgttatctccgtgtccttgt

SEQ ID NO: 7968847 - DNA, 22 bp, Homo sapiens
cttgttatctgaaccaaaatta

SEQ ID NO: 7968848 - DNA, 22 bp, Homo sapiens
cttgttattggaaatgtcatgc

SEQ ID NO: 7968849 - DNA, 22 bp, Homo sapiens
cttgttatctccgtgtccttgt

SEQ ID NO: 7968850 - DNA, 22 bp, Homo sapiens
cttgttatctgaaccaaaatta

SEQ ID NO: 7968851 - DNA, 22 bp, Homo sapiens
cttgttcatctgcataccaagt

SEQ ID NO: 7968852 - DNA, 22 bp, Homo sapiens
cttgttcagtcctgacttcctg

SEQ ID NO: 7968853 - DNA, 22 bp, Homo sapiens
cttgttcatctgcataccaagt

SEQ ID NO: 7968854 - DNA, 22 bp, Homo sapiens
cttgttattggaaatgtcatgc

SEQ ID NO: 7968855 - DNA, 20 bp, Homo sapiens
cttgttaaatatgcaggtag

SEQ ID NO: 7968856 - DNA, 22 bp, Homo sapiens
cttgttaaattatataagcaga

SEQ ID NO: 7968857 - DNA, 22 bp, Homo sapiens
cttgttaaattatataagcaga

SEQ ID NO: 7968858 - DNA, 22 bp, Homo sapiens
cttgttaaattatataagcaga

SEQ ID NO: 7968859 - DNA, 22 bp, Homo sapiens
atgaaaagggagtgatatttgt

SEQ ID NO: 7968860 - DNA, 22 bp, Homo sapiens
atgaaaagggagtgatatttgt

SEQ ID NO: 7968861 - DNA, 22 bp, Homo sapiens
atgaaaagttcgatctagaagg

SEQ ID NO: 7968862 - DNA, 22 bp, Homo sapiens
atgaaaagggagtgatatttgt

SEQ ID NO: 7968863 - DNA, 22 bp, Homo sapiens
atgaaaagggagtgatatttgt

SEQ ID NO: 7968864 - DNA, 22 bp, Homo sapiens
atgaaaagggagtgatatttgt

SEQ ID NO: 7968865 - DNA, 22 bp, Homo sapiens
atgaaaagcataaacgctgaag

SEQ ID NO: 7968866 - DNA, 22 bp, Homo sapiens
cttgtgtggtctggtcttgcta

SEQ ID NO: 7968867 - DNA, 22 bp, Homo sapiens
cttgtggcccatggcttcctgc

SEQ ID NO: 7968868 - DNA, 22 bp, Homo sapiens
cttgtggcccatggcttcctgc

SEQ ID NO: 7968869 - DNA, 22 bp, Homo sapiens
cttgtggccaatgtttgttata

SEQ ID NO: 7968870 - DNA, 17 bp, Homo sapiens
cttgtggccagttttta

SEQ ID NO: 7968871 - DNA, 17 bp, Homo sapiens
cttgtggccagttttta

SEQ ID NO: 7968872 - DNA, 22 bp, Homo sapiens
cttgtggcaggtggatggtgcc

SEQ ID NO: 7968873 - DNA, 22 bp, Homo sapiens
cttgcctttgtcttcaaaggct

SEQ ID NO: 7968874 - DNA, 22 bp, Homo sapiens
cttgcctttgtcttcaaaggct

SEQ ID NO: 7968875 - DNA, 22 bp, Homo sapiens
cttgcctttgtcttcaaaggct

SEQ ID NO: 7968876 - DNA, 22 bp, Homo sapiens
cttgcctttgtcttcaaaggct

SEQ ID NO: 7968877 - DNA, 22 bp, Homo sapiens
cttgcctttgtcttcaaaggct

SEQ ID NO: 7968878 - DNA, 22 bp, Homo sapiens
cttgccttcttttcctatagaa

SEQ ID NO: 7968879 - DNA, 22 bp, Homo sapiens
cttgccttcttttcctatagaa

SEQ ID NO: 7968880 - DNA, 22 bp, Homo sapiens
cttgccttcttttcctatagaa

SEQ ID NO: 7968881 - DNA, 22 bp, Homo sapiens
cttgccttctgttcctatagaa

SEQ ID NO: 7968882 - DNA, 22 bp, Homo sapiens
cttgccttctgttcctatagaa

SEQ ID NO: 7968883 - DNA, 22 bp, Homo sapiens
cttgccttcagtccatcagtca

SEQ ID NO: 7968884 - DNA, 22 bp, Homo sapiens
cttgccttcagtccatcagtca

SEQ ID NO: 7968885 - DNA, 22 bp, Homo sapiens
cttgccttcagtgtccctttgc

SEQ ID NO: 7968886 - DNA, 22 bp, Homo sapiens
cttgccttcagtccatcagtca

SEQ ID NO: 7968887 - DNA, 22 bp, Homo sapiens
cttgccttctgttcctatagaa

SEQ ID NO: 7968888 - DNA, 22 bp, Homo sapiens
cttgccttctctggggtggcag

SEQ ID NO: 7968889 - DNA, 22 bp, Homo sapiens
cttgctctgggaagaaaaagtc

SEQ ID NO: 7968890 - DNA, 22 bp, Homo sapiens
cttgctctgggaagaaaaagtc

SEQ ID NO: 7968891 - DNA, 22 bp, Homo sapiens
cttgctctttgatgaattttcc

SEQ ID NO: 7968892 - DNA, 22 bp, Homo sapiens
cttgctcttttcactgtaatat

SEQ ID NO: 7968893 - DNA, 22 bp, Homo sapiens
cttgctctagatgttcagagct

SEQ ID NO: 7968894 - DNA, 22 bp, Homo sapiens
cttgctcattaagtagctcaca

SEQ ID NO: 7968895 - DNA, 22 bp, Homo sapiens
cttgcctttgtcttcaaaggct

SEQ ID NO: 7968896 - DNA, 22 bp, Homo sapiens
cttgctcacagtacctggcttg

SEQ ID NO: 7968897 - DNA, 22 bp, Homo sapiens
cttgctgctgcatctgagcatg

SEQ ID NO: 7968898 - DNA, 22 bp, Homo sapiens
cttgctgctgcatctgagcatg

SEQ ID NO: 7968899 - DNA, 22 bp, Homo sapiens
cttgctgctgcatctgagcatg

SEQ ID NO: 7968900 - DNA, 22 bp, Homo sapiens
cttgctgcttgtaagtaaaaca

SEQ ID NO: 7968901 - DNA, 22 bp, Homo sapiens
cttgctggaaactctctctgcc

SEQ ID NO: 7968902 - DNA, 22 bp, Homo sapiens
cttgctggaaactctctctgcc

SEQ ID NO: 7968903 - DNA, 22 bp, Homo sapiens
cttgctggagcggagcgggtgt

SEQ ID NO: 7968904 - DNA, 22 bp, Homo sapiens
cttgcctgtggctagttggctc

SEQ ID NO: 7968905 - DNA, 19 bp, Homo sapiens
cttgcctgttcctacagct

SEQ ID NO: 7968906 - DNA, 19 bp, Homo sapiens
cttgcctgttcctacagct

SEQ ID NO: 7968907 - DNA, 22 bp, Homo sapiens
cttgcctgggactgaggcattt

SEQ ID NO: 7968908 - DNA, 23 bp, Homo sapiens
cttgcctggcctctctgcccaga

SEQ ID NO: 7968909 - DNA, 22 bp, Homo sapiens
cttgcctgctggagcagggctc

SEQ ID NO: 7968910 - DNA, 22 bp, Homo sapiens
cttgatctacatagtgaaaccc

SEQ ID NO: 7968911 - DNA, 23 bp, Homo sapiens
cttgcctggcctctctgcccaga

SEQ ID NO: 7968912 - DNA, 22 bp, Homo sapiens
cttgatcctaggatggaaggga

SEQ ID NO: 7968913 - DNA, 22 bp, Homo sapiens
cttgatcattcactggctctgt

SEQ ID NO: 7968914 - DNA, 22 bp, Homo sapiens
cttgatctacatagtgaaaccc

SEQ ID NO: 7968915 - DNA, 22 bp, Homo sapiens
cttgatcattcactggctctgt

SEQ ID NO: 7968916 - DNA, 22 bp, Homo sapiens
atctattatgctgagaaactgt

SEQ ID NO: 7968917 - DNA, 22 bp, Homo sapiens
cttgatattttaaacatacagt

SEQ ID NO: 7968918 - DNA, 22 bp, Homo sapiens
atctatatcatggggtaaggta

SEQ ID NO: 7968919 - DNA, 22 bp, Homo sapiens
atctaggtttggaagatagagt

SEQ ID NO: 7968920 - DNA, 22 bp, Homo sapiens
atctaggatttgaatgcacagt

SEQ ID NO: 7968921 - DNA, 22 bp, Homo sapiens
atctagggtgtaggtcactgat

SEQ ID NO: 7968922 - DNA, 22 bp, Homo sapiens
atctatacccatcatgatttaa

SEQ ID NO: 7968923 - DNA, 22 bp, Homo sapiens
atctatgtgcctttgtatagaa

SEQ ID NO: 7968924 - DNA, 22 bp, Homo sapiens
atctatgtgcctttgtatagaa

SEQ ID NO: 7968925 - DNA, 22 bp, Homo sapiens
atctatccagcgccaggcagag

SEQ ID NO: 7968926 - DNA, 22 bp, Homo sapiens
atctatcccagtttaactcatt

SEQ ID NO: 7968927 - DNA, 22 bp, Homo sapiens
cttgagtattttaatccataat

SEQ ID NO: 7968928 - DNA, 22 bp, Homo sapiens
atctattatgctgagaaactgt

SEQ ID NO: 7968929 - DNA, 22 bp, Homo sapiens
cttgagtcatataaagacagag

SEQ ID NO: 7968930 - DNA, 22 bp, Homo sapiens
cttgagtcatataaagacagag

SEQ ID NO: 7968931 - DNA, 22 bp, Homo sapiens
atctagattaggtataagagct

SEQ ID NO: 7968932 - DNA, 22 bp, Homo sapiens
atctagattaggtataagagct

SEQ ID NO: 7968933 - DNA, 22 bp, Homo sapiens
atctagattaactggctgtctt

SEQ ID NO: 7968934 - DNA, 22 bp, Homo sapiens
atctagattaggtataagagct

SEQ ID NO: 7968935 - DNA, 22 bp, Homo sapiens
atctagattaggtataagagct

SEQ ID NO: 7968936 - DNA, 19 bp, Homo sapiens
atctagattattgagaagg

SEQ ID NO: 7968937 - DNA, 22 bp, Homo sapiens
atctaggatttgaatgcacagt

SEQ ID NO: 7968938 - DNA, 22 bp, Homo sapiens
atctaggatttgaatgcacagt

SEQ ID NO: 7968939 - DNA, 22 bp, Homo sapiens
atctagcagtgttataattgga

SEQ ID NO: 7968940 - DNA, 22 bp, Homo sapiens
atctagcaccaaactagctttt

SEQ ID NO: 7968941 - DNA, 19 bp, Homo sapiens
atctagattattgagaagg

SEQ ID NO: 7968942 - DNA, 19 bp, Homo sapiens
atctagattattgagaagg

SEQ ID NO: 7968943 - DNA, 22 bp, Homo sapiens
atctagaagtggcatgaattac

SEQ ID NO: 7968944 - DNA, 22 bp, Homo sapiens
atctagaagtggcatgaattac

SEQ ID NO: 7968945 - DNA, 22 bp, Homo sapiens
atctagaagtcatggctttctt

SEQ ID NO: 7968946 - DNA, 22 bp, Homo sapiens
atctagaagtggcatgaattac

SEQ ID NO: 7968947 - DNA, 21 bp, Homo sapiens
atctagaatctctctccccac

SEQ ID NO: 7968948 - DNA, 21 bp, Homo sapiens
atctagaatctctctccccac

SEQ ID NO: 7968949 - DNA, 21 bp, Homo sapiens
atctagaatctctctccccac

SEQ ID NO: 7968950 - DNA, 22 bp, Homo sapiens
atctagacatctgaaacattta

SEQ ID NO: 7968951 - DNA, 22 bp, Homo sapiens
atctagaggagggctgctggat

SEQ ID NO: 7968952 - DNA, 22 bp, Homo sapiens
atctagaggcaatgaaggaggt

SEQ ID NO: 7968953 - DNA, 22 bp, Homo sapiens
atctagattaggtataagagct

SEQ ID NO: 7968954 - DNA, 22 bp, Homo sapiens
atctagaggcaatgaaggaggt

SEQ ID NO: 7968955 - DNA, 22 bp, Homo sapiens
atctagaggcaatgaaggaggt

SEQ ID NO: 7968956 - DNA, 22 bp, Homo sapiens
atctagatggaattgtatatag

SEQ ID NO: 7968957 - DNA, 22 bp, Homo sapiens
atctagatggaattgtatatag

SEQ ID NO: 7968958 - DNA, 22 bp, Homo sapiens
atctagaacaattattgtcaca

SEQ ID NO: 7968959 - DNA, 22 bp, Homo sapiens
atctagaacttaaagtcagtca

SEQ ID NO: 7968960 - DNA, 22 bp, Homo sapiens
atctagaacttaaagtcagtca

SEQ ID NO: 7968961 - DNA, 22 bp, Homo sapiens
atctagaacttaaagtcagtca

SEQ ID NO: 7968962 - DNA, 22 bp, Homo sapiens
atctagaagcctgagccaagat

SEQ ID NO: 7968963 - DNA, 22 bp, Homo sapiens
atctagaagcctgagccaagat

SEQ ID NO: 7968964 - DNA, 22 bp, Homo sapiens
atctagaagcctgagccaagat

SEQ ID NO: 7968965 - DNA, 22 bp, Homo sapiens
atctagaagtcatggctttctt

SEQ ID NO: 7968966 - DNA, 22 bp, Homo sapiens
atctagaagtcatggctttctt

SEQ ID NO: 7968967 - DNA, 22 bp, Homo sapiens
atctagaagtcatggctttctt

SEQ ID NO: 7968968 - DNA, 22 bp, Homo sapiens
atctagaagtggcatgaattac

SEQ ID NO: 7968969 - DNA, 22 bp, Homo sapiens
atctagaagtggcatgaattac

SEQ ID NO: 7968970 - DNA, 22 bp, Homo sapiens
atctagaaagccaggggcctgc

SEQ ID NO: 7968971 - DNA, 22 bp, Homo sapiens
atctagaaagtgttgaagatca

SEQ ID NO: 7968972 - DNA, 22 bp, Homo sapiens
atctagaaagccaggggcctgc

SEQ ID NO: 7968973 - DNA, 22 bp, Homo sapiens
atctagaaagccaggggcctgc

SEQ ID NO: 7968974 - DNA, 22 bp, Homo sapiens
atctagaaagccaggggcctgc

SEQ ID NO: 7968975 - DNA, 23 bp, Homo sapiens
atctagaaacctgatgactctgt

SEQ ID NO: 7968976 - DNA, 23 bp, Homo sapiens
atctagaaacctgatgactctgt

SEQ ID NO: 7968977 - DNA, 23 bp, Homo sapiens
atctagaaacctgatgactctgt

SEQ ID NO: 7968978 - DNA, 22 bp, Homo sapiens
atctagaaagtgttgaagatca

SEQ ID NO: 7968979 - DNA, 22 bp, Homo sapiens
atctagaaagtgttgaagatca

SEQ ID NO: 7968980 - DNA, 22 bp, Homo sapiens
atctagaacaattattgtcaca

SEQ ID NO: 7968981 - DNA, 22 bp, Homo sapiens
atctagaacaattattgtcaca

SEQ ID NO: 7968982 - DNA, 22 bp, Homo sapiens
atctagaacaattattgtcaca

SEQ ID NO: 7968983 - DNA, 22 bp, Homo sapiens
atctagaacaattattgtcaca

SEQ ID NO: 7968984 - DNA, 22 bp, Homo sapiens
atctagaaaaggtgactaaaat

SEQ ID NO: 7968985 - DNA, 22 bp, Homo sapiens
atctagaaaaggtgactaaaat

SEQ ID NO: 7968986 - DNA, 22 bp, Homo sapiens
atctagaaaaggtgactaaaat

SEQ ID NO: 7968987 - DNA, 22 bp, Homo sapiens
atctactttacaaatcatctcc

SEQ ID NO: 7968988 - DNA, 22 bp, Homo sapiens
atctacccactgaacacaatat

SEQ ID NO: 7968989 - DNA, 22 bp, Homo sapiens
atctacatgttgatttaaagaa

SEQ ID NO: 7968990 - DNA, 22 bp, Homo sapiens
atctacatgttgatttaaagaa

SEQ ID NO: 7968991 - DNA, 22 bp, Homo sapiens
atctacataaaacgaatacata

SEQ ID NO: 7968992 - DNA, 22 bp, Homo sapiens
atctacaggattttacagagtt

SEQ ID NO: 7968993 - DNA, 22 bp, Homo sapiens
atctacagtgcacaggacagcc

SEQ ID NO: 7968994 - DNA, 22 bp, Homo sapiens
atctacataaaacgaatacata

SEQ ID NO: 7968995 - DNA, 22 bp, Homo sapiens
atctacaggattttacagagtt

SEQ ID NO: 7968996 - DNA, 22 bp, Homo sapiens
atctacaggatagtttaatatt

SEQ ID NO: 7968997 - DNA, 22 bp, Homo sapiens
atctacaggaagagaaagggcc

SEQ ID NO: 7968998 - DNA, 22 bp, Homo sapiens
atctacaggatagtttaatatt

SEQ ID NO: 7968999 - DNA, 22 bp, Homo sapiens
atctacagctgtctgcacagta

SEQ ID NO: 7969000 - DNA, 22 bp, Homo sapiens
atctacagctgtctgcacagta

SEQ ID NO: 7969001 - DNA, 19 bp, Homo sapiens
atctacaattattctcagt

SEQ ID NO: 7969002 - DNA, 22 bp, Homo sapiens
atctacagcagtgccaggtagc

SEQ ID NO: 7969003 - DNA, 22 bp, Homo sapiens
atctacactataacagaatgct

SEQ ID NO: 7969004 - DNA, 22 bp, Homo sapiens
atctacagcagtgccaggtagc

SEQ ID NO: 7969005 - DNA, 22 bp, Homo sapiens
atctacagccagtctggtttgt

SEQ ID NO: 7969006 - DNA, 22 bp, Homo sapiens
cttggcagagggctgggctcag

SEQ ID NO: 7969007 - DNA, 22 bp, Homo sapiens
cttgctggggtaagtctgtgct

SEQ ID NO: 7969008 - DNA, 22 bp, Homo sapiens
cttgctggggtaagtctgtgct

SEQ ID NO: 7969009 - DNA, 22 bp, Homo sapiens
cttgctggagcggagcgggtgt

SEQ ID NO: 7969010 - DNA, 22 bp, Homo sapiens
cttgctggcagtcactgttgcg

SEQ ID NO: 7969011 - DNA, 22 bp, Homo sapiens
cttgctggagcggagcgggtgt

SEQ ID NO: 7969012 - DNA, 22 bp, Homo sapiens
cttgctggcagtcactgttgcg

SEQ ID NO: 7969013 - DNA, 22 bp, Homo sapiens
cttgctggcagtcactgttgcg

SEQ ID NO: 7969014 - DNA, 22 bp, Homo sapiens
cttgctggctggcaacctgggc

SEQ ID NO: 7969015 - DNA, 22 bp, Homo sapiens
cttggcagtttcggaaggatga

SEQ ID NO: 7969016 - DNA, 22 bp, Homo sapiens
cttggcagggtggaggatgcag

SEQ ID NO: 7969017 - DNA, 19 bp, Homo sapiens
cttggcatctgtgaagtga

SEQ ID NO: 7969018 - DNA, 19 bp, Homo sapiens
cttggcatctgtgaagtga

SEQ ID NO: 7969019 - DNA, 22 bp, Homo sapiens
cttggcatgcagcaggcactca

SEQ ID NO: 7969020 - DNA, 22 bp, Homo sapiens
cttggcatgcagcaggcactca

SEQ ID NO: 7969021 - DNA, 22 bp, Homo sapiens
cttggcatgcagcaggcactca

SEQ ID NO: 7969022 - DNA, 22 bp, Homo sapiens
cttggcattttgctctgatatg

SEQ ID NO: 7969023 - DNA, 22 bp, Homo sapiens
cttggcattgtgttgatagaag

SEQ ID NO: 7969024 - DNA, 22 bp, Homo sapiens
cttggccagacagggagctcca

SEQ ID NO: 7969025 - DNA, 22 bp, Homo sapiens
cttggccagacagggagctcca

SEQ ID NO: 7969026 - DNA, 22 bp, Homo sapiens
cttggcccagttgccaaggaaa

SEQ ID NO: 7969027 - DNA, 22 bp, Homo sapiens
cttggcccggagccccatgaag

SEQ ID NO: 7969028 - DNA, 22 bp, Homo sapiens
cttggcccagttgccaaggaaa

SEQ ID NO: 7969029 - DNA, 22 bp, Homo sapiens
cttggcctcttctcagggtggg

SEQ ID NO: 7969030 - DNA, 22 bp, Homo sapiens
cttggcctgtggctcaagaatt

SEQ ID NO: 7969031 - DNA, 22 bp, Homo sapiens
cttggctccaatcccagctctg

SEQ ID NO: 7969032 - DNA, 22 bp, Homo sapiens
cttggctccaatcccagctctg

SEQ ID NO: 7969033 - DNA, 22 bp, Homo sapiens
cttggctccttcacagggagat

SEQ ID NO: 7969034 - DNA, 22 bp, Homo sapiens
cttggctccaatcccagctctg

SEQ ID NO: 7969035 - DNA, 22 bp, Homo sapiens
cttggctccttcacagggagat

SEQ ID NO: 7969036 - DNA, 22 bp, Homo sapiens
cttggcctgggccgcagccact

SEQ ID NO: 7969037 - DNA, 22 bp, Homo sapiens
cttggcctgacatgtggcaggg

SEQ ID NO: 7969038 - DNA, 22 bp, Homo sapiens
cttggctgaactccaggatgca

SEQ ID NO: 7969039 - DNA, 22 bp, Homo sapiens
cttggctcgtacccggggcagg

SEQ ID NO: 7969040 - DNA, 22 bp, Homo sapiens
cttgggtgttttaaaactagat

SEQ ID NO: 7969041 - DNA, 22 bp, Homo sapiens
cttgggtgtgaccttggcattg

SEQ ID NO: 7969042 - DNA, 22 bp, Homo sapiens
cttgggtgttttaaaactagat

SEQ ID NO: 7969043 - DNA, 22 bp, Homo sapiens
cttggtaaaactgtcttaaatt

SEQ ID NO: 7969044 - DNA, 22 bp, Homo sapiens
cttggtcaaatgcaggcttccc

SEQ ID NO: 7969045 - DNA, 18 bp, Homo sapiens
cttggtaagtaaaacagc

SEQ ID NO: 7969046 - DNA, 22 bp, Homo sapiens
cttggtaaattgtcttataaat

SEQ ID NO: 7969047 - DNA, 22 bp, Homo sapiens
cttggtcatcgataattgaatc

SEQ ID NO: 7969048 - DNA, 22 bp, Homo sapiens
cttggtcacagttcccaacatt

SEQ ID NO: 7969049 - DNA, 22 bp, Homo sapiens
cttggtcatgcaagatatcgat

SEQ ID NO: 7969050 - DNA, 22 bp, Homo sapiens
cttggtccgagggcgcctaggc

SEQ ID NO: 7969051 - DNA, 22 bp, Homo sapiens
cttgtaaatgcagattctgatt

SEQ ID NO: 7969052 - DNA, 22 bp, Homo sapiens
cttgtaaatgcagattctgatt

SEQ ID NO: 7969053 - DNA, 19 bp, Homo sapiens
cttgtaaagggctgtttct

SEQ ID NO: 7969054 - DNA, 19 bp, Homo sapiens
cttgtaaagggctgtttct

SEQ ID NO: 7969055 - DNA, 22 bp, Homo sapiens
cttgtaaatgcagattctgatt

SEQ ID NO: 7969056 - DNA, 22 bp, Homo sapiens
cttgtaaacttgagcagggcat

SEQ ID NO: 7969057 - DNA, 19 bp, Homo sapiens
cttggttatggtatgatgc

SEQ ID NO: 7969058 - DNA, 22 bp, Homo sapiens
cttggtttacctaaacaatagg

SEQ ID NO: 7969059 - DNA, 22 bp, Homo sapiens
cttgtaaaaggtacattatgct

SEQ ID NO: 7969060 - DNA, 22 bp, Homo sapiens
cttggtgcccagcaggtggctg

SEQ ID NO: 7969061 - DNA, 20 bp, Homo sapiens
cttggtggctctgggaagtg

SEQ ID NO: 7969062 - DNA, 20 bp, Homo sapiens
cttggtggctctgggaagtg

SEQ ID NO: 7969063 - DNA, 22 bp, Homo sapiens
cttggttatactccaggaacca

SEQ ID NO: 7969064 - DNA, 16 bp, Homo sapiens
cttggtgttggcagag

SEQ ID NO: 7969065 - DNA, 22 bp, Homo sapiens
cttggtctctttaccggagtgt

SEQ ID NO: 7969066 - DNA, 22 bp, Homo sapiens
cttggtcttgggagcagggaca

SEQ ID NO: 7969067 - DNA, 22 bp, Homo sapiens
cttggtgcattactcaatctgt

SEQ ID NO: 7969068 - DNA, 22 bp, Homo sapiens
cttggtgagactcccacccacc

SEQ ID NO: 7969069 - DNA, 22 bp, Homo sapiens
cttggtcctgcagggtctcttg

SEQ ID NO: 7969070 - DNA, 22 bp, Homo sapiens
cttgtacactcagtacttctag

SEQ ID NO: 7969071 - DNA, 22 bp, Homo sapiens
cttgtacactcagtacttctag

SEQ ID NO: 7969072 - DNA, 22 bp, Homo sapiens
atcttcctttgccatgggatag

SEQ ID NO: 7969073 - DNA, 22 bp, Homo sapiens
cttgtaatagataggatcaaat

SEQ ID NO: 7969074 - DNA, 22 bp, Homo sapiens
cttgtacaagtcagtgctgggg

SEQ ID NO: 7969075 - DNA, 22 bp, Homo sapiens
atcttctcatgtgtaatgaggt

SEQ ID NO: 7969076 - DNA, 22 bp, Homo sapiens
atcttctcaagcagcatcctgt

SEQ ID NO: 7969077 - DNA, 22 bp, Homo sapiens
atcttctcaagcagcatcctgt

SEQ ID NO: 7969078 - DNA, 22 bp, Homo sapiens
atcttctcatgtgtaatgaggt

SEQ ID NO: 7969079 - DNA, 22 bp, Homo sapiens
atcttctatagatattctgaag

SEQ ID NO: 7969080 - DNA, 22 bp, Homo sapiens
cttgtaactcctatttactatg

SEQ ID NO: 7969081 - DNA, 22 bp, Homo sapiens
atcttctatagatattctgaag

SEQ ID NO: 7969082 - DNA, 22 bp, Homo sapiens
atcttctatagatattctgaag

SEQ ID NO: 7969083 - DNA, 22 bp, Homo sapiens
atcttctcaagcagcatcctgt

SEQ ID NO: 7969084 - DNA, 22 bp, Homo sapiens
atcttgaaatactttctagaat

SEQ ID NO: 7969085 - DNA, 22 bp, Homo sapiens
atcttgaaatactttctagaat

SEQ ID NO: 7969086 - DNA, 22 bp, Homo sapiens
atcttgaaatactttctagaat

SEQ ID NO: 7969087 - DNA, 22 bp, Homo sapiens
atcttgaaaagcagcatggcct

SEQ ID NO: 7969088 - DNA, 22 bp, Homo sapiens
atcttgaaggttctaccataca

SEQ ID NO: 7969089 - DNA, 22 bp, Homo sapiens
atcttgaaggttctaccataca

SEQ ID NO: 7969090 - DNA, 22 bp, Homo sapiens
atcttctgggcagtgaaaattg

SEQ ID NO: 7969091 - DNA, 22 bp, Homo sapiens
atcttctgggcagtgaaaattg

SEQ ID NO: 7969092 - DNA, 22 bp, Homo sapiens
atcttctggtcaaatttttgca

SEQ ID NO: 7969093 - DNA, 22 bp, Homo sapiens
atcttcttcaaggatctggagc

SEQ ID NO: 7969094 - DNA, 22 bp, Homo sapiens
atcttctggtcaaatttttgca

SEQ ID NO: 7969095 - DNA, 20 bp, Homo sapiens
atcttcttggccagcttgct

SEQ ID NO: 7969096 - DNA, 22 bp, Homo sapiens
atcttcttcaaggatctggagc

SEQ ID NO: 7969097 - DNA, 22 bp, Homo sapiens
atcttcttcaaggatctggagc

SEQ ID NO: 7969098 - DNA, 20 bp, Homo sapiens
atcttcttggccagcttgct

SEQ ID NO: 7969099 - DNA, 22 bp, Homo sapiens
gagaaatgcatgcatgtcatca

SEQ ID NO: 7969100 - DNA, 22 bp, Homo sapiens
gagaaatatggctcagttccac

SEQ ID NO: 7969101 - DNA, 22 bp, Homo sapiens
gagaaatgagtgattcactttt

SEQ ID NO: 7969102 - DNA, 22 bp, Homo sapiens
gagaaatgagtgattcactttt

SEQ ID NO: 7969103 - DNA, 22 bp, Homo sapiens
gagaaatgagtgattcactttt

SEQ ID NO: 7969104 - DNA, 22 bp, Homo sapiens
gagaaatgagtgattcactttt

SEQ ID NO: 7969105 - DNA, 22 bp, Homo sapiens
gagaaatgagtgattcactttt

SEQ ID NO: 7969106 - DNA, 22 bp, Homo sapiens
gagaacacatgcagactgggta

SEQ ID NO: 7969107 - DNA, 22 bp, Homo sapiens
gagaaatgcatgcatgtcatca

SEQ ID NO: 7969108 - DNA, 22 bp, Homo sapiens
gagaacaaggaagagtcggcag

SEQ ID NO: 7969109 - DNA, 22 bp, Homo sapiens
gagaaatgctagcttaggaatc

SEQ ID NO: 7969110 - DNA, 22 bp, Homo sapiens
gagaaatgctagcttaggaatc

SEQ ID NO: 7969111 - DNA, 22 bp, Homo sapiens
gagaaatgctagcttaggaatc

SEQ ID NO: 7969112 - DNA, 22 bp, Homo sapiens
gagaaatgcatgcatgtcatca

SEQ ID NO: 7969113 - DNA, 22 bp, Homo sapiens
atggaggatgtgcagcatgggc

SEQ ID NO: 7969114 - DNA, 22 bp, Homo sapiens
gagaaagggataatttgaagag

SEQ ID NO: 7969115 - DNA, 22 bp, Homo sapiens
gagaaagggataatttgaagag

SEQ ID NO: 7969116 - DNA, 22 bp, Homo sapiens
gagaaaggtactattccctcca

SEQ ID NO: 7969117 - DNA, 22 bp, Homo sapiens
gagaaaggtactattccctcca

SEQ ID NO: 7969118 - DNA, 22 bp, Homo sapiens
gagaaaggtactattccctcca

SEQ ID NO: 7969119 - DNA, 22 bp, Homo sapiens
gagaaatagattcatggtagat

SEQ ID NO: 7969120 - DNA, 22 bp, Homo sapiens
gagaaatagattcatggtagat

SEQ ID NO: 7969121 - DNA, 22 bp, Homo sapiens
gagaaaggtactattccctcca

SEQ ID NO: 7969122 - DNA, 22 bp, Homo sapiens
gagaaataggcaatggtatcta

SEQ ID NO: 7969123 - DNA, 22 bp, Homo sapiens
gagaaataggcaatggtatcta

SEQ ID NO: 7969124 - DNA, 22 bp, Homo sapiens
gagaaataggcaatggtatcta

SEQ ID NO: 7969125 - DNA, 22 bp, Homo sapiens
gagaaatatggctcagttccac

SEQ ID NO: 7969126 - DNA, 22 bp, Homo sapiens
gagaaatatggctcagttccac

SEQ ID NO: 7969127 - DNA, 20 bp, Homo sapiens
atggaggaagggcaagagaa

SEQ ID NO: 7969128 - DNA, 20 bp, Homo sapiens
atggaggaagggcaagagaa

SEQ ID NO: 7969129 - DNA, 20 bp, Homo sapiens
atggaggaagggcaagagaa

SEQ ID NO: 7969130 - DNA, 20 bp, Homo sapiens
atggaggaagggcaagagaa

SEQ ID NO: 7969131 - DNA, 20 bp, Homo sapiens
atggaggaagggcaagagaa

SEQ ID NO: 7969132 - DNA, 20 bp, Homo sapiens
atggaggaagggcaagagaa

SEQ ID NO: 7969133 - DNA, 22 bp, Homo sapiens
atggagctgtagggagcagtgg

SEQ ID NO: 7969134 - DNA, 22 bp, Homo sapiens
atggagctgtgtgaatattcat

SEQ ID NO: 7969135 - DNA, 22 bp, Homo sapiens
atggagctgtgtgaatattcat

SEQ ID NO: 7969136 - DNA, 22 bp, Homo sapiens
atggagctctgatatatcaatt

SEQ ID NO: 7969137 - DNA, 22 bp, Homo sapiens
atggagctaaattgtaatcata

SEQ ID NO: 7969138 - DNA, 21 bp, Homo sapiens
atggagcctaagagtggaggt

SEQ ID NO: 7969139 - DNA, 22 bp, Homo sapiens
atggagccattcctgaagactt

SEQ ID NO: 7969140 - DNA, 22 bp, Homo sapiens
atggagcaaatggggctgcagg

SEQ ID NO: 7969141 - DNA, 22 bp, Homo sapiens
atggagcagcagaaggggcttg

SEQ ID NO: 7969142 - DNA, 22 bp, Homo sapiens
atggagcagcagaaggggcttg

SEQ ID NO: 7969143 - DNA, 22 bp, Homo sapiens
atggagcaaatggggctgcagg

SEQ ID NO: 7969144 - DNA, 22 bp, Homo sapiens
atggagagtgaaagtctctcta

SEQ ID NO: 7969145 - DNA, 22 bp, Homo sapiens
atggagagttcacttctaagtt

SEQ ID NO: 7969146 - DNA, 22 bp, Homo sapiens
atggagagttcacttctaagtt

SEQ ID NO: 7969147 - DNA, 22 bp, Homo sapiens
atggagagtgaaagtctctcta

SEQ ID NO: 7969148 - DNA, 22 bp, Homo sapiens
atggagagagaaggcttgctgt

SEQ ID NO: 7969149 - DNA, 22 bp, Homo sapiens
atggagagtgaaagtctctcta

SEQ ID NO: 7969150 - DNA, 22 bp, Homo sapiens
atggagagagaaggcttgctgt

SEQ ID NO: 7969151 - DNA, 22 bp, Homo sapiens
atggagacgcaagggacctagg

SEQ ID NO: 7969152 - DNA, 22 bp, Homo sapiens
atggaagcagacaggtaattcc

SEQ ID NO: 7969153 - DNA, 22 bp, Homo sapiens
atggaagagtccccatggatga

SEQ ID NO: 7969154 - DNA, 22 bp, Homo sapiens
atggaagagtccccatggatga

SEQ ID NO: 7969155 - DNA, 22 bp, Homo sapiens
atggaagctgaaaaagacacgg

SEQ ID NO: 7969156 - DNA, 22 bp, Homo sapiens
atggaagctgaaaaagacacgg

SEQ ID NO: 7969157 - DNA, 22 bp, Homo sapiens
atggaaggctttatgactcaaa

SEQ ID NO: 7969158 - DNA, 19 bp, Homo sapiens
atggaagctgggatcaatg

SEQ ID NO: 7969159 - DNA, 20 bp, Homo sapiens
atggaagctgctcttctcct

SEQ ID NO: 7969160 - DNA, 23 bp, Homo sapiens
atggaagtcactgttttcttgtc

SEQ ID NO: 7969161 - DNA, 22 bp, Homo sapiens
atggaagtgcaacttgctcatc

SEQ ID NO: 7969162 - DNA, 23 bp, Homo sapiens
atggaagtcactgttttcttgtc

SEQ ID NO: 7969163 - DNA, 22 bp, Homo sapiens
atggaaggtcctacagagcgca

SEQ ID NO: 7969164 - DNA, 22 bp, Homo sapiens
atggaagggacagaagggcaag

SEQ ID NO: 7969165 - DNA, 22 bp, Homo sapiens
atggaagggacagaagggcaag

SEQ ID NO: 7969166 - DNA, 22 bp, Homo sapiens
atggaagggacagaagggcaag

SEQ ID NO: 7969167 - DNA, 22 bp, Homo sapiens
atggaagagtccccatggatga

SEQ ID NO: 7969168 - DNA, 22 bp, Homo sapiens
atggaagagtccccatggatga

SEQ ID NO: 7969169 - DNA, 22 bp, Homo sapiens
atggaagactaacagaaacatg

SEQ ID NO: 7969170 - DNA, 22 bp, Homo sapiens
atggaagactaacagaaacatg

SEQ ID NO: 7969171 - DNA, 22 bp, Homo sapiens
atggaagactaacagaaacatg

SEQ ID NO: 7969172 - DNA, 22 bp, Homo sapiens
atggaagaacgctcagggttac

SEQ ID NO: 7969173 - DNA, 22 bp, Homo sapiens
atggaagacagataaggcagaa

SEQ ID NO: 7969174 - DNA, 22 bp, Homo sapiens
atggaagacagataaggcagaa

SEQ ID NO: 7969175 - DNA, 22 bp, Homo sapiens
atggactgggaggtcatcttct

SEQ ID NO: 7969176 - DNA, 22 bp, Homo sapiens
atggactctggaggagatagag

SEQ ID NO: 7969177 - DNA, 22 bp, Homo sapiens
atggacatttgagttatttcca

SEQ ID NO: 7969178 - DNA, 22 bp, Homo sapiens
atggaccagagcctcattctgt

SEQ ID NO: 7969179 - DNA, 22 bp, Homo sapiens
atggaccatgagttttctctgg

SEQ ID NO: 7969180 - DNA, 22 bp, Homo sapiens
atggactcactaattcctccac

SEQ ID NO: 7969181 - DNA, 22 bp, Homo sapiens
atggacatttgagttatttcca

SEQ ID NO: 7969182 - DNA, 22 bp, Homo sapiens
atggacatttgagttatttcca

SEQ ID NO: 7969183 - DNA, 22 bp, Homo sapiens
atggaagttggaaccattcata

SEQ ID NO: 7969184 - DNA, 22 bp, Homo sapiens
atggaagttggaaccattcata

SEQ ID NO: 7969185 - DNA, 22 bp, Homo sapiens
atggaataattgtttcacagaa

SEQ ID NO: 7969186 - DNA, 22 bp, Homo sapiens
atggaataattgtttcacagaa

SEQ ID NO: 7969187 - DNA, 22 bp, Homo sapiens
atggaatatttgacacataggg

SEQ ID NO: 7969188 - DNA, 22 bp, Homo sapiens
atggaatatagtcttatatctc

SEQ ID NO: 7969189 - DNA, 22 bp, Homo sapiens
atggaatatagtcttatatctc

SEQ ID NO: 7969190 - DNA, 22 bp, Homo sapiens
atggaataggctgctctttaaa

SEQ ID NO: 7969191 - DNA, 22 bp, Homo sapiens
atggaatatttgacacataggg

SEQ ID NO: 7969192 - DNA, 22 bp, Homo sapiens
atggaatgaaaaacacatgcaa

SEQ ID NO: 7969193 - DNA, 22 bp, Homo sapiens
atggaatgccaagttcactgct

SEQ ID NO: 7969194 - DNA, 22 bp, Homo sapiens
atggaatgcggtagtatgtgca

SEQ ID NO: 7969195 - DNA, 22 bp, Homo sapiens
atggaatgggaagagtgtgtga

SEQ ID NO: 7969196 - DNA, 22 bp, Homo sapiens
atggaatggcctgtcataatct

SEQ ID NO: 7969197 - DNA, 22 bp, Homo sapiens
atggaatggcctgtcataatct

SEQ ID NO: 7969198 - DNA, 22 bp, Homo sapiens
atgccactgcgctctagcctgg

SEQ ID NO: 7969199 - DNA, 22 bp, Homo sapiens
atgccactgcgctctagcctgg

SEQ ID NO: 7969200 - DNA, 22 bp, Homo sapiens
atgccactgcgctccagcctgg

SEQ ID NO: 7969201 - DNA, 22 bp, Homo sapiens
atgccactgcgctccagcctgg

SEQ ID NO: 7969202 - DNA, 22 bp, Homo sapiens
atgccactgcgctctagcctgg

SEQ ID NO: 7969203 - DNA, 22 bp, Homo sapiens
atgccactgcgctctagcctgg

SEQ ID NO: 7969204 - DNA, 22 bp, Homo sapiens
atgccactgcgctctagcctgg

SEQ ID NO: 7969205 - DNA, 22 bp, Homo sapiens
atgccacttcattccagcctcg

SEQ ID NO: 7969206 - DNA, 22 bp, Homo sapiens
atgccacttcattccagcctcg

SEQ ID NO: 7969207 - DNA, 22 bp, Homo sapiens
atgccacttcattccagcctcg

SEQ ID NO: 7969208 - DNA, 22 bp, Homo sapiens
atggaaaaggctgatttcatta

SEQ ID NO: 7969209 - DNA, 22 bp, Homo sapiens
atgccacttcattccagcctcg

SEQ ID NO: 7969210 - DNA, 22 bp, Homo sapiens
atgccacttcattccagcctcg

SEQ ID NO: 7969211 - DNA, 22 bp, Homo sapiens
atgccacttcattccagcctcg

SEQ ID NO: 7969212 - DNA, 22 bp, Homo sapiens
atgccacttcattccagcctcg

SEQ ID NO: 7969213 - DNA, 22 bp, Homo sapiens
atggaaatggagggtgctagaa

SEQ ID NO: 7969214 - DNA, 22 bp, Homo sapiens
atggaaatgatggaacattaaa

SEQ ID NO: 7969215 - DNA, 22 bp, Homo sapiens
atggaaatgatggaacattaaa

SEQ ID NO: 7969216 - DNA, 22 bp, Homo sapiens
atggaaatgatggaacattaaa

SEQ ID NO: 7969217 - DNA, 22 bp, Homo sapiens
atggaaaaggctgatttcatta

SEQ ID NO: 7969218 - DNA, 22 bp, Homo sapiens
atggaaatgttccatatattga

SEQ ID NO: 7969219 - DNA, 22 bp, Homo sapiens
atggaaatgttccatatattga

SEQ ID NO: 7969220 - DNA, 22 bp, Homo sapiens
atggaaatgttaagtcagtccg

SEQ ID NO: 7969221 - DNA, 22 bp, Homo sapiens
atggaaatgttccatatattga

SEQ ID NO: 7969222 - DNA, 22 bp, Homo sapiens
atggaaatgttaagtcagtccg

SEQ ID NO: 7969223 - DNA, 22 bp, Homo sapiens
atggaaatgttaagtcagtccg

SEQ ID NO: 7969224 - DNA, 22 bp, Homo sapiens
atggaaattaagatttgtctca

SEQ ID NO: 7969225 - DNA, 22 bp, Homo sapiens
atggaaattaagatttgtctca

SEQ ID NO: 7969226 - DNA, 22 bp, Homo sapiens
atggaaattaagatttgtctca

SEQ ID NO: 7969227 - DNA, 22 bp, Homo sapiens
atggaaatggagtgtgcttgct

SEQ ID NO: 7969228 - DNA, 22 bp, Homo sapiens
atggaaatggagtgtgcttgct

SEQ ID NO: 7969229 - DNA, 22 bp, Homo sapiens
atggaaatgtaacttctgattc

SEQ ID NO: 7969230 - DNA, 22 bp, Homo sapiens
atggaaatgtaacttctgattc

SEQ ID NO: 7969231 - DNA, 22 bp, Homo sapiens
atggaagaaagagacaatttga

SEQ ID NO: 7969232 - DNA, 22 bp, Homo sapiens
atggaactgatcaggagtgcca

SEQ ID NO: 7969233 - DNA, 22 bp, Homo sapiens
atggaacaagaactcagattta

SEQ ID NO: 7969234 - DNA, 21 bp, Homo sapiens
atggaaattggcaaatgctac

SEQ ID NO: 7969235 - DNA, 22 bp, Homo sapiens
atggaacagattaaagtgaggg

SEQ ID NO: 7969236 - DNA, 23 bp, Homo sapiens
gacagagtgagaccttgtcttac

SEQ ID NO: 7969237 - DNA, 23 bp, Homo sapiens
gacagagtgagaccttgtcttac

SEQ ID NO: 7969238 - DNA, 23 bp, Homo sapiens
gacagagtgagaccttgtcttac

SEQ ID NO: 7969239 - DNA, 23 bp, Homo sapiens
gacagagtgagaccttgtcttac

SEQ ID NO: 7969240 - DNA, 23 bp, Homo sapiens
gacagagtgagaccttgtcttac

SEQ ID NO: 7969241 - DNA, 22 bp, Homo sapiens
gacagagtgcagggctagaaga

SEQ ID NO: 7969242 - DNA, 22 bp, Homo sapiens
gacagatggtcagtgttgaagt

SEQ ID NO: 7969243 - DNA, 22 bp, Homo sapiens
gacagatgagggagtattctca

SEQ ID NO: 7969244 - DNA, 23 bp, Homo sapiens
gacagagtgagaccttgtcttac

SEQ ID NO: 7969245 - DNA, 22 bp, Homo sapiens
gacagagtgcagggctagaaga

SEQ ID NO: 7969246 - DNA, 22 bp, Homo sapiens
gacagaggtgtccttgagtcca

SEQ ID NO: 7969247 - DNA, 23 bp, Homo sapiens
gacagagtgagaccttgtcttac

SEQ ID NO: 7969248 - DNA, 23 bp, Homo sapiens
gacagagtgagaccttgtcttac

SEQ ID NO: 7969249 - DNA, 23 bp, Homo sapiens
gacagagtgagaccttgtcttac

SEQ ID NO: 7969250 - DNA, 23 bp, Homo sapiens
gacagagtgagaccttgtcttac

SEQ ID NO: 7969251 - DNA, 22 bp, Homo sapiens
gacagaggctggagcacctcct

SEQ ID NO: 7969252 - DNA, 22 bp, Homo sapiens
gacagaggctggagcacctcct

SEQ ID NO: 7969253 - DNA, 22 bp, Homo sapiens
gacagaggcaagaccagaagcc

SEQ ID NO: 7969254 - DNA, 22 bp, Homo sapiens
gacagaggcaagaccagaagcc

SEQ ID NO: 7969255 - DNA, 22 bp, Homo sapiens
gacagcaaagcagagccaaggc

SEQ ID NO: 7969256 - DNA, 22 bp, Homo sapiens
gacagatgtgggtgacagcagc

SEQ ID NO: 7969257 - DNA, 22 bp, Homo sapiens
gacagatgtgggtgacagcagc

SEQ ID NO: 7969258 - DNA, 22 bp, Homo sapiens
gacagatggtcagtgttgaagt

SEQ ID NO: 7969259 - DNA, 22 bp, Homo sapiens
gacagatgtgggtgacagcagc

SEQ ID NO: 7969260 - DNA, 22 bp, Homo sapiens
gacagcaacctcatgagaaact

SEQ ID NO: 7969261 - DNA, 22 bp, Homo sapiens
atgccactgcacttcagcttgg

SEQ ID NO: 7969262 - DNA, 22 bp, Homo sapiens
gacagcaacacatgcttagtgc

SEQ ID NO: 7969263 - DNA, 22 bp, Homo sapiens
atgccactgcgctccagcctgg

SEQ ID NO: 7969264 - DNA, 22 bp, Homo sapiens
atgccactgcgctccagcctgg

SEQ ID NO: 7969265 - DNA, 22 bp, Homo sapiens
atgccactgcgctccagcctgg

SEQ ID NO: 7969266 - DNA, 22 bp, Homo sapiens
atgccactgcgctccagcctgg

SEQ ID NO: 7969267 - DNA, 22 bp, Homo sapiens
atgccactgcgctccagcctgg

SEQ ID NO: 7969268 - DNA, 22 bp, Homo sapiens
atgccactgcacttcagcttgg

SEQ ID NO: 7969269 - DNA, 22 bp, Homo sapiens
atgccactgcacttcagcttgg

SEQ ID NO: 7969270 - DNA, 22 bp, Homo sapiens
atgccactgcgctccagcctgg

SEQ ID NO: 7969271 - DNA, 22 bp, Homo sapiens
atgccactgcgctccagcctgg

SEQ ID NO: 7969272 - DNA, 22 bp, Homo sapiens
atgccactgcgctccagcctgg

SEQ ID NO: 7969273 - DNA, 22 bp, Homo sapiens
gagaggaactcccagtgcctgg

SEQ ID NO: 7969274 - DNA, 22 bp, Homo sapiens
gagaggaactcccagtgcctgg

SEQ ID NO: 7969275 - DNA, 22 bp, Homo sapiens
gagaggaagccagggggtgttg

SEQ ID NO: 7969276 - DNA, 22 bp, Homo sapiens
gagaggaaagatatatacttct

SEQ ID NO: 7969277 - DNA, 22 bp, Homo sapiens
gagaggaaagaaccaatgaccc

SEQ ID NO: 7969278 - DNA, 22 bp, Homo sapiens
gagaggaaagatatatacttct

SEQ ID NO: 7969279 - DNA, 22 bp, Homo sapiens
gagaggaagccttctgtacttg

SEQ ID NO: 7969280 - DNA, 22 bp, Homo sapiens
atggccagatgaaataatagag

SEQ ID NO: 7969281 - DNA, 22 bp, Homo sapiens
atggccagcaaggtagggcaat

SEQ ID NO: 7969282 - DNA, 22 bp, Homo sapiens
atggccagcaaggtagggcaat

SEQ ID NO: 7969283 - DNA, 22 bp, Homo sapiens
atggccagtctgttggacagca

SEQ ID NO: 7969284 - DNA, 22 bp, Homo sapiens
atggccagtctgttggacagca

SEQ ID NO: 7969285 - DNA, 22 bp, Homo sapiens
atggccagtctgactagtttcc

SEQ ID NO: 7969286 - DNA, 22 bp, Homo sapiens
atggccagtctgttggacagca

SEQ ID NO: 7969287 - DNA, 22 bp, Homo sapiens
atggccagtctattcatggtta

SEQ ID NO: 7969288 - DNA, 22 bp, Homo sapiens
atggccagtcaagcctctggct

SEQ ID NO: 7969289 - DNA, 22 bp, Homo sapiens
atggcagtgtttcagtttttgg

SEQ ID NO: 7969290 - DNA, 22 bp, Homo sapiens
atggcagttgtatgggctgtat

SEQ ID NO: 7969291 - DNA, 22 bp, Homo sapiens
atggcagtgtttcagtttttgg

SEQ ID NO: 7969292 - DNA, 22 bp, Homo sapiens
atggcagtttcactctgggatt

SEQ ID NO: 7969293 - DNA, 22 bp, Homo sapiens
atggcagttttagaacttttca

SEQ ID NO: 7969294 - DNA, 22 bp, Homo sapiens
gagagctgtggtttgaccaggc

SEQ ID NO: 7969295 - DNA, 22 bp, Homo sapiens
gagagctgtggtttgaccaggc

SEQ ID NO: 7969296 - DNA, 22 bp, Homo sapiens
gagagctgtggtttgaccaggc

SEQ ID NO: 7969297 - DNA, 22 bp, Homo sapiens
gagagctgtccggctgagcagc

SEQ ID NO: 7969298 - DNA, 22 bp, Homo sapiens
gagagctgtccggctgagcagc

SEQ ID NO: 7969299 - DNA, 22 bp, Homo sapiens
gagagctgtccggctgagcagc

SEQ ID NO: 7969300 - DNA, 22 bp, Homo sapiens
gagagctgtccggctgagcagc

SEQ ID NO: 7969301 - DNA, 22 bp, Homo sapiens
gagaggaaagaaccaatgaccc

SEQ ID NO: 7969302 - DNA, 22 bp, Homo sapiens
gagaggaaagaaccaatgaccc

SEQ ID NO: 7969303 - DNA, 22 bp, Homo sapiens
gagagctttcccattttgctta

SEQ ID NO: 7969304 - DNA, 22 bp, Homo sapiens
gagagctttcatgttgggaatg

SEQ ID NO: 7969305 - DNA, 22 bp, Homo sapiens
gagagctgtttatcttcttcaa

SEQ ID NO: 7969306 - DNA, 22 bp, Homo sapiens
gagagctgtttatcttcttcaa

SEQ ID NO: 7969307 - DNA, 22 bp, Homo sapiens
gagagctgtttatcttcttcaa

SEQ ID NO: 7969308 - DNA, 22 bp, Homo sapiens
gagagctgtgttcattctacca

SEQ ID NO: 7969309 - DNA, 22 bp, Homo sapiens
gagagctgtgttcattctacca

SEQ ID NO: 7969310 - DNA, 22 bp, Homo sapiens
gagagctgtttatcttcttcaa

SEQ ID NO: 7969311 - DNA, 22 bp, Homo sapiens
gagagctgtggtttgaccaggc

SEQ ID NO: 7969312 - DNA, 22 bp, Homo sapiens
gagagctgtggtttgaccaggc

SEQ ID NO: 7969313 - DNA, 22 bp, Homo sapiens
gagagctgtggtttgaccaggc

SEQ ID NO: 7969314 - DNA, 22 bp, Homo sapiens
gagagctgtgttcattctacca

SEQ ID NO: 7969315 - DNA, 22 bp, Homo sapiens
gagagctgtgttcattctacca

SEQ ID NO: 7969316 - DNA, 22 bp, Homo sapiens
atggcagggactgtggcccttg

SEQ ID NO: 7969317 - DNA, 22 bp, Homo sapiens
atggcagggaccaagctgtcat

SEQ ID NO: 7969318 - DNA, 22 bp, Homo sapiens
atggcagggaccaagctgtcat

SEQ ID NO: 7969319 - DNA, 22 bp, Homo sapiens
atggcagggaccaagctgtcat

SEQ ID NO: 7969320 - DNA, 22 bp, Homo sapiens
atggcagggcacagctctagtt

SEQ ID NO: 7969321 - DNA, 22 bp, Homo sapiens
atggcagggactgtggcccttg

SEQ ID NO: 7969322 - DNA, 22 bp, Homo sapiens
atggcagggcacagctctagtt

SEQ ID NO: 7969323 - DNA, 22 bp, Homo sapiens
atggcagggcacagctctagtt

SEQ ID NO: 7969324 - DNA, 22 bp, Homo sapiens
atggcagggcccttggctccca

SEQ ID NO: 7969325 - DNA, 22 bp, Homo sapiens
atggcagggcccttggctccca

SEQ ID NO: 7969326 - DNA, 22 bp, Homo sapiens
atggcagggcagcctctcagag

SEQ ID NO: 7969327 - DNA, 22 bp, Homo sapiens
atggcagggcagcctctcagag

SEQ ID NO: 7969328 - DNA, 22 bp, Homo sapiens
atggcagggcacagctctagtt

SEQ ID NO: 7969329 - DNA, 22 bp, Homo sapiens
atggcagggcccttggctccca

SEQ ID NO: 7969330 - DNA, 22 bp, Homo sapiens
atggcagggtctgtcttcagct

SEQ ID NO: 7969331 - DNA, 22 bp, Homo sapiens
atggcagggtctgtcttcagct

SEQ ID NO: 7969332 - DNA, 22 bp, Homo sapiens
atggcagggcccttggctccca

SEQ ID NO: 7969333 - DNA, 22 bp, Homo sapiens
atggcagtacgttgaaaatttt

SEQ ID NO: 7969334 - DNA, 22 bp, Homo sapiens
atggcagtatttcagtacagag

SEQ ID NO: 7969335 - DNA, 22 bp, Homo sapiens
atggcagtatttgtatcacaga

SEQ ID NO: 7969336 - DNA, 22 bp, Homo sapiens
atggcagtgataggctagtgat

SEQ ID NO: 7969337 - DNA, 22 bp, Homo sapiens
atggcagtgacttgaagggtag

SEQ ID NO: 7969338 - DNA, 22 bp, Homo sapiens
atggcagtatttgtatcacaga

SEQ ID NO: 7969339 - DNA, 22 bp, Homo sapiens
atggcagtcagagacaggcaga

SEQ ID NO: 7969340 - DNA, 22 bp, Homo sapiens
atggcaggatacccagtccggc

SEQ ID NO: 7969341 - DNA, 22 bp, Homo sapiens
atggcaggatacccagtccggc

SEQ ID NO: 7969342 - DNA, 22 bp, Homo sapiens
atggcaggatacccagtccggc

SEQ ID NO: 7969343 - DNA, 22 bp, Homo sapiens
atggcaggatacccagtccggc

SEQ ID NO: 7969344 - DNA, 22 bp, Homo sapiens
atggcaggatacccagtccggc

SEQ ID NO: 7969345 - DNA, 22 bp, Homo sapiens
atggcaggatacccagtccggc

SEQ ID NO: 7969346 - DNA, 22 bp, Homo sapiens
atggcaggatacccagtccggc

SEQ ID NO: 7969347 - DNA, 22 bp, Homo sapiens
atggcaggcccaggtgttcatt

SEQ ID NO: 7969348 - DNA, 22 bp, Homo sapiens
atggcaggatgagacaacaatt

SEQ ID NO: 7969349 - DNA, 22 bp, Homo sapiens
atggcagctggcttgggcacct

SEQ ID NO: 7969350 - DNA, 22 bp, Homo sapiens
atggcagctggcttgggcacct

SEQ ID NO: 7969351 - DNA, 22 bp, Homo sapiens
atggcagctttcattgtccaca

SEQ ID NO: 7969352 - DNA, 22 bp, Homo sapiens
atggcagctttcattgtccaca

SEQ ID NO: 7969353 - DNA, 22 bp, Homo sapiens
atggcagctttgaatttcttga

SEQ ID NO: 7969354 - DNA, 22 bp, Homo sapiens
atggcagctttgaatttcttga

SEQ ID NO: 7969355 - DNA, 22 bp, Homo sapiens
atggcagagggattgaacagct

SEQ ID NO: 7969356 - DNA, 22 bp, Homo sapiens
atggcagcggagctggaaatga

SEQ ID NO: 7969357 - DNA, 22 bp, Homo sapiens
atggcagcggagctggaaatga

SEQ ID NO: 7969358 - DNA, 22 bp, Homo sapiens
atggcagctggcttgggcacct

SEQ ID NO: 7969359 - DNA, 22 bp, Homo sapiens
gagaacagaagcattcctaatt

SEQ ID NO: 7969360 - DNA, 22 bp, Homo sapiens
gagaacagaagcattcctaatt

SEQ ID NO: 7969361 - DNA, 22 bp, Homo sapiens
gagaacactaatggtttcttaa

SEQ ID NO: 7969362 - DNA, 22 bp, Homo sapiens
gagaacagatttttctgctgtc

SEQ ID NO: 7969363 - DNA, 22 bp, Homo sapiens
gagaacagaagcattcctaatt

SEQ ID NO: 7969364 - DNA, 22 bp, Homo sapiens
gagaacagagataattttactt

SEQ ID NO: 7969365 - DNA, 23 bp, Homo sapiens
gagaacagccacagagagctgtg

SEQ ID NO: 7969366 - DNA, 23 bp, Homo sapiens
gagaacagccacagagagctgtg

SEQ ID NO: 7969367 - DNA, 23 bp, Homo sapiens
gagaacagccacagagagctgtg

SEQ ID NO: 7969368 - DNA, 22 bp, Homo sapiens
atggcagagggattgaacagct

SEQ ID NO: 7969369 - DNA, 22 bp, Homo sapiens
gagccaggaggcagagactgca

SEQ ID NO: 7969370 - DNA, 22 bp, Homo sapiens
gagccaggaggcagagactgca

SEQ ID NO: 7969371 - DNA, 22 bp, Homo sapiens
gagccaggaggcagagactgca

SEQ ID NO: 7969372 - DNA, 22 bp, Homo sapiens
gagccaggaggcagagactgca

SEQ ID NO: 7969373 - DNA, 22 bp, Homo sapiens
gagccaggaggcagagactgca

SEQ ID NO: 7969374 - DNA, 22 bp, Homo sapiens
gagccaggaggcagagactgca

SEQ ID NO: 7969375 - DNA, 22 bp, Homo sapiens
gagccaggaagaaggccttact

SEQ ID NO: 7969376 - DNA, 22 bp, Homo sapiens
gagccaggaagaaggccttact

SEQ ID NO: 7969377 - DNA, 22 bp, Homo sapiens
gagccagctgagctgcactgtc

SEQ ID NO: 7969378 - DNA, 22 bp, Homo sapiens
gagccaggagatacctaagggg

SEQ ID NO: 7969379 - DNA, 22 bp, Homo sapiens
gagccaggagatacctaagggg

SEQ ID NO: 7969380 - DNA, 22 bp, Homo sapiens
gagccaggagatacctaagggg

SEQ ID NO: 7969381 - DNA, 22 bp, Homo sapiens
gagccagctatgtagcaagagg

SEQ ID NO: 7969382 - DNA, 22 bp, Homo sapiens
gagccagctatgtagcaagagg

SEQ ID NO: 7969383 - DNA, 22 bp, Homo sapiens
gagccagctatgtagcaagagg

SEQ ID NO: 7969384 - DNA, 22 bp, Homo sapiens
gagccagctgagctgcactgtc

SEQ ID NO: 7969385 - DNA, 22 bp, Homo sapiens
gagccagctgagctgcactgtc

SEQ ID NO: 7969386 - DNA, 22 bp, Homo sapiens
gagccagctgagctgcactgtc

SEQ ID NO: 7969387 - DNA, 22 bp, Homo sapiens
gagccagctgagctgcactgtc

SEQ ID NO: 7969388 - DNA, 22 bp, Homo sapiens
gagccagctacatggtctgcaa

SEQ ID NO: 7969389 - DNA, 22 bp, Homo sapiens
gagccagctacatggtctgcaa

SEQ ID NO: 7969390 - DNA, 22 bp, Homo sapiens
gagccagcgccttgcctctggg

SEQ ID NO: 7969391 - DNA, 22 bp, Homo sapiens
gagccaggcccgtacttgctgt

SEQ ID NO: 7969392 - DNA, 22 bp, Homo sapiens
gagccaggcccgtacttgctgt

SEQ ID NO: 7969393 - DNA, 22 bp, Homo sapiens
gagccaggcccgtacttgctgt

SEQ ID NO: 7969394 - DNA, 22 bp, Homo sapiens
gagccaggcccgtacttgctgt

SEQ ID NO: 7969395 - DNA, 22 bp, Homo sapiens
gagccaggcccgtacttgctgt

SEQ ID NO: 7969396 - DNA, 22 bp, Homo sapiens
gagccaggcaccttctgtgttg

SEQ ID NO: 7969397 - DNA, 22 bp, Homo sapiens
gagccaggcaccttctgtgttg

SEQ ID NO: 7969398 - DNA, 22 bp, Homo sapiens
atggctgcccacgttggtgctt

SEQ ID NO: 7969399 - DNA, 22 bp, Homo sapiens
gagccagggctgtgagctgagc

SEQ ID NO: 7969400 - DNA, 22 bp, Homo sapiens
atggctgcccacgttggtgctt

SEQ ID NO: 7969401 - DNA, 22 bp, Homo sapiens
gagccagggagggtctggtata

SEQ ID NO: 7969402 - DNA, 22 bp, Homo sapiens
gagccagggagggtctggtata

SEQ ID NO: 7969403 - DNA, 22 bp, Homo sapiens
gagccagggctgtgagctgagc

SEQ ID NO: 7969404 - DNA, 22 bp, Homo sapiens
atggctggaagagtcgaagagt

SEQ ID NO: 7969405 - DNA, 22 bp, Homo sapiens
atggctgctttcccttagcacc

SEQ ID NO: 7969406 - DNA, 22 bp, Homo sapiens
atggctgctgccttcccctgct

SEQ ID NO: 7969407 - DNA, 19 bp, Homo sapiens
atggctgctgattggggat

SEQ ID NO: 7969408 - DNA, 22 bp, Homo sapiens
atggctgctctggatggagtcc

SEQ ID NO: 7969409 - DNA, 22 bp, Homo sapiens
atggctgccttaattcttcagc

SEQ ID NO: 7969410 - DNA, 22 bp, Homo sapiens
atggctgcctagaggtgagatg

SEQ ID NO: 7969411 - DNA, 22 bp, Homo sapiens
atggctgcctagaggtgagatg

SEQ ID NO: 7969412 - DNA, 22 bp, Homo sapiens
atggctgcctgggcgctggccg

SEQ ID NO: 7969413 - DNA, 22 bp, Homo sapiens
atggctgcctgggcgctggccg

SEQ ID NO: 7969414 - DNA, 22 bp, Homo sapiens
gagcagtgactggagcatgaga

SEQ ID NO: 7969415 - DNA, 22 bp, Homo sapiens
gagcagtgactggagcatgaga

SEQ ID NO: 7969416 - DNA, 22 bp, Homo sapiens
gagcagtgactggagcatgaga

SEQ ID NO: 7969417 - DNA, 22 bp, Homo sapiens
gagccagcctccgcctctctcc

SEQ ID NO: 7969418 - DNA, 22 bp, Homo sapiens
gagccagcctccgcctctctcc

SEQ ID NO: 7969419 - DNA, 22 bp, Homo sapiens
gagccagccttcttctgaggtc

SEQ ID NO: 7969420 - DNA, 22 bp, Homo sapiens
gagccagcctccgcctctctcc

SEQ ID NO: 7969421 - DNA, 22 bp, Homo sapiens
gagccagcgccttgcctctggg

SEQ ID NO: 7969422 - DNA, 22 bp, Homo sapiens
gagccagccttcttctgaggtc

SEQ ID NO: 7969423 - DNA, 22 bp, Homo sapiens
gagccagccttcttctgaggtc

SEQ ID NO: 7969424 - DNA, 22 bp, Homo sapiens
gagccagccttcttctgaggtc

SEQ ID NO: 7969425 - DNA, 22 bp, Homo sapiens
gagccagccttcttctgaggtc

SEQ ID NO: 7969426 - DNA, 22 bp, Homo sapiens
atggccctcagtccttccttgg

SEQ ID NO: 7969427 - DNA, 22 bp, Homo sapiens
atggccctcagtccttccttgg

SEQ ID NO: 7969428 - DNA, 22 bp, Homo sapiens
atggccctctccttaggtcagc

SEQ ID NO: 7969429 - DNA, 22 bp, Homo sapiens
atggccctgaccttgatgacct

SEQ ID NO: 7969430 - DNA, 22 bp, Homo sapiens
atggccctaatgagttggtgtt

SEQ ID NO: 7969431 - DNA, 22 bp, Homo sapiens
atggccctatcacctttgcttc

SEQ ID NO: 7969432 - DNA, 22 bp, Homo sapiens
atggccctaatgagttggtgtt

SEQ ID NO: 7969433 - DNA, 22 bp, Homo sapiens
atggccctatcacctttgcttc

SEQ ID NO: 7969434 - DNA, 22 bp, Homo sapiens
atggccctggaaagagcttgag

SEQ ID NO: 7969435 - DNA, 22 bp, Homo sapiens
atggccctggaaagagcttgag

SEQ ID NO: 7969436 - DNA, 22 bp, Homo sapiens
atggccctggaaagagcttgag

SEQ ID NO: 7969437 - DNA, 22 bp, Homo sapiens
atggccctggcccagaccccac

SEQ ID NO: 7969438 - DNA, 22 bp, Homo sapiens
atggccctgctaccacttttct

SEQ ID NO: 7969439 - DNA, 22 bp, Homo sapiens
atggccctgctggtttgatcgt

SEQ ID NO: 7969440 - DNA, 22 bp, Homo sapiens
atggccctgccaggaggaacaa

SEQ ID NO: 7969441 - DNA, 22 bp, Homo sapiens
atggccagtgttgagatcaggc

SEQ ID NO: 7969442 - DNA, 22 bp, Homo sapiens
atggccagtgttgagatcaggc

SEQ ID NO: 7969443 - DNA, 22 bp, Homo sapiens
atggccagtctgttggacagca

SEQ ID NO: 7969444 - DNA, 22 bp, Homo sapiens
atggccagtctgttggacagca

SEQ ID NO: 7969445 - DNA, 22 bp, Homo sapiens
atggccagtgtttccctcagtt

SEQ ID NO: 7969446 - DNA, 22 bp, Homo sapiens
atggccagtgtttccctcagtt

SEQ ID NO: 7969447 - DNA, 22 bp, Homo sapiens
atggccagtgtttccctcagtt

SEQ ID NO: 7969448 - DNA, 19 bp, Homo sapiens
atggccagtttagaggttt

SEQ ID NO: 7969449 - DNA, 19 bp, Homo sapiens
atggccagtttagaggttt

SEQ ID NO: 7969450 - DNA, 22 bp, Homo sapiens
atggccagtgtttccctcagtt

SEQ ID NO: 7969451 - DNA, 22 bp, Homo sapiens
atggccagttagaaatcaaaaa

SEQ ID NO: 7969452 - DNA, 19 bp, Homo sapiens
atggccagtttagaggttt

SEQ ID NO: 7969453 - DNA, 19 bp, Homo sapiens
atggccagtttagaggttt

SEQ ID NO: 7969454 - DNA, 22 bp, Homo sapiens
atggcccaggcctcctgtggct

SEQ ID NO: 7969455 - DNA, 22 bp, Homo sapiens
atggcccaggccaggatccagc

SEQ ID NO: 7969456 - DNA, 22 bp, Homo sapiens
atggcccaggcaggctggtact

SEQ ID NO: 7969457 - DNA, 22 bp, Homo sapiens
atggcccagactcagactggtg

SEQ ID NO: 7969458 - DNA, 22 bp, Homo sapiens
atggcccagaagtttggaaagg

SEQ ID NO: 7969459 - DNA, 22 bp, Homo sapiens
atggcccactctggtcccggca

SEQ ID NO: 7969460 - DNA, 22 bp, Homo sapiens
atggcccaaaacctcctccctc

SEQ ID NO: 7969461 - DNA, 22 bp, Homo sapiens
atggcccaaaacctcctccctc

SEQ ID NO: 7969462 - DNA, 22 bp, Homo sapiens
atggccatgccagtttacagcc

SEQ ID NO: 7969463 - DNA, 22 bp, Homo sapiens
atggcccaagtgccctgacctg

SEQ ID NO: 7969464 - DNA, 22 bp, Homo sapiens
atggcccaagtgccctgacctg

SEQ ID NO: 7969465 - DNA, 22 bp, Homo sapiens
atggcccaagtgccctgacctg

SEQ ID NO: 7969466 - DNA, 22 bp, Homo sapiens
atggcccaaactgcaattactt

SEQ ID NO: 7969467 - DNA, 22 bp, Homo sapiens
atgtgtgtatgtgcctatatct

SEQ ID NO: 7969468 - DNA, 22 bp, Homo sapiens
atgtgtgtatgtgcctatatct

SEQ ID NO: 7969469 - DNA, 22 bp, Homo sapiens
atgtgtgtgatgggcgccgcca

SEQ ID NO: 7969470 - DNA, 22 bp, Homo sapiens
atgtgtgtgatgggcgccgcca

SEQ ID NO: 7969471 - DNA, 22 bp, Homo sapiens
atgtgtgtgatgggcgccgcca

SEQ ID NO: 7969472 - DNA, 22 bp, Homo sapiens
atgtgtgtatgtgcctatatct

SEQ ID NO: 7969473 - DNA, 22 bp, Homo sapiens
atgtgtgtgcatttctctccct

SEQ ID NO: 7969474 - DNA, 22 bp, Homo sapiens
atgtgtgtgcatttctctccct

SEQ ID NO: 7969475 - DNA, 22 bp, Homo sapiens
atgtgtgtgatgggcgccgcca

SEQ ID NO: 7969476 - DNA, 22 bp, Homo sapiens
atgtgtgtgcatttctctccct

SEQ ID NO: 7969477 - DNA, 22 bp, Homo sapiens
atgtgtgtgcatttctctccct

SEQ ID NO: 7969478 - DNA, 22 bp, Homo sapiens
atgtgtgtatatatagtcattt

SEQ ID NO: 7969479 - DNA, 22 bp, Homo sapiens
atgtgtgtatatatagtcattt

SEQ ID NO: 7969480 - DNA, 22 bp, Homo sapiens
atgtgtgtatatatagtcattt

SEQ ID NO: 7969481 - DNA, 22 bp, Homo sapiens
atgtgtgtatatatagtcattt

SEQ ID NO: 7969482 - DNA, 22 bp, Homo sapiens
atgtgtgtatatatagtcattt

SEQ ID NO: 7969483 - DNA, 22 bp, Homo sapiens
atgtgtgtatgtgcctatatct

SEQ ID NO: 7969484 - DNA, 22 bp, Homo sapiens
atgtgtgtatgtgcctatatct

SEQ ID NO: 7969485 - DNA, 22 bp, Homo sapiens
atgtgtgtatatatagtcattt

SEQ ID NO: 7969486 - DNA, 22 bp, Homo sapiens
atgtgtgtacacacgtgactct

SEQ ID NO: 7969487 - DNA, 22 bp, Homo sapiens
atgtgtgtatatatagtcattt

SEQ ID NO: 7969488 - DNA, 22 bp, Homo sapiens
atgtgtcttggagttttaatgt

SEQ ID NO: 7969489 - DNA, 22 bp, Homo sapiens
atgtgtcttgcggcagttggta

SEQ ID NO: 7969490 - DNA, 22 bp, Homo sapiens
atgtgtcttgcggcagttggta

SEQ ID NO: 7969491 - DNA, 22 bp, Homo sapiens
atgtgtcttgagggggatggag

SEQ ID NO: 7969492 - DNA, 22 bp, Homo sapiens
atgtgtcttgagggggatggag

SEQ ID NO: 7969493 - DNA, 22 bp, Homo sapiens
gaggggagaggcttatggatca

SEQ ID NO: 7969494 - DNA, 16 bp, Homo sapiens
gaggggagcagtaggc

SEQ ID NO: 7969495 - DNA, 22 bp, Homo sapiens
gaggggagaggcttatggatca

SEQ ID NO: 7969496 - DNA, 22 bp, Homo sapiens
gaggggagaggcttatggatca

SEQ ID NO: 7969497 - DNA, 22 bp, Homo sapiens
gaggggagacagggaaatcagt

SEQ ID NO: 7969498 - DNA, 22 bp, Homo sapiens
gaggggagaggcttatggatca

SEQ ID NO: 7969499 - DNA, 22 bp, Homo sapiens
gaggggagaggcttatggatca

SEQ ID NO: 7969500 - DNA, 22 bp, Homo sapiens
gaggggagaaggcactaaccag

SEQ ID NO: 7969501 - DNA, 22 bp, Homo sapiens
gaggggagacagggaaatcagt

SEQ ID NO: 7969502 - DNA, 22 bp, Homo sapiens
gaggggagacagggaaatcagt

SEQ ID NO: 7969503 - DNA, 22 bp, Homo sapiens
gaggggagacagggaaatcagt

SEQ ID NO: 7969504 - DNA, 22 bp, Homo sapiens
gaggggagacagggaaatcagt

SEQ ID NO: 7969505 - DNA, 22 bp, Homo sapiens
gaggggagacagggaaatcagt

SEQ ID NO: 7969506 - DNA, 16 bp, Homo sapiens
gaggggagcagtaggc

SEQ ID NO: 7969507 - DNA, 16 bp, Homo sapiens
gaggggagcagtaggc

SEQ ID NO: 7969508 - DNA, 16 bp, Homo sapiens
gaggggagcagtaggc

SEQ ID NO: 7969509 - DNA, 16 bp, Homo sapiens
gaggggagcagtaggc

SEQ ID NO: 7969510 - DNA, 22 bp, Homo sapiens
gaggggagcatgatctagattg

SEQ ID NO: 7969511 - DNA, 22 bp, Homo sapiens
gaggggagcccccatcctccag

SEQ ID NO: 7969512 - DNA, 22 bp, Homo sapiens
atgtgtcttctgtgggtttgaa

SEQ ID NO: 7969513 - DNA, 22 bp, Homo sapiens
atgtgtcttgagggggatggag

SEQ ID NO: 7969514 - DNA, 22 bp, Homo sapiens
atgtgtcttctgtgggtttgaa

SEQ ID NO: 7969515 - DNA, 22 bp, Homo sapiens
gaggggagcccccatcctccag

SEQ ID NO: 7969516 - DNA, 22 bp, Homo sapiens
atgtgtcaattttcaaatgctt

SEQ ID NO: 7969517 - DNA, 22 bp, Homo sapiens
atgtgtattttgtactattggg

SEQ ID NO: 7969518 - DNA, 22 bp, Homo sapiens
atgtgtattttgtactattggg

SEQ ID NO: 7969519 - DNA, 22 bp, Homo sapiens
atgtgtcattatccagaataac

SEQ ID NO: 7969520 - DNA, 22 bp, Homo sapiens
atgtgtattagttagtttaatg

SEQ ID NO: 7969521 - DNA, 22 bp, Homo sapiens
atgtgtattgagcacctactgc

SEQ ID NO: 7969522 - DNA, 22 bp, Homo sapiens
gaggggaagacttctggacagt

SEQ ID NO: 7969523 - DNA, 22 bp, Homo sapiens
gaggggaagacttctggacagt

SEQ ID NO: 7969524 - DNA, 22 bp, Homo sapiens
gaggggaagacttctggacagt

SEQ ID NO: 7969525 - DNA, 22 bp, Homo sapiens
gaggggaagacttctggacagt

SEQ ID NO: 7969526 - DNA, 22 bp, Homo sapiens
gaggggagaaggcactaaccag

SEQ ID NO: 7969527 - DNA, 22 bp, Homo sapiens
atgtgtcctgctgtgtcacaca

SEQ ID NO: 7969528 - DNA, 22 bp, Homo sapiens
gaggggaagacttctggacagt

SEQ ID NO: 7969529 - DNA, 22 bp, Homo sapiens
atgtgtccacaggtgtgagaga

SEQ ID NO: 7969530 - DNA, 22 bp, Homo sapiens
atgtgtccattatcagttctgg

SEQ ID NO: 7969531 - DNA, 22 bp, Homo sapiens
atgtgtcctctggcaggtttag

SEQ ID NO: 7969532 - DNA, 22 bp, Homo sapiens
atgtgtccaaggccacaatagc

SEQ ID NO: 7969533 - DNA, 22 bp, Homo sapiens
atgtgtcatttttctgtgcata

SEQ ID NO: 7969534 - DNA, 22 bp, Homo sapiens
atgtgtattacctcgattgtga

SEQ ID NO: 7969535 - DNA, 22 bp, Homo sapiens
atgtgtattaccctttcattcc

SEQ ID NO: 7969536 - DNA, 22 bp, Homo sapiens
atgtgtatgtcttattcaaaga

SEQ ID NO: 7969537 - DNA, 22 bp, Homo sapiens
atgtgtattaccctttcattcc

SEQ ID NO: 7969538 - DNA, 22 bp, Homo sapiens
atgtgtattaccctttcattcc

SEQ ID NO: 7969539 - DNA, 22 bp, Homo sapiens
atgtgtattaccctttcattcc

SEQ ID NO: 7969540 - DNA, 22 bp, Homo sapiens
atgtgtatgtcttattcaaaga

SEQ ID NO: 7969541 - DNA, 22 bp, Homo sapiens
gaggctgctgttagccctgggc

SEQ ID NO: 7969542 - DNA, 22 bp, Homo sapiens
gaggctgctgttagccctgggc

SEQ ID NO: 7969543 - DNA, 22 bp, Homo sapiens
gaggctgctgttagccctgggc

SEQ ID NO: 7969544 - DNA, 22 bp, Homo sapiens
gaggctgctgttagccctgggc

SEQ ID NO: 7969545 - DNA, 22 bp, Homo sapiens
gaggctgctgttagccctgggc

SEQ ID NO: 7969546 - DNA, 22 bp, Homo sapiens
atgtggctgtcacagcataatg

SEQ ID NO: 7969547 - DNA, 22 bp, Homo sapiens
atgtggcttagttaggtgcccc

SEQ ID NO: 7969548 - DNA, 22 bp, Homo sapiens
atgtggcttagttaggtgcccc

SEQ ID NO: 7969549 - DNA, 22 bp, Homo sapiens
atgtggcttggcagggaatatg

SEQ ID NO: 7969550 - DNA, 22 bp, Homo sapiens
atgtggcttagttaggtgcccc

SEQ ID NO: 7969551 - DNA, 22 bp, Homo sapiens
atgtggctggtgactgccgtac

SEQ ID NO: 7969552 - DNA, 22 bp, Homo sapiens
gaggctgctttgatgacaggag

SEQ ID NO: 7969553 - DNA, 22 bp, Homo sapiens
gaggctgctttgatgacaggag

SEQ ID NO: 7969554 - DNA, 22 bp, Homo sapiens
gaggctgctttgatgacaggag

SEQ ID NO: 7969555 - DNA, 22 bp, Homo sapiens
atgtctttattaatatcatgcc

SEQ ID NO: 7969556 - DNA, 22 bp, Homo sapiens
atgtctttataaatgtataatg

SEQ ID NO: 7969557 - DNA, 22 bp, Homo sapiens
atgtctttaaacttgagttgtt

SEQ ID NO: 7969558 - DNA, 22 bp, Homo sapiens
atgtctttataaatgtataatg

SEQ ID NO: 7969559 - DNA, 22 bp, Homo sapiens
atgtctttataaatgtataatg

SEQ ID NO: 7969560 - DNA, 22 bp, Homo sapiens
atgtctttcaaattctgcctag

SEQ ID NO: 7969561 - DNA, 22 bp, Homo sapiens
atgtctttcaaattctgcctag

SEQ ID NO: 7969562 - DNA, 22 bp, Homo sapiens
atgtctttcaaattctgcctag

SEQ ID NO: 7969563 - DNA, 22 bp, Homo sapiens
atgtctttcaaattctgcctag

SEQ ID NO: 7969564 - DNA, 22 bp, Homo sapiens
atgtctttattaatatcatgcc

SEQ ID NO: 7969565 - DNA, 22 bp, Homo sapiens
atgtctttctagttaagagcta

SEQ ID NO: 7969566 - DNA, 22 bp, Homo sapiens
atgtctttctagttaagagcta

SEQ ID NO: 7969567 - DNA, 22 bp, Homo sapiens
atgtctttctagttaagagcta

SEQ ID NO: 7969568 - DNA, 22 bp, Homo sapiens
atgtctttcaaattctgcctag

SEQ ID NO: 7969569 - DNA, 22 bp, Homo sapiens
atgtctttcgcatcagtagcta

SEQ ID NO: 7969570 - DNA, 22 bp, Homo sapiens
gaggcctgggttacctactcgt

SEQ ID NO: 7969571 - DNA, 19 bp, Homo sapiens
atgtctgggtaacagctgc

SEQ ID NO: 7969572 - DNA, 22 bp, Homo sapiens
gaggcctgggagcctgtcctcc

SEQ ID NO: 7969573 - DNA, 22 bp, Homo sapiens
gaggcctgggcaagggggtctg

SEQ ID NO: 7969574 - DNA, 22 bp, Homo sapiens
gaggcctggagccgcctaggcg

SEQ ID NO: 7969575 - DNA, 23 bp, Homo sapiens
gaggcctggccctgccacatctc

SEQ ID NO: 7969576 - DNA, 22 bp, Homo sapiens
gaggcctggagccgcctaggcg

SEQ ID NO: 7969577 - DNA, 22 bp, Homo sapiens
gaggcctggagccgcctaggcg

SEQ ID NO: 7969578 - DNA, 22 bp, Homo sapiens
gaggcctggagccgcctaggcg

SEQ ID NO: 7969579 - DNA, 22 bp, Homo sapiens
gaggcctggagccgcctaggcg

SEQ ID NO: 7969580 - DNA, 22 bp, Homo sapiens
gaggcctggctctgccctcctg

SEQ ID NO: 7969581 - DNA, 23 bp, Homo sapiens
gaggcctggccctgccacatctc

SEQ ID NO: 7969582 - DNA, 22 bp, Homo sapiens
gaggcctggctctgccctcctg

SEQ ID NO: 7969583 - DNA, 22 bp, Homo sapiens
gaggcctggctgtcagtcccca

SEQ ID NO: 7969584 - DNA, 22 bp, Homo sapiens
gaggcctggctgtcagtcccca

SEQ ID NO: 7969585 - DNA, 22 bp, Homo sapiens
gaggcctggctgtcagtcccca

SEQ ID NO: 7969586 - DNA, 22 bp, Homo sapiens
gaggcctgggagaactgttttt

SEQ ID NO: 7969587 - DNA, 22 bp, Homo sapiens
gaggcctgggagcctgtcctcc

SEQ ID NO: 7969588 - DNA, 22 bp, Homo sapiens
gaggcctgggagcctgtcctcc

SEQ ID NO: 7969589 - DNA, 22 bp, Homo sapiens
gaggcctggctgggaggaggtg

SEQ ID NO: 7969590 - DNA, 22 bp, Homo sapiens
gaggcctggctgggaggaggtg

SEQ ID NO: 7969591 - DNA, 22 bp, Homo sapiens
gaggcctggctgggaggaggtg

SEQ ID NO: 7969592 - DNA, 22 bp, Homo sapiens
gaggcctggctgggaggaggtg

SEQ ID NO: 7969593 - DNA, 22 bp, Homo sapiens
gaggcctggctgggaggaggtg

SEQ ID NO: 7969594 - DNA, 22 bp, Homo sapiens
atgtctttgccatagttcatat

SEQ ID NO: 7969595 - DNA, 22 bp, Homo sapiens
atgtctttgccatagttcatat

SEQ ID NO: 7969596 - DNA, 22 bp, Homo sapiens
atgtctttcttgtgtcccaaga

SEQ ID NO: 7969597 - DNA, 22 bp, Homo sapiens
atgtctttgccatagttcatat

SEQ ID NO: 7969598 - DNA, 22 bp, Homo sapiens
atgtctttcttgtgtcccaaga

SEQ ID NO: 7969599 - DNA, 22 bp, Homo sapiens
atgtctttgccatagttcatat

SEQ ID NO: 7969600 - DNA, 22 bp, Homo sapiens
atgtctttcttatggtctgttg

SEQ ID NO: 7969601 - DNA, 22 bp, Homo sapiens
atgtctttctcatacaagccca

SEQ ID NO: 7969602 - DNA, 22 bp, Homo sapiens
atgtctttcttatggtctgttg

SEQ ID NO: 7969603 - DNA, 22 bp, Homo sapiens
atgtctttcttgtgtcccaaga

SEQ ID NO: 7969604 - DNA, 22 bp, Homo sapiens
atgtctttctagttaagagcta

SEQ ID NO: 7969605 - DNA, 22 bp, Homo sapiens
atgtctttctcacagccagttc

SEQ ID NO: 7969606 - DNA, 22 bp, Homo sapiens
atgtctttctcatacaagccca

SEQ ID NO: 7969607 - DNA, 22 bp, Homo sapiens
atgtctttctcatacaagccca

SEQ ID NO: 7969608 - DNA, 22 bp, Homo sapiens
atgtgaaaaatttcttattaca

SEQ ID NO: 7969609 - DNA, 22 bp, Homo sapiens
atgtcttttatggagatgtcat

SEQ ID NO: 7969610 - DNA, 22 bp, Homo sapiens
atgtgaaaaatttcttattaca

SEQ ID NO: 7969611 - DNA, 22 bp, Homo sapiens
atgtgaaaaatttcttattaca

SEQ ID NO: 7969612 - DNA, 22 bp, Homo sapiens
atgtcttttatggagatgtcat

SEQ ID NO: 7969613 - DNA, 22 bp, Homo sapiens
atgtcttttatggagatgtcat

SEQ ID NO: 7969614 - DNA, 22 bp, Homo sapiens
atgtctttggctttgacatggc

SEQ ID NO: 7969615 - DNA, 22 bp, Homo sapiens
gaggctgcggggaggagcctgc

SEQ ID NO: 7969616 - DNA, 22 bp, Homo sapiens
gaggctgctgagagccctgttt

SEQ ID NO: 7969617 - DNA, 22 bp, Homo sapiens
gaggctgctgagagccctgttt

SEQ ID NO: 7969618 - DNA, 22 bp, Homo sapiens
gaggctgctgccatcattaggt

SEQ ID NO: 7969619 - DNA, 22 bp, Homo sapiens
gaggctgctgccatcattaggt

SEQ ID NO: 7969620 - DNA, 22 bp, Homo sapiens
gaggctgctgagagccctgttt

SEQ ID NO: 7969621 - DNA, 20 bp, Homo sapiens
gaggctgcggactgctggac

SEQ ID NO: 7969622 - DNA, 20 bp, Homo sapiens
gaggctgcggactgctggac

SEQ ID NO: 7969623 - DNA, 20 bp, Homo sapiens
gaggctgcggactgctggac

SEQ ID NO: 7969624 - DNA, 22 bp, Homo sapiens
gaggctgccccttcctcagctg

SEQ ID NO: 7969625 - DNA, 22 bp, Homo sapiens
atgtgaaaatccaatggcagca

SEQ ID NO: 7969626 - DNA, 22 bp, Homo sapiens
atgtgaaaatccaatggcagca

SEQ ID NO: 7969627 - DNA, 22 bp, Homo sapiens
atgtgaaacctgtgagtagagt

SEQ ID NO: 7969628 - DNA, 21 bp, Homo sapiens
atgtgaaaccttccacgctga

SEQ ID NO: 7969629 - DNA, 21 bp, Homo sapiens
atgtgaaaccttccacgctga

SEQ ID NO: 7969630 - DNA, 22 bp, Homo sapiens
atgggtttataggtggactttt

SEQ ID NO: 7969631 - DNA, 22 bp, Homo sapiens
atgggtttccctctgaaattat

SEQ ID NO: 7969632 - DNA, 22 bp, Homo sapiens
atggtaaattttaccttatgta

SEQ ID NO: 7969633 - DNA, 22 bp, Homo sapiens
atggtaaacatttaacaactag

SEQ ID NO: 7969634 - DNA, 22 bp, Homo sapiens
atggtaaacatttaacaactag

SEQ ID NO: 7969635 - DNA, 22 bp, Homo sapiens
atggggctgggattctcctcgg

SEQ ID NO: 7969636 - DNA, 22 bp, Homo sapiens
atggggctgaaacatggaagag

SEQ ID NO: 7969637 - DNA, 22 bp, Homo sapiens
atgggttacagccttggatttc

SEQ ID NO: 7969638 - DNA, 22 bp, Homo sapiens
atgggttcaagtgattctcctg

SEQ ID NO: 7969639 - DNA, 22 bp, Homo sapiens
atggctggaagagtcgaagagt

SEQ ID NO: 7969640 - DNA, 22 bp, Homo sapiens
atggctggaggccgggcttcct

SEQ ID NO: 7969641 - DNA, 22 bp, Homo sapiens
atggctggaggccgggcttcct

SEQ ID NO: 7969642 - DNA, 22 bp, Homo sapiens
atggctggatagttgaagctct

SEQ ID NO: 7969643 - DNA, 22 bp, Homo sapiens
atggctggaggccgggcttcct

SEQ ID NO: 7969644 - DNA, 22 bp, Homo sapiens
atggctggatagttgaagctct

SEQ ID NO: 7969645 - DNA, 22 bp, Homo sapiens
atggctggatagttgaagctct

SEQ ID NO: 7969646 - DNA, 22 bp, Homo sapiens
atggctggatttgatccatggg

SEQ ID NO: 7969647 - DNA, 22 bp, Homo sapiens
atggctggcactggcctgggtt

SEQ ID NO: 7969648 - DNA, 22 bp, Homo sapiens
atggctggatttgatccatggg

SEQ ID NO: 7969649 - DNA, 22 bp, Homo sapiens
atggctggcactggcctgggtt

SEQ ID NO: 7969650 - DNA, 22 bp, Homo sapiens
atggctggcactggcctgggtt

SEQ ID NO: 7969651 - DNA, 22 bp, Homo sapiens
atggctggcactggcctgggtt

SEQ ID NO: 7969652 - DNA, 23 bp, Homo sapiens
atggggctcaacacttagtagct

SEQ ID NO: 7969653 - DNA, 22 bp, Homo sapiens
atggggctctgcggctgctccc

SEQ ID NO: 7969654 - DNA, 22 bp, Homo sapiens
atggggctctgcggctgctccc

SEQ ID NO: 7969655 - DNA, 22 bp, Homo sapiens
atggtacaaaatgtataaagtc

SEQ ID NO: 7969656 - DNA, 22 bp, Homo sapiens
atggtaatgatttatgtaaatt

SEQ ID NO: 7969657 - DNA, 22 bp, Homo sapiens
atggtaacagttgagtagaaac

SEQ ID NO: 7969658 - DNA, 22 bp, Homo sapiens
atggtaaccagaagactatgac

SEQ ID NO: 7969659 - DNA, 22 bp, Homo sapiens
atggtacaatgtgtttgttagg

SEQ ID NO: 7969660 - DNA, 22 bp, Homo sapiens
atggtacaatgtgtgtatcttt

SEQ ID NO: 7969661 - DNA, 22 bp, Homo sapiens
atggtacaatgtgtgtatcttt

SEQ ID NO: 7969662 - DNA, 19 bp, Homo sapiens
atggtacagtgtacacttg

SEQ ID NO: 7969663 - DNA, 19 bp, Homo sapiens
atggtacagtgtacacttg

SEQ ID NO: 7969664 - DNA, 22 bp, Homo sapiens
atggtacatagtttaaataagg

SEQ ID NO: 7969665 - DNA, 22 bp, Homo sapiens
atggtacatagtttaaataagg

SEQ ID NO: 7969666 - DNA, 19 bp, Homo sapiens
atggtacagtgtacacttg

SEQ ID NO: 7969667 - DNA, 19 bp, Homo sapiens
atggtacagtgtacacttg

SEQ ID NO: 7969668 - DNA, 22 bp, Homo sapiens
atggtacagataatacatgctg

SEQ ID NO: 7969669 - DNA, 22 bp, Homo sapiens
atggtacagataatacatgctg

SEQ ID NO: 7969670 - DNA, 22 bp, Homo sapiens
atggtaggtacaacagcaggca

SEQ ID NO: 7969671 - DNA, 21 bp, Homo sapiens
atggtaggtggagcaggtgat

SEQ ID NO: 7969672 - DNA, 22 bp, Homo sapiens
atggtcacaccactgtactcca

SEQ ID NO: 7969673 - DNA, 22 bp, Homo sapiens
atggtcaaagataaagtgatct

SEQ ID NO: 7969674 - DNA, 22 bp, Homo sapiens
atggtccttatggccgtgatat

SEQ ID NO: 7969675 - DNA, 23 bp, Homo sapiens
atggtccagccagctgcacagga

SEQ ID NO: 7969676 - DNA, 22 bp, Homo sapiens
gagctgggcctcagaacacagt

SEQ ID NO: 7969677 - DNA, 22 bp, Homo sapiens
gagctgggcctcagaacacagt

SEQ ID NO: 7969678 - DNA, 22 bp, Homo sapiens
gagctgggcctcagaacacagt

SEQ ID NO: 7969679 - DNA, 22 bp, Homo sapiens
atggtcagggcaccctggcccc

SEQ ID NO: 7969680 - DNA, 22 bp, Homo sapiens
atggtcagggcaccctggcccc

SEQ ID NO: 7969681 - DNA, 22 bp, Homo sapiens
atggtcagttgcagctaatgtt

SEQ ID NO: 7969682 - DNA, 22 bp, Homo sapiens
atggtcagttgcagctaatgtt

SEQ ID NO: 7969683 - DNA, 22 bp, Homo sapiens
atggtcaggcaaggagggctgg

SEQ ID NO: 7969684 - DNA, 23 bp, Homo sapiens
atggtcagaattttccagctgag

SEQ ID NO: 7969685 - DNA, 22 bp, Homo sapiens
atggtcaggcaaggagggctgg

SEQ ID NO: 7969686 - DNA, 23 bp, Homo sapiens
atggtcagaattttccagctgag

SEQ ID NO: 7969687 - DNA, 22 bp, Homo sapiens
atggtcactttttgactgttca

SEQ ID NO: 7969688 - DNA, 23 bp, Homo sapiens
atggtcagaattttccagctgag

SEQ ID NO: 7969689 - DNA, 22 bp, Homo sapiens
atggtcacatgaccctttccaa

SEQ ID NO: 7969690 - DNA, 22 bp, Homo sapiens
atggtcaccttgggagcctgct

SEQ ID NO: 7969691 - DNA, 22 bp, Homo sapiens
gagctgggcctgcgagtgctgc

SEQ ID NO: 7969692 - DNA, 22 bp, Homo sapiens
gagctgggcctgcgagtgctgc

SEQ ID NO: 7969693 - DNA, 22 bp, Homo sapiens
gagctgggcctgcgagtgctgc

SEQ ID NO: 7969694 - DNA, 22 bp, Homo sapiens
gagctgggcctgcgagtgctgc

SEQ ID NO: 7969695 - DNA, 22 bp, Homo sapiens
gagctgggcctgcgagtgctgc

SEQ ID NO: 7969696 - DNA, 22 bp, Homo sapiens
gagctgggcctgcgagtgctgc

SEQ ID NO: 7969697 - DNA, 22 bp, Homo sapiens
gagctgggcctgcgagtgctgc

SEQ ID NO: 7969698 - DNA, 22 bp, Homo sapiens
gagctgggcctgcgagtgctgc

SEQ ID NO: 7969699 - DNA, 22 bp, Homo sapiens
gagctgggcctgcgagtgctgc

SEQ ID NO: 7969700 - DNA, 22 bp, Homo sapiens
gagctgggcctgcgagtgctgc

SEQ ID NO: 7969701 - DNA, 22 bp, Homo sapiens
gagctgggcctgcgagtgctgc

SEQ ID NO: 7969702 - DNA, 22 bp, Homo sapiens
gagctgggcctgcgagtgctgc

SEQ ID NO: 7969703 - DNA, 22 bp, Homo sapiens
gagctgggcctgcgagtgctgc

SEQ ID NO: 7969704 - DNA, 22 bp, Homo sapiens
gagctgggcctgcgagtgctgc

SEQ ID NO: 7969705 - DNA, 22 bp, Homo sapiens
atgtacaattctccttggtagg

SEQ ID NO: 7969706 - DNA, 22 bp, Homo sapiens
atgtacaattctccttggtagg

SEQ ID NO: 7969707 - DNA, 22 bp, Homo sapiens
atgtacaattctccttggtagg

SEQ ID NO: 7969708 - DNA, 22 bp, Homo sapiens
atgtacaattctccttggtagg

SEQ ID NO: 7969709 - DNA, 22 bp, Homo sapiens
atgtacatctttataacaagct

SEQ ID NO: 7969710 - DNA, 22 bp, Homo sapiens
atgtacatctttataacaagct

SEQ ID NO: 7969711 - DNA, 22 bp, Homo sapiens
atgtacaatttttgcttagggg

SEQ ID NO: 7969712 - DNA, 22 bp, Homo sapiens
atgtacaatttttgcttagggg

SEQ ID NO: 7969713 - DNA, 22 bp, Homo sapiens
gagctggggcagcttaggagtg

SEQ ID NO: 7969714 - DNA, 22 bp, Homo sapiens
gagctggggcagcttaggagtg

SEQ ID NO: 7969715 - DNA, 22 bp, Homo sapiens
gagctggggcagcttaggagtg

SEQ ID NO: 7969716 - DNA, 22 bp, Homo sapiens
gagctggggcagcttaggagtg

SEQ ID NO: 7969717 - DNA, 22 bp, Homo sapiens
atgtacaatctatcacaagaag

SEQ ID NO: 7969718 - DNA, 22 bp, Homo sapiens
atgtacaatctatcacaagaag

SEQ ID NO: 7969719 - DNA, 21 bp, Homo sapiens
gagctgggcgaggctccgggg

SEQ ID NO: 7969720 - DNA, 21 bp, Homo sapiens
gagctgggcgaggctccgggg

SEQ ID NO: 7969721 - DNA, 21 bp, Homo sapiens
gagctgggcgaggctccgggg

SEQ ID NO: 7969722 - DNA, 21 bp, Homo sapiens
gagctgggcgaggctccgggg

SEQ ID NO: 7969723 - DNA, 22 bp, Homo sapiens
gagctgggctggcttcctccct

SEQ ID NO: 7969724 - DNA, 22 bp, Homo sapiens
gagctgggctggcttcctccct

SEQ ID NO: 7969725 - DNA, 22 bp, Homo sapiens
gagctgggctggcttcctccct

SEQ ID NO: 7969726 - DNA, 22 bp, Homo sapiens
gagctgggcgagccggggaagt

SEQ ID NO: 7969727 - DNA, 22 bp, Homo sapiens
gagctgggcgagccggggaagt

SEQ ID NO: 7969728 - DNA, 22 bp, Homo sapiens
gagctgggcctgcgagtgctgc

SEQ ID NO: 7969729 - DNA, 22 bp, Homo sapiens
gagctgggcgagccggggaagt

SEQ ID NO: 7969730 - DNA, 22 bp, Homo sapiens
gagctgggcgagccggggaagt

SEQ ID NO: 7969731 - DNA, 21 bp, Homo sapiens
gagctgggcgaggctccgggg

SEQ ID NO: 7969732 - DNA, 22 bp, Homo sapiens
gagctgggcgagccggggaagt

SEQ ID NO: 7969733 - DNA, 21 bp, Homo sapiens
gagctgggcgaggctccgggg

SEQ ID NO: 7969734 - DNA, 22 bp, Homo sapiens
gaggagctgggaccctgtcatc

SEQ ID NO: 7969735 - DNA, 22 bp, Homo sapiens
gaggagctgggaccctgtcatc

SEQ ID NO: 7969736 - DNA, 22 bp, Homo sapiens
gaggagctgggaccctgtcatc

SEQ ID NO: 7969737 - DNA, 22 bp, Homo sapiens
gaggagctgggctgagagggtc

SEQ ID NO: 7969738 - DNA, 22 bp, Homo sapiens
gaggagctggcagcgtctccgc

SEQ ID NO: 7969739 - DNA, 22 bp, Homo sapiens
gaggagctggcgctatttatga

SEQ ID NO: 7969740 - DNA, 22 bp, Homo sapiens
gaggagctgcccgtgtgtctgc

SEQ ID NO: 7969741 - DNA, 22 bp, Homo sapiens
gaggagctggctgtcgggaggc

SEQ ID NO: 7969742 - DNA, 22 bp, Homo sapiens
gaggagctggctgtcgggaggc

SEQ ID NO: 7969743 - DNA, 22 bp, Homo sapiens
gaggagctggctgtcgggaggc

SEQ ID NO: 7969744 - DNA, 22 bp, Homo sapiens
gaggagctggctgtcgggaggc

SEQ ID NO: 7969745 - DNA, 22 bp, Homo sapiens
gaggagctggcgctatttatga

SEQ ID NO: 7969746 - DNA, 22 bp, Homo sapiens
gaggagctggcgctatttatga

SEQ ID NO: 7969747 - DNA, 22 bp, Homo sapiens
gaggccaggagtgctgtaagtt

SEQ ID NO: 7969748 - DNA, 22 bp, Homo sapiens
gaggccaggagtgctgtaagtt

SEQ ID NO: 7969749 - DNA, 22 bp, Homo sapiens
gaggccaggagtgctgtaagtt

SEQ ID NO: 7969750 - DNA, 22 bp, Homo sapiens
gaggccaggagtgctgtaagtt

SEQ ID NO: 7969751 - DNA, 22 bp, Homo sapiens
gaggccaggaggatctctctaa

SEQ ID NO: 7969752 - DNA, 22 bp, Homo sapiens
gaggccaggagtgctgtaagtt

SEQ ID NO: 7969753 - DNA, 22 bp, Homo sapiens
gaggccaggagtgctgtaagtt

SEQ ID NO: 7969754 - DNA, 22 bp, Homo sapiens
gaggccaccctatgggtcccag

SEQ ID NO: 7969755 - DNA, 23 bp, Homo sapiens
gaggccacattcccctgcttgag

SEQ ID NO: 7969756 - DNA, 22 bp, Homo sapiens
gaggagctgggtcagggagaca

SEQ ID NO: 7969757 - DNA, 22 bp, Homo sapiens
gaggagctgggctgagagggtc

SEQ ID NO: 7969758 - DNA, 22 bp, Homo sapiens
gaggagctgggctgagagggtc

SEQ ID NO: 7969759 - DNA, 22 bp, Homo sapiens
gaggccaggggcctggagatga

SEQ ID NO: 7969760 - DNA, 22 bp, Homo sapiens
gaggccaggggcctggagatga

SEQ ID NO: 7969761 - DNA, 22 bp, Homo sapiens
gaggccaggggcctggagatga

SEQ ID NO: 7969762 - DNA, 22 bp, Homo sapiens
gaggccaggggcctggagatga

SEQ ID NO: 7969763 - DNA, 22 bp, Homo sapiens
gaggccaggggcctggagatga

SEQ ID NO: 7969764 - DNA, 22 bp, Homo sapiens
gaggccaggggtcagcaattgg

SEQ ID NO: 7969765 - DNA, 22 bp, Homo sapiens
gaggccagggtaccatcaacat

SEQ ID NO: 7969766 - DNA, 22 bp, Homo sapiens
gaggccagggtaccatcaacat

SEQ ID NO: 7969767 - DNA, 22 bp, Homo sapiens
gaggccagggtaccatcaacat

SEQ ID NO: 7969768 - DNA, 22 bp, Homo sapiens
gaggccagggtaccatcaacat

SEQ ID NO: 7969769 - DNA, 22 bp, Homo sapiens
gaggccagggatgcaatgagag

SEQ ID NO: 7969770 - DNA, 22 bp, Homo sapiens
gaggccagggatgcaatgagag

SEQ ID NO: 7969771 - DNA, 22 bp, Homo sapiens
gaggccagggatgcaatgagag

SEQ ID NO: 7969772 - DNA, 22 bp, Homo sapiens
gaggccagggatgcaatgagag

SEQ ID NO: 7969773 - DNA, 22 bp, Homo sapiens
gaggccagggatgcaatgagag

SEQ ID NO: 7969774 - DNA, 15 bp, Homo sapiens
gaggccaggcatgtg

SEQ ID NO: 7969775 - DNA, 22 bp, Homo sapiens
gaggccaggggagtcagcgtcc

SEQ ID NO: 7969776 - DNA, 22 bp, Homo sapiens
gaggccaggggcctggagatga

SEQ ID NO: 7969777 - DNA, 22 bp, Homo sapiens
gaggccaggggagtcagcgtcc

SEQ ID NO: 7969778 - DNA, 22 bp, Homo sapiens
gaggccaggggagtcagcgtcc

SEQ ID NO: 7969779 - DNA, 22 bp, Homo sapiens
gaggccaggggagtcagcgtcc

SEQ ID NO: 7969780 - DNA, 22 bp, Homo sapiens
atgtacattttcctaatgtttt

SEQ ID NO: 7969781 - DNA, 22 bp, Homo sapiens
atgtacattttcctaatgtttt

SEQ ID NO: 7969782 - DNA, 22 bp, Homo sapiens
atgtacattttcctaatgtttt

SEQ ID NO: 7969783 - DNA, 22 bp, Homo sapiens
atgtaccagatgtatgttctca

SEQ ID NO: 7969784 - DNA, 22 bp, Homo sapiens
atgtacattttcctaatgtttt

SEQ ID NO: 7969785 - DNA, 19 bp, Homo sapiens
atgtaccatttgaagttct

SEQ ID NO: 7969786 - DNA, 19 bp, Homo sapiens
atgtacccagtgtcaatcc

SEQ ID NO: 7969787 - DNA, 22 bp, Homo sapiens
atgtacatttagatcatttctg

SEQ ID NO: 7969788 - DNA, 18 bp, Homo sapiens
atgtacatttgctaaagc

SEQ ID NO: 7969789 - DNA, 18 bp, Homo sapiens
atgtacatttgctaaagc

SEQ ID NO: 7969790 - DNA, 18 bp, Homo sapiens
atgtacatttgctaaagc

SEQ ID NO: 7969791 - DNA, 22 bp, Homo sapiens
atgtacatttgtagtaatatca

SEQ ID NO: 7969792 - DNA, 22 bp, Homo sapiens
atgtacatttgtagtaatatca

SEQ ID NO: 7969793 - DNA, 22 bp, Homo sapiens
atgtacatttgtagtaatatca

SEQ ID NO: 7969794 - DNA, 18 bp, Homo sapiens
atgtacatgtactcacac

SEQ ID NO: 7969795 - DNA, 18 bp, Homo sapiens
atgtacatgtactcacac

SEQ ID NO: 7969796 - DNA, 22 bp, Homo sapiens
atgtacatgtgaatttaggcaa

SEQ ID NO: 7969797 - DNA, 18 bp, Homo sapiens
atgtacatgtactcacac

SEQ ID NO: 7969798 - DNA, 22 bp, Homo sapiens
atgtacattattcgagtgatgg

SEQ ID NO: 7969799 - DNA, 22 bp, Homo sapiens
atgtacatgtttaagtgaagga

SEQ ID NO: 7969800 - DNA, 22 bp, Homo sapiens
atgtacattattcgagtgatgg

SEQ ID NO: 7969801 - DNA, 21 bp, Homo sapiens
atgtacattcggcaacagata

SEQ ID NO: 7969802 - DNA, 22 bp, Homo sapiens
atgtacatttagatcatttctg

SEQ ID NO: 7969803 - DNA, 22 bp, Homo sapiens
atgtacattcttctcaccgaag

SEQ ID NO: 7969804 - DNA, 22 bp, Homo sapiens
atgtacattcttctcaccgaag

SEQ ID NO: 7969805 - DNA, 22 bp, Homo sapiens
atgtacattcttctcaccgaag

SEQ ID NO: 7969806 - DNA, 22 bp, Homo sapiens
atgtacattctaagtatgtgta

SEQ ID NO: 7969807 - DNA, 22 bp, Homo sapiens
atgtacattctaagtatgtgta

SEQ ID NO: 7969808 - DNA, 21 bp, Homo sapiens
atgtacattcggcaacagata

SEQ ID NO: 7969809 - DNA, 21 bp, Homo sapiens
atgtacattcggcaacagata

SEQ ID NO: 7969810 - DNA, 17 bp, Homo sapiens
gaggagctccagtaggt

SEQ ID NO: 7969811 - DNA, 17 bp, Homo sapiens
gaggagctccagtaggt

SEQ ID NO: 7969812 - DNA, 22 bp, Homo sapiens
atgtagaaagttattgtcactg

SEQ ID NO: 7969813 - DNA, 22 bp, Homo sapiens
atgtactgactgtacttttaaa

SEQ ID NO: 7969814 - DNA, 19 bp, Homo sapiens
atgtacccagtgtcaatcc

SEQ ID NO: 7969815 - DNA, 19 bp, Homo sapiens
atgtacccagtgtcaatcc

SEQ ID NO: 7969816 - DNA, 19 bp, Homo sapiens
atgtacccagtgtcaatcc

SEQ ID NO: 7969817 - DNA, 22 bp, Homo sapiens
atgtactaaagaaatttgcagg

SEQ ID NO: 7969818 - DNA, 22 bp, Homo sapiens
gaggagctctgctccatccttc

SEQ ID NO: 7969819 - DNA, 17 bp, Homo sapiens
gaggagctccagtaggt

SEQ ID NO: 7969820 - DNA, 22 bp, Homo sapiens
gaggagctgcagggggagtcta

SEQ ID NO: 7969821 - DNA, 22 bp, Homo sapiens
gaggagctgcagggggagtcta

SEQ ID NO: 7969822 - DNA, 22 bp, Homo sapiens
gaggagctgaggctgaggcctc

SEQ ID NO: 7969823 - DNA, 22 bp, Homo sapiens
gaggagctgaggctgaggcctc

SEQ ID NO: 7969824 - DNA, 22 bp, Homo sapiens
gaggagctgaggctgaggcctc

SEQ ID NO: 7969825 - DNA, 22 bp, Homo sapiens
gaggagctgatatttataatga

SEQ ID NO: 7969826 - DNA, 22 bp, Homo sapiens
gaggagctgatatttataatga

SEQ ID NO: 7969827 - DNA, 22 bp, Homo sapiens
gaggagctgatatttataatga

SEQ ID NO: 7969828 - DNA, 22 bp, Homo sapiens
ggatgttctggggttctcttgt

SEQ ID NO: 7969829 - DNA, 22 bp, Homo sapiens
ggatgtggaccttgcctggtga

SEQ ID NO: 7969830 - DNA, 22 bp, Homo sapiens
ggatgtggaccttgcctggtga

SEQ ID NO: 7969831 - DNA, 22 bp, Homo sapiens
ggatgttctggggttctcttgt

SEQ ID NO: 7969832 - DNA, 22 bp, Homo sapiens
ggatgttctggggttctcttgt

SEQ ID NO: 7969833 - DNA, 22 bp, Homo sapiens
ggatgttctggggttctcttgt

SEQ ID NO: 7969834 - DNA, 18 bp, Homo sapiens
ggatgtgaaccagagata

SEQ ID NO: 7969835 - DNA, 22 bp, Homo sapiens
ggatgtctttactttgggattt

SEQ ID NO: 7969836 - DNA, 22 bp, Homo sapiens
ggatgtctgtcattatgctttc

SEQ ID NO: 7969837 - DNA, 22 bp, Homo sapiens
ggatgtctttactttgggattt

SEQ ID NO: 7969838 - DNA, 22 bp, Homo sapiens
ggatgtgaatctgggctgagac

SEQ ID NO: 7969839 - DNA, 22 bp, Homo sapiens
ggatgtctagggtttatgtgcc

SEQ ID NO: 7969840 - DNA, 22 bp, Homo sapiens
ggatgtctagggtttatgtgcc

SEQ ID NO: 7969841 - DNA, 22 bp, Homo sapiens
ggatgtctcccagcaccaaagt

SEQ ID NO: 7969842 - DNA, 22 bp, Homo sapiens
ggatgtctgtcattatgctttc

SEQ ID NO: 7969843 - DNA, 22 bp, Homo sapiens
ggatgtctcccagcaccaaagt

SEQ ID NO: 7969844 - DNA, 22 bp, Homo sapiens
ggatgtctggtctatttcaagt

SEQ ID NO: 7969845 - DNA, 22 bp, Homo sapiens
ggatgtctggtctatttcaagt

SEQ ID NO: 7969846 - DNA, 22 bp, Homo sapiens
ggatgtaactttcctagtccat

SEQ ID NO: 7969847 - DNA, 19 bp, Homo sapiens
ggatggtggggtgcccatc

SEQ ID NO: 7969848 - DNA, 22 bp, Homo sapiens
ggatgtcgaggatggggtagca

SEQ ID NO: 7969849 - DNA, 22 bp, Homo sapiens
ggatgggttccgtgggcaaatg

SEQ ID NO: 7969850 - DNA, 22 bp, Homo sapiens
ggatggtcagaggaccaaatac

SEQ ID NO: 7969851 - DNA, 19 bp, Homo sapiens
ggatggtggggtgcccatc

SEQ ID NO: 7969852 - DNA, 22 bp, Homo sapiens
ggatggtcagaggaccaaatac

SEQ ID NO: 7969853 - DNA, 22 bp, Homo sapiens
ggatgggcccgggacggcgctg

SEQ ID NO: 7969854 - DNA, 22 bp, Homo sapiens
ggatgggcagacaggacggcac

SEQ ID NO: 7969855 - DNA, 22 bp, Homo sapiens
ggatgggcccgggacggcgctg

SEQ ID NO: 7969856 - DNA, 22 bp, Homo sapiens
ggatgggctgaaaggtagcccc

SEQ ID NO: 7969857 - DNA, 22 bp, Homo sapiens
ggatgggcccgggacggcgctg

SEQ ID NO: 7969858 - DNA, 22 bp, Homo sapiens
cacagggaggcagccatgctcc

SEQ ID NO: 7969859 - DNA, 22 bp, Homo sapiens
cacagggaggcagccatgctcc

SEQ ID NO: 7969860 - DNA, 19 bp, Homo sapiens
cacagggagaccacatgtc

SEQ ID NO: 7969861 - DNA, 22 bp, Homo sapiens
cacagggaggcagccatgctcc

SEQ ID NO: 7969862 - DNA, 22 bp, Homo sapiens
cacagggaggacatcaacagtg

SEQ ID NO: 7969863 - DNA, 22 bp, Homo sapiens
cacagggaggacatcaacagtg

SEQ ID NO: 7969864 - DNA, 22 bp, Homo sapiens
cacagggaggacatcaacagtg

SEQ ID NO: 7969865 - DNA, 22 bp, Homo sapiens
cacagggagaggaacagcgcag

SEQ ID NO: 7969866 - DNA, 22 bp, Homo sapiens
cacagggagaggaacagcgcag

SEQ ID NO: 7969867 - DNA, 22 bp, Homo sapiens
ggatgttgattgaatggccatt

SEQ ID NO: 7969868 - DNA, 19 bp, Homo sapiens
cacagggagaccacatgtc

SEQ ID NO: 7969869 - DNA, 19 bp, Homo sapiens
cacagggagaccacatgtc

SEQ ID NO: 7969870 - DNA, 22 bp, Homo sapiens
cacagggaggcggtcactggct

SEQ ID NO: 7969871 - DNA, 22 bp, Homo sapiens
cacagggaggcggtcactggct

SEQ ID NO: 7969872 - DNA, 23 bp, Homo sapiens
cacagggagggaaactctttcag

SEQ ID NO: 7969873 - DNA, 22 bp, Homo sapiens
cacagggagttacagaagcact

SEQ ID NO: 7969874 - DNA, 22 bp, Homo sapiens
cacagggagttacagaagcact

SEQ ID NO: 7969875 - DNA, 22 bp, Homo sapiens
cacagggagttacagaagcact

SEQ ID NO: 7969876 - DNA, 22 bp, Homo sapiens
cacagggagttacagaagcact

SEQ ID NO: 7969877 - DNA, 22 bp, Homo sapiens
cacagggcagagacctgggtgc

SEQ ID NO: 7969878 - DNA, 22 bp, Homo sapiens
cacagggcagagacctgggtgc

SEQ ID NO: 7969879 - DNA, 22 bp, Homo sapiens
cacagggaggcggtcactggct

SEQ ID NO: 7969880 - DNA, 22 bp, Homo sapiens
cacagggcagagacctgggtgc

SEQ ID NO: 7969881 - DNA, 22 bp, Homo sapiens
cacagggcaccagttggccatc

SEQ ID NO: 7969882 - DNA, 22 bp, Homo sapiens
cacagggcaccagttggccatc

SEQ ID NO: 7969883 - DNA, 22 bp, Homo sapiens
cacagggcaccagttggccatc

SEQ ID NO: 7969884 - DNA, 22 bp, Homo sapiens
cacagggagttacagaagcact

SEQ ID NO: 7969885 - DNA, 22 bp, Homo sapiens
cacagggagttacagaagcact

SEQ ID NO: 7969886 - DNA, 22 bp, Homo sapiens
ggatgggaacttggtagggcat

SEQ ID NO: 7969887 - DNA, 22 bp, Homo sapiens
ggatgggaacttggtagggcat

SEQ ID NO: 7969888 - DNA, 22 bp, Homo sapiens
ggatctgggctctgccaatcag

SEQ ID NO: 7969889 - DNA, 22 bp, Homo sapiens
ggatctgagagcaagcaggacc

SEQ ID NO: 7969890 - DNA, 22 bp, Homo sapiens
ggatctgagagcaagcaggacc

SEQ ID NO: 7969891 - DNA, 22 bp, Homo sapiens
ggatgggaacttggtagggcat

SEQ ID NO: 7969892 - DNA, 23 bp, Homo sapiens
ggatgggcaagcctagtgcctac

SEQ ID NO: 7969893 - DNA, 23 bp, Homo sapiens
ggatgggcaagcctagtgcctac

SEQ ID NO: 7969894 - DNA, 22 bp, Homo sapiens
ggatgggcagacaggacggcac

SEQ ID NO: 7969895 - DNA, 23 bp, Homo sapiens
ggatgggcaagcctagtgcctac

SEQ ID NO: 7969896 - DNA, 22 bp, Homo sapiens
ggatgggagcagaggacgacca

SEQ ID NO: 7969897 - DNA, 22 bp, Homo sapiens
ggatgggagcagaggacgacca

SEQ ID NO: 7969898 - DNA, 22 bp, Homo sapiens
ggatgggagcagaggacgacca

SEQ ID NO: 7969899 - DNA, 22 bp, Homo sapiens
ggagggagtcagctgattagaa

SEQ ID NO: 7969900 - DNA, 22 bp, Homo sapiens
ggagggagtcagctgattagaa

SEQ ID NO: 7969901 - DNA, 22 bp, Homo sapiens
ggagggagtcagctgattagaa

SEQ ID NO: 7969902 - DNA, 22 bp, Homo sapiens
ggagggagtttcattcctgccc

SEQ ID NO: 7969903 - DNA, 22 bp, Homo sapiens
ggagggagtttcattcctgccc

SEQ ID NO: 7969904 - DNA, 22 bp, Homo sapiens
ggagggagtttcattcctgccc

SEQ ID NO: 7969905 - DNA, 22 bp, Homo sapiens
ggagggagcagagaacccaacc

SEQ ID NO: 7969906 - DNA, 22 bp, Homo sapiens
ggagggagcagagaacccaacc

SEQ ID NO: 7969907 - DNA, 22 bp, Homo sapiens
ggagggagcatccccttgctga

SEQ ID NO: 7969908 - DNA, 22 bp, Homo sapiens
ggagggagcatccccttgctga

SEQ ID NO: 7969909 - DNA, 22 bp, Homo sapiens
ggagggagcatccccttgctga

SEQ ID NO: 7969910 - DNA, 22 bp, Homo sapiens
ggaggcggaggctgcagtgagc

SEQ ID NO: 7969911 - DNA, 22 bp, Homo sapiens
ggaggcggaggctgcagtgagc

SEQ ID NO: 7969912 - DNA, 22 bp, Homo sapiens
ggaggcggaggctgcagtgagc

SEQ ID NO: 7969913 - DNA, 22 bp, Homo sapiens
ggaggcggaggctgcagtgagc

SEQ ID NO: 7969914 - DNA, 22 bp, Homo sapiens
ggagggagggctagaccaaaga

SEQ ID NO: 7969915 - DNA, 22 bp, Homo sapiens
ggagggagggctagaccaaaga

SEQ ID NO: 7969916 - DNA, 22 bp, Homo sapiens
ggagggagggctagaccaaaga

SEQ ID NO: 7969917 - DNA, 22 bp, Homo sapiens
ggagggagggctagaccaaaga

SEQ ID NO: 7969918 - DNA, 22 bp, Homo sapiens
ggagggagcatccccttgctga

SEQ ID NO: 7969919 - DNA, 22 bp, Homo sapiens
ggagggagcatccccttgctga

SEQ ID NO: 7969920 - DNA, 22 bp, Homo sapiens
ggagggaggttagattcaagct

SEQ ID NO: 7969921 - DNA, 22 bp, Homo sapiens
ggagggaggttagattcaagct

SEQ ID NO: 7969922 - DNA, 22 bp, Homo sapiens
ggagggagggctagaccaaaga

SEQ ID NO: 7969923 - DNA, 22 bp, Homo sapiens
ggagggaggttagattcaagct

SEQ ID NO: 7969924 - DNA, 22 bp, Homo sapiens
ggagggagggctagaccaaaga

SEQ ID NO: 7969925 - DNA, 22 bp, Homo sapiens
cacagcttctgagtgaggattt

SEQ ID NO: 7969926 - DNA, 22 bp, Homo sapiens
cacagcttctgagtgaggattt

SEQ ID NO: 7969927 - DNA, 22 bp, Homo sapiens
cacagcttctccttgatatcgc

SEQ ID NO: 7969928 - DNA, 22 bp, Homo sapiens
cacagcttctccccgctgcggc

SEQ ID NO: 7969929 - DNA, 22 bp, Homo sapiens
cacagcttcccaaagtggacct

SEQ ID NO: 7969930 - DNA, 22 bp, Homo sapiens
cacagcttcccgtgcatggaga

SEQ ID NO: 7969931 - DNA, 22 bp, Homo sapiens
cacagcttctccttgatatcgc

SEQ ID NO: 7969932 - DNA, 22 bp, Homo sapiens
cacagcttctccccgctgcggc

SEQ ID NO: 7969933 - DNA, 22 bp, Homo sapiens
cacagcttcttccattccactc

SEQ ID NO: 7969934 - DNA, 20 bp, Homo sapiens
cacagcttgccttttatgac

SEQ ID NO: 7969935 - DNA, 22 bp, Homo sapiens
cacagcttctgtctgacccatg

SEQ ID NO: 7969936 - DNA, 22 bp, Homo sapiens
cacagcttcttccattccactc

SEQ ID NO: 7969937 - DNA, 22 bp, Homo sapiens
cacagcttctgtctgacccatg

SEQ ID NO: 7969938 - DNA, 22 bp, Homo sapiens
ggaggccaaggcaggtggatcg

SEQ ID NO: 7969939 - DNA, 22 bp, Homo sapiens
cacagcttgtttagtgactcac

SEQ ID NO: 7969940 - DNA, 22 bp, Homo sapiens
ggaggccaaggcaggtggatca

SEQ ID NO: 7969941 - DNA, 22 bp, Homo sapiens
cacagcttgggctctgacaata

SEQ ID NO: 7969942 - DNA, 22 bp, Homo sapiens
ggaggccttgcctgcaggcaca

SEQ ID NO: 7969943 - DNA, 22 bp, Homo sapiens
ggaggccttgcctgcaggcaca

SEQ ID NO: 7969944 - DNA, 22 bp, Homo sapiens
ggaggccttgcctgcaggcaca

SEQ ID NO: 7969945 - DNA, 22 bp, Homo sapiens
ggaggccaaggcaggtggatcg

SEQ ID NO: 7969946 - DNA, 20 bp, Homo sapiens
ggaggcgctgggctcgcgct

SEQ ID NO: 7969947 - DNA, 20 bp, Homo sapiens
ggaggcgctgggctcgcgct

SEQ ID NO: 7969948 - DNA, 22 bp, Homo sapiens
ggaggcgcggctcggctgtgcc

SEQ ID NO: 7969949 - DNA, 22 bp, Homo sapiens
ggaggcgcggctcggctgtgcc

SEQ ID NO: 7969950 - DNA, 22 bp, Homo sapiens
ggaggcgcggctcggctgtgcc

SEQ ID NO: 7969951 - DNA, 22 bp, Homo sapiens
ggaggcgatcctgggaaacacc

SEQ ID NO: 7969952 - DNA, 22 bp, Homo sapiens
ggaggcggaagttgcagtgagc

SEQ ID NO: 7969953 - DNA, 22 bp, Homo sapiens
ggaggcggaagttgcagtgagc

SEQ ID NO: 7969954 - DNA, 22 bp, Homo sapiens
ggaggcggaagttgcagtgagc

SEQ ID NO: 7969955 - DNA, 22 bp, Homo sapiens
ggaggcggaagttgcagtgagc

SEQ ID NO: 7969956 - DNA, 22 bp, Homo sapiens
ggaggcggaagttgcagtgagc

SEQ ID NO: 7969957 - DNA, 22 bp, Homo sapiens
ggaggcggaagttgcagtgagc

SEQ ID NO: 7969958 - DNA, 22 bp, Homo sapiens
ggaggcggacacaggtagtgtt

SEQ ID NO: 7969959 - DNA, 22 bp, Homo sapiens
ggaggcggacacaggtagtgtt

SEQ ID NO: 7969960 - DNA, 22 bp, Homo sapiens
ggaggcggacacaggtagtgtt

SEQ ID NO: 7969961 - DNA, 22 bp, Homo sapiens
ggaggcggacacaggtagtgtt

SEQ ID NO: 7969962 - DNA, 22 bp, Homo sapiens
ggaggcggacacaggtagtgtt

SEQ ID NO: 7969963 - DNA, 22 bp, Homo sapiens
ggaggcggagcttgcagtgagc

SEQ ID NO: 7969964 - DNA, 22 bp, Homo sapiens
ggaggcggagcttgcagtgagc

SEQ ID NO: 7969965 - DNA, 22 bp, Homo sapiens
ggaggcggagcttgcagtgagc

SEQ ID NO: 7969966 - DNA, 22 bp, Homo sapiens
ggaggcggacacaggtagtgtt

SEQ ID NO: 7969967 - DNA, 22 bp, Homo sapiens
ggaggcggagcttgcagtgagc

SEQ ID NO: 7969968 - DNA, 22 bp, Homo sapiens
ggaggcggaggctgcagtgagc

SEQ ID NO: 7969969 - DNA, 22 bp, Homo sapiens
ggaggcggaggctgcagtgagc

SEQ ID NO: 7969970 - DNA, 22 bp, Homo sapiens
ggaggcggagcttgcagtgagc

SEQ ID NO: 7969971 - DNA, 22 bp, Homo sapiens
ggaggcggagcttgcagtgagc

SEQ ID NO: 7969972 - DNA, 22 bp, Homo sapiens
cacagcttcagtttctgacttg

SEQ ID NO: 7969973 - DNA, 22 bp, Homo sapiens
cacagcttcagtttctgacttg

SEQ ID NO: 7969974 - DNA, 22 bp, Homo sapiens
cacagcttatgccactgattgg

SEQ ID NO: 7969975 - DNA, 22 bp, Homo sapiens
cacagcttatgccactgattgg

SEQ ID NO: 7969976 - DNA, 22 bp, Homo sapiens
cacagcttagaaaagaagccat

SEQ ID NO: 7969977 - DNA, 22 bp, Homo sapiens
cacagcttagaaaagaagccat

SEQ ID NO: 7969978 - DNA, 22 bp, Homo sapiens
cacagctgtgagaagggagcct

SEQ ID NO: 7969979 - DNA, 22 bp, Homo sapiens
cacagcttcccgtgcatggaga

SEQ ID NO: 7969980 - DNA, 22 bp, Homo sapiens
cacagcttcccaaagtggacct

SEQ ID NO: 7969981 - DNA, 22 bp, Homo sapiens
cacagcttccattagaatgaga

SEQ ID NO: 7969982 - DNA, 22 bp, Homo sapiens
cacagcttccattagaatgaga

SEQ ID NO: 7969983 - DNA, 22 bp, Homo sapiens
cacagcttccattagaatgaga

SEQ ID NO: 7969984 - DNA, 22 bp, Homo sapiens
cacagcttccattagaatgaga

SEQ ID NO: 7969985 - DNA, 22 bp, Homo sapiens
cacagctgtgagaagggagcct

SEQ ID NO: 7969986 - DNA, 22 bp, Homo sapiens
cacagctgtgagaagggagcct

SEQ ID NO: 7969987 - DNA, 22 bp, Homo sapiens
cacagctgtgagaagggagcct

SEQ ID NO: 7969988 - DNA, 22 bp, Homo sapiens
cacagctgttttctccaggcag

SEQ ID NO: 7969989 - DNA, 22 bp, Homo sapiens
cacagctgttttctccaggcag

SEQ ID NO: 7969990 - DNA, 22 bp, Homo sapiens
cacagctgttttctccaggcag

SEQ ID NO: 7969991 - DNA, 22 bp, Homo sapiens
cacagctgtgagaagggagcct

SEQ ID NO: 7969992 - DNA, 22 bp, Homo sapiens
cacagctgttttctccaggcag

SEQ ID NO: 7969993 - DNA, 22 bp, Homo sapiens
cacagctgttttctccaggcag

SEQ ID NO: 7969994 - DNA, 22 bp, Homo sapiens
cacagctgtcagctgacctagg

SEQ ID NO: 7969995 - DNA, 22 bp, Homo sapiens
cacagctgtcagctgacctagg

SEQ ID NO: 7969996 - DNA, 22 bp, Homo sapiens
cacagctgtcagctgacctagg

SEQ ID NO: 7969997 - DNA, 22 bp, Homo sapiens
cacagctgtcagctgacctagg

SEQ ID NO: 7969998 - DNA, 22 bp, Homo sapiens
cacagctgtatccaggagatcc

SEQ ID NO: 7969999 - DNA, 22 bp, Homo sapiens
cacagctgtatccaggagatcc

SEQ ID NO: 7970000 - DNA, 22 bp, Homo sapiens
cacagctggtgcactagctctg

SEQ ID NO: 7970001 - DNA, 22 bp, Homo sapiens
cacagctgaagtagccatgtgg

SEQ ID NO: 7970002 - DNA, 22 bp, Homo sapiens
cacactgtcaggtaaataacac

SEQ ID NO: 7970003 - DNA, 22 bp, Homo sapiens
cacactgtccccttctccccag

SEQ ID NO: 7970004 - DNA, 22 bp, Homo sapiens
cacactgcttacacaaaatgat

SEQ ID NO: 7970005 - DNA, 22 bp, Homo sapiens
cacactgtcaggtaaataacac

SEQ ID NO: 7970006 - DNA, 22 bp, Homo sapiens
cacagctggtgcactagctctg

SEQ ID NO: 7970007 - DNA, 22 bp, Homo sapiens
cacagctggtgcactagctctg

SEQ ID NO: 7970008 - DNA, 22 bp, Homo sapiens
cacagctggtgcactagctctg

SEQ ID NO: 7970009 - DNA, 22 bp, Homo sapiens
cacagctggtgacagagcccag

SEQ ID NO: 7970010 - DNA, 22 bp, Homo sapiens
cacagctggtgacagagcccag

SEQ ID NO: 7970011 - DNA, 22 bp, Homo sapiens
cacagctggtgacagagcccag

SEQ ID NO: 7970012 - DNA, 22 bp, Homo sapiens
cacagctggtgacagagcccag

SEQ ID NO: 7970013 - DNA, 22 bp, Homo sapiens
cacagctgaccaccctgctccc

SEQ ID NO: 7970014 - DNA, 22 bp, Homo sapiens
cacactgtcaggtaaataacac

SEQ ID NO: 7970015 - DNA, 22 bp, Homo sapiens
cacactgtcaggtaaataacac

SEQ ID NO: 7970016 - DNA, 22 bp, Homo sapiens
cacactgccacattcactcttc

SEQ ID NO: 7970017 - DNA, 22 bp, Homo sapiens
cacactgccacattcactcttc

SEQ ID NO: 7970018 - DNA, 22 bp, Homo sapiens
cacactgactggaatcaaggat

SEQ ID NO: 7970019 - DNA, 22 bp, Homo sapiens
cacactgataggcttgacaggc

SEQ ID NO: 7970020 - DNA, 22 bp, Homo sapiens
cacactatcttcctatcctggc

SEQ ID NO: 7970021 - DNA, 22 bp, Homo sapiens
cacactcattagtcatttctct

SEQ ID NO: 7970022 - DNA, 22 bp, Homo sapiens
cacactcattagtcatttctct

SEQ ID NO: 7970023 - DNA, 22 bp, Homo sapiens
cacactgactggaatcaaggat

SEQ ID NO: 7970024 - DNA, 22 bp, Homo sapiens
cacactgactggaatcaaggat

SEQ ID NO: 7970025 - DNA, 22 bp, Homo sapiens
cacagtgtagttaatgtgacat

SEQ ID NO: 7970026 - DNA, 22 bp, Homo sapiens
cacagtgtctgtgcttcagtgt

SEQ ID NO: 7970027 - DNA, 22 bp, Homo sapiens
cacagtgtctgtgcttcagtgt

SEQ ID NO: 7970028 - DNA, 22 bp, Homo sapiens
ggcagatggaagaggctgggtc

SEQ ID NO: 7970029 - DNA, 22 bp, Homo sapiens
ggcagcagttacaaatgtgcag

SEQ ID NO: 7970030 - DNA, 22 bp, Homo sapiens
ggcagcagttacaaatgtgcag

SEQ ID NO: 7970031 - DNA, 22 bp, Homo sapiens
ggcagcagttacaaatgtgcag

SEQ ID NO: 7970032 - DNA, 22 bp, Homo sapiens
ggcagcagttacaaatgtgcag

SEQ ID NO: 7970033 - DNA, 22 bp, Homo sapiens
ggcagcagtggctgctattgtc

SEQ ID NO: 7970034 - DNA, 22 bp, Homo sapiens
ggcagcagtggctgctattgtc

SEQ ID NO: 7970035 - DNA, 22 bp, Homo sapiens
ggcagcagtggctgctattgtc

SEQ ID NO: 7970036 - DNA, 22 bp, Homo sapiens
ggcagcagtggctgctattgtc

SEQ ID NO: 7970037 - DNA, 22 bp, Homo sapiens
ggcagcagtggctgctattgtc

SEQ ID NO: 7970038 - DNA, 22 bp, Homo sapiens
ggcagcagtggctgctattgtc

SEQ ID NO: 7970039 - DNA, 22 bp, Homo sapiens
ggcagcagtggctgctattgtc

SEQ ID NO: 7970040 - DNA, 22 bp, Homo sapiens
ggcagatggaaggacagacgga

SEQ ID NO: 7970041 - DNA, 22 bp, Homo sapiens
ggcagatggaaggacagacgga

SEQ ID NO: 7970042 - DNA, 22 bp, Homo sapiens
ggcagcatatattcagtgggca

SEQ ID NO: 7970043 - DNA, 22 bp, Homo sapiens
ggcagcagttacaaatgtgcag

SEQ ID NO: 7970044 - DNA, 22 bp, Homo sapiens
ggcagcatatattcagtgggca

SEQ ID NO: 7970045 - DNA, 22 bp, Homo sapiens
ggcagcagttacaaatgtgcag

SEQ ID NO: 7970046 - DNA, 22 bp, Homo sapiens
ggcagcagttacaaatgtgcag

SEQ ID NO: 7970047 - DNA, 22 bp, Homo sapiens
ggcagcatcccatggaccgcat

SEQ ID NO: 7970048 - DNA, 22 bp, Homo sapiens
ggcagcatcacttgtctccagc

SEQ ID NO: 7970049 - DNA, 22 bp, Homo sapiens
ggcagcatcacttgtctccagc

SEQ ID NO: 7970050 - DNA, 22 bp, Homo sapiens
ggcagcatcacttgtctccagc

SEQ ID NO: 7970051 - DNA, 22 bp, Homo sapiens
ggcagcatatattcagtgggca

SEQ ID NO: 7970052 - DNA, 22 bp, Homo sapiens
ggcagcatatattcagtgggca

SEQ ID NO: 7970053 - DNA, 22 bp, Homo sapiens
ggcagcatatattcagtgggca

SEQ ID NO: 7970054 - DNA, 22 bp, Homo sapiens
ggcagcatccgcccggcaccct

SEQ ID NO: 7970055 - DNA, 22 bp, Homo sapiens
ggcagcatccgcccggcaccct

SEQ ID NO: 7970056 - DNA, 22 bp, Homo sapiens
ggcagcatcccatggaccgcat

SEQ ID NO: 7970057 - DNA, 22 bp, Homo sapiens
ggcagcatcccatggaccgcat

SEQ ID NO: 7970058 - DNA, 22 bp, Homo sapiens
ggcagcatctcatatcttcagg

SEQ ID NO: 7970059 - DNA, 22 bp, Homo sapiens
ggcagcatccgcccggcaccct

SEQ ID NO: 7970060 - DNA, 22 bp, Homo sapiens
ggcagcatctctggcagcagct

SEQ ID NO: 7970061 - DNA, 22 bp, Homo sapiens
ggcagcatctcatatcttcagg

SEQ ID NO: 7970062 - DNA, 22 bp, Homo sapiens
ggcagcatctctggcagcagct

SEQ ID NO: 7970063 - DNA, 22 bp, Homo sapiens
ggcagcatcttgatattggttt

SEQ ID NO: 7970064 - DNA, 22 bp, Homo sapiens
ggcagcatctctggcagcagct

SEQ ID NO: 7970065 - DNA, 22 bp, Homo sapiens
ggcagcatgagcctggtgaatt

SEQ ID NO: 7970066 - DNA, 22 bp, Homo sapiens
ggcagcatgagcctggtgaatt

SEQ ID NO: 7970067 - DNA, 22 bp, Homo sapiens
ggcagcatcttgatattggttt

SEQ ID NO: 7970068 - DNA, 22 bp, Homo sapiens
ggcagcatcttgatattggttt

SEQ ID NO: 7970069 - DNA, 22 bp, Homo sapiens
ggcagccaccctgggaggcaga

SEQ ID NO: 7970070 - DNA, 22 bp, Homo sapiens
ggcagccaccctgggaggcaga

SEQ ID NO: 7970071 - DNA, 20 bp, Homo sapiens
ggcagccaatcagcgtgccg

SEQ ID NO: 7970072 - DNA, 20 bp, Homo sapiens
ggcagccaatcagcgtgccg

SEQ ID NO: 7970073 - DNA, 22 bp, Homo sapiens
ggcagccaccctgggaggcaga

SEQ ID NO: 7970074 - DNA, 22 bp, Homo sapiens
ggcagccaccctgggaggcaga

SEQ ID NO: 7970075 - DNA, 22 bp, Homo sapiens
ggcagccaccctgggaggcaga

SEQ ID NO: 7970076 - DNA, 22 bp, Homo sapiens
ggcagcatgggtgcctttgtga

SEQ ID NO: 7970077 - DNA, 22 bp, Homo sapiens
ggcagcatgagcctggtgaatt

SEQ ID NO: 7970078 - DNA, 22 bp, Homo sapiens
ggcagcatgggtgcctttgtga

SEQ ID NO: 7970079 - DNA, 22 bp, Homo sapiens
ggcagcatgtgtggtccgctgg

SEQ ID NO: 7970080 - DNA, 22 bp, Homo sapiens
ggcagcatgggtgcctttgtga

SEQ ID NO: 7970081 - DNA, 22 bp, Homo sapiens
ggcagcatgtgtggtccgctgg

SEQ ID NO: 7970082 - DNA, 22 bp, Homo sapiens
ggcagcatgtgtggtccgctgg

SEQ ID NO: 7970083 - DNA, 22 bp, Homo sapiens
ggcagcatttagagcacagtgt

SEQ ID NO: 7970084 - DNA, 22 bp, Homo sapiens
ggcagcatttagagcacagtgt

SEQ ID NO: 7970085 - DNA, 22 bp, Homo sapiens
ggcagcatttagagcacagtgt

SEQ ID NO: 7970086 - DNA, 22 bp, Homo sapiens
ggcagcattgcctttgcagtga

SEQ ID NO: 7970087 - DNA, 22 bp, Homo sapiens
ggcagcattgcctttgcagtga

SEQ ID NO: 7970088 - DNA, 22 bp, Homo sapiens
ggcagcattgcctttgcagtga

SEQ ID NO: 7970089 - DNA, 22 bp, Homo sapiens
ggcagcattgccaatccagaca

SEQ ID NO: 7970090 - DNA, 16 bp, Homo sapiens
cacagtgctgctgctc

SEQ ID NO: 7970091 - DNA, 22 bp, Homo sapiens
cacagtgctcgggttttatgtc

SEQ ID NO: 7970092 - DNA, 16 bp, Homo sapiens
cacagtgctgctgctc

SEQ ID NO: 7970093 - DNA, 22 bp, Homo sapiens
cacagtgctcgggttttatgtc

SEQ ID NO: 7970094 - DNA, 22 bp, Homo sapiens
cacagtgctcgggttttatgtc

SEQ ID NO: 7970095 - DNA, 22 bp, Homo sapiens
cacagtgctgtttgtaaagaga

SEQ ID NO: 7970096 - DNA, 22 bp, Homo sapiens
cacagtgctttacatgttttct

SEQ ID NO: 7970097 - DNA, 22 bp, Homo sapiens
cacagtgctttacatgttttct

SEQ ID NO: 7970098 - DNA, 22 bp, Homo sapiens
cacagtgctgtttgtaaagaga

SEQ ID NO: 7970099 - DNA, 22 bp, Homo sapiens
cacagtgctttatgagagatct

SEQ ID NO: 7970100 - DNA, 22 bp, Homo sapiens
cacagtgctttacatgttttct

SEQ ID NO: 7970101 - DNA, 22 bp, Homo sapiens
ggcagagcttgcagtgagccga

SEQ ID NO: 7970102 - DNA, 22 bp, Homo sapiens
ggcagagcttgcagtgagccga

SEQ ID NO: 7970103 - DNA, 22 bp, Homo sapiens
ggcagagcttgcagtgagccga

SEQ ID NO: 7970104 - DNA, 22 bp, Homo sapiens
cacagtgcgaaagaaacccagc

SEQ ID NO: 7970105 - DNA, 22 bp, Homo sapiens
cacagtgctcaaacacaagtgc

SEQ ID NO: 7970106 - DNA, 22 bp, Homo sapiens
cacagtgctcaaacacaagtgc

SEQ ID NO: 7970107 - DNA, 22 bp, Homo sapiens
cacagtgctttatgagagatct

SEQ ID NO: 7970108 - DNA, 22 bp, Homo sapiens
cacagtgctttatgagagatct

SEQ ID NO: 7970109 - DNA, 22 bp, Homo sapiens
cacagtgctttatgagagatct

SEQ ID NO: 7970110 - DNA, 22 bp, Homo sapiens
cacagtggaagtccaggatccc

SEQ ID NO: 7970111 - DNA, 22 bp, Homo sapiens
cacagtggaagtccaggatccc

SEQ ID NO: 7970112 - DNA, 22 bp, Homo sapiens
cacagtggaagtccaggatccc

SEQ ID NO: 7970113 - DNA, 22 bp, Homo sapiens
cacagtggcaaaggggcttggg

SEQ ID NO: 7970114 - DNA, 22 bp, Homo sapiens
cacagtggattgggtgatgccc

SEQ ID NO: 7970115 - DNA, 22 bp, Homo sapiens
cacagtggcaaaggggcttggg

SEQ ID NO: 7970116 - DNA, 22 bp, Homo sapiens
cacagtggattgggtgatgccc

SEQ ID NO: 7970117 - DNA, 22 bp, Homo sapiens
ggcagagctctggactgagaac

SEQ ID NO: 7970118 - DNA, 19 bp, Homo sapiens
ggcagagctcctgctttct

SEQ ID NO: 7970119 - DNA, 19 bp, Homo sapiens
ggcagagctcctgctttct

SEQ ID NO: 7970120 - DNA, 20 bp, Homo sapiens
ggcagagctatgtctgttgc

SEQ ID NO: 7970121 - DNA, 20 bp, Homo sapiens
ggcagagctatgtctgttgc

SEQ ID NO: 7970122 - DNA, 20 bp, Homo sapiens
ggcagagctatgtctgttgc

SEQ ID NO: 7970123 - DNA, 22 bp, Homo sapiens
ggcagagctagtggcttctctt

SEQ ID NO: 7970124 - DNA, 22 bp, Homo sapiens
ggcagagctagtggcttctctt

SEQ ID NO: 7970125 - DNA, 22 bp, Homo sapiens
ggcagagctagtggcttctctt

SEQ ID NO: 7970126 - DNA, 22 bp, Homo sapiens
ggcagagctagtggcttctctt

SEQ ID NO: 7970127 - DNA, 22 bp, Homo sapiens
ggcagagctagtggcttctctt

SEQ ID NO: 7970128 - DNA, 22 bp, Homo sapiens
ggcagagctagtggcttctctt

SEQ ID NO: 7970129 - DNA, 22 bp, Homo sapiens
ggcagagccttctggagctcgc

SEQ ID NO: 7970130 - DNA, 22 bp, Homo sapiens
ggcagagccttctggagctcgc

SEQ ID NO: 7970131 - DNA, 22 bp, Homo sapiens
ggcagagcgcatgcgtcgcaga

SEQ ID NO: 7970132 - DNA, 21 bp, Homo sapiens
ggcagagctggggcctccagc

SEQ ID NO: 7970133 - DNA, 21 bp, Homo sapiens
ggcagagctggggcctccagc

SEQ ID NO: 7970134 - DNA, 21 bp, Homo sapiens
ggcagagctggggcctccagc

SEQ ID NO: 7970135 - DNA, 22 bp, Homo sapiens
ggcagagctgcatgagcactca

SEQ ID NO: 7970136 - DNA, 22 bp, Homo sapiens
ggcagagctgcatgagcactca

SEQ ID NO: 7970137 - DNA, 22 bp, Homo sapiens
ggcagagctgcatgagcactca

SEQ ID NO: 7970138 - DNA, 22 bp, Homo sapiens
ggcagagctgcatgagcactca

SEQ ID NO: 7970139 - DNA, 22 bp, Homo sapiens
ggcagagctgcatgagcactca

SEQ ID NO: 7970140 - DNA, 17 bp, Homo sapiens
ggcagagctgacagggc

SEQ ID NO: 7970141 - DNA, 17 bp, Homo sapiens
ggcagagctgacagggc

SEQ ID NO: 7970142 - DNA, 17 bp, Homo sapiens
ggcagagctgacagggc

SEQ ID NO: 7970143 - DNA, 17 bp, Homo sapiens
ggcagagctgacagggc

SEQ ID NO: 7970144 - DNA, 22 bp, Homo sapiens
ggcagagctctggactgagaac

SEQ ID NO: 7970145 - DNA, 22 bp, Homo sapiens
ggcacagggggctgaggactag

SEQ ID NO: 7970146 - DNA, 22 bp, Homo sapiens
ggcacagggggctgaggactag

SEQ ID NO: 7970147 - DNA, 22 bp, Homo sapiens
ggcacagggggctgaggactag

SEQ ID NO: 7970148 - DNA, 22 bp, Homo sapiens
ggcacagggtgatgttgcagtt

SEQ ID NO: 7970149 - DNA, 22 bp, Homo sapiens
ggcacagggtgatgttgcagtt

SEQ ID NO: 7970150 - DNA, 22 bp, Homo sapiens
ggcacagggtgatgttgcagtt

SEQ ID NO: 7970151 - DNA, 22 bp, Homo sapiens
ggcacagggtgatgttgcagtt

SEQ ID NO: 7970152 - DNA, 22 bp, Homo sapiens
ggcacagtgattaagagccagt

SEQ ID NO: 7970153 - DNA, 22 bp, Homo sapiens
ggcacagttttctacatatgct

SEQ ID NO: 7970154 - DNA, 22 bp, Homo sapiens
ggcacagttttctacatatgct

SEQ ID NO: 7970155 - DNA, 22 bp, Homo sapiens
ggcacagggtgatgttgcagtt

SEQ ID NO: 7970156 - DNA, 22 bp, Homo sapiens
ggcacagggtgatgttgcagtt

SEQ ID NO: 7970157 - DNA, 22 bp, Homo sapiens
ggcacagtccctggcacagagt

SEQ ID NO: 7970158 - DNA, 22 bp, Homo sapiens
ggcacagggtgatgttgcagtt

SEQ ID NO: 7970159 - DNA, 22 bp, Homo sapiens
ggcacagggagccgcagttgca

SEQ ID NO: 7970160 - DNA, 22 bp, Homo sapiens
ggcacagggaggccctggtgtg

SEQ ID NO: 7970161 - DNA, 22 bp, Homo sapiens
ggcacagggaggccctggtgtg

SEQ ID NO: 7970162 - DNA, 22 bp, Homo sapiens
ggcacagggaggccctggtgtg

SEQ ID NO: 7970163 - DNA, 22 bp, Homo sapiens
ggcacagggggctgaggactag

SEQ ID NO: 7970164 - DNA, 22 bp, Homo sapiens
ggcacagggggctgaggactag

SEQ ID NO: 7970165 - DNA, 22 bp, Homo sapiens
ggcacagggggctgaggactag

SEQ ID NO: 7970166 - DNA, 22 bp, Homo sapiens
ggcacagggggctgaggactag

SEQ ID NO: 7970167 - DNA, 22 bp, Homo sapiens
ggcacagggggctgaggactag

SEQ ID NO: 7970168 - DNA, 22 bp, Homo sapiens
ggcacagggggctgaggactag

SEQ ID NO: 7970169 - DNA, 22 bp, Homo sapiens
ggcacagggggctgaggactag

SEQ ID NO: 7970170 - DNA, 22 bp, Homo sapiens
ggcacagggggctgaggactag

SEQ ID NO: 7970171 - DNA, 22 bp, Homo sapiens
cacagggcagagacctgggtgc

SEQ ID NO: 7970172 - DNA, 22 bp, Homo sapiens
cacagggcagagacctgggtgc

SEQ ID NO: 7970173 - DNA, 22 bp, Homo sapiens
cacagggcagagacctgggtgc

SEQ ID NO: 7970174 - DNA, 22 bp, Homo sapiens
cacagggcagagacctgggtgc

SEQ ID NO: 7970175 - DNA, 22 bp, Homo sapiens
cacagggcagagggtccgtggc

SEQ ID NO: 7970176 - DNA, 22 bp, Homo sapiens
cacagggcagagggtccgtggc

SEQ ID NO: 7970177 - DNA, 22 bp, Homo sapiens
ggcacaagtttgatgtgagtta

SEQ ID NO: 7970178 - DNA, 22 bp, Homo sapiens
ggcacaagtttgatgtgagtta

SEQ ID NO: 7970179 - DNA, 22 bp, Homo sapiens
cacagggcaggccccaggcctc

SEQ ID NO: 7970180 - DNA, 22 bp, Homo sapiens
ggcacaaggtttaaataacatc

SEQ ID NO: 7970181 - DNA, 22 bp, Homo sapiens
ggcacaaggtttaaataacatc

SEQ ID NO: 7970182 - DNA, 22 bp, Homo sapiens
cacagggcaggccccaggcctc

SEQ ID NO: 7970183 - DNA, 22 bp, Homo sapiens
cacagggcagagggtccgtggc

SEQ ID NO: 7970184 - DNA, 22 bp, Homo sapiens
ggcacaggagtcacagcatttc

SEQ ID NO: 7970185 - DNA, 22 bp, Homo sapiens
ggcacaggagtcacagcatttc

SEQ ID NO: 7970186 - DNA, 22 bp, Homo sapiens
ggcacacaaaggcagcatttga

SEQ ID NO: 7970187 - DNA, 22 bp, Homo sapiens
ggcacagggagccgcagttgca

SEQ ID NO: 7970188 - DNA, 22 bp, Homo sapiens
ggcacagggagccgcagttgca

SEQ ID NO: 7970189 - DNA, 22 bp, Homo sapiens
ggcacagggagccgcagttgca

SEQ ID NO: 7970190 - DNA, 22 bp, Homo sapiens
ggcacagggagccgcagttgca

SEQ ID NO: 7970191 - DNA, 22 bp, Homo sapiens
ggcacagggagccgcagttgca

SEQ ID NO: 7970192 - DNA, 22 bp, Homo sapiens
ggcacagggagaggcggatttt

SEQ ID NO: 7970193 - DNA, 22 bp, Homo sapiens
ggcacagggagccgcagttgca

SEQ ID NO: 7970194 - DNA, 22 bp, Homo sapiens
ggcacagggagccgcagttgca

SEQ ID NO: 7970195 - DNA, 22 bp, Homo sapiens
ggcactgggcaccggctgaggg

SEQ ID NO: 7970196 - DNA, 22 bp, Homo sapiens
ggcactgggcaccggctgaggg

SEQ ID NO: 7970197 - DNA, 22 bp, Homo sapiens
ggcagagagttctccacctctc

SEQ ID NO: 7970198 - DNA, 22 bp, Homo sapiens
ggcactgggcaccggctgaggg

SEQ ID NO: 7970199 - DNA, 22 bp, Homo sapiens
ggcactgggagaggtgagacgg

SEQ ID NO: 7970200 - DNA, 22 bp, Homo sapiens
ggcactgggagaggtgagacgg

SEQ ID NO: 7970201 - DNA, 22 bp, Homo sapiens
ggcactgggagaggtgagacgg

SEQ ID NO: 7970202 - DNA, 22 bp, Homo sapiens
ggcactgggagaggtgagacgg

SEQ ID NO: 7970203 - DNA, 22 bp, Homo sapiens
ggcactgggcaccggctgaggg

SEQ ID NO: 7970204 - DNA, 22 bp, Homo sapiens
ggcactgggcaccggctgaggg

SEQ ID NO: 7970205 - DNA, 22 bp, Homo sapiens
ggcactgggaatgcagtgatga

SEQ ID NO: 7970206 - DNA, 22 bp, Homo sapiens
ggcactgggaatgcagtgatga

SEQ ID NO: 7970207 - DNA, 22 bp, Homo sapiens
ggcactgggaatgcagtgatga

SEQ ID NO: 7970208 - DNA, 22 bp, Homo sapiens
ggcactgggagaggtgagacgg

SEQ ID NO: 7970209 - DNA, 22 bp, Homo sapiens
ggcactgggagaggtgagacgg

SEQ ID NO: 7970210 - DNA, 22 bp, Homo sapiens
ggcagagatgtgggtcagaatc

SEQ ID NO: 7970211 - DNA, 22 bp, Homo sapiens
ggcagagagttctccacctctc

SEQ ID NO: 7970212 - DNA, 22 bp, Homo sapiens
ggcagagatgtgggtcagaatc

SEQ ID NO: 7970213 - DNA, 22 bp, Homo sapiens
ggcagagcagccccagggtttg

SEQ ID NO: 7970214 - DNA, 22 bp, Homo sapiens
ggcagagcagccccagggtttg

SEQ ID NO: 7970215 - DNA, 22 bp, Homo sapiens
ggcagagcagccccagggtttg

SEQ ID NO: 7970216 - DNA, 22 bp, Homo sapiens
ggcagagccttctggagctcgc

SEQ ID NO: 7970217 - DNA, 22 bp, Homo sapiens
ggcagagccttctggagctcgc

SEQ ID NO: 7970218 - DNA, 22 bp, Homo sapiens
ggcagagccttctggagctcgc

SEQ ID NO: 7970219 - DNA, 22 bp, Homo sapiens
ggcagagccttctggagctcgc

SEQ ID NO: 7970220 - DNA, 22 bp, Homo sapiens
ggcagagcctcagccctccacc

SEQ ID NO: 7970221 - DNA, 22 bp, Homo sapiens
ggcagagcattcgatggacctg

SEQ ID NO: 7970222 - DNA, 22 bp, Homo sapiens
ggcagagcattcgatggacctg

SEQ ID NO: 7970223 - DNA, 22 bp, Homo sapiens
ggcactggcaaagcaaagtctg

SEQ ID NO: 7970224 - DNA, 22 bp, Homo sapiens
ggcactggcaaagcaaagtctg

SEQ ID NO: 7970225 - DNA, 22 bp, Homo sapiens
ggcactggcaaagcaaagtctg

SEQ ID NO: 7970226 - DNA, 22 bp, Homo sapiens
ggcactggcctggggccaagag

SEQ ID NO: 7970227 - DNA, 16 bp, Homo sapiens
ggcactggcaggtcct

SEQ ID NO: 7970228 - DNA, 16 bp, Homo sapiens
ggcactggcaggtcct

SEQ ID NO: 7970229 - DNA, 22 bp, Homo sapiens
ggcactggcctggggccaagag

SEQ ID NO: 7970230 - DNA, 22 bp, Homo sapiens
ggcactggaaggatcatgtgag

SEQ ID NO: 7970231 - DNA, 22 bp, Homo sapiens
ggcactggaagtcccattgtct

SEQ ID NO: 7970232 - DNA, 22 bp, Homo sapiens
ggcactggaagtcccattgtct

SEQ ID NO: 7970233 - DNA, 22 bp, Homo sapiens
ggcactggagactgttatgaga

SEQ ID NO: 7970234 - DNA, 22 bp, Homo sapiens
ggcactggagactgttatgaga

SEQ ID NO: 7970235 - DNA, 22 bp, Homo sapiens
ggcactggaaggatcatgtgag

SEQ ID NO: 7970236 - DNA, 22 bp, Homo sapiens
ggcactggaaggatcatgtgag

SEQ ID NO: 7970237 - DNA, 22 bp, Homo sapiens
ggcactggaaggatcatgtgag

SEQ ID NO: 7970238 - DNA, 22 bp, Homo sapiens
ggcactggaaggatcatgtgag

SEQ ID NO: 7970239 - DNA, 20 bp, Homo sapiens
ggcactggaagcacacagga

SEQ ID NO: 7970240 - DNA, 22 bp, Homo sapiens
ggcactggaaggatcatgtgag

SEQ ID NO: 7970241 - DNA, 20 bp, Homo sapiens
ggcactggaagcacacagga

SEQ ID NO: 7970242 - DNA, 20 bp, Homo sapiens
ggcactggaagcacacagga

SEQ ID NO: 7970243 - DNA, 20 bp, Homo sapiens
ggcactggaagcacacagga

SEQ ID NO: 7970244 - DNA, 22 bp, Homo sapiens
ggcactgcttcctgagcctgag

SEQ ID NO: 7970245 - DNA, 22 bp, Homo sapiens
ggcactgcttcctgagcctgag

SEQ ID NO: 7970246 - DNA, 22 bp, Homo sapiens
ggcactgcttcctgagcctgag

SEQ ID NO: 7970247 - DNA, 22 bp, Homo sapiens
ggcacatggagacttggcatca

SEQ ID NO: 7970248 - DNA, 22 bp, Homo sapiens
ggcacatgtatgtgggagtgtg

SEQ ID NO: 7970249 - DNA, 22 bp, Homo sapiens
ggcacatgtatgtgggagtgtg

SEQ ID NO: 7970250 - DNA, 22 bp, Homo sapiens
ggcactgctgtaggcagtgagg

SEQ ID NO: 7970251 - DNA, 22 bp, Homo sapiens
cactggaagttcattctcagaa

SEQ ID NO: 7970252 - DNA, 22 bp, Homo sapiens
cactggaagttcattctcagaa

SEQ ID NO: 7970253 - DNA, 22 bp, Homo sapiens
cactggaagttcattctcagaa

SEQ ID NO: 7970254 - DNA, 22 bp, Homo sapiens
cactggaagttcattctcagaa

SEQ ID NO: 7970255 - DNA, 22 bp, Homo sapiens
cactggaatagcattgattctt

SEQ ID NO: 7970256 - DNA, 22 bp, Homo sapiens
cactggaatagcattgattctt

SEQ ID NO: 7970257 - DNA, 22 bp, Homo sapiens
cactggaatggatagagcagag

SEQ ID NO: 7970258 - DNA, 22 bp, Homo sapiens
cactggaatggatagagcagag

SEQ ID NO: 7970259 - DNA, 22 bp, Homo sapiens
cactggaagagcatctgagcca

SEQ ID NO: 7970260 - DNA, 22 bp, Homo sapiens
cactggaagagcatctgagcca

SEQ ID NO: 7970261 - DNA, 22 bp, Homo sapiens
cactggaaccatccacatagtg

SEQ ID NO: 7970262 - DNA, 22 bp, Homo sapiens
cactggaaccaagacccagggc

SEQ ID NO: 7970263 - DNA, 20 bp, Homo sapiens
cactggaaagcaggcgactc

SEQ ID NO: 7970264 - DNA, 22 bp, Homo sapiens
cactgcttttttggctatgtac

SEQ ID NO: 7970265 - DNA, 22 bp, Homo sapiens
cactgcttttcagacagttatt

SEQ ID NO: 7970266 - DNA, 22 bp, Homo sapiens
cactgcttttcagacagttatt

SEQ ID NO: 7970267 - DNA, 22 bp, Homo sapiens
cactgctttgcccaagagggca

SEQ ID NO: 7970268 - DNA, 22 bp, Homo sapiens
cactgcctgctggctgtcactt

SEQ ID NO: 7970269 - DNA, 22 bp, Homo sapiens
cactgcctgctggctgtcactt

SEQ ID NO: 7970270 - DNA, 22 bp, Homo sapiens
cactgcctgtgagctgtgtgcc

SEQ ID NO: 7970271 - DNA, 22 bp, Homo sapiens
cactgctttaaggctgagtaac

SEQ ID NO: 7970272 - DNA, 22 bp, Homo sapiens
cactggcatgtgaggcggtggc

SEQ ID NO: 7970273 - DNA, 22 bp, Homo sapiens
cactggcattagtcacgaggca

SEQ ID NO: 7970274 - DNA, 22 bp, Homo sapiens
cactggcattagtcacgaggca

SEQ ID NO: 7970275 - DNA, 22 bp, Homo sapiens
cactggcattagtcacgaggca

SEQ ID NO: 7970276 - DNA, 22 bp, Homo sapiens
cactggcattagtcacgaggca

SEQ ID NO: 7970277 - DNA, 22 bp, Homo sapiens
cactggcattagtcacgaggca

SEQ ID NO: 7970278 - DNA, 22 bp, Homo sapiens
cactggcaaatggagagaatgt

SEQ ID NO: 7970279 - DNA, 22 bp, Homo sapiens
cactggcaaatggagagaatgt

SEQ ID NO: 7970280 - DNA, 22 bp, Homo sapiens
cactggcaaatggagagaatgt

SEQ ID NO: 7970281 - DNA, 22 bp, Homo sapiens
cactggatttccaggaatactc

SEQ ID NO: 7970282 - DNA, 17 bp, Homo sapiens
cactggattcgcagagc

SEQ ID NO: 7970283 - DNA, 22 bp, Homo sapiens
cactggataaaaatttggaagt

SEQ ID NO: 7970284 - DNA, 22 bp, Homo sapiens
cactggaggtcagtggagcact

SEQ ID NO: 7970285 - DNA, 22 bp, Homo sapiens
cactggaggtcagtggagcact

SEQ ID NO: 7970286 - DNA, 21 bp, Homo sapiens
cactggaattttctgtgacat

SEQ ID NO: 7970287 - DNA, 22 bp, Homo sapiens
cactggacagagtggggttccc

SEQ ID NO: 7970288 - DNA, 22 bp, Homo sapiens
cactggaattcaagatactgag

SEQ ID NO: 7970289 - DNA, 22 bp, Homo sapiens
cactggaatgttgaggagacaa

SEQ ID NO: 7970290 - DNA, 22 bp, Homo sapiens
cactggacttggagtcagaagg

SEQ ID NO: 7970291 - DNA, 22 bp, Homo sapiens
cactggacttggagtcagaagg

SEQ ID NO: 7970292 - DNA, 22 bp, Homo sapiens
cactggacttaaggcagagttt

SEQ ID NO: 7970293 - DNA, 22 bp, Homo sapiens
cactggacctgctttgatcctg

SEQ ID NO: 7970294 - DNA, 20 bp, Homo sapiens
cactggacctctctgagcct

SEQ ID NO: 7970295 - DNA, 18 bp, Homo sapiens
cactggacctcatgagag

SEQ ID NO: 7970296 - DNA, 18 bp, Homo sapiens
cactggacctcatgagag

SEQ ID NO: 7970297 - DNA, 22 bp, Homo sapiens
cactggaggtcagtggagcact

SEQ ID NO: 7970298 - DNA, 22 bp, Homo sapiens
cactggaggtcagtggagcact

SEQ ID NO: 7970299 - DNA, 22 bp, Homo sapiens
cactggaggtcagtggagcact

SEQ ID NO: 7970300 - DNA, 22 bp, Homo sapiens
cactggaggtcagtggagcact

SEQ ID NO: 7970301 - DNA, 22 bp, Homo sapiens
cactggaggtcagtggagcact

SEQ ID NO: 7970302 - DNA, 22 bp, Homo sapiens
cactggaggtcagtggagcact

SEQ ID NO: 7970303 - DNA, 19 bp, Homo sapiens
ggctcaagcatccaggtag

SEQ ID NO: 7970304 - DNA, 22 bp, Homo sapiens
ggctcaagcagtctgcctgcct

SEQ ID NO: 7970305 - DNA, 22 bp, Homo sapiens
ggctcaagcagtctgcctgcct

SEQ ID NO: 7970306 - DNA, 22 bp, Homo sapiens
ggctcaagcagtctgcctgcct

SEQ ID NO: 7970307 - DNA, 22 bp, Homo sapiens
ggctcaatgcaacttctgcctc

SEQ ID NO: 7970308 - DNA, 22 bp, Homo sapiens
ggctcaatgcaacttctgcctc

SEQ ID NO: 7970309 - DNA, 18 bp, Homo sapiens
ggctcaagtgatcctcct

SEQ ID NO: 7970310 - DNA, 22 bp, Homo sapiens
ggctatggaagataaggctgaa

SEQ ID NO: 7970311 - DNA, 22 bp, Homo sapiens
ggctatggcaaagaactcagat

SEQ ID NO: 7970312 - DNA, 22 bp, Homo sapiens
ggctatgggaagatggcagggg

SEQ ID NO: 7970313 - DNA, 22 bp, Homo sapiens
ggctaggggaataatctgtggt

SEQ ID NO: 7970314 - DNA, 22 bp, Homo sapiens
ggctaggggaataatctgtggt

SEQ ID NO: 7970315 - DNA, 22 bp, Homo sapiens
ggctaggggaataatctgtggt

SEQ ID NO: 7970316 - DNA, 22 bp, Homo sapiens
ggctagggagacagagggcatg

SEQ ID NO: 7970317 - DNA, 22 bp, Homo sapiens
ggctagggatctagaccaggac

SEQ ID NO: 7970318 - DNA, 22 bp, Homo sapiens
ggctagggatctagaccaggac

SEQ ID NO: 7970319 - DNA, 22 bp, Homo sapiens
ggctagggatctagaccaggac

SEQ ID NO: 7970320 - DNA, 22 bp, Homo sapiens
ggctagggatctagaccaggac

SEQ ID NO: 7970321 - DNA, 22 bp, Homo sapiens
ggctagggatctagaccaggac

SEQ ID NO: 7970322 - DNA, 22 bp, Homo sapiens
ggctagggatctagaccaggac

SEQ ID NO: 7970323 - DNA, 22 bp, Homo sapiens
cactgcagttccccagtgcgca

SEQ ID NO: 7970324 - DNA, 22 bp, Homo sapiens
cactgcagtaactctaggactg

SEQ ID NO: 7970325 - DNA, 22 bp, Homo sapiens
cactgcagtaactctaggactg

SEQ ID NO: 7970326 - DNA, 22 bp, Homo sapiens
cactgcagttccccagtgcgca

SEQ ID NO: 7970327 - DNA, 22 bp, Homo sapiens
cactgcagttccccagtgcgca

SEQ ID NO: 7970328 - DNA, 22 bp, Homo sapiens
cactgcatggatgatggctgta

SEQ ID NO: 7970329 - DNA, 20 bp, Homo sapiens
cactgcattgatggaaacag

SEQ ID NO: 7970330 - DNA, 22 bp, Homo sapiens
cactgcatggctgtgaggcagc

SEQ ID NO: 7970331 - DNA, 20 bp, Homo sapiens
cactgccagaatacactgtc

SEQ ID NO: 7970332 - DNA, 22 bp, Homo sapiens
cactgccacctgcatgccctga

SEQ ID NO: 7970333 - DNA, 20 bp, Homo sapiens
cactgccagaatacactgtc

SEQ ID NO: 7970334 - DNA, 20 bp, Homo sapiens
cactgccagaatacactgtc

SEQ ID NO: 7970335 - DNA, 22 bp, Homo sapiens
ggctagggactcctcctcaggg

SEQ ID NO: 7970336 - DNA, 22 bp, Homo sapiens
cactgcccagagggcagcattg

SEQ ID NO: 7970337 - DNA, 22 bp, Homo sapiens
cactgcccagagggcagcattg

SEQ ID NO: 7970338 - DNA, 22 bp, Homo sapiens
cactgccatgttgatagatgtg

SEQ ID NO: 7970339 - DNA, 22 bp, Homo sapiens
cactgccatgttgatagatgtg

SEQ ID NO: 7970340 - DNA, 22 bp, Homo sapiens
cactgcccaccaagtggctggt

SEQ ID NO: 7970341 - DNA, 22 bp, Homo sapiens
ggctagggagacagagggcatg

SEQ ID NO: 7970342 - DNA, 22 bp, Homo sapiens
ggctagggagacagagggcatg

SEQ ID NO: 7970343 - DNA, 22 bp, Homo sapiens
ggctagggagacagagggcatg

SEQ ID NO: 7970344 - DNA, 22 bp, Homo sapiens
ggctagggagacagagggcatg

SEQ ID NO: 7970345 - DNA, 22 bp, Homo sapiens
ggctagggagacagagggcatg

SEQ ID NO: 7970346 - DNA, 22 bp, Homo sapiens
ggctagggagacagagggcatg

SEQ ID NO: 7970347 - DNA, 22 bp, Homo sapiens
ggctagggagacagagggcatg

SEQ ID NO: 7970348 - DNA, 22 bp, Homo sapiens
cactgagagatgtgtcacagca

SEQ ID NO: 7970349 - DNA, 22 bp, Homo sapiens
cactgagaggtctcatttccaa

SEQ ID NO: 7970350 - DNA, 22 bp, Homo sapiens
cactgagaggtctcatttccaa

SEQ ID NO: 7970351 - DNA, 22 bp, Homo sapiens
cactgagagatgtgtcacagca

SEQ ID NO: 7970352 - DNA, 22 bp, Homo sapiens
cactgagagatgtgtcacagca

SEQ ID NO: 7970353 - DNA, 22 bp, Homo sapiens
cactgagagatgtgtcacagca

SEQ ID NO: 7970354 - DNA, 17 bp, Homo sapiens
cactgacttaaaatctt

SEQ ID NO: 7970355 - DNA, 22 bp, Homo sapiens
cactgagaccagagtccctgac

SEQ ID NO: 7970356 - DNA, 22 bp, Homo sapiens
cactgagaaagtgacctgccaa

SEQ ID NO: 7970357 - DNA, 22 bp, Homo sapiens
cactgactccaaaaataaagaa

SEQ ID NO: 7970358 - DNA, 22 bp, Homo sapiens
cactgactgcccgctgtacatt

SEQ ID NO: 7970359 - DNA, 22 bp, Homo sapiens
cactgactccaaaaataaagaa

SEQ ID NO: 7970360 - DNA, 22 bp, Homo sapiens
cactgactgcccgctgtacatt

SEQ ID NO: 7970361 - DNA, 22 bp, Homo sapiens
cactgactaagtttgtgaaggt

SEQ ID NO: 7970362 - DNA, 22 bp, Homo sapiens
cactgactaagtttgtgaaggt

SEQ ID NO: 7970363 - DNA, 22 bp, Homo sapiens
cactgaagatgcgactagtgct

SEQ ID NO: 7970364 - DNA, 22 bp, Homo sapiens
cactgaagccactggaagagga

SEQ ID NO: 7970365 - DNA, 22 bp, Homo sapiens
cactgaagccactggaagagga

SEQ ID NO: 7970366 - DNA, 22 bp, Homo sapiens
cactgaaggaaggactactgca

SEQ ID NO: 7970367 - DNA, 22 bp, Homo sapiens
cactgaaggaaggactactgca

SEQ ID NO: 7970368 - DNA, 22 bp, Homo sapiens
cactgacagtatcagagctgtt

SEQ ID NO: 7970369 - DNA, 22 bp, Homo sapiens
cactgaaggtaggaccaaggct

SEQ ID NO: 7970370 - DNA, 22 bp, Homo sapiens
cactgaatctcaaggggagggt

SEQ ID NO: 7970371 - DNA, 22 bp, Homo sapiens
cactgaatttaacttgtatccc

SEQ ID NO: 7970372 - DNA, 22 bp, Homo sapiens
cactgaatttaacttgtatccc

SEQ ID NO: 7970373 - DNA, 22 bp, Homo sapiens
cactgaaggctgcagctcagcc

SEQ ID NO: 7970374 - DNA, 22 bp, Homo sapiens
cactgaaggctgcagctcagcc

SEQ ID NO: 7970375 - DNA, 22 bp, Homo sapiens
cactgaaggctaggattagatg

SEQ ID NO: 7970376 - DNA, 22 bp, Homo sapiens
cactgaaggctgcagctcagcc

SEQ ID NO: 7970377 - DNA, 22 bp, Homo sapiens
cactgaaggacagtaggaaggg

SEQ ID NO: 7970378 - DNA, 22 bp, Homo sapiens
cactgaaggacagtaggaaggg

SEQ ID NO: 7970379 - DNA, 22 bp, Homo sapiens
ggcctcctgttggctagtgtga

SEQ ID NO: 7970380 - DNA, 22 bp, Homo sapiens
ggcctcgcggcttctggtggct

SEQ ID NO: 7970381 - DNA, 22 bp, Homo sapiens
ggcctcgcggcttctggtggct

SEQ ID NO: 7970382 - DNA, 22 bp, Homo sapiens
ggcctcgcggcttctggtggct

SEQ ID NO: 7970383 - DNA, 22 bp, Homo sapiens
ggcctcctgttggctagtgtga

SEQ ID NO: 7970384 - DNA, 22 bp, Homo sapiens
ggcctcctgttggctagtgtga

SEQ ID NO: 7970385 - DNA, 23 bp, Homo sapiens
ggcctcctggtctaggctagact

SEQ ID NO: 7970386 - DNA, 23 bp, Homo sapiens
ggcctcctggtctaggctagact

SEQ ID NO: 7970387 - DNA, 23 bp, Homo sapiens
ggcctcctggtctaggctagact

SEQ ID NO: 7970388 - DNA, 22 bp, Homo sapiens
ggcctcctcaccctgctcaggc

SEQ ID NO: 7970389 - DNA, 22 bp, Homo sapiens
cactgaggctgggggagaaggt

SEQ ID NO: 7970390 - DNA, 22 bp, Homo sapiens
ggcctcctcaccctgctcaggc

SEQ ID NO: 7970391 - DNA, 22 bp, Homo sapiens
ggcctcctcaccctgctcaggc

SEQ ID NO: 7970392 - DNA, 22 bp, Homo sapiens
cactgaggctgggggagaaggt

SEQ ID NO: 7970393 - DNA, 22 bp, Homo sapiens
cactgagctgatttcaggtgcc

SEQ ID NO: 7970394 - DNA, 22 bp, Homo sapiens
cactgagctgatttcaggtgcc

SEQ ID NO: 7970395 - DNA, 19 bp, Homo sapiens
cactgagctctgttcacta

SEQ ID NO: 7970396 - DNA, 22 bp, Homo sapiens
cactgaggactcccacgtaggt

SEQ ID NO: 7970397 - DNA, 22 bp, Homo sapiens
cactgagcaagtcagtacagca

SEQ ID NO: 7970398 - DNA, 22 bp, Homo sapiens
cactgagagtagggcacaagtg

SEQ ID NO: 7970399 - DNA, 17 bp, Homo sapiens
cactgagaggtttgaga

SEQ ID NO: 7970400 - DNA, 22 bp, Homo sapiens
cactgagccttgccagcttggt

SEQ ID NO: 7970401 - DNA, 22 bp, Homo sapiens
cactgagcaagtcagtacagca

SEQ ID NO: 7970402 - DNA, 22 bp, Homo sapiens
cactgagcatgagtgggctgtg

SEQ ID NO: 7970403 - DNA, 22 bp, Homo sapiens
ggcctctcagggcagagaccct

SEQ ID NO: 7970404 - DNA, 22 bp, Homo sapiens
ggcctctcatgtcctgggcttc

SEQ ID NO: 7970405 - DNA, 22 bp, Homo sapiens
ggcctctcatgcccagagccaa

SEQ ID NO: 7970406 - DNA, 22 bp, Homo sapiens
ggcctctcatgcccagagccaa

SEQ ID NO: 7970407 - DNA, 22 bp, Homo sapiens
ggcctctcatgcccagagccaa

SEQ ID NO: 7970408 - DNA, 22 bp, Homo sapiens
ggcctcgcggcttctggtggct

SEQ ID NO: 7970409 - DNA, 22 bp, Homo sapiens
ggcctcgcggcttctggtggct

SEQ ID NO: 7970410 - DNA, 22 bp, Homo sapiens
ggcctcggcccactgctgcggt

SEQ ID NO: 7970411 - DNA, 22 bp, Homo sapiens
ggcctcgcggcttctggtggct

SEQ ID NO: 7970412 - DNA, 22 bp, Homo sapiens
ggcctcggcccactgctgcggt

SEQ ID NO: 7970413 - DNA, 22 bp, Homo sapiens
ggcctctctagcatccagcctg

SEQ ID NO: 7970414 - DNA, 22 bp, Homo sapiens
ggcctctcattctccctggtcc

SEQ ID NO: 7970415 - DNA, 22 bp, Homo sapiens
ggcctctcattctccctggtcc

SEQ ID NO: 7970416 - DNA, 22 bp, Homo sapiens
ggcctctcattctccctggtcc

SEQ ID NO: 7970417 - DNA, 22 bp, Homo sapiens
ggcctctcatgtcctgggcttc

SEQ ID NO: 7970418 - DNA, 22 bp, Homo sapiens
ggcctctctagcatccagcctg

SEQ ID NO: 7970419 - DNA, 22 bp, Homo sapiens
ggcctctctagcatccagcctg

SEQ ID NO: 7970420 - DNA, 22 bp, Homo sapiens
cactgcactccagcttgggtga

SEQ ID NO: 7970421 - DNA, 22 bp, Homo sapiens
cactgcactccagcttgggtga

SEQ ID NO: 7970422 - DNA, 22 bp, Homo sapiens
cactgcactccagcttgggtga

SEQ ID NO: 7970423 - DNA, 22 bp, Homo sapiens
cactgcaggtctgagatggggg

SEQ ID NO: 7970424 - DNA, 22 bp, Homo sapiens
cactgcaggtctgagatggggg

SEQ ID NO: 7970425 - DNA, 22 bp, Homo sapiens
cactgcaggtctgagatggggg

SEQ ID NO: 7970426 - DNA, 22 bp, Homo sapiens
cactgcaggtctgagatggggg

SEQ ID NO: 7970427 - DNA, 21 bp, Homo sapiens
cactgcagccttgacctgggc

SEQ ID NO: 7970428 - DNA, 22 bp, Homo sapiens
cactgcagcctcgctctcctga

SEQ ID NO: 7970429 - DNA, 23 bp, Homo sapiens
cactgcagcgtggtctggcagga

SEQ ID NO: 7970430 - DNA, 23 bp, Homo sapiens
cactgcagcgtggtctggcagga

SEQ ID NO: 7970431 - DNA, 23 bp, Homo sapiens
cactgcagcgtggtctggcagga

SEQ ID NO: 7970432 - DNA, 23 bp, Homo sapiens
cactgcagcgtggtctggcagga

SEQ ID NO: 7970433 - DNA, 22 bp, Homo sapiens
cactgcagcctcaaattcctgg

SEQ ID NO: 7970434 - DNA, 22 bp, Homo sapiens
cactgcagccacatagatgacg

SEQ ID NO: 7970435 - DNA, 22 bp, Homo sapiens
cactgcagcaccatgcagggct

SEQ ID NO: 7970436 - DNA, 22 bp, Homo sapiens
cactgcagcaccatgcagggct

SEQ ID NO: 7970437 - DNA, 22 bp, Homo sapiens
cactgcagcaccatgcagggct

SEQ ID NO: 7970438 - DNA, 22 bp, Homo sapiens
cactgcagcaccatgcagggct

SEQ ID NO: 7970439 - DNA, 22 bp, Homo sapiens
cactgcagcaccatgcagggct

SEQ ID NO: 7970440 - DNA, 22 bp, Homo sapiens
cactgcactccatcctgggaaa

SEQ ID NO: 7970441 - DNA, 22 bp, Homo sapiens
cactgcactccatcctgggaaa

SEQ ID NO: 7970442 - DNA, 22 bp, Homo sapiens
ggcagtgtccagcttcctggag

SEQ ID NO: 7970443 - DNA, 22 bp, Homo sapiens
ggcagtgtccagcttcctggag

SEQ ID NO: 7970444 - DNA, 22 bp, Homo sapiens
ggcagtgtcaaaataggcagaa

SEQ ID NO: 7970445 - DNA, 22 bp, Homo sapiens
ggcagtgtcaaaataggcagaa

SEQ ID NO: 7970446 - DNA, 22 bp, Homo sapiens
ggcagtgtcaaaataggcagaa

SEQ ID NO: 7970447 - DNA, 22 bp, Homo sapiens
cacccagagcctgagagggata

SEQ ID NO: 7970448 - DNA, 22 bp, Homo sapiens
cacccagagcagacactgtcca

SEQ ID NO: 7970449 - DNA, 22 bp, Homo sapiens
cacccagagcctgagagggata

SEQ ID NO: 7970450 - DNA, 22 bp, Homo sapiens
cacccagagggcttgctgaaca

SEQ ID NO: 7970451 - DNA, 22 bp, Homo sapiens
ggcagtgttccagaccttcacc

SEQ ID NO: 7970452 - DNA, 22 bp, Homo sapiens
ggcagtgttatttttcagaaat

SEQ ID NO: 7970453 - DNA, 22 bp, Homo sapiens
ggcagtgttatttttcagaaat

SEQ ID NO: 7970454 - DNA, 22 bp, Homo sapiens
ggcagtgtggcctgagtaagtc

SEQ ID NO: 7970455 - DNA, 22 bp, Homo sapiens
ggcagtgtggcctgagtaagtc

SEQ ID NO: 7970456 - DNA, 22 bp, Homo sapiens
ggcagtgtggcataacatgtag

SEQ ID NO: 7970457 - DNA, 22 bp, Homo sapiens
ggcagtgtggcataacatgtag

SEQ ID NO: 7970458 - DNA, 22 bp, Homo sapiens
ggcagtgtggcataacatgtag

SEQ ID NO: 7970459 - DNA, 22 bp, Homo sapiens
ggcagtgtggcataacatgtag

SEQ ID NO: 7970460 - DNA, 22 bp, Homo sapiens
ggcagtgtgcatctgtgtggcc

SEQ ID NO: 7970461 - DNA, 22 bp, Homo sapiens
ggcagtgtgcatctgtgtggcc

SEQ ID NO: 7970462 - DNA, 22 bp, Homo sapiens
ggcagtgtccttgcagctctac

SEQ ID NO: 7970463 - DNA, 22 bp, Homo sapiens
ggcagtgtgcatctgtgtggcc

SEQ ID NO: 7970464 - DNA, 22 bp, Homo sapiens
ggcagtgtttatgggtaacaca

SEQ ID NO: 7970465 - DNA, 22 bp, Homo sapiens
ggcagtgttctggttgtcagga

SEQ ID NO: 7970466 - DNA, 22 bp, Homo sapiens
ggcagttccagaatttcagtac

SEQ ID NO: 7970467 - DNA, 22 bp, Homo sapiens
ggcagtgtttatgggtaacaca

SEQ ID NO: 7970468 - DNA, 22 bp, Homo sapiens
ggcagttgcgtgcatcagtggt

SEQ ID NO: 7970469 - DNA, 22 bp, Homo sapiens
ggcagttgcgtgcatcagtggt

SEQ ID NO: 7970470 - DNA, 22 bp, Homo sapiens
ggcagttgctgtggatgaggtt

SEQ ID NO: 7970471 - DNA, 22 bp, Homo sapiens
ggcagttgctgtggatgaggtt

SEQ ID NO: 7970472 - DNA, 22 bp, Homo sapiens
cacccacatggaaattcacagt

SEQ ID NO: 7970473 - DNA, 22 bp, Homo sapiens
cacccacatggaaattcacagt

SEQ ID NO: 7970474 - DNA, 22 bp, Homo sapiens
cacccacattccatcactctgc

SEQ ID NO: 7970475 - DNA, 22 bp, Homo sapiens
cacccacattccatcactctgc

SEQ ID NO: 7970476 - DNA, 22 bp, Homo sapiens
cacccacattccatcactctgc

SEQ ID NO: 7970477 - DNA, 22 bp, Homo sapiens
cacccacccagaagatcctggc

SEQ ID NO: 7970478 - DNA, 22 bp, Homo sapiens
cacccacccactgctcattggc

SEQ ID NO: 7970479 - DNA, 22 bp, Homo sapiens
cacccagacatgtggtcccaga

SEQ ID NO: 7970480 - DNA, 22 bp, Homo sapiens
cacccactgagctcatgtccca

SEQ ID NO: 7970481 - DNA, 22 bp, Homo sapiens
caccattttctaaaaatatgac

SEQ ID NO: 7970482 - DNA, 22 bp, Homo sapiens
caccatttagtagcaagagctc

SEQ ID NO: 7970483 - DNA, 22 bp, Homo sapiens
caccatttaagaaagccaaatt

SEQ ID NO: 7970484 - DNA, 22 bp, Homo sapiens
caccattctgaggagagtggat

SEQ ID NO: 7970485 - DNA, 22 bp, Homo sapiens
caccattgttgttactgggaga

SEQ ID NO: 7970486 - DNA, 22 bp, Homo sapiens
caccattctgaggagagtggat

SEQ ID NO: 7970487 - DNA, 22 bp, Homo sapiens
caccatctggtaggcattagtg

SEQ ID NO: 7970488 - DNA, 22 bp, Homo sapiens
caccatcttggcaaaggttcgc

SEQ ID NO: 7970489 - DNA, 22 bp, Homo sapiens
caccatctagcatttatttgga

SEQ ID NO: 7970490 - DNA, 22 bp, Homo sapiens
caccatctagcatttatttgga

SEQ ID NO: 7970491 - DNA, 22 bp, Homo sapiens
caccatctggtaggcattagtg

SEQ ID NO: 7970492 - DNA, 22 bp, Homo sapiens
caccatctatagaggtatttgg

SEQ ID NO: 7970493 - DNA, 22 bp, Homo sapiens
ggcagctgagatcatgctgttg

SEQ ID NO: 7970494 - DNA, 22 bp, Homo sapiens
ggcagctgagatcatgctgttg

SEQ ID NO: 7970495 - DNA, 22 bp, Homo sapiens
ggcagctgagatcatgctgttg

SEQ ID NO: 7970496 - DNA, 22 bp, Homo sapiens
ggcagctgagatcatgctgttg

SEQ ID NO: 7970497 - DNA, 22 bp, Homo sapiens
ggcagctgagatcatgctgttg

SEQ ID NO: 7970498 - DNA, 22 bp, Homo sapiens
ggcagctgagatcatgctgttg

SEQ ID NO: 7970499 - DNA, 22 bp, Homo sapiens
ggcagctgagcatggctacctt

SEQ ID NO: 7970500 - DNA, 22 bp, Homo sapiens
ggcagctgagatcatgctgttg

SEQ ID NO: 7970501 - DNA, 22 bp, Homo sapiens
ggcagctgacctagcaccatcc

SEQ ID NO: 7970502 - DNA, 21 bp, Homo sapiens
ggcagctgaccgcgcggtgca

SEQ ID NO: 7970503 - DNA, 22 bp, Homo sapiens
ggcagctgacctagcaccatcc

SEQ ID NO: 7970504 - DNA, 22 bp, Homo sapiens
ggcagctgacctagcaccatcc

SEQ ID NO: 7970505 - DNA, 22 bp, Homo sapiens
ggcagctgacctagcaccatcc

SEQ ID NO: 7970506 - DNA, 22 bp, Homo sapiens
ggcagctgacctagcaccatcc

SEQ ID NO: 7970507 - DNA, 22 bp, Homo sapiens
ggcagctgacctagcaccatcc

SEQ ID NO: 7970508 - DNA, 21 bp, Homo sapiens
ggcagctgaccgcgcggtgca

SEQ ID NO: 7970509 - DNA, 21 bp, Homo sapiens
ggcagctgaccgcgcggtgca

SEQ ID NO: 7970510 - DNA, 22 bp, Homo sapiens
ggcagctgaagaggaactttgg

SEQ ID NO: 7970511 - DNA, 21 bp, Homo sapiens
ggcagctgaccgcgcggtgca

SEQ ID NO: 7970512 - DNA, 22 bp, Homo sapiens
ggcagctgaagaggaactttgg

SEQ ID NO: 7970513 - DNA, 22 bp, Homo sapiens
ggcagctgaagaggaactttgg

SEQ ID NO: 7970514 - DNA, 22 bp, Homo sapiens
ggcagctgaagaggaactttgg

SEQ ID NO: 7970515 - DNA, 21 bp, Homo sapiens
ggcagctgaccgcgcggtgca

SEQ ID NO: 7970516 - DNA, 21 bp, Homo sapiens
ggcagctgaccgcgcggtgca

SEQ ID NO: 7970517 - DNA, 21 bp, Homo sapiens
ggcagctgaccgcgcggtgca

SEQ ID NO: 7970518 - DNA, 21 bp, Homo sapiens
ggcagctgaccgcgcggtgca

SEQ ID NO: 7970519 - DNA, 22 bp, Homo sapiens
ggcagccagagggcagctggat

SEQ ID NO: 7970520 - DNA, 22 bp, Homo sapiens
ggcagccagagggcagctggat

SEQ ID NO: 7970521 - DNA, 19 bp, Homo sapiens
ggcagctcttgtcttctgc

SEQ ID NO: 7970522 - DNA, 22 bp, Homo sapiens
ggcagccagagggcagctggat

SEQ ID NO: 7970523 - DNA, 22 bp, Homo sapiens
ggcagccagagggcagctggat

SEQ ID NO: 7970524 - DNA, 22 bp, Homo sapiens
ggcagccagagggcagctggat

SEQ ID NO: 7970525 - DNA, 22 bp, Homo sapiens
caccaggctggagtgcagtggc

SEQ ID NO: 7970526 - DNA, 22 bp, Homo sapiens
caccaggctggagtgcagtggc

SEQ ID NO: 7970527 - DNA, 22 bp, Homo sapiens
caccaggctggagtgcagtggc

SEQ ID NO: 7970528 - DNA, 22 bp, Homo sapiens
ggcagctgcaaatctgctctgt

SEQ ID NO: 7970529 - DNA, 22 bp, Homo sapiens
caccaggctggagtgcagtggc

SEQ ID NO: 7970530 - DNA, 22 bp, Homo sapiens
ggcagctgattagcatcaagga

SEQ ID NO: 7970531 - DNA, 22 bp, Homo sapiens
caccagtttaacaatcaaaaga

SEQ ID NO: 7970532 - DNA, 23 bp, Homo sapiens
caccagttaaaatataaatcagc

SEQ ID NO: 7970533 - DNA, 22 bp, Homo sapiens
caccagtgtttacctgtgacaa

SEQ ID NO: 7970534 - DNA, 22 bp, Homo sapiens
caccagtgtttacctgtgacaa

SEQ ID NO: 7970535 - DNA, 16 bp, Homo sapiens
caccagtccttcctgc

SEQ ID NO: 7970536 - DNA, 22 bp, Homo sapiens
caccagtctttattttgttatt

SEQ ID NO: 7970537 - DNA, 22 bp, Homo sapiens
caccaggttccgggcagagctg

SEQ ID NO: 7970538 - DNA, 20 bp, Homo sapiens
caccagtcatgagtcaatac

SEQ ID NO: 7970539 - DNA, 22 bp, Homo sapiens
ggcagctgattagcatcaagga

SEQ ID NO: 7970540 - DNA, 22 bp, Homo sapiens
ggcagctgattagcatcaagga

SEQ ID NO: 7970541 - DNA, 22 bp, Homo sapiens
ggcagctgattagcatcaagga

SEQ ID NO: 7970542 - DNA, 22 bp, Homo sapiens
ggcagctgattagcatcaagga

SEQ ID NO: 7970543 - DNA, 22 bp, Homo sapiens
ggcagctgattagcatcaagga

SEQ ID NO: 7970544 - DNA, 22 bp, Homo sapiens
ggcagctgattagcatcaagga

SEQ ID NO: 7970545 - DNA, 22 bp, Homo sapiens
ggcagctgagcatggctacctt

SEQ ID NO: 7970546 - DNA, 22 bp, Homo sapiens
ggcagctgagcatggctacctt

SEQ ID NO: 7970547 - DNA, 22 bp, Homo sapiens
ggcagctgattagcatcaagga

SEQ ID NO: 7970548 - DNA, 22 bp, Homo sapiens
ggcagctgattagcatcaagga

SEQ ID NO: 7970549 - DNA, 22 bp, Homo sapiens
ggcagctgattagcatcaagga

SEQ ID NO: 7970550 - DNA, 22 bp, Homo sapiens
ggcagctgattagcatcaagga

SEQ ID NO: 7970551 - DNA, 22 bp, Homo sapiens
ggcagctgagatcatgctgttg

SEQ ID NO: 7970552 - DNA, 22 bp, Homo sapiens
ggcagctgagcatggctacctt

SEQ ID NO: 7970553 - DNA, 22 bp, Homo sapiens
ggcagctgagcatggctacctt

SEQ ID NO: 7970554 - DNA, 22 bp, Homo sapiens
ggcagctgagcatggctacctt

SEQ ID NO: 7970555 - DNA, 22 bp, Homo sapiens
ggcagctgagcatggctacctt

SEQ ID NO: 7970556 - DNA, 22 bp, Homo sapiens
ggcagctgagcatggctacctt

SEQ ID NO: 7970557 - DNA, 22 bp, Homo sapiens
ggcagctgagcatggctacctt

SEQ ID NO: 7970558 - DNA, 22 bp, Homo sapiens
ggcagctgagcatggctacctt

SEQ ID NO: 7970559 - DNA, 22 bp, Homo sapiens
cacccccacctgtgggctcctg

SEQ ID NO: 7970560 - DNA, 22 bp, Homo sapiens
cacccccagcagggaaaggagg

SEQ ID NO: 7970561 - DNA, 22 bp, Homo sapiens
cacccctacctgagtcaggagt

SEQ ID NO: 7970562 - DNA, 22 bp, Homo sapiens
caccccccaattctgccagctg

SEQ ID NO: 7970563 - DNA, 22 bp, Homo sapiens
cacccccaggagctccagggac

SEQ ID NO: 7970564 - DNA, 22 bp, Homo sapiens
cacccccaggagctccagggac

SEQ ID NO: 7970565 - DNA, 22 bp, Homo sapiens
cacccctgtggagcatggtggc

SEQ ID NO: 7970566 - DNA, 22 bp, Homo sapiens
cacccctgggctgggcacacag

SEQ ID NO: 7970567 - DNA, 22 bp, Homo sapiens
cacccctgtggagcatggtggc

SEQ ID NO: 7970568 - DNA, 22 bp, Homo sapiens
cacccctgtggagcatggtggc

SEQ ID NO: 7970569 - DNA, 22 bp, Homo sapiens
cacccctgtggagcatggtggc

SEQ ID NO: 7970570 - DNA, 22 bp, Homo sapiens
cacccctgtggagcatggtggc

SEQ ID NO: 7970571 - DNA, 22 bp, Homo sapiens
caccccctccatggttgtgaca

SEQ ID NO: 7970572 - DNA, 22 bp, Homo sapiens
cacccctgggctgggcacacag

SEQ ID NO: 7970573 - DNA, 22 bp, Homo sapiens
cacccctgggctgggcacacag

SEQ ID NO: 7970574 - DNA, 22 bp, Homo sapiens
cacccctgggctgggcacacag

SEQ ID NO: 7970575 - DNA, 18 bp, Homo sapiens
caccctccgcggctgccc

SEQ ID NO: 7970576 - DNA, 22 bp, Homo sapiens
caccctcccgtcagcccctggg

SEQ ID NO: 7970577 - DNA, 22 bp, Homo sapiens
caccctcccgtcagcccctggg

SEQ ID NO: 7970578 - DNA, 22 bp, Homo sapiens
caccctcccgtcagcccctggg

SEQ ID NO: 7970579 - DNA, 20 bp, Homo sapiens
caccctcccagcacctatgc

SEQ ID NO: 7970580 - DNA, 20 bp, Homo sapiens
caccctcccagcacctatgc

SEQ ID NO: 7970581 - DNA, 20 bp, Homo sapiens
caccctcccagcacctatgc

SEQ ID NO: 7970582 - DNA, 20 bp, Homo sapiens
caccctcccagcacctatgc

SEQ ID NO: 7970583 - DNA, 20 bp, Homo sapiens
caccctcccagcacctatgc

SEQ ID NO: 7970584 - DNA, 22 bp, Homo sapiens
caccccttgtctttggggtcgt

SEQ ID NO: 7970585 - DNA, 20 bp, Homo sapiens
caccctacggcctcacctcc

SEQ ID NO: 7970586 - DNA, 22 bp, Homo sapiens
cacccctgtggagcatggtggc

SEQ ID NO: 7970587 - DNA, 22 bp, Homo sapiens
caccccttccgccactgccttc

SEQ ID NO: 7970588 - DNA, 22 bp, Homo sapiens
caccctggaaagaaggtctggg

SEQ ID NO: 7970589 - DNA, 22 bp, Homo sapiens
caccctggaaagaaggtctggg

SEQ ID NO: 7970590 - DNA, 22 bp, Homo sapiens
caccctggaaagaaggtctggg

SEQ ID NO: 7970591 - DNA, 22 bp, Homo sapiens
caccctggaatagccccgggag

SEQ ID NO: 7970592 - DNA, 22 bp, Homo sapiens
caccctggaaagaaggtctggg

SEQ ID NO: 7970593 - DNA, 22 bp, Homo sapiens
caccctgctacaaagcctcctg

SEQ ID NO: 7970594 - DNA, 22 bp, Homo sapiens
caccctgctctgctgtgcggcc

SEQ ID NO: 7970595 - DNA, 22 bp, Homo sapiens
caccctggaaagaaggtctggg

SEQ ID NO: 7970596 - DNA, 18 bp, Homo sapiens
caccctccgcggctgccc

SEQ ID NO: 7970597 - DNA, 22 bp, Homo sapiens
caccctgctacaaagcctcctg

SEQ ID NO: 7970598 - DNA, 22 bp, Homo sapiens
caccctgctacaaagcctcctg

SEQ ID NO: 7970599 - DNA, 22 bp, Homo sapiens
caccctgcccactagcaatctg

SEQ ID NO: 7970600 - DNA, 22 bp, Homo sapiens
caccctgcccactagcaatctg

SEQ ID NO: 7970601 - DNA, 22 bp, Homo sapiens
caccctgaggccacccagacct

SEQ ID NO: 7970602 - DNA, 17 bp, Homo sapiens
caccctggctagtctga

SEQ ID NO: 7970603 - DNA, 22 bp, Homo sapiens
caccctggctggaggtgcagtg

SEQ ID NO: 7970604 - DNA, 22 bp, Homo sapiens
caccctggctggaggtgcagtg

SEQ ID NO: 7970605 - DNA, 22 bp, Homo sapiens
caccctggctggaggtgcagtg

SEQ ID NO: 7970606 - DNA, 22 bp, Homo sapiens
caccctggaatagtagttctgc

SEQ ID NO: 7970607 - DNA, 22 bp, Homo sapiens
caccctggcctcgctctctgca

SEQ ID NO: 7970608 - DNA, 22 bp, Homo sapiens
caccctggaatagtagttctgc

SEQ ID NO: 7970609 - DNA, 22 bp, Homo sapiens
caccctggcctcgctctctgca

SEQ ID NO: 7970610 - DNA, 17 bp, Homo sapiens
caccctggctagtctga

SEQ ID NO: 7970611 - DNA, 17 bp, Homo sapiens
caccctggctagtctga

SEQ ID NO: 7970612 - DNA, 22 bp, Homo sapiens
caccctggctggaggtgcagtg

SEQ ID NO: 7970613 - DNA, 22 bp, Homo sapiens
cacccaggctagagtgcagtgg

SEQ ID NO: 7970614 - DNA, 22 bp, Homo sapiens
cacccaggctggaatgcaatgg

SEQ ID NO: 7970615 - DNA, 22 bp, Homo sapiens
cacccaggctggaatgcagtgg

SEQ ID NO: 7970616 - DNA, 22 bp, Homo sapiens
cacccaggttggagtgcagtgg

SEQ ID NO: 7970617 - DNA, 22 bp, Homo sapiens
ggcatagcggctcagcgtccag

SEQ ID NO: 7970618 - DNA, 22 bp, Homo sapiens
ggcatagatttctttaggttta

SEQ ID NO: 7970619 - DNA, 22 bp, Homo sapiens
ggcatatgtagcgtgtgttctg

SEQ ID NO: 7970620 - DNA, 22 bp, Homo sapiens
ggcatattcccagacctcatct

SEQ ID NO: 7970621 - DNA, 22 bp, Homo sapiens
ggcatcagaggtgtgttctgct

SEQ ID NO: 7970622 - DNA, 22 bp, Homo sapiens
ggcatatttatgagaacttagt

SEQ ID NO: 7970623 - DNA, 22 bp, Homo sapiens
ggcatcagaggtgtgttctgct

SEQ ID NO: 7970624 - DNA, 18 bp, Homo sapiens
ggcagtttgtgtagggga

SEQ ID NO: 7970625 - DNA, 22 bp, Homo sapiens
ggcagtttggcaggatggaggg

SEQ ID NO: 7970626 - DNA, 22 bp, Homo sapiens
ggcagtttcatcaggagaaaag

SEQ ID NO: 7970627 - DNA, 22 bp, Homo sapiens
ggcagtttctcaggcaggggta

SEQ ID NO: 7970628 - DNA, 22 bp, Homo sapiens
ggcagtttatattatgtgtgtg

SEQ ID NO: 7970629 - DNA, 22 bp, Homo sapiens
ggcatagatttctttaggttta

SEQ ID NO: 7970630 - DNA, 22 bp, Homo sapiens
ggcatagatttctttaggttta

SEQ ID NO: 7970631 - DNA, 22 bp, Homo sapiens
ggcatagaatgtgctgtgacaa

SEQ ID NO: 7970632 - DNA, 22 bp, Homo sapiens
ggcagttttaacagaggtagta

SEQ ID NO: 7970633 - DNA, 22 bp, Homo sapiens
ggcataaagttagagattaaga

SEQ ID NO: 7970634 - DNA, 22 bp, Homo sapiens
ggcataaagttagagattaaga

SEQ ID NO: 7970635 - DNA, 22 bp, Homo sapiens
ggcataaagttagagattaaga

SEQ ID NO: 7970636 - DNA, 22 bp, Homo sapiens
ggcatacaagagaaatataaga

SEQ ID NO: 7970637 - DNA, 22 bp, Homo sapiens
cacccagtaagcatgaggccct

SEQ ID NO: 7970638 - DNA, 22 bp, Homo sapiens
cacccagtaagcatgaggccct

SEQ ID NO: 7970639 - DNA, 22 bp, Homo sapiens
cacccagtgaaggagcaagagg

SEQ ID NO: 7970640 - DNA, 22 bp, Homo sapiens
cacccagttgactacaaagggg

SEQ ID NO: 7970641 - DNA, 22 bp, Homo sapiens
cacccagttgactacaaagggg

SEQ ID NO: 7970642 - DNA, 22 bp, Homo sapiens
cacccattaaccaaagagtgaa

SEQ ID NO: 7970643 - DNA, 22 bp, Homo sapiens
cacccaggttggagtgcagtgg

SEQ ID NO: 7970644 - DNA, 22 bp, Homo sapiens
cacccaggttggagtgcagtgg

SEQ ID NO: 7970645 - DNA, 22 bp, Homo sapiens
cacccaggttggagtgcagtgg

SEQ ID NO: 7970646 - DNA, 22 bp, Homo sapiens
cacccaggttggagtgcagtgg

SEQ ID NO: 7970647 - DNA, 22 bp, Homo sapiens
caccccaagttctgtccactgc

SEQ ID NO: 7970648 - DNA, 22 bp, Homo sapiens
caccccacatcaggcttctcca

SEQ ID NO: 7970649 - DNA, 23 bp, Homo sapiens
caccccaccctgaggaggaggga

SEQ ID NO: 7970650 - DNA, 23 bp, Homo sapiens
caccccaccctgaggaggaggga

SEQ ID NO: 7970651 - DNA, 22 bp, Homo sapiens
caccccagcttctcaggataga

SEQ ID NO: 7970652 - DNA, 22 bp, Homo sapiens
caccccagtctaaaaccagcct

SEQ ID NO: 7970653 - DNA, 22 bp, Homo sapiens
caccccatgtgcaggaagctgg

SEQ ID NO: 7970654 - DNA, 22 bp, Homo sapiens
caccccagtctaaaaccagcct

SEQ ID NO: 7970655 - DNA, 19 bp, Homo sapiens
caccccagtcctctttccc

SEQ ID NO: 7970656 - DNA, 19 bp, Homo sapiens
caccccagtcctctttccc

SEQ ID NO: 7970657 - DNA, 22 bp, Homo sapiens
caccccagcttctcaggataga

SEQ ID NO: 7970658 - DNA, 22 bp, Homo sapiens
caccccagcttctcaggataga

SEQ ID NO: 7970659 - DNA, 22 bp, Homo sapiens
gcttctccctacagatgtcagt

SEQ ID NO: 7970660 - DNA, 22 bp, Homo sapiens
gcttctccagaccttcatcccc

SEQ ID NO: 7970661 - DNA, 22 bp, Homo sapiens
gcttctccagaccttcatcccc

SEQ ID NO: 7970662 - DNA, 22 bp, Homo sapiens
gcttctcctcccgctcccaggc

SEQ ID NO: 7970663 - DNA, 22 bp, Homo sapiens
gcttctcctcccgctcccaggc

SEQ ID NO: 7970664 - DNA, 22 bp, Homo sapiens
gcttctcctcccgctcccaggc

SEQ ID NO: 7970665 - DNA, 22 bp, Homo sapiens
gcttctctcaggagcatcagcc

SEQ ID NO: 7970666 - DNA, 22 bp, Homo sapiens
gcttctcttaatgcctggcttt

SEQ ID NO: 7970667 - DNA, 22 bp, Homo sapiens
gcttctcttaatgcctggcttt

SEQ ID NO: 7970668 - DNA, 22 bp, Homo sapiens
gcttctctggctggtctgccac

SEQ ID NO: 7970669 - DNA, 22 bp, Homo sapiens
gcttctctggcctgcagggcat

SEQ ID NO: 7970670 - DNA, 22 bp, Homo sapiens
gcttctctggcctgcagggcat

SEQ ID NO: 7970671 - DNA, 22 bp, Homo sapiens
gcttctctctcagactgcaagc

SEQ ID NO: 7970672 - DNA, 22 bp, Homo sapiens
gcttctctcaggagcatcagcc

SEQ ID NO: 7970673 - DNA, 22 bp, Homo sapiens
gcttctctcaggagcatcagcc

SEQ ID NO: 7970674 - DNA, 22 bp, Homo sapiens
gcttctccagaccttcatcccc

SEQ ID NO: 7970675 - DNA, 18 bp, Homo sapiens
gcttctcatttctaagca

SEQ ID NO: 7970676 - DNA, 22 bp, Homo sapiens
gcttccaggtcattctcaccct

SEQ ID NO: 7970677 - DNA, 22 bp, Homo sapiens
gcttctcatgtttatttttaca

SEQ ID NO: 7970678 - DNA, 20 bp, Homo sapiens
gcttctcagggcttctctga

SEQ ID NO: 7970679 - DNA, 22 bp, Homo sapiens
gctgtggcctggcgcagagctg

SEQ ID NO: 7970680 - DNA, 22 bp, Homo sapiens
gcttccaggggctgtgggctga

SEQ ID NO: 7970681 - DNA, 22 bp, Homo sapiens
gcttccaggggctgtgggctga

SEQ ID NO: 7970682 - DNA, 22 bp, Homo sapiens
gcttccaggggctgtgggctga

SEQ ID NO: 7970683 - DNA, 22 bp, Homo sapiens
gcttccaggtcattctcaccct

SEQ ID NO: 7970684 - DNA, 22 bp, Homo sapiens
gcttccaggtcattctcaccct

SEQ ID NO: 7970685 - DNA, 22 bp, Homo sapiens
gcttccagggtgggggatgttt

SEQ ID NO: 7970686 - DNA, 22 bp, Homo sapiens
gcttccagggtgggggatgttt

SEQ ID NO: 7970687 - DNA, 22 bp, Homo sapiens
gcttccagggtgggggatgttt

SEQ ID NO: 7970688 - DNA, 22 bp, Homo sapiens
gcttccagggtgggggatgttt

SEQ ID NO: 7970689 - DNA, 22 bp, Homo sapiens
gcttccaggggtgctttgaagg

SEQ ID NO: 7970690 - DNA, 22 bp, Homo sapiens
gcttccaggggtgctttgaagg

SEQ ID NO: 7970691 - DNA, 22 bp, Homo sapiens
gctgtggccgtcagggaaatgg

SEQ ID NO: 7970692 - DNA, 22 bp, Homo sapiens
gctgtggccgggcccaggccgc

SEQ ID NO: 7970693 - DNA, 22 bp, Homo sapiens
gctgtggcccttggcatctgcg

SEQ ID NO: 7970694 - DNA, 22 bp, Homo sapiens
gctgtggcccttggcatctgcg

SEQ ID NO: 7970695 - DNA, 22 bp, Homo sapiens
gctgtggcccttggcatctgcg

SEQ ID NO: 7970696 - DNA, 22 bp, Homo sapiens
gctgtggcccttggcatctgcg

SEQ ID NO: 7970697 - DNA, 22 bp, Homo sapiens
gctgtggccgggcccaggccgc

SEQ ID NO: 7970698 - DNA, 22 bp, Homo sapiens
gctgtggcctagtttgttatat

SEQ ID NO: 7970699 - DNA, 20 bp, Homo sapiens
gctgtggccgtgccagactc

SEQ ID NO: 7970700 - DNA, 20 bp, Homo sapiens
gctgtggccgtgccagactc

SEQ ID NO: 7970701 - DNA, 22 bp, Homo sapiens
gctgtggcctccagcactcccc

SEQ ID NO: 7970702 - DNA, 22 bp, Homo sapiens
gctgtggcctccagcactcccc

SEQ ID NO: 7970703 - DNA, 22 bp, Homo sapiens
gcttggccagcagccgggatgc

SEQ ID NO: 7970704 - DNA, 22 bp, Homo sapiens
gcttggccagcagccgggatgc

SEQ ID NO: 7970705 - DNA, 22 bp, Homo sapiens
gcttggccagcagccgggatgc

SEQ ID NO: 7970706 - DNA, 22 bp, Homo sapiens
gcttggccagcagccgggatgc

SEQ ID NO: 7970707 - DNA, 22 bp, Homo sapiens
gcttggctcctggctcacaggt

SEQ ID NO: 7970708 - DNA, 22 bp, Homo sapiens
gcttggctcctggctcacaggt

SEQ ID NO: 7970709 - DNA, 22 bp, Homo sapiens
gcttggccctgccgcctgggtc

SEQ ID NO: 7970710 - DNA, 22 bp, Homo sapiens
gcttggccagcagccgggatgc

SEQ ID NO: 7970711 - DNA, 22 bp, Homo sapiens
gcttggcccattgatcagctgg

SEQ ID NO: 7970712 - DNA, 22 bp, Homo sapiens
gcttggccctgccgcctgggtc

SEQ ID NO: 7970713 - DNA, 22 bp, Homo sapiens
gcttggctggaaataggttgag

SEQ ID NO: 7970714 - DNA, 22 bp, Homo sapiens
gcttggctggaaataggttgag

SEQ ID NO: 7970715 - DNA, 22 bp, Homo sapiens
gcttggctgcctttggatgttg

SEQ ID NO: 7970716 - DNA, 22 bp, Homo sapiens
gcttggctgcctttggatgttg

SEQ ID NO: 7970717 - DNA, 22 bp, Homo sapiens
gcttggctctaagacacctatt

SEQ ID NO: 7970718 - DNA, 18 bp, Homo sapiens
gcttggctgcagagagag

SEQ ID NO: 7970719 - DNA, 18 bp, Homo sapiens
gcttggctgcagagagag

SEQ ID NO: 7970720 - DNA, 22 bp, Homo sapiens
gcttggctcctggctcacaggt

SEQ ID NO: 7970721 - DNA, 22 bp, Homo sapiens
gcttggctcctggctcacaggt

SEQ ID NO: 7970722 - DNA, 22 bp, Homo sapiens
gcttggctctaagacacctatt

SEQ ID NO: 7970723 - DNA, 22 bp, Homo sapiens
gcttggcatttgctgggagctg

SEQ ID NO: 7970724 - DNA, 22 bp, Homo sapiens
gcttggccagcagccgggatgc

SEQ ID NO: 7970725 - DNA, 22 bp, Homo sapiens
gcttggcattgaccattatcat

SEQ ID NO: 7970726 - DNA, 22 bp, Homo sapiens
gcttctgaggaaggctcagcct

SEQ ID NO: 7970727 - DNA, 22 bp, Homo sapiens
gcttctgaggaaggctcagcct

SEQ ID NO: 7970728 - DNA, 22 bp, Homo sapiens
gcttctctttctcccctggcgg

SEQ ID NO: 7970729 - DNA, 22 bp, Homo sapiens
cacaaaagtaggaggcaggcgg

SEQ ID NO: 7970730 - DNA, 22 bp, Homo sapiens
cacaaaagtaggaggcaggcgg

SEQ ID NO: 7970731 - DNA, 22 bp, Homo sapiens
cacaaaatatcaagcactttta

SEQ ID NO: 7970732 - DNA, 22 bp, Homo sapiens
caatttctctttatatctcaca

SEQ ID NO: 7970733 - DNA, 22 bp, Homo sapiens
cacaaaagtaggaggcaggcgg

SEQ ID NO: 7970734 - DNA, 22 bp, Homo sapiens
caatttctctttatatctcaca

SEQ ID NO: 7970735 - DNA, 19 bp, Homo sapiens
gcttgggagagggagctaa

SEQ ID NO: 7970736 - DNA, 19 bp, Homo sapiens
gcttgggagagggagctaa

SEQ ID NO: 7970737 - DNA, 22 bp, Homo sapiens
caatttctcgaactctaatcca

SEQ ID NO: 7970738 - DNA, 17 bp, Homo sapiens
gcttgggctgcctgttg

SEQ ID NO: 7970739 - DNA, 17 bp, Homo sapiens
gcttgggctgcctgttg

SEQ ID NO: 7970740 - DNA, 22 bp, Homo sapiens
gcttgggatatgctgatgtaaa

SEQ ID NO: 7970741 - DNA, 22 bp, Homo sapiens
gcttgggaagggccctgtgtac

SEQ ID NO: 7970742 - DNA, 22 bp, Homo sapiens
gcttgggactggagaatagggt

SEQ ID NO: 7970743 - DNA, 22 bp, Homo sapiens
gcttgggagaggcttcctcttt

SEQ ID NO: 7970744 - DNA, 22 bp, Homo sapiens
gcttggcttgggctcagaggcc

SEQ ID NO: 7970745 - DNA, 22 bp, Homo sapiens
gcttggctggagaaagttacct

SEQ ID NO: 7970746 - DNA, 22 bp, Homo sapiens
gcttggctgtgagctttgctgt

SEQ ID NO: 7970747 - DNA, 22 bp, Homo sapiens
gcttggctgtgttcaagggcgg

SEQ ID NO: 7970748 - DNA, 22 bp, Homo sapiens
gcttggcttgggctcagaggcc

SEQ ID NO: 7970749 - DNA, 22 bp, Homo sapiens
caaggcagctattgtctccata

SEQ ID NO: 7970750 - DNA, 22 bp, Homo sapiens
caaggcagctattgtctccata

SEQ ID NO: 7970751 - DNA, 22 bp, Homo sapiens
caaggcagctgtagggatttgg

SEQ ID NO: 7970752 - DNA, 22 bp, Homo sapiens
caaggcagctgtagggatttgg

SEQ ID NO: 7970753 - DNA, 22 bp, Homo sapiens
gctgtaaataagcttacttgaa

SEQ ID NO: 7970754 - DNA, 22 bp, Homo sapiens
caaggcagcgttcctttctgga

SEQ ID NO: 7970755 - DNA, 22 bp, Homo sapiens
caaggcagctattgtctccata

SEQ ID NO: 7970756 - DNA, 22 bp, Homo sapiens
caaggcagcgttcctttctgga

SEQ ID NO: 7970757 - DNA, 22 bp, Homo sapiens
caaggcagctattgtctccata

SEQ ID NO: 7970758 - DNA, 22 bp, Homo sapiens
caaggcagctattgtctccata

SEQ ID NO: 7970759 - DNA, 22 bp, Homo sapiens
caaggcagctattgtctccata

SEQ ID NO: 7970760 - DNA, 22 bp, Homo sapiens
gctgtacaaattccacaagaga

SEQ ID NO: 7970761 - DNA, 22 bp, Homo sapiens
gctgtctccatagctgtgtgtc

SEQ ID NO: 7970762 - DNA, 22 bp, Homo sapiens
gctgtctccatagctgtgtgtc

SEQ ID NO: 7970763 - DNA, 22 bp, Homo sapiens
gctgtctccatagctgtgtgtc

SEQ ID NO: 7970764 - DNA, 22 bp, Homo sapiens
gctgtctcatgggtgctagtcc

SEQ ID NO: 7970765 - DNA, 22 bp, Homo sapiens
gctgtacaaattccacaagaga

SEQ ID NO: 7970766 - DNA, 22 bp, Homo sapiens
gctgtctcatgggtgctagtcc

SEQ ID NO: 7970767 - DNA, 21 bp, Homo sapiens
gctgtctcctccttgcaccag

SEQ ID NO: 7970768 - DNA, 22 bp, Homo sapiens
gctgtctcgcctgacactggct

SEQ ID NO: 7970769 - DNA, 21 bp, Homo sapiens
gctgtctcctccttgcaccag

SEQ ID NO: 7970770 - DNA, 22 bp, Homo sapiens
gctgtctccccgcacccgaccg

SEQ ID NO: 7970771 - DNA, 22 bp, Homo sapiens
gctgtctccccgcacccgaccg

SEQ ID NO: 7970772 - DNA, 22 bp, Homo sapiens
gctgtctccccgcacccgaccg

SEQ ID NO: 7970773 - DNA, 22 bp, Homo sapiens
caaggcagaattcagactcagg

SEQ ID NO: 7970774 - DNA, 20 bp, Homo sapiens
caaggcagaccagagtgagt

SEQ ID NO: 7970775 - DNA, 22 bp, Homo sapiens
caaggcagaattcagactcagg

SEQ ID NO: 7970776 - DNA, 22 bp, Homo sapiens
caaggcagaattcagactcagg

SEQ ID NO: 7970777 - DNA, 22 bp, Homo sapiens
caaggcagaattcagactcagg

SEQ ID NO: 7970778 - DNA, 22 bp, Homo sapiens
caaggcaatctcatggcttctt

SEQ ID NO: 7970779 - DNA, 22 bp, Homo sapiens
caaggaggcagtgggacttgaa

SEQ ID NO: 7970780 - DNA, 22 bp, Homo sapiens
caaggattctcactagactaga

SEQ ID NO: 7970781 - DNA, 22 bp, Homo sapiens
caaggataggtactatgtaata

SEQ ID NO: 7970782 - DNA, 22 bp, Homo sapiens
caaggatttcactggaaagcct

SEQ ID NO: 7970783 - DNA, 20 bp, Homo sapiens
caaggcagaccagagtgagt

SEQ ID NO: 7970784 - DNA, 20 bp, Homo sapiens
caaggcagaccagagtgagt

SEQ ID NO: 7970785 - DNA, 20 bp, Homo sapiens
caaggcagaccagagtgagt

SEQ ID NO: 7970786 - DNA, 20 bp, Homo sapiens
caaggcagaccagagtgagt

SEQ ID NO: 7970787 - DNA, 20 bp, Homo sapiens
caaggcagaccagagtgagt

SEQ ID NO: 7970788 - DNA, 20 bp, Homo sapiens
caaggcagaccagagtgagt

SEQ ID NO: 7970789 - DNA, 22 bp, Homo sapiens
caaggcagcgttcctttctgga

SEQ ID NO: 7970790 - DNA, 22 bp, Homo sapiens
caaggcagcgttcctttctgga

SEQ ID NO: 7970791 - DNA, 22 bp, Homo sapiens
caaggcagcccgctgaaccaca

SEQ ID NO: 7970792 - DNA, 22 bp, Homo sapiens
caaggcagcccgctgaaccaca

SEQ ID NO: 7970793 - DNA, 22 bp, Homo sapiens
caaggcagcccgctgaaccaca

SEQ ID NO: 7970794 - DNA, 22 bp, Homo sapiens
caaggcagcccgctgaaccaca

SEQ ID NO: 7970795 - DNA, 22 bp, Homo sapiens
caaggcagcccgctgaaccaca

SEQ ID NO: 7970796 - DNA, 22 bp, Homo sapiens
gctgtggagtacagagctggtt

SEQ ID NO: 7970797 - DNA, 22 bp, Homo sapiens
gctgtggagtacagagctggtt

SEQ ID NO: 7970798 - DNA, 22 bp, Homo sapiens
gctgtggatgctatggatcatc

SEQ ID NO: 7970799 - DNA, 22 bp, Homo sapiens
gctgtggatgctatggatcatc

SEQ ID NO: 7970800 - DNA, 20 bp, Homo sapiens
gctgtggcaaagctttgtgt

SEQ ID NO: 7970801 - DNA, 20 bp, Homo sapiens
gctgtggcaaagctttgtgt

SEQ ID NO: 7970802 - DNA, 20 bp, Homo sapiens
gctgtggcaaagctttgtgt

SEQ ID NO: 7970803 - DNA, 22 bp, Homo sapiens
gctgtggcccttggcatctgcg

SEQ ID NO: 7970804 - DNA, 22 bp, Homo sapiens
gctgtggcccttggcatctgcg

SEQ ID NO: 7970805 - DNA, 20 bp, Homo sapiens
gctgtggcaagtgctcactg

SEQ ID NO: 7970806 - DNA, 20 bp, Homo sapiens
gctgtggcaagtgctcactg

SEQ ID NO: 7970807 - DNA, 20 bp, Homo sapiens
gctgtggcaagtgctcactg

SEQ ID NO: 7970808 - DNA, 20 bp, Homo sapiens
gctgtggcaagtgctcactg

SEQ ID NO: 7970809 - DNA, 20 bp, Homo sapiens
gctgtggcaagtgctcactg

SEQ ID NO: 7970810 - DNA, 22 bp, Homo sapiens
gctgtggcaatgtttataatta

SEQ ID NO: 7970811 - DNA, 22 bp, Homo sapiens
gctgtgctgattcattccctgc

SEQ ID NO: 7970812 - DNA, 22 bp, Homo sapiens
gctgtctgccgcaggctgccac

SEQ ID NO: 7970813 - DNA, 22 bp, Homo sapiens
gctgtgctgtttccacctctct

SEQ ID NO: 7970814 - DNA, 22 bp, Homo sapiens
gctgtgctggaaggggacctgc

SEQ ID NO: 7970815 - DNA, 22 bp, Homo sapiens
gctgtgctgcgggaggattccg

SEQ ID NO: 7970816 - DNA, 22 bp, Homo sapiens
gctgtgctgcgggaggattccg

SEQ ID NO: 7970817 - DNA, 22 bp, Homo sapiens
gctgtctgctgggtcgctcagg

SEQ ID NO: 7970818 - DNA, 22 bp, Homo sapiens
gctgtgctgcgggaggattccg

SEQ ID NO: 7970819 - DNA, 22 bp, Homo sapiens
gctgtgcttttggtagatccca

SEQ ID NO: 7970820 - DNA, 22 bp, Homo sapiens
gctgtggagtacagagctggtt

SEQ ID NO: 7970821 - DNA, 22 bp, Homo sapiens
gctgtgcttgcatgagtgtctg

SEQ ID NO: 7970822 - DNA, 22 bp, Homo sapiens
gctgtgctgattcattccctgc

SEQ ID NO: 7970823 - DNA, 22 bp, Homo sapiens
gctgtgcttgggaagaatctct

SEQ ID NO: 7970824 - DNA, 22 bp, Homo sapiens
gctgtgcttgggaagaatctct

SEQ ID NO: 7970825 - DNA, 22 bp, Homo sapiens
gctgtctgactccaagttggag

SEQ ID NO: 7970826 - DNA, 20 bp, Homo sapiens
gctgtctgacagttcccaga

SEQ ID NO: 7970827 - DNA, 22 bp, Homo sapiens
gctgtctgagaacatggtggaa

SEQ ID NO: 7970828 - DNA, 21 bp, Homo sapiens
gctgtctctggctcctgggaa

SEQ ID NO: 7970829 - DNA, 21 bp, Homo sapiens
gctgtctctggctcctgggaa

SEQ ID NO: 7970830 - DNA, 21 bp, Homo sapiens
gctgtctctggctcctgggaa

SEQ ID NO: 7970831 - DNA, 20 bp, Homo sapiens
gctgtctgacagttcccaga

SEQ ID NO: 7970832 - DNA, 22 bp, Homo sapiens
gctgtctcgcctgacactggct

SEQ ID NO: 7970833 - DNA, 22 bp, Homo sapiens
gctgtctcgcctgacactggct

SEQ ID NO: 7970834 - DNA, 22 bp, Homo sapiens
gctgtctcggggctttctcctg

SEQ ID NO: 7970835 - DNA, 22 bp, Homo sapiens
gctgtctcggggctttctcctg

SEQ ID NO: 7970836 - DNA, 22 bp, Homo sapiens
gctgtctctcccaggatccatg

SEQ ID NO: 7970837 - DNA, 22 bp, Homo sapiens
gctgtctctcccaggatccatg

SEQ ID NO: 7970838 - DNA, 18 bp, Homo sapiens
gctgtctgaggtctgagg

SEQ ID NO: 7970839 - DNA, 22 bp, Homo sapiens
gctgtctgagtaagagaatcct

SEQ ID NO: 7970840 - DNA, 19 bp, Homo sapiens
gctgtctgatgctgaggtc

SEQ ID NO: 7970841 - DNA, 19 bp, Homo sapiens
gctgtctgatgctgaggtc

SEQ ID NO: 7970842 - DNA, 22 bp, Homo sapiens
gctgtctgccgcaggctgccac

SEQ ID NO: 7970843 - DNA, 22 bp, Homo sapiens
gctgtctgcatctctagagctt

SEQ ID NO: 7970844 - DNA, 22 bp, Homo sapiens
gctgtctgcatctctagagctt

SEQ ID NO: 7970845 - DNA, 22 bp, Homo sapiens
cacaaaatatcaagcactttta

SEQ ID NO: 7970846 - DNA, 22 bp, Homo sapiens
cacaaaatctttctcgattatt

SEQ ID NO: 7970847 - DNA, 22 bp, Homo sapiens
cacaaaatctttctcgattatt

SEQ ID NO: 7970848 - DNA, 22 bp, Homo sapiens
cacaaaatctttctcgattatt

SEQ ID NO: 7970849 - DNA, 22 bp, Homo sapiens
cacaaaatctttctcgattatt

SEQ ID NO: 7970850 - DNA, 22 bp, Homo sapiens
cacaaaatctttctcgattatt

SEQ ID NO: 7970851 - DNA, 22 bp, Homo sapiens
cacaaaatatcaagcactttta

SEQ ID NO: 7970852 - DNA, 22 bp, Homo sapiens
cacaaaatatcaagcactttta

SEQ ID NO: 7970853 - DNA, 22 bp, Homo sapiens
cacaaaatatcaagcactttta

SEQ ID NO: 7970854 - DNA, 22 bp, Homo sapiens
cacaaaatatcaagcactttta

SEQ ID NO: 7970855 - DNA, 23 bp, Homo sapiens
cacaaaggttccattctctcacc

SEQ ID NO: 7970856 - DNA, 23 bp, Homo sapiens
cacaaaggttccattctctcacc

SEQ ID NO: 7970857 - DNA, 22 bp, Homo sapiens
cacaaacatcaatcctgttttc

SEQ ID NO: 7970858 - DNA, 22 bp, Homo sapiens
cacaaacatcaatcctgttttc

SEQ ID NO: 7970859 - DNA, 22 bp, Homo sapiens
cacaaacatcaatcctgttttc

SEQ ID NO: 7970860 - DNA, 22 bp, Homo sapiens
cacaaaccttctgcagcctgta

SEQ ID NO: 7970861 - DNA, 22 bp, Homo sapiens
cacaaacctgccagccctgccc

SEQ ID NO: 7970862 - DNA, 22 bp, Homo sapiens
ggaaaactgaggctctcagcag

SEQ ID NO: 7970863 - DNA, 22 bp, Homo sapiens
cacaaagtgttagatgccactc

SEQ ID NO: 7970864 - DNA, 22 bp, Homo sapiens
cacaaagttggacaacgcaccc

SEQ ID NO: 7970865 - DNA, 21 bp, Homo sapiens
ggaaaactttccttgtctgaa

SEQ ID NO: 7970866 - DNA, 22 bp, Homo sapiens
ggaaaactgtatttgaataact

SEQ ID NO: 7970867 - DNA, 22 bp, Homo sapiens
ggaaaagaaagggactgattgg

SEQ ID NO: 7970868 - DNA, 22 bp, Homo sapiens
ggaaaagaaagggactgattgg

SEQ ID NO: 7970869 - DNA, 22 bp, Homo sapiens
cacaaagtctgcagctgctgta

SEQ ID NO: 7970870 - DNA, 22 bp, Homo sapiens
cacaaagtataacttgatggaa

SEQ ID NO: 7970871 - DNA, 23 bp, Homo sapiens
cacaaaggttccattctctcacc

SEQ ID NO: 7970872 - DNA, 22 bp, Homo sapiens
cacaaagtggcaggagaggaga

SEQ ID NO: 7970873 - DNA, 22 bp, Homo sapiens
cacaaagtgggtggaaaactaa

SEQ ID NO: 7970874 - DNA, 22 bp, Homo sapiens
cacaaagtgggtggaaaactaa

SEQ ID NO: 7970875 - DNA, 22 bp, Homo sapiens
cacaaagtgttagatgccactc

SEQ ID NO: 7970876 - DNA, 22 bp, Homo sapiens
cacaaagtgttagatgccactc

SEQ ID NO: 7970877 - DNA, 17 bp, Homo sapiens
ggaaaagaagagtagga

SEQ ID NO: 7970878 - DNA, 22 bp, Homo sapiens
ggaaaagaaagggactgattgg

SEQ ID NO: 7970879 - DNA, 22 bp, Homo sapiens
ggaaaagaaagggactgattgg

SEQ ID NO: 7970880 - DNA, 22 bp, Homo sapiens
ggaaaagaaagggactgattgg

SEQ ID NO: 7970881 - DNA, 22 bp, Homo sapiens
ggaaaagaaagggactgattgg

SEQ ID NO: 7970882 - DNA, 17 bp, Homo sapiens
ggaaaagaagagtagga

SEQ ID NO: 7970883 - DNA, 17 bp, Homo sapiens
ggaaaagaagagtagga

SEQ ID NO: 7970884 - DNA, 17 bp, Homo sapiens
ggaaaagaagagtagga

SEQ ID NO: 7970885 - DNA, 17 bp, Homo sapiens
ggaaaagaagagtagga

SEQ ID NO: 7970886 - DNA, 17 bp, Homo sapiens
ggaaaagaagagtagga

SEQ ID NO: 7970887 - DNA, 22 bp, Homo sapiens
ggaaaagaattgcagtgaagta

SEQ ID NO: 7970888 - DNA, 22 bp, Homo sapiens
ggaaaagaattgcagtgaagta

SEQ ID NO: 7970889 - DNA, 22 bp, Homo sapiens
ggaaaagaattgcagtgaagta

SEQ ID NO: 7970890 - DNA, 22 bp, Homo sapiens
ggaaaagaattgcagtgaagta

SEQ ID NO: 7970891 - DNA, 22 bp, Homo sapiens
ggaaaagacagaattctagaat

SEQ ID NO: 7970892 - DNA, 22 bp, Homo sapiens
ggaaaagaattgcagtgaagta

SEQ ID NO: 7970893 - DNA, 22 bp, Homo sapiens
ggaaaagacagaattctagaat

SEQ ID NO: 7970894 - DNA, 22 bp, Homo sapiens
ggaaaagacagaattctagaat

SEQ ID NO: 7970895 - DNA, 22 bp, Homo sapiens
ggaaaagacagaattctagaat

SEQ ID NO: 7970896 - DNA, 22 bp, Homo sapiens
ggaaaagacagaattctagaat

SEQ ID NO: 7970897 - DNA, 22 bp, Homo sapiens
cacaatgcagcatgtaaatgca

SEQ ID NO: 7970898 - DNA, 22 bp, Homo sapiens
cacaataaatgtttgctgatga

SEQ ID NO: 7970899 - DNA, 22 bp, Homo sapiens
cacaagtggctggggaaaggga

SEQ ID NO: 7970900 - DNA, 22 bp, Homo sapiens
cacaagtgaaccatgtgtcctt

SEQ ID NO: 7970901 - DNA, 22 bp, Homo sapiens
cacaagtcattttcagcaggct

SEQ ID NO: 7970902 - DNA, 22 bp, Homo sapiens
cacaagtcattttcagcaggct

SEQ ID NO: 7970903 - DNA, 22 bp, Homo sapiens
cacaagtctgtggtctccaaca

SEQ ID NO: 7970904 - DNA, 22 bp, Homo sapiens
cacaatgtatatgtatatcaaa

SEQ ID NO: 7970905 - DNA, 22 bp, Homo sapiens
cacaatgtatatgtatatcaaa

SEQ ID NO: 7970906 - DNA, 22 bp, Homo sapiens
cacaatctcaactgccttttag

SEQ ID NO: 7970907 - DNA, 22 bp, Homo sapiens
cacaatgtatatgtatatcaaa

SEQ ID NO: 7970908 - DNA, 22 bp, Homo sapiens
cacaatgtaagagtttgttcat

SEQ ID NO: 7970909 - DNA, 22 bp, Homo sapiens
cacaatgtaagagtttgttcat

SEQ ID NO: 7970910 - DNA, 22 bp, Homo sapiens
cacaatgcagcatgtaaatgca

SEQ ID NO: 7970911 - DNA, 22 bp, Homo sapiens
cacaatgatttggttcaaaaat

SEQ ID NO: 7970912 - DNA, 22 bp, Homo sapiens
cacaatgtggtttgtcatcttt

SEQ ID NO: 7970913 - DNA, 22 bp, Homo sapiens
cacaatgtggtttgtcatcttt

SEQ ID NO: 7970914 - DNA, 22 bp, Homo sapiens
cacaatgtggtttgtcatcttt

SEQ ID NO: 7970915 - DNA, 22 bp, Homo sapiens
cacaatgtgttgggttaagttt

SEQ ID NO: 7970916 - DNA, 22 bp, Homo sapiens
cacaatgtgttgggttaagttt

SEQ ID NO: 7970917 - DNA, 21 bp, Homo sapiens
cacaatgttggccaggttggt

SEQ ID NO: 7970918 - DNA, 22 bp, Homo sapiens
cacaattacttttgcaccaaca

SEQ ID NO: 7970919 - DNA, 21 bp, Homo sapiens
cacaatgttggccaggttggt

SEQ ID NO: 7970920 - DNA, 22 bp, Homo sapiens
cacaattacttttgcaccaaca

SEQ ID NO: 7970921 - DNA, 22 bp, Homo sapiens
cacaattagcagctctttattt

SEQ ID NO: 7970922 - DNA, 22 bp, Homo sapiens
cacaattagcagctctttattt

SEQ ID NO: 7970923 - DNA, 22 bp, Homo sapiens
cacaattagcagctctttattt

SEQ ID NO: 7970924 - DNA, 21 bp, Homo sapiens
ggaaaattcagagtgcaattt

SEQ ID NO: 7970925 - DNA, 22 bp, Homo sapiens
ggaaaatactgattcatgccat

SEQ ID NO: 7970926 - DNA, 22 bp, Homo sapiens
ggaaaatactgattcatgccat

SEQ ID NO: 7970927 - DNA, 22 bp, Homo sapiens
ggaaaatactgattcatgccat

SEQ ID NO: 7970928 - DNA, 22 bp, Homo sapiens
cacaactttaggaaccacattc

SEQ ID NO: 7970929 - DNA, 22 bp, Homo sapiens
cacaaggttctgtaaaatcaaa

SEQ ID NO: 7970930 - DNA, 19 bp, Homo sapiens
cacaacttcgcttgattcc

SEQ ID NO: 7970931 - DNA, 22 bp, Homo sapiens
ggaaaagacagaattctagaat

SEQ ID NO: 7970932 - DNA, 22 bp, Homo sapiens
ggaaaagacagaattctagaat

SEQ ID NO: 7970933 - DNA, 22 bp, Homo sapiens
ggaaaagacagaattctagaat

SEQ ID NO: 7970934 - DNA, 22 bp, Homo sapiens
ggaaaagacaggttaactgtga

SEQ ID NO: 7970935 - DNA, 22 bp, Homo sapiens
ggaaaagacaggttaactgtga

SEQ ID NO: 7970936 - DNA, 22 bp, Homo sapiens
ggaaaagacaggttaactgtga

SEQ ID NO: 7970937 - DNA, 22 bp, Homo sapiens
ggaaaagacaggttaactgtga

SEQ ID NO: 7970938 - DNA, 20 bp, Homo sapiens
ggaaaagtactcctccttaa

SEQ ID NO: 7970939 - DNA, 22 bp, Homo sapiens
ggaaaaggccattgtttctctg

SEQ ID NO: 7970940 - DNA, 17 bp, Homo sapiens
ggaaaaggatgatacag

SEQ ID NO: 7970941 - DNA, 17 bp, Homo sapiens
ggaaaaggatgatacag

SEQ ID NO: 7970942 - DNA, 22 bp, Homo sapiens
cacacattaatatcaaaggctc

SEQ ID NO: 7970943 - DNA, 22 bp, Homo sapiens
cacacatattgtccctagtgtg

SEQ ID NO: 7970944 - DNA, 22 bp, Homo sapiens
cacacattaatatcaaaggctc

SEQ ID NO: 7970945 - DNA, 22 bp, Homo sapiens
cacacatcaacctagacattgt

SEQ ID NO: 7970946 - DNA, 22 bp, Homo sapiens
cacacatcaacctagacattgt

SEQ ID NO: 7970947 - DNA, 22 bp, Homo sapiens
cacacatattgtccctagtgtg

SEQ ID NO: 7970948 - DNA, 22 bp, Homo sapiens
cacacatattgtccctagtgtg

SEQ ID NO: 7970949 - DNA, 22 bp, Homo sapiens
cacaatttgttttatcagtatt

SEQ ID NO: 7970950 - DNA, 22 bp, Homo sapiens
cacaatttgttttatcagtatt

SEQ ID NO: 7970951 - DNA, 22 bp, Homo sapiens
cacaatttgtttgctcttagtc

SEQ ID NO: 7970952 - DNA, 22 bp, Homo sapiens
cacaatttccttgcttcacttt

SEQ ID NO: 7970953 - DNA, 22 bp, Homo sapiens
cacaatttggtgctaaagaaag

SEQ ID NO: 7970954 - DNA, 22 bp, Homo sapiens
cacaatttggtgctaaagaaag

SEQ ID NO: 7970955 - DNA, 22 bp, Homo sapiens
cacaatttgtattttgcatcca

SEQ ID NO: 7970956 - DNA, 18 bp, Homo sapiens
cacaatttacagatgaca

SEQ ID NO: 7970957 - DNA, 18 bp, Homo sapiens
cacaatttacagatgaca

SEQ ID NO: 7970958 - DNA, 22 bp, Homo sapiens
cacaatttccaagtcatgttat

SEQ ID NO: 7970959 - DNA, 22 bp, Homo sapiens
cacaatttccttgcttcacttt

SEQ ID NO: 7970960 - DNA, 22 bp, Homo sapiens
cacaatttcagttgcatgcaac

SEQ ID NO: 7970961 - DNA, 22 bp, Homo sapiens
cacaatttccaagtcatgttat

SEQ ID NO: 7970962 - DNA, 19 bp, Homo sapiens
cacaattatgagacactta

SEQ ID NO: 7970963 - DNA, 19 bp, Homo sapiens
cacaattatgagacactta

SEQ ID NO: 7970964 - DNA, 19 bp, Homo sapiens
cacaattatgagacactta

SEQ ID NO: 7970965 - DNA, 22 bp, Homo sapiens
cacaattatagaagaaagcata

SEQ ID NO: 7970966 - DNA, 22 bp, Homo sapiens
cacaattatagaagaaagcata

SEQ ID NO: 7970967 - DNA, 22 bp, Homo sapiens
cacaattagcagctctttattt

SEQ ID NO: 7970968 - DNA, 22 bp, Homo sapiens
cacaattagcagctctttattt

SEQ ID NO: 7970969 - DNA, 22 bp, Homo sapiens
cacaattatagaagaaagcata

SEQ ID NO: 7970970 - DNA, 22 bp, Homo sapiens
cacaattatagaagaaagcata

SEQ ID NO: 7970971 - DNA, 22 bp, Homo sapiens
cacaattattatctctttctac

SEQ ID NO: 7970972 - DNA, 22 bp, Homo sapiens
cacaattattatctctttctac

SEQ ID NO: 7970973 - DNA, 22 bp, Homo sapiens
cacaattctatcagaaagcaga

SEQ ID NO: 7970974 - DNA, 22 bp, Homo sapiens
cacaattctatcagaaagcaga

SEQ ID NO: 7970975 - DNA, 22 bp, Homo sapiens
cacaattattatctctttctac

SEQ ID NO: 7970976 - DNA, 22 bp, Homo sapiens
cacaattattatctctttctac

SEQ ID NO: 7970977 - DNA, 19 bp, Homo sapiens
cacaattatgagacactta

SEQ ID NO: 7970978 - DNA, 19 bp, Homo sapiens
cacaattatgagacactta

SEQ ID NO: 7970979 - DNA, 22 bp, Homo sapiens
cacacatttcagatgctacaat

SEQ ID NO: 7970980 - DNA, 21 bp, Homo sapiens
cacaccaaacaggaacaggga

SEQ ID NO: 7970981 - DNA, 22 bp, Homo sapiens
cacacattgagcagctgtttgt

SEQ ID NO: 7970982 - DNA, 22 bp, Homo sapiens
cacacattgaattcattcttgt

SEQ ID NO: 7970983 - DNA, 22 bp, Homo sapiens
cacaccagaggttacctgcaaa

SEQ ID NO: 7970984 - DNA, 22 bp, Homo sapiens
cacaccagaggttacctgcaaa

SEQ ID NO: 7970985 - DNA, 22 bp, Homo sapiens
cacaccagatggcagcgtggga

SEQ ID NO: 7970986 - DNA, 22 bp, Homo sapiens
cacaccagaggttacctgcaaa

SEQ ID NO: 7970987 - DNA, 23 bp, Homo sapiens
cacaccaggagccgtctgggcca

SEQ ID NO: 7970988 - DNA, 21 bp, Homo sapiens
cacaccaggcatgtcttgagc

SEQ ID NO: 7970989 - DNA, 21 bp, Homo sapiens
cacaccaggcatgtcttgagc

SEQ ID NO: 7970990 - DNA, 21 bp, Homo sapiens
cacaccaggcatgtcttgagc

SEQ ID NO: 7970991 - DNA, 21 bp, Homo sapiens
cacaccaggcatgtcttgagc

SEQ ID NO: 7970992 - DNA, 23 bp, Homo sapiens
cacaccaggagccgtctgggcca

SEQ ID NO: 7970993 - DNA, 23 bp, Homo sapiens
cacaccaggagccgtctgggcca

SEQ ID NO: 7970994 - DNA, 22 bp, Homo sapiens
cacaccagcatggtctcagtgt

SEQ ID NO: 7970995 - DNA, 22 bp, Homo sapiens
cacaccagcatggtctcagtgt

SEQ ID NO: 7970996 - DNA, 22 bp, Homo sapiens
cacaccagcatggtctcagtgt

SEQ ID NO: 7970997 - DNA, 23 bp, Homo sapiens
cacaccaggagccgtctgggcca

SEQ ID NO: 7970998 - DNA, 19 bp, Homo sapiens
cacacccatgcttgccaag

SEQ ID NO: 7970999 - DNA, 22 bp, Homo sapiens
cacaccctcgtgctccctcccg

SEQ ID NO: 7971000 - DNA, 22 bp, Homo sapiens
cacaccctcgtgctccctcccg

SEQ ID NO: 7971001 - DNA, 23 bp, Homo sapiens
cacacccatcactaagagctcct

SEQ ID NO: 7971002 - DNA, 19 bp, Homo sapiens
cacacccatgcttgccaag

SEQ ID NO: 7971003 - DNA, 22 bp, Homo sapiens
cacacccaaatttctctctcag

SEQ ID NO: 7971004 - DNA, 23 bp, Homo sapiens
cacacccatcactaagagctcct

SEQ ID NO: 7971005 - DNA, 22 bp, Homo sapiens
cacacccaaatttctctctcag

SEQ ID NO: 7971006 - DNA, 22 bp, Homo sapiens
cacacccaaattctaacagtag

SEQ ID NO: 7971007 - DNA, 22 bp, Homo sapiens
cacacctgtaataccagctact

SEQ ID NO: 7971008 - DNA, 22 bp, Homo sapiens
cacacctgtaataccagctact

SEQ ID NO: 7971009 - DNA, 22 bp, Homo sapiens
cacacctgtaatcctagcactt

SEQ ID NO: 7971010 - DNA, 22 bp, Homo sapiens
cacacctgtaataccagctact

SEQ ID NO: 7971011 - DNA, 22 bp, Homo sapiens
cacacctgtaatcctagcactt

SEQ ID NO: 7971012 - DNA, 22 bp, Homo sapiens
cacacccttgctaacacttgtt

SEQ ID NO: 7971013 - DNA, 22 bp, Homo sapiens
cacacctgcctgccgtgtgctg

SEQ ID NO: 7971014 - DNA, 22 bp, Homo sapiens
cacacctcacacctcgcatgct

SEQ ID NO: 7971015 - DNA, 22 bp, Homo sapiens
cacacctcagccatgtggaggc

SEQ ID NO: 7971016 - DNA, 19 bp, Homo sapiens
cacacccatgcttgccaag

SEQ ID NO: 7971017 - DNA, 22 bp, Homo sapiens
cacaccttaggcctgagcgctt

SEQ ID NO: 7971018 - DNA, 23 bp, Homo sapiens
cacacctgttaagaagagtgcct

SEQ ID NO: 7971019 - DNA, 23 bp, Homo sapiens
cacacctgttaagaagagtgcct

SEQ ID NO: 7971020 - DNA, 23 bp, Homo sapiens
cacacctgttaagaagagtgcct

SEQ ID NO: 7971021 - DNA, 22 bp, Homo sapiens
cacacctgtaataccagctact

SEQ ID NO: 7971022 - DNA, 22 bp, Homo sapiens
cacacctgtgagtctcggcttg

SEQ ID NO: 7971023 - DNA, 22 bp, Homo sapiens
cacacctgtgagtctcggcttg

SEQ ID NO: 7971024 - DNA, 22 bp, Homo sapiens
caaagtatcaactcccacactg

SEQ ID NO: 7971025 - DNA, 22 bp, Homo sapiens
caaagtatatttcatagtctca

SEQ ID NO: 7971026 - DNA, 22 bp, Homo sapiens
caaagtatgaaccagtttctct

SEQ ID NO: 7971027 - DNA, 22 bp, Homo sapiens
caaagtatatttcatagtctca

SEQ ID NO: 7971028 - DNA, 22 bp, Homo sapiens
caaagtatcaactcccacactg

SEQ ID NO: 7971029 - DNA, 22 bp, Homo sapiens
caaagtatcaactcccacactg

SEQ ID NO: 7971030 - DNA, 22 bp, Homo sapiens
gctcctgaaggctctgcagggt

SEQ ID NO: 7971031 - DNA, 22 bp, Homo sapiens
gctcctgaaggctctgcagggt

SEQ ID NO: 7971032 - DNA, 22 bp, Homo sapiens
gctcctgaaggctctgcagggt

SEQ ID NO: 7971033 - DNA, 22 bp, Homo sapiens
gctcctgaaggctctgcagggt

SEQ ID NO: 7971034 - DNA, 22 bp, Homo sapiens
caaagtatgaaccagtttctct

SEQ ID NO: 7971035 - DNA, 18 bp, Homo sapiens
gctcctggaccaggtcac

SEQ ID NO: 7971036 - DNA, 18 bp, Homo sapiens
gctcctggaccaggtcac

SEQ ID NO: 7971037 - DNA, 18 bp, Homo sapiens
gctcctggaccaggtcac

SEQ ID NO: 7971038 - DNA, 22 bp, Homo sapiens
gctcctgccctcttgcaattcc

SEQ ID NO: 7971039 - DNA, 17 bp, Homo sapiens
gctcctgcaggtcagga

SEQ ID NO: 7971040 - DNA, 17 bp, Homo sapiens
gctcctgcaggtcagga

SEQ ID NO: 7971041 - DNA, 22 bp, Homo sapiens
gctcctgcaggacccaggagac

SEQ ID NO: 7971042 - DNA, 22 bp, Homo sapiens
gctcctgcaggacccaggagac

SEQ ID NO: 7971043 - DNA, 22 bp, Homo sapiens
gctcctgcagagatgttccatg

SEQ ID NO: 7971044 - DNA, 22 bp, Homo sapiens
gctcctgcaggacccaggagac

SEQ ID NO: 7971045 - DNA, 22 bp, Homo sapiens
gctcctgcaggacccaggagac

SEQ ID NO: 7971046 - DNA, 22 bp, Homo sapiens
gctcctgcaggacccaggagac

SEQ ID NO: 7971047 - DNA, 17 bp, Homo sapiens
gctcctgcaggtcagga

SEQ ID NO: 7971048 - DNA, 22 bp, Homo sapiens
caaagtaatttggagatatata

SEQ ID NO: 7971049 - DNA, 22 bp, Homo sapiens
caaagtaatttggagatatata

SEQ ID NO: 7971050 - DNA, 22 bp, Homo sapiens
caaagtaatttggagatatata

SEQ ID NO: 7971051 - DNA, 22 bp, Homo sapiens
caaagtaatttggagatatata

SEQ ID NO: 7971052 - DNA, 22 bp, Homo sapiens
caaagtaatatggtcccagtga

SEQ ID NO: 7971053 - DNA, 22 bp, Homo sapiens
caaagtaactgcctttccaatt

SEQ ID NO: 7971054 - DNA, 22 bp, Homo sapiens
caaagtaactgcctttccaatt

SEQ ID NO: 7971055 - DNA, 22 bp, Homo sapiens
caaagtaaactaccactgtttc

SEQ ID NO: 7971056 - DNA, 22 bp, Homo sapiens
caaagtaaactaccactgtttc

SEQ ID NO: 7971057 - DNA, 22 bp, Homo sapiens
caaaggtttcacagtagcccat

SEQ ID NO: 7971058 - DNA, 22 bp, Homo sapiens
caaaggttgttgagagtgcagg

SEQ ID NO: 7971059 - DNA, 22 bp, Homo sapiens
caaaggttatgaaccacttgta

SEQ ID NO: 7971060 - DNA, 22 bp, Homo sapiens
caaagtatatttcatagtctca

SEQ ID NO: 7971061 - DNA, 22 bp, Homo sapiens
caaagtatatttcatagtctca

SEQ ID NO: 7971062 - DNA, 22 bp, Homo sapiens
caaagtatatttcatagtctca

SEQ ID NO: 7971063 - DNA, 22 bp, Homo sapiens
caaagtatatttcatagtctca

SEQ ID NO: 7971064 - DNA, 22 bp, Homo sapiens
caaagtatattggattgaatgg

SEQ ID NO: 7971065 - DNA, 22 bp, Homo sapiens
caaagtatattggattgaatgg

SEQ ID NO: 7971066 - DNA, 19 bp, Homo sapiens
caaagtacctggcacagtg

SEQ ID NO: 7971067 - DNA, 22 bp, Homo sapiens
caaagtatagtgtaggatggca

SEQ ID NO: 7971068 - DNA, 22 bp, Homo sapiens
caaagtatattggattgaatgg

SEQ ID NO: 7971069 - DNA, 22 bp, Homo sapiens
caaagtacagtgcttcctggga

SEQ ID NO: 7971070 - DNA, 18 bp, Homo sapiens
gctcctggagtctgactc

SEQ ID NO: 7971071 - DNA, 18 bp, Homo sapiens
gctcctggagtctgactc

SEQ ID NO: 7971072 - DNA, 18 bp, Homo sapiens
gctcctggagtctgactc

SEQ ID NO: 7971073 - DNA, 18 bp, Homo sapiens
gctcctggagtctgactc

SEQ ID NO: 7971074 - DNA, 18 bp, Homo sapiens
gctcctggagtctgactc

SEQ ID NO: 7971075 - DNA, 18 bp, Homo sapiens
gctcctggagtctgactc

SEQ ID NO: 7971076 - DNA, 19 bp, Homo sapiens
gctcctggatgacctgtgg

SEQ ID NO: 7971077 - DNA, 19 bp, Homo sapiens
gctcctggatgacctgtgg

SEQ ID NO: 7971078 - DNA, 22 bp, Homo sapiens
gctcctggagagattgagaaag

SEQ ID NO: 7971079 - DNA, 22 bp, Homo sapiens
gctcctggagagattgagaaag

SEQ ID NO: 7971080 - DNA, 22 bp, Homo sapiens
gctcctggagagattgagaaag

SEQ ID NO: 7971081 - DNA, 22 bp, Homo sapiens
gctcctggagagattgagaaag

SEQ ID NO: 7971082 - DNA, 18 bp, Homo sapiens
gctcctggaccaggtcac

SEQ ID NO: 7971083 - DNA, 22 bp, Homo sapiens
gctcctggagagattgagaaag

SEQ ID NO: 7971084 - DNA, 19 bp, Homo sapiens
gctcctggatgacctgtgg

SEQ ID NO: 7971085 - DNA, 19 bp, Homo sapiens
gctcctggatgacctgtgg

SEQ ID NO: 7971086 - DNA, 19 bp, Homo sapiens
gctcctggatgacctgtgg

SEQ ID NO: 7971087 - DNA, 19 bp, Homo sapiens
gctcctggatgacctgtgg

SEQ ID NO: 7971088 - DNA, 20 bp, Homo sapiens
gctgaggtggaggaaggaga

SEQ ID NO: 7971089 - DNA, 22 bp, Homo sapiens
gctgcagagacagctgccgatg

SEQ ID NO: 7971090 - DNA, 22 bp, Homo sapiens
gctgcagagacagctgccgatg

SEQ ID NO: 7971091 - DNA, 22 bp, Homo sapiens
gctgcagagacagctgccgatg

SEQ ID NO: 7971092 - DNA, 22 bp, Homo sapiens
gctgcagacttctcatctcatt

SEQ ID NO: 7971093 - DNA, 22 bp, Homo sapiens
gctgcagacttctcatctcatt

SEQ ID NO: 7971094 - DNA, 22 bp, Homo sapiens
gctgcagacttctcatctcatt

SEQ ID NO: 7971095 - DNA, 22 bp, Homo sapiens
gctgaggtggaggaaggagacc

SEQ ID NO: 7971096 - DNA, 22 bp, Homo sapiens
gctgcagccaaattcattgtca

SEQ ID NO: 7971097 - DNA, 22 bp, Homo sapiens
gctgcagcccggcgcgcctgag

SEQ ID NO: 7971098 - DNA, 22 bp, Homo sapiens
gctgcagcagctgcagggttgt

SEQ ID NO: 7971099 - DNA, 22 bp, Homo sapiens
gctgcagcaagccctccagggg

SEQ ID NO: 7971100 - DNA, 22 bp, Homo sapiens
gctgcagcaagccctccagggg

SEQ ID NO: 7971101 - DNA, 22 bp, Homo sapiens
gctgcagcaagccctccagggg

SEQ ID NO: 7971102 - DNA, 22 bp, Homo sapiens
gctgcagcagaagttctcagag

SEQ ID NO: 7971103 - DNA, 19 bp, Homo sapiens
gctgcagcagagaaactgg

SEQ ID NO: 7971104 - DNA, 19 bp, Homo sapiens
gctgcagcagagaaactgg

SEQ ID NO: 7971105 - DNA, 22 bp, Homo sapiens
gctgcagatcccacccattccc

SEQ ID NO: 7971106 - DNA, 22 bp, Homo sapiens
gctgcagagtgatgaagtgggg

SEQ ID NO: 7971107 - DNA, 19 bp, Homo sapiens
gctgcagagtattcttggg

SEQ ID NO: 7971108 - DNA, 22 bp, Homo sapiens
gctgcagagtgatgaagtgggg

SEQ ID NO: 7971109 - DNA, 22 bp, Homo sapiens
gctgcagagacagctgccgatg

SEQ ID NO: 7971110 - DNA, 22 bp, Homo sapiens
gctgcagagggaggggctcgca

SEQ ID NO: 7971111 - DNA, 22 bp, Homo sapiens
caacatataatatttgagttct

SEQ ID NO: 7971112 - DNA, 22 bp, Homo sapiens
caacagttctcatagcagattc

SEQ ID NO: 7971113 - DNA, 22 bp, Homo sapiens
caacagttctcatagcagattc

SEQ ID NO: 7971114 - DNA, 22 bp, Homo sapiens
caacagtgattctgcatgagga

SEQ ID NO: 7971115 - DNA, 22 bp, Homo sapiens
caacagtgattctgcatgagga

SEQ ID NO: 7971116 - DNA, 22 bp, Homo sapiens
caacagtgttgcaatctgaaaa

SEQ ID NO: 7971117 - DNA, 22 bp, Homo sapiens
caacatatgattttgtatataa

SEQ ID NO: 7971118 - DNA, 22 bp, Homo sapiens
caacatatgattttgtatataa

SEQ ID NO: 7971119 - DNA, 22 bp, Homo sapiens
caacatatgattttgtatataa

SEQ ID NO: 7971120 - DNA, 22 bp, Homo sapiens
caacatatttttatgtaggtca

SEQ ID NO: 7971121 - DNA, 22 bp, Homo sapiens
caacatcagtcctcatgagaca

SEQ ID NO: 7971122 - DNA, 22 bp, Homo sapiens
caacatcagtcctcatgagaca

SEQ ID NO: 7971123 - DNA, 22 bp, Homo sapiens
caacatttgagtaaagaaatgg

SEQ ID NO: 7971124 - DNA, 22 bp, Homo sapiens
caacatttcaaggtctttagga

SEQ ID NO: 7971125 - DNA, 22 bp, Homo sapiens
caacatttgagtaaagaaatgg

SEQ ID NO: 7971126 - DNA, 22 bp, Homo sapiens
caacatttgagtaaagaaatgg

SEQ ID NO: 7971127 - DNA, 22 bp, Homo sapiens
caacattttcatggccagggag

SEQ ID NO: 7971128 - DNA, 22 bp, Homo sapiens
caacatttgtgatgagcaaact

SEQ ID NO: 7971129 - DNA, 22 bp, Homo sapiens
caacatgtgttagacaatagac

SEQ ID NO: 7971130 - DNA, 22 bp, Homo sapiens
caacatgtgttagacaatagac

SEQ ID NO: 7971131 - DNA, 22 bp, Homo sapiens
caacatgtgttagacaatagac

SEQ ID NO: 7971132 - DNA, 22 bp, Homo sapiens
caacatctttgtgtatgtgaga

SEQ ID NO: 7971133 - DNA, 22 bp, Homo sapiens
caacattatatagccacatgcc

SEQ ID NO: 7971134 - DNA, 22 bp, Homo sapiens
caacatctgtatcattagtaca

SEQ ID NO: 7971135 - DNA, 22 bp, Homo sapiens
caacattcaaccaacatttatg

SEQ ID NO: 7971136 - DNA, 22 bp, Homo sapiens
caacattcttatcactataagc

SEQ ID NO: 7971137 - DNA, 22 bp, Homo sapiens
gctgcagtgagccaagatcgtg

SEQ ID NO: 7971138 - DNA, 22 bp, Homo sapiens
gctgcagtgagccaagatcgtg

SEQ ID NO: 7971139 - DNA, 22 bp, Homo sapiens
gctgcagtgagccaagatcgtg

SEQ ID NO: 7971140 - DNA, 22 bp, Homo sapiens
gctgcagtgagccaagatcgtg

SEQ ID NO: 7971141 - DNA, 22 bp, Homo sapiens
gctgcagtgagccaagatcgtg

SEQ ID NO: 7971142 - DNA, 22 bp, Homo sapiens
gctgcagtgagccaagatcgtg

SEQ ID NO: 7971143 - DNA, 22 bp, Homo sapiens
gctgcagtgagccaagatcgtg

SEQ ID NO: 7971144 - DNA, 22 bp, Homo sapiens
gctgcagtgttggacctcaggg

SEQ ID NO: 7971145 - DNA, 22 bp, Homo sapiens
gctgcatgacagacaggcctgg

SEQ ID NO: 7971146 - DNA, 22 bp, Homo sapiens
gctgcatggagggtgcccagga

SEQ ID NO: 7971147 - DNA, 22 bp, Homo sapiens
gctgcatgacagacaggcctgg

SEQ ID NO: 7971148 - DNA, 22 bp, Homo sapiens
gctgcatgacagacaggcctgg

SEQ ID NO: 7971149 - DNA, 17 bp, Homo sapiens
gctgcagcggtaggcag

SEQ ID NO: 7971150 - DNA, 22 bp, Homo sapiens
gctgcaggtttgtctagtctgg

SEQ ID NO: 7971151 - DNA, 22 bp, Homo sapiens
gctgcaggtttgtctagtctgg

SEQ ID NO: 7971152 - DNA, 22 bp, Homo sapiens
gctgcaggtttgtctagtctgg

SEQ ID NO: 7971153 - DNA, 22 bp, Homo sapiens
gctgcagccttcttgccattaa

SEQ ID NO: 7971154 - DNA, 22 bp, Homo sapiens
gctgcagccctgcggatcactt

SEQ ID NO: 7971155 - DNA, 22 bp, Homo sapiens
gctgcagccctgcggatcactt

SEQ ID NO: 7971156 - DNA, 22 bp, Homo sapiens
gctgcagcctttgggaaggaca

SEQ ID NO: 7971157 - DNA, 22 bp, Homo sapiens
gctgcagcctttgggaaggaca

SEQ ID NO: 7971158 - DNA, 22 bp, Homo sapiens
gctgcagcctttgggaaggaca

SEQ ID NO: 7971159 - DNA, 17 bp, Homo sapiens
gctgcagcggtaggcag

SEQ ID NO: 7971160 - DNA, 21 bp, Homo sapiens
gctgccaccgcgtgctccagg

SEQ ID NO: 7971161 - DNA, 22 bp, Homo sapiens
gctgccacattttcaggactaa

SEQ ID NO: 7971162 - DNA, 21 bp, Homo sapiens
gctgccaccgcgtgctccagg

SEQ ID NO: 7971163 - DNA, 22 bp, Homo sapiens
gctgccaccgtggagatgagtg

SEQ ID NO: 7971164 - DNA, 21 bp, Homo sapiens
gctgccaccgcgtgctccagg

SEQ ID NO: 7971165 - DNA, 22 bp, Homo sapiens
gctgcatggagggtgcccagga

SEQ ID NO: 7971166 - DNA, 22 bp, Homo sapiens
gctgcatggagggtgcccagga

SEQ ID NO: 7971167 - DNA, 19 bp, Homo sapiens
gctgcattcatggtgagtg

SEQ ID NO: 7971168 - DNA, 23 bp, Homo sapiens
gctgccacagggctcaggcaggt

SEQ ID NO: 7971169 - DNA, 23 bp, Homo sapiens
gctgccacagggctcaggcaggt

SEQ ID NO: 7971170 - DNA, 22 bp, Homo sapiens
gctgccacattttcaggactaa

SEQ ID NO: 7971171 - DNA, 22 bp, Homo sapiens
caacagtctctatagctccttg

SEQ ID NO: 7971172 - DNA, 22 bp, Homo sapiens
caacagtcagaatgaagctgag

SEQ ID NO: 7971173 - DNA, 22 bp, Homo sapiens
caacagtccccagggctggggt

SEQ ID NO: 7971174 - DNA, 22 bp, Homo sapiens
caacagtgattctgcatgagga

SEQ ID NO: 7971175 - DNA, 22 bp, Homo sapiens
caacagtctggtttatataata

SEQ ID NO: 7971176 - DNA, 22 bp, Homo sapiens
caacagtcttgagataaaactt

SEQ ID NO: 7971177 - DNA, 19 bp, Homo sapiens
caacagtactggtttgtcc

SEQ ID NO: 7971178 - DNA, 22 bp, Homo sapiens
caacagtatagcttttgactgc

SEQ ID NO: 7971179 - DNA, 22 bp, Homo sapiens
caacagtatagcttttgactgc

SEQ ID NO: 7971180 - DNA, 22 bp, Homo sapiens
caacagtattgtgggccaggta

SEQ ID NO: 7971181 - DNA, 22 bp, Homo sapiens
caacactgattatggctgagct

SEQ ID NO: 7971182 - DNA, 22 bp, Homo sapiens
caacactgattatggctgagct

SEQ ID NO: 7971183 - DNA, 22 bp, Homo sapiens
caacactgattatggctgagct

SEQ ID NO: 7971184 - DNA, 19 bp, Homo sapiens
caacagtactggtttgtcc

SEQ ID NO: 7971185 - DNA, 22 bp, Homo sapiens
caacactgattatggctgagct

SEQ ID NO: 7971186 - DNA, 22 bp, Homo sapiens
caacactgacaatggactgatt

SEQ ID NO: 7971187 - DNA, 22 bp, Homo sapiens
caagagtgaaactctgtctcaa

SEQ ID NO: 7971188 - DNA, 22 bp, Homo sapiens
caagagtgaaactctgtctcaa

SEQ ID NO: 7971189 - DNA, 22 bp, Homo sapiens
caagaggcaaattgtctagaag

SEQ ID NO: 7971190 - DNA, 22 bp, Homo sapiens
caagaggctaaactgggctatt

SEQ ID NO: 7971191 - DNA, 22 bp, Homo sapiens
caagaggctaaactgggctatt

SEQ ID NO: 7971192 - DNA, 22 bp, Homo sapiens
caagataatttattctgagttt

SEQ ID NO: 7971193 - DNA, 22 bp, Homo sapiens
caagataagatcatttacacta

SEQ ID NO: 7971194 - DNA, 22 bp, Homo sapiens
caagataaagccaccagaagct

SEQ ID NO: 7971195 - DNA, 22 bp, Homo sapiens
caagataaaatcagcattccaa

SEQ ID NO: 7971196 - DNA, 22 bp, Homo sapiens
caagagttgaggttcaaatggg

SEQ ID NO: 7971197 - DNA, 22 bp, Homo sapiens
caagagttgaggttcaaatggg

SEQ ID NO: 7971198 - DNA, 22 bp, Homo sapiens
caagagttgaggttcaaatggg

SEQ ID NO: 7971199 - DNA, 22 bp, Homo sapiens
caagagttgagggatgtcagtt

SEQ ID NO: 7971200 - DNA, 22 bp, Homo sapiens
caagaggagcaggcaggtgtgc

SEQ ID NO: 7971201 - DNA, 22 bp, Homo sapiens
caagagctttagaaatgctcat

SEQ ID NO: 7971202 - DNA, 22 bp, Homo sapiens
caagagcttctgctcttcatgg

SEQ ID NO: 7971203 - DNA, 22 bp, Homo sapiens
caagagctgtgacctcattcac

SEQ ID NO: 7971204 - DNA, 22 bp, Homo sapiens
caagagctgggtggcaagctag

SEQ ID NO: 7971205 - DNA, 22 bp, Homo sapiens
caagagctgggtggcaagctag

SEQ ID NO: 7971206 - DNA, 18 bp, Homo sapiens
caagagctgctcctggcc

SEQ ID NO: 7971207 - DNA, 22 bp, Homo sapiens
caagagctggagaggcagtcta

SEQ ID NO: 7971208 - DNA, 18 bp, Homo sapiens
caagagctgctcctggcc

SEQ ID NO: 7971209 - DNA, 18 bp, Homo sapiens
caagagctgctcctggcc

SEQ ID NO: 7971210 - DNA, 22 bp, Homo sapiens
caagagctggagaggcagtcta

SEQ ID NO: 7971211 - DNA, 18 bp, Homo sapiens
caagagctgctcctggcc

SEQ ID NO: 7971212 - DNA, 22 bp, Homo sapiens
caagatactcagaaaggcattg

SEQ ID NO: 7971213 - DNA, 22 bp, Homo sapiens
caagatatcaatgacatagtat

SEQ ID NO: 7971214 - DNA, 22 bp, Homo sapiens
caagatatcaatgacatagtat

SEQ ID NO: 7971215 - DNA, 22 bp, Homo sapiens
caagatatgtcctgttactaag

SEQ ID NO: 7971216 - DNA, 22 bp, Homo sapiens
caagatatgtgttgttagctct

SEQ ID NO: 7971217 - DNA, 22 bp, Homo sapiens
caagatatgtgttgttagctct

SEQ ID NO: 7971218 - DNA, 22 bp, Homo sapiens
caagatcaagtgtagtatcaaa

SEQ ID NO: 7971219 - DNA, 22 bp, Homo sapiens
caagatcaagtgtagtatcaaa

SEQ ID NO: 7971220 - DNA, 22 bp, Homo sapiens
caagatcaaggtatcagcagat

SEQ ID NO: 7971221 - DNA, 22 bp, Homo sapiens
caagatcaaggtgtcagcaggt

SEQ ID NO: 7971222 - DNA, 22 bp, Homo sapiens
caagatcacacaggtaacaagt

SEQ ID NO: 7971223 - DNA, 22 bp, Homo sapiens
caagatcaagtgtagtatcaaa

SEQ ID NO: 7971224 - DNA, 22 bp, Homo sapiens
caagatgaaactacagggagga

SEQ ID NO: 7971225 - DNA, 22 bp, Homo sapiens
caagatgaaattgtgatatttt

SEQ ID NO: 7971226 - DNA, 22 bp, Homo sapiens
caagatgaaattgtgatatttt

SEQ ID NO: 7971227 - DNA, 22 bp, Homo sapiens
caagatgaaattgtgatatttt

SEQ ID NO: 7971228 - DNA, 21 bp, Homo sapiens
caagatctcggcttgcttcct

SEQ ID NO: 7971229 - DNA, 22 bp, Homo sapiens
caagatcttcctcaatagacct

SEQ ID NO: 7971230 - DNA, 22 bp, Homo sapiens
caagatgaggtcatactggaat

SEQ ID NO: 7971231 - DNA, 22 bp, Homo sapiens
caagatgacaaggctggaggct

SEQ ID NO: 7971232 - DNA, 22 bp, Homo sapiens
caagatgactttgggggattaa

SEQ ID NO: 7971233 - DNA, 22 bp, Homo sapiens
caagatgacaaggctggaggct

SEQ ID NO: 7971234 - DNA, 22 bp, Homo sapiens
caagatgaatgatgaagtgtgt

SEQ ID NO: 7971235 - DNA, 22 bp, Homo sapiens
caagatgaaattgtgatatttt

SEQ ID NO: 7971236 - DNA, 22 bp, Homo sapiens
caagatgaagtgaagattagaa

SEQ ID NO: 7971237 - DNA, 22 bp, Homo sapiens
caagatggagaagcagcaaggg

SEQ ID NO: 7971238 - DNA, 22 bp, Homo sapiens
caagatggagaagcagcaaggg

SEQ ID NO: 7971239 - DNA, 22 bp, Homo sapiens
caagatgatccctgaaggcagc

SEQ ID NO: 7971240 - DNA, 22 bp, Homo sapiens
caagctgccaccagaagagcat

SEQ ID NO: 7971241 - DNA, 22 bp, Homo sapiens
caagctgccaccagaagagcat

SEQ ID NO: 7971242 - DNA, 22 bp, Homo sapiens
caagctgccaccagaagagcat

SEQ ID NO: 7971243 - DNA, 22 bp, Homo sapiens
caagattactatccactgctgg

SEQ ID NO: 7971244 - DNA, 22 bp, Homo sapiens
caagattactatccactgctgg

SEQ ID NO: 7971245 - DNA, 22 bp, Homo sapiens
caagatgtggtgggctgagttt

SEQ ID NO: 7971246 - DNA, 22 bp, Homo sapiens
caagatgtggtgggctgagttt

SEQ ID NO: 7971247 - DNA, 22 bp, Homo sapiens
caagatgtgcctaatcagacct

SEQ ID NO: 7971248 - DNA, 22 bp, Homo sapiens
caaggacaacttcatattgtgg

SEQ ID NO: 7971249 - DNA, 22 bp, Homo sapiens
caaggaatatttaagaacgtca

SEQ ID NO: 7971250 - DNA, 22 bp, Homo sapiens
caagctgcttattctctgctct

SEQ ID NO: 7971251 - DNA, 22 bp, Homo sapiens
caagctgcttattctctgctct

SEQ ID NO: 7971252 - DNA, 21 bp, Homo sapiens
caagctgcctgagggtggttg

SEQ ID NO: 7971253 - DNA, 22 bp, Homo sapiens
caaggacactccctgctgggca

SEQ ID NO: 7971254 - DNA, 22 bp, Homo sapiens
caaggacactccctgctgggca

SEQ ID NO: 7971255 - DNA, 22 bp, Homo sapiens
caaggacactccctgctgggca

SEQ ID NO: 7971256 - DNA, 22 bp, Homo sapiens
caaggacaacttcatattgtgg

SEQ ID NO: 7971257 - DNA, 22 bp, Homo sapiens
caaggacactccctgctgggca

SEQ ID NO: 7971258 - DNA, 22 bp, Homo sapiens
caaggacactgagctttgtaaa

SEQ ID NO: 7971259 - DNA, 22 bp, Homo sapiens
caaggagaaaacggcttctgaa

SEQ ID NO: 7971260 - DNA, 22 bp, Homo sapiens
caaggagaaaacggcttctgaa

SEQ ID NO: 7971261 - DNA, 22 bp, Homo sapiens
caaggagagtaattgaatgaga

SEQ ID NO: 7971262 - DNA, 22 bp, Homo sapiens
caaggagagtaattgaatgaga

SEQ ID NO: 7971263 - DNA, 22 bp, Homo sapiens
caaggagagtaattgaatgaga

SEQ ID NO: 7971264 - DNA, 22 bp, Homo sapiens
caaggagataaaatgttgagct

SEQ ID NO: 7971265 - DNA, 22 bp, Homo sapiens
caaggaggaagatgcaggggac

SEQ ID NO: 7971266 - DNA, 22 bp, Homo sapiens
caaggaggaagatgcaggggac

SEQ ID NO: 7971267 - DNA, 22 bp, Homo sapiens
caaggaggcagtgggacttgaa

SEQ ID NO: 7971268 - DNA, 22 bp, Homo sapiens
caaggaggcagtgggacttgaa

SEQ ID NO: 7971269 - DNA, 21 bp, Homo sapiens
caaggacaggttgcagggcaa

SEQ ID NO: 7971270 - DNA, 21 bp, Homo sapiens
caaggacaggttgcagggcaa

SEQ ID NO: 7971271 - DNA, 22 bp, Homo sapiens
caaggagaaaacggcttctgaa

SEQ ID NO: 7971272 - DNA, 22 bp, Homo sapiens
caaggacactgatgttcatcct

SEQ ID NO: 7971273 - DNA, 22 bp, Homo sapiens
caaggacactgatgttcatcct

SEQ ID NO: 7971274 - DNA, 22 bp, Homo sapiens
caaggacagcgtcaggtgcaac

SEQ ID NO: 7971275 - DNA, 22 bp, Homo sapiens
caaggacagcgtcaggtgcaac

SEQ ID NO: 7971276 - DNA, 22 bp, Homo sapiens
caagacaatgggtaagtgtaac

SEQ ID NO: 7971277 - DNA, 22 bp, Homo sapiens
caagacaatgggtaagtgtaac

SEQ ID NO: 7971278 - DNA, 22 bp, Homo sapiens
caagagctcaccggagagcatt

SEQ ID NO: 7971279 - DNA, 22 bp, Homo sapiens
caagagctcagaaacccttgct

SEQ ID NO: 7971280 - DNA, 22 bp, Homo sapiens
caagagctgaggctggagaggt

SEQ ID NO: 7971281 - DNA, 22 bp, Homo sapiens
caagagctctccactaggttgg

SEQ ID NO: 7971282 - DNA, 22 bp, Homo sapiens
caagagctcccagacctgggca

SEQ ID NO: 7971283 - DNA, 22 bp, Homo sapiens
caagagctcccagacctgggca

SEQ ID NO: 7971284 - DNA, 22 bp, Homo sapiens
caagagctcccagacctgggca

SEQ ID NO: 7971285 - DNA, 22 bp, Homo sapiens
caagagctgaggctggagaggt

SEQ ID NO: 7971286 - DNA, 22 bp, Homo sapiens
caagagctgaggctggagaggt

SEQ ID NO: 7971287 - DNA, 22 bp, Homo sapiens
caagagctgaggctggagaggt

SEQ ID NO: 7971288 - DNA, 22 bp, Homo sapiens
caagagctgaggctggagaggt

SEQ ID NO: 7971289 - DNA, 22 bp, Homo sapiens
caagagctgcaaatagcgtgac

SEQ ID NO: 7971290 - DNA, 22 bp, Homo sapiens
caagagctgaggctggagaggt

SEQ ID NO: 7971291 - DNA, 22 bp, Homo sapiens
caagagctgcaaatagcgtgac

SEQ ID NO: 7971292 - DNA, 22 bp, Homo sapiens
caagagctgcaaatagcgtgac

SEQ ID NO: 7971293 - DNA, 22 bp, Homo sapiens
caagagctgcaaatagcgtgac

SEQ ID NO: 7971294 - DNA, 22 bp, Homo sapiens
caagagctgcaaatagcgtgac

SEQ ID NO: 7971295 - DNA, 22 bp, Homo sapiens
caagacaagatctaagcatgct

SEQ ID NO: 7971296 - DNA, 22 bp, Homo sapiens
caagacaatgggtaagtgtaac

SEQ ID NO: 7971297 - DNA, 22 bp, Homo sapiens
caagacaatgggtaagtgtaac

SEQ ID NO: 7971298 - DNA, 22 bp, Homo sapiens
caagacaatgggtaagtgtaac

SEQ ID NO: 7971299 - DNA, 22 bp, Homo sapiens
gctgctggccccacatgctcca

SEQ ID NO: 7971300 - DNA, 22 bp, Homo sapiens
gctgctggccccacatgctcca

SEQ ID NO: 7971301 - DNA, 22 bp, Homo sapiens
caagacaagatctaagcatgct

SEQ ID NO: 7971302 - DNA, 22 bp, Homo sapiens
caagacaagatctaagcatgct

SEQ ID NO: 7971303 - DNA, 22 bp, Homo sapiens
gctgctggccccacatgctcca

SEQ ID NO: 7971304 - DNA, 22 bp, Homo sapiens
caagacaagatctaagcatgct

SEQ ID NO: 7971305 - DNA, 22 bp, Homo sapiens
gctgctggccccacatgctcca

SEQ ID NO: 7971306 - DNA, 22 bp, Homo sapiens
gctgctggcatctagggggtgg

SEQ ID NO: 7971307 - DNA, 22 bp, Homo sapiens
gctgctggcatctagggggtgg

SEQ ID NO: 7971308 - DNA, 22 bp, Homo sapiens
gctgctggcatctagggggtgg

SEQ ID NO: 7971309 - DNA, 22 bp, Homo sapiens
gctgctggcactggagtgagcc

SEQ ID NO: 7971310 - DNA, 22 bp, Homo sapiens
gctgctggccccacatgctcca

SEQ ID NO: 7971311 - DNA, 22 bp, Homo sapiens
gctgctggcatctagggggtgg

SEQ ID NO: 7971312 - DNA, 22 bp, Homo sapiens
gctgctggccccacatgctcca

SEQ ID NO: 7971313 - DNA, 22 bp, Homo sapiens
gctgctggccccacatgctcca

SEQ ID NO: 7971314 - DNA, 22 bp, Homo sapiens
gctgctggccccacatgctcca

SEQ ID NO: 7971315 - DNA, 22 bp, Homo sapiens
gctgctggccccacatgctcca

SEQ ID NO: 7971316 - DNA, 22 bp, Homo sapiens
gctgctggcatctagggggtgg

SEQ ID NO: 7971317 - DNA, 22 bp, Homo sapiens
gctgctggcactggagtgagcc

SEQ ID NO: 7971318 - DNA, 22 bp, Homo sapiens
gctgctggcactggagtgagcc

SEQ ID NO: 7971319 - DNA, 22 bp, Homo sapiens
gctgctggcactggagtgagcc

SEQ ID NO: 7971320 - DNA, 22 bp, Homo sapiens
gctgctggcactggagtgagcc

SEQ ID NO: 7971321 - DNA, 22 bp, Homo sapiens
gctgctggcactggagtgagcc

SEQ ID NO: 7971322 - DNA, 22 bp, Homo sapiens
gctgctggcactggagtgagcc

SEQ ID NO: 7971323 - DNA, 22 bp, Homo sapiens
gctgctggcactggagtgagcc

SEQ ID NO: 7971324 - DNA, 22 bp, Homo sapiens
gctgctggcactggagtgagcc

SEQ ID NO: 7971325 - DNA, 22 bp, Homo sapiens
gctgctggatgcgcttgatggt

SEQ ID NO: 7971326 - DNA, 22 bp, Homo sapiens
gctgctggatgcgcttgatggt

SEQ ID NO: 7971327 - DNA, 22 bp, Homo sapiens
gctgctggatgcgcttgatggt

SEQ ID NO: 7971328 - DNA, 22 bp, Homo sapiens
gctgctggatgcgcttgatggt

SEQ ID NO: 7971329 - DNA, 22 bp, Homo sapiens
gctgctggatgcgcttgatggt

SEQ ID NO: 7971330 - DNA, 22 bp, Homo sapiens
gctgctggatgcgcttgatggt

SEQ ID NO: 7971331 - DNA, 22 bp, Homo sapiens
gctgctggagctttgcagaagg

SEQ ID NO: 7971332 - DNA, 22 bp, Homo sapiens
gctgctggagctttgcagaagg

SEQ ID NO: 7971333 - DNA, 22 bp, Homo sapiens
gctgctggatgcgcttgatggt

SEQ ID NO: 7971334 - DNA, 22 bp, Homo sapiens
gctgctggagagcgagactgtt

SEQ ID NO: 7971335 - DNA, 22 bp, Homo sapiens
gctgctggagagcgagactgtt

SEQ ID NO: 7971336 - DNA, 22 bp, Homo sapiens
gctgctggagagcgagactgtt

SEQ ID NO: 7971337 - DNA, 22 bp, Homo sapiens
gctgctggagagcgagactgtt

SEQ ID NO: 7971338 - DNA, 22 bp, Homo sapiens
gctgctggagagcgagactgtt

SEQ ID NO: 7971339 - DNA, 22 bp, Homo sapiens
gctgctggagctttgcagaagg

SEQ ID NO: 7971340 - DNA, 22 bp, Homo sapiens
gctgctggagctttgcagaagg

SEQ ID NO: 7971341 - DNA, 22 bp, Homo sapiens
gctgctggagctttgcagaagg

SEQ ID NO: 7971342 - DNA, 22 bp, Homo sapiens
gctgctggagctttgcagaagg

SEQ ID NO: 7971343 - DNA, 22 bp, Homo sapiens
gctgctggagctttgcagaagg

SEQ ID NO: 7971344 - DNA, 22 bp, Homo sapiens
gctgctggagctttgcagaagg

SEQ ID NO: 7971345 - DNA, 22 bp, Homo sapiens
gctgctggagctttgcagaagg

SEQ ID NO: 7971346 - DNA, 22 bp, Homo sapiens
gctgccttttaaagcctcgctt

SEQ ID NO: 7971347 - DNA, 22 bp, Homo sapiens
gctgcctttgtgagccaagggg

SEQ ID NO: 7971348 - DNA, 22 bp, Homo sapiens
gctgccttttaaagcctcgctt

SEQ ID NO: 7971349 - DNA, 22 bp, Homo sapiens
gctgccttttaaagcctcgctt

SEQ ID NO: 7971350 - DNA, 22 bp, Homo sapiens
gctgctggagagcgagactgtt

SEQ ID NO: 7971351 - DNA, 22 bp, Homo sapiens
gctgctggagagcgagactgtt

SEQ ID NO: 7971352 - DNA, 22 bp, Homo sapiens
caactacaggaaaagtcattca

SEQ ID NO: 7971353 - DNA, 22 bp, Homo sapiens
caactaatcctttgaaaagaag

SEQ ID NO: 7971354 - DNA, 22 bp, Homo sapiens
caacctgatgtgcatgccacgg

SEQ ID NO: 7971355 - DNA, 22 bp, Homo sapiens
caacctgatgtgcatgccacgg

SEQ ID NO: 7971356 - DNA, 22 bp, Homo sapiens
caacctggccctagccctggga

SEQ ID NO: 7971357 - DNA, 22 bp, Homo sapiens
gctgcctgccttgcctggagga

SEQ ID NO: 7971358 - DNA, 22 bp, Homo sapiens
gctgcctgccttgcctggagga

SEQ ID NO: 7971359 - DNA, 22 bp, Homo sapiens
gctgccttccataatgtacgta

SEQ ID NO: 7971360 - DNA, 22 bp, Homo sapiens
gctgccttccaaagagttttat

SEQ ID NO: 7971361 - DNA, 22 bp, Homo sapiens
caacctgatgaattgaatttaa

SEQ ID NO: 7971362 - DNA, 22 bp, Homo sapiens
caacctgatgaattgaatttaa

SEQ ID NO: 7971363 - DNA, 21 bp, Homo sapiens
caacctgagctgaacccgtgc

SEQ ID NO: 7971364 - DNA, 21 bp, Homo sapiens
caacctgagctgaacccgtgc

SEQ ID NO: 7971365 - DNA, 22 bp, Homo sapiens
caacctgagactccaggcacct

SEQ ID NO: 7971366 - DNA, 22 bp, Homo sapiens
caacctgagactccaggcacct

SEQ ID NO: 7971367 - DNA, 22 bp, Homo sapiens
caacctgacaaggttaatgaat

SEQ ID NO: 7971368 - DNA, 22 bp, Homo sapiens
caacctgacaaggttaatgaat

SEQ ID NO: 7971369 - DNA, 22 bp, Homo sapiens
caacctgacaagactatgagta

SEQ ID NO: 7971370 - DNA, 22 bp, Homo sapiens
caacctgacaagactatgagta

SEQ ID NO: 7971371 - DNA, 22 bp, Homo sapiens
caacctgaattctgctttggca

SEQ ID NO: 7971372 - DNA, 22 bp, Homo sapiens
caacctgaattctgctttggca

SEQ ID NO: 7971373 - DNA, 22 bp, Homo sapiens
caacctcatagaaagaaaatgt

SEQ ID NO: 7971374 - DNA, 22 bp, Homo sapiens
caacctcatagaaagaaaatgt

SEQ ID NO: 7971375 - DNA, 22 bp, Homo sapiens
caacctctatcggtcaggaagc

SEQ ID NO: 7971376 - DNA, 22 bp, Homo sapiens
gctgccttgaacttggcctggg

SEQ ID NO: 7971377 - DNA, 22 bp, Homo sapiens
gctgccttgaacttggcctggg

SEQ ID NO: 7971378 - DNA, 22 bp, Homo sapiens
gctgccttgaacatcctaagta

SEQ ID NO: 7971379 - DNA, 22 bp, Homo sapiens
gctgccttgaacatcctaagta

SEQ ID NO: 7971380 - DNA, 22 bp, Homo sapiens
gctgccttgaacatcctaagta

SEQ ID NO: 7971381 - DNA, 22 bp, Homo sapiens
gctgccttcttctgactctatt

SEQ ID NO: 7971382 - DNA, 22 bp, Homo sapiens
gctgccttctgagaagttaaat

SEQ ID NO: 7971383 - DNA, 22 bp, Homo sapiens
gctgccttctggaggaagtgaa

SEQ ID NO: 7971384 - DNA, 18 bp, Homo sapiens
gctgccttcccagtcaag

SEQ ID NO: 7971385 - DNA, 22 bp, Homo sapiens
gctgccttcccaggcctttgct

SEQ ID NO: 7971386 - DNA, 22 bp, Homo sapiens
gctgccttcccaggcctttgct

SEQ ID NO: 7971387 - DNA, 22 bp, Homo sapiens
gctgccttccctgttctttcag

SEQ ID NO: 7971388 - DNA, 22 bp, Homo sapiens
gctgccttccctgttctttcag

SEQ ID NO: 7971389 - DNA, 22 bp, Homo sapiens
gctgccttcccggaatgtcatc

SEQ ID NO: 7971390 - DNA, 22 bp, Homo sapiens
gctgccttggtagtgaccatct

SEQ ID NO: 7971391 - DNA, 20 bp, Homo sapiens
gctgccttgtcctgcttggt

SEQ ID NO: 7971392 - DNA, 20 bp, Homo sapiens
gctgccttgtcctgcttggt

SEQ ID NO: 7971393 - DNA, 22 bp, Homo sapiens
gctgcctttagggggtgctcag

SEQ ID NO: 7971394 - DNA, 22 bp, Homo sapiens
gctgcctttagggggtgctcag

SEQ ID NO: 7971395 - DNA, 22 bp, Homo sapiens
gctgccttgcttactccactgc

SEQ ID NO: 7971396 - DNA, 20 bp, Homo sapiens
gctgccttggatggctacac

SEQ ID NO: 7971397 - DNA, 22 bp, Homo sapiens
gctgccttgccctcttcccata

SEQ ID NO: 7971398 - DNA, 22 bp, Homo sapiens
gctgccttgccaggggcagaaa

SEQ ID NO: 7971399 - DNA, 22 bp, Homo sapiens
gctgccttgaacttggcctggg

SEQ ID NO: 7971400 - DNA, 22 bp, Homo sapiens
gctgccttgaacttggcctggg

SEQ ID NO: 7971401 - DNA, 22 bp, Homo sapiens
gtatttctagaaaatgcagatt

SEQ ID NO: 7971402 - DNA, 22 bp, Homo sapiens
gtatttctagaaaatgcagatt

SEQ ID NO: 7971403 - DNA, 22 bp, Homo sapiens
gtatttctagaaccaaaagcca

SEQ ID NO: 7971404 - DNA, 22 bp, Homo sapiens
gtatttctagaaccaaaagcca

SEQ ID NO: 7971405 - DNA, 22 bp, Homo sapiens
cagcaggcggcccgcgggcccg

SEQ ID NO: 7971406 - DNA, 22 bp, Homo sapiens
cagcaggcggcccgcgggcccg

SEQ ID NO: 7971407 - DNA, 22 bp, Homo sapiens
cagcaggcggcccgcgggcccg

SEQ ID NO: 7971408 - DNA, 22 bp, Homo sapiens
cagcaggcggcccgcgggcccg

SEQ ID NO: 7971409 - DNA, 22 bp, Homo sapiens
cagcaggcccaggtgctggtga

SEQ ID NO: 7971410 - DNA, 22 bp, Homo sapiens
cagcaggcccaggtgctggtga

SEQ ID NO: 7971411 - DNA, 22 bp, Homo sapiens
cagcaggcccaggtgctggtga

SEQ ID NO: 7971412 - DNA, 22 bp, Homo sapiens
cagcaggcccaggtgctggtga

SEQ ID NO: 7971413 - DNA, 22 bp, Homo sapiens
cagcaggcccaggtgctggtga

SEQ ID NO: 7971414 - DNA, 22 bp, Homo sapiens
cagcaggcccaggtgctggtga

SEQ ID NO: 7971415 - DNA, 22 bp, Homo sapiens
cagcaggcccaggtgctggtga

SEQ ID NO: 7971416 - DNA, 22 bp, Homo sapiens
cagcaggcccaggtgctggtga

SEQ ID NO: 7971417 - DNA, 22 bp, Homo sapiens
cagcaggcccagagtttcatgg

SEQ ID NO: 7971418 - DNA, 22 bp, Homo sapiens
gtatttctttccattatagtca

SEQ ID NO: 7971419 - DNA, 22 bp, Homo sapiens
gtatttcttggaaatcctttta

SEQ ID NO: 7971420 - DNA, 22 bp, Homo sapiens
gtatttcttggaaatcctttta

SEQ ID NO: 7971421 - DNA, 22 bp, Homo sapiens
gtatttctggttaaatgtgcta

SEQ ID NO: 7971422 - DNA, 22 bp, Homo sapiens
gtatttctagtttcttccacag

SEQ ID NO: 7971423 - DNA, 22 bp, Homo sapiens
gtatttctggttaaatgtgcta

SEQ ID NO: 7971424 - DNA, 22 bp, Homo sapiens
gtatttcttggaaatcctttta

SEQ ID NO: 7971425 - DNA, 22 bp, Homo sapiens
cagcaggatttgaaaggaagag

SEQ ID NO: 7971426 - DNA, 22 bp, Homo sapiens
cagcaggatttgaaaggaagag

SEQ ID NO: 7971427 - DNA, 22 bp, Homo sapiens
cagcaggatttgaaaggaagag

SEQ ID NO: 7971428 - DNA, 22 bp, Homo sapiens
cagcaggattggatacatctca

SEQ ID NO: 7971429 - DNA, 22 bp, Homo sapiens
cagcaggatttgaaaggaagag

SEQ ID NO: 7971430 - DNA, 22 bp, Homo sapiens
cagcaggatatggtggagagag

SEQ ID NO: 7971431 - DNA, 22 bp, Homo sapiens
cagcaggattggatacatctca

SEQ ID NO: 7971432 - DNA, 22 bp, Homo sapiens
cagcaggcagccatttcactgt

SEQ ID NO: 7971433 - DNA, 22 bp, Homo sapiens
cagcaggcagccatttcactgt

SEQ ID NO: 7971434 - DNA, 22 bp, Homo sapiens
cagcaggcaagaggttttatca

SEQ ID NO: 7971435 - DNA, 22 bp, Homo sapiens
cagcaggatttgaaaggaagag

SEQ ID NO: 7971436 - DNA, 22 bp, Homo sapiens
cagcaggccatgctgcttttca

SEQ ID NO: 7971437 - DNA, 22 bp, Homo sapiens
cagcaggccatgctgcttttca

SEQ ID NO: 7971438 - DNA, 22 bp, Homo sapiens
cagcaggccatgctgcttttca

SEQ ID NO: 7971439 - DNA, 22 bp, Homo sapiens
cagcaggcaggtgggccaagtc

SEQ ID NO: 7971440 - DNA, 22 bp, Homo sapiens
cagcaggcaggtgggccaagtc

SEQ ID NO: 7971441 - DNA, 22 bp, Homo sapiens
cagcaggcaggtgggccaagtc

SEQ ID NO: 7971442 - DNA, 22 bp, Homo sapiens
cagcaggcaggtgggccaagtc

SEQ ID NO: 7971443 - DNA, 22 bp, Homo sapiens
cagcaggcaggtgggccaagtc

SEQ ID NO: 7971444 - DNA, 22 bp, Homo sapiens
cagcaggcagccatttcactgt

SEQ ID NO: 7971445 - DNA, 22 bp, Homo sapiens
gtatgagaatcagacacatatt

SEQ ID NO: 7971446 - DNA, 20 bp, Homo sapiens
gtatgacatgcgaaatgcat

SEQ ID NO: 7971447 - DNA, 22 bp, Homo sapiens
gtatgaaggcgagagcccacta

SEQ ID NO: 7971448 - DNA, 22 bp, Homo sapiens
gtatgaaagcatcattcctgct

SEQ ID NO: 7971449 - DNA, 22 bp, Homo sapiens
gtatctttgtcttcatgttgga

SEQ ID NO: 7971450 - DNA, 22 bp, Homo sapiens
gtatcttttacaccaggaaatt

SEQ ID NO: 7971451 - DNA, 22 bp, Homo sapiens
gtatctttgtcttcatgttgga

SEQ ID NO: 7971452 - DNA, 22 bp, Homo sapiens
gtatctttgtcttcatgttgga

SEQ ID NO: 7971453 - DNA, 22 bp, Homo sapiens
gtatgaaaattgtaaagttctt

SEQ ID NO: 7971454 - DNA, 22 bp, Homo sapiens
gtatcttttggtggaaaaataa

SEQ ID NO: 7971455 - DNA, 21 bp, Homo sapiens
gtatgctgggggttagggctt

SEQ ID NO: 7971456 - DNA, 22 bp, Homo sapiens
cagcagcctccactcgccccac

SEQ ID NO: 7971457 - DNA, 22 bp, Homo sapiens
cagcagcctccactcgccccac

SEQ ID NO: 7971458 - DNA, 22 bp, Homo sapiens
cagcagcctagggttccatcat

SEQ ID NO: 7971459 - DNA, 22 bp, Homo sapiens
cagcagcctcaagtttattttc

SEQ ID NO: 7971460 - DNA, 22 bp, Homo sapiens
cagcagcctcttgtgcctgtgg

SEQ ID NO: 7971461 - DNA, 22 bp, Homo sapiens
cagcagcctgccttgggagctt

SEQ ID NO: 7971462 - DNA, 22 bp, Homo sapiens
cagcagcctgccttgggagctt

SEQ ID NO: 7971463 - DNA, 22 bp, Homo sapiens
cagcagcctgccttgggagctt

SEQ ID NO: 7971464 - DNA, 22 bp, Homo sapiens
cagcagcctgccttgggagctt

SEQ ID NO: 7971465 - DNA, 22 bp, Homo sapiens
cagcagcctgccttgggagctt

SEQ ID NO: 7971466 - DNA, 22 bp, Homo sapiens
gtatgctgcctacgaacatgca

SEQ ID NO: 7971467 - DNA, 22 bp, Homo sapiens
cagcagcctcttgtgcctgtgg

SEQ ID NO: 7971468 - DNA, 22 bp, Homo sapiens
cagcagcctcttgtgcctgtgg

SEQ ID NO: 7971469 - DNA, 22 bp, Homo sapiens
cagcagcctcttgtgcctgtgg

SEQ ID NO: 7971470 - DNA, 22 bp, Homo sapiens
cagcagcctcttgtgcctgtgg

SEQ ID NO: 7971471 - DNA, 22 bp, Homo sapiens
cagcagcctccactcgccccac

SEQ ID NO: 7971472 - DNA, 22 bp, Homo sapiens
cagcagcctcttgtgcctgtgg

SEQ ID NO: 7971473 - DNA, 22 bp, Homo sapiens
cagcagcctggcccctcctcgg

SEQ ID NO: 7971474 - DNA, 22 bp, Homo sapiens
cagcagcctggcccctcctcgg

SEQ ID NO: 7971475 - DNA, 22 bp, Homo sapiens
cagcagcctggcccctcctcgg

SEQ ID NO: 7971476 - DNA, 22 bp, Homo sapiens
cagcagcctggcccctcctcgg

SEQ ID NO: 7971477 - DNA, 22 bp, Homo sapiens
cagcagctaaggcatgttcctg

SEQ ID NO: 7971478 - DNA, 22 bp, Homo sapiens
cagcagctaaggcatgttcctg

SEQ ID NO: 7971479 - DNA, 22 bp, Homo sapiens
cagcagcgcacactggtatgga

SEQ ID NO: 7971480 - DNA, 22 bp, Homo sapiens
cagcagctaaggcatgttcctg

SEQ ID NO: 7971481 - DNA, 22 bp, Homo sapiens
cagcagcctgccttgggagctt

SEQ ID NO: 7971482 - DNA, 22 bp, Homo sapiens
cagcagcctggagggggccacg

SEQ ID NO: 7971483 - DNA, 22 bp, Homo sapiens
cagcagcctgccttgggagctt

SEQ ID NO: 7971484 - DNA, 22 bp, Homo sapiens
cagcagcctgccttgggagctt

SEQ ID NO: 7971485 - DNA, 22 bp, Homo sapiens
cagcagcctggagggggccacg

SEQ ID NO: 7971486 - DNA, 22 bp, Homo sapiens
cagcagcctgccttgggagctt

SEQ ID NO: 7971487 - DNA, 22 bp, Homo sapiens
cagcagcctggagggggccacg

SEQ ID NO: 7971488 - DNA, 22 bp, Homo sapiens
cagcagcctggagggggccacg

SEQ ID NO: 7971489 - DNA, 22 bp, Homo sapiens
cagcagctacctgctcttgtgg

SEQ ID NO: 7971490 - DNA, 22 bp, Homo sapiens
cagcagctacctgctcttgtgg

SEQ ID NO: 7971491 - DNA, 22 bp, Homo sapiens
cagcagctacctgctcttgtgg

SEQ ID NO: 7971492 - DNA, 22 bp, Homo sapiens
cagcagctacctgctcttgtgg

SEQ ID NO: 7971493 - DNA, 22 bp, Homo sapiens
cagcagctacttggagcagcag

SEQ ID NO: 7971494 - DNA, 22 bp, Homo sapiens
cagcagctacttggagcagcag

SEQ ID NO: 7971495 - DNA, 22 bp, Homo sapiens
cagcagctacctgctcttgtgg

SEQ ID NO: 7971496 - DNA, 22 bp, Homo sapiens
cagcagctacttggagcagcag

SEQ ID NO: 7971497 - DNA, 22 bp, Homo sapiens
cagcagctacttggagcagcag

SEQ ID NO: 7971498 - DNA, 22 bp, Homo sapiens
cagcaggaccattgaggcatca

SEQ ID NO: 7971499 - DNA, 22 bp, Homo sapiens
cagcaggaccattgaggcatca

SEQ ID NO: 7971500 - DNA, 22 bp, Homo sapiens
cagcaggaccattgaggcatca

SEQ ID NO: 7971501 - DNA, 22 bp, Homo sapiens
cagcaggaccattgaggcatca

SEQ ID NO: 7971502 - DNA, 22 bp, Homo sapiens
cagcaggacatggaggagtaaa

SEQ ID NO: 7971503 - DNA, 22 bp, Homo sapiens
cagcaggacatggaggagtaaa

SEQ ID NO: 7971504 - DNA, 22 bp, Homo sapiens
cagcaggacatggaggagtaaa

SEQ ID NO: 7971505 - DNA, 22 bp, Homo sapiens
cagcagagctgtgtgggaaggg

SEQ ID NO: 7971506 - DNA, 22 bp, Homo sapiens
cagcagagcttatgttgggtca

SEQ ID NO: 7971507 - DNA, 21 bp, Homo sapiens
cagcagagtaatgcattcgta

SEQ ID NO: 7971508 - DNA, 21 bp, Homo sapiens
cagcagagtaatgcattcgta

SEQ ID NO: 7971509 - DNA, 21 bp, Homo sapiens
cagcagagtaatgcattcgta

SEQ ID NO: 7971510 - DNA, 22 bp, Homo sapiens
cagcagagtaattctcacctct

SEQ ID NO: 7971511 - DNA, 22 bp, Homo sapiens
cagcagagtaattctcacctct

SEQ ID NO: 7971512 - DNA, 22 bp, Homo sapiens
cagcagagtaattctcacctct

SEQ ID NO: 7971513 - DNA, 22 bp, Homo sapiens
cagcagagtaattctcacctct

SEQ ID NO: 7971514 - DNA, 22 bp, Homo sapiens
cagcagagtatggcactcaact

SEQ ID NO: 7971515 - DNA, 22 bp, Homo sapiens
cagcagagtatggcactcaact

SEQ ID NO: 7971516 - DNA, 22 bp, Homo sapiens
cagcagagtaggtgctacttct

SEQ ID NO: 7971517 - DNA, 22 bp, Homo sapiens
cagcagagtaggtgctacttct

SEQ ID NO: 7971518 - DNA, 22 bp, Homo sapiens
cagcagagtaggtgctacttct

SEQ ID NO: 7971519 - DNA, 22 bp, Homo sapiens
cagcagagtaggtgctacttct

SEQ ID NO: 7971520 - DNA, 22 bp, Homo sapiens
cagcagagtttggcttctaatg

SEQ ID NO: 7971521 - DNA, 22 bp, Homo sapiens
cagcagagtttggcttctaatg

SEQ ID NO: 7971522 - DNA, 22 bp, Homo sapiens
cagcagagtatggcactcaact

SEQ ID NO: 7971523 - DNA, 22 bp, Homo sapiens
cagcagagtatggcactcaact

SEQ ID NO: 7971524 - DNA, 22 bp, Homo sapiens
cagcagcaacaacggaagcctt

SEQ ID NO: 7971525 - DNA, 22 bp, Homo sapiens
cagcagcaacaacggaagcctt

SEQ ID NO: 7971526 - DNA, 22 bp, Homo sapiens
cagcagcaacaacggaagcctt

SEQ ID NO: 7971527 - DNA, 22 bp, Homo sapiens
cagcagcaacaacggaagcctt

SEQ ID NO: 7971528 - DNA, 22 bp, Homo sapiens
cagcagcaacaacggaagcctt

SEQ ID NO: 7971529 - DNA, 22 bp, Homo sapiens
cagcagcaacaatagcggtcac

SEQ ID NO: 7971530 - DNA, 22 bp, Homo sapiens
cagcagcaacaatagcggtcac

SEQ ID NO: 7971531 - DNA, 22 bp, Homo sapiens
cagcagcaaggtgagggtggag

SEQ ID NO: 7971532 - DNA, 22 bp, Homo sapiens
cagcagcaacaatagcggtcac

SEQ ID NO: 7971533 - DNA, 22 bp, Homo sapiens
cagcagcaacaatagcggtcac

SEQ ID NO: 7971534 - DNA, 22 bp, Homo sapiens
cagcagatcaatgtagaatatt

SEQ ID NO: 7971535 - DNA, 22 bp, Homo sapiens
cagcagatttgggaaacactgt

SEQ ID NO: 7971536 - DNA, 22 bp, Homo sapiens
cagcagatgccaagttgtagtc

SEQ ID NO: 7971537 - DNA, 22 bp, Homo sapiens
cagcagcaaatctagaagagga

SEQ ID NO: 7971538 - DNA, 22 bp, Homo sapiens
cagcagatcaatgtagaatatt

SEQ ID NO: 7971539 - DNA, 22 bp, Homo sapiens
cagcagcaaatctagaagagga

SEQ ID NO: 7971540 - DNA, 22 bp, Homo sapiens
cagcagcaaatctagaagagga

SEQ ID NO: 7971541 - DNA, 22 bp, Homo sapiens
cagcagcaaatctagaagagga

SEQ ID NO: 7971542 - DNA, 22 bp, Homo sapiens
cagcagcaacaacggaagcctt

SEQ ID NO: 7971543 - DNA, 22 bp, Homo sapiens
cagcagcaacaacggaagcctt

SEQ ID NO: 7971544 - DNA, 19 bp, Homo sapiens
gtatatttatatggctgta

SEQ ID NO: 7971545 - DNA, 22 bp, Homo sapiens
gtatatgtgtgggcctgcatat

SEQ ID NO: 7971546 - DNA, 22 bp, Homo sapiens
gtatatgtgtgcaagtgcatgg

SEQ ID NO: 7971547 - DNA, 22 bp, Homo sapiens
gtatatgtatgcgtatacacac

SEQ ID NO: 7971548 - DNA, 22 bp, Homo sapiens
gtatcacttttgagagtgagaa

SEQ ID NO: 7971549 - DNA, 22 bp, Homo sapiens
gtatcacttttgagagtgagaa

SEQ ID NO: 7971550 - DNA, 22 bp, Homo sapiens
gtatcacttttgagagtgagaa

SEQ ID NO: 7971551 - DNA, 22 bp, Homo sapiens
gtatcacttttgagagtgagaa

SEQ ID NO: 7971552 - DNA, 21 bp, Homo sapiens
gtatcacatttgcatgcttat

SEQ ID NO: 7971553 - DNA, 22 bp, Homo sapiens
gtatcacactagaatgcattca

SEQ ID NO: 7971554 - DNA, 21 bp, Homo sapiens
gtatcacatttgcatgcttat

SEQ ID NO: 7971555 - DNA, 22 bp, Homo sapiens
gtatattttgatcaccctctat

SEQ ID NO: 7971556 - DNA, 22 bp, Homo sapiens
gtatcacactagaatgcattca

SEQ ID NO: 7971557 - DNA, 22 bp, Homo sapiens
gtatctatgatcctttatatct

SEQ ID NO: 7971558 - DNA, 22 bp, Homo sapiens
gtatcctaggagcttccttagg

SEQ ID NO: 7971559 - DNA, 22 bp, Homo sapiens
gtatctgtagctagagggagag

SEQ ID NO: 7971560 - DNA, 22 bp, Homo sapiens
gtatctgtagctagagggagag

SEQ ID NO: 7971561 - DNA, 22 bp, Homo sapiens
gtatctgtggattttggtatcc

SEQ ID NO: 7971562 - DNA, 22 bp, Homo sapiens
gtatctgtatgtgttttttcct

SEQ ID NO: 7971563 - DNA, 22 bp, Homo sapiens
gtatctgtagctagagggagag

SEQ ID NO: 7971564 - DNA, 22 bp, Homo sapiens
gtatctgtggattttggtatcc

SEQ ID NO: 7971565 - DNA, 22 bp, Homo sapiens
gtatctttatccctcgttggag

SEQ ID NO: 7971566 - DNA, 22 bp, Homo sapiens
gtatctttcaccagctcccagg

SEQ ID NO: 7971567 - DNA, 22 bp, Homo sapiens
gtatctttccacatcttcagta

SEQ ID NO: 7971568 - DNA, 20 bp, Homo sapiens
gtatccccgcgtggggaagg

SEQ ID NO: 7971569 - DNA, 22 bp, Homo sapiens
gtatccatgggggattggttcc

SEQ ID NO: 7971570 - DNA, 22 bp, Homo sapiens
gtatccatgggggattggttcc

SEQ ID NO: 7971571 - DNA, 22 bp, Homo sapiens
gtatccatgggggattggttcc

SEQ ID NO: 7971572 - DNA, 22 bp, Homo sapiens
gtatcatatgcatcaggcttgc

SEQ ID NO: 7971573 - DNA, 22 bp, Homo sapiens
cagcagcagagatactggtttc

SEQ ID NO: 7971574 - DNA, 22 bp, Homo sapiens
cagcagcagacatttgatcttc

SEQ ID NO: 7971575 - DNA, 22 bp, Homo sapiens
cagcagcagacatttgatcttc

SEQ ID NO: 7971576 - DNA, 22 bp, Homo sapiens
cagcagcagacatttgatcttc

SEQ ID NO: 7971577 - DNA, 22 bp, Homo sapiens
cagcagcagagatactggtttc

SEQ ID NO: 7971578 - DNA, 22 bp, Homo sapiens
cagcagcagagatactggtttc

SEQ ID NO: 7971579 - DNA, 22 bp, Homo sapiens
cagcagcagattcagcgtctgg

SEQ ID NO: 7971580 - DNA, 22 bp, Homo sapiens
gtagggattcttctcactgagc

SEQ ID NO: 7971581 - DNA, 22 bp, Homo sapiens
gtagggataggtgtccagagac

SEQ ID NO: 7971582 - DNA, 22 bp, Homo sapiens
cagcagcaaggtgagggtggag

SEQ ID NO: 7971583 - DNA, 22 bp, Homo sapiens
cagcagcaaggtgagggtggag

SEQ ID NO: 7971584 - DNA, 22 bp, Homo sapiens
cagcagcaaggtgagggtggag

SEQ ID NO: 7971585 - DNA, 22 bp, Homo sapiens
cagcagcacctattatagtgtt

SEQ ID NO: 7971586 - DNA, 22 bp, Homo sapiens
cagcagcacctattatagtgtt

SEQ ID NO: 7971587 - DNA, 22 bp, Homo sapiens
cagcagcaaggtgagggtggag

SEQ ID NO: 7971588 - DNA, 22 bp, Homo sapiens
cagcagcaaggtgagggtggag

SEQ ID NO: 7971589 - DNA, 22 bp, Homo sapiens
cagcagcaaggtgagggtggag

SEQ ID NO: 7971590 - DNA, 22 bp, Homo sapiens
cagcagcactctgcgggtcccc

SEQ ID NO: 7971591 - DNA, 22 bp, Homo sapiens
cagcagcacctattatagtgtt

SEQ ID NO: 7971592 - DNA, 22 bp, Homo sapiens
cagcagcactctgcgggtcccc

SEQ ID NO: 7971593 - DNA, 22 bp, Homo sapiens
cagcagcagacatttgatcttc

SEQ ID NO: 7971594 - DNA, 22 bp, Homo sapiens
cagcagcagacatttgatcttc

SEQ ID NO: 7971595 - DNA, 22 bp, Homo sapiens
cagcagcactctgcgggtcccc

SEQ ID NO: 7971596 - DNA, 22 bp, Homo sapiens
cagcagcactctgcgggtcccc

SEQ ID NO: 7971597 - DNA, 22 bp, Homo sapiens
ggttcccggatctccgagtccc

SEQ ID NO: 7971598 - DNA, 19 bp, Homo sapiens
ggttcctcacgctaagggc

SEQ ID NO: 7971599 - DNA, 22 bp, Homo sapiens
ggttcccggatctccgagtccc

SEQ ID NO: 7971600 - DNA, 21 bp, Homo sapiens
ggttcccttgatcattgctaa

SEQ ID NO: 7971601 - DNA, 21 bp, Homo sapiens
ggttcccttgatcattgctaa

SEQ ID NO: 7971602 - DNA, 19 bp, Homo sapiens
ggttcctcacgctaagggc

SEQ ID NO: 7971603 - DNA, 22 bp, Homo sapiens
ggttccagagtgggctgggaaa

SEQ ID NO: 7971604 - DNA, 22 bp, Homo sapiens
ggttccaggcatggcaggatgt

SEQ ID NO: 7971605 - DNA, 22 bp, Homo sapiens
ggttccagagtatttcatttca

SEQ ID NO: 7971606 - DNA, 22 bp, Homo sapiens
ggttccagagtatttcatttca

SEQ ID NO: 7971607 - DNA, 22 bp, Homo sapiens
ggttccaggcatggcaggatgt

SEQ ID NO: 7971608 - DNA, 22 bp, Homo sapiens
ggttccccaggcggcccttgga

SEQ ID NO: 7971609 - DNA, 22 bp, Homo sapiens
ggttccccaggcggcccttgga

SEQ ID NO: 7971610 - DNA, 22 bp, Homo sapiens
ggttcccggatctccgagtccc

SEQ ID NO: 7971611 - DNA, 22 bp, Homo sapiens
ggttctcttcctcctgactgag

SEQ ID NO: 7971612 - DNA, 22 bp, Homo sapiens
ggttctgagaaactctcaccat

SEQ ID NO: 7971613 - DNA, 23 bp, Homo sapiens
ggttctgccgcttactgctgtgc

SEQ ID NO: 7971614 - DNA, 23 bp, Homo sapiens
ggttctgccgcttactgctgtgc

SEQ ID NO: 7971615 - DNA, 22 bp, Homo sapiens
ggttctaggattaggaggccca

SEQ ID NO: 7971616 - DNA, 22 bp, Homo sapiens
ggttctaggtctggggataatg

SEQ ID NO: 7971617 - DNA, 22 bp, Homo sapiens
ggttctctaactttgactggag

SEQ ID NO: 7971618 - DNA, 22 bp, Homo sapiens
ggttcctgtgcctctagctggc

SEQ ID NO: 7971619 - DNA, 22 bp, Homo sapiens
ggttccttctgaggtccctgta

SEQ ID NO: 7971620 - DNA, 22 bp, Homo sapiens
ggttccttcctgccttagccac

SEQ ID NO: 7971621 - DNA, 22 bp, Homo sapiens
ggttccttctgaggtccctgta

SEQ ID NO: 7971622 - DNA, 22 bp, Homo sapiens
cagcaagtcatccaggatgatg

SEQ ID NO: 7971623 - DNA, 22 bp, Homo sapiens
cagcaagtcagtgagtagaaga

SEQ ID NO: 7971624 - DNA, 22 bp, Homo sapiens
cagcaagtcagtgagtagaaga

SEQ ID NO: 7971625 - DNA, 22 bp, Homo sapiens
cagcaagtcagtgagtagaaga

SEQ ID NO: 7971626 - DNA, 22 bp, Homo sapiens
cagcaagggttatatcaaagat

SEQ ID NO: 7971627 - DNA, 23 bp, Homo sapiens
cagcaagtgaattccaagagaga

SEQ ID NO: 7971628 - DNA, 23 bp, Homo sapiens
cagcaagtgaattccaagagaga

SEQ ID NO: 7971629 - DNA, 23 bp, Homo sapiens
cagcaagtgaattccaagagaga

SEQ ID NO: 7971630 - DNA, 22 bp, Homo sapiens
cagcaagtgatggaaatcagag

SEQ ID NO: 7971631 - DNA, 22 bp, Homo sapiens
cagcaataactcaaagccattt

SEQ ID NO: 7971632 - DNA, 22 bp, Homo sapiens
cagcaataatgtctacaaatct

SEQ ID NO: 7971633 - DNA, 22 bp, Homo sapiens
cagcaataaggtaagcttctcc

SEQ ID NO: 7971634 - DNA, 22 bp, Homo sapiens
cagcaataactcaaagccattt

SEQ ID NO: 7971635 - DNA, 22 bp, Homo sapiens
cagcaataactcaaagccattt

SEQ ID NO: 7971636 - DNA, 22 bp, Homo sapiens
cagcacaattttcaggagtcca

SEQ ID NO: 7971637 - DNA, 22 bp, Homo sapiens
ggtgtgcctggggcttagctgc

SEQ ID NO: 7971638 - DNA, 22 bp, Homo sapiens
ggtgtggatcatctgaggtcag

SEQ ID NO: 7971639 - DNA, 22 bp, Homo sapiens
ggttccagaagggggcgaggtg

SEQ ID NO: 7971640 - DNA, 22 bp, Homo sapiens
ggtgtgcttgggcttcgcaggg

SEQ ID NO: 7971641 - DNA, 22 bp, Homo sapiens
ggtgtgctaagagcactttcaa

SEQ ID NO: 7971642 - DNA, 22 bp, Homo sapiens
ggtgtgctaagagcactttcaa

SEQ ID NO: 7971643 - DNA, 22 bp, Homo sapiens
ggtgtgctaagagcactttcaa

SEQ ID NO: 7971644 - DNA, 22 bp, Homo sapiens
ggtgtgcttgggcttcgcaggg

SEQ ID NO: 7971645 - DNA, 22 bp, Homo sapiens
cagcaatctttcttggtcttct

SEQ ID NO: 7971646 - DNA, 22 bp, Homo sapiens
cagcaatcgggtgatatgcaat

SEQ ID NO: 7971647 - DNA, 22 bp, Homo sapiens
cagcaatcgggtgatatgcaat

SEQ ID NO: 7971648 - DNA, 22 bp, Homo sapiens
cagcaatcgggtgatatgcaat

SEQ ID NO: 7971649 - DNA, 22 bp, Homo sapiens
cagcaatccaagctttctttaa

SEQ ID NO: 7971650 - DNA, 22 bp, Homo sapiens
cagcaatggcaggcggagagtg

SEQ ID NO: 7971651 - DNA, 22 bp, Homo sapiens
cagcaatatacacagtctatgg

SEQ ID NO: 7971652 - DNA, 22 bp, Homo sapiens
cagcaatccaagctttctttaa

SEQ ID NO: 7971653 - DNA, 22 bp, Homo sapiens
cagcaatccaagctttctttaa

SEQ ID NO: 7971654 - DNA, 22 bp, Homo sapiens
cagcaatatacacagtctatgg

SEQ ID NO: 7971655 - DNA, 22 bp, Homo sapiens
gtaaaatcatttagttacttaa

SEQ ID NO: 7971656 - DNA, 20 bp, Homo sapiens
gtaaaatatggtctttgggt

SEQ ID NO: 7971657 - DNA, 20 bp, Homo sapiens
gtaaaatatggtctttgggt

SEQ ID NO: 7971658 - DNA, 20 bp, Homo sapiens
gtaaaatatggtctttgggt

SEQ ID NO: 7971659 - DNA, 20 bp, Homo sapiens
gtaaaatatggtctttgggt

SEQ ID NO: 7971660 - DNA, 19 bp, Homo sapiens
ggttggagaagagcggccc

SEQ ID NO: 7971661 - DNA, 19 bp, Homo sapiens
ggttggagaagagcggccc

SEQ ID NO: 7971662 - DNA, 22 bp, Homo sapiens
gtaaaatagaataacgtggcta

SEQ ID NO: 7971663 - DNA, 22 bp, Homo sapiens
ggttgcatttctcagtggaata

SEQ ID NO: 7971664 - DNA, 22 bp, Homo sapiens
ggttgcaaactcctgggatcaa

SEQ ID NO: 7971665 - DNA, 22 bp, Homo sapiens
ggttgcaaactcctgggatcaa

SEQ ID NO: 7971666 - DNA, 22 bp, Homo sapiens
ggttggacactaggtaggagcg

SEQ ID NO: 7971667 - DNA, 22 bp, Homo sapiens
ggttgcaaactcctgggatcaa

SEQ ID NO: 7971668 - DNA, 18 bp, Homo sapiens
ggttgataacttgtgatt

SEQ ID NO: 7971669 - DNA, 22 bp, Homo sapiens
ggttgagacagcagggatgtgt

SEQ ID NO: 7971670 - DNA, 22 bp, Homo sapiens
ggttctgctactctcttgctta

SEQ ID NO: 7971671 - DNA, 22 bp, Homo sapiens
ggttctttggcagtctgattga

SEQ ID NO: 7971672 - DNA, 22 bp, Homo sapiens
ggttctgctactctcttgctta

SEQ ID NO: 7971673 - DNA, 22 bp, Homo sapiens
ggttctttgtatatatcacttt

SEQ ID NO: 7971674 - DNA, 22 bp, Homo sapiens
ggttctttgtatatatcacttt

SEQ ID NO: 7971675 - DNA, 22 bp, Homo sapiens
cagcagagctgtgtgggaaggg

SEQ ID NO: 7971676 - DNA, 22 bp, Homo sapiens
cagcagagctgtgtgggaaggg

SEQ ID NO: 7971677 - DNA, 22 bp, Homo sapiens
gtaaacaggaatgtggtcatgg

SEQ ID NO: 7971678 - DNA, 22 bp, Homo sapiens
gtaaacaggaatgtggtcatgg

SEQ ID NO: 7971679 - DNA, 22 bp, Homo sapiens
gtaaacaggaatgtggtcatgg

SEQ ID NO: 7971680 - DNA, 22 bp, Homo sapiens
gtaaacacctgttaaattcaga

SEQ ID NO: 7971681 - DNA, 22 bp, Homo sapiens
gtaaacaacacaaatcatttga

SEQ ID NO: 7971682 - DNA, 22 bp, Homo sapiens
gtaaacaagtctaccattagaa

SEQ ID NO: 7971683 - DNA, 22 bp, Homo sapiens
gtaaaattgcaattacttttgc

SEQ ID NO: 7971684 - DNA, 22 bp, Homo sapiens
gtaaaattgcaattacttttgc

SEQ ID NO: 7971685 - DNA, 22 bp, Homo sapiens
gtaaaattgcaattacttttgc

SEQ ID NO: 7971686 - DNA, 22 bp, Homo sapiens
gtaaaattctagcatctgaaag

SEQ ID NO: 7971687 - DNA, 22 bp, Homo sapiens
gtaaaattgcaattacttttgc

SEQ ID NO: 7971688 - DNA, 22 bp, Homo sapiens
gtaaaattctagcatctgaaag

SEQ ID NO: 7971689 - DNA, 22 bp, Homo sapiens
gtaaaattctagcatctgaaag

SEQ ID NO: 7971690 - DNA, 22 bp, Homo sapiens
gtaaaattctagcatctgaaag

SEQ ID NO: 7971691 - DNA, 22 bp, Homo sapiens
gtaaaatctttattgctggtga

SEQ ID NO: 7971692 - DNA, 22 bp, Homo sapiens
gtaaaatctttcctatttgcct

SEQ ID NO: 7971693 - DNA, 22 bp, Homo sapiens
cagagtcagagctccatggagt

SEQ ID NO: 7971694 - DNA, 22 bp, Homo sapiens
cagagtcagctagtcttgggat

SEQ ID NO: 7971695 - DNA, 22 bp, Homo sapiens
cagagtcaatgtccaagaagct

SEQ ID NO: 7971696 - DNA, 22 bp, Homo sapiens
cagagtatccctttagaattaa

SEQ ID NO: 7971697 - DNA, 22 bp, Homo sapiens
cagagtcagagcacctgggatt

SEQ ID NO: 7971698 - DNA, 22 bp, Homo sapiens
cagagtcagagctccatggagt

SEQ ID NO: 7971699 - DNA, 20 bp, Homo sapiens
cagagtaattattacccttt

SEQ ID NO: 7971700 - DNA, 22 bp, Homo sapiens
cagagtcaatgtccaagaagct

SEQ ID NO: 7971701 - DNA, 22 bp, Homo sapiens
gggtgggactgaagtctgaggg

SEQ ID NO: 7971702 - DNA, 22 bp, Homo sapiens
gggtgggactgaagtctgaggg

SEQ ID NO: 7971703 - DNA, 22 bp, Homo sapiens
gggtgggagaaatgagtatcta

SEQ ID NO: 7971704 - DNA, 22 bp, Homo sapiens
gggtgggagaaatgagtatcta

SEQ ID NO: 7971705 - DNA, 22 bp, Homo sapiens
gggtgggactgaagtctgaggg

SEQ ID NO: 7971706 - DNA, 22 bp, Homo sapiens
gggtgggagaaatgagtatcta

SEQ ID NO: 7971707 - DNA, 22 bp, Homo sapiens
gggtgggactgaagtctgaggg

SEQ ID NO: 7971708 - DNA, 22 bp, Homo sapiens
gggtgggactgaagtctgaggg

SEQ ID NO: 7971709 - DNA, 22 bp, Homo sapiens
gggtgggactgaagtctgaggg

SEQ ID NO: 7971710 - DNA, 22 bp, Homo sapiens
gggtgggactctttggcctgag

SEQ ID NO: 7971711 - DNA, 22 bp, Homo sapiens
gggtgggaaggctaagggattg

SEQ ID NO: 7971712 - DNA, 22 bp, Homo sapiens
gggtgggactctttggcctgag

SEQ ID NO: 7971713 - DNA, 22 bp, Homo sapiens
gggtgggaaggctaagggattg

SEQ ID NO: 7971714 - DNA, 22 bp, Homo sapiens
ggtggggctaggacctcaggat

SEQ ID NO: 7971715 - DNA, 22 bp, Homo sapiens
ggtgggagagctctgtctccag

SEQ ID NO: 7971716 - DNA, 22 bp, Homo sapiens
gggtgggatctgtggagcctca

SEQ ID NO: 7971717 - DNA, 22 bp, Homo sapiens
ggtgggagagctctgtctccag

SEQ ID NO: 7971718 - DNA, 22 bp, Homo sapiens
ggtgggagagctctgtctccag

SEQ ID NO: 7971719 - DNA, 22 bp, Homo sapiens
ggtggggctaggacctcaggat

SEQ ID NO: 7971720 - DNA, 22 bp, Homo sapiens
ggtggggctaggacctcaggat

SEQ ID NO: 7971721 - DNA, 22 bp, Homo sapiens
gggtgggatctgtggagcctca

SEQ ID NO: 7971722 - DNA, 22 bp, Homo sapiens
gggtgggatctgtggagcctca

SEQ ID NO: 7971723 - DNA, 22 bp, Homo sapiens
gggtgggatctgtggagcctca

SEQ ID NO: 7971724 - DNA, 22 bp, Homo sapiens
gggtgggagtctggccctcaaa

SEQ ID NO: 7971725 - DNA, 22 bp, Homo sapiens
gggtgggagtctggccctcaaa

SEQ ID NO: 7971726 - DNA, 21 bp, Homo sapiens
gggtgggaggacacagcaggc

SEQ ID NO: 7971727 - DNA, 20 bp, Homo sapiens
gggtgggagagtctgagggt

SEQ ID NO: 7971728 - DNA, 20 bp, Homo sapiens
gggtgggagagtctgagggt

SEQ ID NO: 7971729 - DNA, 20 bp, Homo sapiens
gggtgggagagtctgagggt

SEQ ID NO: 7971730 - DNA, 20 bp, Homo sapiens
gggtgggagagtctgagggt

SEQ ID NO: 7971731 - DNA, 20 bp, Homo sapiens
gggtgggagagtctgagggt

SEQ ID NO: 7971732 - DNA, 20 bp, Homo sapiens
gggtgggagagtctgagggt

SEQ ID NO: 7971733 - DNA, 21 bp, Homo sapiens
gggtgggaggacacagcaggc

SEQ ID NO: 7971734 - DNA, 21 bp, Homo sapiens
gggtgggaggacacagcaggc

SEQ ID NO: 7971735 - DNA, 21 bp, Homo sapiens
gggtgggaggacacagcaggc

SEQ ID NO: 7971736 - DNA, 21 bp, Homo sapiens
gggtgggaggacacagcaggc

SEQ ID NO: 7971737 - DNA, 21 bp, Homo sapiens
gggtgggaggacacagcaggc

SEQ ID NO: 7971738 - DNA, 21 bp, Homo sapiens
gggtgggaggacacagcaggc

SEQ ID NO: 7971739 - DNA, 20 bp, Homo sapiens
gggtgggagagtctgagggt

SEQ ID NO: 7971740 - DNA, 22 bp, Homo sapiens
ggtgggtaaaactgctggcact

SEQ ID NO: 7971741 - DNA, 22 bp, Homo sapiens
ggtgggtaaaactgctggcact

SEQ ID NO: 7971742 - DNA, 22 bp, Homo sapiens
ggtgggtatagttagggcctct

SEQ ID NO: 7971743 - DNA, 22 bp, Homo sapiens
ggtggggttttaggctgctgca

SEQ ID NO: 7971744 - DNA, 22 bp, Homo sapiens
ggtggggttttaggctgctgca

SEQ ID NO: 7971745 - DNA, 22 bp, Homo sapiens
ggtggggttttaggctgctgca

SEQ ID NO: 7971746 - DNA, 22 bp, Homo sapiens
ggtggggtcacgacagagggaa

SEQ ID NO: 7971747 - DNA, 22 bp, Homo sapiens
ggtggggtcacgacagagggaa

SEQ ID NO: 7971748 - DNA, 22 bp, Homo sapiens
ggtggggtcacgacagagggaa

SEQ ID NO: 7971749 - DNA, 22 bp, Homo sapiens
ggtggggtcacgacagagggaa

SEQ ID NO: 7971750 - DNA, 22 bp, Homo sapiens
ggtggggtcacgacagagggaa

SEQ ID NO: 7971751 - DNA, 22 bp, Homo sapiens
ggtggggtcacgacagagggaa

SEQ ID NO: 7971752 - DNA, 22 bp, Homo sapiens
ggtggggtatttggtacttgta

SEQ ID NO: 7971753 - DNA, 22 bp, Homo sapiens
ggtgggggagacttggtcaaga

SEQ ID NO: 7971754 - DNA, 22 bp, Homo sapiens
ggtgggggagacttggtcaaga

SEQ ID NO: 7971755 - DNA, 22 bp, Homo sapiens
ggtgggggagacttggtcaaga

SEQ ID NO: 7971756 - DNA, 22 bp, Homo sapiens
ggtgggggagacttggtcaaga

SEQ ID NO: 7971757 - DNA, 21 bp, Homo sapiens
ggtggggtacctaaggtagct

SEQ ID NO: 7971758 - DNA, 22 bp, Homo sapiens
ggtgggggagacttggtcaaga

SEQ ID NO: 7971759 - DNA, 22 bp, Homo sapiens
ggtggggctgcaagcagttcgg

SEQ ID NO: 7971760 - DNA, 22 bp, Homo sapiens
ggtgggggagacttggtcaaga

SEQ ID NO: 7971761 - DNA, 22 bp, Homo sapiens
ggtggggctgcaagcagttcgg

SEQ ID NO: 7971762 - DNA, 22 bp, Homo sapiens
ggtggggctcagcaatctgtgt

SEQ ID NO: 7971763 - DNA, 22 bp, Homo sapiens
ggtgggtgaaatctaggtgtgt

SEQ ID NO: 7971764 - DNA, 22 bp, Homo sapiens
ggtgggtgaaatctaggtgtgt

SEQ ID NO: 7971765 - DNA, 22 bp, Homo sapiens
cagcaaggcattctgtggatta

SEQ ID NO: 7971766 - DNA, 22 bp, Homo sapiens
cagcaaggcattctgtggatta

SEQ ID NO: 7971767 - DNA, 22 bp, Homo sapiens
cagcaaggccattggatgcagt

SEQ ID NO: 7971768 - DNA, 22 bp, Homo sapiens
cagcaaggccattggatgcagt

SEQ ID NO: 7971769 - DNA, 22 bp, Homo sapiens
cagcaaggccattggatgcagt

SEQ ID NO: 7971770 - DNA, 22 bp, Homo sapiens
ggtgggtgaaatctaggtgtgt

SEQ ID NO: 7971771 - DNA, 22 bp, Homo sapiens
ggtgggtcttgtggggcagctt

SEQ ID NO: 7971772 - DNA, 22 bp, Homo sapiens
ggtgggtcttgcggggcagctt

SEQ ID NO: 7971773 - DNA, 22 bp, Homo sapiens
ggtgggtattgaatacaggtgt

SEQ ID NO: 7971774 - DNA, 22 bp, Homo sapiens
cagcaagggataaacaaggacg

SEQ ID NO: 7971775 - DNA, 22 bp, Homo sapiens
cagcaagggataaacaaggacg

SEQ ID NO: 7971776 - DNA, 22 bp, Homo sapiens
cagcaaggccattggatgcagt

SEQ ID NO: 7971777 - DNA, 22 bp, Homo sapiens
cagcaaggccattggatgcagt

SEQ ID NO: 7971778 - DNA, 22 bp, Homo sapiens
cagcaaggccattggatgcagt

SEQ ID NO: 7971779 - DNA, 22 bp, Homo sapiens
cagcaagggataaagagttact

SEQ ID NO: 7971780 - DNA, 22 bp, Homo sapiens
cagcaagggataaagagttact

SEQ ID NO: 7971781 - DNA, 22 bp, Homo sapiens
cagcaaggtctgtcaatagtgg

SEQ ID NO: 7971782 - DNA, 22 bp, Homo sapiens
cagcaagggttatatcaaagat

SEQ ID NO: 7971783 - DNA, 22 bp, Homo sapiens
cagccacttgtgatgctgggga

SEQ ID NO: 7971784 - DNA, 22 bp, Homo sapiens
cagccacttcgagcttcctgat

SEQ ID NO: 7971785 - DNA, 22 bp, Homo sapiens
cagccactgtggtctagctgca

SEQ ID NO: 7971786 - DNA, 22 bp, Homo sapiens
cagccacttgtgatgctgggga

SEQ ID NO: 7971787 - DNA, 22 bp, Homo sapiens
cagccacttgtgatgctgggga

SEQ ID NO: 7971788 - DNA, 21 bp, Homo sapiens
cagcccagagcagtggggcca

SEQ ID NO: 7971789 - DNA, 21 bp, Homo sapiens
cagcccagagcagtggggcca

SEQ ID NO: 7971790 - DNA, 21 bp, Homo sapiens
cagcccagagcagtggggcca

SEQ ID NO: 7971791 - DNA, 22 bp, Homo sapiens
cagccaggttcaagtccttata

SEQ ID NO: 7971792 - DNA, 17 bp, Homo sapiens
cagccagtcccttcatt

SEQ ID NO: 7971793 - DNA, 22 bp, Homo sapiens
cagccagtggttgaagatgcag

SEQ ID NO: 7971794 - DNA, 22 bp, Homo sapiens
cagccactggtgccaggctgtt

SEQ ID NO: 7971795 - DNA, 22 bp, Homo sapiens
cagccactggtgccaggctgtt

SEQ ID NO: 7971796 - DNA, 22 bp, Homo sapiens
cagccactggtgccaggctgtt

SEQ ID NO: 7971797 - DNA, 22 bp, Homo sapiens
cagccactggtgccaggctgtt

SEQ ID NO: 7971798 - DNA, 22 bp, Homo sapiens
cagccactggtgccaggctgtt

SEQ ID NO: 7971799 - DNA, 22 bp, Homo sapiens
cagccactgacaggaatggtcc

SEQ ID NO: 7971800 - DNA, 22 bp, Homo sapiens
cagccactgacaggaatggtcc

SEQ ID NO: 7971801 - DNA, 22 bp, Homo sapiens
cagccactgaactcctggctat

SEQ ID NO: 7971802 - DNA, 22 bp, Homo sapiens
cagccactggtgccaggctgtt

SEQ ID NO: 7971803 - DNA, 22 bp, Homo sapiens
cagccactgtggtctagctgca

SEQ ID NO: 7971804 - DNA, 22 bp, Homo sapiens
cagccactgtggtctagctgca

SEQ ID NO: 7971805 - DNA, 22 bp, Homo sapiens
cagccactgtggaatagccccc

SEQ ID NO: 7971806 - DNA, 22 bp, Homo sapiens
cagccactgtggaatagccccc

SEQ ID NO: 7971807 - DNA, 22 bp, Homo sapiens
cagccactgtggaatagccccc

SEQ ID NO: 7971808 - DNA, 22 bp, Homo sapiens
cagccactgtggtctagctgca

SEQ ID NO: 7971809 - DNA, 22 bp, Homo sapiens
cagccacttcgagcttcctgat

SEQ ID NO: 7971810 - DNA, 22 bp, Homo sapiens
cagccacttcgagcttcctgat

SEQ ID NO: 7971811 - DNA, 22 bp, Homo sapiens
cagccacttcgagcttcctgat

SEQ ID NO: 7971812 - DNA, 22 bp, Homo sapiens
cagccacttcccctctatgggt

SEQ ID NO: 7971813 - DNA, 22 bp, Homo sapiens
cagccacttcccctctatgggt

SEQ ID NO: 7971814 - DNA, 22 bp, Homo sapiens
cagccaaatgagtcataaatgt

SEQ ID NO: 7971815 - DNA, 22 bp, Homo sapiens
cagcattttcttaatgtaggtg

SEQ ID NO: 7971816 - DNA, 22 bp, Homo sapiens
cagccaaatgagtcataaatgt

SEQ ID NO: 7971817 - DNA, 22 bp, Homo sapiens
cagccaagaaagcagtgctcca

SEQ ID NO: 7971818 - DNA, 22 bp, Homo sapiens
cagccaagaaagcagtgctcca

SEQ ID NO: 7971819 - DNA, 22 bp, Homo sapiens
cagccaagaaagcagtgctcca

SEQ ID NO: 7971820 - DNA, 22 bp, Homo sapiens
cagccaagaaagcagtgctcca

SEQ ID NO: 7971821 - DNA, 22 bp, Homo sapiens
cagccacagctgggtgcctgac

SEQ ID NO: 7971822 - DNA, 22 bp, Homo sapiens
cagccacagctgggtgcctgac

SEQ ID NO: 7971823 - DNA, 22 bp, Homo sapiens
cagccaattctagcttgtgaat

SEQ ID NO: 7971824 - DNA, 22 bp, Homo sapiens
cagccaatgggggacttggcca

SEQ ID NO: 7971825 - DNA, 22 bp, Homo sapiens
cagccaatctgcatatttcttt

SEQ ID NO: 7971826 - DNA, 22 bp, Homo sapiens
cagccaatcctgggaaagtgca

SEQ ID NO: 7971827 - DNA, 22 bp, Homo sapiens
cagccaagaaccacagacccag

SEQ ID NO: 7971828 - DNA, 22 bp, Homo sapiens
cagccaatagcaagggaagctg

SEQ ID NO: 7971829 - DNA, 22 bp, Homo sapiens
cagccaatcctgggaaagtgca

SEQ ID NO: 7971830 - DNA, 22 bp, Homo sapiens
cagccaagaaccacagacccag

SEQ ID NO: 7971831 - DNA, 22 bp, Homo sapiens
cagccaagaaccacagacccag

SEQ ID NO: 7971832 - DNA, 22 bp, Homo sapiens
cagccactcggccataaaggct

SEQ ID NO: 7971833 - DNA, 22 bp, Homo sapiens
cagccactctcagacagtccca

SEQ ID NO: 7971834 - DNA, 22 bp, Homo sapiens
cagccactcggccataaaggct

SEQ ID NO: 7971835 - DNA, 22 bp, Homo sapiens
cagccactacaattggttccat

SEQ ID NO: 7971836 - DNA, 22 bp, Homo sapiens
cagccactacaattggttccat

SEQ ID NO: 7971837 - DNA, 22 bp, Homo sapiens
cagccaccatacagcagaagct

SEQ ID NO: 7971838 - DNA, 22 bp, Homo sapiens
cagccacagctgggtgcctgac

SEQ ID NO: 7971839 - DNA, 22 bp, Homo sapiens
cagccacagctgggtgcctgac

SEQ ID NO: 7971840 - DNA, 22 bp, Homo sapiens
cagccaccatacagcagaagct

SEQ ID NO: 7971841 - DNA, 22 bp, Homo sapiens
cagccactctcagacagtccca

SEQ ID NO: 7971842 - DNA, 22 bp, Homo sapiens
cagccactctcagacagtccca

SEQ ID NO: 7971843 - DNA, 22 bp, Homo sapiens
cagccactgaactcctggctat

SEQ ID NO: 7971844 - DNA, 22 bp, Homo sapiens
cagccactctcagacagtccca

SEQ ID NO: 7971845 - DNA, 22 bp, Homo sapiens
cagccactctcagacagtccca

SEQ ID NO: 7971846 - DNA, 22 bp, Homo sapiens
cagccactgacaggaatggtcc

SEQ ID NO: 7971847 - DNA, 22 bp, Homo sapiens
cagccactgaactcctggctat

SEQ ID NO: 7971848 - DNA, 22 bp, Homo sapiens
cagccactgaactcctggctat

SEQ ID NO: 7971849 - DNA, 22 bp, Homo sapiens
cagccactgaactcctggctat

SEQ ID NO: 7971850 - DNA, 22 bp, Homo sapiens
cagccactgaactcctggctat

SEQ ID NO: 7971851 - DNA, 22 bp, Homo sapiens
cagcatttaatgcagtgcttcc

SEQ ID NO: 7971852 - DNA, 22 bp, Homo sapiens
cagcatttaatgcagtgcttcc

SEQ ID NO: 7971853 - DNA, 22 bp, Homo sapiens
cagcatttaatgcagtgcttcc

SEQ ID NO: 7971854 - DNA, 22 bp, Homo sapiens
cagcatttaatgcagtgcttcc

SEQ ID NO: 7971855 - DNA, 22 bp, Homo sapiens
cagcattgtaagaatgaagacc

SEQ ID NO: 7971856 - DNA, 18 bp, Homo sapiens
cagcattagcagcttcca

SEQ ID NO: 7971857 - DNA, 22 bp, Homo sapiens
cagcattctactttgtgaactg

SEQ ID NO: 7971858 - DNA, 22 bp, Homo sapiens
cagcattgagcacagaaggaaa

SEQ ID NO: 7971859 - DNA, 22 bp, Homo sapiens
cagcatgcttgggggagggagc

SEQ ID NO: 7971860 - DNA, 22 bp, Homo sapiens
cagcatgcttgggggagggagc

SEQ ID NO: 7971861 - DNA, 22 bp, Homo sapiens
cagcatgcttgggggagggagc

SEQ ID NO: 7971862 - DNA, 22 bp, Homo sapiens
cagcatgcctgggctgcctgcc

SEQ ID NO: 7971863 - DNA, 22 bp, Homo sapiens
cagcatttagaatttgaagtgt

SEQ ID NO: 7971864 - DNA, 22 bp, Homo sapiens
cagcatttagaatttgaagtgt

SEQ ID NO: 7971865 - DNA, 22 bp, Homo sapiens
cagcatttatcttgtagcagga

SEQ ID NO: 7971866 - DNA, 22 bp, Homo sapiens
cagcatttcaggaggctgaggt

SEQ ID NO: 7971867 - DNA, 22 bp, Homo sapiens
cagcatttatcttgtagcagga

SEQ ID NO: 7971868 - DNA, 22 bp, Homo sapiens
cagcatttggaggagaggcttt

SEQ ID NO: 7971869 - DNA, 22 bp, Homo sapiens
cagcatttggtgatcatcttaa

SEQ ID NO: 7971870 - DNA, 22 bp, Homo sapiens
cagcatttggtgatcatcttaa

SEQ ID NO: 7971871 - DNA, 22 bp, Homo sapiens
cagcatttggtgatcatcttaa

SEQ ID NO: 7971872 - DNA, 22 bp, Homo sapiens
cagcatttggtgatcatcttaa

SEQ ID NO: 7971873 - DNA, 22 bp, Homo sapiens
cagcatttggtgatcatcttaa

SEQ ID NO: 7971874 - DNA, 22 bp, Homo sapiens
gtatttgtcttgttggtctcca

SEQ ID NO: 7971875 - DNA, 22 bp, Homo sapiens
gtatttgtagtagcatagaatt

SEQ ID NO: 7971876 - DNA, 22 bp, Homo sapiens
gtatttgtagtagcatagaatt

SEQ ID NO: 7971877 - DNA, 22 bp, Homo sapiens
gtatttgtagtagcatagaatt

SEQ ID NO: 7971878 - DNA, 22 bp, Homo sapiens
gtattttaagtgactactaggt

SEQ ID NO: 7971879 - DNA, 22 bp, Homo sapiens
gtattttaagtgactactaggt

SEQ ID NO: 7971880 - DNA, 22 bp, Homo sapiens
gtatttctttccattatagtca

SEQ ID NO: 7971881 - DNA, 22 bp, Homo sapiens
gtatttgctcatacagtgatac

SEQ ID NO: 7971882 - DNA, 22 bp, Homo sapiens
gtatttgctcatacagtgatac

SEQ ID NO: 7971883 - DNA, 22 bp, Homo sapiens
gtatttgcaaatctaaaagaga

SEQ ID NO: 7971884 - DNA, 22 bp, Homo sapiens
gtatttgatcattagaatgatt

SEQ ID NO: 7971885 - DNA, 22 bp, Homo sapiens
gtatttgatacatgaaatggtg

SEQ ID NO: 7971886 - DNA, 22 bp, Homo sapiens
gtatttgagctttatgtatatt

SEQ ID NO: 7971887 - DNA, 22 bp, Homo sapiens
gtatttgatagatttcaaagga

SEQ ID NO: 7971888 - DNA, 22 bp, Homo sapiens
gtatttgatacatgaaatggtg

SEQ ID NO: 7971889 - DNA, 22 bp, Homo sapiens
gtatttgatagatttcaaagga

SEQ ID NO: 7971890 - DNA, 22 bp, Homo sapiens
gtattttaagtgactactaggt

SEQ ID NO: 7971891 - DNA, 22 bp, Homo sapiens
gtattttaagtgactactaggt

SEQ ID NO: 7971892 - DNA, 22 bp, Homo sapiens
gtattttactgctcaaagctct

SEQ ID NO: 7971893 - DNA, 22 bp, Homo sapiens
gtattttactgctcaaagctct

SEQ ID NO: 7971894 - DNA, 22 bp, Homo sapiens
gtattttactgctcaaagctct

SEQ ID NO: 7971895 - DNA, 22 bp, Homo sapiens
gtattttactgctcaaagctct

SEQ ID NO: 7971896 - DNA, 22 bp, Homo sapiens
gtattttactgctcaaagctct

SEQ ID NO: 7971897 - DNA, 22 bp, Homo sapiens
gtattttactgctcaaagctct

SEQ ID NO: 7971898 - DNA, 22 bp, Homo sapiens
cagcatgcccagactgagctaa

SEQ ID NO: 7971899 - DNA, 22 bp, Homo sapiens
cagcatgcctgggctgcctgcc

SEQ ID NO: 7971900 - DNA, 22 bp, Homo sapiens
cagcatgcctgggctgcctgcc

SEQ ID NO: 7971901 - DNA, 22 bp, Homo sapiens
cagcccagagccagttcccgct

SEQ ID NO: 7971902 - DNA, 22 bp, Homo sapiens
cagcccagagccagttcccgct

SEQ ID NO: 7971903 - DNA, 22 bp, Homo sapiens
cagcccagagccagttcccgct

SEQ ID NO: 7971904 - DNA, 22 bp, Homo sapiens
cagcccagcactaagtagattt

SEQ ID NO: 7971905 - DNA, 22 bp, Homo sapiens
cagcccagcactaagtagattt

SEQ ID NO: 7971906 - DNA, 22 bp, Homo sapiens
cagcccagcactaagtagattt

SEQ ID NO: 7971907 - DNA, 22 bp, Homo sapiens
cagcccagcagactgttaccac

SEQ ID NO: 7971908 - DNA, 22 bp, Homo sapiens
cagcccagcagactgttaccac

SEQ ID NO: 7971909 - DNA, 22 bp, Homo sapiens
cagcccagcagactgttaccac

SEQ ID NO: 7971910 - DNA, 22 bp, Homo sapiens
cagcccagcagggtctggccct

SEQ ID NO: 7971911 - DNA, 22 bp, Homo sapiens
cagcccagcactaagtagattt

SEQ ID NO: 7971912 - DNA, 22 bp, Homo sapiens
cagcccagcagggtctggccct

SEQ ID NO: 7971913 - DNA, 22 bp, Homo sapiens
cagcccagcagtcttagcctgc

SEQ ID NO: 7971914 - DNA, 22 bp, Homo sapiens
cagcccagcagtcttagcctgc

SEQ ID NO: 7971915 - DNA, 21 bp, Homo sapiens
cagcccagcccattgacagtg

SEQ ID NO: 7971916 - DNA, 21 bp, Homo sapiens
cagcccagcccattgacagtg

SEQ ID NO: 7971917 - DNA, 21 bp, Homo sapiens
cagcccagcccattgacagtg

SEQ ID NO: 7971918 - DNA, 21 bp, Homo sapiens
cagcccagcccattgacagtg

SEQ ID NO: 7971919 - DNA, 21 bp, Homo sapiens
cagcccagcccattgacagtg

SEQ ID NO: 7971920 - DNA, 22 bp, Homo sapiens
cagcccagcagggtctggccct

SEQ ID NO: 7971921 - DNA, 22 bp, Homo sapiens
cagcccagcagggtctggccct

SEQ ID NO: 7971922 - DNA, 22 bp, Homo sapiens
cagcccagcagggtctggccct

SEQ ID NO: 7971923 - DNA, 22 bp, Homo sapiens
cagcccagcagggtctggccct

SEQ ID NO: 7971924 - DNA, 22 bp, Homo sapiens
cagcccagcagggtctggccct

SEQ ID NO: 7971925 - DNA, 22 bp, Homo sapiens
cagcccagcagggtctggccct

SEQ ID NO: 7971926 - DNA, 22 bp, Homo sapiens
cagcccagcagggtctggccct

SEQ ID NO: 7971927 - DNA, 22 bp, Homo sapiens
cagcccagcagggtctggccct

SEQ ID NO: 7971928 - DNA, 21 bp, Homo sapiens
cagcccagcccattgacagtg

SEQ ID NO: 7971929 - DNA, 21 bp, Homo sapiens
cagcccagcccattgacagtg

SEQ ID NO: 7971930 - DNA, 21 bp, Homo sapiens
cagcccagcccattgacagtg

SEQ ID NO: 7971931 - DNA, 21 bp, Homo sapiens
cagcccagcccattgacagtg

SEQ ID NO: 7971932 - DNA, 22 bp, Homo sapiens
cagaggtgttggtgaatggaga

SEQ ID NO: 7971933 - DNA, 22 bp, Homo sapiens
cagaggttacctagagcaagaa

SEQ ID NO: 7971934 - DNA, 23 bp, Homo sapiens
cagaggtgtcagtgcccagtgtc

SEQ ID NO: 7971935 - DNA, 22 bp, Homo sapiens
cagaggtgttggtgaatggaga

SEQ ID NO: 7971936 - DNA, 22 bp, Homo sapiens
cagaggtgttggtgaatggaga

SEQ ID NO: 7971937 - DNA, 22 bp, Homo sapiens
cagaggtgttggtgaatggaga

SEQ ID NO: 7971938 - DNA, 22 bp, Homo sapiens
cagagtaaacctgtcatcaaga

SEQ ID NO: 7971939 - DNA, 22 bp, Homo sapiens
cagaggtttgatcgagtaggtc

SEQ ID NO: 7971940 - DNA, 22 bp, Homo sapiens
cagaggtgtacagagggaggcc

SEQ ID NO: 7971941 - DNA, 22 bp, Homo sapiens
cagaggtgtacagagggaggcc

SEQ ID NO: 7971942 - DNA, 23 bp, Homo sapiens
cagaggtgtcagtgcccagtgtc

SEQ ID NO: 7971943 - DNA, 23 bp, Homo sapiens
cagaggtgtcagtgcccagtgtc

SEQ ID NO: 7971944 - DNA, 21 bp, Homo sapiens
cagaggtggcctgacctctga

SEQ ID NO: 7971945 - DNA, 22 bp, Homo sapiens
cagaggtagggagctatgttat

SEQ ID NO: 7971946 - DNA, 22 bp, Homo sapiens
cagaggtgtacagagggaggcc

SEQ ID NO: 7971947 - DNA, 22 bp, Homo sapiens
cagaggtgtacagagggaggcc

SEQ ID NO: 7971948 - DNA, 22 bp, Homo sapiens
cagaggctgggacctcaggcat

SEQ ID NO: 7971949 - DNA, 22 bp, Homo sapiens
cagaggctgggacctcaggcat

SEQ ID NO: 7971950 - DNA, 22 bp, Homo sapiens
cagaggctgggacctcaggcat

SEQ ID NO: 7971951 - DNA, 22 bp, Homo sapiens
cagaggctgggacctcaggcat

SEQ ID NO: 7971952 - DNA, 22 bp, Homo sapiens
cagaggctggcggccgccccga

SEQ ID NO: 7971953 - DNA, 22 bp, Homo sapiens
cagaggctggatggacttgcct

SEQ ID NO: 7971954 - DNA, 22 bp, Homo sapiens
cagaggctggatggacttgcct

SEQ ID NO: 7971955 - DNA, 22 bp, Homo sapiens
cagaggctggatggacttgcct

SEQ ID NO: 7971956 - DNA, 22 bp, Homo sapiens
cagaggctgggacctcaggcat

SEQ ID NO: 7971957 - DNA, 22 bp, Homo sapiens
cagaggctgggacctcaggcat

SEQ ID NO: 7971958 - DNA, 22 bp, Homo sapiens
cagaggctgggacctcaggcat

SEQ ID NO: 7971959 - DNA, 22 bp, Homo sapiens
cagaggctgggacctcaggcat

SEQ ID NO: 7971960 - DNA, 22 bp, Homo sapiens
cagaggctgtgtaggcagactg

SEQ ID NO: 7971961 - DNA, 22 bp, Homo sapiens
cagaggctgtgtaggcagactg

SEQ ID NO: 7971962 - DNA, 22 bp, Homo sapiens
cagaggctgtgtaggcagactg

SEQ ID NO: 7971963 - DNA, 22 bp, Homo sapiens
cagaggtagccgagtgcaatcg

SEQ ID NO: 7971964 - DNA, 22 bp, Homo sapiens
cagaggctttgccctggaaacc

SEQ ID NO: 7971965 - DNA, 22 bp, Homo sapiens
cagaggcttggcattatcatgc

SEQ ID NO: 7971966 - DNA, 22 bp, Homo sapiens
cagaggcttcaagtcattctcc

SEQ ID NO: 7971967 - DNA, 22 bp, Homo sapiens
cagaggctgtgtaggcagactg

SEQ ID NO: 7971968 - DNA, 22 bp, Homo sapiens
cagaggctgtgtaggcagactg

SEQ ID NO: 7971969 - DNA, 22 bp, Homo sapiens
cagaggctgtgtaggcagactg

SEQ ID NO: 7971970 - DNA, 22 bp, Homo sapiens
cagaggcttatacctgattagg

SEQ ID NO: 7971971 - DNA, 22 bp, Homo sapiens
gggtctccatgttaacatcact

SEQ ID NO: 7971972 - DNA, 19 bp, Homo sapiens
gggtcgggaagttgagaat

SEQ ID NO: 7971973 - DNA, 22 bp, Homo sapiens
gggtctaggagacatgggcaag

SEQ ID NO: 7971974 - DNA, 22 bp, Homo sapiens
gggtcgggcaggcgccctcgtc

SEQ ID NO: 7971975 - DNA, 22 bp, Homo sapiens
gggtcgcttggagaggcttcct

SEQ ID NO: 7971976 - DNA, 22 bp, Homo sapiens
gggtcgctgccgctgctggacc

SEQ ID NO: 7971977 - DNA, 20 bp, Homo sapiens
gggtcgctctgagcccatcc

SEQ ID NO: 7971978 - DNA, 22 bp, Homo sapiens
cagaggccttcaatactcattt

SEQ ID NO: 7971979 - DNA, 22 bp, Homo sapiens
cagaggccttcaatactcattt

SEQ ID NO: 7971980 - DNA, 22 bp, Homo sapiens
cagaggccttgtcttctttgct

SEQ ID NO: 7971981 - DNA, 22 bp, Homo sapiens
cagaggcctggcttggacacct

SEQ ID NO: 7971982 - DNA, 22 bp, Homo sapiens
cagaggcctggcttggacacct

SEQ ID NO: 7971983 - DNA, 22 bp, Homo sapiens
cagaggcctggcttggacacct

SEQ ID NO: 7971984 - DNA, 22 bp, Homo sapiens
cagaggcctggcttggacacct

SEQ ID NO: 7971985 - DNA, 22 bp, Homo sapiens
cagaggcctggcttggacacct

SEQ ID NO: 7971986 - DNA, 22 bp, Homo sapiens
cagaggcctggcttggacacct

SEQ ID NO: 7971987 - DNA, 22 bp, Homo sapiens
cagaggcctggcttggacacct

SEQ ID NO: 7971988 - DNA, 22 bp, Homo sapiens
cagaggcctggcttggacacct

SEQ ID NO: 7971989 - DNA, 22 bp, Homo sapiens
gggtctccatgttaacatcact

SEQ ID NO: 7971990 - DNA, 22 bp, Homo sapiens
gggtgcaggggaccctagggac

SEQ ID NO: 7971991 - DNA, 22 bp, Homo sapiens
gggtgcaggggaccctagggac

SEQ ID NO: 7971992 - DNA, 22 bp, Homo sapiens
gggtgcaggggaccctagggac

SEQ ID NO: 7971993 - DNA, 22 bp, Homo sapiens
gggtgcaggggaccctagggac

SEQ ID NO: 7971994 - DNA, 22 bp, Homo sapiens
gggtgcaggggaccctagggac

SEQ ID NO: 7971995 - DNA, 22 bp, Homo sapiens
gggtgcaggggaccctagggac

SEQ ID NO: 7971996 - DNA, 22 bp, Homo sapiens
gggtgcaggggaccctagggac

SEQ ID NO: 7971997 - DNA, 22 bp, Homo sapiens
gggtgcagggtctccagcagct

SEQ ID NO: 7971998 - DNA, 22 bp, Homo sapiens
gggtgcagggtctccagcagct

SEQ ID NO: 7971999 - DNA, 22 bp, Homo sapiens
gggtgcagtggttcacgcctgt

SEQ ID NO: 7972000 - DNA, 22 bp, Homo sapiens
gggtgcagtggttcacgcctgt

SEQ ID NO: 7972001 - DNA, 22 bp, Homo sapiens
gggtgcagggtctccagcagct

SEQ ID NO: 7972002 - DNA, 22 bp, Homo sapiens
gggtgcagggtctccagcagct

SEQ ID NO: 7972003 - DNA, 22 bp, Homo sapiens
gggtgcagggtctccagcagct

SEQ ID NO: 7972004 - DNA, 22 bp, Homo sapiens
gggtgcagggtctccagcagct

SEQ ID NO: 7972005 - DNA, 22 bp, Homo sapiens
gggtgcatggtgtatgactgga

SEQ ID NO: 7972006 - DNA, 22 bp, Homo sapiens
gggtgcagtggttcacgcctgt

SEQ ID NO: 7972007 - DNA, 22 bp, Homo sapiens
gggtgcagtggttcacgcctgt

SEQ ID NO: 7972008 - DNA, 22 bp, Homo sapiens
gggtgcagtggttcacgcctgt

SEQ ID NO: 7972009 - DNA, 22 bp, Homo sapiens
gggtgccacagagcttccactt

SEQ ID NO: 7972010 - DNA, 22 bp, Homo sapiens
gggtgccacagagcttccactt

SEQ ID NO: 7972011 - DNA, 22 bp, Homo sapiens
gggtgccctgggtaggtcagtt

SEQ ID NO: 7972012 - DNA, 22 bp, Homo sapiens
gggtgcctgagttagggcagaa

SEQ ID NO: 7972013 - DNA, 22 bp, Homo sapiens
gggtgcctgagttagggcagaa

SEQ ID NO: 7972014 - DNA, 22 bp, Homo sapiens
gggtgccttggtgtgctgtagg

SEQ ID NO: 7972015 - DNA, 22 bp, Homo sapiens
gggtgcctgcctcaggcagtgt

SEQ ID NO: 7972016 - DNA, 22 bp, Homo sapiens
gggtgcctacatgtcctccatg

SEQ ID NO: 7972017 - DNA, 22 bp, Homo sapiens
gggtgctagaagatactgaacg

SEQ ID NO: 7972018 - DNA, 22 bp, Homo sapiens
gggtgctatccgtcctccctcc

SEQ ID NO: 7972019 - DNA, 22 bp, Homo sapiens
gggtgctcctggcggcctcttt

SEQ ID NO: 7972020 - DNA, 23 bp, Homo sapiens
gggtgctgcctgtagtcatgctg

SEQ ID NO: 7972021 - DNA, 23 bp, Homo sapiens
gggtgctgcctgtagtcatgctg

SEQ ID NO: 7972022 - DNA, 22 bp, Homo sapiens
gggtgctgactggggcctgaaa

SEQ ID NO: 7972023 - DNA, 22 bp, Homo sapiens
gggtgctcttgggaaacgtagt

SEQ ID NO: 7972024 - DNA, 22 bp, Homo sapiens
gggtgctgaggaagacagcagg

SEQ ID NO: 7972025 - DNA, 22 bp, Homo sapiens
gggtgctgaggaagacagcagg

SEQ ID NO: 7972026 - DNA, 22 bp, Homo sapiens
gggtgctgactggggcctgaaa

SEQ ID NO: 7972027 - DNA, 22 bp, Homo sapiens
cagaggccaggctgcctgactg

SEQ ID NO: 7972028 - DNA, 22 bp, Homo sapiens
cagaggccaggctgcctgactg

SEQ ID NO: 7972029 - DNA, 22 bp, Homo sapiens
cagaggccaggctgcctgactg

SEQ ID NO: 7972030 - DNA, 22 bp, Homo sapiens
cagaggccaggctgcctgactg

SEQ ID NO: 7972031 - DNA, 22 bp, Homo sapiens
cagaggccaggctgcctgactg

SEQ ID NO: 7972032 - DNA, 22 bp, Homo sapiens
cagaggccaggctgcctgactg

SEQ ID NO: 7972033 - DNA, 22 bp, Homo sapiens
cagaggccaggctgcctgactg

SEQ ID NO: 7972034 - DNA, 22 bp, Homo sapiens
cagaggccaggctgcctgactg

SEQ ID NO: 7972035 - DNA, 22 bp, Homo sapiens
cagaggccaggctgcctgactg

SEQ ID NO: 7972036 - DNA, 22 bp, Homo sapiens
cagaggccagggggctcacaaa

SEQ ID NO: 7972037 - DNA, 19 bp, Homo sapiens
cagaggccagaagcacagg

SEQ ID NO: 7972038 - DNA, 19 bp, Homo sapiens
cagaggccagaagcacagg

SEQ ID NO: 7972039 - DNA, 22 bp, Homo sapiens
cagaggccaggctgcctgactg

SEQ ID NO: 7972040 - DNA, 22 bp, Homo sapiens
cagaggccacctgtggccactg

SEQ ID NO: 7972041 - DNA, 22 bp, Homo sapiens
cagaggccacctgtggccactg

SEQ ID NO: 7972042 - DNA, 19 bp, Homo sapiens
cagaggccagaagcacagg

SEQ ID NO: 7972043 - DNA, 19 bp, Homo sapiens
cagaggccagaagcacagg

SEQ ID NO: 7972044 - DNA, 19 bp, Homo sapiens
cagaggccagaagcacagg

SEQ ID NO: 7972045 - DNA, 22 bp, Homo sapiens
cagaggcccagtgagagggctg

SEQ ID NO: 7972046 - DNA, 22 bp, Homo sapiens
cagaggcccagtgagagggctg

SEQ ID NO: 7972047 - DNA, 22 bp, Homo sapiens
cagaggcccagtgagagggctg

SEQ ID NO: 7972048 - DNA, 22 bp, Homo sapiens
cagaggcccagtgagagggctg

SEQ ID NO: 7972049 - DNA, 22 bp, Homo sapiens
cagaggccatatttcttcactc

SEQ ID NO: 7972050 - DNA, 22 bp, Homo sapiens
cagaggccatatttcttcactc

SEQ ID NO: 7972051 - DNA, 22 bp, Homo sapiens
cagaggccagtggacaagggcc

SEQ ID NO: 7972052 - DNA, 22 bp, Homo sapiens
cagaggccagtggacaagggcc

SEQ ID NO: 7972053 - DNA, 22 bp, Homo sapiens
cagaggccagtggacaagggcc

SEQ ID NO: 7972054 - DNA, 22 bp, Homo sapiens
cagaggccagggggctcacaaa

SEQ ID NO: 7972055 - DNA, 22 bp, Homo sapiens
cagaggccagggggctcacaaa

SEQ ID NO: 7972056 - DNA, 22 bp, Homo sapiens
cagaggccagggggctcacaaa

SEQ ID NO: 7972057 - DNA, 22 bp, Homo sapiens
cagaggccagggggctcacaaa

SEQ ID NO: 7972058 - DNA, 22 bp, Homo sapiens
cagaggccagggggctcacaaa

SEQ ID NO: 7972059 - DNA, 22 bp, Homo sapiens
cagaggcctcacttccagccag

SEQ ID NO: 7972060 - DNA, 22 bp, Homo sapiens
cagaggcctcacttccagccag

SEQ ID NO: 7972061 - DNA, 22 bp, Homo sapiens
cagaggcctcacttccagccag

SEQ ID NO: 7972062 - DNA, 22 bp, Homo sapiens
cagaggcctatccagtgtccat

SEQ ID NO: 7972063 - DNA, 22 bp, Homo sapiens
cagaggcctatccagtgtccat

SEQ ID NO: 7972064 - DNA, 22 bp, Homo sapiens
cagaggcctcacttccagccag

SEQ ID NO: 7972065 - DNA, 21 bp, Homo sapiens
cagaggcctcatgctctgtgc

SEQ ID NO: 7972066 - DNA, 21 bp, Homo sapiens
cagaggcctcatgctctgtgc

SEQ ID NO: 7972067 - DNA, 21 bp, Homo sapiens
cagaggcctcatgctctgtgc

SEQ ID NO: 7972068 - DNA, 22 bp, Homo sapiens
cagaggcctcacttccagccag

SEQ ID NO: 7972069 - DNA, 21 bp, Homo sapiens
cagaggcctcatgctctgtgc

SEQ ID NO: 7972070 - DNA, 21 bp, Homo sapiens
cagaggcctcatgctctgtgc

SEQ ID NO: 7972071 - DNA, 21 bp, Homo sapiens
cagaggcctcatgctctgtgc

SEQ ID NO: 7972072 - DNA, 21 bp, Homo sapiens
cagaggcctcatgctctgtgc

SEQ ID NO: 7972073 - DNA, 21 bp, Homo sapiens
cagaggcctcatgctctgtgc

SEQ ID NO: 7972074 - DNA, 22 bp, Homo sapiens
cagaggcccagtgagagggctg

SEQ ID NO: 7972075 - DNA, 22 bp, Homo sapiens
cagaggcccagtgagagggctg

SEQ ID NO: 7972076 - DNA, 22 bp, Homo sapiens
cagaggcccagtgagagggctg

SEQ ID NO: 7972077 - DNA, 22 bp, Homo sapiens
cagaggcccagtgagagggctg

SEQ ID NO: 7972078 - DNA, 22 bp, Homo sapiens
cagaggcccagtgagagggctg

SEQ ID NO: 7972079 - DNA, 22 bp, Homo sapiens
cagaggccccagaactagctct

SEQ ID NO: 7972080 - DNA, 22 bp, Homo sapiens
cagaggccccagaactagctct

SEQ ID NO: 7972081 - DNA, 22 bp, Homo sapiens
cagaggccccagaactagctct

SEQ ID NO: 7972082 - DNA, 22 bp, Homo sapiens
cagaggcctatccagtgtccat

SEQ ID NO: 7972083 - DNA, 22 bp, Homo sapiens
cagaggcctatccagtgtccat

SEQ ID NO: 7972084 - DNA, 21 bp, Homo sapiens
cagaggcctatcacagactcc

SEQ ID NO: 7972085 - DNA, 21 bp, Homo sapiens
cagaggcctatcacagactcc

SEQ ID NO: 7972086 - DNA, 21 bp, Homo sapiens
cagaggcctatcacagactcc

SEQ ID NO: 7972087 - DNA, 22 bp, Homo sapiens
cagaggccccagaactagctct

SEQ ID NO: 7972088 - DNA, 21 bp, Homo sapiens
cagaggcctatcacagactcc

SEQ ID NO: 7972089 - DNA, 21 bp, Homo sapiens
cagaggcctatcacagactcc

SEQ ID NO: 7972090 - DNA, 21 bp, Homo sapiens
cagaggcctatcacagactcc

SEQ ID NO: 7972091 - DNA, 22 bp, Homo sapiens
cagagctggtgtgtcctggcat

SEQ ID NO: 7972092 - DNA, 22 bp, Homo sapiens
cagagctggtgtgtcctggcat

SEQ ID NO: 7972093 - DNA, 22 bp, Homo sapiens
cagagctggtgtgtcctggcat

SEQ ID NO: 7972094 - DNA, 22 bp, Homo sapiens
cagagctggtgtgtcctggcat

SEQ ID NO: 7972095 - DNA, 22 bp, Homo sapiens
cagagctggtgtgtcctggcat

SEQ ID NO: 7972096 - DNA, 22 bp, Homo sapiens
cagagctggtgtgtcctggcat

SEQ ID NO: 7972097 - DNA, 22 bp, Homo sapiens
cagagctggtgtgtcctggcat

SEQ ID NO: 7972098 - DNA, 22 bp, Homo sapiens
cagagctggtaagtggtagagg

SEQ ID NO: 7972099 - DNA, 22 bp, Homo sapiens
cagagctggtaagtggtagagg

SEQ ID NO: 7972100 - DNA, 22 bp, Homo sapiens
cagagctggtaagtggtagagg

SEQ ID NO: 7972101 - DNA, 22 bp, Homo sapiens
cagagctggtaagtggtagagg

SEQ ID NO: 7972102 - DNA, 22 bp, Homo sapiens
cagagctggtaagtggtagagg

SEQ ID NO: 7972103 - DNA, 22 bp, Homo sapiens
ggggaagaatgctctctagaga

SEQ ID NO: 7972104 - DNA, 20 bp, Homo sapiens
ggggaagaaaaggatgtgat

SEQ ID NO: 7972105 - DNA, 20 bp, Homo sapiens
ggggaagaaaaggatgtgat

SEQ ID NO: 7972106 - DNA, 20 bp, Homo sapiens
ggggaagaaaaggatgtgat

SEQ ID NO: 7972107 - DNA, 20 bp, Homo sapiens
ggggaagaaaaggatgtgat

SEQ ID NO: 7972108 - DNA, 22 bp, Homo sapiens
ggggaagaaatagaacattttg

SEQ ID NO: 7972109 - DNA, 22 bp, Homo sapiens
ggggaagaaatctgggttcttc

SEQ ID NO: 7972110 - DNA, 22 bp, Homo sapiens
ggggaagaatgctctctagaga

SEQ ID NO: 7972111 - DNA, 22 bp, Homo sapiens
ggggaagaatgctctctagaga

SEQ ID NO: 7972112 - DNA, 22 bp, Homo sapiens
ggggaagaatgctctctagaga

SEQ ID NO: 7972113 - DNA, 22 bp, Homo sapiens
ggggaagaaatctgggttcttc

SEQ ID NO: 7972114 - DNA, 22 bp, Homo sapiens
ggggaagaaatctgggttcttc

SEQ ID NO: 7972115 - DNA, 22 bp, Homo sapiens
ggggaagaaccgggattcccat

SEQ ID NO: 7972116 - DNA, 22 bp, Homo sapiens
ggggaagaaccgggattcccat

SEQ ID NO: 7972117 - DNA, 22 bp, Homo sapiens
cagagctggtgttacaagtcca

SEQ ID NO: 7972118 - DNA, 22 bp, Homo sapiens
cagagctggtgttacaagtcca

SEQ ID NO: 7972119 - DNA, 22 bp, Homo sapiens
cagagctggtgtgtcctggcat

SEQ ID NO: 7972120 - DNA, 22 bp, Homo sapiens
cagagctggtgttacaagtcca

SEQ ID NO: 7972121 - DNA, 22 bp, Homo sapiens
cagagctggtgttacaagtcca

SEQ ID NO: 7972122 - DNA, 22 bp, Homo sapiens
cagagctggtgttacaagtcca

SEQ ID NO: 7972123 - DNA, 22 bp, Homo sapiens
cagagctgtcatttgccagtga

SEQ ID NO: 7972124 - DNA, 22 bp, Homo sapiens
cagagctgtcatttgccagtga

SEQ ID NO: 7972125 - DNA, 22 bp, Homo sapiens
cagagctgtatttatctttcca

SEQ ID NO: 7972126 - DNA, 22 bp, Homo sapiens
cagagctggtgttacaagtcca

SEQ ID NO: 7972127 - DNA, 22 bp, Homo sapiens
cagagctgtatttatctttcca

SEQ ID NO: 7972128 - DNA, 22 bp, Homo sapiens
cagagctggtgttacaagtcca

SEQ ID NO: 7972129 - DNA, 22 bp, Homo sapiens
cagaggccacctgtggccactg

SEQ ID NO: 7972130 - DNA, 22 bp, Homo sapiens
cagaggccacctgtggccactg

SEQ ID NO: 7972131 - DNA, 22 bp, Homo sapiens
cagaggccacctgtggccactg

SEQ ID NO: 7972132 - DNA, 22 bp, Homo sapiens
cagaggccacctgtggccactg

SEQ ID NO: 7972133 - DNA, 20 bp, Homo sapiens
cagaggcattttcagactct

SEQ ID NO: 7972134 - DNA, 20 bp, Homo sapiens
cagaggcattttcagactct

SEQ ID NO: 7972135 - DNA, 20 bp, Homo sapiens
cagaggcattttcagactct

SEQ ID NO: 7972136 - DNA, 20 bp, Homo sapiens
cagaggcattttcagactct

SEQ ID NO: 7972137 - DNA, 22 bp, Homo sapiens
cagaggccacctgtggccactg

SEQ ID NO: 7972138 - DNA, 22 bp, Homo sapiens
cagaggcaggataagaactgcg

SEQ ID NO: 7972139 - DNA, 22 bp, Homo sapiens
cagaggcaggataagaactgcg

SEQ ID NO: 7972140 - DNA, 22 bp, Homo sapiens
cagaggcaggataagaactgcg

SEQ ID NO: 7972141 - DNA, 22 bp, Homo sapiens
cagagctgtcatttgccagtga

SEQ ID NO: 7972142 - DNA, 22 bp, Homo sapiens
cagaggcaggataagaactgcg

SEQ ID NO: 7972143 - DNA, 21 bp, Homo sapiens
cagaggcaggctctgtgtgtg

SEQ ID NO: 7972144 - DNA, 21 bp, Homo sapiens
cagaggcaggctctgtgtgtg

SEQ ID NO: 7972145 - DNA, 21 bp, Homo sapiens
cagaggcaggctctgtgtgtg

SEQ ID NO: 7972146 - DNA, 20 bp, Homo sapiens
cagaggcattttcagactct

SEQ ID NO: 7972147 - DNA, 23 bp, Homo sapiens
cagagctgattaaacttaatctc

SEQ ID NO: 7972148 - DNA, 22 bp, Homo sapiens
cagagctgattggatccagaga

SEQ ID NO: 7972149 - DNA, 22 bp, Homo sapiens
cagagctgattggatccagaga

SEQ ID NO: 7972150 - DNA, 23 bp, Homo sapiens
cagagctgattaaacttaatctc

SEQ ID NO: 7972151 - DNA, 22 bp, Homo sapiens
cagagctgagtcttcaaggttg

SEQ ID NO: 7972152 - DNA, 22 bp, Homo sapiens
cagagctgagaatgttgatgct

SEQ ID NO: 7972153 - DNA, 22 bp, Homo sapiens
cagagctgagaatgttgatgct

SEQ ID NO: 7972154 - DNA, 22 bp, Homo sapiens
cagagctgagaatgttgatgct

SEQ ID NO: 7972155 - DNA, 22 bp, Homo sapiens
cagagctgagtcttcaaggttg

SEQ ID NO: 7972156 - DNA, 22 bp, Homo sapiens
cagagctgagtcttcaaggttg

SEQ ID NO: 7972157 - DNA, 22 bp, Homo sapiens
cagagctgcacattctatgatg

SEQ ID NO: 7972158 - DNA, 22 bp, Homo sapiens
cagagctgcagattgaaggcat

SEQ ID NO: 7972159 - DNA, 22 bp, Homo sapiens
cagagctgcagattgaaggcat

SEQ ID NO: 7972160 - DNA, 22 bp, Homo sapiens
cagagctgcacattctatgatg

SEQ ID NO: 7972161 - DNA, 22 bp, Homo sapiens
cagagctgcacattctatgatg

SEQ ID NO: 7972162 - DNA, 22 bp, Homo sapiens
cagagctgcacattctatgatg

SEQ ID NO: 7972163 - DNA, 22 bp, Homo sapiens
cagagctgcaaatgcccctccg

SEQ ID NO: 7972164 - DNA, 22 bp, Homo sapiens
cagagctgcaaatgcccctccg

SEQ ID NO: 7972165 - DNA, 22 bp, Homo sapiens
cagagctgcaaatgcccctccg

SEQ ID NO: 7972166 - DNA, 22 bp, Homo sapiens
cagagctgattggatccagaga

SEQ ID NO: 7972167 - DNA, 22 bp, Homo sapiens
cagagctgagaatgttgatgct

SEQ ID NO: 7972168 - DNA, 22 bp, Homo sapiens
cagagctgagaatgttgatgct

SEQ ID NO: 7972169 - DNA, 22 bp, Homo sapiens
cagagctgacccaaggattgaa

SEQ ID NO: 7972170 - DNA, 22 bp, Homo sapiens
cagagctgacccaaggattgaa

SEQ ID NO: 7972171 - DNA, 21 bp, Homo sapiens
cagagctgaagggtgtagtgt

SEQ ID NO: 7972172 - DNA, 21 bp, Homo sapiens
cagagctgaagggtgtagtgt

SEQ ID NO: 7972173 - DNA, 21 bp, Homo sapiens
cagagctgaagggtgtagtgt

SEQ ID NO: 7972174 - DNA, 21 bp, Homo sapiens
cagagctctttctgcttgctg

SEQ ID NO: 7972175 - DNA, 21 bp, Homo sapiens
cagagctctttctgcttgctg

SEQ ID NO: 7972176 - DNA, 22 bp, Homo sapiens
gggcgcagccaatcctggccct

SEQ ID NO: 7972177 - DNA, 22 bp, Homo sapiens
gggcgcagccaatcctggccct

SEQ ID NO: 7972178 - DNA, 22 bp, Homo sapiens
gggcgcagccaatcctggccct

SEQ ID NO: 7972179 - DNA, 22 bp, Homo sapiens
gggcgcatcacctgaggtcagg

SEQ ID NO: 7972180 - DNA, 22 bp, Homo sapiens
gggcgcatcacctgaggtcagg

SEQ ID NO: 7972181 - DNA, 22 bp, Homo sapiens
gggcgccgtgggaaacagccgg

SEQ ID NO: 7972182 - DNA, 22 bp, Homo sapiens
cagagcctgctcacgtctctgt

SEQ ID NO: 7972183 - DNA, 22 bp, Homo sapiens
gggcgccgtgggaaacagccgg

SEQ ID NO: 7972184 - DNA, 22 bp, Homo sapiens
gggcgccgtgggaaacagccgg

SEQ ID NO: 7972185 - DNA, 22 bp, Homo sapiens
cagagcctgctgccttctgaag

SEQ ID NO: 7972186 - DNA, 22 bp, Homo sapiens
cagagcctgctgccttctgaag

SEQ ID NO: 7972187 - DNA, 22 bp, Homo sapiens
cagagcctgctgccttctgaag

SEQ ID NO: 7972188 - DNA, 22 bp, Homo sapiens
cagagcctgctgccttctgaag

SEQ ID NO: 7972189 - DNA, 22 bp, Homo sapiens
gggctgtgtgcagtacgggtcc

SEQ ID NO: 7972190 - DNA, 22 bp, Homo sapiens
gggctgtgtatcagttatctat

SEQ ID NO: 7972191 - DNA, 22 bp, Homo sapiens
ggggaaacatgttgttcagacc

SEQ ID NO: 7972192 - DNA, 23 bp, Homo sapiens
ggggaaagaccatgcttgaggac

SEQ ID NO: 7972193 - DNA, 23 bp, Homo sapiens
ggggaaagaccatgcttgaggac

SEQ ID NO: 7972194 - DNA, 23 bp, Homo sapiens
ggggaaagaccatgcttgaggac

SEQ ID NO: 7972195 - DNA, 22 bp, Homo sapiens
ggggaaaggccatggcaagaac

SEQ ID NO: 7972196 - DNA, 22 bp, Homo sapiens
ggggaaaggccatggcaagaac

SEQ ID NO: 7972197 - DNA, 22 bp, Homo sapiens
ggggaaaggccatggcaagaac

SEQ ID NO: 7972198 - DNA, 22 bp, Homo sapiens
ggggaaagtgaattgtgtagtg

SEQ ID NO: 7972199 - DNA, 22 bp, Homo sapiens
ggggaaagtgaattgtgtagtg

SEQ ID NO: 7972200 - DNA, 20 bp, Homo sapiens
ggggaagaaaaggatgtgat

SEQ ID NO: 7972201 - DNA, 20 bp, Homo sapiens
ggggaagaaaaggatgtgat

SEQ ID NO: 7972202 - DNA, 20 bp, Homo sapiens
ggggaagaaaaggatgtgat

SEQ ID NO: 7972203 - DNA, 22 bp, Homo sapiens
ggggaacaccgggcagaggcgc

SEQ ID NO: 7972204 - DNA, 22 bp, Homo sapiens
ggggaaattgtggctgacagtg

SEQ ID NO: 7972205 - DNA, 19 bp, Homo sapiens
cagagctgctggcctcgtc

SEQ ID NO: 7972206 - DNA, 19 bp, Homo sapiens
cagagctgctggcctcgtc

SEQ ID NO: 7972207 - DNA, 22 bp, Homo sapiens
gggctgtgtactatgaggaggg

SEQ ID NO: 7972208 - DNA, 19 bp, Homo sapiens
cagagctgctggcctcgtc

SEQ ID NO: 7972209 - DNA, 19 bp, Homo sapiens
cagagctgctggcctcgtc

SEQ ID NO: 7972210 - DNA, 19 bp, Homo sapiens
cagagctgctggcctcgtc

SEQ ID NO: 7972211 - DNA, 22 bp, Homo sapiens
cagagctgctcatggtggccag

SEQ ID NO: 7972212 - DNA, 22 bp, Homo sapiens
cagagctgctcatggtggccag

SEQ ID NO: 7972213 - DNA, 22 bp, Homo sapiens
cagagctgctcatggtggccag

SEQ ID NO: 7972214 - DNA, 22 bp, Homo sapiens
cagagctgctcatggtggccag

SEQ ID NO: 7972215 - DNA, 22 bp, Homo sapiens
cagagctgctcatggtggccag

SEQ ID NO: 7972216 - DNA, 22 bp, Homo sapiens
cagagctgctcatggtggccag

SEQ ID NO: 7972217 - DNA, 19 bp, Homo sapiens
cagagctgctggcctcgtc

SEQ ID NO: 7972218 - DNA, 19 bp, Homo sapiens
cagagctgctggcctcgtc

SEQ ID NO: 7972219 - DNA, 19 bp, Homo sapiens
cagagctgctggcctcgtc

SEQ ID NO: 7972220 - DNA, 22 bp, Homo sapiens
cagagctgcgctttttcctggt

SEQ ID NO: 7972221 - DNA, 22 bp, Homo sapiens
cagagctgcgctttttcctggt

SEQ ID NO: 7972222 - DNA, 22 bp, Homo sapiens
cagagctgcgctttttcctggt

SEQ ID NO: 7972223 - DNA, 22 bp, Homo sapiens
cagagctgctcatggtggccag

SEQ ID NO: 7972224 - DNA, 22 bp, Homo sapiens
cagagctgcgctttttcctggt

SEQ ID NO: 7972225 - DNA, 22 bp, Homo sapiens
cagagctgcgctttttcctggt

SEQ ID NO: 7972226 - DNA, 22 bp, Homo sapiens
cagagctgcagattgaaggcat

SEQ ID NO: 7972227 - DNA, 22 bp, Homo sapiens
cagagctgcagattgaaggcat

SEQ ID NO: 7972228 - DNA, 22 bp, Homo sapiens
cagagctgcagattgaaggcat

SEQ ID NO: 7972229 - DNA, 22 bp, Homo sapiens
cagagctgcgctttttcctggt

SEQ ID NO: 7972230 - DNA, 22 bp, Homo sapiens
gggcagagaaatggacagttgg

SEQ ID NO: 7972231 - DNA, 22 bp, Homo sapiens
gggcagagaaatggacagttgg

SEQ ID NO: 7972232 - DNA, 22 bp, Homo sapiens
gggcagagaaatggacagttgg

SEQ ID NO: 7972233 - DNA, 22 bp, Homo sapiens
gggcagactggttatacacggg

SEQ ID NO: 7972234 - DNA, 22 bp, Homo sapiens
gggcagagaaatggacagttgg

SEQ ID NO: 7972235 - DNA, 22 bp, Homo sapiens
gggcagactggttatacacggg

SEQ ID NO: 7972236 - DNA, 22 bp, Homo sapiens
gggcagagaaatggacagttgg

SEQ ID NO: 7972237 - DNA, 22 bp, Homo sapiens
gggcagagaaatggacagttgg

SEQ ID NO: 7972238 - DNA, 22 bp, Homo sapiens
gggcacttctaagcatggggct

SEQ ID NO: 7972239 - DNA, 22 bp, Homo sapiens
gggcacttgtgttcttcacttt

SEQ ID NO: 7972240 - DNA, 22 bp, Homo sapiens
gggcacttaatgggcacagaga

SEQ ID NO: 7972241 - DNA, 22 bp, Homo sapiens
gggcacttactgccaaggcgag

SEQ ID NO: 7972242 - DNA, 22 bp, Homo sapiens
gggcactttgtgcctcactgtg

SEQ ID NO: 7972243 - DNA, 22 bp, Homo sapiens
gggcactttgtgcctcactgtg

SEQ ID NO: 7972244 - DNA, 22 bp, Homo sapiens
cagagccccccttctgatcaca

SEQ ID NO: 7972245 - DNA, 22 bp, Homo sapiens
cagagcccatggcacatgtgga

SEQ ID NO: 7972246 - DNA, 22 bp, Homo sapiens
cagagcccatcctatactctcc

SEQ ID NO: 7972247 - DNA, 22 bp, Homo sapiens
gggcagagaaatggacagttgg

SEQ ID NO: 7972248 - DNA, 22 bp, Homo sapiens
cagagccagctgtccttggcat

SEQ ID NO: 7972249 - DNA, 22 bp, Homo sapiens
cagagccaggcctgccctcttt

SEQ ID NO: 7972250 - DNA, 22 bp, Homo sapiens
gggcacagagggtcttgaagaa

SEQ ID NO: 7972251 - DNA, 22 bp, Homo sapiens
gggcacagagggtcttgaagaa

SEQ ID NO: 7972252 - DNA, 22 bp, Homo sapiens
gggcacagagggtcttgaagaa

SEQ ID NO: 7972253 - DNA, 22 bp, Homo sapiens
gggcacagagggtcttgaagaa

SEQ ID NO: 7972254 - DNA, 22 bp, Homo sapiens
gggcacagcccagtggggtccc

SEQ ID NO: 7972255 - DNA, 22 bp, Homo sapiens
gggcacagcccagtggggtccc

SEQ ID NO: 7972256 - DNA, 22 bp, Homo sapiens
gggcacagagggtcttgaagaa

SEQ ID NO: 7972257 - DNA, 22 bp, Homo sapiens
gggcacagagaaggttttagtg

SEQ ID NO: 7972258 - DNA, 22 bp, Homo sapiens
gggcacagagaaggttttagtg

SEQ ID NO: 7972259 - DNA, 22 bp, Homo sapiens
gggcacagagggtcttgaagaa

SEQ ID NO: 7972260 - DNA, 22 bp, Homo sapiens
gggcacagagggtcttgaagaa

SEQ ID NO: 7972261 - DNA, 22 bp, Homo sapiens
gggcactgtggggcccatgctg

SEQ ID NO: 7972262 - DNA, 22 bp, Homo sapiens
gggcactgtgctgggtgcttta

SEQ ID NO: 7972263 - DNA, 22 bp, Homo sapiens
gggcactgtgctgggtgcttta

SEQ ID NO: 7972264 - DNA, 22 bp, Homo sapiens
gggcactgtgctgggtgcttta

SEQ ID NO: 7972265 - DNA, 22 bp, Homo sapiens
gggcactgtgctgggtgcttta

SEQ ID NO: 7972266 - DNA, 22 bp, Homo sapiens
gggcactgtgctgggtgcttta

SEQ ID NO: 7972267 - DNA, 22 bp, Homo sapiens
gggcactgtgctgggtgcttta

SEQ ID NO: 7972268 - DNA, 22 bp, Homo sapiens
gggcactgtgctgggtgcttta

SEQ ID NO: 7972269 - DNA, 22 bp, Homo sapiens
gggcactgtgctaggtgctgag

SEQ ID NO: 7972270 - DNA, 22 bp, Homo sapiens
gggcactgtggggcccatgctg

SEQ ID NO: 7972271 - DNA, 22 bp, Homo sapiens
gggcactgtggggcccatgctg

SEQ ID NO: 7972272 - DNA, 22 bp, Homo sapiens
gggcactgtgttcagagtgcag

SEQ ID NO: 7972273 - DNA, 22 bp, Homo sapiens
gggcactgtgttcagagtgcag

SEQ ID NO: 7972274 - DNA, 22 bp, Homo sapiens
gggcactgtgttcagagtgcag

SEQ ID NO: 7972275 - DNA, 22 bp, Homo sapiens
gggcactgtgttcagagtgcag

SEQ ID NO: 7972276 - DNA, 21 bp, Homo sapiens
gggcgaggcctgatgtggctc

SEQ ID NO: 7972277 - DNA, 22 bp, Homo sapiens
gggcgagggcgaaagcgagagc

SEQ ID NO: 7972278 - DNA, 21 bp, Homo sapiens
gggcgaggcctgatgtggctc

SEQ ID NO: 7972279 - DNA, 21 bp, Homo sapiens
gggcgaggcctgatgtggctc

SEQ ID NO: 7972280 - DNA, 22 bp, Homo sapiens
gggcgagggcgaaagcgagagc

SEQ ID NO: 7972281 - DNA, 22 bp, Homo sapiens
gggcgagggcgaaagcgagagc

SEQ ID NO: 7972282 - DNA, 22 bp, Homo sapiens
gggcgagggcgaaagcgagagc

SEQ ID NO: 7972283 - DNA, 22 bp, Homo sapiens
gggcgagggcgaaagcgagagc

SEQ ID NO: 7972284 - DNA, 22 bp, Homo sapiens
gggcgagggcgaaagcgagagc

SEQ ID NO: 7972285 - DNA, 22 bp, Homo sapiens
gggcgagggcgaaagcgagagc

SEQ ID NO: 7972286 - DNA, 22 bp, Homo sapiens
gggcgagggcgaaagcgagagc

SEQ ID NO: 7972287 - DNA, 22 bp, Homo sapiens
gggcgagggcgaaagcgagagc

SEQ ID NO: 7972288 - DNA, 22 bp, Homo sapiens
gggcgagggcgaaagcgagagc

SEQ ID NO: 7972289 - DNA, 22 bp, Homo sapiens
gggcgagggcgaaagcgagagc

SEQ ID NO: 7972290 - DNA, 22 bp, Homo sapiens
cagagcccttggctggagccca

SEQ ID NO: 7972291 - DNA, 22 bp, Homo sapiens
cagagcccttcctcccacgggg

SEQ ID NO: 7972292 - DNA, 22 bp, Homo sapiens
gggccttccgactcccaaggcc

SEQ ID NO: 7972293 - DNA, 22 bp, Homo sapiens
gggccttcagccttggactgag

SEQ ID NO: 7972294 - DNA, 22 bp, Homo sapiens
gggccttctagttagccccaat

SEQ ID NO: 7972295 - DNA, 22 bp, Homo sapiens
gggccttgccatggagcctgag

SEQ ID NO: 7972296 - DNA, 21 bp, Homo sapiens
gggccttgagtgtgcggtggg

SEQ ID NO: 7972297 - DNA, 22 bp, Homo sapiens
gggccttgccatggagcctgag

SEQ ID NO: 7972298 - DNA, 22 bp, Homo sapiens
gggccttggcgaagtgtggtgg

SEQ ID NO: 7972299 - DNA, 22 bp, Homo sapiens
gggcgaggactgactctgggca

SEQ ID NO: 7972300 - DNA, 22 bp, Homo sapiens
gggcgaggactgactctgggca

SEQ ID NO: 7972301 - DNA, 22 bp, Homo sapiens
gggcgaggactgactctgggca

SEQ ID NO: 7972302 - DNA, 22 bp, Homo sapiens
cagagccctagtcctgatggcc

SEQ ID NO: 7972303 - DNA, 22 bp, Homo sapiens
cagagccctagtcctgatggcc

SEQ ID NO: 7972304 - DNA, 22 bp, Homo sapiens
cagagccctagtcctgatggcc

SEQ ID NO: 7972305 - DNA, 22 bp, Homo sapiens
cagagcccctgggttgggagct

SEQ ID NO: 7972306 - DNA, 22 bp, Homo sapiens
cagagcccctcagctctctccc

SEQ ID NO: 7972307 - DNA, 22 bp, Homo sapiens
cagagcccctcagctctctccc

SEQ ID NO: 7972308 - DNA, 22 bp, Homo sapiens
cagagccccccttctgatcaca

SEQ ID NO: 7972309 - DNA, 22 bp, Homo sapiens
cagagccccccttctgatcaca

SEQ ID NO: 7972310 - DNA, 22 bp, Homo sapiens
cagagccctcaaggccgatgca

SEQ ID NO: 7972311 - DNA, 22 bp, Homo sapiens
cagagccctccgctccccggct

SEQ ID NO: 7972312 - DNA, 22 bp, Homo sapiens
cagagccctgcatgctccatct

SEQ ID NO: 7972313 - DNA, 22 bp, Homo sapiens
cagagccctgtgtgccatgtga

SEQ ID NO: 7972314 - DNA, 22 bp, Homo sapiens
cagagccctgtgtgccatgtga

SEQ ID NO: 7972315 - DNA, 19 bp, Homo sapiens
gggagcaggaaagctgtgg

SEQ ID NO: 7972316 - DNA, 19 bp, Homo sapiens
gggagcaggaaagctgtgg

SEQ ID NO: 7972317 - DNA, 19 bp, Homo sapiens
gggagcaggaaagctgtgg

SEQ ID NO: 7972318 - DNA, 19 bp, Homo sapiens
gggagcaggaaagctgtgg

SEQ ID NO: 7972319 - DNA, 22 bp, Homo sapiens
gggagcagcctgcctcccacct

SEQ ID NO: 7972320 - DNA, 22 bp, Homo sapiens
gggagcagcctgcctcccacct

SEQ ID NO: 7972321 - DNA, 22 bp, Homo sapiens
gggagcactgagaggcaggtag

SEQ ID NO: 7972322 - DNA, 22 bp, Homo sapiens
gggagcactgagaggcaggtag

SEQ ID NO: 7972323 - DNA, 22 bp, Homo sapiens
gggagcactaaggcagtcgctt

SEQ ID NO: 7972324 - DNA, 22 bp, Homo sapiens
gggagcacccgtggcctcaagg

SEQ ID NO: 7972325 - DNA, 22 bp, Homo sapiens
gggagcacatctgagcacccgg

SEQ ID NO: 7972326 - DNA, 22 bp, Homo sapiens
gggagcagcctgcctcccacct

SEQ ID NO: 7972327 - DNA, 22 bp, Homo sapiens
gggagcactgagaggcaggtag

SEQ ID NO: 7972328 - DNA, 22 bp, Homo sapiens
gggagcactgagaggcaggtag

SEQ ID NO: 7972329 - DNA, 22 bp, Homo sapiens
gggagcagcctgcctcccacct

SEQ ID NO: 7972330 - DNA, 22 bp, Homo sapiens
gggagcaggacataatagcaat

SEQ ID NO: 7972331 - DNA, 22 bp, Homo sapiens
gggagcaggacataatagcaat

SEQ ID NO: 7972332 - DNA, 22 bp, Homo sapiens
gggagcaggacataatagcaat

SEQ ID NO: 7972333 - DNA, 19 bp, Homo sapiens
gggagcaggaaagctgtgg

SEQ ID NO: 7972334 - DNA, 19 bp, Homo sapiens
gggagcaggaaagctgtgg

SEQ ID NO: 7972335 - DNA, 22 bp, Homo sapiens
gggagcaggacataatagcaat

SEQ ID NO: 7972336 - DNA, 22 bp, Homo sapiens
gggagcaggacataatagcaat

SEQ ID NO: 7972337 - DNA, 22 bp, Homo sapiens
gggagcaggacataatagcaat

SEQ ID NO: 7972338 - DNA, 22 bp, Homo sapiens
gggagcaggacataatagcaat

SEQ ID NO: 7972339 - DNA, 22 bp, Homo sapiens
gggagcaggacataatagcaat

SEQ ID NO: 7972340 - DNA, 22 bp, Homo sapiens
gggagcaggagcctgcctgcca

SEQ ID NO: 7972341 - DNA, 22 bp, Homo sapiens
gggagcaggagcctgcctgcca

SEQ ID NO: 7972342 - DNA, 22 bp, Homo sapiens
gggagcaggacataatagcaat

SEQ ID NO: 7972343 - DNA, 22 bp, Homo sapiens
gggagcaggagcctgcctgcca

SEQ ID NO: 7972344 - DNA, 22 bp, Homo sapiens
gggagcaggagcctgcctgcca

SEQ ID NO: 7972345 - DNA, 22 bp, Homo sapiens
gggagcaggagcctgcctgcca

SEQ ID NO: 7972346 - DNA, 22 bp, Homo sapiens
gggagcaggagcctgcctgcca

SEQ ID NO: 7972347 - DNA, 22 bp, Homo sapiens
gggagcaggagcctgcctgcca

SEQ ID NO: 7972348 - DNA, 22 bp, Homo sapiens
cagacaggcaggtgagagctcc

SEQ ID NO: 7972349 - DNA, 22 bp, Homo sapiens
cagacaggcaggtgagagctcc

SEQ ID NO: 7972350 - DNA, 22 bp, Homo sapiens
cagacaggcaggtgagagctcc

SEQ ID NO: 7972351 - DNA, 22 bp, Homo sapiens
cagacaggcaggtgagagctcc

SEQ ID NO: 7972352 - DNA, 22 bp, Homo sapiens
cagacaggcaggtgagagctcc

SEQ ID NO: 7972353 - DNA, 22 bp, Homo sapiens
cagacaggcaggtgagagctcc

SEQ ID NO: 7972354 - DNA, 22 bp, Homo sapiens
cagacaggcaggtgagagctcc

SEQ ID NO: 7972355 - DNA, 22 bp, Homo sapiens
cagacaggagactggatcatgg

SEQ ID NO: 7972356 - DNA, 22 bp, Homo sapiens
cagacaggagactggatcatgg

SEQ ID NO: 7972357 - DNA, 22 bp, Homo sapiens
cagacaggaattctggcgtggt

SEQ ID NO: 7972358 - DNA, 22 bp, Homo sapiens
cagacaggagactggatcatgg

SEQ ID NO: 7972359 - DNA, 22 bp, Homo sapiens
cagacaggaattctggcgtggt

SEQ ID NO: 7972360 - DNA, 22 bp, Homo sapiens
cagacaggaattctggcgtggt

SEQ ID NO: 7972361 - DNA, 22 bp, Homo sapiens
cagacaggaattctggcgtggt

SEQ ID NO: 7972362 - DNA, 22 bp, Homo sapiens
cagacaggaattctggcgtggt

SEQ ID NO: 7972363 - DNA, 22 bp, Homo sapiens
cagacaggaattctggcgtggt

SEQ ID NO: 7972364 - DNA, 22 bp, Homo sapiens
cagacaggaattctggcgtggt

SEQ ID NO: 7972365 - DNA, 22 bp, Homo sapiens
cagacaggcaggtgctgctttg

SEQ ID NO: 7972366 - DNA, 22 bp, Homo sapiens
cagacaggcaggtgctgctttg

SEQ ID NO: 7972367 - DNA, 22 bp, Homo sapiens
cagacaggcaggtgctgctttg

SEQ ID NO: 7972368 - DNA, 22 bp, Homo sapiens
cagacaggcaggtgctgctttg

SEQ ID NO: 7972369 - DNA, 22 bp, Homo sapiens
cagacaggctagccagactcac

SEQ ID NO: 7972370 - DNA, 22 bp, Homo sapiens
cagacaggcaggtgctgctttg

SEQ ID NO: 7972371 - DNA, 19 bp, Homo sapiens
gggagcacaagcgttaaga

SEQ ID NO: 7972372 - DNA, 22 bp, Homo sapiens
gggagcaagccggaggtactgt

SEQ ID NO: 7972373 - DNA, 23 bp, Homo sapiens
gggagcacagcctggtgggcgcg

SEQ ID NO: 7972374 - DNA, 22 bp, Homo sapiens
gggagcacatctgagcacccgg

SEQ ID NO: 7972375 - DNA, 22 bp, Homo sapiens
gggagcacacagaggtgccctt

SEQ ID NO: 7972376 - DNA, 22 bp, Homo sapiens
cagacaggcaggtgctgctttg

SEQ ID NO: 7972377 - DNA, 22 bp, Homo sapiens
gggagcacacagaggtgccctt

SEQ ID NO: 7972378 - DNA, 22 bp, Homo sapiens
cagacagaaggctccttgaggt

SEQ ID NO: 7972379 - DNA, 22 bp, Homo sapiens
cagacaggaagttcagaagaaa

SEQ ID NO: 7972380 - DNA, 22 bp, Homo sapiens
cagacagaaggctccttgaggt

SEQ ID NO: 7972381 - DNA, 22 bp, Homo sapiens
cagacaggaattctggcgtggt

SEQ ID NO: 7972382 - DNA, 22 bp, Homo sapiens
cagacaggaattctggcgtggt

SEQ ID NO: 7972383 - DNA, 22 bp, Homo sapiens
cagacaggaagttcagaagaaa

SEQ ID NO: 7972384 - DNA, 22 bp, Homo sapiens
cagaagtttgcaattgtttatt

SEQ ID NO: 7972385 - DNA, 22 bp, Homo sapiens
cagaagtttgacatgtttagct

SEQ ID NO: 7972386 - DNA, 22 bp, Homo sapiens
cagaataaaaactcctatgtct

SEQ ID NO: 7972387 - DNA, 22 bp, Homo sapiens
cagacagaaggctccttgaggt

SEQ ID NO: 7972388 - DNA, 22 bp, Homo sapiens
cagacagaaggctccttgaggt

SEQ ID NO: 7972389 - DNA, 22 bp, Homo sapiens
cagacagaaggctccttgaggt

SEQ ID NO: 7972390 - DNA, 22 bp, Homo sapiens
cagaagttgatcctgcgtttcc

SEQ ID NO: 7972391 - DNA, 22 bp, Homo sapiens
cagaagttggagctttccatca

SEQ ID NO: 7972392 - DNA, 22 bp, Homo sapiens
cagaagttcctatttacctcct

SEQ ID NO: 7972393 - DNA, 22 bp, Homo sapiens
cagaagttcatttagcctctct

SEQ ID NO: 7972394 - DNA, 22 bp, Homo sapiens
cagaagttcatttagcctctct

SEQ ID NO: 7972395 - DNA, 22 bp, Homo sapiens
cagaagtgatgttgagctagtc

SEQ ID NO: 7972396 - DNA, 22 bp, Homo sapiens
cagaagtgaatgtgataaacca

SEQ ID NO: 7972397 - DNA, 22 bp, Homo sapiens
cagaagtgaatgtgataaacca

SEQ ID NO: 7972398 - DNA, 22 bp, Homo sapiens
gggacttaatgcagagagggac

SEQ ID NO: 7972399 - DNA, 22 bp, Homo sapiens
gggacttcatagctaggcactt

SEQ ID NO: 7972400 - DNA, 22 bp, Homo sapiens
gggactgtgaggcctaactggg

SEQ ID NO: 7972401 - DNA, 22 bp, Homo sapiens
gggacttaatgcagagagggac

SEQ ID NO: 7972402 - DNA, 22 bp, Homo sapiens
gggactgggagatcctcctggc

SEQ ID NO: 7972403 - DNA, 22 bp, Homo sapiens
gggactgtaaattcatatggcc

SEQ ID NO: 7972404 - DNA, 22 bp, Homo sapiens
gggactgtccggcagaaggtac

SEQ ID NO: 7972405 - DNA, 22 bp, Homo sapiens
gggactgtccggcagaaggtac

SEQ ID NO: 7972406 - DNA, 20 bp, Homo sapiens
gggactgtcccatcctcatc

SEQ ID NO: 7972407 - DNA, 22 bp, Homo sapiens
gggactgtcctacatggagagg

SEQ ID NO: 7972408 - DNA, 22 bp, Homo sapiens
gggactgtcctacatggagagg

SEQ ID NO: 7972409 - DNA, 22 bp, Homo sapiens
gggactgtcctctgtgtctgtg

SEQ ID NO: 7972410 - DNA, 22 bp, Homo sapiens
cagaagtggcatcattcaagag

SEQ ID NO: 7972411 - DNA, 22 bp, Homo sapiens
cagaagtggcatcattcaagag

SEQ ID NO: 7972412 - DNA, 22 bp, Homo sapiens
cagaagtggatattagagtaat

SEQ ID NO: 7972413 - DNA, 22 bp, Homo sapiens
cagaagtgatgttgagctagtc

SEQ ID NO: 7972414 - DNA, 22 bp, Homo sapiens
cagaagtgcaatttaaattagg

SEQ ID NO: 7972415 - DNA, 22 bp, Homo sapiens
cagaagtggcctcagagggagt

SEQ ID NO: 7972416 - DNA, 22 bp, Homo sapiens
cagaagtggcctcagagggagt

SEQ ID NO: 7972417 - DNA, 22 bp, Homo sapiens
cagaagttagacttcaactaat

SEQ ID NO: 7972418 - DNA, 22 bp, Homo sapiens
gggaggtgaaaggtcatgtgtg

SEQ ID NO: 7972419 - DNA, 22 bp, Homo sapiens
gggaggtgaaaggttgctgcag

SEQ ID NO: 7972420 - DNA, 22 bp, Homo sapiens
cagacaggctagccagactcac

SEQ ID NO: 7972421 - DNA, 22 bp, Homo sapiens
cagacaggctagccagactcac

SEQ ID NO: 7972422 - DNA, 22 bp, Homo sapiens
cagacaggctagccagactcac

SEQ ID NO: 7972423 - DNA, 22 bp, Homo sapiens
gggaggtgaaaggtcatgtgtg

SEQ ID NO: 7972424 - DNA, 22 bp, Homo sapiens
gggaggtgaaaggtcatgtgtg

SEQ ID NO: 7972425 - DNA, 22 bp, Homo sapiens
gggaggtcagggtgcctgctgg

SEQ ID NO: 7972426 - DNA, 22 bp, Homo sapiens
gggaggtcctaaaggggaccag

SEQ ID NO: 7972427 - DNA, 22 bp, Homo sapiens
gggaggtagcaagcctgcagct

SEQ ID NO: 7972428 - DNA, 22 bp, Homo sapiens
gggaggtcagggtgcctgctgg

SEQ ID NO: 7972429 - DNA, 22 bp, Homo sapiens
gggaggtaaagatgagctcagt

SEQ ID NO: 7972430 - DNA, 22 bp, Homo sapiens
gggaggtaaagatgagctcagt

SEQ ID NO: 7972431 - DNA, 22 bp, Homo sapiens
gggaggtagcaagcctgcagct

SEQ ID NO: 7972432 - DNA, 22 bp, Homo sapiens
gggaggtagcaagcctgcagct

SEQ ID NO: 7972433 - DNA, 22 bp, Homo sapiens
gggagggtgttctcccaagaac

SEQ ID NO: 7972434 - DNA, 22 bp, Homo sapiens
gggagggtgttctcccaagaac

SEQ ID NO: 7972435 - DNA, 22 bp, Homo sapiens
gggagggtctgagagctgcacc

SEQ ID NO: 7972436 - DNA, 22 bp, Homo sapiens
gggagggtctgagagctgcacc

SEQ ID NO: 7972437 - DNA, 22 bp, Homo sapiens
gggagggtctgagagctgcacc

SEQ ID NO: 7972438 - DNA, 22 bp, Homo sapiens
gggagggtctgccatgctccct

SEQ ID NO: 7972439 - DNA, 22 bp, Homo sapiens
gggagggtctgagagctgcacc

SEQ ID NO: 7972440 - DNA, 20 bp, Homo sapiens
gggaggccagcctcagagaa

SEQ ID NO: 7972441 - DNA, 22 bp, Homo sapiens
gggagcagttaaaatgattcct

SEQ ID NO: 7972442 - DNA, 22 bp, Homo sapiens
gggagcagttaaaatgattcct

SEQ ID NO: 7972443 - DNA, 22 bp, Homo sapiens
gggagcagttaaaatgattcct

SEQ ID NO: 7972444 - DNA, 22 bp, Homo sapiens
gggagcagttaaaatgattcct

SEQ ID NO: 7972445 - DNA, 22 bp, Homo sapiens
gggagcaggagcctgcctgcca

SEQ ID NO: 7972446 - DNA, 22 bp, Homo sapiens
gggagcagttaaaatgattcct

SEQ ID NO: 7972447 - DNA, 22 bp, Homo sapiens
gggagcagttaaaatgattcct

SEQ ID NO: 7972448 - DNA, 20 bp, Homo sapiens
gggaggccccagagtccagg

SEQ ID NO: 7972449 - DNA, 20 bp, Homo sapiens
gggaggccccagagtccagg

SEQ ID NO: 7972450 - DNA, 20 bp, Homo sapiens
gggaggccccagagtccagg

SEQ ID NO: 7972451 - DNA, 20 bp, Homo sapiens
gggaggccagcctcagagaa

SEQ ID NO: 7972452 - DNA, 20 bp, Homo sapiens
gggaggccagcctcagagaa

SEQ ID NO: 7972453 - DNA, 20 bp, Homo sapiens
gggaggccagcctcagagaa

SEQ ID NO: 7972454 - DNA, 20 bp, Homo sapiens
gggaggccagcctcagagaa

SEQ ID NO: 7972455 - DNA, 20 bp, Homo sapiens
gggaggccagcctcagagaa

SEQ ID NO: 7972456 - DNA, 22 bp, Homo sapiens
gggagggccagtgctctctaga

SEQ ID NO: 7972457 - DNA, 22 bp, Homo sapiens
gggagggccagtgctctctaga

SEQ ID NO: 7972458 - DNA, 22 bp, Homo sapiens
gggaggggttgcatgtttgagt

SEQ ID NO: 7972459 - DNA, 22 bp, Homo sapiens
gggaggggttgcatgtttgagt

SEQ ID NO: 7972460 - DNA, 22 bp, Homo sapiens
gggaggggttgcatgtttgagt

SEQ ID NO: 7972461 - DNA, 22 bp, Homo sapiens
gggaggggttgcatgtttgagt

SEQ ID NO: 7972462 - DNA, 22 bp, Homo sapiens
gggaggggttgcatgtttgagt

SEQ ID NO: 7972463 - DNA, 22 bp, Homo sapiens
gggagggcttggacccagatgt

SEQ ID NO: 7972464 - DNA, 22 bp, Homo sapiens
gggagggccagtgctctctaga

SEQ ID NO: 7972465 - DNA, 22 bp, Homo sapiens
gggagggcttggacccagatgt

SEQ ID NO: 7972466 - DNA, 22 bp, Homo sapiens
gggcaagtaactctcgtgcggg

SEQ ID NO: 7972467 - DNA, 22 bp, Homo sapiens
gggcaagtgtcaagcatgtcat

SEQ ID NO: 7972468 - DNA, 22 bp, Homo sapiens
gggcaagtgttttgtctgcctg

SEQ ID NO: 7972469 - DNA, 22 bp, Homo sapiens
gggcaatggatgtgatgactcc

SEQ ID NO: 7972470 - DNA, 22 bp, Homo sapiens
gggcaatgggcttttctgtaag

SEQ ID NO: 7972471 - DNA, 22 bp, Homo sapiens
gggcaatgctatgaagagctaa

SEQ ID NO: 7972472 - DNA, 22 bp, Homo sapiens
gggcaatggatgtgatgactcc

SEQ ID NO: 7972473 - DNA, 22 bp, Homo sapiens
gggcaatgctatgaagagctaa

SEQ ID NO: 7972474 - DNA, 22 bp, Homo sapiens
gggcacaccttgtctgagcaca

SEQ ID NO: 7972475 - DNA, 22 bp, Homo sapiens
gggcacagaagtctaagacatc

SEQ ID NO: 7972476 - DNA, 22 bp, Homo sapiens
gggcaatgtggcaaaaccctgt

SEQ ID NO: 7972477 - DNA, 22 bp, Homo sapiens
gggcacaaaatttcagaaagct

SEQ ID NO: 7972478 - DNA, 22 bp, Homo sapiens
gggcaaggcagaagagttggag

SEQ ID NO: 7972479 - DNA, 22 bp, Homo sapiens
gggcaaggcagaagagttggag

SEQ ID NO: 7972480 - DNA, 22 bp, Homo sapiens
gggcaaggcagaagagttggag

SEQ ID NO: 7972481 - DNA, 22 bp, Homo sapiens
gggcaaggcagaagagttggag

SEQ ID NO: 7972482 - DNA, 20 bp, Homo sapiens
gggcaaggaaacagccccca

SEQ ID NO: 7972483 - DNA, 22 bp, Homo sapiens
gggcaagctcttcagaagctct

SEQ ID NO: 7972484 - DNA, 22 bp, Homo sapiens
cagacagggacctcgctccaga

SEQ ID NO: 7972485 - DNA, 22 bp, Homo sapiens
cagacagggacctcgctccaga

SEQ ID NO: 7972486 - DNA, 22 bp, Homo sapiens
cagacagggacctcgctccaga

SEQ ID NO: 7972487 - DNA, 22 bp, Homo sapiens
cagacagggacctcgctccaga

SEQ ID NO: 7972488 - DNA, 22 bp, Homo sapiens
cagacagggccctgtgatggta

SEQ ID NO: 7972489 - DNA, 22 bp, Homo sapiens
cagacaggctagccagactcac

SEQ ID NO: 7972490 - DNA, 17 bp, Homo sapiens
cagacaggctgtcaccc

SEQ ID NO: 7972491 - DNA, 17 bp, Homo sapiens
cagacaggctgtcaccc

SEQ ID NO: 7972492 - DNA, 17 bp, Homo sapiens
cagacaggctgtcaccc

SEQ ID NO: 7972493 - DNA, 17 bp, Homo sapiens
cagacaggctgtcaccc

SEQ ID NO: 7972494 - DNA, 17 bp, Homo sapiens
cagacaggctgtcaccc

SEQ ID NO: 7972495 - DNA, 20 bp, Homo sapiens
gggatgagagtcctagctct

SEQ ID NO: 7972496 - DNA, 20 bp, Homo sapiens
gggatgagagtcctagctct

SEQ ID NO: 7972497 - DNA, 22 bp, Homo sapiens
cagacagggtcctgtccgtcac

SEQ ID NO: 7972498 - DNA, 22 bp, Homo sapiens
gggatgagagtagggtgtgaaa

SEQ ID NO: 7972499 - DNA, 22 bp, Homo sapiens
cagacagggccctgtgatggta

SEQ ID NO: 7972500 - DNA, 22 bp, Homo sapiens
cagacagggccctgtgatggta

SEQ ID NO: 7972501 - DNA, 22 bp, Homo sapiens
cagacagggccctgtgatggta

SEQ ID NO: 7972502 - DNA, 22 bp, Homo sapiens
cagacagggccctgtgatggta

SEQ ID NO: 7972503 - DNA, 22 bp, Homo sapiens
cagacagggccctgtgatggta

SEQ ID NO: 7972504 - DNA, 22 bp, Homo sapiens
cagacagggccctgtgatggta

SEQ ID NO: 7972505 - DNA, 22 bp, Homo sapiens
cagacaggggtaaccttcctca

SEQ ID NO: 7972506 - DNA, 22 bp, Homo sapiens
gggaaactgtccagttctcccc

SEQ ID NO: 7972507 - DNA, 22 bp, Homo sapiens
gggaaactgtccagttctcccc

SEQ ID NO: 7972508 - DNA, 22 bp, Homo sapiens
gggaaactggggactgaatctg

SEQ ID NO: 7972509 - DNA, 21 bp, Homo sapiens
gggaaactctgcttaacagag

SEQ ID NO: 7972510 - DNA, 22 bp, Homo sapiens
gggaaactgcaactcagagagg

SEQ ID NO: 7972511 - DNA, 22 bp, Homo sapiens
gggaaactgaattcaggactct

SEQ ID NO: 7972512 - DNA, 22 bp, Homo sapiens
gggaaactttcacaatgtccag

SEQ ID NO: 7972513 - DNA, 22 bp, Homo sapiens
gggaaagaagaagagccatttt

SEQ ID NO: 7972514 - DNA, 22 bp, Homo sapiens
gggaaacttctgctaaaaccag

SEQ ID NO: 7972515 - DNA, 22 bp, Homo sapiens
gggaaagaagatctagatactg

SEQ ID NO: 7972516 - DNA, 22 bp, Homo sapiens
gggaaagaagaagagccatttt

SEQ ID NO: 7972517 - DNA, 22 bp, Homo sapiens
gggaaagaccctgagtcttatt

SEQ ID NO: 7972518 - DNA, 22 bp, Homo sapiens
gggaaagaagatctagatactg

SEQ ID NO: 7972519 - DNA, 22 bp, Homo sapiens
gggaaagagaggtggacgcagg

SEQ ID NO: 7972520 - DNA, 22 bp, Homo sapiens
gggaaagagaggtggacgcagg

SEQ ID NO: 7972521 - DNA, 22 bp, Homo sapiens
gggaaagacttattttgacttc

SEQ ID NO: 7972522 - DNA, 22 bp, Homo sapiens
gggaaagacttattttgacttc

SEQ ID NO: 7972523 - DNA, 22 bp, Homo sapiens
gggaaagaccttcctggggtgt

SEQ ID NO: 7972524 - DNA, 22 bp, Homo sapiens
gggaaagagaggtggacgcagg

SEQ ID NO: 7972525 - DNA, 22 bp, Homo sapiens
gggaaagagaggtggacgcagg

SEQ ID NO: 7972526 - DNA, 22 bp, Homo sapiens
gggaaagagtgcttgtccagag

SEQ ID NO: 7972527 - DNA, 22 bp, Homo sapiens
gggaaagagaggtggacgcagg

SEQ ID NO: 7972528 - DNA, 22 bp, Homo sapiens
cagaagtctttctgtttcacct

SEQ ID NO: 7972529 - DNA, 22 bp, Homo sapiens
cagaagtctttctgtttcacct

SEQ ID NO: 7972530 - DNA, 22 bp, Homo sapiens
cagaagtcaccctcagaataac

SEQ ID NO: 7972531 - DNA, 18 bp, Homo sapiens
cagaagtccttcaaggcc

SEQ ID NO: 7972532 - DNA, 22 bp, Homo sapiens
ggcttttgctgtgttttccaga

SEQ ID NO: 7972533 - DNA, 22 bp, Homo sapiens
ggcttttgaattccaaggcatt

SEQ ID NO: 7972534 - DNA, 22 bp, Homo sapiens
gggaaaaataatgcacagatat

SEQ ID NO: 7972535 - DNA, 22 bp, Homo sapiens
gggaaaaataatgcacagatat

SEQ ID NO: 7972536 - DNA, 22 bp, Homo sapiens
gggaaactcaggcatttccact

SEQ ID NO: 7972537 - DNA, 22 bp, Homo sapiens
gggaaactcacaggtgcagggg

SEQ ID NO: 7972538 - DNA, 22 bp, Homo sapiens
gggaaactagaagcagggttat

SEQ ID NO: 7972539 - DNA, 22 bp, Homo sapiens
gggaaactagaagcagggttat

SEQ ID NO: 7972540 - DNA, 22 bp, Homo sapiens
gggaaacaacaaagtatctatg

SEQ ID NO: 7972541 - DNA, 22 bp, Homo sapiens
cagaagtcaccctcagaataac

SEQ ID NO: 7972542 - DNA, 22 bp, Homo sapiens
cagaagtaatgatgtcattcct

SEQ ID NO: 7972543 - DNA, 22 bp, Homo sapiens
cagaagtaagattactgtgagt

SEQ ID NO: 7972544 - DNA, 21 bp, Homo sapiens
cagaagtaagggtaacttctc

SEQ ID NO: 7972545 - DNA, 22 bp, Homo sapiens
cagaagtaagattactgtgaga

SEQ ID NO: 7972546 - DNA, 22 bp, Homo sapiens
cagaagtaagattactgtgaga

SEQ ID NO: 7972547 - DNA, 22 bp, Homo sapiens
cagaagtaagattactgtgagt

SEQ ID NO: 7972548 - DNA, 22 bp, Homo sapiens
cagaaggtttgaaagatgtctt

SEQ ID NO: 7972549 - DNA, 22 bp, Homo sapiens
cagaaggtttgaaagatgtctt

SEQ ID NO: 7972550 - DNA, 22 bp, Homo sapiens
cactggcccataaaggcctggg

SEQ ID NO: 7972551 - DNA, 22 bp, Homo sapiens
cactggcccagccaggcctgtt

SEQ ID NO: 7972552 - DNA, 22 bp, Homo sapiens
cactggcccagccaggcctgtt

SEQ ID NO: 7972553 - DNA, 22 bp, Homo sapiens
cactggcccagccaggcctgtt

SEQ ID NO: 7972554 - DNA, 22 bp, Homo sapiens
cactggcccagccaggcctgtt

SEQ ID NO: 7972555 - DNA, 22 bp, Homo sapiens
cactggcccataaaggcctggg

SEQ ID NO: 7972556 - DNA, 22 bp, Homo sapiens
cactggcccataaaggcctggg

SEQ ID NO: 7972557 - DNA, 22 bp, Homo sapiens
cactggcccagccaggcctgtt

SEQ ID NO: 7972558 - DNA, 22 bp, Homo sapiens
cactggcccataaaggcctggg

SEQ ID NO: 7972559 - DNA, 22 bp, Homo sapiens
cactggcccattcctgtctggc

SEQ ID NO: 7972560 - DNA, 22 bp, Homo sapiens
cactggcctaagcgcctcagcc

SEQ ID NO: 7972561 - DNA, 22 bp, Homo sapiens
cactggcctaagcgcctcagcc

SEQ ID NO: 7972562 - DNA, 22 bp, Homo sapiens
cactggcctaagcgcctcagcc

SEQ ID NO: 7972563 - DNA, 22 bp, Homo sapiens
cactggcctaagcgcctcagcc

SEQ ID NO: 7972564 - DNA, 22 bp, Homo sapiens
cactggcccataaaggcctggg

SEQ ID NO: 7972565 - DNA, 22 bp, Homo sapiens
cactggctaaaaaagaggcaga

SEQ ID NO: 7972566 - DNA, 22 bp, Homo sapiens
cactggctaaaaaagaggcaga

SEQ ID NO: 7972567 - DNA, 22 bp, Homo sapiens
cactggctaaaaaagaggcaga

SEQ ID NO: 7972568 - DNA, 22 bp, Homo sapiens
cactggctaaagataagctcaa

SEQ ID NO: 7972569 - DNA, 22 bp, Homo sapiens
cactggctaaagataagctcaa

SEQ ID NO: 7972570 - DNA, 22 bp, Homo sapiens
cactggctgggccagcactcct

SEQ ID NO: 7972571 - DNA, 22 bp, Homo sapiens
cactggctgggccagcactcct

SEQ ID NO: 7972572 - DNA, 22 bp, Homo sapiens
cactggctgagcttctctaggg

SEQ ID NO: 7972573 - DNA, 22 bp, Homo sapiens
cactggctgagcttctctaggg

SEQ ID NO: 7972574 - DNA, 22 bp, Homo sapiens
cactggctgagcttctctaggg

SEQ ID NO: 7972575 - DNA, 22 bp, Homo sapiens
cactggctatgagggagatggg

SEQ ID NO: 7972576 - DNA, 22 bp, Homo sapiens
cactggctatgagggagatggg

SEQ ID NO: 7972577 - DNA, 22 bp, Homo sapiens
cactggctaaagataagctcaa

SEQ ID NO: 7972578 - DNA, 22 bp, Homo sapiens
cactggctccctgatttgaagc

SEQ ID NO: 7972579 - DNA, 22 bp, Homo sapiens
cactggctgagcttctctaggg

SEQ ID NO: 7972580 - DNA, 22 bp, Homo sapiens
cactggctatgagggagatggg

SEQ ID NO: 7972581 - DNA, 22 bp, Homo sapiens
cactggctatgagggagatggg

SEQ ID NO: 7972582 - DNA, 22 bp, Homo sapiens
cactgggaatctgggaaagaga

SEQ ID NO: 7972583 - DNA, 22 bp, Homo sapiens
cactgggaatctgggaaagaga

SEQ ID NO: 7972584 - DNA, 22 bp, Homo sapiens
cactggctgggccagcactcct

SEQ ID NO: 7972585 - DNA, 22 bp, Homo sapiens
cactggcttgatgggtaatgcc

SEQ ID NO: 7972586 - DNA, 22 bp, Homo sapiens
cactggcttgatgggtaatgcc

SEQ ID NO: 7972587 - DNA, 22 bp, Homo sapiens
cactgggacctaggactgagct

SEQ ID NO: 7972588 - DNA, 22 bp, Homo sapiens
cactgggacctaggactgagct

SEQ ID NO: 7972589 - DNA, 22 bp, Homo sapiens
cactgggacctaggactgagct

SEQ ID NO: 7972590 - DNA, 22 bp, Homo sapiens
cagaagcagtgagagatgtgca

SEQ ID NO: 7972591 - DNA, 22 bp, Homo sapiens
cagaagcagtgagagatgtgca

SEQ ID NO: 7972592 - DNA, 22 bp, Homo sapiens
cactgggagagctggacttggg

SEQ ID NO: 7972593 - DNA, 22 bp, Homo sapiens
cagaagcagtgagagatgtgca

SEQ ID NO: 7972594 - DNA, 22 bp, Homo sapiens
cagaagcagtgagagatgtgca

SEQ ID NO: 7972595 - DNA, 22 bp, Homo sapiens
cagaaggcaaacaaaaggattt

SEQ ID NO: 7972596 - DNA, 22 bp, Homo sapiens
cagaaggcaaacaaaaggattt

SEQ ID NO: 7972597 - DNA, 22 bp, Homo sapiens
cagaaggcatagatgaaggcct

SEQ ID NO: 7972598 - DNA, 22 bp, Homo sapiens
cagaaggcatagatgaaggcct

SEQ ID NO: 7972599 - DNA, 22 bp, Homo sapiens
cagaaggcatagatgaaggcct

SEQ ID NO: 7972600 - DNA, 22 bp, Homo sapiens
cagaaggcatagatgaaggcct

SEQ ID NO: 7972601 - DNA, 22 bp, Homo sapiens
cagaaggcaaggcctgccacgc

SEQ ID NO: 7972602 - DNA, 22 bp, Homo sapiens
cagaaggcaaggcctgccacgc

SEQ ID NO: 7972603 - DNA, 22 bp, Homo sapiens
cagaaggcagcaaatgaaaacc

SEQ ID NO: 7972604 - DNA, 22 bp, Homo sapiens
cagaaggcagcaaatgaaaacc

SEQ ID NO: 7972605 - DNA, 22 bp, Homo sapiens
cagaagggcagcactgggaagg

SEQ ID NO: 7972606 - DNA, 22 bp, Homo sapiens
cagaagggcagcactgggaagg

SEQ ID NO: 7972607 - DNA, 22 bp, Homo sapiens
cagaagggcagcactgggaagg

SEQ ID NO: 7972608 - DNA, 22 bp, Homo sapiens
cagaagggacagggtttgtaga

SEQ ID NO: 7972609 - DNA, 22 bp, Homo sapiens
cagaagggacagggtttgtaga

SEQ ID NO: 7972610 - DNA, 22 bp, Homo sapiens
cagaagggacagggtttgtaga

SEQ ID NO: 7972611 - DNA, 22 bp, Homo sapiens
cagaaggctttgtggagtagac

SEQ ID NO: 7972612 - DNA, 22 bp, Homo sapiens
cagaaggctttgtggagtagac

SEQ ID NO: 7972613 - DNA, 22 bp, Homo sapiens
cagaaggctttgtggagtagac

SEQ ID NO: 7972614 - DNA, 22 bp, Homo sapiens
cagaaggctttgtggagtagac

SEQ ID NO: 7972615 - DNA, 22 bp, Homo sapiens
cagaaggctgcaggtttgctgt

SEQ ID NO: 7972616 - DNA, 22 bp, Homo sapiens
cagaaggcctgaatctttgttc

SEQ ID NO: 7972617 - DNA, 22 bp, Homo sapiens
cagaaggcctgaatctttgttc

SEQ ID NO: 7972618 - DNA, 22 bp, Homo sapiens
cagaaggcatagatgaaggcct

SEQ ID NO: 7972619 - DNA, 22 bp, Homo sapiens
cagaaggctttgtggagtagac

SEQ ID NO: 7972620 - DNA, 22 bp, Homo sapiens
cagaaggctggcagattgagat

SEQ ID NO: 7972621 - DNA, 22 bp, Homo sapiens
cagaaggctggcagattgagat

SEQ ID NO: 7972622 - DNA, 22 bp, Homo sapiens
cagaaggctggcagattgagat

SEQ ID NO: 7972623 - DNA, 22 bp, Homo sapiens
gggacagaaggaagtgagcaca

SEQ ID NO: 7972624 - DNA, 22 bp, Homo sapiens
gggacagaaggaagtgagcaca

SEQ ID NO: 7972625 - DNA, 22 bp, Homo sapiens
gggacagaaggaagtgagcaca

SEQ ID NO: 7972626 - DNA, 22 bp, Homo sapiens
gggacagaaggaagtgagcaca

SEQ ID NO: 7972627 - DNA, 22 bp, Homo sapiens
gggacacagccatctgtgtttt

SEQ ID NO: 7972628 - DNA, 22 bp, Homo sapiens
gggacacaggtatctcaaatga

SEQ ID NO: 7972629 - DNA, 22 bp, Homo sapiens
gggacacaggtatctcaaatga

SEQ ID NO: 7972630 - DNA, 21 bp, Homo sapiens
gggacaccaactccagggctt

SEQ ID NO: 7972631 - DNA, 22 bp, Homo sapiens
gggacactggacccagtgtcca

SEQ ID NO: 7972632 - DNA, 22 bp, Homo sapiens
gggacactggacccagtgtcca

SEQ ID NO: 7972633 - DNA, 21 bp, Homo sapiens
gggacaccaactccagggctt

SEQ ID NO: 7972634 - DNA, 22 bp, Homo sapiens
gggacagacccatgggccaggt

SEQ ID NO: 7972635 - DNA, 22 bp, Homo sapiens
gggacagacccatgggccaggt

SEQ ID NO: 7972636 - DNA, 22 bp, Homo sapiens
gggacagacccatgggccaggt

SEQ ID NO: 7972637 - DNA, 22 bp, Homo sapiens
gggacagacccatgggccaggt

SEQ ID NO: 7972638 - DNA, 22 bp, Homo sapiens
gggacagacccatgggccaggt

SEQ ID NO: 7972639 - DNA, 22 bp, Homo sapiens
gggacagaggcaaactagcaga

SEQ ID NO: 7972640 - DNA, 22 bp, Homo sapiens
gggacagaggcaaactagcaga

SEQ ID NO: 7972641 - DNA, 22 bp, Homo sapiens
gggacagcagaaagaaggcaag

SEQ ID NO: 7972642 - DNA, 22 bp, Homo sapiens
gggactcctgcatttcaagtcc

SEQ ID NO: 7972643 - DNA, 22 bp, Homo sapiens
gggactcctttaaggagggtga

SEQ ID NO: 7972644 - DNA, 22 bp, Homo sapiens
gggactggaactactggtgcag

SEQ ID NO: 7972645 - DNA, 22 bp, Homo sapiens
gggactggaactactggtgcag

SEQ ID NO: 7972646 - DNA, 22 bp, Homo sapiens
gggactggaactactggtgcag

SEQ ID NO: 7972647 - DNA, 22 bp, Homo sapiens
gggactggaactactggtgcag

SEQ ID NO: 7972648 - DNA, 22 bp, Homo sapiens
gggactggaactactggtgcag

SEQ ID NO: 7972649 - DNA, 22 bp, Homo sapiens
gggactggaactactggtgcag

SEQ ID NO: 7972650 - DNA, 22 bp, Homo sapiens
gggactctgagagcctgagggt

SEQ ID NO: 7972651 - DNA, 19 bp, Homo sapiens
gggactggaggatgtggag

SEQ ID NO: 7972652 - DNA, 19 bp, Homo sapiens
gggactggaggatgtggag

SEQ ID NO: 7972653 - DNA, 19 bp, Homo sapiens
gggactggaggatgtggag

SEQ ID NO: 7972654 - DNA, 19 bp, Homo sapiens
gggactggaggatgtggag

SEQ ID NO: 7972655 - DNA, 22 bp, Homo sapiens
gggactggagtagaggccggtg

SEQ ID NO: 7972656 - DNA, 22 bp, Homo sapiens
gggactggatagatgtgggtga

SEQ ID NO: 7972657 - DNA, 22 bp, Homo sapiens
gggactggagtagaggccggtg

SEQ ID NO: 7972658 - DNA, 22 bp, Homo sapiens
gggactggatagatgtgggtga

SEQ ID NO: 7972659 - DNA, 22 bp, Homo sapiens
gggactggcacagggctgggag

SEQ ID NO: 7972660 - DNA, 22 bp, Homo sapiens
gggactggcacagggctgggag

SEQ ID NO: 7972661 - DNA, 22 bp, Homo sapiens
gggactggccagggtttggaat

SEQ ID NO: 7972662 - DNA, 22 bp, Homo sapiens
gggactggccagggtttggaat

SEQ ID NO: 7972663 - DNA, 22 bp, Homo sapiens
gggactgggagatcctcctggc

SEQ ID NO: 7972664 - DNA, 22 bp, Homo sapiens
gggactggccagggtttggaat

SEQ ID NO: 7972665 - DNA, 22 bp, Homo sapiens
gggactgggagatcctcctggc

SEQ ID NO: 7972666 - DNA, 22 bp, Homo sapiens
gggactggcacagggctgggag

SEQ ID NO: 7972667 - DNA, 22 bp, Homo sapiens
gggactggcacagggctgggag

SEQ ID NO: 7972668 - DNA, 22 bp, Homo sapiens
gggactggcacagggctgggag

SEQ ID NO: 7972669 - DNA, 23 bp, Homo sapiens
gggaaaggatatgatcctagggg

SEQ ID NO: 7972670 - DNA, 22 bp, Homo sapiens
gggaaagagtgcttgtccagag

SEQ ID NO: 7972671 - DNA, 23 bp, Homo sapiens
gggaaaggatatgatcctagggg

SEQ ID NO: 7972672 - DNA, 22 bp, Homo sapiens
gggaaaggatcagtgggaggct

SEQ ID NO: 7972673 - DNA, 18 bp, Homo sapiens
gggaagccgggaagccgg

SEQ ID NO: 7972674 - DNA, 23 bp, Homo sapiens
gggaagctccatggaggtgctgg

SEQ ID NO: 7972675 - DNA, 22 bp, Homo sapiens
gggaagctgaagctagagaaaa

SEQ ID NO: 7972676 - DNA, 23 bp, Homo sapiens
gggaagctccatggaggtgctgg

SEQ ID NO: 7972677 - DNA, 23 bp, Homo sapiens
gggaagctccatggaggtgctgg

SEQ ID NO: 7972678 - DNA, 23 bp, Homo sapiens
gggaagctccatggaggtgctgg

SEQ ID NO: 7972679 - DNA, 22 bp, Homo sapiens
gggaagctgcgtggtctagggc

SEQ ID NO: 7972680 - DNA, 22 bp, Homo sapiens
gggaaggaaagttattagcaga

SEQ ID NO: 7972681 - DNA, 22 bp, Homo sapiens
gggaaggaaagttattagcaga

SEQ ID NO: 7972682 - DNA, 22 bp, Homo sapiens
gggaaggaaagttattagcaga

SEQ ID NO: 7972683 - DNA, 22 bp, Homo sapiens
gggaaggaaagttattagcaga

SEQ ID NO: 7972684 - DNA, 22 bp, Homo sapiens
gggaaggaaagttattagcaga

SEQ ID NO: 7972685 - DNA, 22 bp, Homo sapiens
gggaaggaaagttattagcaga

SEQ ID NO: 7972686 - DNA, 22 bp, Homo sapiens
gggaaggaaatcttgcttgtga

SEQ ID NO: 7972687 - DNA, 22 bp, Homo sapiens
gggaaggacacagccatgactg

SEQ ID NO: 7972688 - DNA, 22 bp, Homo sapiens
gggaaggacacagccatgactg

SEQ ID NO: 7972689 - DNA, 22 bp, Homo sapiens
gggaaggacacagccatgactg

SEQ ID NO: 7972690 - DNA, 22 bp, Homo sapiens
gggaaggacacagccatgactg

SEQ ID NO: 7972691 - DNA, 22 bp, Homo sapiens
gggaaggacacagccatgactg

SEQ ID NO: 7972692 - DNA, 22 bp, Homo sapiens
gggaaggacacagccatgactg

SEQ ID NO: 7972693 - DNA, 22 bp, Homo sapiens
gggaaggacattctgggctcag

SEQ ID NO: 7972694 - DNA, 22 bp, Homo sapiens
gggaaggacattctgggctcag

SEQ ID NO: 7972695 - DNA, 22 bp, Homo sapiens
gggacacagagaaactggagaa

SEQ ID NO: 7972696 - DNA, 22 bp, Homo sapiens
gggacaatggaggcctctctcc

SEQ ID NO: 7972697 - DNA, 22 bp, Homo sapiens
gggacaatggaggcctctctcc

SEQ ID NO: 7972698 - DNA, 22 bp, Homo sapiens
gggacaatggaggcctctctcc

SEQ ID NO: 7972699 - DNA, 22 bp, Homo sapiens
gggacaatggaggcctctctcc

SEQ ID NO: 7972700 - DNA, 22 bp, Homo sapiens
gggacaaccaacttagcattac

SEQ ID NO: 7972701 - DNA, 22 bp, Homo sapiens
gggaatgtggcaggcagcagtt

SEQ ID NO: 7972702 - DNA, 22 bp, Homo sapiens
gggaatgtggccctggggctcc

SEQ ID NO: 7972703 - DNA, 22 bp, Homo sapiens
gggaatgtggtgatagtctata

SEQ ID NO: 7972704 - DNA, 22 bp, Homo sapiens
gggaatgtgtctgatggaaaga

SEQ ID NO: 7972705 - DNA, 16 bp, Homo sapiens
gggaatgtgtcttctc

SEQ ID NO: 7972706 - DNA, 22 bp, Homo sapiens
gggaatgttgactgagagcagg

SEQ ID NO: 7972707 - DNA, 15 bp, Homo sapiens
gggaatgttttacaa

SEQ ID NO: 7972708 - DNA, 22 bp, Homo sapiens
gggaaggaggtggacctgcccc

SEQ ID NO: 7972709 - DNA, 22 bp, Homo sapiens
gggaaggaggtggacctgcccc

SEQ ID NO: 7972710 - DNA, 22 bp, Homo sapiens
gggaaggaggtggacctgcccc

SEQ ID NO: 7972711 - DNA, 22 bp, Homo sapiens
gggaaggaggtggcttgaagtg

SEQ ID NO: 7972712 - DNA, 22 bp, Homo sapiens
gggaaggaggtggacctgcccc

SEQ ID NO: 7972713 - DNA, 22 bp, Homo sapiens
gggaaggaggtggcttgaagtg

SEQ ID NO: 7972714 - DNA, 22 bp, Homo sapiens
gggaaggacattctgggctcag

SEQ ID NO: 7972715 - DNA, 22 bp, Homo sapiens
gggaaggacattctgggctcag

SEQ ID NO: 7972716 - DNA, 22 bp, Homo sapiens
gggaaggagcctgcttgctaga

SEQ ID NO: 7972717 - DNA, 22 bp, Homo sapiens
gggaaggagcctgcttgctaga

SEQ ID NO: 7972718 - DNA, 22 bp, Homo sapiens
cgggttcacgccattctcctgc

SEQ ID NO: 7972719 - DNA, 22 bp, Homo sapiens
cgggttcacgccattctcctgc

SEQ ID NO: 7972720 - DNA, 22 bp, Homo sapiens
cgggttcacgccattctcctgc

SEQ ID NO: 7972721 - DNA, 22 bp, Homo sapiens
cgggttcacgccattctcctgc

SEQ ID NO: 7972722 - DNA, 22 bp, Homo sapiens
cgggtggttttcatcaagatgg

SEQ ID NO: 7972723 - DNA, 22 bp, Homo sapiens
cgggtcccctcgggaggctgct

SEQ ID NO: 7972724 - DNA, 22 bp, Homo sapiens
cgggttcacgccattctcctgc

SEQ ID NO: 7972725 - DNA, 22 bp, Homo sapiens
cgggttcacgccattctcctgc

SEQ ID NO: 7972726 - DNA, 22 bp, Homo sapiens
cgggttcacgccattctcctgc

SEQ ID NO: 7972727 - DNA, 22 bp, Homo sapiens
cgggttcacgccattctcctgc

SEQ ID NO: 7972728 - DNA, 22 bp, Homo sapiens
cgggttcacgccattctcctgc

SEQ ID NO: 7972729 - DNA, 22 bp, Homo sapiens
cgggttcacgccattctcctgc

SEQ ID NO: 7972730 - DNA, 22 bp, Homo sapiens
cggggttcatccatgctgtggc

SEQ ID NO: 7972731 - DNA, 22 bp, Homo sapiens
cgggtaggaacaaagagctgca

SEQ ID NO: 7972732 - DNA, 22 bp, Homo sapiens
cgggtaggaacaaagagctgca

SEQ ID NO: 7972733 - DNA, 22 bp, Homo sapiens
cggggttcatccatgctgtggc

SEQ ID NO: 7972734 - DNA, 22 bp, Homo sapiens
cggggtgggaatagacctgtct

SEQ ID NO: 7972735 - DNA, 22 bp, Homo sapiens
cggggtgggaatagacctgtct

SEQ ID NO: 7972736 - DNA, 22 bp, Homo sapiens
cggggtgggaatagacctgtct

SEQ ID NO: 7972737 - DNA, 22 bp, Homo sapiens
cggggtgggaatagacctgtct

SEQ ID NO: 7972738 - DNA, 22 bp, Homo sapiens
cggggtgggaatagacctgtct

SEQ ID NO: 7972739 - DNA, 22 bp, Homo sapiens
cggggtggcactctaaatagaa

SEQ ID NO: 7972740 - DNA, 22 bp, Homo sapiens
cggggtggcactctaaatagaa

SEQ ID NO: 7972741 - DNA, 22 bp, Homo sapiens
cggggtggcactctaaatagaa

SEQ ID NO: 7972742 - DNA, 21 bp, Homo sapiens
agtatcataatgaatagttct

SEQ ID NO: 7972743 - DNA, 22 bp, Homo sapiens
agtatcaatcaccctttgaagt

SEQ ID NO: 7972744 - DNA, 22 bp, Homo sapiens
agtatcatgttggaattaatca

SEQ ID NO: 7972745 - DNA, 22 bp, Homo sapiens
agtatcatgttggaattaatca

SEQ ID NO: 7972746 - DNA, 22 bp, Homo sapiens
agtatcatctccatttcactga

SEQ ID NO: 7972747 - DNA, 22 bp, Homo sapiens
agtatctttacttaaatagtca

SEQ ID NO: 7972748 - DNA, 22 bp, Homo sapiens
agtatgaaagttaatcaattta

SEQ ID NO: 7972749 - DNA, 22 bp, Homo sapiens
agtatctcaaagtggtttatgg

SEQ ID NO: 7972750 - DNA, 22 bp, Homo sapiens
agtatctgcatgattttgagaa

SEQ ID NO: 7972751 - DNA, 22 bp, Homo sapiens
agtatctgcatgattttgagaa

SEQ ID NO: 7972752 - DNA, 22 bp, Homo sapiens
agtatcattttggcattagtat

SEQ ID NO: 7972753 - DNA, 22 bp, Homo sapiens
agtatcattttggcattagtat

SEQ ID NO: 7972754 - DNA, 22 bp, Homo sapiens
cggggtggcactctaaatagaa

SEQ ID NO: 7972755 - DNA, 22 bp, Homo sapiens
cggggtccctgcccacccatac

SEQ ID NO: 7972756 - DNA, 22 bp, Homo sapiens
cgggggcacccacaaatgagga

SEQ ID NO: 7972757 - DNA, 22 bp, Homo sapiens
cgggggcgtctggtgagaccat

SEQ ID NO: 7972758 - DNA, 22 bp, Homo sapiens
agtatgaacctgggttctggat

SEQ ID NO: 7972759 - DNA, 22 bp, Homo sapiens
agtatgaatctctttattctgc

SEQ ID NO: 7972760 - DNA, 22 bp, Homo sapiens
agtatgaatggaaactacctat

SEQ ID NO: 7972761 - DNA, 22 bp, Homo sapiens
cgggggcacccacaaatgagga

SEQ ID NO: 7972762 - DNA, 22 bp, Homo sapiens
cgggggagttgaggcacatggg

SEQ ID NO: 7972763 - DNA, 22 bp, Homo sapiens
agtatgaagctgaatgatttta

SEQ ID NO: 7972764 - DNA, 22 bp, Homo sapiens
agtatgaagctgaatgatttta

SEQ ID NO: 7972765 - DNA, 22 bp, Homo sapiens
agtatgaagattataatttttc

SEQ ID NO: 7972766 - DNA, 22 bp, Homo sapiens
agtatgaagattataatttttc

SEQ ID NO: 7972767 - DNA, 22 bp, Homo sapiens
agtatgaatctctttattctgc

SEQ ID NO: 7972768 - DNA, 22 bp, Homo sapiens
agtatgaatacagattttctct

SEQ ID NO: 7972769 - DNA, 22 bp, Homo sapiens
agtatgaatacagattttctct

SEQ ID NO: 7972770 - DNA, 22 bp, Homo sapiens
agtatgaagatgatgaaaaata

SEQ ID NO: 7972771 - DNA, 22 bp, Homo sapiens
agtatgaagaatacatagatga

SEQ ID NO: 7972772 - DNA, 22 bp, Homo sapiens
agtatgaagaatacatagatga

SEQ ID NO: 7972773 - DNA, 22 bp, Homo sapiens
agtatgaagaatacatagatga

SEQ ID NO: 7972774 - DNA, 22 bp, Homo sapiens
agtatgaacggaaggcctggga

SEQ ID NO: 7972775 - DNA, 22 bp, Homo sapiens
ctcaagaagagggagacctaca

SEQ ID NO: 7972776 - DNA, 23 bp, Homo sapiens
ctcaaccctagtaagggagtagg

SEQ ID NO: 7972777 - DNA, 23 bp, Homo sapiens
ctcaaccctagtaagggagtagg

SEQ ID NO: 7972778 - DNA, 22 bp, Homo sapiens
ctcaacatttaacagtgaaaaa

SEQ ID NO: 7972779 - DNA, 22 bp, Homo sapiens
ctcaagaaggatgagctattgc

SEQ ID NO: 7972780 - DNA, 22 bp, Homo sapiens
ctcaagaaggatgagctattgc

SEQ ID NO: 7972781 - DNA, 22 bp, Homo sapiens
ctcaagaagagggagacctaca

SEQ ID NO: 7972782 - DNA, 22 bp, Homo sapiens
agtcccagagaggtcggggcca

SEQ ID NO: 7972783 - DNA, 22 bp, Homo sapiens
agtcccagagaggtcggggcca

SEQ ID NO: 7972784 - DNA, 22 bp, Homo sapiens
agtcccagactccagttttctg

SEQ ID NO: 7972785 - DNA, 20 bp, Homo sapiens
agtcccaacattcagctctg

SEQ ID NO: 7972786 - DNA, 20 bp, Homo sapiens
agtcccaacattcagctctg

SEQ ID NO: 7972787 - DNA, 22 bp, Homo sapiens
agtcccaacagcttacaaggaa

SEQ ID NO: 7972788 - DNA, 22 bp, Homo sapiens
ctcaaatatgtggtcagaaagc

SEQ ID NO: 7972789 - DNA, 22 bp, Homo sapiens
ctcaaatatgtggtcagaaagc

SEQ ID NO: 7972790 - DNA, 22 bp, Homo sapiens
ctcaaatatgtggtcagaaagc

SEQ ID NO: 7972791 - DNA, 22 bp, Homo sapiens
ctcaaatatgtggtcagaaagc

SEQ ID NO: 7972792 - DNA, 22 bp, Homo sapiens
ctcaaatccccgttcctcattc

SEQ ID NO: 7972793 - DNA, 22 bp, Homo sapiens
ctcaaatccccgttcctcattc

SEQ ID NO: 7972794 - DNA, 21 bp, Homo sapiens
ctcaaatgccagttttattta

SEQ ID NO: 7972795 - DNA, 21 bp, Homo sapiens
ctcaaatgccagttttattta

SEQ ID NO: 7972796 - DNA, 22 bp, Homo sapiens
ctcaaatgtttccacttctgct

SEQ ID NO: 7972797 - DNA, 22 bp, Homo sapiens
ctcaaatgtttccacttctgct

SEQ ID NO: 7972798 - DNA, 22 bp, Homo sapiens
ctatttatgtgctattttgtat

SEQ ID NO: 7972799 - DNA, 21 bp, Homo sapiens
ctcaaaattctttctgttgga

SEQ ID NO: 7972800 - DNA, 22 bp, Homo sapiens
ctatttatgtccaagtgtttta

SEQ ID NO: 7972801 - DNA, 22 bp, Homo sapiens
cgggttcttaaacgactgggct

SEQ ID NO: 7972802 - DNA, 22 bp, Homo sapiens
ctcaaatagaactgatctataa

SEQ ID NO: 7972803 - DNA, 22 bp, Homo sapiens
ctcaaatagaactgatctataa

SEQ ID NO: 7972804 - DNA, 22 bp, Homo sapiens
ctcaaatacctctccatgtgac

SEQ ID NO: 7972805 - DNA, 22 bp, Homo sapiens
ctcaaatacctctccatgtgac

SEQ ID NO: 7972806 - DNA, 22 bp, Homo sapiens
ctcaaagataatcctatgtctc

SEQ ID NO: 7972807 - DNA, 22 bp, Homo sapiens
ctcaaagagccaggtaatcacc

SEQ ID NO: 7972808 - DNA, 22 bp, Homo sapiens
ctcaaatatgtggtcagaaagc

SEQ ID NO: 7972809 - DNA, 22 bp, Homo sapiens
ctcaaatataagctaaatgtgg

SEQ ID NO: 7972810 - DNA, 22 bp, Homo sapiens
ctcaaatatgtggtcagaaagc

SEQ ID NO: 7972811 - DNA, 22 bp, Homo sapiens
ctcaaatagaactgatctataa

SEQ ID NO: 7972812 - DNA, 22 bp, Homo sapiens
ctcaaatataagctaaatgtgg

SEQ ID NO: 7972813 - DNA, 22 bp, Homo sapiens
ctcaaatagaactgatctataa

SEQ ID NO: 7972814 - DNA, 17 bp, Homo sapiens
ctcagagttgctttgtc

SEQ ID NO: 7972815 - DNA, 22 bp, Homo sapiens
ctcagataatctttgagtcttc

SEQ ID NO: 7972816 - DNA, 22 bp, Homo sapiens
ctcagagtctgcatttctgtca

SEQ ID NO: 7972817 - DNA, 23 bp, Homo sapiens
ctcagaggtgtttttcacttact

SEQ ID NO: 7972818 - DNA, 23 bp, Homo sapiens
ctcagaggtgtttttcacttact

SEQ ID NO: 7972819 - DNA, 22 bp, Homo sapiens
ctcagaggtcaagagcagagct

SEQ ID NO: 7972820 - DNA, 22 bp, Homo sapiens
ctcagaggtcaagagcagagct

SEQ ID NO: 7972821 - DNA, 22 bp, Homo sapiens
ctcagatgtttgatattgttat

SEQ ID NO: 7972822 - DNA, 22 bp, Homo sapiens
ctcagatcatcagaaacaatgt

SEQ ID NO: 7972823 - DNA, 22 bp, Homo sapiens
ctcagatctttcccattttccc

SEQ ID NO: 7972824 - DNA, 22 bp, Homo sapiens
ctcagatgtagaaagattgtga

SEQ ID NO: 7972825 - DNA, 22 bp, Homo sapiens
ctcagcaacacggcctattaag

SEQ ID NO: 7972826 - DNA, 22 bp, Homo sapiens
ctcagattgtttgcctcgcagt

SEQ ID NO: 7972827 - DNA, 22 bp, Homo sapiens
ctcagcaagattaagcagcttg

SEQ ID NO: 7972828 - DNA, 22 bp, Homo sapiens
ctcagcaaccctagaacatttg

SEQ ID NO: 7972829 - DNA, 19 bp, Homo sapiens
ctcagcaagatagaaatgg

SEQ ID NO: 7972830 - DNA, 19 bp, Homo sapiens
ctcagcaagatagaaatgg

SEQ ID NO: 7972831 - DNA, 22 bp, Homo sapiens
ctcagactggagccccaaggac

SEQ ID NO: 7972832 - DNA, 22 bp, Homo sapiens
ctcagactggagccccaaggac

SEQ ID NO: 7972833 - DNA, 22 bp, Homo sapiens
ctcagactaaaatgggaatgta

SEQ ID NO: 7972834 - DNA, 22 bp, Homo sapiens
ctcagactaaaatgggaatgta

SEQ ID NO: 7972835 - DNA, 18 bp, Homo sapiens
ctcagacatgcttctttt

SEQ ID NO: 7972836 - DNA, 22 bp, Homo sapiens
ctcagacatttgtagaaagtgc

SEQ ID NO: 7972837 - DNA, 22 bp, Homo sapiens
ctcagacatttgtagaaagtgc

SEQ ID NO: 7972838 - DNA, 22 bp, Homo sapiens
ctcagacccccagagctgctaa

SEQ ID NO: 7972839 - DNA, 21 bp, Homo sapiens
ctcagaccacagctcacaccc

SEQ ID NO: 7972840 - DNA, 21 bp, Homo sapiens
ctcagaccacagctcacaccc

SEQ ID NO: 7972841 - DNA, 22 bp, Homo sapiens
ctcagagggtctcctccagaat

SEQ ID NO: 7972842 - DNA, 22 bp, Homo sapiens
ctcagagggttgaaggtgctct

SEQ ID NO: 7972843 - DNA, 22 bp, Homo sapiens
ctcagagggtctcctccagaat

SEQ ID NO: 7972844 - DNA, 22 bp, Homo sapiens
ctcagagggtacaggtgaaccc

SEQ ID NO: 7972845 - DNA, 22 bp, Homo sapiens
ctcagactttcagggtaggcca

SEQ ID NO: 7972846 - DNA, 22 bp, Homo sapiens
ctcagaggtcaagagcagagct

SEQ ID NO: 7972847 - DNA, 22 bp, Homo sapiens
ctcagagggtctcctccagaat

SEQ ID NO: 7972848 - DNA, 22 bp, Homo sapiens
ctcagagggttgaaggtgctct

SEQ ID NO: 7972849 - DNA, 22 bp, Homo sapiens
ctcagagggttgaaggtgctct

SEQ ID NO: 7972850 - DNA, 22 bp, Homo sapiens
ctcagaggtcaagagcagagct

SEQ ID NO: 7972851 - DNA, 22 bp, Homo sapiens
ctcagaggtcaagagcagagct

SEQ ID NO: 7972852 - DNA, 22 bp, Homo sapiens
ctcagaaagtgacaggggggtg

SEQ ID NO: 7972853 - DNA, 22 bp, Homo sapiens
ctcagaaatcccactctgtgta

SEQ ID NO: 7972854 - DNA, 22 bp, Homo sapiens
ctcagaaagtgacaggggggtg

SEQ ID NO: 7972855 - DNA, 22 bp, Homo sapiens
ctcagaaatcccactctgtgta

SEQ ID NO: 7972856 - DNA, 22 bp, Homo sapiens
ctcagaaattacaaaagggaca

SEQ ID NO: 7972857 - DNA, 22 bp, Homo sapiens
ctcagaaattacaaaagggaca

SEQ ID NO: 7972858 - DNA, 22 bp, Homo sapiens
ctcagaaattacaaaagggaca

SEQ ID NO: 7972859 - DNA, 22 bp, Homo sapiens
ctcagaaatcccactctgtgta

SEQ ID NO: 7972860 - DNA, 22 bp, Homo sapiens
ctcagaaatcccactctgtgta

SEQ ID NO: 7972861 - DNA, 22 bp, Homo sapiens
ctcagaagaacaaaggctctac

SEQ ID NO: 7972862 - DNA, 22 bp, Homo sapiens
ctcagaagaacaaaggctctac

SEQ ID NO: 7972863 - DNA, 22 bp, Homo sapiens
ctcagaagaatcagcagctatt

SEQ ID NO: 7972864 - DNA, 22 bp, Homo sapiens
ctcagaagaacccagggtccca

SEQ ID NO: 7972865 - DNA, 22 bp, Homo sapiens
ctcagaagaatcagcagctatt

SEQ ID NO: 7972866 - DNA, 22 bp, Homo sapiens
ctcagaagaacaaaggctctac

SEQ ID NO: 7972867 - DNA, 22 bp, Homo sapiens
ctcagaagaacaaaggctctac

SEQ ID NO: 7972868 - DNA, 22 bp, Homo sapiens
ctcagaagaacccagggtccca

SEQ ID NO: 7972869 - DNA, 22 bp, Homo sapiens
ctcagaagttcagcctagagta

SEQ ID NO: 7972870 - DNA, 22 bp, Homo sapiens
ctcagaagctctgctcctttgc

SEQ ID NO: 7972871 - DNA, 22 bp, Homo sapiens
ctcagaagttcagcctagagta

SEQ ID NO: 7972872 - DNA, 22 bp, Homo sapiens
ctcagaagttcagcctagagta

SEQ ID NO: 7972873 - DNA, 22 bp, Homo sapiens
ctcagaagccttcagtcttggc

SEQ ID NO: 7972874 - DNA, 22 bp, Homo sapiens
ctcagaagaatcagcagctatt

SEQ ID NO: 7972875 - DNA, 22 bp, Homo sapiens
ctcagaagccttcagtcttggc

SEQ ID NO: 7972876 - DNA, 22 bp, Homo sapiens
ctcagaagccttcagtcttggc

SEQ ID NO: 7972877 - DNA, 22 bp, Homo sapiens
ctcagaagccttcagtcttggc

SEQ ID NO: 7972878 - DNA, 22 bp, Homo sapiens
ctcagaattaataaccacaagg

SEQ ID NO: 7972879 - DNA, 22 bp, Homo sapiens
ctcagaatctgccaagttcagg

SEQ ID NO: 7972880 - DNA, 22 bp, Homo sapiens
ctcagaataatgtttctaaagg

SEQ ID NO: 7972881 - DNA, 22 bp, Homo sapiens
ctcagacacagccccacgaagt

SEQ ID NO: 7972882 - DNA, 22 bp, Homo sapiens
ctcagacacagccccacgaagt

SEQ ID NO: 7972883 - DNA, 22 bp, Homo sapiens
ctcagacaaatgattaaggtta

SEQ ID NO: 7972884 - DNA, 21 bp, Homo sapiens
ctcagacagggaggctctggg

SEQ ID NO: 7972885 - DNA, 21 bp, Homo sapiens
ctcagacagggaggctctggg

SEQ ID NO: 7972886 - DNA, 21 bp, Homo sapiens
ctcagacagggaggctctggg

SEQ ID NO: 7972887 - DNA, 18 bp, Homo sapiens
ctcagacaggctgtgcta

SEQ ID NO: 7972888 - DNA, 18 bp, Homo sapiens
ctcagacaggctgtgcta

SEQ ID NO: 7972889 - DNA, 22 bp, Homo sapiens
agtcccagagaggtcggggcca

SEQ ID NO: 7972890 - DNA, 22 bp, Homo sapiens
agtcccagagaggtcggggcca

SEQ ID NO: 7972891 - DNA, 22 bp, Homo sapiens
agtcccagagaggtcggggcca

SEQ ID NO: 7972892 - DNA, 20 bp, Homo sapiens
agtcccagatcaaatttctg

SEQ ID NO: 7972893 - DNA, 20 bp, Homo sapiens
agtcccagatcaaatttctg

SEQ ID NO: 7972894 - DNA, 22 bp, Homo sapiens
agtcccagatctacaggaggga

SEQ ID NO: 7972895 - DNA, 22 bp, Homo sapiens
agtcccagatctacaggaggga

SEQ ID NO: 7972896 - DNA, 22 bp, Homo sapiens
agtcccagatctacaggaggga

SEQ ID NO: 7972897 - DNA, 22 bp, Homo sapiens
agtcccagatctacaggaggga

SEQ ID NO: 7972898 - DNA, 22 bp, Homo sapiens
agtcccagatctacaggaggga

SEQ ID NO: 7972899 - DNA, 22 bp, Homo sapiens
agtcccagatctacaggaggga

SEQ ID NO: 7972900 - DNA, 22 bp, Homo sapiens
agtcccagatctacaggaggga

SEQ ID NO: 7972901 - DNA, 22 bp, Homo sapiens
agtcccagatctccattcggtc

SEQ ID NO: 7972902 - DNA, 22 bp, Homo sapiens
agtcccagatctccattcggtc

SEQ ID NO: 7972903 - DNA, 22 bp, Homo sapiens
agtcccagatgacccagctact

SEQ ID NO: 7972904 - DNA, 22 bp, Homo sapiens
agtcccagatgacccagctact

SEQ ID NO: 7972905 - DNA, 22 bp, Homo sapiens
agtcccagcccagtcctgtaag

SEQ ID NO: 7972906 - DNA, 22 bp, Homo sapiens
agtcccagatgacccagctact

SEQ ID NO: 7972907 - DNA, 22 bp, Homo sapiens
agtcccagatgacccagctact

SEQ ID NO: 7972908 - DNA, 22 bp, Homo sapiens
agtcccagcctaggctgtgctg

SEQ ID NO: 7972909 - DNA, 22 bp, Homo sapiens
agtcccagcccagtcctgtaag

SEQ ID NO: 7972910 - DNA, 22 bp, Homo sapiens
agtcccagcctaggctgtgctg

SEQ ID NO: 7972911 - DNA, 22 bp, Homo sapiens
agtcccagcctgtaggattggg

SEQ ID NO: 7972912 - DNA, 22 bp, Homo sapiens
agtcccagcctgtaggattggg

SEQ ID NO: 7972913 - DNA, 22 bp, Homo sapiens
agtcccagcctaggctgtgctg

SEQ ID NO: 7972914 - DNA, 22 bp, Homo sapiens
agtcccagcctaggctgtgctg

SEQ ID NO: 7972915 - DNA, 22 bp, Homo sapiens
ctcaccaggaacagctgcggag

SEQ ID NO: 7972916 - DNA, 22 bp, Homo sapiens
ctcaccagatgtcgggctgagt

SEQ ID NO: 7972917 - DNA, 20 bp, Homo sapiens
ctcaccaggtgtaggctgag

SEQ ID NO: 7972918 - DNA, 22 bp, Homo sapiens
ctccagaattgtccattggaaa

SEQ ID NO: 7972919 - DNA, 19 bp, Homo sapiens
ctccagaatacatgttcct

SEQ ID NO: 7972920 - DNA, 20 bp, Homo sapiens
ctccagactacagaagagcc

SEQ ID NO: 7972921 - DNA, 22 bp, Homo sapiens
ctccagaattgtccattggaaa

SEQ ID NO: 7972922 - DNA, 22 bp, Homo sapiens
ctccagagacacttctcatgat

SEQ ID NO: 7972923 - DNA, 22 bp, Homo sapiens
ctccagagacacttctcatgat

SEQ ID NO: 7972924 - DNA, 22 bp, Homo sapiens
ctccagagagaaaggaggccgc

SEQ ID NO: 7972925 - DNA, 22 bp, Homo sapiens
ctccagagagaaaggaggccgc

SEQ ID NO: 7972926 - DNA, 22 bp, Homo sapiens
ctccagagagaaaggaggccgc

SEQ ID NO: 7972927 - DNA, 22 bp, Homo sapiens
ctccagagagaaaggaggccgc

SEQ ID NO: 7972928 - DNA, 22 bp, Homo sapiens
ctccagagacacttctcatgat

SEQ ID NO: 7972929 - DNA, 22 bp, Homo sapiens
ctccagagagaaaggaggccgc

SEQ ID NO: 7972930 - DNA, 22 bp, Homo sapiens
ctccagagacacttctcatgat

SEQ ID NO: 7972931 - DNA, 22 bp, Homo sapiens
ctccagaaatttggatgcagca

SEQ ID NO: 7972932 - DNA, 22 bp, Homo sapiens
ctccagaaatttggatgcagca

SEQ ID NO: 7972933 - DNA, 22 bp, Homo sapiens
ctccagaaattcaacagcaaat

SEQ ID NO: 7972934 - DNA, 22 bp, Homo sapiens
ctccagaaattcaacagcaaat

SEQ ID NO: 7972935 - DNA, 22 bp, Homo sapiens
ctccagaaatttggatgcagca

SEQ ID NO: 7972936 - DNA, 22 bp, Homo sapiens
ctccagaaatttggatgcagca

SEQ ID NO: 7972937 - DNA, 22 bp, Homo sapiens
ctccagaaattcaacagcaaat

SEQ ID NO: 7972938 - DNA, 22 bp, Homo sapiens
ctccagaaattcaacagcaaat

SEQ ID NO: 7972939 - DNA, 22 bp, Homo sapiens
ctccagaaattcaacagcaaat

SEQ ID NO: 7972940 - DNA, 22 bp, Homo sapiens
ctccactctggggtgggtgaga

SEQ ID NO: 7972941 - DNA, 22 bp, Homo sapiens
ctccactctggggtgggtgaga

SEQ ID NO: 7972942 - DNA, 22 bp, Homo sapiens
ctccagaactgggagagaataa

SEQ ID NO: 7972943 - DNA, 22 bp, Homo sapiens
ctccagaagacccatcctcatg

SEQ ID NO: 7972944 - DNA, 22 bp, Homo sapiens
ctccagaagacccatcctcatg

SEQ ID NO: 7972945 - DNA, 22 bp, Homo sapiens
ctccagaagacccatcctcatg

SEQ ID NO: 7972946 - DNA, 22 bp, Homo sapiens
ctccagaactgggagagaataa

SEQ ID NO: 7972947 - DNA, 22 bp, Homo sapiens
ctccagaaatttggatgcagca

SEQ ID NO: 7972948 - DNA, 22 bp, Homo sapiens
ctccagaactgggagagaataa

SEQ ID NO: 7972949 - DNA, 22 bp, Homo sapiens
ctccagaactgggagagaataa

SEQ ID NO: 7972950 - DNA, 19 bp, Homo sapiens
ctccagaatacatgttcct

SEQ ID NO: 7972951 - DNA, 19 bp, Homo sapiens
ctccagaatacatgttcct

SEQ ID NO: 7972952 - DNA, 19 bp, Homo sapiens
ctccagaatacatgttcct

SEQ ID NO: 7972953 - DNA, 22 bp, Homo sapiens
ctccagaaggtgggggagccac

SEQ ID NO: 7972954 - DNA, 22 bp, Homo sapiens
ctccagaaggtgggggagccac

SEQ ID NO: 7972955 - DNA, 22 bp, Homo sapiens
ctccagaaggtgggggagccac

SEQ ID NO: 7972956 - DNA, 22 bp, Homo sapiens
ctccagaagacccatcctcatg

SEQ ID NO: 7972957 - DNA, 21 bp, Homo sapiens
agtgacagaggaaggtgcata

SEQ ID NO: 7972958 - DNA, 21 bp, Homo sapiens
agtgacagaggaaggtgcata

SEQ ID NO: 7972959 - DNA, 22 bp, Homo sapiens
agtgacagaggcaggcctgtgg

SEQ ID NO: 7972960 - DNA, 22 bp, Homo sapiens
agtgacagagcttggtgccccc

SEQ ID NO: 7972961 - DNA, 20 bp, Homo sapiens
agtgacagagactgtgtggc

SEQ ID NO: 7972962 - DNA, 22 bp, Homo sapiens
agtgacagagcttggtgccccc

SEQ ID NO: 7972963 - DNA, 21 bp, Homo sapiens
agtgacagaggaaggtgcata

SEQ ID NO: 7972964 - DNA, 22 bp, Homo sapiens
agtgacagattaccggcagagc

SEQ ID NO: 7972965 - DNA, 22 bp, Homo sapiens
agtgacagaggcaggcctgtgg

SEQ ID NO: 7972966 - DNA, 21 bp, Homo sapiens
agtgacagaggaaggtgcata

SEQ ID NO: 7972967 - DNA, 22 bp, Homo sapiens
agtgacagctgggaaggtgaaa

SEQ ID NO: 7972968 - DNA, 22 bp, Homo sapiens
agtgacagccaaatccatccat

SEQ ID NO: 7972969 - DNA, 22 bp, Homo sapiens
agtgacagctgggaaggtgaaa

SEQ ID NO: 7972970 - DNA, 22 bp, Homo sapiens
agtgacaggaccaggtctggaa

SEQ ID NO: 7972971 - DNA, 22 bp, Homo sapiens
agtgacaggaccaggtctggaa

SEQ ID NO: 7972972 - DNA, 22 bp, Homo sapiens
agtgacagggaaaatgacactg

SEQ ID NO: 7972973 - DNA, 22 bp, Homo sapiens
agtgacaggaccaggtctggaa

SEQ ID NO: 7972974 - DNA, 22 bp, Homo sapiens
agtgacagggaaggataggatt

SEQ ID NO: 7972975 - DNA, 22 bp, Homo sapiens
agtgacagggaaggataggatt

SEQ ID NO: 7972976 - DNA, 22 bp, Homo sapiens
agtgacagggaaggataggatt

SEQ ID NO: 7972977 - DNA, 22 bp, Homo sapiens
agtgacagggaaaatgacactg

SEQ ID NO: 7972978 - DNA, 22 bp, Homo sapiens
agtgacagggaaggataggatt

SEQ ID NO: 7972979 - DNA, 22 bp, Homo sapiens
ctccactcaccgaggcagagca

SEQ ID NO: 7972980 - DNA, 22 bp, Homo sapiens
ctccactcaggtgcttaagttg

SEQ ID NO: 7972981 - DNA, 22 bp, Homo sapiens
agtgacaggggaggcaggtgtg

SEQ ID NO: 7972982 - DNA, 22 bp, Homo sapiens
ctccactcaccgaggcagagca

SEQ ID NO: 7972983 - DNA, 22 bp, Homo sapiens
agtgacaggggaggcaggtgtg

SEQ ID NO: 7972984 - DNA, 22 bp, Homo sapiens
agtgacaggggaggcaggtgtg

SEQ ID NO: 7972985 - DNA, 22 bp, Homo sapiens
agtgacagggaaggataggatt

SEQ ID NO: 7972986 - DNA, 22 bp, Homo sapiens
agtgacaggggaggcaggtgtg

SEQ ID NO: 7972987 - DNA, 23 bp, Homo sapiens
ctcagtgtgtgacccatggcctc

SEQ ID NO: 7972988 - DNA, 23 bp, Homo sapiens
ctcagtgtgtgacccatggcctc

SEQ ID NO: 7972989 - DNA, 22 bp, Homo sapiens
ctcagtgtgagtgagaagtgca

SEQ ID NO: 7972990 - DNA, 22 bp, Homo sapiens
ctcagtgtgagtgagaagtgca

SEQ ID NO: 7972991 - DNA, 20 bp, Homo sapiens
ctcagtgtggcctgagtgtt

SEQ ID NO: 7972992 - DNA, 20 bp, Homo sapiens
ctcagtgtggcctgagtgtt

SEQ ID NO: 7972993 - DNA, 20 bp, Homo sapiens
ctcagtgtggcctgagtgtt

SEQ ID NO: 7972994 - DNA, 22 bp, Homo sapiens
ctcagtgtgaatgctcagtaaa

SEQ ID NO: 7972995 - DNA, 22 bp, Homo sapiens
ctcagtgtgaatgctcagtaaa

SEQ ID NO: 7972996 - DNA, 22 bp, Homo sapiens
ctcagtgtcttatttgagttct

SEQ ID NO: 7972997 - DNA, 22 bp, Homo sapiens
ctcagtgtcttatttgagttct

SEQ ID NO: 7972998 - DNA, 22 bp, Homo sapiens
ctcagtgtcttatttgagttct

SEQ ID NO: 7972999 - DNA, 22 bp, Homo sapiens
ctcagtgtcttattgtacacat

SEQ ID NO: 7973000 - DNA, 22 bp, Homo sapiens
ctcagtgtcacgttttgcctta

SEQ ID NO: 7973001 - DNA, 22 bp, Homo sapiens
ctcagtggttgagagcctgggc

SEQ ID NO: 7973002 - DNA, 22 bp, Homo sapiens
ctcagtggtcggcacagtttgt

SEQ ID NO: 7973003 - DNA, 22 bp, Homo sapiens
ctcagtgtctggggccccaggg

SEQ ID NO: 7973004 - DNA, 20 bp, Homo sapiens
ctcagtgtattctgggtgct

SEQ ID NO: 7973005 - DNA, 20 bp, Homo sapiens
ctcagtgtattctgggtgct

SEQ ID NO: 7973006 - DNA, 22 bp, Homo sapiens
ctcagtggttgagagcctgggc

SEQ ID NO: 7973007 - DNA, 22 bp, Homo sapiens
ctcagtggttgagagcctgggc

SEQ ID NO: 7973008 - DNA, 20 bp, Homo sapiens
ctcagtgtattctgggtgct

SEQ ID NO: 7973009 - DNA, 22 bp, Homo sapiens
ctcagtgctttggatcctggat

SEQ ID NO: 7973010 - DNA, 22 bp, Homo sapiens
ctcagtgctttggatcctggat

SEQ ID NO: 7973011 - DNA, 22 bp, Homo sapiens
ctcagtgggaggagtcagttgc

SEQ ID NO: 7973012 - DNA, 22 bp, Homo sapiens
ctcagggagtagcacatgtgga

SEQ ID NO: 7973013 - DNA, 22 bp, Homo sapiens
ctcagtgctttggatcctggat

SEQ ID NO: 7973014 - DNA, 22 bp, Homo sapiens
ctcagtggggcgacagggtgct

SEQ ID NO: 7973015 - DNA, 22 bp, Homo sapiens
ctcagtggagagcggtcctggg

SEQ ID NO: 7973016 - DNA, 22 bp, Homo sapiens
agtgaaattgctgtaagaggaa

SEQ ID NO: 7973017 - DNA, 17 bp, Homo sapiens
agtgaaatttacattgc

SEQ ID NO: 7973018 - DNA, 17 bp, Homo sapiens
agtgaaatttacattgc

SEQ ID NO: 7973019 - DNA, 22 bp, Homo sapiens
ctcagtgttaaagactttccag

SEQ ID NO: 7973020 - DNA, 22 bp, Homo sapiens
ctcagtgttaaagactttccag

SEQ ID NO: 7973021 - DNA, 22 bp, Homo sapiens
ctcagtgttaaatataaggtat

SEQ ID NO: 7973022 - DNA, 22 bp, Homo sapiens
ctcagtgttaaatataaggtat

SEQ ID NO: 7973023 - DNA, 22 bp, Homo sapiens
agtgaattctaaatgctaaaga

SEQ ID NO: 7973024 - DNA, 17 bp, Homo sapiens
agtgaaatttacattgc

SEQ ID NO: 7973025 - DNA, 22 bp, Homo sapiens
agtgacaaaacggaacatacag

SEQ ID NO: 7973026 - DNA, 22 bp, Homo sapiens
agtgaattgttgccacagagac

SEQ ID NO: 7973027 - DNA, 20 bp, Homo sapiens
agtgaatttaaataatattc

SEQ ID NO: 7973028 - DNA, 22 bp, Homo sapiens
agtgacaacaagttgactagaa

SEQ ID NO: 7973029 - DNA, 22 bp, Homo sapiens
agtgacaaggcctgaagctcct

SEQ ID NO: 7973030 - DNA, 22 bp, Homo sapiens
agtgacaaagattctccttgtt

SEQ ID NO: 7973031 - DNA, 22 bp, Homo sapiens
agtgacaaggtggtaatgaagc

SEQ ID NO: 7973032 - DNA, 22 bp, Homo sapiens
agtgacaaggtggtaatgaagc

SEQ ID NO: 7973033 - DNA, 22 bp, Homo sapiens
agtgacacggagagacagcatg

SEQ ID NO: 7973034 - DNA, 22 bp, Homo sapiens
agtgacacggagagacagcatg

SEQ ID NO: 7973035 - DNA, 22 bp, Homo sapiens
agtctccacttgacatcagcag

SEQ ID NO: 7973036 - DNA, 22 bp, Homo sapiens
agtctccacccatgacagtaca

SEQ ID NO: 7973037 - DNA, 22 bp, Homo sapiens
agtctccacactggcagatgcc

SEQ ID NO: 7973038 - DNA, 22 bp, Homo sapiens
agtctccacactggcagatgcc

SEQ ID NO: 7973039 - DNA, 22 bp, Homo sapiens
agtctccacactggcagatgcc

SEQ ID NO: 7973040 - DNA, 22 bp, Homo sapiens
agtctccacaacagccctgata

SEQ ID NO: 7973041 - DNA, 22 bp, Homo sapiens
agtctccacaacagccctgata

SEQ ID NO: 7973042 - DNA, 22 bp, Homo sapiens
agtctcatcaggcatgtagtca

SEQ ID NO: 7973043 - DNA, 22 bp, Homo sapiens
agtctccacactggcagatgcc

SEQ ID NO: 7973044 - DNA, 22 bp, Homo sapiens
agtctccacactggcagatgcc

SEQ ID NO: 7973045 - DNA, 19 bp, Homo sapiens
agtctcagtgtacagaggc

SEQ ID NO: 7973046 - DNA, 22 bp, Homo sapiens
agtctcatcaggcatgtagtca

SEQ ID NO: 7973047 - DNA, 22 bp, Homo sapiens
agtctcaggcagaggaaggcta

SEQ ID NO: 7973048 - DNA, 23 bp, Homo sapiens
agtctcagctggaaacatgtgtc

SEQ ID NO: 7973049 - DNA, 23 bp, Homo sapiens
agtctcagctggaaacatgtgtc

SEQ ID NO: 7973050 - DNA, 22 bp, Homo sapiens
agtctccacttgacatcagcag

SEQ ID NO: 7973051 - DNA, 22 bp, Homo sapiens
agtctccacttgacatcagcag

SEQ ID NO: 7973052 - DNA, 22 bp, Homo sapiens
agtctccagaaatatagcagtg

SEQ ID NO: 7973053 - DNA, 22 bp, Homo sapiens
agtctccagaaatatagcagtg

SEQ ID NO: 7973054 - DNA, 22 bp, Homo sapiens
agtctccagaaatatagcagtg

SEQ ID NO: 7973055 - DNA, 21 bp, Homo sapiens
ctcaggcatttgaggagagtc

SEQ ID NO: 7973056 - DNA, 22 bp, Homo sapiens
ctcaggccaataagctccagcc

SEQ ID NO: 7973057 - DNA, 22 bp, Homo sapiens
ctcaggccaataagctccagcc

SEQ ID NO: 7973058 - DNA, 22 bp, Homo sapiens
ctcaggccaataagctccagcc

SEQ ID NO: 7973059 - DNA, 22 bp, Homo sapiens
ctcagggaggagcttctgggcc

SEQ ID NO: 7973060 - DNA, 22 bp, Homo sapiens
ctcagggaggagcttctgggcc

SEQ ID NO: 7973061 - DNA, 22 bp, Homo sapiens
ctcagggaggccctgggaccct

SEQ ID NO: 7973062 - DNA, 22 bp, Homo sapiens
ctcagggaggccctgggaccct

SEQ ID NO: 7973063 - DNA, 22 bp, Homo sapiens
ctcagggaggagcttctgggcc

SEQ ID NO: 7973064 - DNA, 22 bp, Homo sapiens
ctcagggagagccaagagttcc

SEQ ID NO: 7973065 - DNA, 22 bp, Homo sapiens
ctcagggagagccaagagttcc

SEQ ID NO: 7973066 - DNA, 22 bp, Homo sapiens
ctcagggagagccaagagttcc

SEQ ID NO: 7973067 - DNA, 22 bp, Homo sapiens
ctcagggaggcctctgctggtt

SEQ ID NO: 7973068 - DNA, 22 bp, Homo sapiens
ctcagggaggtcctgtgctgaa

SEQ ID NO: 7973069 - DNA, 22 bp, Homo sapiens
ctcagggaggtcctgtgctgaa

SEQ ID NO: 7973070 - DNA, 22 bp, Homo sapiens
ctcagggaggtcctgtgctgaa

SEQ ID NO: 7973071 - DNA, 22 bp, Homo sapiens
ctcagggaggtcctgtgctgaa

SEQ ID NO: 7973072 - DNA, 22 bp, Homo sapiens
ctcagggaggccctgggaccct

SEQ ID NO: 7973073 - DNA, 22 bp, Homo sapiens
ctcagggaggccctgggaccct

SEQ ID NO: 7973074 - DNA, 22 bp, Homo sapiens
ctcagggaggccctgggaccct

SEQ ID NO: 7973075 - DNA, 22 bp, Homo sapiens
ctcagggaggcctctgctggtt

SEQ ID NO: 7973076 - DNA, 22 bp, Homo sapiens
ctcagggaggcctctgctggtt

SEQ ID NO: 7973077 - DNA, 22 bp, Homo sapiens
ctcagggacgttagaggacagg

SEQ ID NO: 7973078 - DNA, 22 bp, Homo sapiens
ctcagggacgttagaggacagg

SEQ ID NO: 7973079 - DNA, 22 bp, Homo sapiens
ctcagggacgttagaggacagg

SEQ ID NO: 7973080 - DNA, 22 bp, Homo sapiens
ctcagggacttggatcctggcc

SEQ ID NO: 7973081 - DNA, 22 bp, Homo sapiens
ctcagggacttggatcctggcc

SEQ ID NO: 7973082 - DNA, 22 bp, Homo sapiens
ctcagggacttggatcctggcc

SEQ ID NO: 7973083 - DNA, 22 bp, Homo sapiens
ctcagggacttggatcctggcc

SEQ ID NO: 7973084 - DNA, 22 bp, Homo sapiens
ctcagggacttggatcctggcc

SEQ ID NO: 7973085 - DNA, 22 bp, Homo sapiens
ctcagggacggaggcttgcgga

SEQ ID NO: 7973086 - DNA, 22 bp, Homo sapiens
ctcagggacggaggcttgcgga

SEQ ID NO: 7973087 - DNA, 22 bp, Homo sapiens
ctcagggacgttagaggacagg

SEQ ID NO: 7973088 - DNA, 22 bp, Homo sapiens
ctcagggacggaggcttgcgga

SEQ ID NO: 7973089 - DNA, 22 bp, Homo sapiens
ctcagggacaaggggagacccc

SEQ ID NO: 7973090 - DNA, 22 bp, Homo sapiens
ctcagggacaaggggagacccc

SEQ ID NO: 7973091 - DNA, 22 bp, Homo sapiens
ctcagggacaaggggagacccc

SEQ ID NO: 7973092 - DNA, 22 bp, Homo sapiens
ctcagggacaaggggagacccc

SEQ ID NO: 7973093 - DNA, 22 bp, Homo sapiens
ctcagctcactcttttgtgctt

SEQ ID NO: 7973094 - DNA, 22 bp, Homo sapiens
ctcagctcactcttttgtgctt

SEQ ID NO: 7973095 - DNA, 22 bp, Homo sapiens
ctcagctcaaaattcacctttg

SEQ ID NO: 7973096 - DNA, 22 bp, Homo sapiens
ctcagctcaaaattcacctttg

SEQ ID NO: 7973097 - DNA, 22 bp, Homo sapiens
ctcagcctgtgaagagcagagg

SEQ ID NO: 7973098 - DNA, 22 bp, Homo sapiens
ctcagctagtaacgtacatgtc

SEQ ID NO: 7973099 - DNA, 22 bp, Homo sapiens
ctcagctccagccctcagcagc

SEQ ID NO: 7973100 - DNA, 22 bp, Homo sapiens
ctcagctccagccctcagcagc

SEQ ID NO: 7973101 - DNA, 22 bp, Homo sapiens
ctcagctccagccctcagcagc

SEQ ID NO: 7973102 - DNA, 22 bp, Homo sapiens
ctcagctcaaaattcacctttg

SEQ ID NO: 7973103 - DNA, 22 bp, Homo sapiens
ctcagctccagccctcagcagc

SEQ ID NO: 7973104 - DNA, 22 bp, Homo sapiens
ctcagctccaggtgtgcatctt

SEQ ID NO: 7973105 - DNA, 22 bp, Homo sapiens
ctcagctccagccctcagcagc

SEQ ID NO: 7973106 - DNA, 22 bp, Homo sapiens
ctcagcacattcctaagggatg

SEQ ID NO: 7973107 - DNA, 22 bp, Homo sapiens
ctcagcacactcccatctaatt

SEQ ID NO: 7973108 - DNA, 22 bp, Homo sapiens
ctcagccccagcccagatagca

SEQ ID NO: 7973109 - DNA, 22 bp, Homo sapiens
ctcagccccagcccagatagca

SEQ ID NO: 7973110 - DNA, 22 bp, Homo sapiens
ctcagccccaatttgccctctt

SEQ ID NO: 7973111 - DNA, 22 bp, Homo sapiens
ctcagccccaatttgccctctt

SEQ ID NO: 7973112 - DNA, 22 bp, Homo sapiens
ctcagcccggtgctcgtgccac

SEQ ID NO: 7973113 - DNA, 22 bp, Homo sapiens
ctcagccctccccggggaataa

SEQ ID NO: 7973114 - DNA, 22 bp, Homo sapiens
ctcagccctccccggggaataa

SEQ ID NO: 7973115 - DNA, 22 bp, Homo sapiens
agtctcagccacacagacctat

SEQ ID NO: 7973116 - DNA, 22 bp, Homo sapiens
agtctcagccacacagacctat

SEQ ID NO: 7973117 - DNA, 18 bp, Homo sapiens
agtctcagcggaggagta

SEQ ID NO: 7973118 - DNA, 23 bp, Homo sapiens
agtctcagctggaaacatgtgtc

SEQ ID NO: 7973119 - DNA, 22 bp, Homo sapiens
agtctcagctacttgggaggct

SEQ ID NO: 7973120 - DNA, 22 bp, Homo sapiens
agtctcagctacttgggaggct

SEQ ID NO: 7973121 - DNA, 22 bp, Homo sapiens
agtctcagctacttgggaggct

SEQ ID NO: 7973122 - DNA, 22 bp, Homo sapiens
agtctcagctacttgggaggct

SEQ ID NO: 7973123 - DNA, 22 bp, Homo sapiens
agtctcagcaagcatggctagt

SEQ ID NO: 7973124 - DNA, 22 bp, Homo sapiens
agtctcagagtacctgagggac

SEQ ID NO: 7973125 - DNA, 22 bp, Homo sapiens
agtctcagagtacctgagggac

SEQ ID NO: 7973126 - DNA, 22 bp, Homo sapiens
ctcagctgcagcctggctggca

SEQ ID NO: 7973127 - DNA, 22 bp, Homo sapiens
ctcagctgcagcctggctggca

SEQ ID NO: 7973128 - DNA, 22 bp, Homo sapiens
ctcagctgcagcctggctggca

SEQ ID NO: 7973129 - DNA, 22 bp, Homo sapiens
agtctcagagtacctgagggac

SEQ ID NO: 7973130 - DNA, 22 bp, Homo sapiens
agtctcagagtacctgagggac

SEQ ID NO: 7973131 - DNA, 20 bp, Homo sapiens
ctcagctcttcagggcaagt

SEQ ID NO: 7973132 - DNA, 20 bp, Homo sapiens
ctcagctcttcagggcaagt

SEQ ID NO: 7973133 - DNA, 22 bp, Homo sapiens
ctcagctctgtcacttactagc

SEQ ID NO: 7973134 - DNA, 22 bp, Homo sapiens
ctcagctctgtcacttactagc

SEQ ID NO: 7973135 - DNA, 20 bp, Homo sapiens
ctcagctcttcagggcaagt

SEQ ID NO: 7973136 - DNA, 22 bp, Homo sapiens
ctcagctctttatactagctgt

SEQ ID NO: 7973137 - DNA, 22 bp, Homo sapiens
ctcagctctttatactagctgt

SEQ ID NO: 7973138 - DNA, 22 bp, Homo sapiens
ctcagctctttatactagctgt

SEQ ID NO: 7973139 - DNA, 17 bp, Homo sapiens
ctcagctgaaccccaga

SEQ ID NO: 7973140 - DNA, 17 bp, Homo sapiens
ctcagctgaaccccaga

SEQ ID NO: 7973141 - DNA, 22 bp, Homo sapiens
ctcagctctgacaggaggcatc

SEQ ID NO: 7973142 - DNA, 22 bp, Homo sapiens
ctcagctctgtcacttactagc

SEQ ID NO: 7973143 - DNA, 22 bp, Homo sapiens
ctcagctctgtcacttactagc

SEQ ID NO: 7973144 - DNA, 22 bp, Homo sapiens
ctcagctccaggtgtgcatctt

SEQ ID NO: 7973145 - DNA, 22 bp, Homo sapiens
ctcagctccaggtgtgcatctt

SEQ ID NO: 7973146 - DNA, 22 bp, Homo sapiens
ctcagctccctccacccagacc

SEQ ID NO: 7973147 - DNA, 22 bp, Homo sapiens
agtggtgctgcgcgcggagctc

SEQ ID NO: 7973148 - DNA, 22 bp, Homo sapiens
agtggtggagagatgaggacac

SEQ ID NO: 7973149 - DNA, 22 bp, Homo sapiens
agtggtggagagatgaggacac

SEQ ID NO: 7973150 - DNA, 22 bp, Homo sapiens
agtggtggagagatgaggacac

SEQ ID NO: 7973151 - DNA, 22 bp, Homo sapiens
agtggtgctaggtggaatatag

SEQ ID NO: 7973152 - DNA, 22 bp, Homo sapiens
agtggtgagacctggtgctttc

SEQ ID NO: 7973153 - DNA, 21 bp, Homo sapiens
agtggtctttttcacccagtg

SEQ ID NO: 7973154 - DNA, 22 bp, Homo sapiens
agtggtcttagcttgctgggct

SEQ ID NO: 7973155 - DNA, 22 bp, Homo sapiens
agtggtgaggggcatgtgtgat

SEQ ID NO: 7973156 - DNA, 22 bp, Homo sapiens
agtggtgccattaaaatcattg

SEQ ID NO: 7973157 - DNA, 22 bp, Homo sapiens
agtgtacaaaatgatagataaa

SEQ ID NO: 7973158 - DNA, 22 bp, Homo sapiens
agtgtacaaaatgatagataaa

SEQ ID NO: 7973159 - DNA, 22 bp, Homo sapiens
ctcttagatatggagaattacc

SEQ ID NO: 7973160 - DNA, 22 bp, Homo sapiens
agtgtaagtgatcattgatagt

SEQ ID NO: 7973161 - DNA, 22 bp, Homo sapiens
agtgtaaagctgtatatgtgcc

SEQ ID NO: 7973162 - DNA, 22 bp, Homo sapiens
agtgtaagtgatcattgatagt

SEQ ID NO: 7973163 - DNA, 22 bp, Homo sapiens
agtgtaatactcatgacaaaaa

SEQ ID NO: 7973164 - DNA, 22 bp, Homo sapiens
agtggtgtcgtgggagtggaag

SEQ ID NO: 7973165 - DNA, 22 bp, Homo sapiens
agtgtaaacttaagagaatatc

SEQ ID NO: 7973166 - DNA, 22 bp, Homo sapiens
agtggtgtctgagtggccaggg

SEQ ID NO: 7973167 - DNA, 22 bp, Homo sapiens
agtggtggagccaggaaatgtg

SEQ ID NO: 7973168 - DNA, 22 bp, Homo sapiens
agtggtggagccaggaaatgtg

SEQ ID NO: 7973169 - DNA, 22 bp, Homo sapiens
agtggtggagccaggaaatgtg

SEQ ID NO: 7973170 - DNA, 22 bp, Homo sapiens
agtggtggagagatgaggacac

SEQ ID NO: 7973171 - DNA, 22 bp, Homo sapiens
agtggtggagccaggaaatgtg

SEQ ID NO: 7973172 - DNA, 22 bp, Homo sapiens
agtggtggagccaggaaatgtg

SEQ ID NO: 7973173 - DNA, 22 bp, Homo sapiens
agtggtggagccaggaaatgtg

SEQ ID NO: 7973174 - DNA, 22 bp, Homo sapiens
ctctgtgagggtctgtacagaa

SEQ ID NO: 7973175 - DNA, 22 bp, Homo sapiens
agtggtctccccagtagaataa

SEQ ID NO: 7973176 - DNA, 22 bp, Homo sapiens
agtggtctgggctaaatgaggt

SEQ ID NO: 7973177 - DNA, 22 bp, Homo sapiens
agtggtctgcctgcctcagcct

SEQ ID NO: 7973178 - DNA, 22 bp, Homo sapiens
agtggtctgcctgcctcagcct

SEQ ID NO: 7973179 - DNA, 22 bp, Homo sapiens
ctctgtccttgcacagttccta

SEQ ID NO: 7973180 - DNA, 22 bp, Homo sapiens
ctctgtcctatgcttgatagaa

SEQ ID NO: 7973181 - DNA, 22 bp, Homo sapiens
ctctgtcctccacctgctttca

SEQ ID NO: 7973182 - DNA, 22 bp, Homo sapiens
ctctgtcctccacctgctttca

SEQ ID NO: 7973183 - DNA, 22 bp, Homo sapiens
ctctgtcccagacccacctctc

SEQ ID NO: 7973184 - DNA, 22 bp, Homo sapiens
ctctgtcccagacccacctctc

SEQ ID NO: 7973185 - DNA, 22 bp, Homo sapiens
ctctgtcccagacccacctctc

SEQ ID NO: 7973186 - DNA, 22 bp, Homo sapiens
ctctgtccacaggtttgtccct

SEQ ID NO: 7973187 - DNA, 22 bp, Homo sapiens
ctctgtcccagacccacctctc

SEQ ID NO: 7973188 - DNA, 22 bp, Homo sapiens
ctctgtcccagacccacctctc

SEQ ID NO: 7973189 - DNA, 22 bp, Homo sapiens
ctcttagtaatgccatgaagca

SEQ ID NO: 7973190 - DNA, 22 bp, Homo sapiens
ctcttagtaatgccatgaagca

SEQ ID NO: 7973191 - DNA, 22 bp, Homo sapiens
ctcttagtaatgccatgaagca

SEQ ID NO: 7973192 - DNA, 22 bp, Homo sapiens
ctcttcttggcccccatgaggg

SEQ ID NO: 7973193 - DNA, 22 bp, Homo sapiens
ctcttcttggcccccatgaggg

SEQ ID NO: 7973194 - DNA, 22 bp, Homo sapiens
ctcttcttgtctctggttagaa

SEQ ID NO: 7973195 - DNA, 22 bp, Homo sapiens
ctcttctttagtccagaccatc

SEQ ID NO: 7973196 - DNA, 22 bp, Homo sapiens
ctcttctttccatccctagcca

SEQ ID NO: 7973197 - DNA, 22 bp, Homo sapiens
ctcttgcatctgttgtattggt

SEQ ID NO: 7973198 - DNA, 22 bp, Homo sapiens
ctcttgcagataccttgaagga

SEQ ID NO: 7973199 - DNA, 22 bp, Homo sapiens
ctcttgcatgagatccaggagt

SEQ ID NO: 7973200 - DNA, 22 bp, Homo sapiens
ctcttgcatctgttgtattggt

SEQ ID NO: 7973201 - DNA, 22 bp, Homo sapiens
ctcttgatgactgttgctggtt

SEQ ID NO: 7973202 - DNA, 22 bp, Homo sapiens
ctcttgatgactgttgctggtt

SEQ ID NO: 7973203 - DNA, 22 bp, Homo sapiens
ctcttgagtggcatgctctaac

SEQ ID NO: 7973204 - DNA, 22 bp, Homo sapiens
ctcttgaactttctagtttcat

SEQ ID NO: 7973205 - DNA, 22 bp, Homo sapiens
ctcttgaactttctagtttcat

SEQ ID NO: 7973206 - DNA, 22 bp, Homo sapiens
ctcttgaaaattggaacacaga

SEQ ID NO: 7973207 - DNA, 22 bp, Homo sapiens
ctcttgaaaattggaacacaga

SEQ ID NO: 7973208 - DNA, 22 bp, Homo sapiens
ctcttgaagggcatctgagtta

SEQ ID NO: 7973209 - DNA, 22 bp, Homo sapiens
ctcttgaactttctagtttcat

SEQ ID NO: 7973210 - DNA, 21 bp, Homo sapiens
ctcttgaatgcttgataagat

SEQ ID NO: 7973211 - DNA, 21 bp, Homo sapiens
ctcttgctgatgtctccttta

SEQ ID NO: 7973212 - DNA, 21 bp, Homo sapiens
ctcttgctgatgtctccttta

SEQ ID NO: 7973213 - DNA, 21 bp, Homo sapiens
ctcttgctgatgtctccttta

SEQ ID NO: 7973214 - DNA, 22 bp, Homo sapiens
ctcttgctgtcaaagcagggta

SEQ ID NO: 7973215 - DNA, 21 bp, Homo sapiens
ctcttgctgatgtctccttta

SEQ ID NO: 7973216 - DNA, 22 bp, Homo sapiens
ctcttgctgtcaaagcagggta

SEQ ID NO: 7973217 - DNA, 22 bp, Homo sapiens
ctcttgcttgcaagtggggata

SEQ ID NO: 7973218 - DNA, 21 bp, Homo sapiens
ctcttgctgatgtctccttta

SEQ ID NO: 7973219 - DNA, 22 bp, Homo sapiens
ctcttgcattctatccctccag

SEQ ID NO: 7973220 - DNA, 22 bp, Homo sapiens
ctcttgcattctatccctccag

SEQ ID NO: 7973221 - DNA, 20 bp, Homo sapiens
ctcttgggcccaaagggcct

SEQ ID NO: 7973222 - DNA, 22 bp, Homo sapiens
ctcttgggatttgcaggctcag

SEQ ID NO: 7973223 - DNA, 19 bp, Homo sapiens
ctcttgggtggcagaggcc

SEQ ID NO: 7973224 - DNA, 19 bp, Homo sapiens
ctcttgggtggcagaggcc

SEQ ID NO: 7973225 - DNA, 22 bp, Homo sapiens
ctcttggccagacacagaggca

SEQ ID NO: 7973226 - DNA, 22 bp, Homo sapiens
ctcttgcttgcaagtggggata

SEQ ID NO: 7973227 - DNA, 20 bp, Homo sapiens
ctcttggcagattacctgtc

SEQ ID NO: 7973228 - DNA, 22 bp, Homo sapiens
ctcttggccagacacagaggca

SEQ ID NO: 7973229 - DNA, 22 bp, Homo sapiens
ctcttggccagacacagaggca

SEQ ID NO: 7973230 - DNA, 20 bp, Homo sapiens
ctcttggcagattacctgtc

SEQ ID NO: 7973231 - DNA, 22 bp, Homo sapiens
ctcttggccagacacagaggca

SEQ ID NO: 7973232 - DNA, 22 bp, Homo sapiens
ctcttgggagtgctctggagaa

SEQ ID NO: 7973233 - DNA, 22 bp, Homo sapiens
ctcttgggagtgctctggagaa

SEQ ID NO: 7973234 - DNA, 22 bp, Homo sapiens
ctctttggcgttggcagagcca

SEQ ID NO: 7973235 - DNA, 22 bp, Homo sapiens
ctctttggcgttggcagagcca

SEQ ID NO: 7973236 - DNA, 22 bp, Homo sapiens
ctctttggcgttggcagagcca

SEQ ID NO: 7973237 - DNA, 21 bp, Homo sapiens
ctcttgtctttgctcagtagc

SEQ ID NO: 7973238 - DNA, 21 bp, Homo sapiens
ctcttgtctttgctcagtagc

SEQ ID NO: 7973239 - DNA, 16 bp, Homo sapiens
ctctttggcttccaag

SEQ ID NO: 7973240 - DNA, 16 bp, Homo sapiens
ctctttggcttccaag

SEQ ID NO: 7973241 - DNA, 22 bp, Homo sapiens
ctctttggctttgactcccatt

SEQ ID NO: 7973242 - DNA, 22 bp, Homo sapiens
ctctttggctttgactcccatt

SEQ ID NO: 7973243 - DNA, 22 bp, Homo sapiens
ctcttgtattggagttagtggg

SEQ ID NO: 7973244 - DNA, 22 bp, Homo sapiens
ctcttggtttgcctccatggac

SEQ ID NO: 7973245 - DNA, 22 bp, Homo sapiens
ctcttggtgtgttctcctggga

SEQ ID NO: 7973246 - DNA, 22 bp, Homo sapiens
ctcttggtgggtggcctgttga

SEQ ID NO: 7973247 - DNA, 21 bp, Homo sapiens
ctcttggtcctccctgtgacc

SEQ ID NO: 7973248 - DNA, 22 bp, Homo sapiens
ctcttggtaagacattagaggt

SEQ ID NO: 7973249 - DNA, 22 bp, Homo sapiens
ctcttgggtgggcagtgggcct

SEQ ID NO: 7973250 - DNA, 22 bp, Homo sapiens
agtggctgtttataggtgggta

SEQ ID NO: 7973251 - DNA, 22 bp, Homo sapiens
agtggctgtttataggtgggta

SEQ ID NO: 7973252 - DNA, 22 bp, Homo sapiens
agtggctgtttataggtgggta

SEQ ID NO: 7973253 - DNA, 22 bp, Homo sapiens
agtggctgtttataggtgggta

SEQ ID NO: 7973254 - DNA, 22 bp, Homo sapiens
agtggcttcatttctgccagaa

SEQ ID NO: 7973255 - DNA, 22 bp, Homo sapiens
agtggcttcatttctgccagaa

SEQ ID NO: 7973256 - DNA, 22 bp, Homo sapiens
agtggcttcatttctgccagaa

SEQ ID NO: 7973257 - DNA, 22 bp, Homo sapiens
agtggcttatctgggacagcta

SEQ ID NO: 7973258 - DNA, 22 bp, Homo sapiens
agtggcttatctgggacagcta

SEQ ID NO: 7973259 - DNA, 22 bp, Homo sapiens
agtggcttatgtttagaatcat

SEQ ID NO: 7973260 - DNA, 22 bp, Homo sapiens
agtggcttatgtttagaatcat

SEQ ID NO: 7973261 - DNA, 22 bp, Homo sapiens
agtggctgttccaggtgaggac

SEQ ID NO: 7973262 - DNA, 22 bp, Homo sapiens
agtggctgttccaggtgaggac

SEQ ID NO: 7973263 - DNA, 22 bp, Homo sapiens
agtggctgttccaggtgaggac

SEQ ID NO: 7973264 - DNA, 22 bp, Homo sapiens
agtggctgttcattttacacaa

SEQ ID NO: 7973265 - DNA, 22 bp, Homo sapiens
agtggctttttagtggcagatg

SEQ ID NO: 7973266 - DNA, 22 bp, Homo sapiens
agtggcttttcttgcttctggc

SEQ ID NO: 7973267 - DNA, 22 bp, Homo sapiens
agtgggaatttcagtgctaaaa

SEQ ID NO: 7973268 - DNA, 22 bp, Homo sapiens
agtgggaatttcagtgctaaaa

SEQ ID NO: 7973269 - DNA, 22 bp, Homo sapiens
agtgggaattttctcccaggga

SEQ ID NO: 7973270 - DNA, 22 bp, Homo sapiens
agtgggacagtgtagagcgtca

SEQ ID NO: 7973271 - DNA, 22 bp, Homo sapiens
agtgggactgctatgacagaag

SEQ ID NO: 7973272 - DNA, 22 bp, Homo sapiens
agtggcttgctctgcctcagcc

SEQ ID NO: 7973273 - DNA, 18 bp, Homo sapiens
agtggcttcctgctcata

SEQ ID NO: 7973274 - DNA, 22 bp, Homo sapiens
agtggcttcatttctgccagaa

SEQ ID NO: 7973275 - DNA, 22 bp, Homo sapiens
agtggcttgtccgtggtcacat

SEQ ID NO: 7973276 - DNA, 22 bp, Homo sapiens
agtggcttgtccgtggtcacat

SEQ ID NO: 7973277 - DNA, 22 bp, Homo sapiens
agtggctttgttccgtatggca

SEQ ID NO: 7973278 - DNA, 22 bp, Homo sapiens
agtggcttgtccgtggtcacat

SEQ ID NO: 7973279 - DNA, 22 bp, Homo sapiens
agtggcttttcttgcttctggc

SEQ ID NO: 7973280 - DNA, 22 bp, Homo sapiens
agtggcttttcttgcttctggc

SEQ ID NO: 7973281 - DNA, 22 bp, Homo sapiens
ctctgtcacttctccagctgag

SEQ ID NO: 7973282 - DNA, 22 bp, Homo sapiens
ctctgtcaggctgcagatgctc

SEQ ID NO: 7973283 - DNA, 18 bp, Homo sapiens
ctctgtcataagtgtcat

SEQ ID NO: 7973284 - DNA, 22 bp, Homo sapiens
ctctgtcagagtgttgtcccca

SEQ ID NO: 7973285 - DNA, 22 bp, Homo sapiens
ctctgtagccatgggtatattc

SEQ ID NO: 7973286 - DNA, 22 bp, Homo sapiens
ctctggtttttcttccattaag

SEQ ID NO: 7973287 - DNA, 21 bp, Homo sapiens
ctctggtttgcattggattat

SEQ ID NO: 7973288 - DNA, 22 bp, Homo sapiens
ctctggggttagatctgatgct

SEQ ID NO: 7973289 - DNA, 22 bp, Homo sapiens
ctctggggttagatctgatgct

SEQ ID NO: 7973290 - DNA, 22 bp, Homo sapiens
agtgggagaatgaataagggcc

SEQ ID NO: 7973291 - DNA, 22 bp, Homo sapiens
agtgggagaatgaataagggcc

SEQ ID NO: 7973292 - DNA, 22 bp, Homo sapiens
agtgggagagaagcaagtagta

SEQ ID NO: 7973293 - DNA, 22 bp, Homo sapiens
ctctggggttagatctgatgct

SEQ ID NO: 7973294 - DNA, 22 bp, Homo sapiens
ctctggacagcaggtgctgtgg

SEQ ID NO: 7973295 - DNA, 22 bp, Homo sapiens
ctctggacagccctccaggaag

SEQ ID NO: 7973296 - DNA, 22 bp, Homo sapiens
ctctggacagccctccaggaag

SEQ ID NO: 7973297 - DNA, 19 bp, Homo sapiens
ctctggagaacaatagtgc

SEQ ID NO: 7973298 - DNA, 22 bp, Homo sapiens
ctctggacctcagtctactaat

SEQ ID NO: 7973299 - DNA, 22 bp, Homo sapiens
ctctggaccctcctgctgagag

SEQ ID NO: 7973300 - DNA, 22 bp, Homo sapiens
ctctggacctcagctacagact

SEQ ID NO: 7973301 - DNA, 17 bp, Homo sapiens
ctctggaattggtgaag

SEQ ID NO: 7973302 - DNA, 17 bp, Homo sapiens
ctctggaattggtgaag

SEQ ID NO: 7973303 - DNA, 22 bp, Homo sapiens
ctctgctgcaggaaggcgtgca

SEQ ID NO: 7973304 - DNA, 20 bp, Homo sapiens
ctctctccatctcagtggcc

SEQ ID NO: 7973305 - DNA, 20 bp, Homo sapiens
ctctctccatctcagtggcc

SEQ ID NO: 7973306 - DNA, 21 bp, Homo sapiens
ctctctagatggcttccagcc

SEQ ID NO: 7973307 - DNA, 19 bp, Homo sapiens
ctctctccagtggctggct

SEQ ID NO: 7973308 - DNA, 20 bp, Homo sapiens
ctctctccatctcagtggcc

SEQ ID NO: 7973309 - DNA, 22 bp, Homo sapiens
ctctctccttagctgcagacca

SEQ ID NO: 7973310 - DNA, 22 bp, Homo sapiens
ctctctccttagctgcagacca

SEQ ID NO: 7973311 - DNA, 22 bp, Homo sapiens
ctctggagaacgctatggatct

SEQ ID NO: 7973312 - DNA, 22 bp, Homo sapiens
ctctggagaacgctatggatct

SEQ ID NO: 7973313 - DNA, 19 bp, Homo sapiens
ctctggagaacaatagtgc

SEQ ID NO: 7973314 - DNA, 22 bp, Homo sapiens
ctctggagaactccttgtgtct

SEQ ID NO: 7973315 - DNA, 22 bp, Homo sapiens
ctctggagaacgctatggatct

SEQ ID NO: 7973316 - DNA, 22 bp, Homo sapiens
ctctggagaggttcccatggga

SEQ ID NO: 7973317 - DNA, 22 bp, Homo sapiens
ctctggagaactccttgtgtct

SEQ ID NO: 7973318 - DNA, 22 bp, Homo sapiens
ctctggagaactccttgtgtct

SEQ ID NO: 7973319 - DNA, 22 bp, Homo sapiens
ctctggagaggttcccatggga

SEQ ID NO: 7973320 - DNA, 23 bp, Homo sapiens
ctctggagatcctctgcctgggt

SEQ ID NO: 7973321 - DNA, 23 bp, Homo sapiens
ctctggagatcctctgcctgggt

SEQ ID NO: 7973322 - DNA, 23 bp, Homo sapiens
ctctggagatcctctgcctgggt

SEQ ID NO: 7973323 - DNA, 23 bp, Homo sapiens
ctctggagatcctctgcctgggt

SEQ ID NO: 7973324 - DNA, 23 bp, Homo sapiens
ctctggagatcctctgcctgggt

SEQ ID NO: 7973325 - DNA, 23 bp, Homo sapiens
ctctggagatcctctgcctgggt

SEQ ID NO: 7973326 - DNA, 23 bp, Homo sapiens
ctctggagatcctctgcctgggt

SEQ ID NO: 7973327 - DNA, 22 bp, Homo sapiens
ctctggagatggttctcaattg

SEQ ID NO: 7973328 - DNA, 23 bp, Homo sapiens
ctctggagatcctctgcctgggt

SEQ ID NO: 7973329 - DNA, 22 bp, Homo sapiens
agtggctgtgaaatacatggga

SEQ ID NO: 7973330 - DNA, 22 bp, Homo sapiens
agtggctgtgaaatacatggga

SEQ ID NO: 7973331 - DNA, 19 bp, Homo sapiens
ctctggagcagacactgga

SEQ ID NO: 7973332 - DNA, 19 bp, Homo sapiens
ctctggagcagacactgga

SEQ ID NO: 7973333 - DNA, 22 bp, Homo sapiens
ctctggagcaccgggctatcca

SEQ ID NO: 7973334 - DNA, 22 bp, Homo sapiens
ctctggagcaccgggctatcca

SEQ ID NO: 7973335 - DNA, 22 bp, Homo sapiens
ctctggagcaccgggctatcca

SEQ ID NO: 7973336 - DNA, 22 bp, Homo sapiens
agtgctgggctatctactgcta

SEQ ID NO: 7973337 - DNA, 22 bp, Homo sapiens
agtgctgggctatctactgcta

SEQ ID NO: 7973338 - DNA, 22 bp, Homo sapiens
agtgctgggctatctactgcta

SEQ ID NO: 7973339 - DNA, 22 bp, Homo sapiens
agtgctgggattgcaggcatga

SEQ ID NO: 7973340 - DNA, 22 bp, Homo sapiens
agtgctgggattgcaggcatga

SEQ ID NO: 7973341 - DNA, 22 bp, Homo sapiens
agtgctgggattgcaggcatga

SEQ ID NO: 7973342 - DNA, 22 bp, Homo sapiens
agtgctgggattgcaggcatga

SEQ ID NO: 7973343 - DNA, 22 bp, Homo sapiens
agtgctgggattgcaggcatga

SEQ ID NO: 7973344 - DNA, 23 bp, Homo sapiens
ctctccaccttcccacccaggga

SEQ ID NO: 7973345 - DNA, 23 bp, Homo sapiens
ctctccaccttcccacccaggga

SEQ ID NO: 7973346 - DNA, 23 bp, Homo sapiens
ctctccaccttcccacccaggga

SEQ ID NO: 7973347 - DNA, 22 bp, Homo sapiens
ctctccaagttatcaagatgaa

SEQ ID NO: 7973348 - DNA, 22 bp, Homo sapiens
agtgctgggctatctactgcta

SEQ ID NO: 7973349 - DNA, 19 bp, Homo sapiens
ctctccacctaacaggtat

SEQ ID NO: 7973350 - DNA, 22 bp, Homo sapiens
agtgctgggctatctactgcta

SEQ ID NO: 7973351 - DNA, 22 bp, Homo sapiens
agtgctgggctatctactgcta

SEQ ID NO: 7973352 - DNA, 22 bp, Homo sapiens
agtgctgggtactgttcccatt

SEQ ID NO: 7973353 - DNA, 22 bp, Homo sapiens
agtgctgggtactgttcccatt

SEQ ID NO: 7973354 - DNA, 22 bp, Homo sapiens
agtgctgggtactgttcccatt

SEQ ID NO: 7973355 - DNA, 22 bp, Homo sapiens
ctctccattccctacagttttc

SEQ ID NO: 7973356 - DNA, 22 bp, Homo sapiens
ctctccattccctacagttttc

SEQ ID NO: 7973357 - DNA, 22 bp, Homo sapiens
ctctccattccctacagttttc

SEQ ID NO: 7973358 - DNA, 22 bp, Homo sapiens
ctctccattccctacagttttc

SEQ ID NO: 7973359 - DNA, 22 bp, Homo sapiens
ctctccattccctacagttttc

SEQ ID NO: 7973360 - DNA, 22 bp, Homo sapiens
ctctccattccctacagttttc

SEQ ID NO: 7973361 - DNA, 20 bp, Homo sapiens
ctctcccagcacagcttcct

SEQ ID NO: 7973362 - DNA, 22 bp, Homo sapiens
ctctccatctgtgtgacctccc

SEQ ID NO: 7973363 - DNA, 22 bp, Homo sapiens
ctctccagttatagctgatttg

SEQ ID NO: 7973364 - DNA, 22 bp, Homo sapiens
ctctccagttatagctgatttg

SEQ ID NO: 7973365 - DNA, 22 bp, Homo sapiens
ctctccatctgtgtgacctccc

SEQ ID NO: 7973366 - DNA, 23 bp, Homo sapiens
ctctccaccttcccacccaggga

SEQ ID NO: 7973367 - DNA, 22 bp, Homo sapiens
ctctccactcagcgtcatgtcc

SEQ ID NO: 7973368 - DNA, 22 bp, Homo sapiens
ctctccagttatagctgatttg

SEQ ID NO: 7973369 - DNA, 22 bp, Homo sapiens
ctcggcaggtggaggttgtagt

SEQ ID NO: 7973370 - DNA, 22 bp, Homo sapiens
ctcggcaggtggaggttgtagt

SEQ ID NO: 7973371 - DNA, 22 bp, Homo sapiens
ctcggcaggtggaggttgtagt

SEQ ID NO: 7973372 - DNA, 22 bp, Homo sapiens
ctcggcaggtggaggttgtagt

SEQ ID NO: 7973373 - DNA, 22 bp, Homo sapiens
ctcgggcaccctggttctggtg

SEQ ID NO: 7973374 - DNA, 22 bp, Homo sapiens
ctcgggcaccctggttctggtg

SEQ ID NO: 7973375 - DNA, 22 bp, Homo sapiens
ctcggctctccatttttgtttg

SEQ ID NO: 7973376 - DNA, 22 bp, Homo sapiens
ctcggctctccatttttgtttg

SEQ ID NO: 7973377 - DNA, 22 bp, Homo sapiens
ctcgggcaccctggttctggtg

SEQ ID NO: 7973378 - DNA, 22 bp, Homo sapiens
ctcgggcttgaggctgtttacc

SEQ ID NO: 7973379 - DNA, 22 bp, Homo sapiens
agtgctggcccatagctgctgg

SEQ ID NO: 7973380 - DNA, 22 bp, Homo sapiens
agtgctggcccatagctgctgg

SEQ ID NO: 7973381 - DNA, 22 bp, Homo sapiens
ctcgggcttgaggctgtttacc

SEQ ID NO: 7973382 - DNA, 22 bp, Homo sapiens
agtgctggcccatagctgctgg

SEQ ID NO: 7973383 - DNA, 22 bp, Homo sapiens
agtgctggcccatagctgctgg

SEQ ID NO: 7973384 - DNA, 22 bp, Homo sapiens
agtgctggcccatagctgctgg

SEQ ID NO: 7973385 - DNA, 22 bp, Homo sapiens
agtgctggcccatagctgctgg

SEQ ID NO: 7973386 - DNA, 22 bp, Homo sapiens
agtgctggcccatagctgctgg

SEQ ID NO: 7973387 - DNA, 22 bp, Homo sapiens
agtgctgggattacaggcataa

SEQ ID NO: 7973388 - DNA, 22 bp, Homo sapiens
agtgctgggattacaggcataa

SEQ ID NO: 7973389 - DNA, 22 bp, Homo sapiens
agtgctgggattgcaggcatga

SEQ ID NO: 7973390 - DNA, 22 bp, Homo sapiens
agtgctgggattgcaggcatga

SEQ ID NO: 7973391 - DNA, 22 bp, Homo sapiens
agtgctgggattgcaggcatga

SEQ ID NO: 7973392 - DNA, 22 bp, Homo sapiens
agtgctgggattacaggcataa

SEQ ID NO: 7973393 - DNA, 22 bp, Homo sapiens
agtgctgggattacaggcataa

SEQ ID NO: 7973394 - DNA, 22 bp, Homo sapiens
agtgctgggattacaggcataa

SEQ ID NO: 7973395 - DNA, 22 bp, Homo sapiens
agtgctgggattacaggcataa

SEQ ID NO: 7973396 - DNA, 22 bp, Homo sapiens
agtgctgggattacaggcataa

SEQ ID NO: 7973397 - DNA, 22 bp, Homo sapiens
agtgctggcccatagctgctgg

SEQ ID NO: 7973398 - DNA, 22 bp, Homo sapiens
agtgctggcccatagctgctgg

SEQ ID NO: 7973399 - DNA, 22 bp, Homo sapiens
agtgctgggattacaggcataa

SEQ ID NO: 7973400 - DNA, 20 bp, Homo sapiens
ctctcccagcacagcttcct

SEQ ID NO: 7973401 - DNA, 22 bp, Homo sapiens
ctctccattccctacagttttc

SEQ ID NO: 7973402 - DNA, 22 bp, Homo sapiens
ctctcccagtcaggctcaggat

SEQ ID NO: 7973403 - DNA, 22 bp, Homo sapiens
ctctcccagtcaggctcaggat

SEQ ID NO: 7973404 - DNA, 22 bp, Homo sapiens
ctctcccagtcaggctcaggat

SEQ ID NO: 7973405 - DNA, 22 bp, Homo sapiens
ctctccccacaccctctgcatg

SEQ ID NO: 7973406 - DNA, 22 bp, Homo sapiens
ctctccccacaccctctgcatg

SEQ ID NO: 7973407 - DNA, 22 bp, Homo sapiens
ctctccccacaccctctgcatg

SEQ ID NO: 7973408 - DNA, 22 bp, Homo sapiens
ctctccccacaccctctgcatg

SEQ ID NO: 7973409 - DNA, 22 bp, Homo sapiens
ctctccccacaccctctgcatg

SEQ ID NO: 7973410 - DNA, 22 bp, Homo sapiens
ctctccccacaccctctgcatg

SEQ ID NO: 7973411 - DNA, 17 bp, Homo sapiens
ctctccttcctctgagg

SEQ ID NO: 7973412 - DNA, 22 bp, Homo sapiens
ctctccccacaccctctgcatg

SEQ ID NO: 7973413 - DNA, 22 bp, Homo sapiens
ctctccccacaccctctgcatg

SEQ ID NO: 7973414 - DNA, 22 bp, Homo sapiens
ctctcccagtcaggctcaggat

SEQ ID NO: 7973415 - DNA, 22 bp, Homo sapiens
ctctctcagtgtaatacaggat

SEQ ID NO: 7973416 - DNA, 22 bp, Homo sapiens
ctctctcagtgtaatacaggat

SEQ ID NO: 7973417 - DNA, 19 bp, Homo sapiens
ctctctccagtggctggct

SEQ ID NO: 7973418 - DNA, 19 bp, Homo sapiens
ctctctccagtggctggct

SEQ ID NO: 7973419 - DNA, 19 bp, Homo sapiens
ctctctccagtggctggct

SEQ ID NO: 7973420 - DNA, 22 bp, Homo sapiens
ctctctagaggcccaccttgag

SEQ ID NO: 7973421 - DNA, 22 bp, Homo sapiens
ctctctagaggcccaccttgag

SEQ ID NO: 7973422 - DNA, 21 bp, Homo sapiens
ctctctagatggcttccagcc

SEQ ID NO: 7973423 - DNA, 22 bp, Homo sapiens
ctctcgccagcggggctgcgct

SEQ ID NO: 7973424 - DNA, 22 bp, Homo sapiens
ctctcgccagcggggctgcgct

SEQ ID NO: 7973425 - DNA, 22 bp, Homo sapiens
ctctcgccagcggggctgcgct

SEQ ID NO: 7973426 - DNA, 22 bp, Homo sapiens
ctctctaacgacattcccattc

SEQ ID NO: 7973427 - DNA, 22 bp, Homo sapiens
ctctctaacgacattcccattc

SEQ ID NO: 7973428 - DNA, 22 bp, Homo sapiens
ctctcggggaaggaggtacatt

SEQ ID NO: 7973429 - DNA, 22 bp, Homo sapiens
ctctcgccagcggggctgcgct

SEQ ID NO: 7973430 - DNA, 22 bp, Homo sapiens
ctctcgcgtgtgcctttccgct

SEQ ID NO: 7973431 - DNA, 22 bp, Homo sapiens
ctctccttgcagatggctgcct

SEQ ID NO: 7973432 - DNA, 22 bp, Homo sapiens
ctctccttgcagatggctgcct

SEQ ID NO: 7973433 - DNA, 17 bp, Homo sapiens
ctctccttcctctgagg

SEQ ID NO: 7973434 - DNA, 22 bp, Homo sapiens
ctctcctttcactaaatattct

SEQ ID NO: 7973435 - DNA, 22 bp, Homo sapiens
ctctcctttcactaaatattct

SEQ ID NO: 7973436 - DNA, 22 bp, Homo sapiens
ctctcctttcactaaatattct

SEQ ID NO: 7973437 - DNA, 22 bp, Homo sapiens
ctctcctttgaagcaactgtat

SEQ ID NO: 7973438 - DNA, 22 bp, Homo sapiens
ctctcctttgaagcaactgtat

SEQ ID NO: 7973439 - DNA, 22 bp, Homo sapiens
ctctcgaagagacttcccagct

SEQ ID NO: 7973440 - DNA, 22 bp, Homo sapiens
ctctcctttactgcagagagcg

SEQ ID NO: 7973441 - DNA, 22 bp, Homo sapiens
ctctcctttactgcagagagcg

SEQ ID NO: 7973442 - DNA, 22 bp, Homo sapiens
ctcctgaggaaaagcttggtca

SEQ ID NO: 7973443 - DNA, 22 bp, Homo sapiens
agtgctggattacaggcgtgag

SEQ ID NO: 7973444 - DNA, 22 bp, Homo sapiens
agtgctggattacaggcgtgag

SEQ ID NO: 7973445 - DNA, 22 bp, Homo sapiens
agtgctggattacaggcgtgag

SEQ ID NO: 7973446 - DNA, 22 bp, Homo sapiens
ctcctgaggaaaagcttggtca

SEQ ID NO: 7973447 - DNA, 22 bp, Homo sapiens
ctcctgaggaaaagcttggtca

SEQ ID NO: 7973448 - DNA, 22 bp, Homo sapiens
ctcctgagggatgcttaggctt

SEQ ID NO: 7973449 - DNA, 22 bp, Homo sapiens
ctcctgagggatgcttaggctt

SEQ ID NO: 7973450 - DNA, 22 bp, Homo sapiens
ctcctgaggacttctattgggt

SEQ ID NO: 7973451 - DNA, 22 bp, Homo sapiens
ctcctgagggatgcttaggctt

SEQ ID NO: 7973452 - DNA, 22 bp, Homo sapiens
ctcctgagggatgcttaggctt

SEQ ID NO: 7973453 - DNA, 22 bp, Homo sapiens
ctcctgagggatgcttaggctt

SEQ ID NO: 7973454 - DNA, 22 bp, Homo sapiens
agtgctggattacaggcgtgag

SEQ ID NO: 7973455 - DNA, 22 bp, Homo sapiens
agtgctggattacaggcgtgag

SEQ ID NO: 7973456 - DNA, 22 bp, Homo sapiens
agtgctggattacaggcgtgag

SEQ ID NO: 7973457 - DNA, 22 bp, Homo sapiens
agtgctggattacaggcgtgag

SEQ ID NO: 7973458 - DNA, 22 bp, Homo sapiens
agtgctggattacaggcgtgag

SEQ ID NO: 7973459 - DNA, 22 bp, Homo sapiens
agtgctggagggaggcaggttc

SEQ ID NO: 7973460 - DNA, 22 bp, Homo sapiens
agtgctggattacaggcgtgag

SEQ ID NO: 7973461 - DNA, 22 bp, Homo sapiens
agtgctggattacaggcgtgag

SEQ ID NO: 7973462 - DNA, 22 bp, Homo sapiens
agtgctggattacaggcgtgag

SEQ ID NO: 7973463 - DNA, 22 bp, Homo sapiens
agtgctggagggaggcaggttc

SEQ ID NO: 7973464 - DNA, 22 bp, Homo sapiens
agtgctggagggaggcaggttc

SEQ ID NO: 7973465 - DNA, 22 bp, Homo sapiens
agtgctggagggaggcaggttc

SEQ ID NO: 7973466 - DNA, 22 bp, Homo sapiens
agtgctggagggaggcaggttc

SEQ ID NO: 7973467 - DNA, 22 bp, Homo sapiens
agtgctggagggaggcaggttc

SEQ ID NO: 7973468 - DNA, 22 bp, Homo sapiens
agtgctggagggaggcaggttc

SEQ ID NO: 7973469 - DNA, 22 bp, Homo sapiens
agtgctggagggaggcaggttc

SEQ ID NO: 7973470 - DNA, 23 bp, Homo sapiens
agtgctggagaagcttctggctt

SEQ ID NO: 7973471 - DNA, 23 bp, Homo sapiens
agtgctggagaagcttctggctt

SEQ ID NO: 7973472 - DNA, 23 bp, Homo sapiens
agtgctggagaagcttctggctt

SEQ ID NO: 7973473 - DNA, 22 bp, Homo sapiens
agtgctggaaagggacggagga

SEQ ID NO: 7973474 - DNA, 22 bp, Homo sapiens
agtgctggaaagggacggagga

SEQ ID NO: 7973475 - DNA, 22 bp, Homo sapiens
agtgctggaaagggacggagga

SEQ ID NO: 7973476 - DNA, 22 bp, Homo sapiens
agtgctggagggaggcaggttc

SEQ ID NO: 7973477 - DNA, 22 bp, Homo sapiens
agtgctggagggaggcaggttc

SEQ ID NO: 7973478 - DNA, 23 bp, Homo sapiens
agtgctggagaagcttctggctt

SEQ ID NO: 7973479 - DNA, 23 bp, Homo sapiens
agtgctggagaagcttctggctt

SEQ ID NO: 7973480 - DNA, 22 bp, Homo sapiens
agtgctggaaagggacggagga

SEQ ID NO: 7973481 - DNA, 22 bp, Homo sapiens
agtgctggaaagggacggagga

SEQ ID NO: 7973482 - DNA, 22 bp, Homo sapiens
agtgctgagtgattgcaaagga

SEQ ID NO: 7973483 - DNA, 22 bp, Homo sapiens
agtgctgaggccatactccata

SEQ ID NO: 7973484 - DNA, 22 bp, Homo sapiens
agtgctgagtgattgcaaagga

SEQ ID NO: 7973485 - DNA, 22 bp, Homo sapiens
agtgctgaggagaggtactcca

SEQ ID NO: 7973486 - DNA, 22 bp, Homo sapiens
agtgctgaggccatactccata

SEQ ID NO: 7973487 - DNA, 22 bp, Homo sapiens
agtgctgactctgggcacagtg

SEQ ID NO: 7973488 - DNA, 22 bp, Homo sapiens
agtgctgactctgggcacagtg

SEQ ID NO: 7973489 - DNA, 22 bp, Homo sapiens
agtgctgaggaaggggcccatt

SEQ ID NO: 7973490 - DNA, 22 bp, Homo sapiens
agtgctatcgagttctaatgct

SEQ ID NO: 7973491 - DNA, 22 bp, Homo sapiens
agtgctatcgagttctaatgct

SEQ ID NO: 7973492 - DNA, 22 bp, Homo sapiens
agtgctatcgagttctaatgct

SEQ ID NO: 7973493 - DNA, 22 bp, Homo sapiens
agtgctatcgagttctaatgct

SEQ ID NO: 7973494 - DNA, 22 bp, Homo sapiens
agtgctgactctgggcacagtg

SEQ ID NO: 7973495 - DNA, 23 bp, Homo sapiens
agtgctgaattgaaagctccagg

SEQ ID NO: 7973496 - DNA, 22 bp, Homo sapiens
agtgctatcgagttctaatgct

SEQ ID NO: 7973497 - DNA, 22 bp, Homo sapiens
agtgctatcgagttctaatgct

SEQ ID NO: 7973498 - DNA, 23 bp, Homo sapiens
agtgctgaattgaaagctccagg

SEQ ID NO: 7973499 - DNA, 22 bp, Homo sapiens
ctccagagagtccagctctggg

SEQ ID NO: 7973500 - DNA, 22 bp, Homo sapiens
ctccagagagtccagctctggg

SEQ ID NO: 7973501 - DNA, 22 bp, Homo sapiens
ctccagagagtccagctctggg

SEQ ID NO: 7973502 - DNA, 22 bp, Homo sapiens
ctccttggttcaaatgataaaa

SEQ ID NO: 7973503 - DNA, 22 bp, Homo sapiens
ctccttggtgtagtactgagca

SEQ ID NO: 7973504 - DNA, 22 bp, Homo sapiens
ctcctttgatcccaaatgaccc

SEQ ID NO: 7973505 - DNA, 22 bp, Homo sapiens
ctcctttgatcccaaatgaccc

SEQ ID NO: 7973506 - DNA, 22 bp, Homo sapiens
ctccttttcctactcatactat

SEQ ID NO: 7973507 - DNA, 18 bp, Homo sapiens
ctcctttccctacacctc

SEQ ID NO: 7973508 - DNA, 23 bp, Homo sapiens
ctccttggtatgccatgcccagc

SEQ ID NO: 7973509 - DNA, 19 bp, Homo sapiens
ctccttgccatttcttttc

SEQ ID NO: 7973510 - DNA, 18 bp, Homo sapiens
ctccttggagaagaggcc

SEQ ID NO: 7973511 - DNA, 18 bp, Homo sapiens
ctccttggagaagaggcc

SEQ ID NO: 7973512 - DNA, 22 bp, Homo sapiens
ctcgcatgccctgcctcatcca

SEQ ID NO: 7973513 - DNA, 22 bp, Homo sapiens
ctcgcaggacagtgctaggact

SEQ ID NO: 7973514 - DNA, 22 bp, Homo sapiens
ctcgcatccaggataccctgag

SEQ ID NO: 7973515 - DNA, 22 bp, Homo sapiens
ctcgcatccaggataccctgag

SEQ ID NO: 7973516 - DNA, 22 bp, Homo sapiens
ctcgcaggacagtgctaggact

SEQ ID NO: 7973517 - DNA, 22 bp, Homo sapiens
ctccttttcctactcatactat

SEQ ID NO: 7973518 - DNA, 22 bp, Homo sapiens
ctccttttcctactcatactat

SEQ ID NO: 7973519 - DNA, 22 bp, Homo sapiens
ctcctttgatcccaaatgaccc

SEQ ID NO: 7973520 - DNA, 22 bp, Homo sapiens
ctccttttcctactcatactat

SEQ ID NO: 7973521 - DNA, 22 bp, Homo sapiens
ctcggaagcctgaagattttaa

SEQ ID NO: 7973522 - DNA, 22 bp, Homo sapiens
ctcggaggtttgttaagtggct

SEQ ID NO: 7973523 - DNA, 22 bp, Homo sapiens
ctcgcctgcctgtgtctctccc

SEQ ID NO: 7973524 - DNA, 22 bp, Homo sapiens
ctcgcggcgcccgaagcccttg

SEQ ID NO: 7973525 - DNA, 22 bp, Homo sapiens
ctcggaagaagcgttctcagag

SEQ ID NO: 7973526 - DNA, 22 bp, Homo sapiens
ctcgctatgcttttgctctgtg

SEQ ID NO: 7973527 - DNA, 22 bp, Homo sapiens
ctcctgcaagcctccccaagca

SEQ ID NO: 7973528 - DNA, 22 bp, Homo sapiens
ctcctgcaggtcagcaggcttg

SEQ ID NO: 7973529 - DNA, 22 bp, Homo sapiens
ctcctgcagccctcagcagcca

SEQ ID NO: 7973530 - DNA, 22 bp, Homo sapiens
ctcctgcagccctcagcagcca

SEQ ID NO: 7973531 - DNA, 22 bp, Homo sapiens
ctcctgagtagtagcattgtca

SEQ ID NO: 7973532 - DNA, 22 bp, Homo sapiens
ctcctgagtagtagcattgtca

SEQ ID NO: 7973533 - DNA, 22 bp, Homo sapiens
ctcctgagtagtagcattgtca

SEQ ID NO: 7973534 - DNA, 17 bp, Homo sapiens
ctcctgagtgaaaggga

SEQ ID NO: 7973535 - DNA, 22 bp, Homo sapiens
ctcctgagtagtagcattgtca

SEQ ID NO: 7973536 - DNA, 22 bp, Homo sapiens
ctcctgaggggacaggactcat

SEQ ID NO: 7973537 - DNA, 22 bp, Homo sapiens
ctcctgaggggacaggactcat

SEQ ID NO: 7973538 - DNA, 22 bp, Homo sapiens
ctcctgaggggacaggactcat

SEQ ID NO: 7973539 - DNA, 22 bp, Homo sapiens
ctcctgaggggacaggactcat

SEQ ID NO: 7973540 - DNA, 22 bp, Homo sapiens
ctcctgcatggttgtgctattg

SEQ ID NO: 7973541 - DNA, 22 bp, Homo sapiens
ctcctggtgctggggctgccgc

SEQ ID NO: 7973542 - DNA, 22 bp, Homo sapiens
ctcctggtgctggggctgccgc

SEQ ID NO: 7973543 - DNA, 22 bp, Homo sapiens
ctcctgccaccgcggtgtcctg

SEQ ID NO: 7973544 - DNA, 22 bp, Homo sapiens
ctcctgccaccgcggtgtcctg

SEQ ID NO: 7973545 - DNA, 22 bp, Homo sapiens
ctcctgccaccgcggtgtcctg

SEQ ID NO: 7973546 - DNA, 22 bp, Homo sapiens
ctcctgcaggtcagcaggcttg

SEQ ID NO: 7973547 - DNA, 22 bp, Homo sapiens
ctcctgcaggtcagcaggcttg

SEQ ID NO: 7973548 - DNA, 22 bp, Homo sapiens
ctcctgcaggtcagcaggcttg

SEQ ID NO: 7973549 - DNA, 22 bp, Homo sapiens
ctcctgcatgctcacatatgcc

SEQ ID NO: 7973550 - DNA, 22 bp, Homo sapiens
ctccttctgggcctggcagtgg

SEQ ID NO: 7973551 - DNA, 22 bp, Homo sapiens
ctccttctgaggctctgggttc

SEQ ID NO: 7973552 - DNA, 22 bp, Homo sapiens
ctcctggttcctgtcttaaata

SEQ ID NO: 7973553 - DNA, 22 bp, Homo sapiens
ctccttctgaggctctgggttc

SEQ ID NO: 7973554 - DNA, 22 bp, Homo sapiens
ctcctggtgctggggctgccgc

SEQ ID NO: 7973555 - DNA, 22 bp, Homo sapiens
ctcctggttcagagagctgaga

SEQ ID NO: 7973556 - DNA, 22 bp, Homo sapiens
ctcctggttcagagagctgaga

SEQ ID NO: 7973557 - DNA, 22 bp, Homo sapiens
ctcctggttcagagagctgaga

SEQ ID NO: 7973558 - DNA, 22 bp, Homo sapiens
aggtggggtgttggatgtttat

SEQ ID NO: 7973559 - DNA, 22 bp, Homo sapiens
aggtggggtgttggatgtttat

SEQ ID NO: 7973560 - DNA, 22 bp, Homo sapiens
aggtggggtgagctgcagacta

SEQ ID NO: 7973561 - DNA, 22 bp, Homo sapiens
cctttattcaattagtcctaat

SEQ ID NO: 7973562 - DNA, 22 bp, Homo sapiens
cctttattcaattagtcctaat

SEQ ID NO: 7973563 - DNA, 22 bp, Homo sapiens
cctttattcaattagtcctaat

SEQ ID NO: 7973564 - DNA, 22 bp, Homo sapiens
aggtggggtgttggatgtttat

SEQ ID NO: 7973565 - DNA, 22 bp, Homo sapiens
cctttattcaattagtcctaat

SEQ ID NO: 7973566 - DNA, 22 bp, Homo sapiens
cctttattcaattagtcctaat

SEQ ID NO: 7973567 - DNA, 22 bp, Homo sapiens
aggtgggggctgtgtccttgac

SEQ ID NO: 7973568 - DNA, 22 bp, Homo sapiens
aggtgggggctgtgtccttgac

SEQ ID NO: 7973569 - DNA, 22 bp, Homo sapiens
aggtgggggctgtgtccttgac

SEQ ID NO: 7973570 - DNA, 22 bp, Homo sapiens
aggtgggggctgtgtccttgac

SEQ ID NO: 7973571 - DNA, 22 bp, Homo sapiens
aggtgggggctgtgtccttgac

SEQ ID NO: 7973572 - DNA, 22 bp, Homo sapiens
aggtgggggctgtgtccttgac

SEQ ID NO: 7973573 - DNA, 22 bp, Homo sapiens
aggtgggggctgtgtccttgac

SEQ ID NO: 7973574 - DNA, 22 bp, Homo sapiens
aggtgggggctgtgtccttgac

SEQ ID NO: 7973575 - DNA, 22 bp, Homo sapiens
aggtggggtgagctgcagacta

SEQ ID NO: 7973576 - DNA, 22 bp, Homo sapiens
aggtggggtgagctgcagacta

SEQ ID NO: 7973577 - DNA, 22 bp, Homo sapiens
aggtggggtgagctgcagacta

SEQ ID NO: 7973578 - DNA, 22 bp, Homo sapiens
aggtggggtgagctgcagacta

SEQ ID NO: 7973579 - DNA, 22 bp, Homo sapiens
cctttggtcacctccactctta

SEQ ID NO: 7973580 - DNA, 22 bp, Homo sapiens
cctttattcaattagtcctaat

SEQ ID NO: 7973581 - DNA, 22 bp, Homo sapiens
cctttggtcacctccactctta

SEQ ID NO: 7973582 - DNA, 22 bp, Homo sapiens
cctttggtcttgatgaactgtt

SEQ ID NO: 7973583 - DNA, 22 bp, Homo sapiens
cctttggtggcttcaaaatggc

SEQ ID NO: 7973584 - DNA, 22 bp, Homo sapiens
cctttggtcttgatgaactgtt

SEQ ID NO: 7973585 - DNA, 22 bp, Homo sapiens
cctttggttgagtgaaagtaag

SEQ ID NO: 7973586 - DNA, 22 bp, Homo sapiens
cctttggtgttattgggagaca

SEQ ID NO: 7973587 - DNA, 22 bp, Homo sapiens
cctttggtggttttcagagatc

SEQ ID NO: 7973588 - DNA, 22 bp, Homo sapiens
cctttgttcactggagagtgga

SEQ ID NO: 7973589 - DNA, 22 bp, Homo sapiens
ccttttataaagttgtattgaa

SEQ ID NO: 7973590 - DNA, 22 bp, Homo sapiens
cctttgtgaatatgcagaaaat

SEQ ID NO: 7973591 - DNA, 19 bp, Homo sapiens
cctttggtttttggttcat

SEQ ID NO: 7973592 - DNA, 19 bp, Homo sapiens
cctttggtttccatgacat

SEQ ID NO: 7973593 - DNA, 22 bp, Homo sapiens
cctttgtaagatgtgaagactg

SEQ ID NO: 7973594 - DNA, 22 bp, Homo sapiens
cctttgtaccttaaatcctgtg

SEQ ID NO: 7973595 - DNA, 22 bp, Homo sapiens
cgaggaggaaacgcggagaact

SEQ ID NO: 7973596 - DNA, 22 bp, Homo sapiens
cgaggatgggatgtcttgacag

SEQ ID NO: 7973597 - DNA, 22 bp, Homo sapiens
cgaggcagacaaaagttggaag

SEQ ID NO: 7973598 - DNA, 22 bp, Homo sapiens
cgaggcaatagagcccagaggt

SEQ ID NO: 7973599 - DNA, 22 bp, Homo sapiens
cgaggcagacaaaagttggaag

SEQ ID NO: 7973600 - DNA, 18 bp, Homo sapiens
cgaggcaggcggatcacg

SEQ ID NO: 7973601 - DNA, 18 bp, Homo sapiens
cgaggcaggcggatcacg

SEQ ID NO: 7973602 - DNA, 22 bp, Homo sapiens
cgaggcaggcaggcggaggata

SEQ ID NO: 7973603 - DNA, 22 bp, Homo sapiens
cgaggcaggcaggcggaggata

SEQ ID NO: 7973604 - DNA, 22 bp, Homo sapiens
cgaggcagaggctgaaacggct

SEQ ID NO: 7973605 - DNA, 22 bp, Homo sapiens
cgaggcagggaagctgcaaaag

SEQ ID NO: 7973606 - DNA, 22 bp, Homo sapiens
cgaggcagggaagctgcaaaag

SEQ ID NO: 7973607 - DNA, 18 bp, Homo sapiens
cgaggcaggcggatcacg

SEQ ID NO: 7973608 - DNA, 20 bp, Homo sapiens
cgaggccaaggggctgggcc

SEQ ID NO: 7973609 - DNA, 22 bp, Homo sapiens
cgaggcagggaagctgcaaaag

SEQ ID NO: 7973610 - DNA, 20 bp, Homo sapiens
cgaggccaaggggctgggcc

SEQ ID NO: 7973611 - DNA, 20 bp, Homo sapiens
cgaggccaaggggctgggcc

SEQ ID NO: 7973612 - DNA, 22 bp, Homo sapiens
cgaggccaatgtgttttatgaa

SEQ ID NO: 7973613 - DNA, 22 bp, Homo sapiens
cgaggccaatgtgttttatgaa

SEQ ID NO: 7973614 - DNA, 22 bp, Homo sapiens
cgaggccacacctgcttctggg

SEQ ID NO: 7973615 - DNA, 22 bp, Homo sapiens
cgaggccacacctgcttctggg

SEQ ID NO: 7973616 - DNA, 23 bp, Homo sapiens
cgctcagaggttctgtccttggt

SEQ ID NO: 7973617 - DNA, 22 bp, Homo sapiens
cgctcagactcatgatatgctg

SEQ ID NO: 7973618 - DNA, 22 bp, Homo sapiens
cgaggccaccgtggtttccgag

SEQ ID NO: 7973619 - DNA, 22 bp, Homo sapiens
cgaggccagctctaagccctac

SEQ ID NO: 7973620 - DNA, 22 bp, Homo sapiens
ccttttatactcagtgatatca

SEQ ID NO: 7973621 - DNA, 22 bp, Homo sapiens
ccttttatactctgtcctctgg

SEQ ID NO: 7973622 - DNA, 22 bp, Homo sapiens
ccttttatactctgtcctctgg

SEQ ID NO: 7973623 - DNA, 22 bp, Homo sapiens
ccttttatactctgtcctctgg

SEQ ID NO: 7973624 - DNA, 22 bp, Homo sapiens
ccttttatactcagtgatatca

SEQ ID NO: 7973625 - DNA, 22 bp, Homo sapiens
ccttttatactcagtgatatca

SEQ ID NO: 7973626 - DNA, 22 bp, Homo sapiens
ccttttataaagttgtattgaa

SEQ ID NO: 7973627 - DNA, 22 bp, Homo sapiens
ccttttatgaacttgagcaggt

SEQ ID NO: 7973628 - DNA, 22 bp, Homo sapiens
ccttttatgaacttgagcaggt

SEQ ID NO: 7973629 - DNA, 22 bp, Homo sapiens
ccttttatgaacttgagcaggt

SEQ ID NO: 7973630 - DNA, 22 bp, Homo sapiens
ccttttatgaacttgagcaggt

SEQ ID NO: 7973631 - DNA, 22 bp, Homo sapiens
ccttttatgaacttgagcaggt

SEQ ID NO: 7973632 - DNA, 22 bp, Homo sapiens
ccttttatatggctcatcacag

SEQ ID NO: 7973633 - DNA, 22 bp, Homo sapiens
ccttttatagatcagtgtgtta

SEQ ID NO: 7973634 - DNA, 22 bp, Homo sapiens
ccttttatagatcagtgtgtta

SEQ ID NO: 7973635 - DNA, 22 bp, Homo sapiens
ccttttatagatcagtgtgtta

SEQ ID NO: 7973636 - DNA, 22 bp, Homo sapiens
ccttttatatggctcatcacag

SEQ ID NO: 7973637 - DNA, 22 bp, Homo sapiens
ccttttatatggctcatcacag

SEQ ID NO: 7973638 - DNA, 22 bp, Homo sapiens
cgaggaggaaacgcggagaact

SEQ ID NO: 7973639 - DNA, 22 bp, Homo sapiens
cgaggaagaagtttgagtcaag

SEQ ID NO: 7973640 - DNA, 22 bp, Homo sapiens
cgaggaagaagtttgagtcaag

SEQ ID NO: 7973641 - DNA, 22 bp, Homo sapiens
cgaggaaatatttacaactgat

SEQ ID NO: 7973642 - DNA, 22 bp, Homo sapiens
cgagcatgatgacggctgtggc

SEQ ID NO: 7973643 - DNA, 22 bp, Homo sapiens
cgaggaaaggcgatggctctcg

SEQ ID NO: 7973644 - DNA, 22 bp, Homo sapiens
cgagcatgatgacggctgtggc

SEQ ID NO: 7973645 - DNA, 22 bp, Homo sapiens
cgagcatgatgacggctgtggc

SEQ ID NO: 7973646 - DNA, 22 bp, Homo sapiens
cgagcatgatgacggctgtggc

SEQ ID NO: 7973647 - DNA, 22 bp, Homo sapiens
ccttttatgaacttgagcaggt

SEQ ID NO: 7973648 - DNA, 22 bp, Homo sapiens
cgagcatgatgacggctgtggc

SEQ ID NO: 7973649 - DNA, 22 bp, Homo sapiens
ccttttcaactaagattctgca

SEQ ID NO: 7973650 - DNA, 22 bp, Homo sapiens
cggcccgctgcgagtgcaccgt

SEQ ID NO: 7973651 - DNA, 22 bp, Homo sapiens
cggccagtgccgctctcgcctc

SEQ ID NO: 7973652 - DNA, 22 bp, Homo sapiens
cggccaggcacagtggcccacg

SEQ ID NO: 7973653 - DNA, 22 bp, Homo sapiens
cggccaagccggggccccgaag

SEQ ID NO: 7973654 - DNA, 22 bp, Homo sapiens
cggccaagccggggccccgaag

SEQ ID NO: 7973655 - DNA, 22 bp, Homo sapiens
cggccaagccggggccccgaag

SEQ ID NO: 7973656 - DNA, 22 bp, Homo sapiens
cggcatgggcgtccccctcact

SEQ ID NO: 7973657 - DNA, 22 bp, Homo sapiens
cggaggttgaggctgcagtgag

SEQ ID NO: 7973658 - DNA, 22 bp, Homo sapiens
cggaggttgaggctgcagtgag

SEQ ID NO: 7973659 - DNA, 22 bp, Homo sapiens
cggcatgggcgtccccctcact

SEQ ID NO: 7973660 - DNA, 22 bp, Homo sapiens
cggcatgggcgtccccctcact

SEQ ID NO: 7973661 - DNA, 22 bp, Homo sapiens
cggccaagccggggccccgaag

SEQ ID NO: 7973662 - DNA, 22 bp, Homo sapiens
cggccaagccggggccccgaag

SEQ ID NO: 7973663 - DNA, 22 bp, Homo sapiens
cggccaagccggggccccgaag

SEQ ID NO: 7973664 - DNA, 22 bp, Homo sapiens
cggccaagccggggccccgaag

SEQ ID NO: 7973665 - DNA, 22 bp, Homo sapiens
cggccaagccggggccccgaag

SEQ ID NO: 7973666 - DNA, 22 bp, Homo sapiens
cggaggggtttgaacagaggag

SEQ ID NO: 7973667 - DNA, 22 bp, Homo sapiens
cggaggggtttgaacagaggag

SEQ ID NO: 7973668 - DNA, 22 bp, Homo sapiens
cggaggggtttgaacagaggag

SEQ ID NO: 7973669 - DNA, 22 bp, Homo sapiens
cggaggggtttgaacagaggag

SEQ ID NO: 7973670 - DNA, 22 bp, Homo sapiens
cggaggggtttgaacagaggag

SEQ ID NO: 7973671 - DNA, 22 bp, Homo sapiens
cggaggggatacattttctgaa

SEQ ID NO: 7973672 - DNA, 22 bp, Homo sapiens
cggaggggatacattttctgaa

SEQ ID NO: 7973673 - DNA, 22 bp, Homo sapiens
cggaggggatacattttctgaa

SEQ ID NO: 7973674 - DNA, 22 bp, Homo sapiens
cggaggggatacattttctgaa

SEQ ID NO: 7973675 - DNA, 22 bp, Homo sapiens
cggaggggtttgaacagaggag

SEQ ID NO: 7973676 - DNA, 22 bp, Homo sapiens
cggaggggtttgaacagaggag

SEQ ID NO: 7973677 - DNA, 22 bp, Homo sapiens
cggagctgcgccgggacacggg

SEQ ID NO: 7973678 - DNA, 22 bp, Homo sapiens
cggagctgcgccgggacacggg

SEQ ID NO: 7973679 - DNA, 22 bp, Homo sapiens
cggagctggcgtctgtgtggac

SEQ ID NO: 7973680 - DNA, 22 bp, Homo sapiens
cggagctgcgccgggacacggg

SEQ ID NO: 7973681 - DNA, 22 bp, Homo sapiens
cggagctgcctgccaagcctgc

SEQ ID NO: 7973682 - DNA, 22 bp, Homo sapiens
cggagctgcctgccaagcctgc

SEQ ID NO: 7973683 - DNA, 22 bp, Homo sapiens
cggaggcaaactcacctggctc

SEQ ID NO: 7973684 - DNA, 21 bp, Homo sapiens
cggagctgggcagggcatccc

SEQ ID NO: 7973685 - DNA, 21 bp, Homo sapiens
cggagctgggcagggcatccc

SEQ ID NO: 7973686 - DNA, 22 bp, Homo sapiens
cggaggcaaactcacctggctc

SEQ ID NO: 7973687 - DNA, 22 bp, Homo sapiens
cggaggggatacattttctgaa

SEQ ID NO: 7973688 - DNA, 22 bp, Homo sapiens
cggaggcctcagctcatggttt

SEQ ID NO: 7973689 - DNA, 22 bp, Homo sapiens
cggaggcctgccaggagcttct

SEQ ID NO: 7973690 - DNA, 23 bp, Homo sapiens
cggaggcaaatcggccatttaag

SEQ ID NO: 7973691 - DNA, 20 bp, Homo sapiens
cgctccagtcgctggtgtgt

SEQ ID NO: 7973692 - DNA, 20 bp, Homo sapiens
cgctccaccctggacctggc

SEQ ID NO: 7973693 - DNA, 22 bp, Homo sapiens
cgctccaagcttgatgggacca

SEQ ID NO: 7973694 - DNA, 21 bp, Homo sapiens
cgctccaccccacccactggc

SEQ ID NO: 7973695 - DNA, 21 bp, Homo sapiens
cgctccaccccacccactggc

SEQ ID NO: 7973696 - DNA, 22 bp, Homo sapiens
cggagcagaaggcgccgccggc

SEQ ID NO: 7973697 - DNA, 22 bp, Homo sapiens
cggagcagaaggcgccgccggc

SEQ ID NO: 7973698 - DNA, 22 bp, Homo sapiens
cggagcctgcttgttgcagctg

SEQ ID NO: 7973699 - DNA, 22 bp, Homo sapiens
cggagcctgcttgttgcagctg

SEQ ID NO: 7973700 - DNA, 22 bp, Homo sapiens
cggagcagagccactcgggccg

SEQ ID NO: 7973701 - DNA, 22 bp, Homo sapiens
cggagcagaaggcgccgccggc

SEQ ID NO: 7973702 - DNA, 22 bp, Homo sapiens
cggagcagagccactcgggccg

SEQ ID NO: 7973703 - DNA, 22 bp, Homo sapiens
cggagcagagccactcgggccg

SEQ ID NO: 7973704 - DNA, 22 bp, Homo sapiens
cggagcagagccactcgggccg

SEQ ID NO: 7973705 - DNA, 22 bp, Homo sapiens
cggctcactgcagctccgcctc

SEQ ID NO: 7973706 - DNA, 22 bp, Homo sapiens
cggctcactgcagctccgcctc

SEQ ID NO: 7973707 - DNA, 22 bp, Homo sapiens
cggctcactgcagctccgcctc

SEQ ID NO: 7973708 - DNA, 22 bp, Homo sapiens
cggctcactgcagctccgcctc

SEQ ID NO: 7973709 - DNA, 22 bp, Homo sapiens
cggctcactgcagctccgcctc

SEQ ID NO: 7973710 - DNA, 22 bp, Homo sapiens
cggctcactgcagctccgcctc

SEQ ID NO: 7973711 - DNA, 22 bp, Homo sapiens
cggctcactgcagctccgcctc

SEQ ID NO: 7973712 - DNA, 22 bp, Homo sapiens
cggctcagacttcccaagaaca

SEQ ID NO: 7973713 - DNA, 22 bp, Homo sapiens
cggctcagacttcccaagaaca

SEQ ID NO: 7973714 - DNA, 20 bp, Homo sapiens
cggctcagcctctccctccc

SEQ ID NO: 7973715 - DNA, 20 bp, Homo sapiens
cggctcagcctctccctccc

SEQ ID NO: 7973716 - DNA, 20 bp, Homo sapiens
agtaggggaatgcaagagca

SEQ ID NO: 7973717 - DNA, 22 bp, Homo sapiens
cggctcagacttcccaagaaca

SEQ ID NO: 7973718 - DNA, 22 bp, Homo sapiens
cggccgcagcagtgtcggccca

SEQ ID NO: 7973719 - DNA, 22 bp, Homo sapiens
cggccgcagcagtgtcggccca

SEQ ID NO: 7973720 - DNA, 22 bp, Homo sapiens
cggccgcagcagtgtcggccca

SEQ ID NO: 7973721 - DNA, 22 bp, Homo sapiens
cggccctgaccagaccttagtt

SEQ ID NO: 7973722 - DNA, 19 bp, Homo sapiens
cggcccctcctctcgcgcc

SEQ ID NO: 7973723 - DNA, 22 bp, Homo sapiens
cggccttggtcggcccacagct

SEQ ID NO: 7973724 - DNA, 22 bp, Homo sapiens
cggctcactgcagctccgcctc

SEQ ID NO: 7973725 - DNA, 20 bp, Homo sapiens
cggcctcacggtggcggtgc

SEQ ID NO: 7973726 - DNA, 22 bp, Homo sapiens
cggctcactgcagctccgcctc

SEQ ID NO: 7973727 - DNA, 22 bp, Homo sapiens
cggctcactgcagctccgcctc

SEQ ID NO: 7973728 - DNA, 22 bp, Homo sapiens
cggctcactgcagctccgcctc

SEQ ID NO: 7973729 - DNA, 22 bp, Homo sapiens
cggccgcagcagtgtcggccca

SEQ ID NO: 7973730 - DNA, 22 bp, Homo sapiens
cggccgcgtccagggccgccag

SEQ ID NO: 7973731 - DNA, 22 bp, Homo sapiens
cggccttctccctgggcatcac

SEQ ID NO: 7973732 - DNA, 22 bp, Homo sapiens
cggcctgcacttgcctcgaggc

SEQ ID NO: 7973733 - DNA, 22 bp, Homo sapiens
cggccttgacaagcttagcagc

SEQ ID NO: 7973734 - DNA, 22 bp, Homo sapiens
cggccttgcgcggagcagaggg

SEQ ID NO: 7973735 - DNA, 22 bp, Homo sapiens
agtatatatgaggaaccacaaa

SEQ ID NO: 7973736 - DNA, 22 bp, Homo sapiens
agtatatatgaggaaccacaaa

SEQ ID NO: 7973737 - DNA, 22 bp, Homo sapiens
agtagtcacttctattaatggc

SEQ ID NO: 7973738 - DNA, 22 bp, Homo sapiens
agtagtcagcagataatatagg

SEQ ID NO: 7973739 - DNA, 22 bp, Homo sapiens
agtatatagtggcgctgtatgc

SEQ ID NO: 7973740 - DNA, 22 bp, Homo sapiens
agtagtcacttctattaatggc

SEQ ID NO: 7973741 - DNA, 22 bp, Homo sapiens
agtagtcacttcacccatccca

SEQ ID NO: 7973742 - DNA, 22 bp, Homo sapiens
agtagtattctacagagggtgc

SEQ ID NO: 7973743 - DNA, 21 bp, Homo sapiens
agtagtatcctggagggacaa

SEQ ID NO: 7973744 - DNA, 22 bp, Homo sapiens
agtatatcacatgtagtaatgg

SEQ ID NO: 7973745 - DNA, 22 bp, Homo sapiens
agtatattgctcttaatcatag

SEQ ID NO: 7973746 - DNA, 22 bp, Homo sapiens
agtatattgctcttaatcatag

SEQ ID NO: 7973747 - DNA, 22 bp, Homo sapiens
agtatattgctcttaatcatag

SEQ ID NO: 7973748 - DNA, 22 bp, Homo sapiens
agtatattgctcttaatcatag

SEQ ID NO: 7973749 - DNA, 22 bp, Homo sapiens
agtatattgctcttaatcatag

SEQ ID NO: 7973750 - DNA, 22 bp, Homo sapiens
agtatattggtgttattcctca

SEQ ID NO: 7973751 - DNA, 22 bp, Homo sapiens
agtatattggtgttattcctca

SEQ ID NO: 7973752 - DNA, 22 bp, Homo sapiens
agtatatttgttaagattattc

SEQ ID NO: 7973753 - DNA, 22 bp, Homo sapiens
agtatatttgttaagattattc

SEQ ID NO: 7973754 - DNA, 22 bp, Homo sapiens
agtatatttgttaagattattc

SEQ ID NO: 7973755 - DNA, 22 bp, Homo sapiens
agtatatttgttaagattattc

SEQ ID NO: 7973756 - DNA, 22 bp, Homo sapiens
agtatatttgttaagattattc

SEQ ID NO: 7973757 - DNA, 22 bp, Homo sapiens
agtatcaaagggcatgtggtta

SEQ ID NO: 7973758 - DNA, 22 bp, Homo sapiens
agtatattttgattgtatgtgt

SEQ ID NO: 7973759 - DNA, 22 bp, Homo sapiens
agtatattttgattgtatgtgt

SEQ ID NO: 7973760 - DNA, 22 bp, Homo sapiens
aggtggcagttgtggaaccatc

SEQ ID NO: 7973761 - DNA, 22 bp, Homo sapiens
aggtgctgtttgtcagcagttt

SEQ ID NO: 7973762 - DNA, 22 bp, Homo sapiens
aggtggcatgagactgtaccag

SEQ ID NO: 7973763 - DNA, 22 bp, Homo sapiens
aggtggctctgacagctctggt

SEQ ID NO: 7973764 - DNA, 22 bp, Homo sapiens
aggtggcatgagactgtaccag

SEQ ID NO: 7973765 - DNA, 22 bp, Homo sapiens
aggtggctctgacagctctggt

SEQ ID NO: 7973766 - DNA, 22 bp, Homo sapiens
aggtggctctgacagctctggt

SEQ ID NO: 7973767 - DNA, 22 bp, Homo sapiens
aggtggctctgacagctctggt

SEQ ID NO: 7973768 - DNA, 22 bp, Homo sapiens
aggtggctctgacagctctggt

SEQ ID NO: 7973769 - DNA, 20 bp, Homo sapiens
aggtggctcttcctgggctt

SEQ ID NO: 7973770 - DNA, 20 bp, Homo sapiens
aggtggctcttcctgggctt

SEQ ID NO: 7973771 - DNA, 20 bp, Homo sapiens
aggtggctcttcctgggctt

SEQ ID NO: 7973772 - DNA, 20 bp, Homo sapiens
aggtggctcttcctgggctt

SEQ ID NO: 7973773 - DNA, 22 bp, Homo sapiens
aggtgctgttggcagcgggcag

SEQ ID NO: 7973774 - DNA, 22 bp, Homo sapiens
aggtgctgttggcagcgggcag

SEQ ID NO: 7973775 - DNA, 22 bp, Homo sapiens
aggtgctgtttgtcagcagttt

SEQ ID NO: 7973776 - DNA, 22 bp, Homo sapiens
aggtgctgtttgtcagcagttt

SEQ ID NO: 7973777 - DNA, 22 bp, Homo sapiens
aggtgctgttggcagcgggcag

SEQ ID NO: 7973778 - DNA, 22 bp, Homo sapiens
aggtgctgtttgtcagcagttt

SEQ ID NO: 7973779 - DNA, 19 bp, Homo sapiens
aggtgctggtgagggtgtt

SEQ ID NO: 7973780 - DNA, 19 bp, Homo sapiens
aggtgctggtgagggtgtt

SEQ ID NO: 7973781 - DNA, 22 bp, Homo sapiens
aggtgctgggcagcagtcattg

SEQ ID NO: 7973782 - DNA, 19 bp, Homo sapiens
aggtgctggtgagggtgtt

SEQ ID NO: 7973783 - DNA, 19 bp, Homo sapiens
aggtgctggtgagggtgtt

SEQ ID NO: 7973784 - DNA, 22 bp, Homo sapiens
aggtgctgtgctatgcacttgt

SEQ ID NO: 7973785 - DNA, 22 bp, Homo sapiens
aggtgctgtgctatgcacttgt

SEQ ID NO: 7973786 - DNA, 22 bp, Homo sapiens
aggtgctgggcagcagtcattg

SEQ ID NO: 7973787 - DNA, 22 bp, Homo sapiens
aggtgctgggcagcagtcattg

SEQ ID NO: 7973788 - DNA, 22 bp, Homo sapiens
aggtgctggcgccccaggagac

SEQ ID NO: 7973789 - DNA, 22 bp, Homo sapiens
aggtgctggcgccccaggagac

SEQ ID NO: 7973790 - DNA, 22 bp, Homo sapiens
aggtgctggcgccccaggagac

SEQ ID NO: 7973791 - DNA, 22 bp, Homo sapiens
aggtgctggagtctgggcagga

SEQ ID NO: 7973792 - DNA, 22 bp, Homo sapiens
aggtgctggagtctgggcagga

SEQ ID NO: 7973793 - DNA, 22 bp, Homo sapiens
aggtgctggagtctgggcagga

SEQ ID NO: 7973794 - DNA, 22 bp, Homo sapiens
aggtgctggagtctgggcagga

SEQ ID NO: 7973795 - DNA, 22 bp, Homo sapiens
aggtgctggagtctgggcagga

SEQ ID NO: 7973796 - DNA, 22 bp, Homo sapiens
aggtgctggagtctgggcagga

SEQ ID NO: 7973797 - DNA, 22 bp, Homo sapiens
aggtgctggagtctgggcagga

SEQ ID NO: 7973798 - DNA, 22 bp, Homo sapiens
aggtgctggagtctgggcagga

SEQ ID NO: 7973799 - DNA, 21 bp, Homo sapiens
aggtgctggcgccccaggaga

SEQ ID NO: 7973800 - DNA, 22 bp, Homo sapiens
aggtgctgaactggtgaggtct

SEQ ID NO: 7973801 - DNA, 22 bp, Homo sapiens
aggtgctgaactggtgaggtct

SEQ ID NO: 7973802 - DNA, 22 bp, Homo sapiens
aggtgctgccccgagaaggatg

SEQ ID NO: 7973803 - DNA, 17 bp, Homo sapiens
aggtgctggagcatcag

SEQ ID NO: 7973804 - DNA, 17 bp, Homo sapiens
aggtgctggagcatcag

SEQ ID NO: 7973805 - DNA, 17 bp, Homo sapiens
aggtgctggagcatcag

SEQ ID NO: 7973806 - DNA, 17 bp, Homo sapiens
aggtgctggagcatcag

SEQ ID NO: 7973807 - DNA, 17 bp, Homo sapiens
aggtgctggagcatcag

SEQ ID NO: 7973808 - DNA, 22 bp, Homo sapiens
aggtgctggagtagaagaaaaa

SEQ ID NO: 7973809 - DNA, 22 bp, Homo sapiens
aggtgctggagtctgggcagga

SEQ ID NO: 7973810 - DNA, 22 bp, Homo sapiens
aggtgctggagtagaagaaaaa

SEQ ID NO: 7973811 - DNA, 22 bp, Homo sapiens
aggtgccttccgcggagctcgc

SEQ ID NO: 7973812 - DNA, 22 bp, Homo sapiens
aggtgcctgggagctccctgag

SEQ ID NO: 7973813 - DNA, 22 bp, Homo sapiens
aggtgcctgtcgtctctggtta

SEQ ID NO: 7973814 - DNA, 22 bp, Homo sapiens
aggtgccttccgcggagctcgc

SEQ ID NO: 7973815 - DNA, 22 bp, Homo sapiens
aggtgccttccgcggagctcgc

SEQ ID NO: 7973816 - DNA, 22 bp, Homo sapiens
aggtgctctaggtatctacttt

SEQ ID NO: 7973817 - DNA, 22 bp, Homo sapiens
aggtgctctaggtatctacttt

SEQ ID NO: 7973818 - DNA, 22 bp, Homo sapiens
aggtgcctatctggtctctgca

SEQ ID NO: 7973819 - DNA, 22 bp, Homo sapiens
aggtgcctatctggtctctgca

SEQ ID NO: 7973820 - DNA, 22 bp, Homo sapiens
aggtgcctatctggtctctgca

SEQ ID NO: 7973821 - DNA, 22 bp, Homo sapiens
aggtgcccatcacctcacagtc

SEQ ID NO: 7973822 - DNA, 17 bp, Homo sapiens
aggtgccagtgatatac

SEQ ID NO: 7973823 - DNA, 17 bp, Homo sapiens
aggtgccagtgatatac

SEQ ID NO: 7973824 - DNA, 22 bp, Homo sapiens
aggtgccaggagggaatttagg

SEQ ID NO: 7973825 - DNA, 22 bp, Homo sapiens
aggtgccagtgctgtggtcccc

SEQ ID NO: 7973826 - DNA, 22 bp, Homo sapiens
aggtgccagctctcaggcagga

SEQ ID NO: 7973827 - DNA, 22 bp, Homo sapiens
aggtgccaggagggaatttagg

SEQ ID NO: 7973828 - DNA, 23 bp, Homo sapiens
aggtgcccagaccccaccctctt

SEQ ID NO: 7973829 - DNA, 22 bp, Homo sapiens
aggtgccattgcttgccagttt

SEQ ID NO: 7973830 - DNA, 22 bp, Homo sapiens
aggtgccagtgctgtggtcccc

SEQ ID NO: 7973831 - DNA, 22 bp, Homo sapiens
aggtgccattgcttgccagttt

SEQ ID NO: 7973832 - DNA, 22 bp, Homo sapiens
aggtgccagtgctgtggtcccc

SEQ ID NO: 7973833 - DNA, 22 bp, Homo sapiens
aggtgcaggagctgtgcaggga

SEQ ID NO: 7973834 - DNA, 22 bp, Homo sapiens
aggtgcaggagctgtgcaggga

SEQ ID NO: 7973835 - DNA, 22 bp, Homo sapiens
cctgggagaactgctgggttgg

SEQ ID NO: 7973836 - DNA, 22 bp, Homo sapiens
aggtgcaggagctgtgcaggga

SEQ ID NO: 7973837 - DNA, 22 bp, Homo sapiens
aggtgcaggagctgtgcaggga

SEQ ID NO: 7973838 - DNA, 22 bp, Homo sapiens
aggtgcaggagctgtgcaggga

SEQ ID NO: 7973839 - DNA, 22 bp, Homo sapiens
aggtgcaggagctgtgcaggga

SEQ ID NO: 7973840 - DNA, 22 bp, Homo sapiens
aggtgcaggagctgtgcaggga

SEQ ID NO: 7973841 - DNA, 22 bp, Homo sapiens
aggtgccagctctcaggcagga

SEQ ID NO: 7973842 - DNA, 22 bp, Homo sapiens
aggtgccagctctcaggcagga

SEQ ID NO: 7973843 - DNA, 22 bp, Homo sapiens
aggtgccagctctcaggcagga

SEQ ID NO: 7973844 - DNA, 22 bp, Homo sapiens
cctgggagaactgctgggttgg

SEQ ID NO: 7973845 - DNA, 22 bp, Homo sapiens
aggtgcaggagctgtgcaggga

SEQ ID NO: 7973846 - DNA, 22 bp, Homo sapiens
cctgggagaactgctgggttgg

SEQ ID NO: 7973847 - DNA, 22 bp, Homo sapiens
cctgggagaactgctgggttgg

SEQ ID NO: 7973848 - DNA, 19 bp, Homo sapiens
cctgggacttaggctgggt

SEQ ID NO: 7973849 - DNA, 19 bp, Homo sapiens
cctgggacttaggctgggt

SEQ ID NO: 7973850 - DNA, 19 bp, Homo sapiens
cctgggacttaggctgggt

SEQ ID NO: 7973851 - DNA, 22 bp, Homo sapiens
cctgggactcggccaggacaga

SEQ ID NO: 7973852 - DNA, 19 bp, Homo sapiens
cctgggacttaggctgggt

SEQ ID NO: 7973853 - DNA, 19 bp, Homo sapiens
cctgggacttaggctgggt

SEQ ID NO: 7973854 - DNA, 22 bp, Homo sapiens
cctgggactcggccaggacaga

SEQ ID NO: 7973855 - DNA, 22 bp, Homo sapiens
cctgggactcggccaggacaga

SEQ ID NO: 7973856 - DNA, 22 bp, Homo sapiens
cctgggacgactctgtaccctt

SEQ ID NO: 7973857 - DNA, 22 bp, Homo sapiens
cctgggactcggccaggacaga

SEQ ID NO: 7973858 - DNA, 22 bp, Homo sapiens
cctgggacctcgcgggaagcgg

SEQ ID NO: 7973859 - DNA, 22 bp, Homo sapiens
cctgggacctcgcgggaagcgg

SEQ ID NO: 7973860 - DNA, 22 bp, Homo sapiens
cctgggacctcgcgggaagcgg

SEQ ID NO: 7973861 - DNA, 22 bp, Homo sapiens
cctgggacctcgcgggaagcgg

SEQ ID NO: 7973862 - DNA, 22 bp, Homo sapiens
cctgggactcggccaggacaga

SEQ ID NO: 7973863 - DNA, 22 bp, Homo sapiens
cctgggaagttgtggctgcagt

SEQ ID NO: 7973864 - DNA, 22 bp, Homo sapiens
cctgggaagttgtggctgcagt

SEQ ID NO: 7973865 - DNA, 22 bp, Homo sapiens
ccttggccctagcctcaggcaa

SEQ ID NO: 7973866 - DNA, 22 bp, Homo sapiens
ccttggctaaactcaatccagc

SEQ ID NO: 7973867 - DNA, 22 bp, Homo sapiens
ccttggctaggcagcggctgtc

SEQ ID NO: 7973868 - DNA, 22 bp, Homo sapiens
ccttggctgaggagggagctga

SEQ ID NO: 7973869 - DNA, 22 bp, Homo sapiens
aggtggggctgggaaagattcc

SEQ ID NO: 7973870 - DNA, 22 bp, Homo sapiens
aggtggggctgggaaagattcc

SEQ ID NO: 7973871 - DNA, 22 bp, Homo sapiens
aggtggggctgggaaagattcc

SEQ ID NO: 7973872 - DNA, 22 bp, Homo sapiens
ccttggcaagacagtggagggt

SEQ ID NO: 7973873 - DNA, 22 bp, Homo sapiens
ccttggcaaaccagggcagctg

SEQ ID NO: 7973874 - DNA, 22 bp, Homo sapiens
ccttggcaagacagtggagggt

SEQ ID NO: 7973875 - DNA, 22 bp, Homo sapiens
ccttggcaaaccagggcagctg

SEQ ID NO: 7973876 - DNA, 22 bp, Homo sapiens
ccttggcaaaccagggcagctg

SEQ ID NO: 7973877 - DNA, 22 bp, Homo sapiens
ccttggagttctgtttggctta

SEQ ID NO: 7973878 - DNA, 22 bp, Homo sapiens
ccttggattttgtgcccacgcc

SEQ ID NO: 7973879 - DNA, 22 bp, Homo sapiens
ccttggcaggcacgtcctgcgg

SEQ ID NO: 7973880 - DNA, 22 bp, Homo sapiens
ccttggcaggggagaaatatat

SEQ ID NO: 7973881 - DNA, 22 bp, Homo sapiens
ccttggcatgtggcatgtggct

SEQ ID NO: 7973882 - DNA, 22 bp, Homo sapiens
ccttggcatcctctgaagaaat

SEQ ID NO: 7973883 - DNA, 22 bp, Homo sapiens
ccttggcatgtggcatgtggct

SEQ ID NO: 7973884 - DNA, 22 bp, Homo sapiens
ccttggccctagcctcaggcaa

SEQ ID NO: 7973885 - DNA, 20 bp, Homo sapiens
ccttctctggaattgcctcc

SEQ ID NO: 7973886 - DNA, 22 bp, Homo sapiens
ccttgctcaagctagtgacggg

SEQ ID NO: 7973887 - DNA, 22 bp, Homo sapiens
ccttgctcaagctagtgacggg

SEQ ID NO: 7973888 - DNA, 22 bp, Homo sapiens
ccttgctcaagctagtgacggg

SEQ ID NO: 7973889 - DNA, 22 bp, Homo sapiens
ccttgcgttttacagcttctag

SEQ ID NO: 7973890 - DNA, 22 bp, Homo sapiens
ccttgctcaagctagtgacggg

SEQ ID NO: 7973891 - DNA, 22 bp, Homo sapiens
ccttgctcaagctagtgacggg

SEQ ID NO: 7973892 - DNA, 22 bp, Homo sapiens
ccttgctcatcccccagtgcct

SEQ ID NO: 7973893 - DNA, 22 bp, Homo sapiens
ccttgctcatcccccagtgcct

SEQ ID NO: 7973894 - DNA, 22 bp, Homo sapiens
ccttgctcggggagctgcagga

SEQ ID NO: 7973895 - DNA, 22 bp, Homo sapiens
ccttgctcggggagctgcagga

SEQ ID NO: 7973896 - DNA, 22 bp, Homo sapiens
ccttgctctcccaagcccgcag

SEQ ID NO: 7973897 - DNA, 22 bp, Homo sapiens
ccttgctgaccatcacctttga

SEQ ID NO: 7973898 - DNA, 19 bp, Homo sapiens
ccttggagttccaggtgga

SEQ ID NO: 7973899 - DNA, 22 bp, Homo sapiens
ccttggaggactgctgcttctt

SEQ ID NO: 7973900 - DNA, 19 bp, Homo sapiens
ccttggagttccaggtgga

SEQ ID NO: 7973901 - DNA, 19 bp, Homo sapiens
ccttggagttccaggtgga

SEQ ID NO: 7973902 - DNA, 22 bp, Homo sapiens
ccttggagcggtcagcactggt

SEQ ID NO: 7973903 - DNA, 22 bp, Homo sapiens
ccttggagcggtcagcactggt

SEQ ID NO: 7973904 - DNA, 22 bp, Homo sapiens
ccttggagcggtcagcactggt

SEQ ID NO: 7973905 - DNA, 22 bp, Homo sapiens
ccttggaggactgctgcttctt

SEQ ID NO: 7973906 - DNA, 22 bp, Homo sapiens
ccttgctgcgtgctagcacaga

SEQ ID NO: 7973907 - DNA, 22 bp, Homo sapiens
ccttgctgcgtgctagcacaga

SEQ ID NO: 7973908 - DNA, 22 bp, Homo sapiens
ccttgctgcgtgctagcacaga

SEQ ID NO: 7973909 - DNA, 22 bp, Homo sapiens
ccttgctgttagcctacattat

SEQ ID NO: 7973910 - DNA, 22 bp, Homo sapiens
ccttggagaagacagtgccagg

SEQ ID NO: 7973911 - DNA, 22 bp, Homo sapiens
ccttggagaagacagtgccagg

SEQ ID NO: 7973912 - DNA, 22 bp, Homo sapiens
ccttggagaagacagtgccagg

SEQ ID NO: 7973913 - DNA, 22 bp, Homo sapiens
ccttggagaagacagtgccagg

SEQ ID NO: 7973914 - DNA, 22 bp, Homo sapiens
ccttggagacaggtttgctttc

SEQ ID NO: 7973915 - DNA, 22 bp, Homo sapiens
ccttggagacctgggtctgtgc

SEQ ID NO: 7973916 - DNA, 22 bp, Homo sapiens
ccttggagacctgggtctgtgc

SEQ ID NO: 7973917 - DNA, 22 bp, Homo sapiens
ccttggagacctgggtctgtgc

SEQ ID NO: 7973918 - DNA, 21 bp, Homo sapiens
aggtggctgcatcctcagaag

SEQ ID NO: 7973919 - DNA, 21 bp, Homo sapiens
aggtggctgcatcctcagaag

SEQ ID NO: 7973920 - DNA, 21 bp, Homo sapiens
aggtggctgcatcctcagaag

SEQ ID NO: 7973921 - DNA, 21 bp, Homo sapiens
aggtggctgcatcctcagaag

SEQ ID NO: 7973922 - DNA, 22 bp, Homo sapiens
aggtggctgcctccccgcgcgg

SEQ ID NO: 7973923 - DNA, 22 bp, Homo sapiens
aggtggctgcctccccgcgcgg

SEQ ID NO: 7973924 - DNA, 22 bp, Homo sapiens
aggtggctgcctccccgcgcgg

SEQ ID NO: 7973925 - DNA, 17 bp, Homo sapiens
aggtggctgctgcgcct

SEQ ID NO: 7973926 - DNA, 22 bp, Homo sapiens
aggtggctgcctccccgcgcgg

SEQ ID NO: 7973927 - DNA, 17 bp, Homo sapiens
aggtggctgctgcgcct

SEQ ID NO: 7973928 - DNA, 22 bp, Homo sapiens
aggtggctgaagagtgggtgag

SEQ ID NO: 7973929 - DNA, 22 bp, Homo sapiens
aggtggctgaagagtgggtgag

SEQ ID NO: 7973930 - DNA, 19 bp, Homo sapiens
aggtggctgaaactacaga

SEQ ID NO: 7973931 - DNA, 19 bp, Homo sapiens
aggtggctgaaactacaga

SEQ ID NO: 7973932 - DNA, 20 bp, Homo sapiens
aggtggctcttcctgggctt

SEQ ID NO: 7973933 - DNA, 22 bp, Homo sapiens
aggtggctgagctgtgcccctg

SEQ ID NO: 7973934 - DNA, 22 bp, Homo sapiens
aggtggctgaagagtgggtgag

SEQ ID NO: 7973935 - DNA, 22 bp, Homo sapiens
aggtggctgagctgtgcccctg

SEQ ID NO: 7973936 - DNA, 21 bp, Homo sapiens
aggtggctgcatcctcagaag

SEQ ID NO: 7973937 - DNA, 22 bp, Homo sapiens
aggtggctggtccaggctgcag

SEQ ID NO: 7973938 - DNA, 22 bp, Homo sapiens
aggtggctggtccaggctgcag

SEQ ID NO: 7973939 - DNA, 22 bp, Homo sapiens
aggtggctggtccaggctgcag

SEQ ID NO: 7973940 - DNA, 17 bp, Homo sapiens
aggtggctgctgcgcct

SEQ ID NO: 7973941 - DNA, 22 bp, Homo sapiens
aggtggctggtccaggctgcag

SEQ ID NO: 7973942 - DNA, 22 bp, Homo sapiens
aggtggctggtccaggctgcag

SEQ ID NO: 7973943 - DNA, 22 bp, Homo sapiens
aggtggctggtccaggctgcag

SEQ ID NO: 7973944 - DNA, 22 bp, Homo sapiens
aggtggctgtggcttcccttgt

SEQ ID NO: 7973945 - DNA, 22 bp, Homo sapiens
aggtggcttctggccaggtgtg

SEQ ID NO: 7973946 - DNA, 22 bp, Homo sapiens
aggtggcttctggccaggtgtg

SEQ ID NO: 7973947 - DNA, 22 bp, Homo sapiens
aggtggcttctggccaggtgtg

SEQ ID NO: 7973948 - DNA, 22 bp, Homo sapiens
aggtggctgtggcttcccttgt

SEQ ID NO: 7973949 - DNA, 22 bp, Homo sapiens
aggtggctgtattcagctgtaa

SEQ ID NO: 7973950 - DNA, 22 bp, Homo sapiens
aggtggctgtattcagctgtaa

SEQ ID NO: 7973951 - DNA, 22 bp, Homo sapiens
aggtggctgtattcagctgtaa

SEQ ID NO: 7973952 - DNA, 21 bp, Homo sapiens
aggtgggagaccatgtaggtc

SEQ ID NO: 7973953 - DNA, 22 bp, Homo sapiens
aggtgggacccgtggggtgcga

SEQ ID NO: 7973954 - DNA, 21 bp, Homo sapiens
aggtgggagaccatgtaggtc

SEQ ID NO: 7973955 - DNA, 21 bp, Homo sapiens
aggtgggagaccatgtaggtc

SEQ ID NO: 7973956 - DNA, 21 bp, Homo sapiens
aggtgggagaccatgtaggtc

SEQ ID NO: 7973957 - DNA, 21 bp, Homo sapiens
aggtgggagaccatgtaggtc

SEQ ID NO: 7973958 - DNA, 22 bp, Homo sapiens
aggtgggacccgtggggtgcga

SEQ ID NO: 7973959 - DNA, 21 bp, Homo sapiens
aggtgggagaccatgtaggtc

SEQ ID NO: 7973960 - DNA, 22 bp, Homo sapiens
aggtgggcaatgaggcctgagt

SEQ ID NO: 7973961 - DNA, 22 bp, Homo sapiens
ccttctctgcaggtagttggct

SEQ ID NO: 7973962 - DNA, 22 bp, Homo sapiens
aggtgggaacccagcagggccc

SEQ ID NO: 7973963 - DNA, 22 bp, Homo sapiens
aggtgggaacccagcagggccc

SEQ ID NO: 7973964 - DNA, 22 bp, Homo sapiens
aggtgggaacccagcagggccc

SEQ ID NO: 7973965 - DNA, 22 bp, Homo sapiens
aggtgggaacccagcagggccc

SEQ ID NO: 7973966 - DNA, 22 bp, Homo sapiens
aggtggctttactgtttcttac

SEQ ID NO: 7973967 - DNA, 22 bp, Homo sapiens
aggtggctttactgtttcttac

SEQ ID NO: 7973968 - DNA, 22 bp, Homo sapiens
aggtggcttctggccaggtgtg

SEQ ID NO: 7973969 - DNA, 22 bp, Homo sapiens
aggtggcttctggccaggtgtg

SEQ ID NO: 7973970 - DNA, 22 bp, Homo sapiens
aggtggcttctggccaggtgtg

SEQ ID NO: 7973971 - DNA, 22 bp, Homo sapiens
aggtgggaacccagcagggccc

SEQ ID NO: 7973972 - DNA, 22 bp, Homo sapiens
aggtgggacccgtggggtgcga

SEQ ID NO: 7973973 - DNA, 22 bp, Homo sapiens
aggtgggacccgtggggtgcga

SEQ ID NO: 7973974 - DNA, 22 bp, Homo sapiens
aggtgggacccgtggggtgcga

SEQ ID NO: 7973975 - DNA, 22 bp, Homo sapiens
aggtgggacccgtggggtgcga

SEQ ID NO: 7973976 - DNA, 22 bp, Homo sapiens
cctctgccacctcccacgaggc

SEQ ID NO: 7973977 - DNA, 22 bp, Homo sapiens
cctctgccacctcccacgaggc

SEQ ID NO: 7973978 - DNA, 22 bp, Homo sapiens
cctctgccacctcccacgaggc

SEQ ID NO: 7973979 - DNA, 22 bp, Homo sapiens
cctctgccacctcccacgaggc

SEQ ID NO: 7973980 - DNA, 19 bp, Homo sapiens
cctctgccagcccgcctct

SEQ ID NO: 7973981 - DNA, 19 bp, Homo sapiens
cctctgccagcccgcctct

SEQ ID NO: 7973982 - DNA, 19 bp, Homo sapiens
cctctgccagcccgcctct

SEQ ID NO: 7973983 - DNA, 22 bp, Homo sapiens
cctgccaggacattgcttgaag

SEQ ID NO: 7973984 - DNA, 22 bp, Homo sapiens
cctgccaggacattgcttgaag

SEQ ID NO: 7973985 - DNA, 22 bp, Homo sapiens
cctgcccaggagtctctctgtg

SEQ ID NO: 7973986 - DNA, 23 bp, Homo sapiens
cctgcccaggaatccggcggcgt

SEQ ID NO: 7973987 - DNA, 22 bp, Homo sapiens
cctgcccagcttcccgagtgca

SEQ ID NO: 7973988 - DNA, 22 bp, Homo sapiens
cctgcccaggagtctctctgtg

SEQ ID NO: 7973989 - DNA, 22 bp, Homo sapiens
cctgcccaggagtctctctgtg

SEQ ID NO: 7973990 - DNA, 22 bp, Homo sapiens
cctgcccagggtcaccacagag

SEQ ID NO: 7973991 - DNA, 22 bp, Homo sapiens
cctgccctaatccagagactag

SEQ ID NO: 7973992 - DNA, 22 bp, Homo sapiens
cctgccctaatccagagactag

SEQ ID NO: 7973993 - DNA, 22 bp, Homo sapiens
cctgccctaatccagagactag

SEQ ID NO: 7973994 - DNA, 22 bp, Homo sapiens
cctgccctaatccagagactag

SEQ ID NO: 7973995 - DNA, 22 bp, Homo sapiens
cctgccctagagatgacacaat

SEQ ID NO: 7973996 - DNA, 22 bp, Homo sapiens
cctgccctatgaccagcttcac

SEQ ID NO: 7973997 - DNA, 22 bp, Homo sapiens
cctgccctatgaccagcttcac

SEQ ID NO: 7973998 - DNA, 22 bp, Homo sapiens
cctgccctatgaccagcttcac

SEQ ID NO: 7973999 - DNA, 22 bp, Homo sapiens
cctgccctatgaccagcttcac

SEQ ID NO: 7974000 - DNA, 22 bp, Homo sapiens
cctgccctatgaccagcttcac

SEQ ID NO: 7974001 - DNA, 22 bp, Homo sapiens
cctgccctatgaccagcttcac

SEQ ID NO: 7974002 - DNA, 22 bp, Homo sapiens
cctgccctatgaccagcttcac

SEQ ID NO: 7974003 - DNA, 22 bp, Homo sapiens
cctgcccccgtcagaggtgatg

SEQ ID NO: 7974004 - DNA, 22 bp, Homo sapiens
cctgcccccgtcagaggtgatg

SEQ ID NO: 7974005 - DNA, 22 bp, Homo sapiens
cctgcccctcaaggcctggtgc

SEQ ID NO: 7974006 - DNA, 22 bp, Homo sapiens
cctgcccctcaaggcctggtgc

SEQ ID NO: 7974007 - DNA, 22 bp, Homo sapiens
cctgcccctcaaggcctggtgc

SEQ ID NO: 7974008 - DNA, 22 bp, Homo sapiens
cctgcccctcaaggcctggtgc

SEQ ID NO: 7974009 - DNA, 22 bp, Homo sapiens
cctgcccagggtcaccacagag

SEQ ID NO: 7974010 - DNA, 22 bp, Homo sapiens
cctgcccagggtcaccacagag

SEQ ID NO: 7974011 - DNA, 22 bp, Homo sapiens
cctgcccatactgacctctaat

SEQ ID NO: 7974012 - DNA, 22 bp, Homo sapiens
cctctgcaccatagccttcagc

SEQ ID NO: 7974013 - DNA, 22 bp, Homo sapiens
cctctgcacttcaccttagctc

SEQ ID NO: 7974014 - DNA, 22 bp, Homo sapiens
cctctgcagcagagagccagag

SEQ ID NO: 7974015 - DNA, 22 bp, Homo sapiens
cctctgcagcagagagccagag

SEQ ID NO: 7974016 - DNA, 22 bp, Homo sapiens
cctctgcagcagagagccagag

SEQ ID NO: 7974017 - DNA, 22 bp, Homo sapiens
cctctgcatgtgcagtaccgag

SEQ ID NO: 7974018 - DNA, 22 bp, Homo sapiens
cctctgccacctcccacgaggc

SEQ ID NO: 7974019 - DNA, 22 bp, Homo sapiens
cctctgccacctcccacgaggc

SEQ ID NO: 7974020 - DNA, 22 bp, Homo sapiens
cctctgcatctggctgctgcag

SEQ ID NO: 7974021 - DNA, 22 bp, Homo sapiens
cctctgcaaagaatttgtctcc

SEQ ID NO: 7974022 - DNA, 22 bp, Homo sapiens
cctctgcaaagaatttgtctcc

SEQ ID NO: 7974023 - DNA, 22 bp, Homo sapiens
cctctgagttggcctgtcttgt

SEQ ID NO: 7974024 - DNA, 22 bp, Homo sapiens
cctctgagtctcactgtaacct

SEQ ID NO: 7974025 - DNA, 22 bp, Homo sapiens
cctctgagtcctttgggctctc

SEQ ID NO: 7974026 - DNA, 22 bp, Homo sapiens
cctctgagtcctttgggctctc

SEQ ID NO: 7974027 - DNA, 22 bp, Homo sapiens
cctctgagtcctttgggctctc

SEQ ID NO: 7974028 - DNA, 22 bp, Homo sapiens
cctctgagtgacagcctcctct

SEQ ID NO: 7974029 - DNA, 22 bp, Homo sapiens
cctctgagtgctttgagggaga

SEQ ID NO: 7974030 - DNA, 22 bp, Homo sapiens
cctctgagtgctttgagggaga

SEQ ID NO: 7974031 - DNA, 22 bp, Homo sapiens
cctctctccttcctttgccaaa

SEQ ID NO: 7974032 - DNA, 22 bp, Homo sapiens
cctctctccttcctttgccaaa

SEQ ID NO: 7974033 - DNA, 22 bp, Homo sapiens
cctctctccttcctttgccaaa

SEQ ID NO: 7974034 - DNA, 22 bp, Homo sapiens
cctctctccttcctttgccaaa

SEQ ID NO: 7974035 - DNA, 22 bp, Homo sapiens
cctctctccttcctttgccaaa

SEQ ID NO: 7974036 - DNA, 22 bp, Homo sapiens
cctctctccttcctttgccaaa

SEQ ID NO: 7974037 - DNA, 22 bp, Homo sapiens
cctctctccaattttcacctca

SEQ ID NO: 7974038 - DNA, 22 bp, Homo sapiens
cctctctccaattttcacctca

SEQ ID NO: 7974039 - DNA, 22 bp, Homo sapiens
cctctctccaattttcacctca

SEQ ID NO: 7974040 - DNA, 22 bp, Homo sapiens
cctctctccaattttcacctca

SEQ ID NO: 7974041 - DNA, 22 bp, Homo sapiens
cctctctccaattttcacctca

SEQ ID NO: 7974042 - DNA, 22 bp, Homo sapiens
cctctctccaattttcacctca

SEQ ID NO: 7974043 - DNA, 22 bp, Homo sapiens
cctctctcttgtagtccctgcc

SEQ ID NO: 7974044 - DNA, 22 bp, Homo sapiens
cctctctcttgtagtccctgcc

SEQ ID NO: 7974045 - DNA, 22 bp, Homo sapiens
cctctctctgcatctggagggc

SEQ ID NO: 7974046 - DNA, 22 bp, Homo sapiens
cctctctctgcatctggagggc

SEQ ID NO: 7974047 - DNA, 22 bp, Homo sapiens
cctctctctgcatctggagggc

SEQ ID NO: 7974048 - DNA, 22 bp, Homo sapiens
cctctctctgcatctggagggc

SEQ ID NO: 7974049 - DNA, 22 bp, Homo sapiens
cctctctctcctgcacacacac

SEQ ID NO: 7974050 - DNA, 22 bp, Homo sapiens
cctctctctcctgcacacacac

SEQ ID NO: 7974051 - DNA, 22 bp, Homo sapiens
cctctctctcctgcacacacac

SEQ ID NO: 7974052 - DNA, 22 bp, Homo sapiens
cctctctctcctgcacacacac

SEQ ID NO: 7974053 - DNA, 20 bp, Homo sapiens
agggtcagtagcacagagct

SEQ ID NO: 7974054 - DNA, 20 bp, Homo sapiens
agggtcagtagcacagagct

SEQ ID NO: 7974055 - DNA, 20 bp, Homo sapiens
agggtcagtagcacagagct

SEQ ID NO: 7974056 - DNA, 22 bp, Homo sapiens
agggtcaggttaagggagtcat

SEQ ID NO: 7974057 - DNA, 20 bp, Homo sapiens
agggtcagtagcacagagct

SEQ ID NO: 7974058 - DNA, 22 bp, Homo sapiens
agggtcaggttaagggagtcat

SEQ ID NO: 7974059 - DNA, 22 bp, Homo sapiens
agggtcaggttaagggagtcat

SEQ ID NO: 7974060 - DNA, 22 bp, Homo sapiens
agggtcaggagacactggcaac

SEQ ID NO: 7974061 - DNA, 19 bp, Homo sapiens
agggtcaggacaaggactt

SEQ ID NO: 7974062 - DNA, 22 bp, Homo sapiens
agggtcaggagacactggcaac

SEQ ID NO: 7974063 - DNA, 22 bp, Homo sapiens
agggtcaggagacactggcaac

SEQ ID NO: 7974064 - DNA, 22 bp, Homo sapiens
agggtcagggagtgagtattta

SEQ ID NO: 7974065 - DNA, 17 bp, Homo sapiens
agggtcaggtgaagttc

SEQ ID NO: 7974066 - DNA, 22 bp, Homo sapiens
agggtctatctctctgcctttg

SEQ ID NO: 7974067 - DNA, 22 bp, Homo sapiens
agggtctcagagcctgagaacc

SEQ ID NO: 7974068 - DNA, 22 bp, Homo sapiens
agggtctctacgcactagaggg

SEQ ID NO: 7974069 - DNA, 22 bp, Homo sapiens
agggtccttctgttcctgagca

SEQ ID NO: 7974070 - DNA, 22 bp, Homo sapiens
agggtcctgggtgcagttgctt

SEQ ID NO: 7974071 - DNA, 22 bp, Homo sapiens
agggtccttctgttcctgagca

SEQ ID NO: 7974072 - DNA, 22 bp, Homo sapiens
agggtcctgagcctggggcgca

SEQ ID NO: 7974073 - DNA, 21 bp, Homo sapiens
agggtcctacagggctcagga

SEQ ID NO: 7974074 - DNA, 20 bp, Homo sapiens
agggtcagtagcacagagct

SEQ ID NO: 7974075 - DNA, 21 bp, Homo sapiens
agggtcctacagggctcagga

SEQ ID NO: 7974076 - DNA, 21 bp, Homo sapiens
agggtcctacagggctcagga

SEQ ID NO: 7974077 - DNA, 20 bp, Homo sapiens
agggtcagagagcgtgagtg

SEQ ID NO: 7974078 - DNA, 20 bp, Homo sapiens
agggtcagagagcgtgagtg

SEQ ID NO: 7974079 - DNA, 20 bp, Homo sapiens
agggtcagagagcgtgagtg

SEQ ID NO: 7974080 - DNA, 20 bp, Homo sapiens
agggtcagagagcgtgagtg

SEQ ID NO: 7974081 - DNA, 22 bp, Homo sapiens
cctgccctgctcactgtcggta

SEQ ID NO: 7974082 - DNA, 22 bp, Homo sapiens
agggtcagagatcggccatgtg

SEQ ID NO: 7974083 - DNA, 22 bp, Homo sapiens
agggtcagagatcggccatgtg

SEQ ID NO: 7974084 - DNA, 22 bp, Homo sapiens
agggtcagagtcaggtgcagta

SEQ ID NO: 7974085 - DNA, 22 bp, Homo sapiens
agggtcagagtcaggtgcagta

SEQ ID NO: 7974086 - DNA, 22 bp, Homo sapiens
agggtcagagatcggccatgtg

SEQ ID NO: 7974087 - DNA, 20 bp, Homo sapiens
agggtcagagagcgtgagtg

SEQ ID NO: 7974088 - DNA, 22 bp, Homo sapiens
agggtcagagatcggccatgtg

SEQ ID NO: 7974089 - DNA, 22 bp, Homo sapiens
agggtcagagatcggccatgtg

SEQ ID NO: 7974090 - DNA, 19 bp, Homo sapiens
agggtcaggacaaggactt

SEQ ID NO: 7974091 - DNA, 19 bp, Homo sapiens
agggtcaggacaaggactt

SEQ ID NO: 7974092 - DNA, 19 bp, Homo sapiens
agggtcaggacaaggactt

SEQ ID NO: 7974093 - DNA, 19 bp, Homo sapiens
agggtcaggacaaggactt

SEQ ID NO: 7974094 - DNA, 21 bp, Homo sapiens
agggtcaggaaccagggtacc

SEQ ID NO: 7974095 - DNA, 21 bp, Homo sapiens
agggtcaggaaccagggtacc

SEQ ID NO: 7974096 - DNA, 21 bp, Homo sapiens
agggtcaggaaccagggtacc

SEQ ID NO: 7974097 - DNA, 22 bp, Homo sapiens
agggtcagctggctgtcagggg

SEQ ID NO: 7974098 - DNA, 22 bp, Homo sapiens
agggtcagctggctgtcagggg

SEQ ID NO: 7974099 - DNA, 21 bp, Homo sapiens
agggtcaggaaccagggtacc

SEQ ID NO: 7974100 - DNA, 21 bp, Homo sapiens
agggtcaggaaccagggtacc

SEQ ID NO: 7974101 - DNA, 22 bp, Homo sapiens
agggtcagctggctgtcagggg

SEQ ID NO: 7974102 - DNA, 22 bp, Homo sapiens
agggtcagagtcaggtgcagta

SEQ ID NO: 7974103 - DNA, 22 bp, Homo sapiens
agggtctgtatttctggcaagc

SEQ ID NO: 7974104 - DNA, 22 bp, Homo sapiens
agggtctgtatttctggcaagc

SEQ ID NO: 7974105 - DNA, 22 bp, Homo sapiens
agggtctgtggatgcatctggg

SEQ ID NO: 7974106 - DNA, 22 bp, Homo sapiens
agggtctgtggatgcatctggg

SEQ ID NO: 7974107 - DNA, 22 bp, Homo sapiens
agggtctgttgtttgttctgga

SEQ ID NO: 7974108 - DNA, 22 bp, Homo sapiens
agggtctgttgtttgttctgga

SEQ ID NO: 7974109 - DNA, 22 bp, Homo sapiens
agggtctgtggatgcatctggg

SEQ ID NO: 7974110 - DNA, 22 bp, Homo sapiens
agggtctttcctgggagccagc

SEQ ID NO: 7974111 - DNA, 22 bp, Homo sapiens
agggtctttcctgggagccagc

SEQ ID NO: 7974112 - DNA, 22 bp, Homo sapiens
agggtgaatctcacaactctta

SEQ ID NO: 7974113 - DNA, 22 bp, Homo sapiens
agggtgaatctcacaactctta

SEQ ID NO: 7974114 - DNA, 22 bp, Homo sapiens
agggtgaatctcacaactctta

SEQ ID NO: 7974115 - DNA, 22 bp, Homo sapiens
agggtgaatctcacaactctta

SEQ ID NO: 7974116 - DNA, 22 bp, Homo sapiens
agggtgaatctcacaactctta

SEQ ID NO: 7974117 - DNA, 23 bp, Homo sapiens
agggtgagcaagctatggagacc

SEQ ID NO: 7974118 - DNA, 23 bp, Homo sapiens
agggtgagcaagctatggagacc

SEQ ID NO: 7974119 - DNA, 20 bp, Homo sapiens
agggtgagacatgagcctcc

SEQ ID NO: 7974120 - DNA, 22 bp, Homo sapiens
agggtgaatctcacaactctta

SEQ ID NO: 7974121 - DNA, 20 bp, Homo sapiens
agggtgagacatgagcctcc

SEQ ID NO: 7974122 - DNA, 20 bp, Homo sapiens
agggtgagacatgagcctcc

SEQ ID NO: 7974123 - DNA, 20 bp, Homo sapiens
agggtgagacatgagcctcc

SEQ ID NO: 7974124 - DNA, 22 bp, Homo sapiens
agggtctctggagagctgagga

SEQ ID NO: 7974125 - DNA, 22 bp, Homo sapiens
agggtctctggagagctgagga

SEQ ID NO: 7974126 - DNA, 22 bp, Homo sapiens
agggtctctgggagtagggcac

SEQ ID NO: 7974127 - DNA, 22 bp, Homo sapiens
agggtctctggagagctgagga

SEQ ID NO: 7974128 - DNA, 22 bp, Homo sapiens
agggtctctggagagctgagga

SEQ ID NO: 7974129 - DNA, 22 bp, Homo sapiens
agggtctcttgccatgcctcag

SEQ ID NO: 7974130 - DNA, 22 bp, Homo sapiens
agggtctctgggagtagggcac

SEQ ID NO: 7974131 - DNA, 22 bp, Homo sapiens
agggtctctgggagtagggcac

SEQ ID NO: 7974132 - DNA, 22 bp, Homo sapiens
agggtctgaccaccagtaggga

SEQ ID NO: 7974133 - DNA, 22 bp, Homo sapiens
agggtctgaccaccagtaggga

SEQ ID NO: 7974134 - DNA, 22 bp, Homo sapiens
agggtctcttgccatgcctcag

SEQ ID NO: 7974135 - DNA, 22 bp, Homo sapiens
agggtctgaccaccagtaggga

SEQ ID NO: 7974136 - DNA, 22 bp, Homo sapiens
agggtctgaccaccagtaggga

SEQ ID NO: 7974137 - DNA, 20 bp, Homo sapiens
agggtctgctgggtaggaca

SEQ ID NO: 7974138 - DNA, 23 bp, Homo sapiens
agggtctgctcagtgtcgttcaa

SEQ ID NO: 7974139 - DNA, 20 bp, Homo sapiens
agggtctgctgggtaggaca

SEQ ID NO: 7974140 - DNA, 20 bp, Homo sapiens
agggtctgatgtggtggccc

SEQ ID NO: 7974141 - DNA, 20 bp, Homo sapiens
agggtctgatgtggtggccc

SEQ ID NO: 7974142 - DNA, 22 bp, Homo sapiens
agggtctgactcctctggcaag

SEQ ID NO: 7974143 - DNA, 22 bp, Homo sapiens
agggtctgactgaatggaaaag

SEQ ID NO: 7974144 - DNA, 22 bp, Homo sapiens
cctgctctgccaagtcctcttt

SEQ ID NO: 7974145 - DNA, 22 bp, Homo sapiens
cctgctctgccaagtcctcttt

SEQ ID NO: 7974146 - DNA, 22 bp, Homo sapiens
cctgctctgccaagtcctcttt

SEQ ID NO: 7974147 - DNA, 22 bp, Homo sapiens
cctgctctgccaagtcctcttt

SEQ ID NO: 7974148 - DNA, 22 bp, Homo sapiens
cctgctctggtttagtcagtct

SEQ ID NO: 7974149 - DNA, 22 bp, Homo sapiens
cctgctctgccaagtcctcttt

SEQ ID NO: 7974150 - DNA, 22 bp, Homo sapiens
cctgcctggcttccagaagaga

SEQ ID NO: 7974151 - DNA, 22 bp, Homo sapiens
cctgcctggcttccagaagaga

SEQ ID NO: 7974152 - DNA, 22 bp, Homo sapiens
cctgcctggcttccagaagaga

SEQ ID NO: 7974153 - DNA, 22 bp, Homo sapiens
cctgctctagactctgggaagg

SEQ ID NO: 7974154 - DNA, 22 bp, Homo sapiens
cctgcctggcttccagaagaga

SEQ ID NO: 7974155 - DNA, 22 bp, Homo sapiens
cctgctctagactctgggaagg

SEQ ID NO: 7974156 - DNA, 22 bp, Homo sapiens
cctgctctccatacactttcta

SEQ ID NO: 7974157 - DNA, 22 bp, Homo sapiens
cctgctctccatacactttcta

SEQ ID NO: 7974158 - DNA, 22 bp, Homo sapiens
cctgctgagaccctgaggtggg

SEQ ID NO: 7974159 - DNA, 22 bp, Homo sapiens
cctgctgagacttccaagggag

SEQ ID NO: 7974160 - DNA, 19 bp, Homo sapiens
cctgctgcaccacttgtta

SEQ ID NO: 7974161 - DNA, 19 bp, Homo sapiens
cctgctgcaccacttgtta

SEQ ID NO: 7974162 - DNA, 19 bp, Homo sapiens
cctgctgcaccacttgtta

SEQ ID NO: 7974163 - DNA, 19 bp, Homo sapiens
cctgctgcaccacttgtta

SEQ ID NO: 7974164 - DNA, 19 bp, Homo sapiens
cctgctgcaccacttgtta

SEQ ID NO: 7974165 - DNA, 19 bp, Homo sapiens
cctgctgaagtgatgcagc

SEQ ID NO: 7974166 - DNA, 22 bp, Homo sapiens
cctgctgagaaatcaagggagt

SEQ ID NO: 7974167 - DNA, 19 bp, Homo sapiens
cctgctgaagtgatgcagc

SEQ ID NO: 7974168 - DNA, 22 bp, Homo sapiens
cctgctcttatagctgtttcca

SEQ ID NO: 7974169 - DNA, 22 bp, Homo sapiens
cctgctcttatagctgtttcca

SEQ ID NO: 7974170 - DNA, 22 bp, Homo sapiens
cctgctcttatagctgtttcca

SEQ ID NO: 7974171 - DNA, 22 bp, Homo sapiens
cctgctgctatgaaggtgacag

SEQ ID NO: 7974172 - DNA, 22 bp, Homo sapiens
cctggaaagaggaaggaagcct

SEQ ID NO: 7974173 - DNA, 22 bp, Homo sapiens
cctggaaagaggaaggaagcct

SEQ ID NO: 7974174 - DNA, 22 bp, Homo sapiens
cctggaaagaggaaggaagcct

SEQ ID NO: 7974175 - DNA, 19 bp, Homo sapiens
cctgctgcccaccctctgc

SEQ ID NO: 7974176 - DNA, 19 bp, Homo sapiens
cctgctgcccaccctctgc

SEQ ID NO: 7974177 - DNA, 19 bp, Homo sapiens
cctgctgcccaccctctgc

SEQ ID NO: 7974178 - DNA, 22 bp, Homo sapiens
cctgctgctatgaaggtgacag

SEQ ID NO: 7974179 - DNA, 22 bp, Homo sapiens
cctgctgctatgaaggtgacag

SEQ ID NO: 7974180 - DNA, 22 bp, Homo sapiens
cctgctgctatgaaggtgacag

SEQ ID NO: 7974181 - DNA, 22 bp, Homo sapiens
cctgctgctatgaaggtgacag

SEQ ID NO: 7974182 - DNA, 22 bp, Homo sapiens
cctggaaatgcaaaagccatga

SEQ ID NO: 7974183 - DNA, 22 bp, Homo sapiens
cctggaaatgcaaaagccatga

SEQ ID NO: 7974184 - DNA, 22 bp, Homo sapiens
cctggaaatgtcgcgtgtagaa

SEQ ID NO: 7974185 - DNA, 22 bp, Homo sapiens
cctggaaatgtcgcgtgtagaa

SEQ ID NO: 7974186 - DNA, 22 bp, Homo sapiens
cctggaaatgcaaaagccatga

SEQ ID NO: 7974187 - DNA, 22 bp, Homo sapiens
cctggaaagctgccctgtgaca

SEQ ID NO: 7974188 - DNA, 22 bp, Homo sapiens
cctggaaagctgccctgtgaca

SEQ ID NO: 7974189 - DNA, 22 bp, Homo sapiens
cctggaaagattgcagttgctg

SEQ ID NO: 7974190 - DNA, 22 bp, Homo sapiens
cctggaaagcggttcattttgt

SEQ ID NO: 7974191 - DNA, 22 bp, Homo sapiens
cctggaaagattgcagttgctg

SEQ ID NO: 7974192 - DNA, 22 bp, Homo sapiens
cctggaaagattgcagttgctg

SEQ ID NO: 7974193 - DNA, 22 bp, Homo sapiens
cctggacaatgagatgtcaggg

SEQ ID NO: 7974194 - DNA, 22 bp, Homo sapiens
cctggacaatgagatgtcaggg

SEQ ID NO: 7974195 - DNA, 22 bp, Homo sapiens
cctggacaatgagatgtcaggg

SEQ ID NO: 7974196 - DNA, 22 bp, Homo sapiens
cctggaagttggaggttgcagt

SEQ ID NO: 7974197 - DNA, 22 bp, Homo sapiens
cctggaatctggagttggaatc

SEQ ID NO: 7974198 - DNA, 22 bp, Homo sapiens
cctggacaagtggcttacttgg

SEQ ID NO: 7974199 - DNA, 18 bp, Homo sapiens
cctggaatgcaccccatt

SEQ ID NO: 7974200 - DNA, 22 bp, Homo sapiens
cctggaccaaacactggcctgg

SEQ ID NO: 7974201 - DNA, 22 bp, Homo sapiens
cctggaccaaacactggcctgg

SEQ ID NO: 7974202 - DNA, 22 bp, Homo sapiens
cctggaccaaacactggcctgg

SEQ ID NO: 7974203 - DNA, 22 bp, Homo sapiens
cctggaccaaacactggcctgg

SEQ ID NO: 7974204 - DNA, 22 bp, Homo sapiens
cctggacagggccaggccatgc

SEQ ID NO: 7974205 - DNA, 22 bp, Homo sapiens
cctggacagggccaggccatgc

SEQ ID NO: 7974206 - DNA, 22 bp, Homo sapiens
cctggacagagggcagcggcca

SEQ ID NO: 7974207 - DNA, 22 bp, Homo sapiens
cctggacagagggcagcggcca

SEQ ID NO: 7974208 - DNA, 22 bp, Homo sapiens
cctggaaggtgatggtacagca

SEQ ID NO: 7974209 - DNA, 22 bp, Homo sapiens
cctggaaggtgatggtacagca

SEQ ID NO: 7974210 - DNA, 22 bp, Homo sapiens
cctggaaggcaggcatggattg

SEQ ID NO: 7974211 - DNA, 22 bp, Homo sapiens
cctggaaggtgatggtacagca

SEQ ID NO: 7974212 - DNA, 22 bp, Homo sapiens
cctggaaggacaatagatagtg

SEQ ID NO: 7974213 - DNA, 22 bp, Homo sapiens
cctggaaggacaatagatagtg

SEQ ID NO: 7974214 - DNA, 22 bp, Homo sapiens
cctggaaatgtcgcgtgtagaa

SEQ ID NO: 7974215 - DNA, 22 bp, Homo sapiens
cctggcagcgccgaagctggcc

SEQ ID NO: 7974216 - DNA, 22 bp, Homo sapiens
cctggcagcgccgaagctggcc

SEQ ID NO: 7974217 - DNA, 22 bp, Homo sapiens
cctggcagcgccgaagctggcc

SEQ ID NO: 7974218 - DNA, 22 bp, Homo sapiens
cctggcagcgccgaagctggcc

SEQ ID NO: 7974219 - DNA, 22 bp, Homo sapiens
cctggcagcgtgccgagctgcg

SEQ ID NO: 7974220 - DNA, 22 bp, Homo sapiens
cctggcagctaagtgctttgag

SEQ ID NO: 7974221 - DNA, 22 bp, Homo sapiens
cctggcagcgtgccgagctgcg

SEQ ID NO: 7974222 - DNA, 22 bp, Homo sapiens
cctggcagcgtgccgagctgcg

SEQ ID NO: 7974223 - DNA, 22 bp, Homo sapiens
cctggcagcgtgccgagctgcg

SEQ ID NO: 7974224 - DNA, 22 bp, Homo sapiens
cctggcacataatagtggctca

SEQ ID NO: 7974225 - DNA, 22 bp, Homo sapiens
cctggaccaaacactggcctgg

SEQ ID NO: 7974226 - DNA, 22 bp, Homo sapiens
cctggacctgcagcatcagcat

SEQ ID NO: 7974227 - DNA, 22 bp, Homo sapiens
cctggcacataatagtggctca

SEQ ID NO: 7974228 - DNA, 22 bp, Homo sapiens
cctggcacataatagtggctca

SEQ ID NO: 7974229 - DNA, 22 bp, Homo sapiens
cctggcagcctcagccaattct

SEQ ID NO: 7974230 - DNA, 22 bp, Homo sapiens
cctggcagcctcagccaattct

SEQ ID NO: 7974231 - DNA, 22 bp, Homo sapiens
cctggcagcgccgaagctggcc

SEQ ID NO: 7974232 - DNA, 22 bp, Homo sapiens
cctggcagcccagagcgccgct

SEQ ID NO: 7974233 - DNA, 22 bp, Homo sapiens
cctggcagcccagagcgccgct

SEQ ID NO: 7974234 - DNA, 22 bp, Homo sapiens
cctggcagctcctccccggcgg

SEQ ID NO: 7974235 - DNA, 22 bp, Homo sapiens
cctggcagctcctccccggcgg

SEQ ID NO: 7974236 - DNA, 22 bp, Homo sapiens
cctggcagctcctccccggcgg

SEQ ID NO: 7974237 - DNA, 22 bp, Homo sapiens
cctggcagctcctccccggcgg

SEQ ID NO: 7974238 - DNA, 22 bp, Homo sapiens
cctggcagctcctccccggcgg

SEQ ID NO: 7974239 - DNA, 22 bp, Homo sapiens
cctggcagctccgtggccttcc

SEQ ID NO: 7974240 - DNA, 22 bp, Homo sapiens
cctggcagctaagtgctttgag

SEQ ID NO: 7974241 - DNA, 22 bp, Homo sapiens
cctggcagctccgtggccttcc

SEQ ID NO: 7974242 - DNA, 22 bp, Homo sapiens
cctggcagctccgtggccttcc

SEQ ID NO: 7974243 - DNA, 22 bp, Homo sapiens
cctggcagctccgtggccttcc

SEQ ID NO: 7974244 - DNA, 22 bp, Homo sapiens
cctggcagctccgtggccttcc

SEQ ID NO: 7974245 - DNA, 22 bp, Homo sapiens
cctggcagctccgtggccttcc

SEQ ID NO: 7974246 - DNA, 22 bp, Homo sapiens
cctggcagctgtttggcttggc

SEQ ID NO: 7974247 - DNA, 22 bp, Homo sapiens
cctggcattttttgcttaaggt

SEQ ID NO: 7974248 - DNA, 22 bp, Homo sapiens
cctggcattttttgcttaaggt

SEQ ID NO: 7974249 - DNA, 17 bp, Homo sapiens
cctggcattgttcctga

SEQ ID NO: 7974250 - DNA, 22 bp, Homo sapiens
cctggcagctgtttggcttggc

SEQ ID NO: 7974251 - DNA, 22 bp, Homo sapiens
cctggcagctgtttggcttggc

SEQ ID NO: 7974252 - DNA, 22 bp, Homo sapiens
cctggcagctgtttggcttggc

SEQ ID NO: 7974253 - DNA, 21 bp, Homo sapiens
cctggccaatctgatagggtt

SEQ ID NO: 7974254 - DNA, 21 bp, Homo sapiens
cctggccaatctgatagggtt

SEQ ID NO: 7974255 - DNA, 21 bp, Homo sapiens
cctggccaatctgatagggtt

SEQ ID NO: 7974256 - DNA, 22 bp, Homo sapiens
cctggccaatctagggctgtta

SEQ ID NO: 7974257 - DNA, 22 bp, Homo sapiens
cctggccaatctagggctgtta

SEQ ID NO: 7974258 - DNA, 22 bp, Homo sapiens
cctggccacccagccttggcca

SEQ ID NO: 7974259 - DNA, 22 bp, Homo sapiens
cctggccacccagccttggcca

SEQ ID NO: 7974260 - DNA, 22 bp, Homo sapiens
cctggccactcaggtgtggggc

SEQ ID NO: 7974261 - DNA, 22 bp, Homo sapiens
cctggccactcaggtgtggggc

SEQ ID NO: 7974262 - DNA, 19 bp, Homo sapiens
cctggccagacttctgccc

SEQ ID NO: 7974263 - DNA, 22 bp, Homo sapiens
cctggccagaggcgtgcctgtg

SEQ ID NO: 7974264 - DNA, 22 bp, Homo sapiens
cctggccagaggcgtgcctgtg

SEQ ID NO: 7974265 - DNA, 19 bp, Homo sapiens
cctggccagacttctgccc

SEQ ID NO: 7974266 - DNA, 19 bp, Homo sapiens
cctggccagacttctgccc

SEQ ID NO: 7974267 - DNA, 22 bp, Homo sapiens
cctggccagaggcgtgcctgtg

SEQ ID NO: 7974268 - DNA, 22 bp, Homo sapiens
cctggccagaggcgtgcctgtg

SEQ ID NO: 7974269 - DNA, 22 bp, Homo sapiens
cctggccagaggcgtgcctgtg

SEQ ID NO: 7974270 - DNA, 22 bp, Homo sapiens
cctggccagaggcgtgcctgtg

SEQ ID NO: 7974271 - DNA, 21 bp, Homo sapiens
cctggccaatctgatagggtt

SEQ ID NO: 7974272 - DNA, 20 bp, Homo sapiens
cctggccaatgagataggaa

SEQ ID NO: 7974273 - DNA, 20 bp, Homo sapiens
cctggccaatgagataggaa

SEQ ID NO: 7974274 - DNA, 20 bp, Homo sapiens
cctggccaatgagataggaa

SEQ ID NO: 7974275 - DNA, 20 bp, Homo sapiens
cctggccaatgagataggaa

SEQ ID NO: 7974276 - DNA, 20 bp, Homo sapiens
cctggccaatgagataggaa

SEQ ID NO: 7974277 - DNA, 22 bp, Homo sapiens
cctggccacagggctctgcatt

SEQ ID NO: 7974278 - DNA, 22 bp, Homo sapiens
cctggccacccagccttggcca

SEQ ID NO: 7974279 - DNA, 22 bp, Homo sapiens
cctggccacccagccttggcca

SEQ ID NO: 7974280 - DNA, 22 bp, Homo sapiens
cctggccacagggctctgcatt

SEQ ID NO: 7974281 - DNA, 22 bp, Homo sapiens
cctggccacagggctctgcatt

SEQ ID NO: 7974282 - DNA, 22 bp, Homo sapiens
cctggccacagggctctgcatt

SEQ ID NO: 7974283 - DNA, 22 bp, Homo sapiens
cctggccacagggctctgcatt

SEQ ID NO: 7974284 - DNA, 22 bp, Homo sapiens
cctggctggtggcagcgacaag

SEQ ID NO: 7974285 - DNA, 22 bp, Homo sapiens
cctggctggtggcagcgacaag

SEQ ID NO: 7974286 - DNA, 22 bp, Homo sapiens
cctgggaaggggaagagaattc

SEQ ID NO: 7974287 - DNA, 22 bp, Homo sapiens
cctggctggttgtctgattcta

SEQ ID NO: 7974288 - DNA, 22 bp, Homo sapiens
cctggctggtggcagcgacaag

SEQ ID NO: 7974289 - DNA, 22 bp, Homo sapiens
cctgggaagtcagccaaggacg

SEQ ID NO: 7974290 - DNA, 22 bp, Homo sapiens
cctgggaagtcagccaaggacg

SEQ ID NO: 7974291 - DNA, 22 bp, Homo sapiens
cctgggaaggtgaggccctgga

SEQ ID NO: 7974292 - DNA, 22 bp, Homo sapiens
cctgggaagtcagccaaggacg

SEQ ID NO: 7974293 - DNA, 22 bp, Homo sapiens
cctgggaaggggaagagaattc

SEQ ID NO: 7974294 - DNA, 22 bp, Homo sapiens
cctgggaaggtgaggccctgga

SEQ ID NO: 7974295 - DNA, 22 bp, Homo sapiens
cctgggaaggtcttagcatcta

SEQ ID NO: 7974296 - DNA, 23 bp, Homo sapiens
cctggctggattctctgcattca

SEQ ID NO: 7974297 - DNA, 23 bp, Homo sapiens
cctggctggattctctgcattca

SEQ ID NO: 7974298 - DNA, 17 bp, Homo sapiens
cctggctgggaatctga

SEQ ID NO: 7974299 - DNA, 17 bp, Homo sapiens
cctggctgggaatctga

SEQ ID NO: 7974300 - DNA, 22 bp, Homo sapiens
cctggctggcaagatcgtgaag

SEQ ID NO: 7974301 - DNA, 22 bp, Homo sapiens
cctggctgggcctgatttctca

SEQ ID NO: 7974302 - DNA, 20 bp, Homo sapiens
cctggctggtggaggaaagg

SEQ ID NO: 7974303 - DNA, 22 bp, Homo sapiens
cctggctggtggcagcgacaag

SEQ ID NO: 7974304 - DNA, 22 bp, Homo sapiens
cctggctggggtagaagtgagg

SEQ ID NO: 7974305 - DNA, 22 bp, Homo sapiens
cctggctgcttcctctgccatg

SEQ ID NO: 7974306 - DNA, 22 bp, Homo sapiens
cctggctgcttcctctgccatg

SEQ ID NO: 7974307 - DNA, 22 bp, Homo sapiens
cctggctgcttcctctgccatg

SEQ ID NO: 7974308 - DNA, 22 bp, Homo sapiens
cctggctgcttcctctgccatg

SEQ ID NO: 7974309 - DNA, 22 bp, Homo sapiens
cctggctgcttcctctgccatg

SEQ ID NO: 7974310 - DNA, 22 bp, Homo sapiens
cctggctgcttcctctgccatg

SEQ ID NO: 7974311 - DNA, 19 bp, Homo sapiens
cctggctgctgtgggatgc

SEQ ID NO: 7974312 - DNA, 19 bp, Homo sapiens
cctggctgctgtgggatgc

SEQ ID NO: 7974313 - DNA, 19 bp, Homo sapiens
cctggctgctgtgggatgc

SEQ ID NO: 7974314 - DNA, 19 bp, Homo sapiens
cctggctgctgtgggatgc

SEQ ID NO: 7974315 - DNA, 19 bp, Homo sapiens
cctggctgctgtgggatgc

SEQ ID NO: 7974316 - DNA, 22 bp, Homo sapiens
cctggccagaggcgtgcctgtg

SEQ ID NO: 7974317 - DNA, 22 bp, Homo sapiens
cctggccagaggcgtgcctgtg

SEQ ID NO: 7974318 - DNA, 22 bp, Homo sapiens
cctggctctgtcctcgcgcaaa

SEQ ID NO: 7974319 - DNA, 22 bp, Homo sapiens
cctggctcttcagaggttccta

SEQ ID NO: 7974320 - DNA, 22 bp, Homo sapiens
cctggctcttcagaggttccta

SEQ ID NO: 7974321 - DNA, 22 bp, Homo sapiens
cctggctgctgtcactgaccat

SEQ ID NO: 7974322 - DNA, 22 bp, Homo sapiens
cctggctggatggagcccctgg

SEQ ID NO: 7974323 - DNA, 22 bp, Homo sapiens
cctggctggatggagcccctgg

SEQ ID NO: 7974324 - DNA, 23 bp, Homo sapiens
cctggctggattctctgcattca

SEQ ID NO: 7974325 - DNA, 22 bp, Homo sapiens
cctggctggactggaccgtggc

SEQ ID NO: 7974326 - DNA, 22 bp, Homo sapiens
cctggctggatggagcccctgg

SEQ ID NO: 7974327 - DNA, 22 bp, Homo sapiens
cctggctgcttcctctgccatg

SEQ ID NO: 7974328 - DNA, 22 bp, Homo sapiens
cctggctgctttcactatggag

SEQ ID NO: 7974329 - DNA, 22 bp, Homo sapiens
cctggctgctttcactatggag

SEQ ID NO: 7974330 - DNA, 22 bp, Homo sapiens
cctggctgctttcactatggag

SEQ ID NO: 7974331 - DNA, 22 bp, Homo sapiens
cctggctggactggaccgtggc

SEQ ID NO: 7974332 - DNA, 22 bp, Homo sapiens
cctggctggactggaccgtggc

SEQ ID NO: 7974333 - DNA, 22 bp, Homo sapiens
cctggctggactggaccgtggc

SEQ ID NO: 7974334 - DNA, 22 bp, Homo sapiens
ataaaagttcaagagagtacag

SEQ ID NO: 7974335 - DNA, 22 bp, Homo sapiens
ataaaagtaggaccaacttaca

SEQ ID NO: 7974336 - DNA, 22 bp, Homo sapiens
ataaaagttcaagagagtacag

SEQ ID NO: 7974337 - DNA, 22 bp, Homo sapiens
ataaaagtttccaatcatgcct

SEQ ID NO: 7974338 - DNA, 22 bp, Homo sapiens
ataaaagtttccaatcatgcct

SEQ ID NO: 7974339 - DNA, 20 bp, Homo sapiens
ataaaataactgccacaaga

SEQ ID NO: 7974340 - DNA, 20 bp, Homo sapiens
ataaaataactgccacaaga

SEQ ID NO: 7974341 - DNA, 20 bp, Homo sapiens
ataaaataactgccacaaga

SEQ ID NO: 7974342 - DNA, 20 bp, Homo sapiens
ataaaataactgccacaaga

SEQ ID NO: 7974343 - DNA, 20 bp, Homo sapiens
ataaaataactgccacaaga

SEQ ID NO: 7974344 - DNA, 20 bp, Homo sapiens
ataaaataactgccacaaga

SEQ ID NO: 7974345 - DNA, 22 bp, Homo sapiens
ataaaagtttccaatcatgcct

SEQ ID NO: 7974346 - DNA, 20 bp, Homo sapiens
ataaaataactgccacaaga

SEQ ID NO: 7974347 - DNA, 20 bp, Homo sapiens
ataaaataactgccacaaga

SEQ ID NO: 7974348 - DNA, 20 bp, Homo sapiens
ataaaataactgccacaaga

SEQ ID NO: 7974349 - DNA, 20 bp, Homo sapiens
ataaaataactgccacaaga

SEQ ID NO: 7974350 - DNA, 20 bp, Homo sapiens
ataaaataactgccacaaga

SEQ ID NO: 7974351 - DNA, 20 bp, Homo sapiens
ataaaataactgccacaaga

SEQ ID NO: 7974352 - DNA, 20 bp, Homo sapiens
ataaaataactgccacaaga

SEQ ID NO: 7974353 - DNA, 22 bp, Homo sapiens
ataaatatcactgttgtccctc

SEQ ID NO: 7974354 - DNA, 22 bp, Homo sapiens
ataaatatcactgttgtccctc

SEQ ID NO: 7974355 - DNA, 22 bp, Homo sapiens
ataaatatcactgttgtccctc

SEQ ID NO: 7974356 - DNA, 22 bp, Homo sapiens
ataaatatcactgttgtccctc

SEQ ID NO: 7974357 - DNA, 22 bp, Homo sapiens
ataaatatcactgttgtccctc

SEQ ID NO: 7974358 - DNA, 22 bp, Homo sapiens
ataaatagtgtgtcataaagtc

SEQ ID NO: 7974359 - DNA, 22 bp, Homo sapiens
ataaatagtgtgtcataaagtc

SEQ ID NO: 7974360 - DNA, 22 bp, Homo sapiens
ataaatagtgtgtcataaagtc

SEQ ID NO: 7974361 - DNA, 22 bp, Homo sapiens
ataaatagtgtgtcataaagtc

SEQ ID NO: 7974362 - DNA, 22 bp, Homo sapiens
ataaatagtgtgtcataaagtc

SEQ ID NO: 7974363 - DNA, 22 bp, Homo sapiens
ataaatagtgtgtcataaagtc

SEQ ID NO: 7974364 - DNA, 19 bp, Homo sapiens
ataaataaaaagtgggaga

SEQ ID NO: 7974365 - DNA, 22 bp, Homo sapiens
ataaagtagccactggaaagct

SEQ ID NO: 7974366 - DNA, 19 bp, Homo sapiens
ataaataaaaagtgggaga

SEQ ID NO: 7974367 - DNA, 17 bp, Homo sapiens
ataaaggcaagtattat

SEQ ID NO: 7974368 - DNA, 22 bp, Homo sapiens
ataaatagtgctgccatgagta

SEQ ID NO: 7974369 - DNA, 22 bp, Homo sapiens
ataaatagtgaagggagccggt

SEQ ID NO: 7974370 - DNA, 22 bp, Homo sapiens
ataaatagtgaagggagccggt

SEQ ID NO: 7974371 - DNA, 22 bp, Homo sapiens
ataaatagtgctgccatgagta

SEQ ID NO: 7974372 - DNA, 22 bp, Homo sapiens
ataaatagtgctgccatgagta

SEQ ID NO: 7974373 - DNA, 22 bp, Homo sapiens
ataaatagtgtgtcataaagtc

SEQ ID NO: 7974374 - DNA, 22 bp, Homo sapiens
ataaaagtctgcttatttgggc

SEQ ID NO: 7974375 - DNA, 22 bp, Homo sapiens
ataaaagtctgcttatttgggc

SEQ ID NO: 7974376 - DNA, 22 bp, Homo sapiens
ataaaagtctgcttatttgggc

SEQ ID NO: 7974377 - DNA, 22 bp, Homo sapiens
ataaaagtaggaccaacttaca

SEQ ID NO: 7974378 - DNA, 22 bp, Homo sapiens
ctgccaggcctccgctgtcccc

SEQ ID NO: 7974379 - DNA, 22 bp, Homo sapiens
ataaaagtaggaccaacttaca

SEQ ID NO: 7974380 - DNA, 22 bp, Homo sapiens
ataaaagtaggaccaacttaca

SEQ ID NO: 7974381 - DNA, 22 bp, Homo sapiens
ataaaagtaggaccaacttaca

SEQ ID NO: 7974382 - DNA, 22 bp, Homo sapiens
ataaaagtaggaccaacttaca

SEQ ID NO: 7974383 - DNA, 22 bp, Homo sapiens
ataaaagtaggaccaacttaca

SEQ ID NO: 7974384 - DNA, 22 bp, Homo sapiens
ctgccaggcagggagatggctg

SEQ ID NO: 7974385 - DNA, 22 bp, Homo sapiens
ctgccaggcagggagatggctg

SEQ ID NO: 7974386 - DNA, 22 bp, Homo sapiens
ctgccaggcagggagatggctg

SEQ ID NO: 7974387 - DNA, 22 bp, Homo sapiens
ctgccaggcagggagatggctg

SEQ ID NO: 7974388 - DNA, 22 bp, Homo sapiens
ctgccaggcagggagatggctg

SEQ ID NO: 7974389 - DNA, 22 bp, Homo sapiens
ctgccaggcagggagatggctg

SEQ ID NO: 7974390 - DNA, 22 bp, Homo sapiens
ctgccaggcagcagagggagaa

SEQ ID NO: 7974391 - DNA, 22 bp, Homo sapiens
ctgccaggcagcagagggagaa

SEQ ID NO: 7974392 - DNA, 22 bp, Homo sapiens
ctgccaggcagcagagggagaa

SEQ ID NO: 7974393 - DNA, 22 bp, Homo sapiens
ctgccaggcctcatcccagcca

SEQ ID NO: 7974394 - DNA, 22 bp, Homo sapiens
ctgccaggcctcatcccagcca

SEQ ID NO: 7974395 - DNA, 22 bp, Homo sapiens
ctgccaggcctcatcccagcca

SEQ ID NO: 7974396 - DNA, 22 bp, Homo sapiens
ctgccaggcagggagatggctg

SEQ ID NO: 7974397 - DNA, 22 bp, Homo sapiens
ctgccaaaaggtgcacctgctg

SEQ ID NO: 7974398 - DNA, 22 bp, Homo sapiens
ctgcatttccacctggccacag

SEQ ID NO: 7974399 - DNA, 22 bp, Homo sapiens
ctgccaaaaggtgcacctgctg

SEQ ID NO: 7974400 - DNA, 22 bp, Homo sapiens
ctgccaaggctggggaggacaa

SEQ ID NO: 7974401 - DNA, 22 bp, Homo sapiens
ctgcatttcacatttaaacttt

SEQ ID NO: 7974402 - DNA, 22 bp, Homo sapiens
agtttgtatgccaacagcaaag

SEQ ID NO: 7974403 - DNA, 22 bp, Homo sapiens
ctgccaaaaggtgcacctgctg

SEQ ID NO: 7974404 - DNA, 21 bp, Homo sapiens
ctgccaggatagcatgcaggc

SEQ ID NO: 7974405 - DNA, 21 bp, Homo sapiens
ctgccaggatagcatgcaggc

SEQ ID NO: 7974406 - DNA, 21 bp, Homo sapiens
ctgccaggatagcatgcaggc

SEQ ID NO: 7974407 - DNA, 21 bp, Homo sapiens
ctgccaggatagcatgcaggc

SEQ ID NO: 7974408 - DNA, 21 bp, Homo sapiens
ctgccaggatagcatgcaggc

SEQ ID NO: 7974409 - DNA, 22 bp, Homo sapiens
ctgccaggattctgtgaacccc

SEQ ID NO: 7974410 - DNA, 22 bp, Homo sapiens
ctgccaggcacgtgcagcatca

SEQ ID NO: 7974411 - DNA, 22 bp, Homo sapiens
ctgccaggattctgtgaacccc

SEQ ID NO: 7974412 - DNA, 22 bp, Homo sapiens
ctgccaggcacgtgcagcatca

SEQ ID NO: 7974413 - DNA, 22 bp, Homo sapiens
ctgccaggcacgtgcagcatca

SEQ ID NO: 7974414 - DNA, 22 bp, Homo sapiens
ctgccaggcacgtgcagcatca

SEQ ID NO: 7974415 - DNA, 22 bp, Homo sapiens
ctgccaggcactgggctctgca

SEQ ID NO: 7974416 - DNA, 22 bp, Homo sapiens
ctgccaggcacgtgcagcatca

SEQ ID NO: 7974417 - DNA, 22 bp, Homo sapiens
ctgccaggcacgtgcagcatca

SEQ ID NO: 7974418 - DNA, 22 bp, Homo sapiens
ctgccaggcactgggctctgca

SEQ ID NO: 7974419 - DNA, 22 bp, Homo sapiens
ctgccaggcactgggctctgca

SEQ ID NO: 7974420 - DNA, 22 bp, Homo sapiens
ctgccaggcagcagagggagaa

SEQ ID NO: 7974421 - DNA, 22 bp, Homo sapiens
agtttaaatcatgttttgtaac

SEQ ID NO: 7974422 - DNA, 22 bp, Homo sapiens
agttgttcgtggtggattcgct

SEQ ID NO: 7974423 - DNA, 22 bp, Homo sapiens
agttgttcgtggtggattcgct

SEQ ID NO: 7974424 - DNA, 22 bp, Homo sapiens
agtttaactttggaaaactata

SEQ ID NO: 7974425 - DNA, 22 bp, Homo sapiens
agtttaactttggaaaactata

SEQ ID NO: 7974426 - DNA, 22 bp, Homo sapiens
agtttaaatcatgttttgtaac

SEQ ID NO: 7974427 - DNA, 22 bp, Homo sapiens
agttgttctaaagagattttaa

SEQ ID NO: 7974428 - DNA, 22 bp, Homo sapiens
agtttaaatcatgttttgtaac

SEQ ID NO: 7974429 - DNA, 22 bp, Homo sapiens
agttgtcagtcaaagacatttg

SEQ ID NO: 7974430 - DNA, 22 bp, Homo sapiens
agttgtcagtcaaagacatttg

SEQ ID NO: 7974431 - DNA, 22 bp, Homo sapiens
agttgtcacttcaagcaagtgt

SEQ ID NO: 7974432 - DNA, 22 bp, Homo sapiens
agttgtcacctctattcaaatc

SEQ ID NO: 7974433 - DNA, 22 bp, Homo sapiens
agttgtgaatagatctgattgg

SEQ ID NO: 7974434 - DNA, 22 bp, Homo sapiens
agttgtgagaaacagaatgagc

SEQ ID NO: 7974435 - DNA, 22 bp, Homo sapiens
agttgttcgtggtggattcgct

SEQ ID NO: 7974436 - DNA, 22 bp, Homo sapiens
agtttacaaagtttcactgttc

SEQ ID NO: 7974437 - DNA, 22 bp, Homo sapiens
agtttaattggaggcgtggctc

SEQ ID NO: 7974438 - DNA, 22 bp, Homo sapiens
agtttacaaagtttcactgttc

SEQ ID NO: 7974439 - DNA, 22 bp, Homo sapiens
agtttacaacagtagctatgga

SEQ ID NO: 7974440 - DNA, 22 bp, Homo sapiens
ctgcagagcaagttctctgttg

SEQ ID NO: 7974441 - DNA, 22 bp, Homo sapiens
agtttaatatccttcaactttc

SEQ ID NO: 7974442 - DNA, 22 bp, Homo sapiens
agtttaatcctccagcccaact

SEQ ID NO: 7974443 - DNA, 22 bp, Homo sapiens
agtttaatatccttcaactttc

SEQ ID NO: 7974444 - DNA, 22 bp, Homo sapiens
agtttaatcctccagcccaact

SEQ ID NO: 7974445 - DNA, 22 bp, Homo sapiens
agtttaactttggaaaactata

SEQ ID NO: 7974446 - DNA, 22 bp, Homo sapiens
agtttaactttggaaaactata

SEQ ID NO: 7974447 - DNA, 20 bp, Homo sapiens
agtttaagaaaaagctccag

SEQ ID NO: 7974448 - DNA, 22 bp, Homo sapiens
agtttaatatccttcaactttc

SEQ ID NO: 7974449 - DNA, 22 bp, Homo sapiens
agtttaagggattttcaatggt

SEQ ID NO: 7974450 - DNA, 22 bp, Homo sapiens
agtttaagggattttcaatggt

SEQ ID NO: 7974451 - DNA, 22 bp, Homo sapiens
agtttaagctggttataggcaa

SEQ ID NO: 7974452 - DNA, 22 bp, Homo sapiens
ctgcagagcagccagtccccca

SEQ ID NO: 7974453 - DNA, 22 bp, Homo sapiens
ctgcagagcaagttctctgttg

SEQ ID NO: 7974454 - DNA, 22 bp, Homo sapiens
ctgcagagcaagttctctgttg

SEQ ID NO: 7974455 - DNA, 22 bp, Homo sapiens
ctgcagagcagccagtccccca

SEQ ID NO: 7974456 - DNA, 22 bp, Homo sapiens
ctgcagcctccaccttttgggt

SEQ ID NO: 7974457 - DNA, 22 bp, Homo sapiens
ctgcagcctcctggggtacatg

SEQ ID NO: 7974458 - DNA, 22 bp, Homo sapiens
ctgcagcctcctggggtacatg

SEQ ID NO: 7974459 - DNA, 22 bp, Homo sapiens
ctgcagcctcctccagctacgt

SEQ ID NO: 7974460 - DNA, 22 bp, Homo sapiens
ctgcagcctcctccagctacgt

SEQ ID NO: 7974461 - DNA, 22 bp, Homo sapiens
ctgcagcctcctccagctacgt

SEQ ID NO: 7974462 - DNA, 22 bp, Homo sapiens
ctgcagcctcctggggtacatg

SEQ ID NO: 7974463 - DNA, 22 bp, Homo sapiens
ctgcagcctcctggggtacatg

SEQ ID NO: 7974464 - DNA, 22 bp, Homo sapiens
ctgcagcctcctggggtacatg

SEQ ID NO: 7974465 - DNA, 22 bp, Homo sapiens
ctgcagcctcctccagctacgt

SEQ ID NO: 7974466 - DNA, 22 bp, Homo sapiens
ctgcagctcctgagctcagaga

SEQ ID NO: 7974467 - DNA, 22 bp, Homo sapiens
ctgcagctcctgagctcagaga

SEQ ID NO: 7974468 - DNA, 22 bp, Homo sapiens
ctgcagctcctctctgtgcccc

SEQ ID NO: 7974469 - DNA, 22 bp, Homo sapiens
ctgcagctccttctggcatgtg

SEQ ID NO: 7974470 - DNA, 22 bp, Homo sapiens
ctgcagctcccctgagatcaag

SEQ ID NO: 7974471 - DNA, 22 bp, Homo sapiens
ctgcagctcctctctgtgcccc

SEQ ID NO: 7974472 - DNA, 22 bp, Homo sapiens
ctgcagctcccctgagatcaag

SEQ ID NO: 7974473 - DNA, 22 bp, Homo sapiens
ctgcagctggctcatgggatat

SEQ ID NO: 7974474 - DNA, 23 bp, Homo sapiens
agtttctttgagacttgccctgt

SEQ ID NO: 7974475 - DNA, 22 bp, Homo sapiens
agtttgaaagtattgacagaag

SEQ ID NO: 7974476 - DNA, 22 bp, Homo sapiens
agtttgaaagtattgacagaag

SEQ ID NO: 7974477 - DNA, 22 bp, Homo sapiens
agtttgaaagcttaacagtaca

SEQ ID NO: 7974478 - DNA, 22 bp, Homo sapiens
agtttgaaagcttaacagtaca

SEQ ID NO: 7974479 - DNA, 22 bp, Homo sapiens
agtttgaattgaaatgcagatg

SEQ ID NO: 7974480 - DNA, 22 bp, Homo sapiens
agtttgaaggagttgaatcacc

SEQ ID NO: 7974481 - DNA, 22 bp, Homo sapiens
agtttgaaggagttgaatcacc

SEQ ID NO: 7974482 - DNA, 22 bp, Homo sapiens
agtttgaaatgttggcaatatt

SEQ ID NO: 7974483 - DNA, 22 bp, Homo sapiens
agtttgaagaaggatctatgaa

SEQ ID NO: 7974484 - DNA, 22 bp, Homo sapiens
agtttgaagaaggtgagatgca

SEQ ID NO: 7974485 - DNA, 22 bp, Homo sapiens
agtttgaagattatgccagagt

SEQ ID NO: 7974486 - DNA, 22 bp, Homo sapiens
agtttgaagaaggatctatgaa

SEQ ID NO: 7974487 - DNA, 22 bp, Homo sapiens
ctgcagctgcagttctgagaga

SEQ ID NO: 7974488 - DNA, 22 bp, Homo sapiens
ctgcagctgcagttctgagaga

SEQ ID NO: 7974489 - DNA, 22 bp, Homo sapiens
ctgcagctgcagttctgagaga

SEQ ID NO: 7974490 - DNA, 22 bp, Homo sapiens
ctgcagctgcagttctgagaga

SEQ ID NO: 7974491 - DNA, 22 bp, Homo sapiens
ctgcagctgccagtgatttcag

SEQ ID NO: 7974492 - DNA, 22 bp, Homo sapiens
ctgcagctgcagttctgagaga

SEQ ID NO: 7974493 - DNA, 22 bp, Homo sapiens
ctgcagctgcagttctgagaga

SEQ ID NO: 7974494 - DNA, 22 bp, Homo sapiens
ctgcagctgcgggaccggagcg

SEQ ID NO: 7974495 - DNA, 22 bp, Homo sapiens
ctgcagctgctcatgttacttg

SEQ ID NO: 7974496 - DNA, 22 bp, Homo sapiens
ctgcagctgccagtgatttcag

SEQ ID NO: 7974497 - DNA, 22 bp, Homo sapiens
agtttggaaaatgagacaagga

SEQ ID NO: 7974498 - DNA, 22 bp, Homo sapiens
agtttgatttgtctatcttcat

SEQ ID NO: 7974499 - DNA, 22 bp, Homo sapiens
agtttgatttgtctatcttcat

SEQ ID NO: 7974500 - DNA, 22 bp, Homo sapiens
agtttgattgtatgggttttaa

SEQ ID NO: 7974501 - DNA, 22 bp, Homo sapiens
agtttgctcagaaatttgaaat

SEQ ID NO: 7974502 - DNA, 22 bp, Homo sapiens
agtttgacaaagtaaaatgaca

SEQ ID NO: 7974503 - DNA, 22 bp, Homo sapiens
agtttgatctgacagattttaa

SEQ ID NO: 7974504 - DNA, 22 bp, Homo sapiens
agtttgatctgacagattttaa

SEQ ID NO: 7974505 - DNA, 22 bp, Homo sapiens
agtttgatggcttaatagtaga

SEQ ID NO: 7974506 - DNA, 21 bp, Homo sapiens
agtttgatgcaatttctgaga

SEQ ID NO: 7974507 - DNA, 22 bp, Homo sapiens
agtttgatggcttaatagtaga

SEQ ID NO: 7974508 - DNA, 22 bp, Homo sapiens
agtttgattgtatgggttttaa

SEQ ID NO: 7974509 - DNA, 22 bp, Homo sapiens
agtttggagtgtggtctttgag

SEQ ID NO: 7974510 - DNA, 22 bp, Homo sapiens
agtttggaggcagggttgatga

SEQ ID NO: 7974511 - DNA, 22 bp, Homo sapiens
agtttggaagtcaggcttttct

SEQ ID NO: 7974512 - DNA, 22 bp, Homo sapiens
agtttggaagagaaaaatattt

SEQ ID NO: 7974513 - DNA, 22 bp, Homo sapiens
agtttgtaaacttgagctagcc

SEQ ID NO: 7974514 - DNA, 22 bp, Homo sapiens
agtttgtaagttcattatgagt

SEQ ID NO: 7974515 - DNA, 22 bp, Homo sapiens
ctgaggtagctgtgaatgttct

SEQ ID NO: 7974516 - DNA, 22 bp, Homo sapiens
ctgaggtatgtgggactagcct

SEQ ID NO: 7974517 - DNA, 22 bp, Homo sapiens
ctgaggtatgtgggactagcct

SEQ ID NO: 7974518 - DNA, 22 bp, Homo sapiens
ctgaggtacctggagcaggtcc

SEQ ID NO: 7974519 - DNA, 22 bp, Homo sapiens
ctgagggtgctattcttgcctt

SEQ ID NO: 7974520 - DNA, 23 bp, Homo sapiens
ctgaggtaaaatattctgaagga

SEQ ID NO: 7974521 - DNA, 22 bp, Homo sapiens
agttgtcacctctattcaaatc

SEQ ID NO: 7974522 - DNA, 22 bp, Homo sapiens
agttgtattagagaacacaaac

SEQ ID NO: 7974523 - DNA, 22 bp, Homo sapiens
agttgtatctgaatgcatgtag

SEQ ID NO: 7974524 - DNA, 22 bp, Homo sapiens
agttgtatctgaatgcatgtag

SEQ ID NO: 7974525 - DNA, 22 bp, Homo sapiens
agttgtattagagaacacaaac

SEQ ID NO: 7974526 - DNA, 22 bp, Homo sapiens
agttgtatctgaatgcatgtag

SEQ ID NO: 7974527 - DNA, 22 bp, Homo sapiens
ctgaggtcagagtttagtctgg

SEQ ID NO: 7974528 - DNA, 22 bp, Homo sapiens
ctgaggtcagagtttagtctgg

SEQ ID NO: 7974529 - DNA, 22 bp, Homo sapiens
ctgaggtcaccccactggctgt

SEQ ID NO: 7974530 - DNA, 22 bp, Homo sapiens
ctgaggtcaattaatcaacaac

SEQ ID NO: 7974531 - DNA, 22 bp, Homo sapiens
ctgaggtcaattaatcaacaac

SEQ ID NO: 7974532 - DNA, 22 bp, Homo sapiens
ctgaggcttgtcctctcagctt

SEQ ID NO: 7974533 - DNA, 22 bp, Homo sapiens
ctgaggctttgtgtgcatgcct

SEQ ID NO: 7974534 - DNA, 22 bp, Homo sapiens
ctgaggctttgtgtgcatgcct

SEQ ID NO: 7974535 - DNA, 22 bp, Homo sapiens
ctgaggctttgtgtgcatgcct

SEQ ID NO: 7974536 - DNA, 22 bp, Homo sapiens
ctgaggctttgtgtgcatgcct

SEQ ID NO: 7974537 - DNA, 22 bp, Homo sapiens
ctgaggctttgtgtgcatgcct

SEQ ID NO: 7974538 - DNA, 22 bp, Homo sapiens
ctgagggaacttgggcaagtct

SEQ ID NO: 7974539 - DNA, 22 bp, Homo sapiens
ctgagggaacttgggcaagtct

SEQ ID NO: 7974540 - DNA, 22 bp, Homo sapiens
ctgagggaacttgggcaagtct

SEQ ID NO: 7974541 - DNA, 22 bp, Homo sapiens
ctgaggggataaaggtttgggt

SEQ ID NO: 7974542 - DNA, 22 bp, Homo sapiens
ctgaggggataaaggtttgggt

SEQ ID NO: 7974543 - DNA, 22 bp, Homo sapiens
ctgaggggtatccaaggggtaa

SEQ ID NO: 7974544 - DNA, 22 bp, Homo sapiens
ctgaggggtatccaaggggtaa

SEQ ID NO: 7974545 - DNA, 22 bp, Homo sapiens
ctgaggggtatccaaggggtaa

SEQ ID NO: 7974546 - DNA, 22 bp, Homo sapiens
ctgagggtcaacttgattgtat

SEQ ID NO: 7974547 - DNA, 22 bp, Homo sapiens
ctgagggtcaacttgattgtat

SEQ ID NO: 7974548 - DNA, 22 bp, Homo sapiens
ctgagggtgctattcttgcctt

SEQ ID NO: 7974549 - DNA, 22 bp, Homo sapiens
ctgagggaacttgggcaagtct

SEQ ID NO: 7974550 - DNA, 22 bp, Homo sapiens
ctgagggtcaacttgattgtat

SEQ ID NO: 7974551 - DNA, 22 bp, Homo sapiens
ctgaggggtcgtgggagcccag

SEQ ID NO: 7974552 - DNA, 22 bp, Homo sapiens
ctgaggggtcgtgggagcccag

SEQ ID NO: 7974553 - DNA, 20 bp, Homo sapiens
ctgaggggtctgacttggac

SEQ ID NO: 7974554 - DNA, 20 bp, Homo sapiens
ctgaggggtctgacttggac

SEQ ID NO: 7974555 - DNA, 22 bp, Homo sapiens
ctgaggcttggaggggtctggt

SEQ ID NO: 7974556 - DNA, 22 bp, Homo sapiens
ctgaggcttggaggggtctggt

SEQ ID NO: 7974557 - DNA, 22 bp, Homo sapiens
ctgaggcttggaggggtctggt

SEQ ID NO: 7974558 - DNA, 22 bp, Homo sapiens
ctgaggcttggaggggtctggt

SEQ ID NO: 7974559 - DNA, 22 bp, Homo sapiens
ctgaggcttctctagttcagct

SEQ ID NO: 7974560 - DNA, 22 bp, Homo sapiens
ctgaggcttctctagttcagct

SEQ ID NO: 7974561 - DNA, 22 bp, Homo sapiens
ctgaggcttctctagttcagct

SEQ ID NO: 7974562 - DNA, 22 bp, Homo sapiens
ctgaggcttctctagttcagct

SEQ ID NO: 7974563 - DNA, 22 bp, Homo sapiens
ctgaggcttgtcctctcagctt

SEQ ID NO: 7974564 - DNA, 22 bp, Homo sapiens
ctgaggcttgtcctctcagctt

SEQ ID NO: 7974565 - DNA, 22 bp, Homo sapiens
ctgaggcttgtcctctcagctt

SEQ ID NO: 7974566 - DNA, 22 bp, Homo sapiens
ctgaggcttgtcctctcagctt

SEQ ID NO: 7974567 - DNA, 22 bp, Homo sapiens
ctgaggcttgtcctctcagctt

SEQ ID NO: 7974568 - DNA, 22 bp, Homo sapiens
ctgaggcttgtcctctcagctt

SEQ ID NO: 7974569 - DNA, 22 bp, Homo sapiens
ctgaggctgggcttgccttctt

SEQ ID NO: 7974570 - DNA, 22 bp, Homo sapiens
ctgaggctgggcttgccttctt

SEQ ID NO: 7974571 - DNA, 22 bp, Homo sapiens
ctgaggctgggcttgccttctt

SEQ ID NO: 7974572 - DNA, 22 bp, Homo sapiens
ctgaggctgggctgagggtata

SEQ ID NO: 7974573 - DNA, 22 bp, Homo sapiens
ctgaggctggggaagggaagtg

SEQ ID NO: 7974574 - DNA, 22 bp, Homo sapiens
ctgaggctgggcttgccttctt

SEQ ID NO: 7974575 - DNA, 22 bp, Homo sapiens
ctgaggctggggaagggaagtg

SEQ ID NO: 7974576 - DNA, 22 bp, Homo sapiens
ctgaggctggggaagggaagtg

SEQ ID NO: 7974577 - DNA, 18 bp, Homo sapiens
ctgaggcttagagaggtt

SEQ ID NO: 7974578 - DNA, 18 bp, Homo sapiens
ctgaggcttagagaggtt

SEQ ID NO: 7974579 - DNA, 18 bp, Homo sapiens
ctgaggcttagagaggtt

SEQ ID NO: 7974580 - DNA, 18 bp, Homo sapiens
ctgaggcttagagaggtt

SEQ ID NO: 7974581 - DNA, 18 bp, Homo sapiens
ctgaggcttagagaggtt

SEQ ID NO: 7974582 - DNA, 22 bp, Homo sapiens
ctgaggcctctctccttggctt

SEQ ID NO: 7974583 - DNA, 22 bp, Homo sapiens
ctgaggcctctctcctgggctt

SEQ ID NO: 7974584 - DNA, 22 bp, Homo sapiens
ctgaggcctctctcctgggctt

SEQ ID NO: 7974585 - DNA, 22 bp, Homo sapiens
ctgaggcctctccttggcttgt

SEQ ID NO: 7974586 - DNA, 22 bp, Homo sapiens
ctgaggcctctctcctgggctt

SEQ ID NO: 7974587 - DNA, 22 bp, Homo sapiens
ctgaggcctctctcctgggctt

SEQ ID NO: 7974588 - DNA, 22 bp, Homo sapiens
ctgaggcctctcccactccagc

SEQ ID NO: 7974589 - DNA, 22 bp, Homo sapiens
ctgaggcctctcccactccagc

SEQ ID NO: 7974590 - DNA, 22 bp, Homo sapiens
ctgaggcctctcccactccagc

SEQ ID NO: 7974591 - DNA, 22 bp, Homo sapiens
ctgaggcctctccttggcttgt

SEQ ID NO: 7974592 - DNA, 22 bp, Homo sapiens
ctgaggcctctccttggcttgt

SEQ ID NO: 7974593 - DNA, 22 bp, Homo sapiens
ctgaggcctcgttggctggaac

SEQ ID NO: 7974594 - DNA, 22 bp, Homo sapiens
ctgaggcctcgttggctggaac

SEQ ID NO: 7974595 - DNA, 22 bp, Homo sapiens
ctgaggcctcgttggctggaac

SEQ ID NO: 7974596 - DNA, 22 bp, Homo sapiens
ctgaggcctctttccttggctt

SEQ ID NO: 7974597 - DNA, 22 bp, Homo sapiens
ctgaggcctctttccttggctt

SEQ ID NO: 7974598 - DNA, 22 bp, Homo sapiens
ctgaggcctctttccttggctt

SEQ ID NO: 7974599 - DNA, 23 bp, Homo sapiens
ctgaggcctgctgcgttcaggtt

SEQ ID NO: 7974600 - DNA, 22 bp, Homo sapiens
ctgaggctgggctgagggtata

SEQ ID NO: 7974601 - DNA, 22 bp, Homo sapiens
ctgaggctgggctgagggtata

SEQ ID NO: 7974602 - DNA, 22 bp, Homo sapiens
ctgaggcctctctccttggctt

SEQ ID NO: 7974603 - DNA, 22 bp, Homo sapiens
ctgaggcctctctccttggctt

SEQ ID NO: 7974604 - DNA, 22 bp, Homo sapiens
ctgaggcctctgttcaccagaa

SEQ ID NO: 7974605 - DNA, 22 bp, Homo sapiens
agttgggagttatagactctat

SEQ ID NO: 7974606 - DNA, 22 bp, Homo sapiens
agttgggattcttggttctggg

SEQ ID NO: 7974607 - DNA, 19 bp, Homo sapiens
agttggggcagggaagaga

SEQ ID NO: 7974608 - DNA, 19 bp, Homo sapiens
agttggggcagggaagaga

SEQ ID NO: 7974609 - DNA, 19 bp, Homo sapiens
agttggggcagggaagaga

SEQ ID NO: 7974610 - DNA, 19 bp, Homo sapiens
agttggggcagggaagaga

SEQ ID NO: 7974611 - DNA, 19 bp, Homo sapiens
agttggggcagggaagaga

SEQ ID NO: 7974612 - DNA, 22 bp, Homo sapiens
agttgggtttgtgtcagttgca

SEQ ID NO: 7974613 - DNA, 22 bp, Homo sapiens
agttggcttcaaaggcagagag

SEQ ID NO: 7974614 - DNA, 22 bp, Homo sapiens
agttggcattcctgcatcctat

SEQ ID NO: 7974615 - DNA, 22 bp, Homo sapiens
agttggcattcctgcatcctat

SEQ ID NO: 7974616 - DNA, 22 bp, Homo sapiens
agttggcactgagctgtgattg

SEQ ID NO: 7974617 - DNA, 22 bp, Homo sapiens
agttggcagtctgcaacctgga

SEQ ID NO: 7974618 - DNA, 23 bp, Homo sapiens
agttggcatattcaagcacagtc

SEQ ID NO: 7974619 - DNA, 23 bp, Homo sapiens
agttggcatattcaagcacagtc

SEQ ID NO: 7974620 - DNA, 22 bp, Homo sapiens
agttggagtgaacatgagattg

SEQ ID NO: 7974621 - DNA, 22 bp, Homo sapiens
agttggagtgaacatgagattg

SEQ ID NO: 7974622 - DNA, 22 bp, Homo sapiens
agttggagaagaggtcgggaat

SEQ ID NO: 7974623 - DNA, 22 bp, Homo sapiens
agttggagtgaacatgagattg

SEQ ID NO: 7974624 - DNA, 22 bp, Homo sapiens
agttggatggattggaatgaag

SEQ ID NO: 7974625 - DNA, 22 bp, Homo sapiens
agttggcaaggtctggccagcg

SEQ ID NO: 7974626 - DNA, 22 bp, Homo sapiens
agttggcaaaggtaggtattct

SEQ ID NO: 7974627 - DNA, 22 bp, Homo sapiens
agttggagaagaggtcgggaat

SEQ ID NO: 7974628 - DNA, 22 bp, Homo sapiens
agttggaccttgggaaaaggta

SEQ ID NO: 7974629 - DNA, 23 bp, Homo sapiens
agttggacctgggtaagaaaatg

SEQ ID NO: 7974630 - DNA, 22 bp, Homo sapiens
agttgctggcacctgtgagtat

SEQ ID NO: 7974631 - DNA, 22 bp, Homo sapiens
agttgctggcacctgtgagtat

SEQ ID NO: 7974632 - DNA, 22 bp, Homo sapiens
agttgctgggaaagatttcagt

SEQ ID NO: 7974633 - DNA, 22 bp, Homo sapiens
agttcttgctataaaaacaaat

SEQ ID NO: 7974634 - DNA, 22 bp, Homo sapiens
ctctttggtgcaccttgcagtc

SEQ ID NO: 7974635 - DNA, 22 bp, Homo sapiens
agttcttcataaccttactgtg

SEQ ID NO: 7974636 - DNA, 22 bp, Homo sapiens
ctctttggtcgcatcatccatt

SEQ ID NO: 7974637 - DNA, 22 bp, Homo sapiens
agttcttcccttttctatggag

SEQ ID NO: 7974638 - DNA, 22 bp, Homo sapiens
ctctttggtgcaccttgcagtc

SEQ ID NO: 7974639 - DNA, 22 bp, Homo sapiens
agttgctgattctgtctgtgat

SEQ ID NO: 7974640 - DNA, 22 bp, Homo sapiens
agttgctgattctgtctgtgat

SEQ ID NO: 7974641 - DNA, 22 bp, Homo sapiens
agttgctgattctgtctgtgat

SEQ ID NO: 7974642 - DNA, 21 bp, Homo sapiens
agttgctgctgctgcaggtga

SEQ ID NO: 7974643 - DNA, 22 bp, Homo sapiens
agttgctgcttctctctagaga

SEQ ID NO: 7974644 - DNA, 21 bp, Homo sapiens
ctctttgggatctttggaaag

SEQ ID NO: 7974645 - DNA, 21 bp, Homo sapiens
ctctttgggatctttggaaag

SEQ ID NO: 7974646 - DNA, 21 bp, Homo sapiens
ctctttgggatctttggaaag

SEQ ID NO: 7974647 - DNA, 22 bp, Homo sapiens
ctctttggctttgactcccatt

SEQ ID NO: 7974648 - DNA, 21 bp, Homo sapiens
ctctttgggatctttggaaag

SEQ ID NO: 7974649 - DNA, 22 bp, Homo sapiens
ctctttgggatgggctctgctg

SEQ ID NO: 7974650 - DNA, 22 bp, Homo sapiens
ctctttgggatgggctctgctg

SEQ ID NO: 7974651 - DNA, 16 bp, Homo sapiens
ctctttgggcttccag

SEQ ID NO: 7974652 - DNA, 22 bp, Homo sapiens
ctctttgggatgggctctgctg

SEQ ID NO: 7974653 - DNA, 22 bp, Homo sapiens
ctctttggggctggaagcctag

SEQ ID NO: 7974654 - DNA, 16 bp, Homo sapiens
ctctttgggcttccag

SEQ ID NO: 7974655 - DNA, 22 bp, Homo sapiens
ctctttggggctggaagcctag

SEQ ID NO: 7974656 - DNA, 22 bp, Homo sapiens
ctctttggggctggaagcctag

SEQ ID NO: 7974657 - DNA, 22 bp, Homo sapiens
ctctttggggtgccccactggt

SEQ ID NO: 7974658 - DNA, 22 bp, Homo sapiens
ctctttggggtgccccactggt

SEQ ID NO: 7974659 - DNA, 22 bp, Homo sapiens
ctctttggggtgccccactggt

SEQ ID NO: 7974660 - DNA, 22 bp, Homo sapiens
ctctttggtcgcatcatccatt

SEQ ID NO: 7974661 - DNA, 22 bp, Homo sapiens
ctctttggtcgcatcatccatt

SEQ ID NO: 7974662 - DNA, 22 bp, Homo sapiens
agttggtgagcgtgtggtaatc

SEQ ID NO: 7974663 - DNA, 22 bp, Homo sapiens
agttggtgggtgtgagctggac

SEQ ID NO: 7974664 - DNA, 22 bp, Homo sapiens
agttgggtttgtgtcagttgca

SEQ ID NO: 7974665 - DNA, 22 bp, Homo sapiens
agttgggtttgtgtcagttgca

SEQ ID NO: 7974666 - DNA, 22 bp, Homo sapiens
agttgtaacagattctaacata

SEQ ID NO: 7974667 - DNA, 22 bp, Homo sapiens
agttggtgggtgtgagctggac

SEQ ID NO: 7974668 - DNA, 22 bp, Homo sapiens
agttgtaagagacagatataaa

SEQ ID NO: 7974669 - DNA, 22 bp, Homo sapiens
agttgtaacagattctaacata

SEQ ID NO: 7974670 - DNA, 21 bp, Homo sapiens
ctgaggcagcacagctagtca

SEQ ID NO: 7974671 - DNA, 22 bp, Homo sapiens
ctgaggcaggagaattgctgga

SEQ ID NO: 7974672 - DNA, 22 bp, Homo sapiens
ctgaggcaggagaattgctgga

SEQ ID NO: 7974673 - DNA, 22 bp, Homo sapiens
ctgaggcaggagaattgctgga

SEQ ID NO: 7974674 - DNA, 22 bp, Homo sapiens
ctgaggcaggggcagctggaga

SEQ ID NO: 7974675 - DNA, 22 bp, Homo sapiens
ctgaggcaggggcagctggaga

SEQ ID NO: 7974676 - DNA, 22 bp, Homo sapiens
ctgaggcaggggcagctggaga

SEQ ID NO: 7974677 - DNA, 22 bp, Homo sapiens
ctgaggcaggggcagctggaga

SEQ ID NO: 7974678 - DNA, 22 bp, Homo sapiens
ctgaggcaggggcagctggaga

SEQ ID NO: 7974679 - DNA, 22 bp, Homo sapiens
ctgaggcaggcagatcacttga

SEQ ID NO: 7974680 - DNA, 22 bp, Homo sapiens
ctgaggcaggcagatcacttga

SEQ ID NO: 7974681 - DNA, 22 bp, Homo sapiens
ctgaggcaggatggcctggctg

SEQ ID NO: 7974682 - DNA, 22 bp, Homo sapiens
ctgaggcaggatggcctggctg

SEQ ID NO: 7974683 - DNA, 22 bp, Homo sapiens
ctgaggcaggatggcctggctg

SEQ ID NO: 7974684 - DNA, 22 bp, Homo sapiens
ctgaggcaggatggcctggctg

SEQ ID NO: 7974685 - DNA, 22 bp, Homo sapiens
ctgaggcaggatggcctggctg

SEQ ID NO: 7974686 - DNA, 22 bp, Homo sapiens
ctgaggcaggagagttgcttga

SEQ ID NO: 7974687 - DNA, 22 bp, Homo sapiens
ctgaggcaggagagttgcttga

SEQ ID NO: 7974688 - DNA, 22 bp, Homo sapiens
ctgaggcaggagagttgcttga

SEQ ID NO: 7974689 - DNA, 22 bp, Homo sapiens
ctgaggcaggagaattgctgga

SEQ ID NO: 7974690 - DNA, 22 bp, Homo sapiens
ctgaggcaggagaattgctgga

SEQ ID NO: 7974691 - DNA, 21 bp, Homo sapiens
ctgaggcatgcaggcctgggc

SEQ ID NO: 7974692 - DNA, 21 bp, Homo sapiens
ctgaggcatgcaggcctgggc

SEQ ID NO: 7974693 - DNA, 21 bp, Homo sapiens
ctgaggcatgcaggcctgggc

SEQ ID NO: 7974694 - DNA, 22 bp, Homo sapiens
ctgaggccgttggtgggcctta

SEQ ID NO: 7974695 - DNA, 21 bp, Homo sapiens
ctgaggcatgcaggcctgggc

SEQ ID NO: 7974696 - DNA, 21 bp, Homo sapiens
ctgaggcatgcaggcctgggc

SEQ ID NO: 7974697 - DNA, 22 bp, Homo sapiens
ctgaggcatgaatgtgggcttt

SEQ ID NO: 7974698 - DNA, 22 bp, Homo sapiens
ctgaggcctcactgtagtccct

SEQ ID NO: 7974699 - DNA, 22 bp, Homo sapiens
ctgaggcctcactgtagtccct

SEQ ID NO: 7974700 - DNA, 22 bp, Homo sapiens
ctgaggcctcactgtagtccct

SEQ ID NO: 7974701 - DNA, 22 bp, Homo sapiens
ctgaggcctaagacatgaatga

SEQ ID NO: 7974702 - DNA, 22 bp, Homo sapiens
ctgaggcctaagacatgaatga

SEQ ID NO: 7974703 - DNA, 22 bp, Homo sapiens
ctgaggcatgaatgtgggcttt

SEQ ID NO: 7974704 - DNA, 22 bp, Homo sapiens
ctgaggcatgaatgtgggcttt

SEQ ID NO: 7974705 - DNA, 22 bp, Homo sapiens
ctgaggcatgaatgtgggcttt

SEQ ID NO: 7974706 - DNA, 22 bp, Homo sapiens
ctgaggcatcatggagaacagt

SEQ ID NO: 7974707 - DNA, 22 bp, Homo sapiens
ctgaggcatgaatgtgggcttt

SEQ ID NO: 7974708 - DNA, 22 bp, Homo sapiens
ctgaggcatgaatgtgggcttt

SEQ ID NO: 7974709 - DNA, 22 bp, Homo sapiens
ctgaggcaggggcagctggaga

SEQ ID NO: 7974710 - DNA, 22 bp, Homo sapiens
ctgaggcaggggcagctggaga

SEQ ID NO: 7974711 - DNA, 22 bp, Homo sapiens
ctgaggcagtttaatttttgaa

SEQ ID NO: 7974712 - DNA, 22 bp, Homo sapiens
ctgaggcagtttaatttttgaa

SEQ ID NO: 7974713 - DNA, 22 bp, Homo sapiens
ctgaggcatcatggagaacagt

SEQ ID NO: 7974714 - DNA, 22 bp, Homo sapiens
ctgaggcatcatggagaacagt

SEQ ID NO: 7974715 - DNA, 22 bp, Homo sapiens
ctgaggcatcatggagaacagt

SEQ ID NO: 7974716 - DNA, 22 bp, Homo sapiens
ctgaggcagtttaatttttgaa

SEQ ID NO: 7974717 - DNA, 22 bp, Homo sapiens
atacagatgggtcagatttcat

SEQ ID NO: 7974718 - DNA, 22 bp, Homo sapiens
atacagatgggtcagatttcat

SEQ ID NO: 7974719 - DNA, 22 bp, Homo sapiens
ctggaggaaaacaactgcagac

SEQ ID NO: 7974720 - DNA, 20 bp, Homo sapiens
atacagatggttccagctgg

SEQ ID NO: 7974721 - DNA, 20 bp, Homo sapiens
atacagatggttccagctgg

SEQ ID NO: 7974722 - DNA, 22 bp, Homo sapiens
ctggaggaaaacaactgcagac

SEQ ID NO: 7974723 - DNA, 22 bp, Homo sapiens
ctggaggaaaacaactgcagac

SEQ ID NO: 7974724 - DNA, 22 bp, Homo sapiens
ctggaggaaaacaactgcagac

SEQ ID NO: 7974725 - DNA, 22 bp, Homo sapiens
ctggagggaggaggctgctatt

SEQ ID NO: 7974726 - DNA, 22 bp, Homo sapiens
ctggagggagattcaaaggagg

SEQ ID NO: 7974727 - DNA, 22 bp, Homo sapiens
ctggagggatgtagggtgtatt

SEQ ID NO: 7974728 - DNA, 22 bp, Homo sapiens
ctggagggatgtagggtgtatt

SEQ ID NO: 7974729 - DNA, 22 bp, Homo sapiens
ctggagggatgtagggtgtatt

SEQ ID NO: 7974730 - DNA, 22 bp, Homo sapiens
ctggagggagttaggacccgga

SEQ ID NO: 7974731 - DNA, 22 bp, Homo sapiens
ctggagggaggaggctgctatt

SEQ ID NO: 7974732 - DNA, 22 bp, Homo sapiens
ctggagggaggaggctgctatt

SEQ ID NO: 7974733 - DNA, 22 bp, Homo sapiens
ctggagggagttaggacccgga

SEQ ID NO: 7974734 - DNA, 22 bp, Homo sapiens
ctggagggaggaggctgctatt

SEQ ID NO: 7974735 - DNA, 22 bp, Homo sapiens
atacagaattcactacagtttc

SEQ ID NO: 7974736 - DNA, 22 bp, Homo sapiens
atacagaattcactacagtttc

SEQ ID NO: 7974737 - DNA, 22 bp, Homo sapiens
atacagaattcactacagtttc

SEQ ID NO: 7974738 - DNA, 22 bp, Homo sapiens
atacagaattcactacagtttc

SEQ ID NO: 7974739 - DNA, 22 bp, Homo sapiens
atacagaattcactacagtttc

SEQ ID NO: 7974740 - DNA, 22 bp, Homo sapiens
atacagaatttgcccttttcat

SEQ ID NO: 7974741 - DNA, 22 bp, Homo sapiens
atacagaattcactacagtttc

SEQ ID NO: 7974742 - DNA, 22 bp, Homo sapiens
atacagaattcactacagtttc

SEQ ID NO: 7974743 - DNA, 18 bp, Homo sapiens
atacagagacctcaagga

SEQ ID NO: 7974744 - DNA, 22 bp, Homo sapiens
atacagagacacttgagactgg

SEQ ID NO: 7974745 - DNA, 22 bp, Homo sapiens
atacagagaagggaggcaaaat

SEQ ID NO: 7974746 - DNA, 22 bp, Homo sapiens
atacagagaagggaggcaaaat

SEQ ID NO: 7974747 - DNA, 22 bp, Homo sapiens
atacagagaagggaggcaaaat

SEQ ID NO: 7974748 - DNA, 22 bp, Homo sapiens
atacagatgcttgctcgtgact

SEQ ID NO: 7974749 - DNA, 22 bp, Homo sapiens
atacagatgaaatactaagcta

SEQ ID NO: 7974750 - DNA, 22 bp, Homo sapiens
atacagatgaaatactaagcta

SEQ ID NO: 7974751 - DNA, 19 bp, Homo sapiens
atacagagcttcctaattt

SEQ ID NO: 7974752 - DNA, 22 bp, Homo sapiens
atacagatcccacagcatgtga

SEQ ID NO: 7974753 - DNA, 22 bp, Homo sapiens
ctggagagaccgaaagaggctg

SEQ ID NO: 7974754 - DNA, 22 bp, Homo sapiens
ctggagagaccgaaagaggctg

SEQ ID NO: 7974755 - DNA, 22 bp, Homo sapiens
atacaagttaatgagaatgaca

SEQ ID NO: 7974756 - DNA, 22 bp, Homo sapiens
atacaagttaatgagaatgaca

SEQ ID NO: 7974757 - DNA, 22 bp, Homo sapiens
ctggagagaccgaaagaggctg

SEQ ID NO: 7974758 - DNA, 22 bp, Homo sapiens
ctggagcatccatgcccagggt

SEQ ID NO: 7974759 - DNA, 22 bp, Homo sapiens
atacaagttaatgagaatgaca

SEQ ID NO: 7974760 - DNA, 22 bp, Homo sapiens
atacaagttaatgagaatgaca

SEQ ID NO: 7974761 - DNA, 22 bp, Homo sapiens
atacaagttaaatgcagtgccc

SEQ ID NO: 7974762 - DNA, 22 bp, Homo sapiens
atacaagtgttgtgcctcatca

SEQ ID NO: 7974763 - DNA, 22 bp, Homo sapiens
atacaagtggccacttgaattc

SEQ ID NO: 7974764 - DNA, 22 bp, Homo sapiens
atacaagtggccacttgaattc

SEQ ID NO: 7974765 - DNA, 22 bp, Homo sapiens
ctggagccactgggtcttgtat

SEQ ID NO: 7974766 - DNA, 22 bp, Homo sapiens
ctggagccactttttatccttt

SEQ ID NO: 7974767 - DNA, 22 bp, Homo sapiens
ctggagccactgggtcttgtat

SEQ ID NO: 7974768 - DNA, 22 bp, Homo sapiens
ctggagccagccagggccctct

SEQ ID NO: 7974769 - DNA, 22 bp, Homo sapiens
ctggagccagccagggccctct

SEQ ID NO: 7974770 - DNA, 17 bp, Homo sapiens
ctggagccaagagggcc

SEQ ID NO: 7974771 - DNA, 17 bp, Homo sapiens
ctggagccaagagggcc

SEQ ID NO: 7974772 - DNA, 22 bp, Homo sapiens
ctggagcatccatgcccagggt

SEQ ID NO: 7974773 - DNA, 22 bp, Homo sapiens
ctggagcatccatgcccagggt

SEQ ID NO: 7974774 - DNA, 17 bp, Homo sapiens
ctggagccaagagggcc

SEQ ID NO: 7974775 - DNA, 22 bp, Homo sapiens
atacagaatactaattcctgag

SEQ ID NO: 7974776 - DNA, 22 bp, Homo sapiens
atacagaatactaattcctgag

SEQ ID NO: 7974777 - DNA, 22 bp, Homo sapiens
atacagaatactaattcctgag

SEQ ID NO: 7974778 - DNA, 22 bp, Homo sapiens
atacagaagttttccacttatt

SEQ ID NO: 7974779 - DNA, 22 bp, Homo sapiens
atacagaatactaattcctgag

SEQ ID NO: 7974780 - DNA, 22 bp, Homo sapiens
atacagaatactaattcctgag

SEQ ID NO: 7974781 - DNA, 22 bp, Homo sapiens
atacagaatactaattcctgag

SEQ ID NO: 7974782 - DNA, 22 bp, Homo sapiens
atacagaatactaattcctgag

SEQ ID NO: 7974783 - DNA, 22 bp, Homo sapiens
atacagaatactaattcctgag

SEQ ID NO: 7974784 - DNA, 22 bp, Homo sapiens
atacagaattcactacagtttc

SEQ ID NO: 7974785 - DNA, 22 bp, Homo sapiens
atacagaattcactacagtttc

SEQ ID NO: 7974786 - DNA, 22 bp, Homo sapiens
ctggagccccaggctgtgcaga

SEQ ID NO: 7974787 - DNA, 22 bp, Homo sapiens
ctggagccccagacagggagag

SEQ ID NO: 7974788 - DNA, 22 bp, Homo sapiens
ctggagccccaggctgtgcaga

SEQ ID NO: 7974789 - DNA, 22 bp, Homo sapiens
ctggagccccaggctgtgcaga

SEQ ID NO: 7974790 - DNA, 22 bp, Homo sapiens
ctggagccccagacagggagag

SEQ ID NO: 7974791 - DNA, 22 bp, Homo sapiens
ctggagccccagacagggagag

SEQ ID NO: 7974792 - DNA, 22 bp, Homo sapiens
ctggagccccagacagggagag

SEQ ID NO: 7974793 - DNA, 22 bp, Homo sapiens
ctggagccccagacagggagag

SEQ ID NO: 7974794 - DNA, 22 bp, Homo sapiens
ctggagccccagacagggagag

SEQ ID NO: 7974795 - DNA, 22 bp, Homo sapiens
ctggagcccaggcctggtgtct

SEQ ID NO: 7974796 - DNA, 22 bp, Homo sapiens
ctggagccatgtcttgactgct

SEQ ID NO: 7974797 - DNA, 22 bp, Homo sapiens
ctggagccatgtcttgactgct

SEQ ID NO: 7974798 - DNA, 22 bp, Homo sapiens
ctggagccatgtatagcctatg

SEQ ID NO: 7974799 - DNA, 22 bp, Homo sapiens
ctggagccagccagggccctct

SEQ ID NO: 7974800 - DNA, 22 bp, Homo sapiens
ctggagccatgtatagcctatg

SEQ ID NO: 7974801 - DNA, 22 bp, Homo sapiens
ctggagcccaggcctggtgtct

SEQ ID NO: 7974802 - DNA, 22 bp, Homo sapiens
ctggagccccagacagggagag

SEQ ID NO: 7974803 - DNA, 22 bp, Homo sapiens
ctggagccccagacagggagag

SEQ ID NO: 7974804 - DNA, 22 bp, Homo sapiens
ctggagccccagacagggagag

SEQ ID NO: 7974805 - DNA, 22 bp, Homo sapiens
ctggagccccagacagggagag

SEQ ID NO: 7974806 - DNA, 22 bp, Homo sapiens
ctggagcccaggcctggtgtct

SEQ ID NO: 7974807 - DNA, 19 bp, Homo sapiens
ctggcagcctgtctgtgtc

SEQ ID NO: 7974808 - DNA, 19 bp, Homo sapiens
ctggcagcctgtctgtgtc

SEQ ID NO: 7974809 - DNA, 19 bp, Homo sapiens
ctggcagcctgtctgtgtc

SEQ ID NO: 7974810 - DNA, 22 bp, Homo sapiens
atactttagagctagattgcct

SEQ ID NO: 7974811 - DNA, 22 bp, Homo sapiens
atactttctgaccaattaattg

SEQ ID NO: 7974812 - DNA, 22 bp, Homo sapiens
atactttctgaccaattaattg

SEQ ID NO: 7974813 - DNA, 22 bp, Homo sapiens
ctggcagcggtttgcagcctgg

SEQ ID NO: 7974814 - DNA, 22 bp, Homo sapiens
ctggcagcggtttgcagcctgg

SEQ ID NO: 7974815 - DNA, 22 bp, Homo sapiens
ctggcagcgtgagcagcatcca

SEQ ID NO: 7974816 - DNA, 22 bp, Homo sapiens
ctggcagcgcagcatgaagtcg

SEQ ID NO: 7974817 - DNA, 22 bp, Homo sapiens
ctggcagcggtttgcagcctgg

SEQ ID NO: 7974818 - DNA, 22 bp, Homo sapiens
ctggcagcggtttgcagcctgg

SEQ ID NO: 7974819 - DNA, 22 bp, Homo sapiens
ctggcagcggtttgcagcctgg

SEQ ID NO: 7974820 - DNA, 22 bp, Homo sapiens
ctggcagcggtttgcagcctgg

SEQ ID NO: 7974821 - DNA, 22 bp, Homo sapiens
ctggcagctctactcagagcct

SEQ ID NO: 7974822 - DNA, 22 bp, Homo sapiens
ctggcagctctactcagagcct

SEQ ID NO: 7974823 - DNA, 22 bp, Homo sapiens
ctggcagctctactcagagcct

SEQ ID NO: 7974824 - DNA, 22 bp, Homo sapiens
ctggcagctctactcagagcct

SEQ ID NO: 7974825 - DNA, 22 bp, Homo sapiens
ctggcagctctgagtcccttct

SEQ ID NO: 7974826 - DNA, 22 bp, Homo sapiens
ctggcagctgcccgagatgccc

SEQ ID NO: 7974827 - DNA, 22 bp, Homo sapiens
ctggcagctgcccgagatgccc

SEQ ID NO: 7974828 - DNA, 22 bp, Homo sapiens
ctggcagctgcccgagatgccc

SEQ ID NO: 7974829 - DNA, 22 bp, Homo sapiens
ctggcagcgtgagcagcatcca

SEQ ID NO: 7974830 - DNA, 22 bp, Homo sapiens
ctggcagcgtgagcagcatcca

SEQ ID NO: 7974831 - DNA, 22 bp, Homo sapiens
ctggcagcgtgagcagcatcca

SEQ ID NO: 7974832 - DNA, 22 bp, Homo sapiens
ctggcagcgtgagcagcatcca

SEQ ID NO: 7974833 - DNA, 22 bp, Homo sapiens
ctggcagcgtgagcagcatcca

SEQ ID NO: 7974834 - DNA, 22 bp, Homo sapiens
ctggcagctctactcagagcct

SEQ ID NO: 7974835 - DNA, 22 bp, Homo sapiens
ctggcagctctactcagagcct

SEQ ID NO: 7974836 - DNA, 22 bp, Homo sapiens
ctggcagctctactcagagcct

SEQ ID NO: 7974837 - DNA, 22 bp, Homo sapiens
ctggcagcgtgtttatgaacat

SEQ ID NO: 7974838 - DNA, 22 bp, Homo sapiens
atactttagagctagattgcct

SEQ ID NO: 7974839 - DNA, 22 bp, Homo sapiens
atactttagagctagattgcct

SEQ ID NO: 7974840 - DNA, 22 bp, Homo sapiens
atacttgttcctgttgctatag

SEQ ID NO: 7974841 - DNA, 22 bp, Homo sapiens
atacttgaggttgtataaatat

SEQ ID NO: 7974842 - DNA, 22 bp, Homo sapiens
atacttctttgatgttcacagg

SEQ ID NO: 7974843 - DNA, 22 bp, Homo sapiens
atacttgtcaacattttatcca

SEQ ID NO: 7974844 - DNA, 22 bp, Homo sapiens
atacttgatggtgtctgtcaaa

SEQ ID NO: 7974845 - DNA, 22 bp, Homo sapiens
atacttctttgatgttcacagg

SEQ ID NO: 7974846 - DNA, 22 bp, Homo sapiens
atacttctggtgacaaagtctt

SEQ ID NO: 7974847 - DNA, 22 bp, Homo sapiens
atacttctcatgggctctgagc

SEQ ID NO: 7974848 - DNA, 22 bp, Homo sapiens
atacttctttaagagtaagtct

SEQ ID NO: 7974849 - DNA, 22 bp, Homo sapiens
atacttctttagcatattgaac

SEQ ID NO: 7974850 - DNA, 22 bp, Homo sapiens
atacttctcatgggctctgagc

SEQ ID NO: 7974851 - DNA, 22 bp, Homo sapiens
atacttctagaaatactatgca

SEQ ID NO: 7974852 - DNA, 22 bp, Homo sapiens
atacttctagaaatactatgca

SEQ ID NO: 7974853 - DNA, 22 bp, Homo sapiens
atacttcatgcttcatgtctgt

SEQ ID NO: 7974854 - DNA, 22 bp, Homo sapiens
atacttatgataaataattgct

SEQ ID NO: 7974855 - DNA, 22 bp, Homo sapiens
atacttcaacatatcagtcaga

SEQ ID NO: 7974856 - DNA, 22 bp, Homo sapiens
atacttcatgcttcatgtctgt

SEQ ID NO: 7974857 - DNA, 22 bp, Homo sapiens
atacttatgataaataattgct

SEQ ID NO: 7974858 - DNA, 22 bp, Homo sapiens
atactcaatttgttggaaagca

SEQ ID NO: 7974859 - DNA, 22 bp, Homo sapiens
ctggagtgcagtggcatgatca

SEQ ID NO: 7974860 - DNA, 22 bp, Homo sapiens
atactcagctgctagacagaag

SEQ ID NO: 7974861 - DNA, 22 bp, Homo sapiens
atactgaaaaagaagtgttgaa

SEQ ID NO: 7974862 - DNA, 22 bp, Homo sapiens
atactgaaaaagaagtgttgaa

SEQ ID NO: 7974863 - DNA, 22 bp, Homo sapiens
ctggagtgatactcagaatgtg

SEQ ID NO: 7974864 - DNA, 22 bp, Homo sapiens
ctggagtgatactcagaatgtg

SEQ ID NO: 7974865 - DNA, 22 bp, Homo sapiens
ctggagtgaggtctgggagcct

SEQ ID NO: 7974866 - DNA, 22 bp, Homo sapiens
ctggagtgaggtctgggagcct

SEQ ID NO: 7974867 - DNA, 22 bp, Homo sapiens
ctggagtgaggtctgggagcct

SEQ ID NO: 7974868 - DNA, 22 bp, Homo sapiens
ctggagtgaggtctgggagcct

SEQ ID NO: 7974869 - DNA, 22 bp, Homo sapiens
ctggagtgaggtctgggagcct

SEQ ID NO: 7974870 - DNA, 22 bp, Homo sapiens
ctggagtgcaacctctgcctcc

SEQ ID NO: 7974871 - DNA, 22 bp, Homo sapiens
ctggagtgatactcagaatgtg

SEQ ID NO: 7974872 - DNA, 22 bp, Homo sapiens
ctggagtgcagtggcatgatca

SEQ ID NO: 7974873 - DNA, 22 bp, Homo sapiens
ctggagtgcagtggcatgatca

SEQ ID NO: 7974874 - DNA, 22 bp, Homo sapiens
ctggagtgcagtggcatgatca

SEQ ID NO: 7974875 - DNA, 22 bp, Homo sapiens
ctggagtgcaatgaacaaggtc

SEQ ID NO: 7974876 - DNA, 22 bp, Homo sapiens
ctggagggctggactaaggaaa

SEQ ID NO: 7974877 - DNA, 22 bp, Homo sapiens
ctggagggctggactaaggaaa

SEQ ID NO: 7974878 - DNA, 22 bp, Homo sapiens
ctggagtctcttctgtagctac

SEQ ID NO: 7974879 - DNA, 22 bp, Homo sapiens
ctggagggctgcagcgaggctg

SEQ ID NO: 7974880 - DNA, 22 bp, Homo sapiens
ctggagggctgcagcgaggctg

SEQ ID NO: 7974881 - DNA, 22 bp, Homo sapiens
ctggagggctgcagcgaggctg

SEQ ID NO: 7974882 - DNA, 22 bp, Homo sapiens
ctggagggatgtagggtgtatt

SEQ ID NO: 7974883 - DNA, 22 bp, Homo sapiens
ctggagggatgtagggtgtatt

SEQ ID NO: 7974884 - DNA, 22 bp, Homo sapiens
ctggagggatgtagggtgtatt

SEQ ID NO: 7974885 - DNA, 22 bp, Homo sapiens
ctggagggctgcagcgaggctg

SEQ ID NO: 7974886 - DNA, 22 bp, Homo sapiens
ctggagggctgcagcgaggctg

SEQ ID NO: 7974887 - DNA, 22 bp, Homo sapiens
ctggagggctgcagcgaggctg

SEQ ID NO: 7974888 - DNA, 22 bp, Homo sapiens
ctggagtgaagtctggcagctt

SEQ ID NO: 7974889 - DNA, 22 bp, Homo sapiens
ctggagtgaagtctggcagctt

SEQ ID NO: 7974890 - DNA, 22 bp, Homo sapiens
ctggagtgaagtctggcagctt

SEQ ID NO: 7974891 - DNA, 22 bp, Homo sapiens
ctggagtgaagtctggcagctt

SEQ ID NO: 7974892 - DNA, 22 bp, Homo sapiens
ctggagtgaagtctggcagctt

SEQ ID NO: 7974893 - DNA, 22 bp, Homo sapiens
ctggagtgaagtctggcagctt

SEQ ID NO: 7974894 - DNA, 22 bp, Homo sapiens
ctggagtgaagtctggcagctt

SEQ ID NO: 7974895 - DNA, 22 bp, Homo sapiens
ctggagtgaagtctggcagctt

SEQ ID NO: 7974896 - DNA, 22 bp, Homo sapiens
ctggagtgactttgttcctttt

SEQ ID NO: 7974897 - DNA, 22 bp, Homo sapiens
ctggagtgaggtctgggagcct

SEQ ID NO: 7974898 - DNA, 22 bp, Homo sapiens
ctggagtgaggtctgggagcct

SEQ ID NO: 7974899 - DNA, 22 bp, Homo sapiens
ctggagtcttcagcttgctgcc

SEQ ID NO: 7974900 - DNA, 22 bp, Homo sapiens
ctggagtcttcagcttgctgcc

SEQ ID NO: 7974901 - DNA, 21 bp, Homo sapiens
ctggagtctgggggtggcagt

SEQ ID NO: 7974902 - DNA, 22 bp, Homo sapiens
ctggagtcttaggttatggtga

SEQ ID NO: 7974903 - DNA, 22 bp, Homo sapiens
ctggagtcttaggttatggtga

SEQ ID NO: 7974904 - DNA, 22 bp, Homo sapiens
ataatatttggataggacagta

SEQ ID NO: 7974905 - DNA, 22 bp, Homo sapiens
ataatatttggataggacagta

SEQ ID NO: 7974906 - DNA, 22 bp, Homo sapiens
ataatatttgcattactgtgat

SEQ ID NO: 7974907 - DNA, 22 bp, Homo sapiens
ataatcaaagtcctatgacatc

SEQ ID NO: 7974908 - DNA, 22 bp, Homo sapiens
ataatcaaagtcctatgacatc

SEQ ID NO: 7974909 - DNA, 22 bp, Homo sapiens
ataatatttggataggacagta

SEQ ID NO: 7974910 - DNA, 22 bp, Homo sapiens
ataatcagaattcatgaaagat

SEQ ID NO: 7974911 - DNA, 22 bp, Homo sapiens
ataatcaaagtcctatgacatc

SEQ ID NO: 7974912 - DNA, 22 bp, Homo sapiens
ctgctgtgtgaccatggacagg

SEQ ID NO: 7974913 - DNA, 22 bp, Homo sapiens
ctgctgtgtgaccatggacagg

SEQ ID NO: 7974914 - DNA, 22 bp, Homo sapiens
ataatataatcctacttcccat

SEQ ID NO: 7974915 - DNA, 22 bp, Homo sapiens
ataatatcgctcctttttttga

SEQ ID NO: 7974916 - DNA, 22 bp, Homo sapiens
ataatatttgcattactgtgat

SEQ ID NO: 7974917 - DNA, 22 bp, Homo sapiens
ataatatttgcattactgtgat

SEQ ID NO: 7974918 - DNA, 22 bp, Homo sapiens
ataatatttgcattactgtgat

SEQ ID NO: 7974919 - DNA, 22 bp, Homo sapiens
ataatatttgcattactgtgat

SEQ ID NO: 7974920 - DNA, 22 bp, Homo sapiens
ataatatttgcattactgtgat

SEQ ID NO: 7974921 - DNA, 22 bp, Homo sapiens
ataatatttgcattactgtgat

SEQ ID NO: 7974922 - DNA, 22 bp, Homo sapiens
ataatatttgcattactgtgat

SEQ ID NO: 7974923 - DNA, 22 bp, Homo sapiens
ataatatttgcattactgtgat

SEQ ID NO: 7974924 - DNA, 22 bp, Homo sapiens
ctgcttctgggatgatggagta

SEQ ID NO: 7974925 - DNA, 22 bp, Homo sapiens
ctgcttctccctgagatagtgt

SEQ ID NO: 7974926 - DNA, 18 bp, Homo sapiens
ctgcttctgtctgccagt

SEQ ID NO: 7974927 - DNA, 18 bp, Homo sapiens
ctgcttctgtctgccagt

SEQ ID NO: 7974928 - DNA, 22 bp, Homo sapiens
ctgcttcttttgggtaattgat

SEQ ID NO: 7974929 - DNA, 22 bp, Homo sapiens
ctgctgtgtgcttacttgggtt

SEQ ID NO: 7974930 - DNA, 22 bp, Homo sapiens
ctgctgtgtgcttacttgggtt

SEQ ID NO: 7974931 - DNA, 22 bp, Homo sapiens
ctgcttctagcaccaagtccct

SEQ ID NO: 7974932 - DNA, 22 bp, Homo sapiens
ctgcttctagcaccaagtccct

SEQ ID NO: 7974933 - DNA, 22 bp, Homo sapiens
ctgcttctagcaccaagtccct

SEQ ID NO: 7974934 - DNA, 22 bp, Homo sapiens
ctgcttggagtcctccagcacc

SEQ ID NO: 7974935 - DNA, 17 bp, Homo sapiens
ctgcttggcctctgggg

SEQ ID NO: 7974936 - DNA, 17 bp, Homo sapiens
ctgcttggcctctgggg

SEQ ID NO: 7974937 - DNA, 22 bp, Homo sapiens
ctgcttggcttataacctcagg

SEQ ID NO: 7974938 - DNA, 22 bp, Homo sapiens
ctgcttggaggcctgggtgcta

SEQ ID NO: 7974939 - DNA, 22 bp, Homo sapiens
ctgcttgggtcctggcatgggt

SEQ ID NO: 7974940 - DNA, 20 bp, Homo sapiens
ctgcttgggcccctctggcc

SEQ ID NO: 7974941 - DNA, 22 bp, Homo sapiens
ctgcttgggtcctggcatgggt

SEQ ID NO: 7974942 - DNA, 22 bp, Homo sapiens
ctgcttgggtcctggcatgggt

SEQ ID NO: 7974943 - DNA, 22 bp, Homo sapiens
ctgcttggggttagggtgtcct

SEQ ID NO: 7974944 - DNA, 20 bp, Homo sapiens
ctgcttgggcccctctggcc

SEQ ID NO: 7974945 - DNA, 18 bp, Homo sapiens
ctgcttgggagacgtcag

SEQ ID NO: 7974946 - DNA, 20 bp, Homo sapiens
ctgcttgggacactgccaga

SEQ ID NO: 7974947 - DNA, 22 bp, Homo sapiens
atacaagtgagaaaactgaaga

SEQ ID NO: 7974948 - DNA, 22 bp, Homo sapiens
atacaagtgagaaaactgaaga

SEQ ID NO: 7974949 - DNA, 22 bp, Homo sapiens
atacaagtcaatccatgtgatt

SEQ ID NO: 7974950 - DNA, 22 bp, Homo sapiens
atacaagtgatataattgtttc

SEQ ID NO: 7974951 - DNA, 22 bp, Homo sapiens
atacaagtgatataattgtttc

SEQ ID NO: 7974952 - DNA, 22 bp, Homo sapiens
atacaagtgatataattgtttc

SEQ ID NO: 7974953 - DNA, 22 bp, Homo sapiens
atacaagtgctgaccctgggat

SEQ ID NO: 7974954 - DNA, 22 bp, Homo sapiens
atacaaggtcatgaaggtttac

SEQ ID NO: 7974955 - DNA, 22 bp, Homo sapiens
atacaaggtggagtcaggaaaa

SEQ ID NO: 7974956 - DNA, 18 bp, Homo sapiens
atacaagcagcagagatt

SEQ ID NO: 7974957 - DNA, 20 bp, Homo sapiens
atacaagatgagtaatttct

SEQ ID NO: 7974958 - DNA, 20 bp, Homo sapiens
atacaagatgagtaatttct

SEQ ID NO: 7974959 - DNA, 20 bp, Homo sapiens
atacaagatgagtaatttct

SEQ ID NO: 7974960 - DNA, 22 bp, Homo sapiens
atacaagatcactccagaaaat

SEQ ID NO: 7974961 - DNA, 18 bp, Homo sapiens
atacaagatcaagtgttc

SEQ ID NO: 7974962 - DNA, 18 bp, Homo sapiens
atacaagatcaagtgttc

SEQ ID NO: 7974963 - DNA, 18 bp, Homo sapiens
atacaagatcaagtgttc

SEQ ID NO: 7974964 - DNA, 19 bp, Homo sapiens
atacaagagagcagttgag

SEQ ID NO: 7974965 - DNA, 19 bp, Homo sapiens
atacaagagagcagttgag

SEQ ID NO: 7974966 - DNA, 19 bp, Homo sapiens
atacaagagagcagttgag

SEQ ID NO: 7974967 - DNA, 22 bp, Homo sapiens
atacaagatcactccagaaaat

SEQ ID NO: 7974968 - DNA, 22 bp, Homo sapiens
atacaagatcactccagaaaat

SEQ ID NO: 7974969 - DNA, 22 bp, Homo sapiens
atacaagatcactccagaaaat

SEQ ID NO: 7974970 - DNA, 22 bp, Homo sapiens
atacaagatcactccagaaaat

SEQ ID NO: 7974971 - DNA, 22 bp, Homo sapiens
atacaagactcagcacagacgg

SEQ ID NO: 7974972 - DNA, 22 bp, Homo sapiens
atacaagactcagcacagacgg

SEQ ID NO: 7974973 - DNA, 22 bp, Homo sapiens
atacaagactcagcacagacgg

SEQ ID NO: 7974974 - DNA, 22 bp, Homo sapiens
atacaagactcagcacagacgg

SEQ ID NO: 7974975 - DNA, 22 bp, Homo sapiens
atacaagactcagcacagacgg

SEQ ID NO: 7974976 - DNA, 22 bp, Homo sapiens
atacaagactcagcacagacgg

SEQ ID NO: 7974977 - DNA, 19 bp, Homo sapiens
atacaagactagcatttac

SEQ ID NO: 7974978 - DNA, 19 bp, Homo sapiens
atacaagactagcatttac

SEQ ID NO: 7974979 - DNA, 22 bp, Homo sapiens
ctgctttaccaaactcttggat

SEQ ID NO: 7974980 - DNA, 22 bp, Homo sapiens
atacaactttatctgtaatgag

SEQ ID NO: 7974981 - DNA, 22 bp, Homo sapiens
atacaagacagtaggaaactga

SEQ ID NO: 7974982 - DNA, 19 bp, Homo sapiens
atacaagactagcatttac

SEQ ID NO: 7974983 - DNA, 19 bp, Homo sapiens
atacaagactagcatttac

SEQ ID NO: 7974984 - DNA, 19 bp, Homo sapiens
atacaagactagcatttac

SEQ ID NO: 7974985 - DNA, 19 bp, Homo sapiens
atacaagactagcatttac

SEQ ID NO: 7974986 - DNA, 22 bp, Homo sapiens
ctgctttaatgtaagatatacc

SEQ ID NO: 7974987 - DNA, 22 bp, Homo sapiens
ctgctttaatggaaagtgtttt

SEQ ID NO: 7974988 - DNA, 22 bp, Homo sapiens
ctgctttaatccctgcctggaa

SEQ ID NO: 7974989 - DNA, 22 bp, Homo sapiens
ctgctttaatgtaagatatacc

SEQ ID NO: 7974990 - DNA, 22 bp, Homo sapiens
ctgctttaatttagacaaggca

SEQ ID NO: 7974991 - DNA, 22 bp, Homo sapiens
ctgctttaatttagacaaggca

SEQ ID NO: 7974992 - DNA, 22 bp, Homo sapiens
ctgctttaatttagacaaggca

SEQ ID NO: 7974993 - DNA, 22 bp, Homo sapiens
ctgctttaacaaggctgatcag

SEQ ID NO: 7974994 - DNA, 22 bp, Homo sapiens
ctgctttaacagatgatggtgt

SEQ ID NO: 7974995 - DNA, 22 bp, Homo sapiens
ctgctttaaaactgatacatga

SEQ ID NO: 7974996 - DNA, 22 bp, Homo sapiens
ctgctttaaaactgatacatga

SEQ ID NO: 7974997 - DNA, 22 bp, Homo sapiens
ctgctttaaaaccctcagctgg

SEQ ID NO: 7974998 - DNA, 22 bp, Homo sapiens
ctgctttaagtattcaacaaag

SEQ ID NO: 7974999 - DNA, 22 bp, Homo sapiens
ctgctttaagtattcaacaaag

SEQ ID NO: 7975000 - DNA, 22 bp, Homo sapiens
ctgctttaagaatgagtgtaag

SEQ ID NO: 7975001 - DNA, 22 bp, Homo sapiens
ctgctttaaaactgatacatga

SEQ ID NO: 7975002 - DNA, 22 bp, Homo sapiens
ctgctttaactctgggaagcca

SEQ ID NO: 7975003 - DNA, 22 bp, Homo sapiens
ctgctttaactctgggaagcca

SEQ ID NO: 7975004 - DNA, 22 bp, Homo sapiens
ctgcccagaagccagatgggca

SEQ ID NO: 7975005 - DNA, 22 bp, Homo sapiens
ctgcccagaagcttagagctta

SEQ ID NO: 7975006 - DNA, 22 bp, Homo sapiens
ctgcccagaagcttagagctta

SEQ ID NO: 7975007 - DNA, 22 bp, Homo sapiens
ctgcccagaagcttagagctta

SEQ ID NO: 7975008 - DNA, 22 bp, Homo sapiens
ctgcccagaagcttagagctta

SEQ ID NO: 7975009 - DNA, 22 bp, Homo sapiens
ctgcccagaatcactcactcga

SEQ ID NO: 7975010 - DNA, 22 bp, Homo sapiens
ctgcccagaagcttagagctta

SEQ ID NO: 7975011 - DNA, 22 bp, Homo sapiens
ctgcccagaagcttagagctta

SEQ ID NO: 7975012 - DNA, 22 bp, Homo sapiens
ctgcccacttggccaccttcta

SEQ ID NO: 7975013 - DNA, 22 bp, Homo sapiens
ctgcccacttggccaccttcta

SEQ ID NO: 7975014 - DNA, 22 bp, Homo sapiens
ctgcccacttggccaccttcta

SEQ ID NO: 7975015 - DNA, 22 bp, Homo sapiens
ctgcccagaagccagatgggca

SEQ ID NO: 7975016 - DNA, 22 bp, Homo sapiens
ctgcccagaagccagatgggca

SEQ ID NO: 7975017 - DNA, 22 bp, Homo sapiens
ctgcccagaagccagatgggca

SEQ ID NO: 7975018 - DNA, 22 bp, Homo sapiens
ctgcccagaagccagatgggca

SEQ ID NO: 7975019 - DNA, 22 bp, Homo sapiens
ctgcccagaatcactcactcga

SEQ ID NO: 7975020 - DNA, 22 bp, Homo sapiens
ctgcccagaatcactcactcga

SEQ ID NO: 7975021 - DNA, 18 bp, Homo sapiens
ctgcccagagcacttgtg

SEQ ID NO: 7975022 - DNA, 22 bp, Homo sapiens
ctgcccagaatcactcactcga

SEQ ID NO: 7975023 - DNA, 22 bp, Homo sapiens
ctgctcagtaatagtcctatct

SEQ ID NO: 7975024 - DNA, 18 bp, Homo sapiens
ctgcccagagcacttgtg

SEQ ID NO: 7975025 - DNA, 22 bp, Homo sapiens
ctgctcagtcatgttggattgt

SEQ ID NO: 7975026 - DNA, 22 bp, Homo sapiens
ctgctccaagccagccctgcag

SEQ ID NO: 7975027 - DNA, 22 bp, Homo sapiens
ctgctccaagccagccctgcag

SEQ ID NO: 7975028 - DNA, 22 bp, Homo sapiens
ctgctccaagccagccctgcag

SEQ ID NO: 7975029 - DNA, 22 bp, Homo sapiens
ctgctccaagccagccctgcag

SEQ ID NO: 7975030 - DNA, 22 bp, Homo sapiens
ctgcccaccacacctgctcctg

SEQ ID NO: 7975031 - DNA, 22 bp, Homo sapiens
ctgcccaccacacctgctcctg

SEQ ID NO: 7975032 - DNA, 22 bp, Homo sapiens
ctgcccaccacacctgctcctg

SEQ ID NO: 7975033 - DNA, 22 bp, Homo sapiens
ctgcccaccgtgtgcacgtgcg

SEQ ID NO: 7975034 - DNA, 22 bp, Homo sapiens
ctgcccaccgtgtgcacgtgcg

SEQ ID NO: 7975035 - DNA, 22 bp, Homo sapiens
ctgcccaccgtgtgcacgtgcg

SEQ ID NO: 7975036 - DNA, 22 bp, Homo sapiens
ctgcccaccacacctgctcctg

SEQ ID NO: 7975037 - DNA, 20 bp, Homo sapiens
ctgcccactagaactacctg

SEQ ID NO: 7975038 - DNA, 22 bp, Homo sapiens
ctgcccactatgttgtcatggg

SEQ ID NO: 7975039 - DNA, 22 bp, Homo sapiens
ctgcccaccgtgtgcacgtgcg

SEQ ID NO: 7975040 - DNA, 20 bp, Homo sapiens
ctgcccactagaactacctg

SEQ ID NO: 7975041 - DNA, 22 bp, Homo sapiens
ctgcccacagttctctgccatg

SEQ ID NO: 7975042 - DNA, 22 bp, Homo sapiens
ctgcccacagttctctgccatg

SEQ ID NO: 7975043 - DNA, 22 bp, Homo sapiens
ataaatctattggacatgtgtg

SEQ ID NO: 7975044 - DNA, 22 bp, Homo sapiens
ataaatctattggacatgtgtg

SEQ ID NO: 7975045 - DNA, 22 bp, Homo sapiens
ataaatctattggacatgtgtg

SEQ ID NO: 7975046 - DNA, 22 bp, Homo sapiens
ctgcccacagttctctgccatg

SEQ ID NO: 7975047 - DNA, 22 bp, Homo sapiens
ataaatatcactgttgtccctc

SEQ ID NO: 7975048 - DNA, 22 bp, Homo sapiens
ataaatatcactgttgtccctc

SEQ ID NO: 7975049 - DNA, 22 bp, Homo sapiens
ataaatatcactgttgtccctc

SEQ ID NO: 7975050 - DNA, 22 bp, Homo sapiens
ataaatatcactgttgtccctc

SEQ ID NO: 7975051 - DNA, 22 bp, Homo sapiens
ataaatatcactgttgtccctc

SEQ ID NO: 7975052 - DNA, 22 bp, Homo sapiens
ataaatccaaggcggccatcat

SEQ ID NO: 7975053 - DNA, 22 bp, Homo sapiens
ataaatcagttagtgccccact

SEQ ID NO: 7975054 - DNA, 22 bp, Homo sapiens
ctgctctgctgatcagtgtctc

SEQ ID NO: 7975055 - DNA, 22 bp, Homo sapiens
ctgctctgctgatcagtgtctc

SEQ ID NO: 7975056 - DNA, 22 bp, Homo sapiens
ctgctctgctgatcagtgtctc

SEQ ID NO: 7975057 - DNA, 22 bp, Homo sapiens
ctgctctgctgatcagtgtctc

SEQ ID NO: 7975058 - DNA, 22 bp, Homo sapiens
ctgctctgctgatcagtgtctc

SEQ ID NO: 7975059 - DNA, 22 bp, Homo sapiens
ctgctctgctgatcagtgtctc

SEQ ID NO: 7975060 - DNA, 20 bp, Homo sapiens
ctgctctgctttgcaggtgg

SEQ ID NO: 7975061 - DNA, 20 bp, Homo sapiens
ctgctctgctttgcaggtgg

SEQ ID NO: 7975062 - DNA, 20 bp, Homo sapiens
ctgctctgctttgcaggtgg

SEQ ID NO: 7975063 - DNA, 20 bp, Homo sapiens
ctgctctgctttgcaggtgg

SEQ ID NO: 7975064 - DNA, 22 bp, Homo sapiens
ctgctctggcgtactcggcatc

SEQ ID NO: 7975065 - DNA, 22 bp, Homo sapiens
ctgctctgctgatcagtgtctc

SEQ ID NO: 7975066 - DNA, 22 bp, Homo sapiens
ctgctctgcagcttggactccc

SEQ ID NO: 7975067 - DNA, 22 bp, Homo sapiens
ctgctctgcagcttggactccc

SEQ ID NO: 7975068 - DNA, 22 bp, Homo sapiens
ctgctctgcagcttggactccc

SEQ ID NO: 7975069 - DNA, 22 bp, Homo sapiens
ctgctctgagtattaacggagg

SEQ ID NO: 7975070 - DNA, 22 bp, Homo sapiens
ctgctctgagtattaacggagg

SEQ ID NO: 7975071 - DNA, 22 bp, Homo sapiens
ctgctctgcaaggcacagtgat

SEQ ID NO: 7975072 - DNA, 22 bp, Homo sapiens
ctgctctgcaaggcacagtgat

SEQ ID NO: 7975073 - DNA, 22 bp, Homo sapiens
ctgctctgcaaggcacagtgat

SEQ ID NO: 7975074 - DNA, 22 bp, Homo sapiens
ctgctctgcaaggcacagtgat

SEQ ID NO: 7975075 - DNA, 22 bp, Homo sapiens
ctgctctggctgtgtacttcag

SEQ ID NO: 7975076 - DNA, 22 bp, Homo sapiens
ctgctctggggaagccagatgt

SEQ ID NO: 7975077 - DNA, 22 bp, Homo sapiens
ctgctctggggaagccagatgt

SEQ ID NO: 7975078 - DNA, 22 bp, Homo sapiens
ctgctctggggaagccagatgt

SEQ ID NO: 7975079 - DNA, 21 bp, Homo sapiens
ctgctctggggaccggctgtg

SEQ ID NO: 7975080 - DNA, 22 bp, Homo sapiens
ataatacatggttaacctcttt

SEQ ID NO: 7975081 - DNA, 22 bp, Homo sapiens
ataatacatggttaacctcttt

SEQ ID NO: 7975082 - DNA, 22 bp, Homo sapiens
ctgctctgtatatgagcaggaa

SEQ ID NO: 7975083 - DNA, 22 bp, Homo sapiens
ctgctctgtatatgagcaggaa

SEQ ID NO: 7975084 - DNA, 22 bp, Homo sapiens
ataatacatggttgatcttttc

SEQ ID NO: 7975085 - DNA, 22 bp, Homo sapiens
ataatacatggttgatcttttc

SEQ ID NO: 7975086 - DNA, 22 bp, Homo sapiens
ataatacatggttaacctcttt

SEQ ID NO: 7975087 - DNA, 22 bp, Homo sapiens
ataatacatggttgatcttttc

SEQ ID NO: 7975088 - DNA, 22 bp, Homo sapiens
ataatacatggttgatcttttc

SEQ ID NO: 7975089 - DNA, 22 bp, Homo sapiens
ataatacatggttgatcttttc

SEQ ID NO: 7975090 - DNA, 22 bp, Homo sapiens
atatatgcatgtgtacttatgt

SEQ ID NO: 7975091 - DNA, 22 bp, Homo sapiens
atatcattctgatgtatatctt

SEQ ID NO: 7975092 - DNA, 19 bp, Homo sapiens
atatatgtatacaatgtgg

SEQ ID NO: 7975093 - DNA, 22 bp, Homo sapiens
atatatgcgcaggcacccagct

SEQ ID NO: 7975094 - DNA, 22 bp, Homo sapiens
atatcattctgatgtatatctt

SEQ ID NO: 7975095 - DNA, 19 bp, Homo sapiens
atatatgtatacaatgtgg

SEQ ID NO: 7975096 - DNA, 22 bp, Homo sapiens
atatcattctgatgtatatctt

SEQ ID NO: 7975097 - DNA, 22 bp, Homo sapiens
atatgaaagtaagcatgtgtgt

SEQ ID NO: 7975098 - DNA, 22 bp, Homo sapiens
atatgaaagtaagcatgtgtgt

SEQ ID NO: 7975099 - DNA, 18 bp, Homo sapiens
atatccaataatgaacac

SEQ ID NO: 7975100 - DNA, 22 bp, Homo sapiens
atatatattgcccaggctggtt

SEQ ID NO: 7975101 - DNA, 22 bp, Homo sapiens
atatatatgctgatggctgcca

SEQ ID NO: 7975102 - DNA, 22 bp, Homo sapiens
atatatattgcccaggctggtt

SEQ ID NO: 7975103 - DNA, 22 bp, Homo sapiens
atatatcatgagtaaaacttga

SEQ ID NO: 7975104 - DNA, 22 bp, Homo sapiens
atatatctgcagtactgaagaa

SEQ ID NO: 7975105 - DNA, 22 bp, Homo sapiens
atatatctgcagtactgaagaa

SEQ ID NO: 7975106 - DNA, 22 bp, Homo sapiens
atatatctgcagtactgaagaa

SEQ ID NO: 7975107 - DNA, 22 bp, Homo sapiens
atatatcatgagtaaaacttga

SEQ ID NO: 7975108 - DNA, 22 bp, Homo sapiens
atatatcatgagtaaaacttga

SEQ ID NO: 7975109 - DNA, 22 bp, Homo sapiens
atatatcatgagtaaaacttga

SEQ ID NO: 7975110 - DNA, 22 bp, Homo sapiens
atatatcatgagtaaaacttga

SEQ ID NO: 7975111 - DNA, 22 bp, Homo sapiens
atatgacagcggattcacatat

SEQ ID NO: 7975112 - DNA, 22 bp, Homo sapiens
atatgacagcggattcacatat

SEQ ID NO: 7975113 - DNA, 22 bp, Homo sapiens
atatgacagcggattcacatat

SEQ ID NO: 7975114 - DNA, 22 bp, Homo sapiens
atatgacagaatgtgtgtgtat

SEQ ID NO: 7975115 - DNA, 22 bp, Homo sapiens
atatgacagaatgtgtgtgtat

SEQ ID NO: 7975116 - DNA, 22 bp, Homo sapiens
atatgaatttggctggaaaggt

SEQ ID NO: 7975117 - DNA, 22 bp, Homo sapiens
atatgaagaattccaatttgga

SEQ ID NO: 7975118 - DNA, 22 bp, Homo sapiens
atatgaagtcagacaaactggg

SEQ ID NO: 7975119 - DNA, 22 bp, Homo sapiens
atatgaagaattccaatttgga

SEQ ID NO: 7975120 - DNA, 22 bp, Homo sapiens
atatgattccactattgtatgg

SEQ ID NO: 7975121 - DNA, 22 bp, Homo sapiens
atatgattccactattgtatgg

SEQ ID NO: 7975122 - DNA, 22 bp, Homo sapiens
atatgattccactattgtatgg

SEQ ID NO: 7975123 - DNA, 22 bp, Homo sapiens
atatgagagaggaaagatttta

SEQ ID NO: 7975124 - DNA, 22 bp, Homo sapiens
atatgagagtaaatgccgatct

SEQ ID NO: 7975125 - DNA, 22 bp, Homo sapiens
atatgagagtaaatgccgatct

SEQ ID NO: 7975126 - DNA, 22 bp, Homo sapiens
atatgacataaaatcatttttg

SEQ ID NO: 7975127 - DNA, 22 bp, Homo sapiens
atatgacataaaatcatttttg

SEQ ID NO: 7975128 - DNA, 22 bp, Homo sapiens
atatgacataaaatcatttttg

SEQ ID NO: 7975129 - DNA, 22 bp, Homo sapiens
atatgagaattggaaaatatca

SEQ ID NO: 7975130 - DNA, 22 bp, Homo sapiens
atatgacataaaatcatttttg

SEQ ID NO: 7975131 - DNA, 22 bp, Homo sapiens
atatgacagcggattcacatat

SEQ ID NO: 7975132 - DNA, 22 bp, Homo sapiens
ctgggcaggatacttcatggga

SEQ ID NO: 7975133 - DNA, 22 bp, Homo sapiens
ctgggcaggtatacaaaaaatg

SEQ ID NO: 7975134 - DNA, 22 bp, Homo sapiens
ctgggcaggatacttcatggga

SEQ ID NO: 7975135 - DNA, 20 bp, Homo sapiens
ctgggcaggtgtttgatctc

SEQ ID NO: 7975136 - DNA, 22 bp, Homo sapiens
ctgggcaggtatacaaaaaatg

SEQ ID NO: 7975137 - DNA, 22 bp, Homo sapiens
ctgggcagtatgaatattcaaa

SEQ ID NO: 7975138 - DNA, 22 bp, Homo sapiens
ctgggcagtgcagctatagaac

SEQ ID NO: 7975139 - DNA, 22 bp, Homo sapiens
atatgattgtccttagcaaatt

SEQ ID NO: 7975140 - DNA, 22 bp, Homo sapiens
atatgattgtccttagcaaatt

SEQ ID NO: 7975141 - DNA, 22 bp, Homo sapiens
atatgattgtccttagcaaatt

SEQ ID NO: 7975142 - DNA, 22 bp, Homo sapiens
atatgattgtccttagcaaatt

SEQ ID NO: 7975143 - DNA, 22 bp, Homo sapiens
atatgcaagcacatagaatact

SEQ ID NO: 7975144 - DNA, 22 bp, Homo sapiens
atatgcaagcacatagaatact

SEQ ID NO: 7975145 - DNA, 22 bp, Homo sapiens
ctgggcaggagggctctatgga

SEQ ID NO: 7975146 - DNA, 22 bp, Homo sapiens
ctgggcaggagggctctatgga

SEQ ID NO: 7975147 - DNA, 22 bp, Homo sapiens
ctgggcaggagggctctatgga

SEQ ID NO: 7975148 - DNA, 22 bp, Homo sapiens
ctgggcagtggtggcatctttg

SEQ ID NO: 7975149 - DNA, 22 bp, Homo sapiens
ctgggcagtggtggcatctttg

SEQ ID NO: 7975150 - DNA, 22 bp, Homo sapiens
ctgggcagtggtggcccttccc

SEQ ID NO: 7975151 - DNA, 22 bp, Homo sapiens
ctgggcagtggtggcatctttg

SEQ ID NO: 7975152 - DNA, 22 bp, Homo sapiens
ctgggcagtggtggcatctttg

SEQ ID NO: 7975153 - DNA, 22 bp, Homo sapiens
ctgggcagtggtggcccttccc

SEQ ID NO: 7975154 - DNA, 22 bp, Homo sapiens
ctgggcagtggtggcccttccc

SEQ ID NO: 7975155 - DNA, 22 bp, Homo sapiens
ctgggcagtggtggcccttccc

SEQ ID NO: 7975156 - DNA, 22 bp, Homo sapiens
atatgcttacactacaagatga

SEQ ID NO: 7975157 - DNA, 22 bp, Homo sapiens
atatgctggagtacaggaaata

SEQ ID NO: 7975158 - DNA, 20 bp, Homo sapiens
atatgcttaatctcactaca

SEQ ID NO: 7975159 - DNA, 22 bp, Homo sapiens
atatgctggagtacaggaaata

SEQ ID NO: 7975160 - DNA, 22 bp, Homo sapiens
atatggcattacattgttaaat

SEQ ID NO: 7975161 - DNA, 22 bp, Homo sapiens
atatggcattacattgttaaat

SEQ ID NO: 7975162 - DNA, 22 bp, Homo sapiens
atatggcattctttttaagggt

SEQ ID NO: 7975163 - DNA, 22 bp, Homo sapiens
atatggcattttaatgtatgag

SEQ ID NO: 7975164 - DNA, 22 bp, Homo sapiens
atatggcattttaatgtatgag

SEQ ID NO: 7975165 - DNA, 22 bp, Homo sapiens
atatgttagggaacaatttgag

SEQ ID NO: 7975166 - DNA, 23 bp, Homo sapiens
atatgttgtgaaattttagtagc

SEQ ID NO: 7975167 - DNA, 22 bp, Homo sapiens
atatgttactctttcaagcaga

SEQ ID NO: 7975168 - DNA, 22 bp, Homo sapiens
atatgttactctttcaagcaga

SEQ ID NO: 7975169 - DNA, 22 bp, Homo sapiens
atatgttactctttcaagcaga

SEQ ID NO: 7975170 - DNA, 22 bp, Homo sapiens
atatgtttcagtattcaagtca

SEQ ID NO: 7975171 - DNA, 22 bp, Homo sapiens
atatgttttgtgcttcattggt

SEQ ID NO: 7975172 - DNA, 22 bp, Homo sapiens
atatgttttgtgcttcattggt

SEQ ID NO: 7975173 - DNA, 22 bp, Homo sapiens
atatgtttcagtattcaagtca

SEQ ID NO: 7975174 - DNA, 23 bp, Homo sapiens
atatgttgtgaaattttagtagc

SEQ ID NO: 7975175 - DNA, 22 bp, Homo sapiens
atatgtttcagtattcaagtca

SEQ ID NO: 7975176 - DNA, 22 bp, Homo sapiens
atatgtttcagtattcaagtca

SEQ ID NO: 7975177 - DNA, 22 bp, Homo sapiens
atatttctctcagacatggaag

SEQ ID NO: 7975178 - DNA, 22 bp, Homo sapiens
atatttctctcagacatggaag

SEQ ID NO: 7975179 - DNA, 22 bp, Homo sapiens
atatttataagcaagcaggact

SEQ ID NO: 7975180 - DNA, 22 bp, Homo sapiens
atatttagctcatttccagtgc

SEQ ID NO: 7975181 - DNA, 22 bp, Homo sapiens
atatttagctcatttccagtgc

SEQ ID NO: 7975182 - DNA, 22 bp, Homo sapiens
atatgtttttggaaagaacaca

SEQ ID NO: 7975183 - DNA, 22 bp, Homo sapiens
atatttagataaaaatgggctt

SEQ ID NO: 7975184 - DNA, 22 bp, Homo sapiens
atatgtttttcacaggtttaag

SEQ ID NO: 7975185 - DNA, 22 bp, Homo sapiens
atatttgtagtgggtaagaagt

SEQ ID NO: 7975186 - DNA, 22 bp, Homo sapiens
atatttgtaaaattctgtgtct

SEQ ID NO: 7975187 - DNA, 22 bp, Homo sapiens
atatttgtaaaattctgtgtct

SEQ ID NO: 7975188 - DNA, 22 bp, Homo sapiens
atatttgtagtgggtaagaagt

SEQ ID NO: 7975189 - DNA, 22 bp, Homo sapiens
atatttgcaggaaactagtttt

SEQ ID NO: 7975190 - DNA, 22 bp, Homo sapiens
atatttgcaggaaactagtttt

SEQ ID NO: 7975191 - DNA, 22 bp, Homo sapiens
atatttgcattttaaacaggca

SEQ ID NO: 7975192 - DNA, 22 bp, Homo sapiens
atatttgctgagaaggagggag

SEQ ID NO: 7975193 - DNA, 22 bp, Homo sapiens
atatttgcaggaaactagtttt

SEQ ID NO: 7975194 - DNA, 22 bp, Homo sapiens
atatttgagggcaatagggtgg

SEQ ID NO: 7975195 - DNA, 22 bp, Homo sapiens
atatttcttgagcacctggtat

SEQ ID NO: 7975196 - DNA, 20 bp, Homo sapiens
atatttcttaagaactttca

SEQ ID NO: 7975197 - DNA, 20 bp, Homo sapiens
atatttcttaagaactttca

SEQ ID NO: 7975198 - DNA, 22 bp, Homo sapiens
atatttctgggggtgtgtttct

SEQ ID NO: 7975199 - DNA, 20 bp, Homo sapiens
atatttcttaagaactttca

SEQ ID NO: 7975200 - DNA, 22 bp, Homo sapiens
atatttctgggggtgtgtttct

SEQ ID NO: 7975201 - DNA, 22 bp, Homo sapiens
atatttctgggggtgtgtttct

SEQ ID NO: 7975202 - DNA, 22 bp, Homo sapiens
atatttctgggggtgtgtttct

SEQ ID NO: 7975203 - DNA, 22 bp, Homo sapiens
atatttctctcagacatggaag

SEQ ID NO: 7975204 - DNA, 22 bp, Homo sapiens
atatttctctcagacatggaag

SEQ ID NO: 7975205 - DNA, 22 bp, Homo sapiens
atatgtatgtacgcacatattc

SEQ ID NO: 7975206 - DNA, 22 bp, Homo sapiens
atatgtatgtacgcacatattc

SEQ ID NO: 7975207 - DNA, 22 bp, Homo sapiens
atatgtatgtacgcacatattc

SEQ ID NO: 7975208 - DNA, 22 bp, Homo sapiens
atatgtatagccagtctttagg

SEQ ID NO: 7975209 - DNA, 22 bp, Homo sapiens
atatgtatagccagtctttagg

SEQ ID NO: 7975210 - DNA, 22 bp, Homo sapiens
atatgtactgaaactgcttttc

SEQ ID NO: 7975211 - DNA, 22 bp, Homo sapiens
atatgtatagccagtctttagg

SEQ ID NO: 7975212 - DNA, 22 bp, Homo sapiens
atatgtattttaacgtgtaagg

SEQ ID NO: 7975213 - DNA, 22 bp, Homo sapiens
atatgtattttaacgtgtaagg

SEQ ID NO: 7975214 - DNA, 22 bp, Homo sapiens
atatgtatgtacgcacatattc

SEQ ID NO: 7975215 - DNA, 22 bp, Homo sapiens
atatgggggggcgtgcagagga

SEQ ID NO: 7975216 - DNA, 22 bp, Homo sapiens
atatgggggggcgtgcagagga

SEQ ID NO: 7975217 - DNA, 22 bp, Homo sapiens
atatgggggggcgtgcagagga

SEQ ID NO: 7975218 - DNA, 22 bp, Homo sapiens
atatgggggggcgtgcagagga

SEQ ID NO: 7975219 - DNA, 22 bp, Homo sapiens
atatgggggggcgtgcagagga

SEQ ID NO: 7975220 - DNA, 22 bp, Homo sapiens
atatggtaagagtatatttact

SEQ ID NO: 7975221 - DNA, 22 bp, Homo sapiens
atatgtacacttacgttacaaa

SEQ ID NO: 7975222 - DNA, 22 bp, Homo sapiens
atatgtacacttacgttacaaa

SEQ ID NO: 7975223 - DNA, 22 bp, Homo sapiens
atatgtacacttacgttacaaa

SEQ ID NO: 7975224 - DNA, 22 bp, Homo sapiens
atatgtacacttacgttacaaa

SEQ ID NO: 7975225 - DNA, 22 bp, Homo sapiens
atatgtgtgcacatatgtattt

SEQ ID NO: 7975226 - DNA, 22 bp, Homo sapiens
atatgtgtgccatttcagcagt

SEQ ID NO: 7975227 - DNA, 22 bp, Homo sapiens
atatgtgtgtgtgagaaaagct

SEQ ID NO: 7975228 - DNA, 18 bp, Homo sapiens
atatgttaattaggtagg

SEQ ID NO: 7975229 - DNA, 22 bp, Homo sapiens
atatgtgtgatgcatggactaa

SEQ ID NO: 7975230 - DNA, 22 bp, Homo sapiens
atatgtcataattgtgtctgta

SEQ ID NO: 7975231 - DNA, 22 bp, Homo sapiens
atatgtcctcggcacataatgt

SEQ ID NO: 7975232 - DNA, 22 bp, Homo sapiens
atatgtgtacgtgcagtatata

SEQ ID NO: 7975233 - DNA, 22 bp, Homo sapiens
atatgtgaatgatatcactttg

SEQ ID NO: 7975234 - DNA, 22 bp, Homo sapiens
atatgtgaagtgggttattttg

SEQ ID NO: 7975235 - DNA, 22 bp, Homo sapiens
atatgtctctgtacaacagtct

SEQ ID NO: 7975236 - DNA, 22 bp, Homo sapiens
atatatacaactagattaaaag

SEQ ID NO: 7975237 - DNA, 22 bp, Homo sapiens
atatataatacttgctgtgggc

SEQ ID NO: 7975238 - DNA, 22 bp, Homo sapiens
atatataatacttgctgtgggc

SEQ ID NO: 7975239 - DNA, 22 bp, Homo sapiens
atatataagctgatgagccaca

SEQ ID NO: 7975240 - DNA, 22 bp, Homo sapiens
atatataagctgatgagccaca

SEQ ID NO: 7975241 - DNA, 22 bp, Homo sapiens
atatataagctgatgagccaca

SEQ ID NO: 7975242 - DNA, 22 bp, Homo sapiens
atatataagctgatgagccaca

SEQ ID NO: 7975243 - DNA, 22 bp, Homo sapiens
atatataagctgatgagccaca

SEQ ID NO: 7975244 - DNA, 22 bp, Homo sapiens
atatataacctggataaggctt

SEQ ID NO: 7975245 - DNA, 22 bp, Homo sapiens
atataatacaacctgctaagtg

SEQ ID NO: 7975246 - DNA, 22 bp, Homo sapiens
atataatacaacctgctaagtg

SEQ ID NO: 7975247 - DNA, 22 bp, Homo sapiens
atataatacaacctgctaagtg

SEQ ID NO: 7975248 - DNA, 22 bp, Homo sapiens
atatacttttcactaatggcta

SEQ ID NO: 7975249 - DNA, 22 bp, Homo sapiens
atatataacctggataaggctt

SEQ ID NO: 7975250 - DNA, 22 bp, Homo sapiens
atatacttttcactaatggcta

SEQ ID NO: 7975251 - DNA, 22 bp, Homo sapiens
atatataacctggataaggctt

SEQ ID NO: 7975252 - DNA, 22 bp, Homo sapiens
atataatacaacctgctaagtg

SEQ ID NO: 7975253 - DNA, 22 bp, Homo sapiens
atatacttggagactatcattg

SEQ ID NO: 7975254 - DNA, 22 bp, Homo sapiens
atatacttggagactatcattg

SEQ ID NO: 7975255 - DNA, 20 bp, Homo sapiens
atataataaattttggttac

SEQ ID NO: 7975256 - DNA, 20 bp, Homo sapiens
atataataaattttggttac

SEQ ID NO: 7975257 - DNA, 20 bp, Homo sapiens
atataataaattttggttac

SEQ ID NO: 7975258 - DNA, 22 bp, Homo sapiens
atataagttagtggtcatgttt

SEQ ID NO: 7975259 - DNA, 22 bp, Homo sapiens
atataagttagtggtcatgttt

SEQ ID NO: 7975260 - DNA, 22 bp, Homo sapiens
atataagtgtgtggctgttagt

SEQ ID NO: 7975261 - DNA, 22 bp, Homo sapiens
atataactcttgttcttatagt

SEQ ID NO: 7975262 - DNA, 22 bp, Homo sapiens
atataactcttgttcttatagt

SEQ ID NO: 7975263 - DNA, 22 bp, Homo sapiens
atataacatacatacagaaaag

SEQ ID NO: 7975264 - DNA, 22 bp, Homo sapiens
atataactcttgttcttatagt

SEQ ID NO: 7975265 - DNA, 22 bp, Homo sapiens
atataactcttgttcttatagt

SEQ ID NO: 7975266 - DNA, 22 bp, Homo sapiens
atataacatacatacagaaaag

SEQ ID NO: 7975267 - DNA, 22 bp, Homo sapiens
atataacatacatacagaaaag

SEQ ID NO: 7975268 - DNA, 22 bp, Homo sapiens
atataacatacatacagaaaag

SEQ ID NO: 7975269 - DNA, 22 bp, Homo sapiens
atataacatacatacagaaaag

SEQ ID NO: 7975270 - DNA, 19 bp, Homo sapiens
ctgggacaatgaaagcatc

SEQ ID NO: 7975271 - DNA, 22 bp, Homo sapiens
ctgggacaagctctgtctagct

SEQ ID NO: 7975272 - DNA, 22 bp, Homo sapiens
ctgggacaagctctgtctagct

SEQ ID NO: 7975273 - DNA, 22 bp, Homo sapiens
ctgggacacagccttacctggg

SEQ ID NO: 7975274 - DNA, 19 bp, Homo sapiens
ctgggacaatgaaagcatc

SEQ ID NO: 7975275 - DNA, 19 bp, Homo sapiens
ctgggacaatgaaagcatc

SEQ ID NO: 7975276 - DNA, 22 bp, Homo sapiens
ctgggaaggggaaggtcctctc

SEQ ID NO: 7975277 - DNA, 22 bp, Homo sapiens
ctgggaaggggaaggtcctctc

SEQ ID NO: 7975278 - DNA, 22 bp, Homo sapiens
ctgggaagtagaatcagatgag

SEQ ID NO: 7975279 - DNA, 22 bp, Homo sapiens
ctgggaaggggaaggtcctctc

SEQ ID NO: 7975280 - DNA, 22 bp, Homo sapiens
ctgggaagtagaatcagatgag

SEQ ID NO: 7975281 - DNA, 22 bp, Homo sapiens
ctgggaagtagaatcagatgag

SEQ ID NO: 7975282 - DNA, 22 bp, Homo sapiens
ctgggaatgagcaggtggctcc

SEQ ID NO: 7975283 - DNA, 22 bp, Homo sapiens
ctgggacaagctctgtctagct

SEQ ID NO: 7975284 - DNA, 22 bp, Homo sapiens
ctgggaagtggtgagggcctga

SEQ ID NO: 7975285 - DNA, 22 bp, Homo sapiens
ctgggaagtggtgagggcctga

SEQ ID NO: 7975286 - DNA, 22 bp, Homo sapiens
ctgggaagtggtgagggcctga

SEQ ID NO: 7975287 - DNA, 22 bp, Homo sapiens
ctgggaagcttcgagcaggaaa

SEQ ID NO: 7975288 - DNA, 22 bp, Homo sapiens
ctgggaagcttcgagcaggaaa

SEQ ID NO: 7975289 - DNA, 22 bp, Homo sapiens
ctgggaagcttcgagcaggaaa

SEQ ID NO: 7975290 - DNA, 22 bp, Homo sapiens
ctgggaagcttcgagcaggaaa

SEQ ID NO: 7975291 - DNA, 22 bp, Homo sapiens
ctgggaagcttcgagcaggaaa

SEQ ID NO: 7975292 - DNA, 22 bp, Homo sapiens
ctgggaagcttcgagcaggaaa

SEQ ID NO: 7975293 - DNA, 22 bp, Homo sapiens
ctgggaagccatgtttctagga

SEQ ID NO: 7975294 - DNA, 22 bp, Homo sapiens
ctgggaagggacgccagtgcct

SEQ ID NO: 7975295 - DNA, 22 bp, Homo sapiens
ctgggaagggagtcaagatact

SEQ ID NO: 7975296 - DNA, 22 bp, Homo sapiens
ctgggaagggagtcaagatact

SEQ ID NO: 7975297 - DNA, 22 bp, Homo sapiens
ctggcttctgggccagggcaga

SEQ ID NO: 7975298 - DNA, 22 bp, Homo sapiens
ctggcagcttagcactctggtt

SEQ ID NO: 7975299 - DNA, 22 bp, Homo sapiens
ctggcagctggaggctagaggc

SEQ ID NO: 7975300 - DNA, 22 bp, Homo sapiens
ctggcagctgtgtgaagaactg

SEQ ID NO: 7975301 - DNA, 22 bp, Homo sapiens
ctggcagcttagcactctggtt

SEQ ID NO: 7975302 - DNA, 22 bp, Homo sapiens
ctggcagctgcccgagatgccc

SEQ ID NO: 7975303 - DNA, 22 bp, Homo sapiens
ctggcagctgcccgagatgccc

SEQ ID NO: 7975304 - DNA, 22 bp, Homo sapiens
ctggcagctggaggctagaggc

SEQ ID NO: 7975305 - DNA, 22 bp, Homo sapiens
ctggcagctggaggctagaggc

SEQ ID NO: 7975306 - DNA, 22 bp, Homo sapiens
ctggcagctggaggctagaggc

SEQ ID NO: 7975307 - DNA, 22 bp, Homo sapiens
ctggcagctggaggctagaggc

SEQ ID NO: 7975308 - DNA, 22 bp, Homo sapiens
ctgggaagcatggtgatggtat

SEQ ID NO: 7975309 - DNA, 22 bp, Homo sapiens
ctgggaagcatggtgatggtat

SEQ ID NO: 7975310 - DNA, 22 bp, Homo sapiens
ctggcttctgggccagggcaga

SEQ ID NO: 7975311 - DNA, 23 bp, Homo sapiens
ctggcttctggggcctctgtttc

SEQ ID NO: 7975312 - DNA, 22 bp, Homo sapiens
ctggcttgaagttatgcaccag

SEQ ID NO: 7975313 - DNA, 22 bp, Homo sapiens
ctgggaagccacagggtgtggg

SEQ ID NO: 7975314 - DNA, 22 bp, Homo sapiens
ctgggaagccacagggtgtggg

SEQ ID NO: 7975315 - DNA, 22 bp, Homo sapiens
ctgggaagcatggtgatggtat

SEQ ID NO: 7975316 - DNA, 22 bp, Homo sapiens
ctgggaagcatggtgatggtat

SEQ ID NO: 7975317 - DNA, 22 bp, Homo sapiens
ctgggaagcatggtgatggtat

SEQ ID NO: 7975318 - DNA, 22 bp, Homo sapiens
atatatatgctgatggctgcca

SEQ ID NO: 7975319 - DNA, 22 bp, Homo sapiens
atatatatcgagttcatgtctc

SEQ ID NO: 7975320 - DNA, 22 bp, Homo sapiens
atatatatgctgatggctgcca

SEQ ID NO: 7975321 - DNA, 22 bp, Homo sapiens
atatatatcgagttcatgtctc

SEQ ID NO: 7975322 - DNA, 22 bp, Homo sapiens
ctgggcacctttgcagcaggct

SEQ ID NO: 7975323 - DNA, 22 bp, Homo sapiens
atatatatcgagttcatgtctc

SEQ ID NO: 7975324 - DNA, 22 bp, Homo sapiens
atatatatcgagttcatgtctc

SEQ ID NO: 7975325 - DNA, 22 bp, Homo sapiens
atatatatcgagttcatgtctc

SEQ ID NO: 7975326 - DNA, 22 bp, Homo sapiens
ctgggcacctttgcagcaggct

SEQ ID NO: 7975327 - DNA, 22 bp, Homo sapiens
ctgggcacctttgcagcaggct

SEQ ID NO: 7975328 - DNA, 20 bp, Homo sapiens
ctgggcacctgtctgcagtt

SEQ ID NO: 7975329 - DNA, 22 bp, Homo sapiens
ctgggcaccaggcatgacaggg

SEQ ID NO: 7975330 - DNA, 22 bp, Homo sapiens
ctgggcaccaggcatgacaggg

SEQ ID NO: 7975331 - DNA, 22 bp, Homo sapiens
ctgggcaccaggcatgacaggg

SEQ ID NO: 7975332 - DNA, 23 bp, Homo sapiens
ctgggcacccagtacctaggccc

SEQ ID NO: 7975333 - DNA, 23 bp, Homo sapiens
ctgggcacccagtacctaggccc

SEQ ID NO: 7975334 - DNA, 20 bp, Homo sapiens
ctgggcacctgtctgcagtt

SEQ ID NO: 7975335 - DNA, 23 bp, Homo sapiens
ctgggcacccagtacctaggccc

SEQ ID NO: 7975336 - DNA, 20 bp, Homo sapiens
ctgggcacctgtctgcagtt

SEQ ID NO: 7975337 - DNA, 20 bp, Homo sapiens
ctgggcacctgtctgcagtt

SEQ ID NO: 7975338 - DNA, 22 bp, Homo sapiens
ctgggcacagtggctcacgcct

SEQ ID NO: 7975339 - DNA, 22 bp, Homo sapiens
ctgggcacagtggctcacgcct

SEQ ID NO: 7975340 - DNA, 22 bp, Homo sapiens
ctgggcacaggggagcagagtc

SEQ ID NO: 7975341 - DNA, 22 bp, Homo sapiens
ctgggcacagtggctcacgcct

SEQ ID NO: 7975342 - DNA, 22 bp, Homo sapiens
ctgggcacattttgactagtgt

SEQ ID NO: 7975343 - DNA, 19 bp, Homo sapiens
ctgggaggtgttcagagaa

SEQ ID NO: 7975344 - DNA, 22 bp, Homo sapiens
ctgggagtactgggggatgtca

SEQ ID NO: 7975345 - DNA, 22 bp, Homo sapiens
ctgggcaatatgctgggcctgg

SEQ ID NO: 7975346 - DNA, 22 bp, Homo sapiens
ctgggcacaagtggccctggat

SEQ ID NO: 7975347 - DNA, 22 bp, Homo sapiens
ctgggcacaagtggccctggat

SEQ ID NO: 7975348 - DNA, 22 bp, Homo sapiens
ctgggcacaagtggccctggat

SEQ ID NO: 7975349 - DNA, 22 bp, Homo sapiens
ctgggcacaagtggccctggat

SEQ ID NO: 7975350 - DNA, 22 bp, Homo sapiens
ctgggcacaagtggccctggat

SEQ ID NO: 7975351 - DNA, 22 bp, Homo sapiens
ctgggcacaagtggccctggat

SEQ ID NO: 7975352 - DNA, 22 bp, Homo sapiens
ctgggcacacagtgactctgca

SEQ ID NO: 7975353 - DNA, 22 bp, Homo sapiens
ctgggcacacagtgactctgca

SEQ ID NO: 7975354 - DNA, 22 bp, Homo sapiens
ctgggcacacagtgactctgca

SEQ ID NO: 7975355 - DNA, 22 bp, Homo sapiens
ctgggcacacagtgactctgca

SEQ ID NO: 7975356 - DNA, 22 bp, Homo sapiens
ctgggcacagaccccctgggcc

SEQ ID NO: 7975357 - DNA, 22 bp, Homo sapiens
ctgggcacagaccccctgggcc

SEQ ID NO: 7975358 - DNA, 22 bp, Homo sapiens
ctgggcacagcgttgggctctt

SEQ ID NO: 7975359 - DNA, 22 bp, Homo sapiens
ctgggcacagcgttgggctctt

SEQ ID NO: 7975360 - DNA, 22 bp, Homo sapiens
ctgggcacacagtgactctgca

SEQ ID NO: 7975361 - DNA, 22 bp, Homo sapiens
ctgggcacactctgctccagct

SEQ ID NO: 7975362 - DNA, 22 bp, Homo sapiens
ctgggcacactctgctccagct

SEQ ID NO: 7975363 - DNA, 22 bp, Homo sapiens
ctgggcacactctgctccagct

SEQ ID NO: 7975364 - DNA, 22 bp, Homo sapiens
ctgggcacactctgctccagct

SEQ ID NO: 7975365 - DNA, 22 bp, Homo sapiens
ctgggcacagcgttgggctctt

SEQ ID NO: 7975366 - DNA, 22 bp, Homo sapiens
ctgggcacagcgttgggctctt

SEQ ID NO: 7975367 - DNA, 22 bp, Homo sapiens
ctgggcacaggggagcagagtc

SEQ ID NO: 7975368 - DNA, 22 bp, Homo sapiens
ctgggcacagcgttgggctctt

SEQ ID NO: 7975369 - DNA, 22 bp, Homo sapiens
ctgggcacaggggagcagagtc

SEQ ID NO: 7975370 - DNA, 22 bp, Homo sapiens
atatatatcgagttcatgtctc

SEQ ID NO: 7975371 - DNA, 22 bp, Homo sapiens
atatatatcgagttcatgtctc

SEQ ID NO: 7975372 - DNA, 22 bp, Homo sapiens
atatatagagctagatgttaaa

SEQ ID NO: 7975373 - DNA, 22 bp, Homo sapiens
atatatagagctagatgttaaa

SEQ ID NO: 7975374 - DNA, 22 bp, Homo sapiens
ctgggactttgtaggccagttg

SEQ ID NO: 7975375 - DNA, 22 bp, Homo sapiens
ctgggactttgtaggccagttg

SEQ ID NO: 7975376 - DNA, 22 bp, Homo sapiens
ctgggactttgtaggccagttg

SEQ ID NO: 7975377 - DNA, 22 bp, Homo sapiens
ctgggactttaccctgtggccc

SEQ ID NO: 7975378 - DNA, 22 bp, Homo sapiens
ctgggactttgtaggccagttg

SEQ ID NO: 7975379 - DNA, 22 bp, Homo sapiens
atatatactttgacacattctg

SEQ ID NO: 7975380 - DNA, 22 bp, Homo sapiens
atatatactttgacacattctg

SEQ ID NO: 7975381 - DNA, 22 bp, Homo sapiens
atatatagagctagatgttaaa

SEQ ID NO: 7975382 - DNA, 22 bp, Homo sapiens
atatatagagctagatgttaaa

SEQ ID NO: 7975383 - DNA, 22 bp, Homo sapiens
atatatagagctagatgttaaa

SEQ ID NO: 7975384 - DNA, 22 bp, Homo sapiens
atatatactttgacacattctg

SEQ ID NO: 7975385 - DNA, 22 bp, Homo sapiens
atatatacaactagattaaaag

SEQ ID NO: 7975386 - DNA, 22 bp, Homo sapiens
atatatacaactagattaaaag

SEQ ID NO: 7975387 - DNA, 22 bp, Homo sapiens
atatatactttgacacattctg

SEQ ID NO: 7975388 - DNA, 22 bp, Homo sapiens
atatatacaactagattaaaag

SEQ ID NO: 7975389 - DNA, 22 bp, Homo sapiens
atatatacaactagattaaaag

SEQ ID NO: 7975390 - DNA, 22 bp, Homo sapiens
atatatacaactagattaaaag

SEQ ID NO: 7975391 - DNA, 22 bp, Homo sapiens
atatatacaactagattaaaag

SEQ ID NO: 7975392 - DNA, 22 bp, Homo sapiens
ctgggagaggaacctcgagggt

SEQ ID NO: 7975393 - DNA, 22 bp, Homo sapiens
ctgggagaggaacctcgagggt

SEQ ID NO: 7975394 - DNA, 22 bp, Homo sapiens
ctgggagagcctttcctgagtc

SEQ ID NO: 7975395 - DNA, 22 bp, Homo sapiens
ctgggagaggaacctcgagggt

SEQ ID NO: 7975396 - DNA, 22 bp, Homo sapiens
ctgggagagcctttcctgagtc

SEQ ID NO: 7975397 - DNA, 22 bp, Homo sapiens
ctgggagagcctttcctgagtc

SEQ ID NO: 7975398 - DNA, 22 bp, Homo sapiens
ctgggagagaagcgaagctggg

SEQ ID NO: 7975399 - DNA, 22 bp, Homo sapiens
ctgggagagaagcgaagctggg

SEQ ID NO: 7975400 - DNA, 22 bp, Homo sapiens
ctgggagagaagcgaagctggg

SEQ ID NO: 7975401 - DNA, 22 bp, Homo sapiens
ctgggagagaagcgaagctggg

SEQ ID NO: 7975402 - DNA, 22 bp, Homo sapiens
ctgggagacaagagagggctga

SEQ ID NO: 7975403 - DNA, 22 bp, Homo sapiens
ctgggagacaagagagggctga

SEQ ID NO: 7975404 - DNA, 22 bp, Homo sapiens
ctgggagacgcagctggggatc

SEQ ID NO: 7975405 - DNA, 22 bp, Homo sapiens
ctgggagacgcagctggggatc

SEQ ID NO: 7975406 - DNA, 22 bp, Homo sapiens
ctgggagacaagagagggctga

SEQ ID NO: 7975407 - DNA, 22 bp, Homo sapiens
ctgggagacgcagctggggatc

SEQ ID NO: 7975408 - DNA, 22 bp, Homo sapiens
ctgggagacgcagctggggatc

SEQ ID NO: 7975409 - DNA, 22 bp, Homo sapiens
ctgggagacgcagctggggatc

SEQ ID NO: 7975410 - DNA, 22 bp, Homo sapiens
ctgggagacgcagctggggatc

SEQ ID NO: 7975411 - DNA, 22 bp, Homo sapiens
ctgggagacaagagagggctga

SEQ ID NO: 7975412 - DNA, 22 bp, Homo sapiens
ctgggagacaagagagggctga

SEQ ID NO: 7975413 - DNA, 22 bp, Homo sapiens
ctgggagaatttgttgaaggat

SEQ ID NO: 7975414 - DNA, 22 bp, Homo sapiens
ctgggagaatttgttgaaggat

SEQ ID NO: 7975415 - DNA, 22 bp, Homo sapiens
ctgggagaatttgttgaaggat

SEQ ID NO: 7975416 - DNA, 22 bp, Homo sapiens
ctgggagaatttgttgaaggat

SEQ ID NO: 7975417 - DNA, 22 bp, Homo sapiens
ctgggagaatttgttgaaggat

SEQ ID NO: 7975418 - DNA, 22 bp, Homo sapiens
ctgggagacaagagagggctga

SEQ ID NO: 7975419 - DNA, 22 bp, Homo sapiens
ctgtctttggtcctgtctgtta

SEQ ID NO: 7975420 - DNA, 22 bp, Homo sapiens
ctgtctttggtcctgtctgtta

SEQ ID NO: 7975421 - DNA, 22 bp, Homo sapiens
ctgtcttctcctttgtttcagg

SEQ ID NO: 7975422 - DNA, 22 bp, Homo sapiens
ctgtcttctcctttgtttcagg

SEQ ID NO: 7975423 - DNA, 22 bp, Homo sapiens
ctgtcttctcctttgtttcagg

SEQ ID NO: 7975424 - DNA, 20 bp, Homo sapiens
ctgtcttgtgggcttcccct

SEQ ID NO: 7975425 - DNA, 22 bp, Homo sapiens
ctgtctgttttgtatacaggcc

SEQ ID NO: 7975426 - DNA, 22 bp, Homo sapiens
ctgtctgttttaccttctccag

SEQ ID NO: 7975427 - DNA, 22 bp, Homo sapiens
ctgtctgttttgtatacaggcc

SEQ ID NO: 7975428 - DNA, 22 bp, Homo sapiens
ctgtctgttttgtatacaggcc

SEQ ID NO: 7975429 - DNA, 22 bp, Homo sapiens
ctgtcttcccgaggccctggag

SEQ ID NO: 7975430 - DNA, 22 bp, Homo sapiens
ctgtcttctaccttcaacctcc

SEQ ID NO: 7975431 - DNA, 19 bp, Homo sapiens
atcacatgtcaagagcagg

SEQ ID NO: 7975432 - DNA, 19 bp, Homo sapiens
atcacatgtcaagagcagg

SEQ ID NO: 7975433 - DNA, 19 bp, Homo sapiens
atcacatgtcaagagcagg

SEQ ID NO: 7975434 - DNA, 19 bp, Homo sapiens
atcacatgtcaagagcagg

SEQ ID NO: 7975435 - DNA, 22 bp, Homo sapiens
atcacattatgtagtgaaaagg

SEQ ID NO: 7975436 - DNA, 22 bp, Homo sapiens
atcacattatgtagtgaaaagg

SEQ ID NO: 7975437 - DNA, 22 bp, Homo sapiens
ctgtctgttttaccttctccag

SEQ ID NO: 7975438 - DNA, 22 bp, Homo sapiens
ctgtctctgttgcctgtaggtg

SEQ ID NO: 7975439 - DNA, 22 bp, Homo sapiens
ctgtctctgttgcctgtaggtg

SEQ ID NO: 7975440 - DNA, 22 bp, Homo sapiens
ctgtctgtttctgattcaacct

SEQ ID NO: 7975441 - DNA, 22 bp, Homo sapiens
ctgtctctgttgcctgtaggtg

SEQ ID NO: 7975442 - DNA, 22 bp, Homo sapiens
ctgtcttttactatcatttact

SEQ ID NO: 7975443 - DNA, 22 bp, Homo sapiens
ctgtcttttactatcatttact

SEQ ID NO: 7975444 - DNA, 22 bp, Homo sapiens
ctgtctttggtcctgtctgtta

SEQ ID NO: 7975445 - DNA, 22 bp, Homo sapiens
ctgtcttttactatcatttact

SEQ ID NO: 7975446 - DNA, 22 bp, Homo sapiens
ctgtcttttcatactttccctc

SEQ ID NO: 7975447 - DNA, 22 bp, Homo sapiens
ctgtcttttcatactttccctc

SEQ ID NO: 7975448 - DNA, 22 bp, Homo sapiens
ctgtcttttcatactttccctc

SEQ ID NO: 7975449 - DNA, 22 bp, Homo sapiens
ctgtcttttcttctcattgatg

SEQ ID NO: 7975450 - DNA, 22 bp, Homo sapiens
ctgtcttttcttctcattgatg

SEQ ID NO: 7975451 - DNA, 22 bp, Homo sapiens
ctgtcttttcttctcattgatg

SEQ ID NO: 7975452 - DNA, 18 bp, Homo sapiens
ctgtcttttttctctcca

SEQ ID NO: 7975453 - DNA, 18 bp, Homo sapiens
ctgtcttttttctctcca

SEQ ID NO: 7975454 - DNA, 18 bp, Homo sapiens
ctgtcttttttctctcca

SEQ ID NO: 7975455 - DNA, 18 bp, Homo sapiens
ctgtcttttttctctcca

SEQ ID NO: 7975456 - DNA, 22 bp, Homo sapiens
ctgtctttttagagagtaggat

SEQ ID NO: 7975457 - DNA, 18 bp, Homo sapiens
ctgtcttttttctctcca

SEQ ID NO: 7975458 - DNA, 22 bp, Homo sapiens
ctgtcttttcttctcattgatg

SEQ ID NO: 7975459 - DNA, 22 bp, Homo sapiens
ctgtgagttcattgtgccacct

SEQ ID NO: 7975460 - DNA, 22 bp, Homo sapiens
ctgtgatatactcccaagagga

SEQ ID NO: 7975461 - DNA, 22 bp, Homo sapiens
ctgtgataggtcatactgtctc

SEQ ID NO: 7975462 - DNA, 22 bp, Homo sapiens
ctgtgatcattcttgatttaag

SEQ ID NO: 7975463 - DNA, 22 bp, Homo sapiens
ctgtgatcattcttgatttaag

SEQ ID NO: 7975464 - DNA, 22 bp, Homo sapiens
ctgtgagttcattgtgccacct

SEQ ID NO: 7975465 - DNA, 22 bp, Homo sapiens
ctgtgagtgaccctggtcagca

SEQ ID NO: 7975466 - DNA, 22 bp, Homo sapiens
ctgtgagtgagatggccacagg

SEQ ID NO: 7975467 - DNA, 18 bp, Homo sapiens
ctgtcttttttctctcca

SEQ ID NO: 7975468 - DNA, 22 bp, Homo sapiens
ctgtgcaagcccaagataaaac

SEQ ID NO: 7975469 - DNA, 22 bp, Homo sapiens
ctgtgcaaggcccatgctcaga

SEQ ID NO: 7975470 - DNA, 22 bp, Homo sapiens
ctgtgcaatattataaaggcca

SEQ ID NO: 7975471 - DNA, 22 bp, Homo sapiens
ctgtgcaaggcccatgctcaga

SEQ ID NO: 7975472 - DNA, 22 bp, Homo sapiens
ctgtgatttctaaagagtagca

SEQ ID NO: 7975473 - DNA, 22 bp, Homo sapiens
ctgtgatgttagctctgtgtta

SEQ ID NO: 7975474 - DNA, 21 bp, Homo sapiens
ctgtgatgttgccggggtagg

SEQ ID NO: 7975475 - DNA, 22 bp, Homo sapiens
ctgtgattgttagttcctatac

SEQ ID NO: 7975476 - DNA, 22 bp, Homo sapiens
ctgtgatgttagctctgtgtta

SEQ ID NO: 7975477 - DNA, 19 bp, Homo sapiens
ctgtgcaggccgggctgag

SEQ ID NO: 7975478 - DNA, 19 bp, Homo sapiens
ctgtgcaggccgggctgag

SEQ ID NO: 7975479 - DNA, 22 bp, Homo sapiens
atcatcatcattgctaacatct

SEQ ID NO: 7975480 - DNA, 22 bp, Homo sapiens
atcatcatctaaattgtgtcgc

SEQ ID NO: 7975481 - DNA, 22 bp, Homo sapiens
ctgtgcagcttggcttcaggcc

SEQ ID NO: 7975482 - DNA, 22 bp, Homo sapiens
ctgtgcagcttggcttcaggcc

SEQ ID NO: 7975483 - DNA, 22 bp, Homo sapiens
ctgtgcagcttggcttcaggcc

SEQ ID NO: 7975484 - DNA, 19 bp, Homo sapiens
ctgtgcaggccgggctgag

SEQ ID NO: 7975485 - DNA, 22 bp, Homo sapiens
ctgtgcagctggcttcctggaa

SEQ ID NO: 7975486 - DNA, 22 bp, Homo sapiens
ctgtgcacttctctttatttgt

SEQ ID NO: 7975487 - DNA, 22 bp, Homo sapiens
ctgtgcacttctctttatttgt

SEQ ID NO: 7975488 - DNA, 18 bp, Homo sapiens
ctgtgcagcaaactgagc

SEQ ID NO: 7975489 - DNA, 18 bp, Homo sapiens
ctgtgcagcaaactgagc

SEQ ID NO: 7975490 - DNA, 18 bp, Homo sapiens
ctgtgcagcaaactgagc

SEQ ID NO: 7975491 - DNA, 22 bp, Homo sapiens
ctgtgcaatattataaaggcca

SEQ ID NO: 7975492 - DNA, 22 bp, Homo sapiens
ctgtgcaatgcctaatcacaaa

SEQ ID NO: 7975493 - DNA, 22 bp, Homo sapiens
ctgtgcacacgtgcccaacagt

SEQ ID NO: 7975494 - DNA, 22 bp, Homo sapiens
ctgtgcactaaccacacccacg

SEQ ID NO: 7975495 - DNA, 22 bp, Homo sapiens
atcatgttaaatatttcaatct

SEQ ID NO: 7975496 - DNA, 22 bp, Homo sapiens
atcatgttcatcgtatttaggc

SEQ ID NO: 7975497 - DNA, 22 bp, Homo sapiens
atcatgttcatcgtatttaggc

SEQ ID NO: 7975498 - DNA, 22 bp, Homo sapiens
atcatgttcatcgtatttaggc

SEQ ID NO: 7975499 - DNA, 22 bp, Homo sapiens
atcatgttcatcgtatttaggc

SEQ ID NO: 7975500 - DNA, 22 bp, Homo sapiens
atcatgtacttgacaaatatgt

SEQ ID NO: 7975501 - DNA, 22 bp, Homo sapiens
atcatgtacttgacaaatatgt

SEQ ID NO: 7975502 - DNA, 22 bp, Homo sapiens
atcatgtaccctaaaaatggaa

SEQ ID NO: 7975503 - DNA, 22 bp, Homo sapiens
atcatgctgacacagtttatct

SEQ ID NO: 7975504 - DNA, 22 bp, Homo sapiens
atcatggaagcctatcttgaga

SEQ ID NO: 7975505 - DNA, 22 bp, Homo sapiens
atcatgaatcttgtgttctatg

SEQ ID NO: 7975506 - DNA, 22 bp, Homo sapiens
atcatgacagagtctgccatcc

SEQ ID NO: 7975507 - DNA, 22 bp, Homo sapiens
atcatgaatcttgtgttctatg

SEQ ID NO: 7975508 - DNA, 22 bp, Homo sapiens
atcatgacagagtctgccatcc

SEQ ID NO: 7975509 - DNA, 22 bp, Homo sapiens
atcatgacatacttttgagaag

SEQ ID NO: 7975510 - DNA, 22 bp, Homo sapiens
atcatgacatctgagtttaagt

SEQ ID NO: 7975511 - DNA, 22 bp, Homo sapiens
atcatcatgcccacttgagact

SEQ ID NO: 7975512 - DNA, 22 bp, Homo sapiens
atcatcatgcactctcaggttt

SEQ ID NO: 7975513 - DNA, 22 bp, Homo sapiens
atcatgcagagtctgggcttca

SEQ ID NO: 7975514 - DNA, 22 bp, Homo sapiens
atcatgcaataaggtgaggcct

SEQ ID NO: 7975515 - DNA, 22 bp, Homo sapiens
atcatgcaataaggtgaggcct

SEQ ID NO: 7975516 - DNA, 22 bp, Homo sapiens
atcatgcagcaacaagcaaggc

SEQ ID NO: 7975517 - DNA, 22 bp, Homo sapiens
atcatgcagagtctgggcttca

SEQ ID NO: 7975518 - DNA, 22 bp, Homo sapiens
atcatgcagcaacaagcaaggc

SEQ ID NO: 7975519 - DNA, 22 bp, Homo sapiens
atcatgcaggtttctcctttct

SEQ ID NO: 7975520 - DNA, 22 bp, Homo sapiens
atcatgcagctaatccaattca

SEQ ID NO: 7975521 - DNA, 22 bp, Homo sapiens
atcatgcatggtactcttgtgc

SEQ ID NO: 7975522 - DNA, 22 bp, Homo sapiens
atcatgcattgtattgagttga

SEQ ID NO: 7975523 - DNA, 18 bp, Homo sapiens
atcatgctgaattaaaga

SEQ ID NO: 7975524 - DNA, 22 bp, Homo sapiens
atatttgtcaattcactgttca

SEQ ID NO: 7975525 - DNA, 22 bp, Homo sapiens
atatttgtatttcgtgtgtgta

SEQ ID NO: 7975526 - DNA, 22 bp, Homo sapiens
atatttgtatttcgtgtgtgta

SEQ ID NO: 7975527 - DNA, 22 bp, Homo sapiens
atatttgtcatctgccttagtt

SEQ ID NO: 7975528 - DNA, 22 bp, Homo sapiens
atatttgtggtaaaggtaagaa

SEQ ID NO: 7975529 - DNA, 22 bp, Homo sapiens
atatttgttagagtctatgtgt

SEQ ID NO: 7975530 - DNA, 22 bp, Homo sapiens
atatttgttagagtctatgtgt

SEQ ID NO: 7975531 - DNA, 22 bp, Homo sapiens
ctgggtagaagattcctcagga

SEQ ID NO: 7975532 - DNA, 22 bp, Homo sapiens
ctgggtagggcaaggaactggc

SEQ ID NO: 7975533 - DNA, 22 bp, Homo sapiens
ctgggtagctgctgctccttca

SEQ ID NO: 7975534 - DNA, 22 bp, Homo sapiens
ctgggtcaaggaatgctggtgg

SEQ ID NO: 7975535 - DNA, 22 bp, Homo sapiens
ctgggtcaaggaatgctggtgg

SEQ ID NO: 7975536 - DNA, 22 bp, Homo sapiens
ctgggtcaaggaatgctggtgg

SEQ ID NO: 7975537 - DNA, 22 bp, Homo sapiens
atatttgtggtttttggctcct

SEQ ID NO: 7975538 - DNA, 22 bp, Homo sapiens
ctgggtcacccaaaagggccag

SEQ ID NO: 7975539 - DNA, 22 bp, Homo sapiens
ctgggtcaaggaatgctggtgg

SEQ ID NO: 7975540 - DNA, 22 bp, Homo sapiens
ctgggtagggtgatatcccaca

SEQ ID NO: 7975541 - DNA, 22 bp, Homo sapiens
ctgggtagggcaaggaactggc

SEQ ID NO: 7975542 - DNA, 20 bp, Homo sapiens
ctgggtcacttggctgctct

SEQ ID NO: 7975543 - DNA, 20 bp, Homo sapiens
ctgggtcacttggctgctct

SEQ ID NO: 7975544 - DNA, 20 bp, Homo sapiens
ctgggtcacttggctgctct

SEQ ID NO: 7975545 - DNA, 22 bp, Homo sapiens
ctgggtcaggagcggctgcccg

SEQ ID NO: 7975546 - DNA, 20 bp, Homo sapiens
ctgggtcacttggctgctct

SEQ ID NO: 7975547 - DNA, 22 bp, Homo sapiens
ctgggtcacccaaaagggccag

SEQ ID NO: 7975548 - DNA, 20 bp, Homo sapiens
ctgggtcacttggctgctct

SEQ ID NO: 7975549 - DNA, 22 bp, Homo sapiens
ctgggtcagtggcaagctgggt

SEQ ID NO: 7975550 - DNA, 22 bp, Homo sapiens
ctgggtcataaacaatgcgtgt

SEQ ID NO: 7975551 - DNA, 22 bp, Homo sapiens
ctgggtcagtggcaagctgggt

SEQ ID NO: 7975552 - DNA, 22 bp, Homo sapiens
ctgggtcagtctgtccctaggg

SEQ ID NO: 7975553 - DNA, 22 bp, Homo sapiens
ctgggtcaggagcggctgcccg

SEQ ID NO: 7975554 - DNA, 22 bp, Homo sapiens
ctgggtcccacagcctgctggg

SEQ ID NO: 7975555 - DNA, 22 bp, Homo sapiens
ctgggtcccacagcctgctggg

SEQ ID NO: 7975556 - DNA, 22 bp, Homo sapiens
ctgggtcccacagcctgctggg

SEQ ID NO: 7975557 - DNA, 22 bp, Homo sapiens
ctgggtcccacagcctgctggg

SEQ ID NO: 7975558 - DNA, 22 bp, Homo sapiens
ctgggtcccacagcctgctggg

SEQ ID NO: 7975559 - DNA, 22 bp, Homo sapiens
ctgtccagtcagaacgtcatta

SEQ ID NO: 7975560 - DNA, 22 bp, Homo sapiens
ctgtccagtctttagcaagctg

SEQ ID NO: 7975561 - DNA, 22 bp, Homo sapiens
ctgtccagtctttagcaagctg

SEQ ID NO: 7975562 - DNA, 22 bp, Homo sapiens
ctgtccagtgactttgggccat

SEQ ID NO: 7975563 - DNA, 22 bp, Homo sapiens
ctgtccagtctttagcaagctg

SEQ ID NO: 7975564 - DNA, 18 bp, Homo sapiens
ctgggtctccaggctgcc

SEQ ID NO: 7975565 - DNA, 22 bp, Homo sapiens
ctgtccagtcagaacgtcatta

SEQ ID NO: 7975566 - DNA, 18 bp, Homo sapiens
ctgggtctccaggctgcc

SEQ ID NO: 7975567 - DNA, 18 bp, Homo sapiens
ctgggtctccaggctgcc

SEQ ID NO: 7975568 - DNA, 22 bp, Homo sapiens
ctgtcccttcccaagcccagcc

SEQ ID NO: 7975569 - DNA, 22 bp, Homo sapiens
ctgtccagtgactttgggccat

SEQ ID NO: 7975570 - DNA, 22 bp, Homo sapiens
ctgtcccttcattattcactac

SEQ ID NO: 7975571 - DNA, 22 bp, Homo sapiens
ctgtcctcaacccatccttctc

SEQ ID NO: 7975572 - DNA, 22 bp, Homo sapiens
ctgggtcccctcagtgacactg

SEQ ID NO: 7975573 - DNA, 22 bp, Homo sapiens
ctgggtcccacagcctgctggg

SEQ ID NO: 7975574 - DNA, 22 bp, Homo sapiens
ctgggtcccggcttctatccac

SEQ ID NO: 7975575 - DNA, 22 bp, Homo sapiens
ctgggtcccctcagtgacactg

SEQ ID NO: 7975576 - DNA, 22 bp, Homo sapiens
ctgggtcccctcagtgacactg

SEQ ID NO: 7975577 - DNA, 22 bp, Homo sapiens
ctgggtctcaggagttctgagg

SEQ ID NO: 7975578 - DNA, 18 bp, Homo sapiens
ctgggtctccaggctgcc

SEQ ID NO: 7975579 - DNA, 22 bp, Homo sapiens
ctgggtctcaggagttctgagg

SEQ ID NO: 7975580 - DNA, 22 bp, Homo sapiens
ctgggtctaaaaattctcagat

SEQ ID NO: 7975581 - DNA, 22 bp, Homo sapiens
ctgggtctaaaaattctcagat

SEQ ID NO: 7975582 - DNA, 22 bp, Homo sapiens
ctgggtcctgctctccctaaga

SEQ ID NO: 7975583 - DNA, 22 bp, Homo sapiens
ctgggtcctggtgctgagttct

SEQ ID NO: 7975584 - DNA, 22 bp, Homo sapiens
atcacagttactcaaataatga

SEQ ID NO: 7975585 - DNA, 22 bp, Homo sapiens
atcacagttactcaaataatga

SEQ ID NO: 7975586 - DNA, 22 bp, Homo sapiens
atcacagttactcaaataatga

SEQ ID NO: 7975587 - DNA, 22 bp, Homo sapiens
atcacagtggctacctctggat

SEQ ID NO: 7975588 - DNA, 22 bp, Homo sapiens
atcacagtgtagaccttttaaa

SEQ ID NO: 7975589 - DNA, 22 bp, Homo sapiens
atcacagtgccttcgtaaattt

SEQ ID NO: 7975590 - DNA, 22 bp, Homo sapiens
atcacagtggctacctctggat

SEQ ID NO: 7975591 - DNA, 22 bp, Homo sapiens
atcacagtgtagaccttttaaa

SEQ ID NO: 7975592 - DNA, 22 bp, Homo sapiens
atcacagtgccttcgtaaattt

SEQ ID NO: 7975593 - DNA, 22 bp, Homo sapiens
atcacagtctttttcttaagta

SEQ ID NO: 7975594 - DNA, 22 bp, Homo sapiens
atcacagtctttttcttaagta

SEQ ID NO: 7975595 - DNA, 22 bp, Homo sapiens
atcacagtgctaggctgaggga

SEQ ID NO: 7975596 - DNA, 22 bp, Homo sapiens
atcacagtggcagggatttggg

SEQ ID NO: 7975597 - DNA, 22 bp, Homo sapiens
atcacaggtggtaggaaaagaa

SEQ ID NO: 7975598 - DNA, 22 bp, Homo sapiens
atcacagggtgaggattagacc

SEQ ID NO: 7975599 - DNA, 22 bp, Homo sapiens
atcacaggctatgtgggttttg

SEQ ID NO: 7975600 - DNA, 22 bp, Homo sapiens
atcacatcacaggttgagctag

SEQ ID NO: 7975601 - DNA, 22 bp, Homo sapiens
atcacatatttaagaaacatgt

SEQ ID NO: 7975602 - DNA, 22 bp, Homo sapiens
atcacatctcaccactgcaacc

SEQ ID NO: 7975603 - DNA, 22 bp, Homo sapiens
atcacatctcaccactgcaacc

SEQ ID NO: 7975604 - DNA, 22 bp, Homo sapiens
atcacatcgaggagcaatcaga

SEQ ID NO: 7975605 - DNA, 22 bp, Homo sapiens
atcacatggaatgattttagac

SEQ ID NO: 7975606 - DNA, 22 bp, Homo sapiens
atcacagttttgtgccttgtgg

SEQ ID NO: 7975607 - DNA, 22 bp, Homo sapiens
atcacagtttacaaacctgctg

SEQ ID NO: 7975608 - DNA, 22 bp, Homo sapiens
atcacagtgtagaccttttaaa

SEQ ID NO: 7975609 - DNA, 22 bp, Homo sapiens
atcacagtttacaaacctgctg

SEQ ID NO: 7975610 - DNA, 22 bp, Homo sapiens
atcacatatttaagaaacatgt

SEQ ID NO: 7975611 - DNA, 22 bp, Homo sapiens
atcacatatatgcaccaagaca

SEQ ID NO: 7975612 - DNA, 22 bp, Homo sapiens
atcacatatatgcaccaagaca

SEQ ID NO: 7975613 - DNA, 22 bp, Homo sapiens
atcacatatatgcaccaagaca

SEQ ID NO: 7975614 - DNA, 22 bp, Homo sapiens
atcacagttttaccatttggta

SEQ ID NO: 7975615 - DNA, 22 bp, Homo sapiens
atcacagttttgtgccttgtgg

SEQ ID NO: 7975616 - DNA, 22 bp, Homo sapiens
atcacagttttgtgccttgtgg

SEQ ID NO: 7975617 - DNA, 22 bp, Homo sapiens
ctgtcctcaccttggcaggggg

SEQ ID NO: 7975618 - DNA, 22 bp, Homo sapiens
ctgtcctcaccttggcaggggg

SEQ ID NO: 7975619 - DNA, 22 bp, Homo sapiens
ctgtcctcaccttggcaggggg

SEQ ID NO: 7975620 - DNA, 22 bp, Homo sapiens
ctgtcctcaacccatccttctc

SEQ ID NO: 7975621 - DNA, 22 bp, Homo sapiens
ctgtcctcaacccatccttctc

SEQ ID NO: 7975622 - DNA, 22 bp, Homo sapiens
ctgtcctcaacccatccttctc

SEQ ID NO: 7975623 - DNA, 22 bp, Homo sapiens
ctgtcctcatctgccccaaggg

SEQ ID NO: 7975624 - DNA, 22 bp, Homo sapiens
ctgtcctcatctgccccaaggg

SEQ ID NO: 7975625 - DNA, 22 bp, Homo sapiens
ctgtcctccagacgacagtccc

SEQ ID NO: 7975626 - DNA, 22 bp, Homo sapiens
ctgtcctctgtcctcagcagga

SEQ ID NO: 7975627 - DNA, 22 bp, Homo sapiens
ctgtcctctgtcctcagcagga

SEQ ID NO: 7975628 - DNA, 22 bp, Homo sapiens
ctgtcctctgtcctcagcagga

SEQ ID NO: 7975629 - DNA, 22 bp, Homo sapiens
atcattctagtccttatggtct

SEQ ID NO: 7975630 - DNA, 22 bp, Homo sapiens
atcattctagctgttgtgttga

SEQ ID NO: 7975631 - DNA, 22 bp, Homo sapiens
ctgtggagtggggagtactggt

SEQ ID NO: 7975632 - DNA, 22 bp, Homo sapiens
ctgtggagtggggagtactggt

SEQ ID NO: 7975633 - DNA, 22 bp, Homo sapiens
ctgtggagtgcttggctcagtg

SEQ ID NO: 7975634 - DNA, 22 bp, Homo sapiens
ctgtggagtgcttggctcagtg

SEQ ID NO: 7975635 - DNA, 22 bp, Homo sapiens
ctgtggagtgcttggctcagtg

SEQ ID NO: 7975636 - DNA, 22 bp, Homo sapiens
ctgtggagtcctggggaatgga

SEQ ID NO: 7975637 - DNA, 22 bp, Homo sapiens
ctgtggagtcctggggaatgga

SEQ ID NO: 7975638 - DNA, 22 bp, Homo sapiens
ctgtggagtgcttggctcagtg

SEQ ID NO: 7975639 - DNA, 22 bp, Homo sapiens
ctgtggagtgcttggctcagtg

SEQ ID NO: 7975640 - DNA, 22 bp, Homo sapiens
ctgtggagcttgtggcagtggg

SEQ ID NO: 7975641 - DNA, 22 bp, Homo sapiens
ctgtggaggtaggagcaggaca

SEQ ID NO: 7975642 - DNA, 22 bp, Homo sapiens
ctgtggagtcctggggaatgga

SEQ ID NO: 7975643 - DNA, 22 bp, Homo sapiens
ctgtggagtcctggggaatgga

SEQ ID NO: 7975644 - DNA, 22 bp, Homo sapiens
ctgtggagtcctggggaatgga

SEQ ID NO: 7975645 - DNA, 22 bp, Homo sapiens
ctgtggagtcctggggaatgga

SEQ ID NO: 7975646 - DNA, 22 bp, Homo sapiens
ctgtggagtcctggggaatgga

SEQ ID NO: 7975647 - DNA, 22 bp, Homo sapiens
ctgtggagcttgtggcagtggg

SEQ ID NO: 7975648 - DNA, 22 bp, Homo sapiens
ctgtggagcttgtggcagtggg

SEQ ID NO: 7975649 - DNA, 22 bp, Homo sapiens
ctgtggagcttgtggcagtggg

SEQ ID NO: 7975650 - DNA, 22 bp, Homo sapiens
ctgtggagcttgtggcagtggg

SEQ ID NO: 7975651 - DNA, 22 bp, Homo sapiens
atcatgttgctcaaaattaaac

SEQ ID NO: 7975652 - DNA, 22 bp, Homo sapiens
atcatgttccagaaacagtgat

SEQ ID NO: 7975653 - DNA, 22 bp, Homo sapiens
atcatgttccagaaacagtgat

SEQ ID NO: 7975654 - DNA, 22 bp, Homo sapiens
atcatgttggctctgacaaaaa

SEQ ID NO: 7975655 - DNA, 22 bp, Homo sapiens
atcatgttggctctgacaaaaa

SEQ ID NO: 7975656 - DNA, 22 bp, Homo sapiens
atcatgttgctcaaaattaaac

SEQ ID NO: 7975657 - DNA, 22 bp, Homo sapiens
atcatgttgtatgtaatctttt

SEQ ID NO: 7975658 - DNA, 22 bp, Homo sapiens
atcatgttgtatgtaatctttt

SEQ ID NO: 7975659 - DNA, 22 bp, Homo sapiens
atcatgttgtatgtaatctttt

SEQ ID NO: 7975660 - DNA, 22 bp, Homo sapiens
atcatgttttaattagcaaact

SEQ ID NO: 7975661 - DNA, 22 bp, Homo sapiens
atcatgtttagttttaagggct

SEQ ID NO: 7975662 - DNA, 22 bp, Homo sapiens
atcatgttttaattagcaaact

SEQ ID NO: 7975663 - DNA, 22 bp, Homo sapiens
ctgtggagcttgtggcagtggg

SEQ ID NO: 7975664 - DNA, 22 bp, Homo sapiens
ctgtggagcttgtggcagtggg

SEQ ID NO: 7975665 - DNA, 23 bp, Homo sapiens
ctgtggagccctttgttgggaga

SEQ ID NO: 7975666 - DNA, 22 bp, Homo sapiens
ctgtggagcagggcagggtcac

SEQ ID NO: 7975667 - DNA, 22 bp, Homo sapiens
ctgtggagcagggcagggtcac

SEQ ID NO: 7975668 - DNA, 22 bp, Homo sapiens
ctgtggagcagggcagggtcac

SEQ ID NO: 7975669 - DNA, 22 bp, Homo sapiens
atcattaaatataagcttcaca

SEQ ID NO: 7975670 - DNA, 22 bp, Homo sapiens
ctgtggagatgcagaccaggcc

SEQ ID NO: 7975671 - DNA, 18 bp, Homo sapiens
atccaaaaagatggaagt

SEQ ID NO: 7975672 - DNA, 22 bp, Homo sapiens
atccaaaaccagtgcattttcc

SEQ ID NO: 7975673 - DNA, 18 bp, Homo sapiens
atccaaaaagatggaagt

SEQ ID NO: 7975674 - DNA, 18 bp, Homo sapiens
atccaaaaagatggaagt

SEQ ID NO: 7975675 - DNA, 22 bp, Homo sapiens
atcatttttaagagactcttct

SEQ ID NO: 7975676 - DNA, 22 bp, Homo sapiens
atcatttttaagagactcttct

SEQ ID NO: 7975677 - DNA, 22 bp, Homo sapiens
atcatttttaagagactcttct

SEQ ID NO: 7975678 - DNA, 22 bp, Homo sapiens
atccaaaatttactgtagcatt

SEQ ID NO: 7975679 - DNA, 22 bp, Homo sapiens
atccaaaatttactgtagcatt

SEQ ID NO: 7975680 - DNA, 22 bp, Homo sapiens
atccaaaaccagtgcattttcc

SEQ ID NO: 7975681 - DNA, 22 bp, Homo sapiens
atccaaaatttactgtagcatt

SEQ ID NO: 7975682 - DNA, 22 bp, Homo sapiens
atccaaacctggacatgagtgg

SEQ ID NO: 7975683 - DNA, 22 bp, Homo sapiens
atccaaaatttactgtagcatt

SEQ ID NO: 7975684 - DNA, 22 bp, Homo sapiens
atccaaacatgtaccacactaa

SEQ ID NO: 7975685 - DNA, 22 bp, Homo sapiens
atccaaactatgactagtgttc

SEQ ID NO: 7975686 - DNA, 22 bp, Homo sapiens
atcatttttaagagactcttct

SEQ ID NO: 7975687 - DNA, 22 bp, Homo sapiens
atcatttttaagagactcttct

SEQ ID NO: 7975688 - DNA, 22 bp, Homo sapiens
atcatttttaagagactcttct

SEQ ID NO: 7975689 - DNA, 22 bp, Homo sapiens
atcattttgtgacaatgcctgt

SEQ ID NO: 7975690 - DNA, 22 bp, Homo sapiens
atcattttgtgacaatgcctgt

SEQ ID NO: 7975691 - DNA, 22 bp, Homo sapiens
atcattttgtgacaatgcctgt

SEQ ID NO: 7975692 - DNA, 22 bp, Homo sapiens
atcattttatggctgagaggac

SEQ ID NO: 7975693 - DNA, 22 bp, Homo sapiens
atcattttgtgacaatgcctgt

SEQ ID NO: 7975694 - DNA, 22 bp, Homo sapiens
atcattttgtgacaatgcctgt

SEQ ID NO: 7975695 - DNA, 22 bp, Homo sapiens
atccaaatcatgtcagaagaac

SEQ ID NO: 7975696 - DNA, 22 bp, Homo sapiens
atccaaatatattttattcact

SEQ ID NO: 7975697 - DNA, 22 bp, Homo sapiens
atccaaagatggaaagaacttt

SEQ ID NO: 7975698 - DNA, 22 bp, Homo sapiens
atccaaaggtgacacagaatac

SEQ ID NO: 7975699 - DNA, 22 bp, Homo sapiens
atccaaagccctaagttaactg

SEQ ID NO: 7975700 - DNA, 22 bp, Homo sapiens
atccaaaggtgacacagaatac

SEQ ID NO: 7975701 - DNA, 22 bp, Homo sapiens
atccaattctaatattgtgttt

SEQ ID NO: 7975702 - DNA, 22 bp, Homo sapiens
atccaattctaatattgtgttt

SEQ ID NO: 7975703 - DNA, 22 bp, Homo sapiens
atccaattacgttttttgtcat

SEQ ID NO: 7975704 - DNA, 22 bp, Homo sapiens
atccaaggggaaagacgtctgg

SEQ ID NO: 7975705 - DNA, 22 bp, Homo sapiens
atccaatggggagtgagttctt

SEQ ID NO: 7975706 - DNA, 22 bp, Homo sapiens
atccaaggggaaagacgtctgg

SEQ ID NO: 7975707 - DNA, 22 bp, Homo sapiens
atccaagaatttgcactcctaa

SEQ ID NO: 7975708 - DNA, 22 bp, Homo sapiens
atccaaatcttcacacataaca

SEQ ID NO: 7975709 - DNA, 22 bp, Homo sapiens
atccaacaggacaaagaaagga

SEQ ID NO: 7975710 - DNA, 22 bp, Homo sapiens
atccaagagacatttgtgaatg

SEQ ID NO: 7975711 - DNA, 22 bp, Homo sapiens
atccaagcagaatcacgtgaga

SEQ ID NO: 7975712 - DNA, 22 bp, Homo sapiens
atccaagctgactcaagataaa

SEQ ID NO: 7975713 - DNA, 22 bp, Homo sapiens
atccaaggcgcaagatggcgct

SEQ ID NO: 7975714 - DNA, 22 bp, Homo sapiens
atcctcagacctcagcaaagcc

SEQ ID NO: 7975715 - DNA, 22 bp, Homo sapiens
atcctcagagaacgaacacaat

SEQ ID NO: 7975716 - DNA, 22 bp, Homo sapiens
atcctcagacttcacgttccat

SEQ ID NO: 7975717 - DNA, 20 bp, Homo sapiens
atcctcaccctcagtcctag

SEQ ID NO: 7975718 - DNA, 22 bp, Homo sapiens
atcctcagacctcagcaaagcc

SEQ ID NO: 7975719 - DNA, 22 bp, Homo sapiens
atcctacaaagcagggctatgg

SEQ ID NO: 7975720 - DNA, 18 bp, Homo sapiens
atcctagaccatacacag

SEQ ID NO: 7975721 - DNA, 22 bp, Homo sapiens
atcctagaatcagcccttgctg

SEQ ID NO: 7975722 - DNA, 22 bp, Homo sapiens
atcctagaatcagcccttgctg

SEQ ID NO: 7975723 - DNA, 22 bp, Homo sapiens
atcctcacaataaaatcagcct

SEQ ID NO: 7975724 - DNA, 22 bp, Homo sapiens
atcctaaaattgttcaatttct

SEQ ID NO: 7975725 - DNA, 23 bp, Homo sapiens
atcccttctccagtgtggtgagg

SEQ ID NO: 7975726 - DNA, 22 bp, Homo sapiens
atcctaaagaaatatttattaa

SEQ ID NO: 7975727 - DNA, 19 bp, Homo sapiens
atcctaaatccagtttcta

SEQ ID NO: 7975728 - DNA, 22 bp, Homo sapiens
atcctaaagcagacagcaggtt

SEQ ID NO: 7975729 - DNA, 22 bp, Homo sapiens
atcctaaattgagagctctaat

SEQ ID NO: 7975730 - DNA, 22 bp, Homo sapiens
atccctggacggcgcctcccca

SEQ ID NO: 7975731 - DNA, 22 bp, Homo sapiens
atccctgccctcatggagctta

SEQ ID NO: 7975732 - DNA, 22 bp, Homo sapiens
atcccttgtgctcagcctcttg

SEQ ID NO: 7975733 - DNA, 22 bp, Homo sapiens
atccctggccacgaagctgccc

SEQ ID NO: 7975734 - DNA, 22 bp, Homo sapiens
atcctcagcatctagcatgaag

SEQ ID NO: 7975735 - DNA, 22 bp, Homo sapiens
atcctcagtgtttctgacatct

SEQ ID NO: 7975736 - DNA, 22 bp, Homo sapiens
atcctccagctcctgcttctgc

SEQ ID NO: 7975737 - DNA, 22 bp, Homo sapiens
atctacaacatcacatggcatt

SEQ ID NO: 7975738 - DNA, 22 bp, Homo sapiens
atctacaacatcacatggcatt

SEQ ID NO: 7975739 - DNA, 22 bp, Homo sapiens
atctacaaaaactgtctcagga

SEQ ID NO: 7975740 - DNA, 22 bp, Homo sapiens
atctacaacatcacatggcatt

SEQ ID NO: 7975741 - DNA, 22 bp, Homo sapiens
atctacaacatcacatggcatt

SEQ ID NO: 7975742 - DNA, 22 bp, Homo sapiens
atctaattttcactcatttgct

SEQ ID NO: 7975743 - DNA, 22 bp, Homo sapiens
atctacaatgtctggctgcact

SEQ ID NO: 7975744 - DNA, 22 bp, Homo sapiens
atctacaacccctcaaactgtg

SEQ ID NO: 7975745 - DNA, 22 bp, Homo sapiens
atctacaacccctcaaactgtg

SEQ ID NO: 7975746 - DNA, 22 bp, Homo sapiens
atcctctgtggattacacctag

SEQ ID NO: 7975747 - DNA, 22 bp, Homo sapiens
atcctttaagttaataaaattc

SEQ ID NO: 7975748 - DNA, 22 bp, Homo sapiens
atcctttagtcctacaactcga

SEQ ID NO: 7975749 - DNA, 22 bp, Homo sapiens
atcctttaagttaataaaattc

SEQ ID NO: 7975750 - DNA, 22 bp, Homo sapiens
atcctttagtcctacaactcga

SEQ ID NO: 7975751 - DNA, 22 bp, Homo sapiens
atcctttagtcctacaactcga

SEQ ID NO: 7975752 - DNA, 22 bp, Homo sapiens
atccacagagaggaagaatagt

SEQ ID NO: 7975753 - DNA, 22 bp, Homo sapiens
atccacagagaggaagaatagt

SEQ ID NO: 7975754 - DNA, 22 bp, Homo sapiens
atccacagaaggaacttgaaag

SEQ ID NO: 7975755 - DNA, 22 bp, Homo sapiens
atccacagagaggaagaatagt

SEQ ID NO: 7975756 - DNA, 22 bp, Homo sapiens
atccacagagaggaagaatagt

SEQ ID NO: 7975757 - DNA, 22 bp, Homo sapiens
atccacagggtgtgttaagatg

SEQ ID NO: 7975758 - DNA, 22 bp, Homo sapiens
atccacaggagggtttggaaaa

SEQ ID NO: 7975759 - DNA, 22 bp, Homo sapiens
atccacaggtcatgtaatgtgg

SEQ ID NO: 7975760 - DNA, 22 bp, Homo sapiens
atccacaggtcatgtaatgtgg

SEQ ID NO: 7975761 - DNA, 22 bp, Homo sapiens
atccacagggtgtgttaagatg

SEQ ID NO: 7975762 - DNA, 22 bp, Homo sapiens
atccacagtcttagccatcaaa

SEQ ID NO: 7975763 - DNA, 22 bp, Homo sapiens
atccacagtgcagcaagggccc

SEQ ID NO: 7975764 - DNA, 22 bp, Homo sapiens
atccacagtgcagcaagggccc

SEQ ID NO: 7975765 - DNA, 22 bp, Homo sapiens
atccacagtgggggtggcggaa

SEQ ID NO: 7975766 - DNA, 17 bp, Homo sapiens
atccccagcatctagaa

SEQ ID NO: 7975767 - DNA, 17 bp, Homo sapiens
atccccagcatctagaa

SEQ ID NO: 7975768 - DNA, 17 bp, Homo sapiens
atccccagcatctagaa

SEQ ID NO: 7975769 - DNA, 22 bp, Homo sapiens
atccatttgtaaatgttagagt

SEQ ID NO: 7975770 - DNA, 22 bp, Homo sapiens
atccacagtgcagcaagggccc

SEQ ID NO: 7975771 - DNA, 23 bp, Homo sapiens
atccacattacagtatcatacaa

SEQ ID NO: 7975772 - DNA, 22 bp, Homo sapiens
atccatttgtaaatgttagagt

SEQ ID NO: 7975773 - DNA, 22 bp, Homo sapiens
atccatttgccgtgctatgtgc

SEQ ID NO: 7975774 - DNA, 22 bp, Homo sapiens
atccaccctgtggtggctttct

SEQ ID NO: 7975775 - DNA, 22 bp, Homo sapiens
atccctctctgcatgactgtgt

SEQ ID NO: 7975776 - DNA, 22 bp, Homo sapiens
atccctcccagagcaagccatt

SEQ ID NO: 7975777 - DNA, 22 bp, Homo sapiens
atccctcagcagacagcaaaat

SEQ ID NO: 7975778 - DNA, 22 bp, Homo sapiens
atccccttcacaccctctgcat

SEQ ID NO: 7975779 - DNA, 22 bp, Homo sapiens
atccctcagccacctttgagga

SEQ ID NO: 7975780 - DNA, 23 bp, Homo sapiens
atccctagaagggaaatatagtg

SEQ ID NO: 7975781 - DNA, 21 bp, Homo sapiens
atcccggctttgaggcagatg

SEQ ID NO: 7975782 - DNA, 22 bp, Homo sapiens
atccccctgtatctggaagaat

SEQ ID NO: 7975783 - DNA, 23 bp, Homo sapiens
atcccctgccttgggtgagtccc

SEQ ID NO: 7975784 - DNA, 22 bp, Homo sapiens
atccccctcttggatggcggca

SEQ ID NO: 7975785 - DNA, 22 bp, Homo sapiens
atccccctgtatctggaagaat

SEQ ID NO: 7975786 - DNA, 22 bp, Homo sapiens
atccccctgtatctggaagaat

SEQ ID NO: 7975787 - DNA, 22 bp, Homo sapiens
atccccctcttggatggcggca

SEQ ID NO: 7975788 - DNA, 22 bp, Homo sapiens
atccccctcttggatggcggca

SEQ ID NO: 7975789 - DNA, 22 bp, Homo sapiens
atccccaggggcattcaagctt

SEQ ID NO: 7975790 - DNA, 22 bp, Homo sapiens
atccccctcttggatggcggca

SEQ ID NO: 7975791 - DNA, 22 bp, Homo sapiens
atccccagggaggcctgacctg

SEQ ID NO: 7975792 - DNA, 22 bp, Homo sapiens
atccccagggagtgagctgtct

SEQ ID NO: 7975793 - DNA, 22 bp, Homo sapiens
atccccagggagtgagctgtct

SEQ ID NO: 7975794 - DNA, 22 bp, Homo sapiens
aggctctgcagtccatcccgtg

SEQ ID NO: 7975795 - DNA, 22 bp, Homo sapiens
aggctctgcagtccatcccgtg

SEQ ID NO: 7975796 - DNA, 22 bp, Homo sapiens
aggctctgcagtccatcccgtg

SEQ ID NO: 7975797 - DNA, 22 bp, Homo sapiens
aggctctgcagtccatcccgtg

SEQ ID NO: 7975798 - DNA, 22 bp, Homo sapiens
aggctctgcaggtatttcttga

SEQ ID NO: 7975799 - DNA, 22 bp, Homo sapiens
aggctctgcagaccccagctgt

SEQ ID NO: 7975800 - DNA, 22 bp, Homo sapiens
aggctctgcagaccccagctgt

SEQ ID NO: 7975801 - DNA, 22 bp, Homo sapiens
aggctctgcaggtatttcttga

SEQ ID NO: 7975802 - DNA, 22 bp, Homo sapiens
aggctctgatgcaagcccaggg

SEQ ID NO: 7975803 - DNA, 22 bp, Homo sapiens
aggctctgatgcaagcccaggg

SEQ ID NO: 7975804 - DNA, 22 bp, Homo sapiens
aggctctgcagaccccagctgt

SEQ ID NO: 7975805 - DNA, 22 bp, Homo sapiens
aggctctgcagaccccagctgt

SEQ ID NO: 7975806 - DNA, 22 bp, Homo sapiens
aggctctgatgcaagcccaggg

SEQ ID NO: 7975807 - DNA, 22 bp, Homo sapiens
aggctctgatgcaagcccaggg

SEQ ID NO: 7975808 - DNA, 22 bp, Homo sapiens
aggctctgcagaccccagctgt

SEQ ID NO: 7975809 - DNA, 22 bp, Homo sapiens
aggctctgcagtgctggaggac

SEQ ID NO: 7975810 - DNA, 22 bp, Homo sapiens
aggctctgcagtgctggaggac

SEQ ID NO: 7975811 - DNA, 22 bp, Homo sapiens
aggctctgcagtgctggaggac

SEQ ID NO: 7975812 - DNA, 22 bp, Homo sapiens
aggctctgcagtgctggaggac

SEQ ID NO: 7975813 - DNA, 22 bp, Homo sapiens
aggctctgcagtgctggaggac

SEQ ID NO: 7975814 - DNA, 22 bp, Homo sapiens
aggctctgcagtgctggaggac

SEQ ID NO: 7975815 - DNA, 22 bp, Homo sapiens
aggctctgcagtccatcccgtg

SEQ ID NO: 7975816 - DNA, 22 bp, Homo sapiens
aggctctgcagtccatcccgtg

SEQ ID NO: 7975817 - DNA, 22 bp, Homo sapiens
aggctctgcagtgctggaggac

SEQ ID NO: 7975818 - DNA, 22 bp, Homo sapiens
aggctctgcatccaggctttat

SEQ ID NO: 7975819 - DNA, 22 bp, Homo sapiens
aggctctgcatccaggctttat

SEQ ID NO: 7975820 - DNA, 20 bp, Homo sapiens
aggctctgcatttctgagtg

SEQ ID NO: 7975821 - DNA, 22 bp, Homo sapiens
aggctctgagtagagctgccag

SEQ ID NO: 7975822 - DNA, 22 bp, Homo sapiens
aggctctgagtagagctgccag

SEQ ID NO: 7975823 - DNA, 22 bp, Homo sapiens
aggctctgagtagagctgccag

SEQ ID NO: 7975824 - DNA, 22 bp, Homo sapiens
aggctctgagtagagctgccag

SEQ ID NO: 7975825 - DNA, 22 bp, Homo sapiens
aggctctgaggcagattttcgt

SEQ ID NO: 7975826 - DNA, 22 bp, Homo sapiens
aggctctgaggcagattttcgt

SEQ ID NO: 7975827 - DNA, 22 bp, Homo sapiens
aggctctgagtagagctgccag

SEQ ID NO: 7975828 - DNA, 19 bp, Homo sapiens
aggctctgagctcctggag

SEQ ID NO: 7975829 - DNA, 19 bp, Homo sapiens
aggctctgagctcctggag

SEQ ID NO: 7975830 - DNA, 22 bp, Homo sapiens
aggctccttgttcatcatccat

SEQ ID NO: 7975831 - DNA, 19 bp, Homo sapiens
aggctctgagctcctggag

SEQ ID NO: 7975832 - DNA, 19 bp, Homo sapiens
aggctctgagctcctggag

SEQ ID NO: 7975833 - DNA, 19 bp, Homo sapiens
aggctctgagctcctggag

SEQ ID NO: 7975834 - DNA, 19 bp, Homo sapiens
aggctctgagctcctggag

SEQ ID NO: 7975835 - DNA, 22 bp, Homo sapiens
aggctctgatgcaagcccaggg

SEQ ID NO: 7975836 - DNA, 22 bp, Homo sapiens
aggctctgatcaggtggctgtg

SEQ ID NO: 7975837 - DNA, 22 bp, Homo sapiens
aggctctgatcaggtggctgtg

SEQ ID NO: 7975838 - DNA, 22 bp, Homo sapiens
aggctctgatcaggtggctgtg

SEQ ID NO: 7975839 - DNA, 22 bp, Homo sapiens
aggctctgatcaggtggctgtg

SEQ ID NO: 7975840 - DNA, 22 bp, Homo sapiens
aggctctgatcaggtggctgtg

SEQ ID NO: 7975841 - DNA, 22 bp, Homo sapiens
aggctctgatcaggtggctgtg

SEQ ID NO: 7975842 - DNA, 22 bp, Homo sapiens
aggctctgagtctggtgtctgc

SEQ ID NO: 7975843 - DNA, 22 bp, Homo sapiens
aggctctgagtagagctgccag

SEQ ID NO: 7975844 - DNA, 22 bp, Homo sapiens
aggctctgagtagagctgccag

SEQ ID NO: 7975845 - DNA, 22 bp, Homo sapiens
aggctctgagtctggtgtctgc

SEQ ID NO: 7975846 - DNA, 22 bp, Homo sapiens
aggctctgagtctggtgtctgc

SEQ ID NO: 7975847 - DNA, 22 bp, Homo sapiens
aggctctgatcaggtggctgtg

SEQ ID NO: 7975848 - DNA, 20 bp, Homo sapiens
aggctctgcctgcaggccca

SEQ ID NO: 7975849 - DNA, 20 bp, Homo sapiens
aggctctgcctgcaggccca

SEQ ID NO: 7975850 - DNA, 20 bp, Homo sapiens
aggctctgcctgcaggccca

SEQ ID NO: 7975851 - DNA, 20 bp, Homo sapiens
aggctctgccattgtccctg

SEQ ID NO: 7975852 - DNA, 20 bp, Homo sapiens
aggctctgccattgtccctg

SEQ ID NO: 7975853 - DNA, 20 bp, Homo sapiens
aggctctgccattgtccctg

SEQ ID NO: 7975854 - DNA, 20 bp, Homo sapiens
aggctctgccattgtccctg

SEQ ID NO: 7975855 - DNA, 22 bp, Homo sapiens
aggctctgccaattccttcctc

SEQ ID NO: 7975856 - DNA, 20 bp, Homo sapiens
aggctctgccattgtccctg

SEQ ID NO: 7975857 - DNA, 20 bp, Homo sapiens
aggctctgccattgtccctg

SEQ ID NO: 7975858 - DNA, 20 bp, Homo sapiens
aggctctgcatttctgagtg

SEQ ID NO: 7975859 - DNA, 20 bp, Homo sapiens
aggctctgcatttctgagtg

SEQ ID NO: 7975860 - DNA, 20 bp, Homo sapiens
aggctctgcatttctgagtg

SEQ ID NO: 7975861 - DNA, 20 bp, Homo sapiens
aggctctgcatttctgagtg

SEQ ID NO: 7975862 - DNA, 22 bp, Homo sapiens
aggctctgccaattccttcctc

SEQ ID NO: 7975863 - DNA, 22 bp, Homo sapiens
aggctctgccaattccttcctc

SEQ ID NO: 7975864 - DNA, 22 bp, Homo sapiens
aggctctgccaattccttcctc

SEQ ID NO: 7975865 - DNA, 20 bp, Homo sapiens
aggctctgcatttctgagtg

SEQ ID NO: 7975866 - DNA, 22 bp, Homo sapiens
aggctctgttattctagagggc

SEQ ID NO: 7975867 - DNA, 22 bp, Homo sapiens
aggctctgttattctagagggc

SEQ ID NO: 7975868 - DNA, 22 bp, Homo sapiens
aggctctgttattctagagggc

SEQ ID NO: 7975869 - DNA, 22 bp, Homo sapiens
aggctctgttattctagagggc

SEQ ID NO: 7975870 - DNA, 22 bp, Homo sapiens
aggctctgttattctagagggc

SEQ ID NO: 7975871 - DNA, 20 bp, Homo sapiens
aggctctgcctgcaggccca

SEQ ID NO: 7975872 - DNA, 20 bp, Homo sapiens
aggctctgcctgcaggccca

SEQ ID NO: 7975873 - DNA, 22 bp, Homo sapiens
aggctgagactgtgcattagtg

SEQ ID NO: 7975874 - DNA, 22 bp, Homo sapiens
aggctgagactgtgcattagtg

SEQ ID NO: 7975875 - DNA, 22 bp, Homo sapiens
aggctgagactgtgcattagtg

SEQ ID NO: 7975876 - DNA, 22 bp, Homo sapiens
aggctgagagcaacgtgtcaga

SEQ ID NO: 7975877 - DNA, 22 bp, Homo sapiens
aggctgagagcaacgtgtcaga

SEQ ID NO: 7975878 - DNA, 22 bp, Homo sapiens
aggctgagagcaacgtgtcaga

SEQ ID NO: 7975879 - DNA, 22 bp, Homo sapiens
aggctgagagcaacgtgtcaga

SEQ ID NO: 7975880 - DNA, 22 bp, Homo sapiens
aggctgagagcaacgtgtcaga

SEQ ID NO: 7975881 - DNA, 22 bp, Homo sapiens
aggctgagcaaagggccttacc

SEQ ID NO: 7975882 - DNA, 22 bp, Homo sapiens
aggctgagcaaagggccttacc

SEQ ID NO: 7975883 - DNA, 22 bp, Homo sapiens
aggctgagcaaagggccttacc

SEQ ID NO: 7975884 - DNA, 22 bp, Homo sapiens
aggctgagcaaagggccttacc

SEQ ID NO: 7975885 - DNA, 22 bp, Homo sapiens
aggctgagcaaagggccttacc

SEQ ID NO: 7975886 - DNA, 22 bp, Homo sapiens
aggctgagataggtggatcatt

SEQ ID NO: 7975887 - DNA, 22 bp, Homo sapiens
aggctgagataggtggatcatt

SEQ ID NO: 7975888 - DNA, 22 bp, Homo sapiens
aggctgagataggtggatcatt

SEQ ID NO: 7975889 - DNA, 22 bp, Homo sapiens
aggctgagataggtggatcatt

SEQ ID NO: 7975890 - DNA, 22 bp, Homo sapiens
aggctgagataggtggatcatt

SEQ ID NO: 7975891 - DNA, 22 bp, Homo sapiens
aggctgagataggtggatcatt

SEQ ID NO: 7975892 - DNA, 22 bp, Homo sapiens
aggctgagagcaacgtgtcaga

SEQ ID NO: 7975893 - DNA, 22 bp, Homo sapiens
aggctgagccacggggctggct

SEQ ID NO: 7975894 - DNA, 22 bp, Homo sapiens
aggctgagccacggggctggct

SEQ ID NO: 7975895 - DNA, 22 bp, Homo sapiens
aggctgagccacggggctggct

SEQ ID NO: 7975896 - DNA, 22 bp, Homo sapiens
aggctgagcaaagggccttacc

SEQ ID NO: 7975897 - DNA, 22 bp, Homo sapiens
aggctgagcaaagggccttacc

SEQ ID NO: 7975898 - DNA, 22 bp, Homo sapiens
aggctgagcctgggcgtggtgg

SEQ ID NO: 7975899 - DNA, 22 bp, Homo sapiens
aggctgagccacggggctggct

SEQ ID NO: 7975900 - DNA, 22 bp, Homo sapiens
aggctgagccacggggctggct

SEQ ID NO: 7975901 - DNA, 22 bp, Homo sapiens
ccagttcaccagtggcagaagt

SEQ ID NO: 7975902 - DNA, 22 bp, Homo sapiens
ccagttcaccagtggcagaagt

SEQ ID NO: 7975903 - DNA, 22 bp, Homo sapiens
ccagttatccagcatgctgtct

SEQ ID NO: 7975904 - DNA, 22 bp, Homo sapiens
ccagttcatacacttagaaatt

SEQ ID NO: 7975905 - DNA, 22 bp, Homo sapiens
ccagtgtgccaatttacagctg

SEQ ID NO: 7975906 - DNA, 22 bp, Homo sapiens
ccagtgtgcattatcatgtgtc

SEQ ID NO: 7975907 - DNA, 22 bp, Homo sapiens
ccagttagaactacatttccca

SEQ ID NO: 7975908 - DNA, 22 bp, Homo sapiens
ccagttagttaaaggcgcagta

SEQ ID NO: 7975909 - DNA, 22 bp, Homo sapiens
aggctgaggcgggaggatcact

SEQ ID NO: 7975910 - DNA, 22 bp, Homo sapiens
aggctgaggcgggaggatcact

SEQ ID NO: 7975911 - DNA, 22 bp, Homo sapiens
aggctgaggcgggaggatcact

SEQ ID NO: 7975912 - DNA, 22 bp, Homo sapiens
ccagtgtgcattatcatgtgtc

SEQ ID NO: 7975913 - DNA, 22 bp, Homo sapiens
ccagtgtgcaatctctggctta

SEQ ID NO: 7975914 - DNA, 22 bp, Homo sapiens
ccagtgtgcattatcatgtgtc

SEQ ID NO: 7975915 - DNA, 22 bp, Homo sapiens
ccagtgtgcattatcatgtgtc

SEQ ID NO: 7975916 - DNA, 22 bp, Homo sapiens
ccagtgtgcattatcatgtgtc

SEQ ID NO: 7975917 - DNA, 22 bp, Homo sapiens
ccagtgtgcattatcatgtgtc

SEQ ID NO: 7975918 - DNA, 23 bp, Homo sapiens
ccagtttatctttagtgtagatc

SEQ ID NO: 7975919 - DNA, 22 bp, Homo sapiens
ccagtttataagaaagaaaacc

SEQ ID NO: 7975920 - DNA, 22 bp, Homo sapiens
ccagtttcttaagtaggaagaa

SEQ ID NO: 7975921 - DNA, 22 bp, Homo sapiens
ccagtttaagacttatctcaat

SEQ ID NO: 7975922 - DNA, 22 bp, Homo sapiens
ccagttgtttgccttgaaatga

SEQ ID NO: 7975923 - DNA, 22 bp, Homo sapiens
ccagttctgacacaagcacagt

SEQ ID NO: 7975924 - DNA, 22 bp, Homo sapiens
ccagttctaaacataaagctaa

SEQ ID NO: 7975925 - DNA, 22 bp, Homo sapiens
aggctgaggcgggaggatcact

SEQ ID NO: 7975926 - DNA, 22 bp, Homo sapiens
aggctgaggcgggaggatcact

SEQ ID NO: 7975927 - DNA, 22 bp, Homo sapiens
aggctgaggcgggaggatcact

SEQ ID NO: 7975928 - DNA, 22 bp, Homo sapiens
aggctgaggcgggaggatcact

SEQ ID NO: 7975929 - DNA, 22 bp, Homo sapiens
aggctgaggcgggaggatcact

SEQ ID NO: 7975930 - DNA, 22 bp, Homo sapiens
aggctgaggcaggtggatcatt

SEQ ID NO: 7975931 - DNA, 22 bp, Homo sapiens
aggctgaggcaggtggatcatt

SEQ ID NO: 7975932 - DNA, 22 bp, Homo sapiens
aggctgaggcaggtggatcatt

SEQ ID NO: 7975933 - DNA, 22 bp, Homo sapiens
aggctgaggcaggtggatcatt

SEQ ID NO: 7975934 - DNA, 22 bp, Homo sapiens
aggctgaggcaggtggatcatt

SEQ ID NO: 7975935 - DNA, 22 bp, Homo sapiens
aggctgaggcaggtggatcact

SEQ ID NO: 7975936 - DNA, 22 bp, Homo sapiens
aggctgaggcaggtggatcact

SEQ ID NO: 7975937 - DNA, 22 bp, Homo sapiens
aggctgaggcaggtggatcact

SEQ ID NO: 7975938 - DNA, 22 bp, Homo sapiens
aggctgaggcaggtggatcatt

SEQ ID NO: 7975939 - DNA, 22 bp, Homo sapiens
aggctgaggcaggtggatcact

SEQ ID NO: 7975940 - DNA, 22 bp, Homo sapiens
ccagtgcaccatttccctctgt

SEQ ID NO: 7975941 - DNA, 22 bp, Homo sapiens
ccagtgcaccatttccctctgt

SEQ ID NO: 7975942 - DNA, 22 bp, Homo sapiens
ccagtgcaccatttccctctgt

SEQ ID NO: 7975943 - DNA, 22 bp, Homo sapiens
aggctgaggcaggtggatcact

SEQ ID NO: 7975944 - DNA, 22 bp, Homo sapiens
aggctgaggcaggtggatcact

SEQ ID NO: 7975945 - DNA, 22 bp, Homo sapiens
ccagtgcaccaagaggcctaga

SEQ ID NO: 7975946 - DNA, 22 bp, Homo sapiens
ccagtgcaccaagaggcctaga

SEQ ID NO: 7975947 - DNA, 22 bp, Homo sapiens
ccagtgcacagccaggcaggtg

SEQ ID NO: 7975948 - DNA, 22 bp, Homo sapiens
ccagtctggcaggagggggaac

SEQ ID NO: 7975949 - DNA, 22 bp, Homo sapiens
ccagtctgctgtggtaggaaga

SEQ ID NO: 7975950 - DNA, 22 bp, Homo sapiens
ccagtcactggaaaatgggaat

SEQ ID NO: 7975951 - DNA, 22 bp, Homo sapiens
ccagtctgtactttgctctgtt

SEQ ID NO: 7975952 - DNA, 22 bp, Homo sapiens
ccagtctgtactttgctctgtt

SEQ ID NO: 7975953 - DNA, 22 bp, Homo sapiens
ccagtcactctgtgagagctac

SEQ ID NO: 7975954 - DNA, 22 bp, Homo sapiens
ccagtcactctgtgagagctac

SEQ ID NO: 7975955 - DNA, 22 bp, Homo sapiens
ccagtcacaggtgtgtttatat

SEQ ID NO: 7975956 - DNA, 22 bp, Homo sapiens
aggctgagctgacctggtttgg

SEQ ID NO: 7975957 - DNA, 23 bp, Homo sapiens
aggctgagctctcccagcttcag

SEQ ID NO: 7975958 - DNA, 23 bp, Homo sapiens
aggctgagctctcccagcttcag

SEQ ID NO: 7975959 - DNA, 23 bp, Homo sapiens
aggctgagctctcccagcttcag

SEQ ID NO: 7975960 - DNA, 23 bp, Homo sapiens
aggctgagctctcccagcttcag

SEQ ID NO: 7975961 - DNA, 23 bp, Homo sapiens
aggctgagctctcccagcttcag

SEQ ID NO: 7975962 - DNA, 23 bp, Homo sapiens
aggctgagctctcccagcttcag

SEQ ID NO: 7975963 - DNA, 23 bp, Homo sapiens
aggctgagctctcccagcttcag

SEQ ID NO: 7975964 - DNA, 22 bp, Homo sapiens
aggctgagcggggtcccagagc

SEQ ID NO: 7975965 - DNA, 22 bp, Homo sapiens
aggctgagcggggtcccagagc

SEQ ID NO: 7975966 - DNA, 22 bp, Homo sapiens
aggctgagcggggtcccagagc

SEQ ID NO: 7975967 - DNA, 22 bp, Homo sapiens
aggctgagcggggtcccagagc

SEQ ID NO: 7975968 - DNA, 22 bp, Homo sapiens
aggctgagcggggtcccagagc

SEQ ID NO: 7975969 - DNA, 22 bp, Homo sapiens
aggctgagcctgggcgtggtgg

SEQ ID NO: 7975970 - DNA, 22 bp, Homo sapiens
aggctgagcctgggcgtggtgg

SEQ ID NO: 7975971 - DNA, 23 bp, Homo sapiens
ccagtgattgcctggaaggaggt

SEQ ID NO: 7975972 - DNA, 23 bp, Homo sapiens
ccagtgattgcctggaaggaggt

SEQ ID NO: 7975973 - DNA, 23 bp, Homo sapiens
ccagtgattgcctggaaggaggt

SEQ ID NO: 7975974 - DNA, 22 bp, Homo sapiens
ccagtgattcattcatttacct

SEQ ID NO: 7975975 - DNA, 22 bp, Homo sapiens
ccagtgatggtgatcagatgtt

SEQ ID NO: 7975976 - DNA, 22 bp, Homo sapiens
ccagtgattcctagtaatataa

SEQ ID NO: 7975977 - DNA, 22 bp, Homo sapiens
ccagtgcacagccaggcaggtg

SEQ ID NO: 7975978 - DNA, 22 bp, Homo sapiens
ccagtgcacagccaggcaggtg

SEQ ID NO: 7975979 - DNA, 22 bp, Homo sapiens
ccagtgcacagccaggcaggtg

SEQ ID NO: 7975980 - DNA, 22 bp, Homo sapiens
ccagtgcacagccaggcaggtg

SEQ ID NO: 7975981 - DNA, 22 bp, Homo sapiens
ccagtgcacaatggaacaactc

SEQ ID NO: 7975982 - DNA, 22 bp, Homo sapiens
ccagtgcacagccaggcaggtg

SEQ ID NO: 7975983 - DNA, 19 bp, Homo sapiens
ccagtgcaaggtaagatag

SEQ ID NO: 7975984 - DNA, 22 bp, Homo sapiens
ccagtgatttagtacaatgtag

SEQ ID NO: 7975985 - DNA, 22 bp, Homo sapiens
ccagtgatctgacaccaaatca

SEQ ID NO: 7975986 - DNA, 22 bp, Homo sapiens
ccagtgagatatctgggcatta

SEQ ID NO: 7975987 - DNA, 22 bp, Homo sapiens
ccagtgacttgccaggtggatc

SEQ ID NO: 7975988 - DNA, 22 bp, Homo sapiens
ccagtgacttgccaggtggatc

SEQ ID NO: 7975989 - DNA, 22 bp, Homo sapiens
ccagtgacttgccaggtggatc

SEQ ID NO: 7975990 - DNA, 22 bp, Homo sapiens
ccagtgactggctttctggtgt

SEQ ID NO: 7975991 - DNA, 22 bp, Homo sapiens
ccagtgactggctttctggtgt

SEQ ID NO: 7975992 - DNA, 22 bp, Homo sapiens
ccagtgacttgccaggtggatc

SEQ ID NO: 7975993 - DNA, 22 bp, Homo sapiens
ccagtgagaatgaagataaggc

SEQ ID NO: 7975994 - DNA, 22 bp, Homo sapiens
ccagtctgtgtgccagcctgcg

SEQ ID NO: 7975995 - DNA, 22 bp, Homo sapiens
ccagtctgtgtgccagcctgcg

SEQ ID NO: 7975996 - DNA, 22 bp, Homo sapiens
ccagtctgttctcacctctgag

SEQ ID NO: 7975997 - DNA, 22 bp, Homo sapiens
ccagtgactggctttctggtgt

SEQ ID NO: 7975998 - DNA, 22 bp, Homo sapiens
ccagtctgttctcacctctgag

SEQ ID NO: 7975999 - DNA, 22 bp, Homo sapiens
ccagtctgtgtgccagcctgcg

SEQ ID NO: 7976000 - DNA, 22 bp, Homo sapiens
aggcctctctccttggcttgta

SEQ ID NO: 7976001 - DNA, 22 bp, Homo sapiens
aggcctctctccttggcttgta

SEQ ID NO: 7976002 - DNA, 22 bp, Homo sapiens
aggcctcctggctccaggcctt

SEQ ID NO: 7976003 - DNA, 22 bp, Homo sapiens
aggcctcctggctccaggcctt

SEQ ID NO: 7976004 - DNA, 22 bp, Homo sapiens
aggcctcctggctccaggcctt

SEQ ID NO: 7976005 - DNA, 22 bp, Homo sapiens
aggcctcctggctccaggcctt

SEQ ID NO: 7976006 - DNA, 22 bp, Homo sapiens
ccaggcacttcatcattagggt

SEQ ID NO: 7976007 - DNA, 22 bp, Homo sapiens
aggcctctgagcagcactcatg

SEQ ID NO: 7976008 - DNA, 22 bp, Homo sapiens
ccaggcacttcatcattagggt

SEQ ID NO: 7976009 - DNA, 22 bp, Homo sapiens
ccaggcacttcatcattagggt

SEQ ID NO: 7976010 - DNA, 22 bp, Homo sapiens
aggcctctctgcttagcttgta

SEQ ID NO: 7976011 - DNA, 22 bp, Homo sapiens
aggcctctgagcagcactcatg

SEQ ID NO: 7976012 - DNA, 22 bp, Homo sapiens
aggcctctgagcagcactcatg

SEQ ID NO: 7976013 - DNA, 22 bp, Homo sapiens
aggcctctgagcagcactcatg

SEQ ID NO: 7976014 - DNA, 22 bp, Homo sapiens
aggcctctgagcagcactcatg

SEQ ID NO: 7976015 - DNA, 22 bp, Homo sapiens
ccaggcagggctcaaggaacct

SEQ ID NO: 7976016 - DNA, 22 bp, Homo sapiens
ccaggcagggctcaaggaacct

SEQ ID NO: 7976017 - DNA, 22 bp, Homo sapiens
ccaggcagggctcaaggaacct

SEQ ID NO: 7976018 - DNA, 22 bp, Homo sapiens
ccaggcagggctcaaggaacct

SEQ ID NO: 7976019 - DNA, 22 bp, Homo sapiens
ccaggcagggctcaaggaacct

SEQ ID NO: 7976020 - DNA, 22 bp, Homo sapiens
ccaggcacttcatcattagggt

SEQ ID NO: 7976021 - DNA, 22 bp, Homo sapiens
ccaggcacttgtttgccaggca

SEQ ID NO: 7976022 - DNA, 22 bp, Homo sapiens
ccaggcagggctcaaggaacct

SEQ ID NO: 7976023 - DNA, 23 bp, Homo sapiens
ccaggcagtagctattgaagtga

SEQ ID NO: 7976024 - DNA, 23 bp, Homo sapiens
ccaggcagtagctattgaagtga

SEQ ID NO: 7976025 - DNA, 23 bp, Homo sapiens
ccaggcagtagctattgaagtga

SEQ ID NO: 7976026 - DNA, 23 bp, Homo sapiens
ccaggcagtagctattgaagtga

SEQ ID NO: 7976027 - DNA, 23 bp, Homo sapiens
ccaggcagtagctattgaagtga

SEQ ID NO: 7976028 - DNA, 23 bp, Homo sapiens
ccaggcagtagctattgaagtga

SEQ ID NO: 7976029 - DNA, 23 bp, Homo sapiens
ccaggcagtagctattgaagtga

SEQ ID NO: 7976030 - DNA, 23 bp, Homo sapiens
ccaggcagtagctattgaagtga

SEQ ID NO: 7976031 - DNA, 22 bp, Homo sapiens
ccaggcagtcagggttgtgtgt

SEQ ID NO: 7976032 - DNA, 22 bp, Homo sapiens
ccaggcatggggagagccagat

SEQ ID NO: 7976033 - DNA, 22 bp, Homo sapiens
ccaggcatggggagagccagat

SEQ ID NO: 7976034 - DNA, 22 bp, Homo sapiens
ccaggcatggggagagccagat

SEQ ID NO: 7976035 - DNA, 22 bp, Homo sapiens
ccaggcattgtgagtgggcagg

SEQ ID NO: 7976036 - DNA, 22 bp, Homo sapiens
ccaggcattgtgagtgggcagg

SEQ ID NO: 7976037 - DNA, 22 bp, Homo sapiens
ccaggcattgtgagtgggcagg

SEQ ID NO: 7976038 - DNA, 22 bp, Homo sapiens
ccaggcattgtgagtgggcagg

SEQ ID NO: 7976039 - DNA, 22 bp, Homo sapiens
ccaggccaaattcagtcagcag

SEQ ID NO: 7976040 - DNA, 22 bp, Homo sapiens
ccaggccaaattcagtcagcag

SEQ ID NO: 7976041 - DNA, 22 bp, Homo sapiens
ccaggccagagtgcagtggcac

SEQ ID NO: 7976042 - DNA, 22 bp, Homo sapiens
ccaggccagagtgcagtggcac

SEQ ID NO: 7976043 - DNA, 22 bp, Homo sapiens
ccaggccaaattcagtcagcag

SEQ ID NO: 7976044 - DNA, 22 bp, Homo sapiens
ccaggccaaattcagtcagcag

SEQ ID NO: 7976045 - DNA, 22 bp, Homo sapiens
ccaggccaaattcagtcagcag

SEQ ID NO: 7976046 - DNA, 21 bp, Homo sapiens
ccaggcatgactgcagagagc

SEQ ID NO: 7976047 - DNA, 21 bp, Homo sapiens
ccaggcatgactgcagagagc

SEQ ID NO: 7976048 - DNA, 21 bp, Homo sapiens
ccaggcatgactgcagagagc

SEQ ID NO: 7976049 - DNA, 22 bp, Homo sapiens
ccaggcatccattgcttcctct

SEQ ID NO: 7976050 - DNA, 22 bp, Homo sapiens
ccaggcagtcagggttgtgtgt

SEQ ID NO: 7976051 - DNA, 22 bp, Homo sapiens
ccaggcagtggaagctaaaatt

SEQ ID NO: 7976052 - DNA, 22 bp, Homo sapiens
ccaggcagtcagggttgtgtgt

SEQ ID NO: 7976053 - DNA, 22 bp, Homo sapiens
ccaggcagtcagggttgtgtgt

SEQ ID NO: 7976054 - DNA, 22 bp, Homo sapiens
ccaggcagtcagggttgtgtgt

SEQ ID NO: 7976055 - DNA, 22 bp, Homo sapiens
ccaggcagtcagggttgtgtgt

SEQ ID NO: 7976056 - DNA, 22 bp, Homo sapiens
ccaggcagtggaagctaaaatt

SEQ ID NO: 7976057 - DNA, 22 bp, Homo sapiens
ccaggcagtggaagctaaaatt

SEQ ID NO: 7976058 - DNA, 22 bp, Homo sapiens
ccaggcatcacgggcatgtggc

SEQ ID NO: 7976059 - DNA, 22 bp, Homo sapiens
ccaggcagtggaagctaaaatt

SEQ ID NO: 7976060 - DNA, 22 bp, Homo sapiens
ccaggcagtggaagctaaaatt

SEQ ID NO: 7976061 - DNA, 22 bp, Homo sapiens
aggcctccagctgagttttgct

SEQ ID NO: 7976062 - DNA, 22 bp, Homo sapiens
aggcctccagccacatgccagt

SEQ ID NO: 7976063 - DNA, 22 bp, Homo sapiens
aggcctccagccacatgccagt

SEQ ID NO: 7976064 - DNA, 22 bp, Homo sapiens
aggcctccagccacatgccagt

SEQ ID NO: 7976065 - DNA, 22 bp, Homo sapiens
aggcctccagccacatgccagt

SEQ ID NO: 7976066 - DNA, 17 bp, Homo sapiens
aggcctccctccaggcc

SEQ ID NO: 7976067 - DNA, 17 bp, Homo sapiens
aggcctccctccaggcc

SEQ ID NO: 7976068 - DNA, 17 bp, Homo sapiens
aggcctccctccaggcc

SEQ ID NO: 7976069 - DNA, 22 bp, Homo sapiens
aggcctcctgcagggatgagtg

SEQ ID NO: 7976070 - DNA, 22 bp, Homo sapiens
aggcctcctgcagggatgagtg

SEQ ID NO: 7976071 - DNA, 22 bp, Homo sapiens
aggcctcatagtagacctgccc

SEQ ID NO: 7976072 - DNA, 22 bp, Homo sapiens
aggcctcatagtagacctgccc

SEQ ID NO: 7976073 - DNA, 22 bp, Homo sapiens
aggcctcatagtagacctgccc

SEQ ID NO: 7976074 - DNA, 22 bp, Homo sapiens
aggcctcagtttgtcatctgta

SEQ ID NO: 7976075 - DNA, 22 bp, Homo sapiens
aggcctcagtttgtcatctgta

SEQ ID NO: 7976076 - DNA, 22 bp, Homo sapiens
aggcctcatagtagacctgccc

SEQ ID NO: 7976077 - DNA, 22 bp, Homo sapiens
aggcctcatgtcaaagcagcaa

SEQ ID NO: 7976078 - DNA, 22 bp, Homo sapiens
aggcctcatgtcaaagcagcaa

SEQ ID NO: 7976079 - DNA, 22 bp, Homo sapiens
aggcctcattgcccacctgtgg

SEQ ID NO: 7976080 - DNA, 22 bp, Homo sapiens
aggcctcattgcccacctgtgg

SEQ ID NO: 7976081 - DNA, 22 bp, Homo sapiens
aggccgtgtgagcatgtgtgag

SEQ ID NO: 7976082 - DNA, 22 bp, Homo sapiens
aggcctagaggaatggccaggg

SEQ ID NO: 7976083 - DNA, 22 bp, Homo sapiens
aggcctagagctttggagggca

SEQ ID NO: 7976084 - DNA, 22 bp, Homo sapiens
aggcctcacacaacagatgcat

SEQ ID NO: 7976085 - DNA, 22 bp, Homo sapiens
aggcctcacattgggcttcaag

SEQ ID NO: 7976086 - DNA, 22 bp, Homo sapiens
aggcctcactctcagagcttct

SEQ ID NO: 7976087 - DNA, 22 bp, Homo sapiens
aggcctcacattgggcttcaag

SEQ ID NO: 7976088 - DNA, 22 bp, Homo sapiens
aggcctcacacaacagatgcat

SEQ ID NO: 7976089 - DNA, 22 bp, Homo sapiens
aggcctcagcctgccaggcctg

SEQ ID NO: 7976090 - DNA, 22 bp, Homo sapiens
aggcctcagttcttgccaggtg

SEQ ID NO: 7976091 - DNA, 22 bp, Homo sapiens
aggcctcagttcttgccaggtg

SEQ ID NO: 7976092 - DNA, 22 bp, Homo sapiens
aggcctcagttcttgccaggtg

SEQ ID NO: 7976093 - DNA, 22 bp, Homo sapiens
aggcctcagctcagtgtgacag

SEQ ID NO: 7976094 - DNA, 22 bp, Homo sapiens
aggcctcagctcagtgtgacag

SEQ ID NO: 7976095 - DNA, 22 bp, Homo sapiens
aggcctcagcctgccaggcctg

SEQ ID NO: 7976096 - DNA, 22 bp, Homo sapiens
aggcctcagctcagtgtgacag

SEQ ID NO: 7976097 - DNA, 17 bp, Homo sapiens
aggcctcaggtgaaacc

SEQ ID NO: 7976098 - DNA, 22 bp, Homo sapiens
aggcctcagtgatcatcatcag

SEQ ID NO: 7976099 - DNA, 22 bp, Homo sapiens
aggcctcaggaaggtaaagaag

SEQ ID NO: 7976100 - DNA, 22 bp, Homo sapiens
aggcctcaggaaggtaaagaag

SEQ ID NO: 7976101 - DNA, 22 bp, Homo sapiens
aggctcccaagcactgacccca

SEQ ID NO: 7976102 - DNA, 22 bp, Homo sapiens
aggctccattttcctgcagctg

SEQ ID NO: 7976103 - DNA, 22 bp, Homo sapiens
aggctccattttcctgcagctg

SEQ ID NO: 7976104 - DNA, 22 bp, Homo sapiens
aggctcccaagcactgacccca

SEQ ID NO: 7976105 - DNA, 22 bp, Homo sapiens
aggctccattttcctgcagctg

SEQ ID NO: 7976106 - DNA, 22 bp, Homo sapiens
aggctccattttcctgcagctg

SEQ ID NO: 7976107 - DNA, 22 bp, Homo sapiens
aggctccattttcctgcagctg

SEQ ID NO: 7976108 - DNA, 22 bp, Homo sapiens
aggctccattttcctgcagctg

SEQ ID NO: 7976109 - DNA, 22 bp, Homo sapiens
aggctccattccaggagctaga

SEQ ID NO: 7976110 - DNA, 22 bp, Homo sapiens
aggctccattccaggagctaga

SEQ ID NO: 7976111 - DNA, 22 bp, Homo sapiens
aggctccattttcctgcagctg

SEQ ID NO: 7976112 - DNA, 22 bp, Homo sapiens
aggctccattttcctgcagctg

SEQ ID NO: 7976113 - DNA, 22 bp, Homo sapiens
aggctccattccaggagctaga

SEQ ID NO: 7976114 - DNA, 22 bp, Homo sapiens
aggctccattccaggagctaga

SEQ ID NO: 7976115 - DNA, 22 bp, Homo sapiens
aggctccattcatgtgaaggca

SEQ ID NO: 7976116 - DNA, 22 bp, Homo sapiens
aggctccattcatgtgaaggca

SEQ ID NO: 7976117 - DNA, 21 bp, Homo sapiens
aggctcccagaaatgggcatc

SEQ ID NO: 7976118 - DNA, 21 bp, Homo sapiens
ccaggctcctgaggctggtca

SEQ ID NO: 7976119 - DNA, 21 bp, Homo sapiens
ccaggctcctgaggctggtca

SEQ ID NO: 7976120 - DNA, 22 bp, Homo sapiens
aggctcccatggtgtggcagga

SEQ ID NO: 7976121 - DNA, 22 bp, Homo sapiens
ccaggctctatccctccttctt

SEQ ID NO: 7976122 - DNA, 22 bp, Homo sapiens
ccaggctctatccctccttctt

SEQ ID NO: 7976123 - DNA, 22 bp, Homo sapiens
ccaggctctatccctccttctt

SEQ ID NO: 7976124 - DNA, 22 bp, Homo sapiens
ccaggctctatccctccttctt

SEQ ID NO: 7976125 - DNA, 22 bp, Homo sapiens
ccaggctctgacatagatggga

SEQ ID NO: 7976126 - DNA, 22 bp, Homo sapiens
ccaggctctgagaggaatgtga

SEQ ID NO: 7976127 - DNA, 22 bp, Homo sapiens
ccaggctctgagcctcactctt

SEQ ID NO: 7976128 - DNA, 22 bp, Homo sapiens
ccaggctctgagaggaatgtga

SEQ ID NO: 7976129 - DNA, 22 bp, Homo sapiens
ccaggctctgacatagatggga

SEQ ID NO: 7976130 - DNA, 22 bp, Homo sapiens
ccaggctctgacatagatggga

SEQ ID NO: 7976131 - DNA, 22 bp, Homo sapiens
ccaggctctgcaaaatcaggct

SEQ ID NO: 7976132 - DNA, 22 bp, Homo sapiens
ccaggctctgcaaaatcaggct

SEQ ID NO: 7976133 - DNA, 22 bp, Homo sapiens
ccaggctctgagcctcactctt

SEQ ID NO: 7976134 - DNA, 22 bp, Homo sapiens
ccaggctctgagcctcactctt

SEQ ID NO: 7976135 - DNA, 22 bp, Homo sapiens
ccaggctctgagcctcactctt

SEQ ID NO: 7976136 - DNA, 22 bp, Homo sapiens
ccaggctctgccaggcccttga

SEQ ID NO: 7976137 - DNA, 22 bp, Homo sapiens
ccaggctctgcgctggacatgg

SEQ ID NO: 7976138 - DNA, 22 bp, Homo sapiens
aggctccttgctcacaggctca

SEQ ID NO: 7976139 - DNA, 22 bp, Homo sapiens
ccaggctctgccaggcccttga

SEQ ID NO: 7976140 - DNA, 22 bp, Homo sapiens
ccaggctctgccaggcccttga

SEQ ID NO: 7976141 - DNA, 22 bp, Homo sapiens
ccaggctctgccaggcccttga

SEQ ID NO: 7976142 - DNA, 22 bp, Homo sapiens
ccaggctctgcaaaatcaggct

SEQ ID NO: 7976143 - DNA, 22 bp, Homo sapiens
ccaggcctcacctgcccaccta

SEQ ID NO: 7976144 - DNA, 22 bp, Homo sapiens
ccaggcctcacctgcccaccta

SEQ ID NO: 7976145 - DNA, 22 bp, Homo sapiens
ccaggcctcacctgcccaccta

SEQ ID NO: 7976146 - DNA, 22 bp, Homo sapiens
ccaggcctagcccctgagggta

SEQ ID NO: 7976147 - DNA, 22 bp, Homo sapiens
ccaggcctagcccctgagggta

SEQ ID NO: 7976148 - DNA, 22 bp, Homo sapiens
ccaggcctcacctgcccaccta

SEQ ID NO: 7976149 - DNA, 22 bp, Homo sapiens
ccaggcctagcccctgagggta

SEQ ID NO: 7976150 - DNA, 22 bp, Homo sapiens
aggctccacggcaggatgctgt

SEQ ID NO: 7976151 - DNA, 22 bp, Homo sapiens
aggctccacggcaggatgctgt

SEQ ID NO: 7976152 - DNA, 22 bp, Homo sapiens
aggctccacggcaggatgctgt

SEQ ID NO: 7976153 - DNA, 22 bp, Homo sapiens
aggctccacggcaggatgctgt

SEQ ID NO: 7976154 - DNA, 22 bp, Homo sapiens
aggctccacggtcactggctct

SEQ ID NO: 7976155 - DNA, 22 bp, Homo sapiens
aggctccagtctgaaccttggg

SEQ ID NO: 7976156 - DNA, 22 bp, Homo sapiens
aggctccagtctgaaccttggg

SEQ ID NO: 7976157 - DNA, 22 bp, Homo sapiens
aggctccataccatctccggag

SEQ ID NO: 7976158 - DNA, 22 bp, Homo sapiens
aggctccataccatctccggag

SEQ ID NO: 7976159 - DNA, 22 bp, Homo sapiens
aggctccataccatctccggag

SEQ ID NO: 7976160 - DNA, 22 bp, Homo sapiens
aggctccataccatctccggag

SEQ ID NO: 7976161 - DNA, 22 bp, Homo sapiens
aggctccatgcaaaggctgttt

SEQ ID NO: 7976162 - DNA, 22 bp, Homo sapiens
aggctccatgcaaaggctgttt

SEQ ID NO: 7976163 - DNA, 22 bp, Homo sapiens
aggctccatgcaaaggctgttt

SEQ ID NO: 7976164 - DNA, 22 bp, Homo sapiens
aggctccattcatgtgaaggca

SEQ ID NO: 7976165 - DNA, 22 bp, Homo sapiens
aggctccattcatgtgaaggca

SEQ ID NO: 7976166 - DNA, 22 bp, Homo sapiens
aggctccatggttctccctcag

SEQ ID NO: 7976167 - DNA, 22 bp, Homo sapiens
aggctccatggttctccctcag

SEQ ID NO: 7976168 - DNA, 22 bp, Homo sapiens
aggctccatgcaaaggctgttt

SEQ ID NO: 7976169 - DNA, 22 bp, Homo sapiens
aggctccatgcaaaggctgttt

SEQ ID NO: 7976170 - DNA, 22 bp, Homo sapiens
aggctccatgcaaaggctgttt

SEQ ID NO: 7976171 - DNA, 22 bp, Homo sapiens
aggctccatgctaagcgatatg

SEQ ID NO: 7976172 - DNA, 22 bp, Homo sapiens
aggctccatgctaagcgatatg

SEQ ID NO: 7976173 - DNA, 22 bp, Homo sapiens
ccaggccctgctcctcacacca

SEQ ID NO: 7976174 - DNA, 22 bp, Homo sapiens
ccaggcccttgcaagtcccacc

SEQ ID NO: 7976175 - DNA, 22 bp, Homo sapiens
ccaggcccttgcaagtcccacc

SEQ ID NO: 7976176 - DNA, 22 bp, Homo sapiens
ccaggcctagcccctgagggta

SEQ ID NO: 7976177 - DNA, 22 bp, Homo sapiens
ccaggcctagcccctgagggta

SEQ ID NO: 7976178 - DNA, 22 bp, Homo sapiens
ccaggcctagcccctgagggta

SEQ ID NO: 7976179 - DNA, 22 bp, Homo sapiens
ccaggcctagcccctgagggta

SEQ ID NO: 7976180 - DNA, 22 bp, Homo sapiens
ccaggcccttgcaagtcccacc

SEQ ID NO: 7976181 - DNA, 22 bp, Homo sapiens
ccaggcctagcccctgagggta

SEQ ID NO: 7976182 - DNA, 22 bp, Homo sapiens
ccaggccctgcctgtggttcct

SEQ ID NO: 7976183 - DNA, 22 bp, Homo sapiens
ccaggccctgcctgtggttcct

SEQ ID NO: 7976184 - DNA, 22 bp, Homo sapiens
ccaggccctgctcctcacacca

SEQ ID NO: 7976185 - DNA, 22 bp, Homo sapiens
ccaggcccgttcccttctccag

SEQ ID NO: 7976186 - DNA, 22 bp, Homo sapiens
ccaggccctgctcctcacacca

SEQ ID NO: 7976187 - DNA, 22 bp, Homo sapiens
ccaggccctgctcctcacacca

SEQ ID NO: 7976188 - DNA, 22 bp, Homo sapiens
ccaggcccgttcccttctccag

SEQ ID NO: 7976189 - DNA, 22 bp, Homo sapiens
ccaggcccgttcccttctccag

SEQ ID NO: 7976190 - DNA, 22 bp, Homo sapiens
ccaggcccgttcccttctccag

SEQ ID NO: 7976191 - DNA, 22 bp, Homo sapiens
ccaggcccgttcccttctccag

SEQ ID NO: 7976192 - DNA, 22 bp, Homo sapiens
ccaggccctgcctgtggttcct

SEQ ID NO: 7976193 - DNA, 22 bp, Homo sapiens
aggcagtgagaaatagcaagat

SEQ ID NO: 7976194 - DNA, 22 bp, Homo sapiens
aggcagtgagaaatagcaagat

SEQ ID NO: 7976195 - DNA, 22 bp, Homo sapiens
aggcagtctatctctggagcct

SEQ ID NO: 7976196 - DNA, 22 bp, Homo sapiens
aggcagtgagaaatagcaagat

SEQ ID NO: 7976197 - DNA, 22 bp, Homo sapiens
aggcagtgagcagggtgtcatg

SEQ ID NO: 7976198 - DNA, 22 bp, Homo sapiens
aggcagtgagcagggtgtcatg

SEQ ID NO: 7976199 - DNA, 22 bp, Homo sapiens
aggcagtgagcagggtgtcatg

SEQ ID NO: 7976200 - DNA, 22 bp, Homo sapiens
aggcagtgagcagggtgtcatg

SEQ ID NO: 7976201 - DNA, 22 bp, Homo sapiens
aggcagtgagcagggtgtcatg

SEQ ID NO: 7976202 - DNA, 22 bp, Homo sapiens
aggcagtgagtgtgacttcaca

SEQ ID NO: 7976203 - DNA, 22 bp, Homo sapiens
aggcagtgagtgtgacttcaca

SEQ ID NO: 7976204 - DNA, 22 bp, Homo sapiens
aggcagtgagtgtgacttcaca

SEQ ID NO: 7976205 - DNA, 22 bp, Homo sapiens
aggcagtgatgagtcatgaata

SEQ ID NO: 7976206 - DNA, 22 bp, Homo sapiens
aggcagtgatgagtcatgaata

SEQ ID NO: 7976207 - DNA, 22 bp, Homo sapiens
aggcagtgcagagtcctcttct

SEQ ID NO: 7976208 - DNA, 22 bp, Homo sapiens
aggcagtgcatgcaaaggtcgg

SEQ ID NO: 7976209 - DNA, 22 bp, Homo sapiens
aggcagtgcagagtcctcttct

SEQ ID NO: 7976210 - DNA, 22 bp, Homo sapiens
aggcagtgcatgcaaaggtcgg

SEQ ID NO: 7976211 - DNA, 22 bp, Homo sapiens
aggcagtgcatgcaaaggtcgg

SEQ ID NO: 7976212 - DNA, 22 bp, Homo sapiens
aggcagtgcctggaccccagct

SEQ ID NO: 7976213 - DNA, 22 bp, Homo sapiens
aggcagtgcctggaccccagct

SEQ ID NO: 7976214 - DNA, 22 bp, Homo sapiens
aggcagtgcctggaccccagct

SEQ ID NO: 7976215 - DNA, 22 bp, Homo sapiens
aggcagtgctcaagacagcagc

SEQ ID NO: 7976216 - DNA, 22 bp, Homo sapiens
aggcagtgctcaagacagcagc

SEQ ID NO: 7976217 - DNA, 22 bp, Homo sapiens
aggcagtgctcaagacagcagc

SEQ ID NO: 7976218 - DNA, 22 bp, Homo sapiens
aggcagtgctcaagacagcagc

SEQ ID NO: 7976219 - DNA, 22 bp, Homo sapiens
aggcagtgctcaagacagcagc

SEQ ID NO: 7976220 - DNA, 22 bp, Homo sapiens
aggcagtggagctggaataggc

SEQ ID NO: 7976221 - DNA, 22 bp, Homo sapiens
aggcagtggagctggaataggc

SEQ ID NO: 7976222 - DNA, 22 bp, Homo sapiens
aggcagtggagctggaataggc

SEQ ID NO: 7976223 - DNA, 22 bp, Homo sapiens
aggcagtggatgtcaggaatgg

SEQ ID NO: 7976224 - DNA, 22 bp, Homo sapiens
aggcagtggagctggaataggc

SEQ ID NO: 7976225 - DNA, 22 bp, Homo sapiens
aggcagtggatgtcaggaatgg

SEQ ID NO: 7976226 - DNA, 22 bp, Homo sapiens
aggcagtggatgtcaggaatgg

SEQ ID NO: 7976227 - DNA, 22 bp, Homo sapiens
aggcagtggctgagaccagggg

SEQ ID NO: 7976228 - DNA, 22 bp, Homo sapiens
aggcagtggctgagaccagggg

SEQ ID NO: 7976229 - DNA, 22 bp, Homo sapiens
aggcagtggatgtcaggaatgg

SEQ ID NO: 7976230 - DNA, 22 bp, Homo sapiens
aggcagtggatgtcaggaatgg

SEQ ID NO: 7976231 - DNA, 22 bp, Homo sapiens
aggcagtggctgagaccagggg

SEQ ID NO: 7976232 - DNA, 22 bp, Homo sapiens
aggcagtggctgagaccagggg

SEQ ID NO: 7976233 - DNA, 22 bp, Homo sapiens
aggcagtggctgagaccagggg

SEQ ID NO: 7976234 - DNA, 22 bp, Homo sapiens
aggcagtggctgagaccagggg

SEQ ID NO: 7976235 - DNA, 22 bp, Homo sapiens
aggcagtggagctggaataggc

SEQ ID NO: 7976236 - DNA, 22 bp, Homo sapiens
aggcagtggagctggaataggc

SEQ ID NO: 7976237 - DNA, 22 bp, Homo sapiens
aggcagtggagaaggtttgtga

SEQ ID NO: 7976238 - DNA, 22 bp, Homo sapiens
aggcagtggagctggaataggc

SEQ ID NO: 7976239 - DNA, 22 bp, Homo sapiens
aggcagtggagctggaataggc

SEQ ID NO: 7976240 - DNA, 22 bp, Homo sapiens
aggcagtggaaggagaaagcaa

SEQ ID NO: 7976241 - DNA, 22 bp, Homo sapiens
aggcagtggaaggagaaagcaa

SEQ ID NO: 7976242 - DNA, 22 bp, Homo sapiens
aggcagtggaaggagaaagcaa

SEQ ID NO: 7976243 - DNA, 22 bp, Homo sapiens
aggcagtggaaggagaaagcaa

SEQ ID NO: 7976244 - DNA, 22 bp, Homo sapiens
aggcagtgctgtgccctgaacc

SEQ ID NO: 7976245 - DNA, 22 bp, Homo sapiens
aggcagtggaaggagaaagcaa

SEQ ID NO: 7976246 - DNA, 22 bp, Homo sapiens
aggcagtgctcaagacagcagc

SEQ ID NO: 7976247 - DNA, 22 bp, Homo sapiens
aggcagtgctgtgccctgaacc

SEQ ID NO: 7976248 - DNA, 22 bp, Homo sapiens
aggcagccctgtgctggatgct

SEQ ID NO: 7976249 - DNA, 22 bp, Homo sapiens
aggcagccctgtgctggatgct

SEQ ID NO: 7976250 - DNA, 22 bp, Homo sapiens
aggcagccctgtgctggatgct

SEQ ID NO: 7976251 - DNA, 22 bp, Homo sapiens
aggcagccctgtgctggatgct

SEQ ID NO: 7976252 - DNA, 22 bp, Homo sapiens
aggcagcccacaggacacagga

SEQ ID NO: 7976253 - DNA, 22 bp, Homo sapiens
aggcagcccacaggacacagga

SEQ ID NO: 7976254 - DNA, 22 bp, Homo sapiens
aggcagcccacaggacacagga

SEQ ID NO: 7976255 - DNA, 22 bp, Homo sapiens
aggcagccctgtgctggatgct

SEQ ID NO: 7976256 - DNA, 22 bp, Homo sapiens
aggcagccctgtgctggatgct

SEQ ID NO: 7976257 - DNA, 22 bp, Homo sapiens
aggcagcctatggggagctcag

SEQ ID NO: 7976258 - DNA, 22 bp, Homo sapiens
aggcagcctatggggagctcag

SEQ ID NO: 7976259 - DNA, 22 bp, Homo sapiens
aggcagcctatggggagctcag

SEQ ID NO: 7976260 - DNA, 22 bp, Homo sapiens
aggcagcctatggggagctcag

SEQ ID NO: 7976261 - DNA, 22 bp, Homo sapiens
aggcagcctatggggagctcag

SEQ ID NO: 7976262 - DNA, 22 bp, Homo sapiens
aggcagcctatggggagctcag

SEQ ID NO: 7976263 - DNA, 22 bp, Homo sapiens
aggcagcctggtttgaatggaa

SEQ ID NO: 7976264 - DNA, 22 bp, Homo sapiens
aggcagcctggtttgaatggaa

SEQ ID NO: 7976265 - DNA, 22 bp, Homo sapiens
aggcagccatctgcaggaagga

SEQ ID NO: 7976266 - DNA, 22 bp, Homo sapiens
aggcagccatctgcaggaagga

SEQ ID NO: 7976267 - DNA, 22 bp, Homo sapiens
aggcagccatctgcaggaagga

SEQ ID NO: 7976268 - DNA, 22 bp, Homo sapiens
aggcagccatctgcaggaagga

SEQ ID NO: 7976269 - DNA, 22 bp, Homo sapiens
aggcagccatctgcaggaagga

SEQ ID NO: 7976270 - DNA, 22 bp, Homo sapiens
aggcagccatccaggaggctca

SEQ ID NO: 7976271 - DNA, 22 bp, Homo sapiens
aggcagccatccaggaggctca

SEQ ID NO: 7976272 - DNA, 22 bp, Homo sapiens
aggcagccatccaggaggctca

SEQ ID NO: 7976273 - DNA, 22 bp, Homo sapiens
aggcagccatccaggaggctca

SEQ ID NO: 7976274 - DNA, 22 bp, Homo sapiens
aggcagccatccaggaggctca

SEQ ID NO: 7976275 - DNA, 22 bp, Homo sapiens
aggcagcccacaggacacagga

SEQ ID NO: 7976276 - DNA, 22 bp, Homo sapiens
aggcagcccacaggacacagga

SEQ ID NO: 7976277 - DNA, 22 bp, Homo sapiens
aggcagccattaccaagggcat

SEQ ID NO: 7976278 - DNA, 22 bp, Homo sapiens
aggcagcccacaggacacagga

SEQ ID NO: 7976279 - DNA, 22 bp, Homo sapiens
aggcagccattaccaagggcat

SEQ ID NO: 7976280 - DNA, 22 bp, Homo sapiens
aggcagccattaccaagggcat

SEQ ID NO: 7976281 - DNA, 22 bp, Homo sapiens
aggcagccattaccaagggcat

SEQ ID NO: 7976282 - DNA, 22 bp, Homo sapiens
aggcagccatctgcaggaagga

SEQ ID NO: 7976283 - DNA, 23 bp, Homo sapiens
aggcaggtttgggctcttcttgt

SEQ ID NO: 7976284 - DNA, 23 bp, Homo sapiens
aggcaggtttgggctcttcttgt

SEQ ID NO: 7976285 - DNA, 22 bp, Homo sapiens
aggcaggtttcccggctgtcaa

SEQ ID NO: 7976286 - DNA, 22 bp, Homo sapiens
aggcaggtttactcttatttgg

SEQ ID NO: 7976287 - DNA, 22 bp, Homo sapiens
aggcagtccccaggggtgttgc

SEQ ID NO: 7976288 - DNA, 19 bp, Homo sapiens
aggcagtcattggaatata

SEQ ID NO: 7976289 - DNA, 22 bp, Homo sapiens
aggcagtctatctctggagcct

SEQ ID NO: 7976290 - DNA, 22 bp, Homo sapiens
aggcagtcagccctgctagggt

SEQ ID NO: 7976291 - DNA, 23 bp, Homo sapiens
aggcaggtttgggctcttcttgt

SEQ ID NO: 7976292 - DNA, 22 bp, Homo sapiens
aggcaggttggtgagaagactg

SEQ ID NO: 7976293 - DNA, 22 bp, Homo sapiens
aggcaggttggtgagaagactg

SEQ ID NO: 7976294 - DNA, 18 bp, Homo sapiens
aggcaggtgctggaagtc

SEQ ID NO: 7976295 - DNA, 18 bp, Homo sapiens
aggcaggtgctaatattt

SEQ ID NO: 7976296 - DNA, 22 bp, Homo sapiens
aggcagcctttagacagtctgc

SEQ ID NO: 7976297 - DNA, 22 bp, Homo sapiens
aggcagcctttagacagtctgc

SEQ ID NO: 7976298 - DNA, 22 bp, Homo sapiens
aggcagcctggtttgaatggaa

SEQ ID NO: 7976299 - DNA, 22 bp, Homo sapiens
aggcagcctggtttgaatggaa

SEQ ID NO: 7976300 - DNA, 22 bp, Homo sapiens
aggcagcctggtttgaatggaa

SEQ ID NO: 7976301 - DNA, 22 bp, Homo sapiens
aggcagcctttttggaaacata

SEQ ID NO: 7976302 - DNA, 22 bp, Homo sapiens
aggcagcctttagacagtctgc

SEQ ID NO: 7976303 - DNA, 22 bp, Homo sapiens
aggcagcctttttggaaacata

SEQ ID NO: 7976304 - DNA, 22 bp, Homo sapiens
ccactgctcggcctcaaagaag

SEQ ID NO: 7976305 - DNA, 22 bp, Homo sapiens
ccactgctcctgaccaaggtca

SEQ ID NO: 7976306 - DNA, 21 bp, Homo sapiens
ccactgctcttccctagggcc

SEQ ID NO: 7976307 - DNA, 22 bp, Homo sapiens
ccactggagaacgtctgatgaa

SEQ ID NO: 7976308 - DNA, 22 bp, Homo sapiens
ccactggagaacgtctgatgaa

SEQ ID NO: 7976309 - DNA, 23 bp, Homo sapiens
ccactggagaaagtggcaggtgg

SEQ ID NO: 7976310 - DNA, 23 bp, Homo sapiens
ccactggagaaagtggcaggtgg

SEQ ID NO: 7976311 - DNA, 23 bp, Homo sapiens
ccactggagaaagtggcaggtgg

SEQ ID NO: 7976312 - DNA, 22 bp, Homo sapiens
ccactggaagatgctgaggtca

SEQ ID NO: 7976313 - DNA, 22 bp, Homo sapiens
ccactggaagatgctgaggtca

SEQ ID NO: 7976314 - DNA, 22 bp, Homo sapiens
ccactggaaatgacacgtcact

SEQ ID NO: 7976315 - DNA, 22 bp, Homo sapiens
ccactggaaatgacacgtcact

SEQ ID NO: 7976316 - DNA, 22 bp, Homo sapiens
ccactggaaatgacacgtcact

SEQ ID NO: 7976317 - DNA, 23 bp, Homo sapiens
ccactgctttcattttgtcatgg

SEQ ID NO: 7976318 - DNA, 22 bp, Homo sapiens
ccactggcatccagctgccatc

SEQ ID NO: 7976319 - DNA, 22 bp, Homo sapiens
ccactggcatccagctgccatc

SEQ ID NO: 7976320 - DNA, 22 bp, Homo sapiens
ccactggcatccagctgccatc

SEQ ID NO: 7976321 - DNA, 22 bp, Homo sapiens
ccactggcagttggctagcctt

SEQ ID NO: 7976322 - DNA, 22 bp, Homo sapiens
ccactggcatccagctgccatc

SEQ ID NO: 7976323 - DNA, 22 bp, Homo sapiens
ccactggcagttggctagcctt

SEQ ID NO: 7976324 - DNA, 22 bp, Homo sapiens
ccactggattttcttactgtag

SEQ ID NO: 7976325 - DNA, 22 bp, Homo sapiens
ccactggattttcttactgtag

SEQ ID NO: 7976326 - DNA, 22 bp, Homo sapiens
ccactggagatgtcagacaggt

SEQ ID NO: 7976327 - DNA, 22 bp, Homo sapiens
ccactggagatgtcagacaggt

SEQ ID NO: 7976328 - DNA, 22 bp, Homo sapiens
ccactggagactggtctctgtg

SEQ ID NO: 7976329 - DNA, 22 bp, Homo sapiens
ccactggagactggtctctgtg

SEQ ID NO: 7976330 - DNA, 22 bp, Homo sapiens
ccactggagactggtctctgtg

SEQ ID NO: 7976331 - DNA, 22 bp, Homo sapiens
aggcattctagaagtagaagta

SEQ ID NO: 7976332 - DNA, 22 bp, Homo sapiens
aggcatttggctgtcatttgta

SEQ ID NO: 7976333 - DNA, 22 bp, Homo sapiens
aggcatttaaagatgtaagact

SEQ ID NO: 7976334 - DNA, 22 bp, Homo sapiens
aggcatttcctatgggcagaga

SEQ ID NO: 7976335 - DNA, 22 bp, Homo sapiens
aggcatttgagtccatgggtga

SEQ ID NO: 7976336 - DNA, 22 bp, Homo sapiens
aggcatttgatgaagattggct

SEQ ID NO: 7976337 - DNA, 22 bp, Homo sapiens
aggcatgtgctgtttgtctcca

SEQ ID NO: 7976338 - DNA, 22 bp, Homo sapiens
aggcatgtgaccctggactcag

SEQ ID NO: 7976339 - DNA, 22 bp, Homo sapiens
aggcattagttgtaaagtattg

SEQ ID NO: 7976340 - DNA, 22 bp, Homo sapiens
aggcattctagaagtagaagta

SEQ ID NO: 7976341 - DNA, 22 bp, Homo sapiens
aggcattattagatgatgttat

SEQ ID NO: 7976342 - DNA, 22 bp, Homo sapiens
aggcattattagatgatgttat

SEQ ID NO: 7976343 - DNA, 19 bp, Homo sapiens
ccactggggctccacatta

SEQ ID NO: 7976344 - DNA, 19 bp, Homo sapiens
ccactggggctccacatta

SEQ ID NO: 7976345 - DNA, 22 bp, Homo sapiens
ccactgggcgtttctgtccaat

SEQ ID NO: 7976346 - DNA, 19 bp, Homo sapiens
ccactggggctccacatta

SEQ ID NO: 7976347 - DNA, 22 bp, Homo sapiens
ccactgggcgtttctgtccaat

SEQ ID NO: 7976348 - DNA, 22 bp, Homo sapiens
ccactgggcgtttctgtccaat

SEQ ID NO: 7976349 - DNA, 22 bp, Homo sapiens
ccactgggcgtttctgtccaat

SEQ ID NO: 7976350 - DNA, 22 bp, Homo sapiens
ccactgggcgtttctgtccaat

SEQ ID NO: 7976351 - DNA, 22 bp, Homo sapiens
ccactggcttttcctaggtctc

SEQ ID NO: 7976352 - DNA, 22 bp, Homo sapiens
aggcatggcatggggcagatgt

SEQ ID NO: 7976353 - DNA, 22 bp, Homo sapiens
aggcatggcatggggcagatgt

SEQ ID NO: 7976354 - DNA, 22 bp, Homo sapiens
aggcatctatacattatgttca

SEQ ID NO: 7976355 - DNA, 22 bp, Homo sapiens
aggcatctctctgcttctgagc

SEQ ID NO: 7976356 - DNA, 22 bp, Homo sapiens
aggcatctatacattatgttca

SEQ ID NO: 7976357 - DNA, 20 bp, Homo sapiens
aggcatctgagtcacatctt

SEQ ID NO: 7976358 - DNA, 22 bp, Homo sapiens
aggcatctctctgcttctgagc

SEQ ID NO: 7976359 - DNA, 22 bp, Homo sapiens
aggcatctaacagagatcttta

SEQ ID NO: 7976360 - DNA, 21 bp, Homo sapiens
aggcatctaaagagagtagac

SEQ ID NO: 7976361 - DNA, 21 bp, Homo sapiens
aggcatctaaagagagtagac

SEQ ID NO: 7976362 - DNA, 22 bp, Homo sapiens
aggcatctgagtttgcaagctt

SEQ ID NO: 7976363 - DNA, 20 bp, Homo sapiens
aggcatctgagtcacatctt

SEQ ID NO: 7976364 - DNA, 22 bp, Homo sapiens
aggcatctgagatttttatact

SEQ ID NO: 7976365 - DNA, 22 bp, Homo sapiens
aggcatctgctgcccttctgga

SEQ ID NO: 7976366 - DNA, 22 bp, Homo sapiens
aggcatctgctgcccttctgga

SEQ ID NO: 7976367 - DNA, 22 bp, Homo sapiens
aggcatctgcagagcttggtga

SEQ ID NO: 7976368 - DNA, 22 bp, Homo sapiens
aggcatgactttggctgaagaa

SEQ ID NO: 7976369 - DNA, 22 bp, Homo sapiens
aggcatgactttggctgaagaa

SEQ ID NO: 7976370 - DNA, 23 bp, Homo sapiens
aggcatcttctgagttaagagca

SEQ ID NO: 7976371 - DNA, 22 bp, Homo sapiens
aggcatctgctgcccttctgga

SEQ ID NO: 7976372 - DNA, 22 bp, Homo sapiens
aggcatgactttggctgaagaa

SEQ ID NO: 7976373 - DNA, 21 bp, Homo sapiens
aggcatgagccctgcatggac

SEQ ID NO: 7976374 - DNA, 22 bp, Homo sapiens
aggcatgactttggctgaagaa

SEQ ID NO: 7976375 - DNA, 21 bp, Homo sapiens
aggcatgagccctgcatggac

SEQ ID NO: 7976376 - DNA, 21 bp, Homo sapiens
aggcatgagccctgcatggac

SEQ ID NO: 7976377 - DNA, 22 bp, Homo sapiens
aggcatgatgtgcagtggcaaa

SEQ ID NO: 7976378 - DNA, 22 bp, Homo sapiens
aggcatgatgtgcagtggcaaa

SEQ ID NO: 7976379 - DNA, 22 bp, Homo sapiens
ccactgctagagatgcatcccc

SEQ ID NO: 7976380 - DNA, 22 bp, Homo sapiens
aggcatgatgtgcagtggcaaa

SEQ ID NO: 7976381 - DNA, 17 bp, Homo sapiens
aggcatgaggcatcact

SEQ ID NO: 7976382 - DNA, 23 bp, Homo sapiens
aggcagtgggggccactttgctt

SEQ ID NO: 7976383 - DNA, 23 bp, Homo sapiens
aggcagtgggggccactttgctt

SEQ ID NO: 7976384 - DNA, 22 bp, Homo sapiens
aggcagtggcttttgttgtgtt

SEQ ID NO: 7976385 - DNA, 22 bp, Homo sapiens
aggcagtggcttttgttgtgtt

SEQ ID NO: 7976386 - DNA, 22 bp, Homo sapiens
aggcagtggcttttgttgtgtt

SEQ ID NO: 7976387 - DNA, 22 bp, Homo sapiens
aggcagtggctgagaccagggg

SEQ ID NO: 7976388 - DNA, 22 bp, Homo sapiens
aggcagtggcttttgttgtgtt

SEQ ID NO: 7976389 - DNA, 23 bp, Homo sapiens
aggcagtgggggccactttgctt

SEQ ID NO: 7976390 - DNA, 23 bp, Homo sapiens
aggcagtggtggtaacatgtcaa

SEQ ID NO: 7976391 - DNA, 22 bp, Homo sapiens
aggcagttctcgtgtgtgtccc

SEQ ID NO: 7976392 - DNA, 22 bp, Homo sapiens
aggcagttctcgtgtgtgtccc

SEQ ID NO: 7976393 - DNA, 23 bp, Homo sapiens
aggcagtggtggtaacatgtcaa

SEQ ID NO: 7976394 - DNA, 21 bp, Homo sapiens
aggcagttgagcatgttatga

SEQ ID NO: 7976395 - DNA, 21 bp, Homo sapiens
aggcagttgagcatgttatga

SEQ ID NO: 7976396 - DNA, 21 bp, Homo sapiens
aggcagttgagcatgttatga

SEQ ID NO: 7976397 - DNA, 22 bp, Homo sapiens
aggcagttgagtggctttttca

SEQ ID NO: 7976398 - DNA, 22 bp, Homo sapiens
aggcagtttatccccagagcct

SEQ ID NO: 7976399 - DNA, 22 bp, Homo sapiens
aggcagtttaggcagcgattta

SEQ ID NO: 7976400 - DNA, 22 bp, Homo sapiens
aggcagttgttgctgagcagct

SEQ ID NO: 7976401 - DNA, 22 bp, Homo sapiens
aggcagttggtcattgctcttt

SEQ ID NO: 7976402 - DNA, 22 bp, Homo sapiens
aggcagttgttgctgagcagct

SEQ ID NO: 7976403 - DNA, 22 bp, Homo sapiens
aggcagttgtagagagggctct

SEQ ID NO: 7976404 - DNA, 22 bp, Homo sapiens
aggcagttgttgctgagcagct

SEQ ID NO: 7976405 - DNA, 20 bp, Homo sapiens
aggcagtttcaattttgtta

SEQ ID NO: 7976406 - DNA, 22 bp, Homo sapiens
aggcagtttctgggacagcata

SEQ ID NO: 7976407 - DNA, 22 bp, Homo sapiens
aggcagtttatccccagagcct

SEQ ID NO: 7976408 - DNA, 22 bp, Homo sapiens
aggcataaccttttatctggat

SEQ ID NO: 7976409 - DNA, 22 bp, Homo sapiens
aggcataggacatctatgtcat

SEQ ID NO: 7976410 - DNA, 22 bp, Homo sapiens
aggcataaccttttatctggat

SEQ ID NO: 7976411 - DNA, 22 bp, Homo sapiens
aggcataaccttttatctggat

SEQ ID NO: 7976412 - DNA, 22 bp, Homo sapiens
aggcatccatggtggtcgctga

SEQ ID NO: 7976413 - DNA, 22 bp, Homo sapiens
aggcatcaggagtatagccaga

SEQ ID NO: 7976414 - DNA, 22 bp, Homo sapiens
aggcatcaggagtatagccaga

SEQ ID NO: 7976415 - DNA, 22 bp, Homo sapiens
aggcatatgattgtaaccttta

SEQ ID NO: 7976416 - DNA, 22 bp, Homo sapiens
aggcataggacatctatgtcat

SEQ ID NO: 7976417 - DNA, 22 bp, Homo sapiens
aggcattttgttcaagatgaca

SEQ ID NO: 7976418 - DNA, 22 bp, Homo sapiens
aggcattttgttcaagatgaca

SEQ ID NO: 7976419 - DNA, 22 bp, Homo sapiens
aggcatttttattgtccttaaa

SEQ ID NO: 7976420 - DNA, 22 bp, Homo sapiens
aggcattttctgtatggacaga

SEQ ID NO: 7976421 - DNA, 22 bp, Homo sapiens
aggcattttaagatgctctgca

SEQ ID NO: 7976422 - DNA, 22 bp, Homo sapiens
aggcattttaagatgctctgca

SEQ ID NO: 7976423 - DNA, 22 bp, Homo sapiens
aggcatttggctgtcatttgta

SEQ ID NO: 7976424 - DNA, 20 bp, Homo sapiens
aggccaaacccagcgcgccc

SEQ ID NO: 7976425 - DNA, 22 bp, Homo sapiens
aggcatttttgttaatctttgg

SEQ ID NO: 7976426 - DNA, 22 bp, Homo sapiens
aggcatttttgttaatctttgg

SEQ ID NO: 7976427 - DNA, 22 bp, Homo sapiens
aggcatttttgttaatctttgg

SEQ ID NO: 7976428 - DNA, 22 bp, Homo sapiens
aggccaaagcacagagctggaa

SEQ ID NO: 7976429 - DNA, 22 bp, Homo sapiens
aggccaaaccggatggaaaagg

SEQ ID NO: 7976430 - DNA, 22 bp, Homo sapiens
aggccaaatgtgtataaaacat

SEQ ID NO: 7976431 - DNA, 22 bp, Homo sapiens
aggccaagattttggatcagct

SEQ ID NO: 7976432 - DNA, 22 bp, Homo sapiens
aggccaagattttggatcagct

SEQ ID NO: 7976433 - DNA, 22 bp, Homo sapiens
aggccaagattttggatcagct

SEQ ID NO: 7976434 - DNA, 22 bp, Homo sapiens
aggccaaatgtgtataaaacat

SEQ ID NO: 7976435 - DNA, 22 bp, Homo sapiens
aggccaaatgtgtataaaacat

SEQ ID NO: 7976436 - DNA, 22 bp, Homo sapiens
aggccaaagcacagagctggaa

SEQ ID NO: 7976437 - DNA, 22 bp, Homo sapiens
aggccaagctcccagagaagct

SEQ ID NO: 7976438 - DNA, 22 bp, Homo sapiens
aggccaagattttggatcagct

SEQ ID NO: 7976439 - DNA, 22 bp, Homo sapiens
aggccaagattttggatcagct

SEQ ID NO: 7976440 - DNA, 22 bp, Homo sapiens
aggccaagctcccagagaagct

SEQ ID NO: 7976441 - DNA, 22 bp, Homo sapiens
aggccaagctcccagagaagct

SEQ ID NO: 7976442 - DNA, 22 bp, Homo sapiens
aggccaagctcccagagaagct

SEQ ID NO: 7976443 - DNA, 22 bp, Homo sapiens
aggccaagtgctgggacaggtg

SEQ ID NO: 7976444 - DNA, 22 bp, Homo sapiens
aggccaagtgctgggacaggtg

SEQ ID NO: 7976445 - DNA, 22 bp, Homo sapiens
aggccaagtgctgggacaggtg

SEQ ID NO: 7976446 - DNA, 22 bp, Homo sapiens
aggccaagtgctgggacaggtg

SEQ ID NO: 7976447 - DNA, 22 bp, Homo sapiens
aggccaagtgctgggacaggtg

SEQ ID NO: 7976448 - DNA, 22 bp, Homo sapiens
aggccaagtgaacaatgctagt

SEQ ID NO: 7976449 - DNA, 22 bp, Homo sapiens
aggccaagtgaacaatgctagt

SEQ ID NO: 7976450 - DNA, 22 bp, Homo sapiens
aggccaagtgctgggacaggtg

SEQ ID NO: 7976451 - DNA, 22 bp, Homo sapiens
aggccaagtgctgggacaggtg

SEQ ID NO: 7976452 - DNA, 22 bp, Homo sapiens
aggccaagtgctgggacaggtg

SEQ ID NO: 7976453 - DNA, 22 bp, Homo sapiens
aggccaagttacttgggaaagc

SEQ ID NO: 7976454 - DNA, 22 bp, Homo sapiens
aggccaagttacttgggaaagc

SEQ ID NO: 7976455 - DNA, 22 bp, Homo sapiens
aggccaagttacttgggaaagc

SEQ ID NO: 7976456 - DNA, 22 bp, Homo sapiens
aggccaagttacttgggaaagc

SEQ ID NO: 7976457 - DNA, 22 bp, Homo sapiens
aggccacaaccaccctgtgccc

SEQ ID NO: 7976458 - DNA, 22 bp, Homo sapiens
aggccaattgctccccactccc

SEQ ID NO: 7976459 - DNA, 22 bp, Homo sapiens
aggccaagtagctagcattgaa

SEQ ID NO: 7976460 - DNA, 22 bp, Homo sapiens
aggccaagtagctagcattgaa

SEQ ID NO: 7976461 - DNA, 22 bp, Homo sapiens
aggccaagtagccgctgtccta

SEQ ID NO: 7976462 - DNA, 22 bp, Homo sapiens
aggccaagtagccgctgtccta

SEQ ID NO: 7976463 - DNA, 22 bp, Homo sapiens
aggccaagtagctagcattgaa

SEQ ID NO: 7976464 - DNA, 22 bp, Homo sapiens
aggccaagtagctagcattgaa

SEQ ID NO: 7976465 - DNA, 22 bp, Homo sapiens
aggccaagtgaacaatgctagt

SEQ ID NO: 7976466 - DNA, 22 bp, Homo sapiens
aggccaagtgaacaatgctagt

SEQ ID NO: 7976467 - DNA, 22 bp, Homo sapiens
aggccaagggcaaagcggagag

SEQ ID NO: 7976468 - DNA, 22 bp, Homo sapiens
aggccaagggcaaagcggagag

SEQ ID NO: 7976469 - DNA, 22 bp, Homo sapiens
aggccaagctcccagagaagct

SEQ ID NO: 7976470 - DNA, 22 bp, Homo sapiens
aggccaagggcaaagcggagag

SEQ ID NO: 7976471 - DNA, 22 bp, Homo sapiens
aggccaagtagccgctgtccta

SEQ ID NO: 7976472 - DNA, 22 bp, Homo sapiens
aggccaagggcaaagcggagag

SEQ ID NO: 7976473 - DNA, 22 bp, Homo sapiens
aggccaagtagccgctgtccta

SEQ ID NO: 7976474 - DNA, 22 bp, Homo sapiens
aggccagctgttactagagcca

SEQ ID NO: 7976475 - DNA, 22 bp, Homo sapiens
aggccagctgttactagagcca

SEQ ID NO: 7976476 - DNA, 22 bp, Homo sapiens
aggccagctgttactagagcca

SEQ ID NO: 7976477 - DNA, 22 bp, Homo sapiens
aggccagctgttactagagcca

SEQ ID NO: 7976478 - DNA, 22 bp, Homo sapiens
aggccagctgttactagagcca

SEQ ID NO: 7976479 - DNA, 22 bp, Homo sapiens
aggccagctgccacccggtccg

SEQ ID NO: 7976480 - DNA, 22 bp, Homo sapiens
aggccagctgccacccggtccg

SEQ ID NO: 7976481 - DNA, 22 bp, Homo sapiens
aggccagctgccacccggtccg

SEQ ID NO: 7976482 - DNA, 22 bp, Homo sapiens
aggccagctgttactagagcca

SEQ ID NO: 7976483 - DNA, 22 bp, Homo sapiens
aggccagctgttactagagcca

SEQ ID NO: 7976484 - DNA, 22 bp, Homo sapiens
aggccagctgttactagagcca

SEQ ID NO: 7976485 - DNA, 22 bp, Homo sapiens
aggccagcttccagaggggcag

SEQ ID NO: 7976486 - DNA, 22 bp, Homo sapiens
aggccagctgttactagagcca

SEQ ID NO: 7976487 - DNA, 22 bp, Homo sapiens
aggccagcttccagaggggcag

SEQ ID NO: 7976488 - DNA, 22 bp, Homo sapiens
aggccagcttccagaggggcag

SEQ ID NO: 7976489 - DNA, 22 bp, Homo sapiens
aggccagctcaccctggctcct

SEQ ID NO: 7976490 - DNA, 22 bp, Homo sapiens
aggccagctcaccctggctcct

SEQ ID NO: 7976491 - DNA, 22 bp, Homo sapiens
aggccagctcaccctggctcct

SEQ ID NO: 7976492 - DNA, 22 bp, Homo sapiens
aggccagctcaccctggctcct

SEQ ID NO: 7976493 - DNA, 22 bp, Homo sapiens
aggccagctcaccctggctcct

SEQ ID NO: 7976494 - DNA, 22 bp, Homo sapiens
aggccagctcaccctggctcct

SEQ ID NO: 7976495 - DNA, 22 bp, Homo sapiens
aggccagctctacccttggact

SEQ ID NO: 7976496 - DNA, 22 bp, Homo sapiens
aggccagctgccacccggtccg

SEQ ID NO: 7976497 - DNA, 22 bp, Homo sapiens
aggccagctctacccttggact

SEQ ID NO: 7976498 - DNA, 22 bp, Homo sapiens
aggccagctgccacccggtccg

SEQ ID NO: 7976499 - DNA, 22 bp, Homo sapiens
aggccagctctacccttggact

SEQ ID NO: 7976500 - DNA, 22 bp, Homo sapiens
aggccagctctacccttggact

SEQ ID NO: 7976501 - DNA, 22 bp, Homo sapiens
aggccagcctcaggcagggacc

SEQ ID NO: 7976502 - DNA, 22 bp, Homo sapiens
aggccagcctcaggcagggacc

SEQ ID NO: 7976503 - DNA, 22 bp, Homo sapiens
aggccagcaagaaagagagtct

SEQ ID NO: 7976504 - DNA, 22 bp, Homo sapiens
aggccagcaagaaagagagtct

SEQ ID NO: 7976505 - DNA, 22 bp, Homo sapiens
aggccagcaagaaagagagtct

SEQ ID NO: 7976506 - DNA, 22 bp, Homo sapiens
aggccagatgtcgggctagaag

SEQ ID NO: 7976507 - DNA, 22 bp, Homo sapiens
aggccacaagaaaatgcttcat

SEQ ID NO: 7976508 - DNA, 21 bp, Homo sapiens
aggccaagttggatttcttca

SEQ ID NO: 7976509 - DNA, 22 bp, Homo sapiens
aggccacaaccaccctgtgccc

SEQ ID NO: 7976510 - DNA, 22 bp, Homo sapiens
aggccacaagaaaatgcttcat

SEQ ID NO: 7976511 - DNA, 22 bp, Homo sapiens
aggccagcgctgctagctcccg

SEQ ID NO: 7976512 - DNA, 22 bp, Homo sapiens
aggccagcgctgctagctcccg

SEQ ID NO: 7976513 - DNA, 22 bp, Homo sapiens
aggccagcgctgctagctcccg

SEQ ID NO: 7976514 - DNA, 22 bp, Homo sapiens
aggccagctatgactctgctcc

SEQ ID NO: 7976515 - DNA, 22 bp, Homo sapiens
aggccagctatgactctgctcc

SEQ ID NO: 7976516 - DNA, 22 bp, Homo sapiens
aggccagctatgactctgctcc

SEQ ID NO: 7976517 - DNA, 22 bp, Homo sapiens
aggccagcgctgctagctcccg

SEQ ID NO: 7976518 - DNA, 22 bp, Homo sapiens
aggccagccttgtaaatgcctc

SEQ ID NO: 7976519 - DNA, 22 bp, Homo sapiens
aggccagcctgcccaaagctgc

SEQ ID NO: 7976520 - DNA, 22 bp, Homo sapiens
aggccagccttgtaaatgcctc

SEQ ID NO: 7976521 - DNA, 23 bp, Homo sapiens
aggccagcgcagacaccgagcac

SEQ ID NO: 7976522 - DNA, 23 bp, Homo sapiens
aggccagcgcagacaccgagcac

SEQ ID NO: 7976523 - DNA, 22 bp, Homo sapiens
aggccagcgctgctagctcccg

SEQ ID NO: 7976524 - DNA, 22 bp, Homo sapiens
aggccaggatagcatggatcag

SEQ ID NO: 7976525 - DNA, 22 bp, Homo sapiens
aggccaggatagcatggatcag

SEQ ID NO: 7976526 - DNA, 22 bp, Homo sapiens
aggccaggatagcatggatcag

SEQ ID NO: 7976527 - DNA, 22 bp, Homo sapiens
aggccaggatagcatggatcag

SEQ ID NO: 7976528 - DNA, 22 bp, Homo sapiens
aggcccagctgggccaggaaca

SEQ ID NO: 7976529 - DNA, 22 bp, Homo sapiens
aggccaggatagcatggatcag

SEQ ID NO: 7976530 - DNA, 22 bp, Homo sapiens
aggcccagctgggccaggaaca

SEQ ID NO: 7976531 - DNA, 22 bp, Homo sapiens
aggcccagctgggccaggaaca

SEQ ID NO: 7976532 - DNA, 22 bp, Homo sapiens
aggcccagctgggccaggaaca

SEQ ID NO: 7976533 - DNA, 22 bp, Homo sapiens
aggcccagctgggccaggaaca

SEQ ID NO: 7976534 - DNA, 22 bp, Homo sapiens
aggcccagtagtcgacggcgct

SEQ ID NO: 7976535 - DNA, 22 bp, Homo sapiens
aggcccagtagtcgacggcgct

SEQ ID NO: 7976536 - DNA, 22 bp, Homo sapiens
aggcccagtagtgctgccttta

SEQ ID NO: 7976537 - DNA, 22 bp, Homo sapiens
aggcccagtagtgctgccttta

SEQ ID NO: 7976538 - DNA, 22 bp, Homo sapiens
aggcccagtagtgctgccttta

SEQ ID NO: 7976539 - DNA, 20 bp, Homo sapiens
aggcccagtgaatatattgc

SEQ ID NO: 7976540 - DNA, 22 bp, Homo sapiens
aggcccagtcctctgccgtctg

SEQ ID NO: 7976541 - DNA, 22 bp, Homo sapiens
aggcccagtcctctgccgtctg

SEQ ID NO: 7976542 - DNA, 22 bp, Homo sapiens
aggcccagtcctctgccgtctg

SEQ ID NO: 7976543 - DNA, 22 bp, Homo sapiens
aggcccagtgccattagttttg

SEQ ID NO: 7976544 - DNA, 22 bp, Homo sapiens
aggcccagtgtggcttcctgga

SEQ ID NO: 7976545 - DNA, 22 bp, Homo sapiens
aggcccagtagtgctgccttta

SEQ ID NO: 7976546 - DNA, 22 bp, Homo sapiens
aggcccagtagtgctgccttta

SEQ ID NO: 7976547 - DNA, 22 bp, Homo sapiens
aggcccagtcctctgccgtctg

SEQ ID NO: 7976548 - DNA, 22 bp, Homo sapiens
aggcccagtagtgctgccttta

SEQ ID NO: 7976549 - DNA, 22 bp, Homo sapiens
aggcccagtagtgctgccttta

SEQ ID NO: 7976550 - DNA, 22 bp, Homo sapiens
aggcccagtcctctgccgtctg

SEQ ID NO: 7976551 - DNA, 20 bp, Homo sapiens
aggccaggaaatgtagttct

SEQ ID NO: 7976552 - DNA, 20 bp, Homo sapiens
aggccaggaaatgtagttct

SEQ ID NO: 7976553 - DNA, 20 bp, Homo sapiens
aggccaggaaatgtagttct

SEQ ID NO: 7976554 - DNA, 20 bp, Homo sapiens
aggccaggaaatgtagttct

SEQ ID NO: 7976555 - DNA, 20 bp, Homo sapiens
aggccaggaaatgtagttct

SEQ ID NO: 7976556 - DNA, 22 bp, Homo sapiens
aggccaggaatccttgtcccag

SEQ ID NO: 7976557 - DNA, 22 bp, Homo sapiens
aggccaggaatccttgtcccag

SEQ ID NO: 7976558 - DNA, 20 bp, Homo sapiens
aggccaggaaatgtagttct

SEQ ID NO: 7976559 - DNA, 22 bp, Homo sapiens
aggccagcttccagaggggcag

SEQ ID NO: 7976560 - DNA, 22 bp, Homo sapiens
aggccagcttctaccctctgtt

SEQ ID NO: 7976561 - DNA, 22 bp, Homo sapiens
aggccagcttctaccctctgtt

SEQ ID NO: 7976562 - DNA, 22 bp, Homo sapiens
aggccagcttctaccctctgtt

SEQ ID NO: 7976563 - DNA, 22 bp, Homo sapiens
aggccaggacacttaagtaaga

SEQ ID NO: 7976564 - DNA, 22 bp, Homo sapiens
aggccaggacacttaagtaaga

SEQ ID NO: 7976565 - DNA, 22 bp, Homo sapiens
aggccaggacacttaagtaaga

SEQ ID NO: 7976566 - DNA, 22 bp, Homo sapiens
aggccaggaatccttgtcccag

SEQ ID NO: 7976567 - DNA, 22 bp, Homo sapiens
aggccaggaccattagcccaga

SEQ ID NO: 7976568 - DNA, 22 bp, Homo sapiens
aggccaggaccattagcccaga

SEQ ID NO: 7976569 - DNA, 22 bp, Homo sapiens
aggccaggatagcatggatcag

SEQ ID NO: 7976570 - DNA, 22 bp, Homo sapiens
aggccaggaccattagcccaga

SEQ ID NO: 7976571 - DNA, 22 bp, Homo sapiens
aggccaggaccattagcccaga

SEQ ID NO: 7976572 - DNA, 22 bp, Homo sapiens
aggccccaaagcagtgcaagta

SEQ ID NO: 7976573 - DNA, 22 bp, Homo sapiens
aggcccatgttcacttgctcag

SEQ ID NO: 7976574 - DNA, 22 bp, Homo sapiens
aggccccaaagcagtgcaagta

SEQ ID NO: 7976575 - DNA, 22 bp, Homo sapiens
aggccccaaagcagtgcaagta

SEQ ID NO: 7976576 - DNA, 20 bp, Homo sapiens
aggccccaggaaactctcag

SEQ ID NO: 7976577 - DNA, 20 bp, Homo sapiens
aggccccaggaaactctcag

SEQ ID NO: 7976578 - DNA, 20 bp, Homo sapiens
aggccccaggtggacactag

SEQ ID NO: 7976579 - DNA, 22 bp, Homo sapiens
aggcccccacaggcttgaggca

SEQ ID NO: 7976580 - DNA, 22 bp, Homo sapiens
aggcccccacaggcttgaggca

SEQ ID NO: 7976581 - DNA, 22 bp, Homo sapiens
aggcccatagtagctctgggca

SEQ ID NO: 7976582 - DNA, 22 bp, Homo sapiens
aggcccagttatcctacttgtt

SEQ ID NO: 7976583 - DNA, 22 bp, Homo sapiens
aggcccagttatcctacttgtt

SEQ ID NO: 7976584 - DNA, 22 bp, Homo sapiens
aggcccatgtgagtcttgtcct

SEQ ID NO: 7976585 - DNA, 22 bp, Homo sapiens
aggcccagttatcctacttgtt

SEQ ID NO: 7976586 - DNA, 22 bp, Homo sapiens
aggcccagtgtggcttcctgga

SEQ ID NO: 7976587 - DNA, 22 bp, Homo sapiens
aggcccagtgtggcttcctgga

SEQ ID NO: 7976588 - DNA, 22 bp, Homo sapiens
aggcccagttatcctacttgtt

SEQ ID NO: 7976589 - DNA, 22 bp, Homo sapiens
aggcccagttatcctacttgtt

SEQ ID NO: 7976590 - DNA, 22 bp, Homo sapiens
aggcccagtgtggcttcctgga

SEQ ID NO: 7976591 - DNA, 22 bp, Homo sapiens
aggcccagtgtggcttcctgga

SEQ ID NO: 7976592 - DNA, 22 bp, Homo sapiens
aggcccagtgtggcttcctgga

SEQ ID NO: 7976593 - DNA, 22 bp, Homo sapiens
aggcccagtgtggcttcctgga

SEQ ID NO: 7976594 - DNA, 22 bp, Homo sapiens
aggccctgaagtcggcccctca

SEQ ID NO: 7976595 - DNA, 22 bp, Homo sapiens
aggccctctcattccagaggca

SEQ ID NO: 7976596 - DNA, 22 bp, Homo sapiens
aggccctctagaggagtgtttg

SEQ ID NO: 7976597 - DNA, 22 bp, Homo sapiens
aggccctctcattccagaggca

SEQ ID NO: 7976598 - DNA, 22 bp, Homo sapiens
aggccctctcattccagaggca

SEQ ID NO: 7976599 - DNA, 20 bp, Homo sapiens
aggccctccccactgttgct

SEQ ID NO: 7976600 - DNA, 22 bp, Homo sapiens
aggccctccattgatgtttatt

SEQ ID NO: 7976601 - DNA, 19 bp, Homo sapiens
aggccctcaagtaacatta

SEQ ID NO: 7976602 - DNA, 22 bp, Homo sapiens
aggccctcacagtctattgtga

SEQ ID NO: 7976603 - DNA, 22 bp, Homo sapiens
aggccctattcaatggggccca

SEQ ID NO: 7976604 - DNA, 22 bp, Homo sapiens
aggccctaatccaacatgactg

SEQ ID NO: 7976605 - DNA, 22 bp, Homo sapiens
aggccctaatccaacatgactg

SEQ ID NO: 7976606 - DNA, 22 bp, Homo sapiens
aggccctattcaatggggccca

SEQ ID NO: 7976607 - DNA, 22 bp, Homo sapiens
aggccctggtcaggtctggctg

SEQ ID NO: 7976608 - DNA, 22 bp, Homo sapiens
aggccggcgcttcccaggaggc

SEQ ID NO: 7976609 - DNA, 22 bp, Homo sapiens
aggccggcgcttcccaggaggc

SEQ ID NO: 7976610 - DNA, 22 bp, Homo sapiens
aggccgcctggggagaggccct

SEQ ID NO: 7976611 - DNA, 22 bp, Homo sapiens
aggcctagagctttggagggca

SEQ ID NO: 7976612 - DNA, 22 bp, Homo sapiens
aggcctagagctttggagggca

SEQ ID NO: 7976613 - DNA, 22 bp, Homo sapiens
aggccctgaagtcggcccctca

SEQ ID NO: 7976614 - DNA, 22 bp, Homo sapiens
aggccctgggttagggcccact

SEQ ID NO: 7976615 - DNA, 22 bp, Homo sapiens
aggccctgacctgggagatcta

SEQ ID NO: 7976616 - DNA, 22 bp, Homo sapiens
aggccctgaagtcggcccctca

SEQ ID NO: 7976617 - DNA, 22 bp, Homo sapiens
aggccctggtcaggtctggctg

SEQ ID NO: 7976618 - DNA, 22 bp, Homo sapiens
ccccatgaagtagggtctctga

SEQ ID NO: 7976619 - DNA, 22 bp, Homo sapiens
ccccatcttccctgagggattt

SEQ ID NO: 7976620 - DNA, 22 bp, Homo sapiens
ccccatcatctttgaggtcatt

SEQ ID NO: 7976621 - DNA, 22 bp, Homo sapiens
ccccagtggttgcaacagcaga

SEQ ID NO: 7976622 - DNA, 22 bp, Homo sapiens
ccccagtggttgcaacagcaga

SEQ ID NO: 7976623 - DNA, 22 bp, Homo sapiens
ccccagtggaggtgagggtcct

SEQ ID NO: 7976624 - DNA, 22 bp, Homo sapiens
ccccagtggaggtgagggtcct

SEQ ID NO: 7976625 - DNA, 22 bp, Homo sapiens
ccccatgaagtagggtctctga

SEQ ID NO: 7976626 - DNA, 22 bp, Homo sapiens
ccccatgaagtagggtctctga

SEQ ID NO: 7976627 - DNA, 22 bp, Homo sapiens
ccccatgaagtagggtctctga

SEQ ID NO: 7976628 - DNA, 22 bp, Homo sapiens
ccccatgaagtagggtctctga

SEQ ID NO: 7976629 - DNA, 22 bp, Homo sapiens
ccccatgaagtagggtctctga

SEQ ID NO: 7976630 - DNA, 21 bp, Homo sapiens
ccccatggagtacagttgggc

SEQ ID NO: 7976631 - DNA, 22 bp, Homo sapiens
ccccatgaagtagggtctctga

SEQ ID NO: 7976632 - DNA, 22 bp, Homo sapiens
ccccatgctgggatctgacacc

SEQ ID NO: 7976633 - DNA, 22 bp, Homo sapiens
ccccatggcaactgctgggggt

SEQ ID NO: 7976634 - DNA, 22 bp, Homo sapiens
ccccatggcaactgctgggggt

SEQ ID NO: 7976635 - DNA, 22 bp, Homo sapiens
ccccatggcaactgctgggggt

SEQ ID NO: 7976636 - DNA, 22 bp, Homo sapiens
ccccatggcaactgctgggggt

SEQ ID NO: 7976637 - DNA, 21 bp, Homo sapiens
ccccatggagtacagttgggc

SEQ ID NO: 7976638 - DNA, 22 bp, Homo sapiens
ccccatgggtgtagggaggtgg

SEQ ID NO: 7976639 - DNA, 22 bp, Homo sapiens
ccccattctggccagcccagct

SEQ ID NO: 7976640 - DNA, 22 bp, Homo sapiens
agggaggaaggaactccttcta

SEQ ID NO: 7976641 - DNA, 22 bp, Homo sapiens
agggaggaaggaactccttcta

SEQ ID NO: 7976642 - DNA, 22 bp, Homo sapiens
agggaggaaggaactccttcta

SEQ ID NO: 7976643 - DNA, 22 bp, Homo sapiens
agggaggaaggaactccttcta

SEQ ID NO: 7976644 - DNA, 22 bp, Homo sapiens
agggagctttttcatgtgtcta

SEQ ID NO: 7976645 - DNA, 22 bp, Homo sapiens
agggagctttttcatgtgtcta

SEQ ID NO: 7976646 - DNA, 22 bp, Homo sapiens
ccccagggtcagtgtgtggagg

SEQ ID NO: 7976647 - DNA, 22 bp, Homo sapiens
ccccagggtcagtgtgtggagg

SEQ ID NO: 7976648 - DNA, 22 bp, Homo sapiens
ccccagggtcagtgtgtggagg

SEQ ID NO: 7976649 - DNA, 22 bp, Homo sapiens
ccccagggtcagtgtgtggagg

SEQ ID NO: 7976650 - DNA, 22 bp, Homo sapiens
ccccaggtggatggctcgcata

SEQ ID NO: 7976651 - DNA, 22 bp, Homo sapiens
ccccagggtcagtgtgtggagg

SEQ ID NO: 7976652 - DNA, 19 bp, Homo sapiens
ccccagggtaggctagggg

SEQ ID NO: 7976653 - DNA, 19 bp, Homo sapiens
ccccagggtaggctagggg

SEQ ID NO: 7976654 - DNA, 19 bp, Homo sapiens
ccccagggtaggctagggg

SEQ ID NO: 7976655 - DNA, 19 bp, Homo sapiens
ccccagggtaggctagggg

SEQ ID NO: 7976656 - DNA, 19 bp, Homo sapiens
ccccagggtaggctagggg

SEQ ID NO: 7976657 - DNA, 22 bp, Homo sapiens
ccccagggtcagtgtgtggagg

SEQ ID NO: 7976658 - DNA, 22 bp, Homo sapiens
ccccagggactggtttcatgga

SEQ ID NO: 7976659 - DNA, 22 bp, Homo sapiens
ccccagggaagctttgcttact

SEQ ID NO: 7976660 - DNA, 22 bp, Homo sapiens
ccccagggactggtttcatgga

SEQ ID NO: 7976661 - DNA, 19 bp, Homo sapiens
ccccagggtaggctagggg

SEQ ID NO: 7976662 - DNA, 19 bp, Homo sapiens
ccccagggtaggctagggg

SEQ ID NO: 7976663 - DNA, 22 bp, Homo sapiens
ccccagcagactcagggcaggt

SEQ ID NO: 7976664 - DNA, 22 bp, Homo sapiens
ccccagcagactcagggcaggt

SEQ ID NO: 7976665 - DNA, 22 bp, Homo sapiens
ccccagcagactcagggcaggt

SEQ ID NO: 7976666 - DNA, 22 bp, Homo sapiens
ccccagcagactcagggcaggt

SEQ ID NO: 7976667 - DNA, 22 bp, Homo sapiens
ccccagcagactcagggcaggt

SEQ ID NO: 7976668 - DNA, 22 bp, Homo sapiens
ccccagggaagctttgcttact

SEQ ID NO: 7976669 - DNA, 22 bp, Homo sapiens
ccccagcagactcagggcaggt

SEQ ID NO: 7976670 - DNA, 22 bp, Homo sapiens
agggagcacagtaagttagtct

SEQ ID NO: 7976671 - DNA, 22 bp, Homo sapiens
agggagcaaaggtttcagggtt

SEQ ID NO: 7976672 - DNA, 22 bp, Homo sapiens
agggagcaaaggtttcagggtt

SEQ ID NO: 7976673 - DNA, 22 bp, Homo sapiens
agggagatcgaccgtgttatat

SEQ ID NO: 7976674 - DNA, 22 bp, Homo sapiens
agggagcaaaggtttcagggtt

SEQ ID NO: 7976675 - DNA, 22 bp, Homo sapiens
agggagagtttgatgtttcctc

SEQ ID NO: 7976676 - DNA, 22 bp, Homo sapiens
agggagagtagatatcaggtgt

SEQ ID NO: 7976677 - DNA, 22 bp, Homo sapiens
agggagagtttgatgtttcctc

SEQ ID NO: 7976678 - DNA, 22 bp, Homo sapiens
agggagcagggctcctttgggt

SEQ ID NO: 7976679 - DNA, 18 bp, Homo sapiens
agggagcatctggttgcc

SEQ ID NO: 7976680 - DNA, 22 bp, Homo sapiens
agggagcagggctcctttgggt

SEQ ID NO: 7976681 - DNA, 18 bp, Homo sapiens
agggagcatctggttgcc

SEQ ID NO: 7976682 - DNA, 22 bp, Homo sapiens
agggagcatgggtgaagcaggc

SEQ ID NO: 7976683 - DNA, 18 bp, Homo sapiens
agggagcatctggttgcc

SEQ ID NO: 7976684 - DNA, 22 bp, Homo sapiens
agggagcagggctcctttgggt

SEQ ID NO: 7976685 - DNA, 22 bp, Homo sapiens
agggagcagcagccacaggatg

SEQ ID NO: 7976686 - DNA, 22 bp, Homo sapiens
agggagcagcagccacaggatg

SEQ ID NO: 7976687 - DNA, 22 bp, Homo sapiens
agggagcacagtaagttagtct

SEQ ID NO: 7976688 - DNA, 22 bp, Homo sapiens
agggagcagcagccacaggatg

SEQ ID NO: 7976689 - DNA, 22 bp, Homo sapiens
agggagcagcagccacaggatg

SEQ ID NO: 7976690 - DNA, 22 bp, Homo sapiens
agggagcagcagccacaggatg

SEQ ID NO: 7976691 - DNA, 22 bp, Homo sapiens
agggagcagcagccacaggatg

SEQ ID NO: 7976692 - DNA, 22 bp, Homo sapiens
agggagcagcagccacaggatg

SEQ ID NO: 7976693 - DNA, 22 bp, Homo sapiens
agggagcagcagccacaggatg

SEQ ID NO: 7976694 - DNA, 21 bp, Homo sapiens
agggagcatgttagctttcga

SEQ ID NO: 7976695 - DNA, 22 bp, Homo sapiens
agggagcattgtgacatatcac

SEQ ID NO: 7976696 - DNA, 22 bp, Homo sapiens
agggagcattgtgacatatcac

SEQ ID NO: 7976697 - DNA, 21 bp, Homo sapiens
agggagcatgttagctttcga

SEQ ID NO: 7976698 - DNA, 21 bp, Homo sapiens
agggagcatgttagctttcga

SEQ ID NO: 7976699 - DNA, 21 bp, Homo sapiens
agggagcatgttagctttcga

SEQ ID NO: 7976700 - DNA, 22 bp, Homo sapiens
agggagcatgggtgaagcaggc

SEQ ID NO: 7976701 - DNA, 22 bp, Homo sapiens
agggagcatgggtgaagcaggc

SEQ ID NO: 7976702 - DNA, 22 bp, Homo sapiens
agggagcatgggtgaagcaggc

SEQ ID NO: 7976703 - DNA, 22 bp, Homo sapiens
agggagcatgggtgaagcaggc

SEQ ID NO: 7976704 - DNA, 22 bp, Homo sapiens
agggagcatgggtgaagcaggc

SEQ ID NO: 7976705 - DNA, 22 bp, Homo sapiens
agggagcatgggtgaagcaggc

SEQ ID NO: 7976706 - DNA, 22 bp, Homo sapiens
agggagccagagttgggagctc

SEQ ID NO: 7976707 - DNA, 22 bp, Homo sapiens
agggagccagagttgggagctc

SEQ ID NO: 7976708 - DNA, 22 bp, Homo sapiens
agggagccagagttgggagctc

SEQ ID NO: 7976709 - DNA, 22 bp, Homo sapiens
agggagccagagttgggagctc

SEQ ID NO: 7976710 - DNA, 22 bp, Homo sapiens
agggagccagagttgggagctc

SEQ ID NO: 7976711 - DNA, 22 bp, Homo sapiens
agggagccagagttgggagctc

SEQ ID NO: 7976712 - DNA, 22 bp, Homo sapiens
agggagccaggggccagctatt

SEQ ID NO: 7976713 - DNA, 22 bp, Homo sapiens
agggagccctgaaccagagggt

SEQ ID NO: 7976714 - DNA, 22 bp, Homo sapiens
agggagccaggggccagctatt

SEQ ID NO: 7976715 - DNA, 22 bp, Homo sapiens
agggagccaggggccagctatt

SEQ ID NO: 7976716 - DNA, 22 bp, Homo sapiens
agggagccaggaacgcaggtcg

SEQ ID NO: 7976717 - DNA, 22 bp, Homo sapiens
agggagccaggaacgcaggtcg

SEQ ID NO: 7976718 - DNA, 22 bp, Homo sapiens
aggcttcaaggacctgagggaa

SEQ ID NO: 7976719 - DNA, 22 bp, Homo sapiens
aggcttcaaggacctgagggaa

SEQ ID NO: 7976720 - DNA, 22 bp, Homo sapiens
aggcttcaaggacagcagccac

SEQ ID NO: 7976721 - DNA, 22 bp, Homo sapiens
aggcttagaaattcagctgagt

SEQ ID NO: 7976722 - DNA, 22 bp, Homo sapiens
aggcttaatgagttaaatcact

SEQ ID NO: 7976723 - DNA, 22 bp, Homo sapiens
agggaaggaaaagctgtcgctt

SEQ ID NO: 7976724 - DNA, 22 bp, Homo sapiens
agggaaggaaaagctgtcgctt

SEQ ID NO: 7976725 - DNA, 22 bp, Homo sapiens
agggaaggaaaagctgtcgctt

SEQ ID NO: 7976726 - DNA, 22 bp, Homo sapiens
agggaaggaaaagctgtcgctt

SEQ ID NO: 7976727 - DNA, 22 bp, Homo sapiens
agggaaggaaaagctgtcgctt

SEQ ID NO: 7976728 - DNA, 22 bp, Homo sapiens
agggaagcttgttactgagaag

SEQ ID NO: 7976729 - DNA, 22 bp, Homo sapiens
agggaaggaaaagctgtcgctt

SEQ ID NO: 7976730 - DNA, 22 bp, Homo sapiens
agggaaggaaaagctgtcgctt

SEQ ID NO: 7976731 - DNA, 22 bp, Homo sapiens
agggaaggaaaagctgtcgctt

SEQ ID NO: 7976732 - DNA, 22 bp, Homo sapiens
agggaaggaaaagctgtcgctt

SEQ ID NO: 7976733 - DNA, 22 bp, Homo sapiens
agggaaggcttttgacatttcc

SEQ ID NO: 7976734 - DNA, 19 bp, Homo sapiens
agggaaggattctgtcatt

SEQ ID NO: 7976735 - DNA, 19 bp, Homo sapiens
agggaaggattctgtcatt

SEQ ID NO: 7976736 - DNA, 19 bp, Homo sapiens
agggaaggattctgtcatt

SEQ ID NO: 7976737 - DNA, 19 bp, Homo sapiens
agggaaggattctgtcatt

SEQ ID NO: 7976738 - DNA, 19 bp, Homo sapiens
agggaaggattctgtcatt

SEQ ID NO: 7976739 - DNA, 22 bp, Homo sapiens
agggaaggcttttgacatttcc

SEQ ID NO: 7976740 - DNA, 22 bp, Homo sapiens
agggaaggcttttgacatttcc

SEQ ID NO: 7976741 - DNA, 22 bp, Homo sapiens
agggaagggaaaaacactcgtc

SEQ ID NO: 7976742 - DNA, 22 bp, Homo sapiens
agggaagggaaaaacactcgtc

SEQ ID NO: 7976743 - DNA, 22 bp, Homo sapiens
agggaagggaaaaacactcgtc

SEQ ID NO: 7976744 - DNA, 22 bp, Homo sapiens
agggaaggcttttgacatttcc

SEQ ID NO: 7976745 - DNA, 19 bp, Homo sapiens
agggaaggattctgtcatt

SEQ ID NO: 7976746 - DNA, 19 bp, Homo sapiens
agggaaggattctgtcatt

SEQ ID NO: 7976747 - DNA, 19 bp, Homo sapiens
agggaaggattctgtcatt

SEQ ID NO: 7976748 - DNA, 22 bp, Homo sapiens
agggaaggaggttagaacccac

SEQ ID NO: 7976749 - DNA, 22 bp, Homo sapiens
agggaaggaggttagaacccac

SEQ ID NO: 7976750 - DNA, 22 bp, Homo sapiens
agggaaggaggttagaacccac

SEQ ID NO: 7976751 - DNA, 22 bp, Homo sapiens
agggaaggaggttagaacccac

SEQ ID NO: 7976752 - DNA, 22 bp, Homo sapiens
agggaaggaggccatgtgtccc

SEQ ID NO: 7976753 - DNA, 22 bp, Homo sapiens
agggaaggaggccatgtgtccc

SEQ ID NO: 7976754 - DNA, 22 bp, Homo sapiens
agggaaggaggccatgtgtccc

SEQ ID NO: 7976755 - DNA, 22 bp, Homo sapiens
agggaaggaggccatgtgtccc

SEQ ID NO: 7976756 - DNA, 22 bp, Homo sapiens
agggaaggaggccatgtgtccc

SEQ ID NO: 7976757 - DNA, 22 bp, Homo sapiens
agggaaggaggttagaacccac

SEQ ID NO: 7976758 - DNA, 22 bp, Homo sapiens
agggaaggaggccatgtgtccc

SEQ ID NO: 7976759 - DNA, 22 bp, Homo sapiens
agggaaggaggccatgtgtccc

SEQ ID NO: 7976760 - DNA, 22 bp, Homo sapiens
agggaaggaggccatgtgtccc

SEQ ID NO: 7976761 - DNA, 22 bp, Homo sapiens
agggagagtagatatcaggtgt

SEQ ID NO: 7976762 - DNA, 22 bp, Homo sapiens
agggagagtagatatcaggtgt

SEQ ID NO: 7976763 - DNA, 22 bp, Homo sapiens
agggagaggttgaaacctcagt

SEQ ID NO: 7976764 - DNA, 22 bp, Homo sapiens
agggagaggttgaaacctcagt

SEQ ID NO: 7976765 - DNA, 22 bp, Homo sapiens
agggagagtagatatcaggtgt

SEQ ID NO: 7976766 - DNA, 22 bp, Homo sapiens
agggagaggttgaaacctcagt

SEQ ID NO: 7976767 - DNA, 22 bp, Homo sapiens
agggagaggctgaactatccta

SEQ ID NO: 7976768 - DNA, 22 bp, Homo sapiens
agggagaggttgaaacctcagt

SEQ ID NO: 7976769 - DNA, 22 bp, Homo sapiens
agggagaggttgaaacctcagt

SEQ ID NO: 7976770 - DNA, 19 bp, Homo sapiens
agggaatccggctgaggga

SEQ ID NO: 7976771 - DNA, 19 bp, Homo sapiens
agggaatccggctgaggga

SEQ ID NO: 7976772 - DNA, 19 bp, Homo sapiens
agggaatccggctgaggga

SEQ ID NO: 7976773 - DNA, 19 bp, Homo sapiens
agggaatccggctgaggga

SEQ ID NO: 7976774 - DNA, 22 bp, Homo sapiens
agggagaggctgaactatccta

SEQ ID NO: 7976775 - DNA, 19 bp, Homo sapiens
agggagaattccaagagga

SEQ ID NO: 7976776 - DNA, 19 bp, Homo sapiens
agggagaattccaagagga

SEQ ID NO: 7976777 - DNA, 22 bp, Homo sapiens
agggagaaggtttagctgtgag

SEQ ID NO: 7976778 - DNA, 22 bp, Homo sapiens
agggagaatgaccaaggtatat

SEQ ID NO: 7976779 - DNA, 22 bp, Homo sapiens
agggaagggcagggtctatgca

SEQ ID NO: 7976780 - DNA, 22 bp, Homo sapiens
agggaagggcagggtctatgca

SEQ ID NO: 7976781 - DNA, 22 bp, Homo sapiens
agggaagggcagggtctatgca

SEQ ID NO: 7976782 - DNA, 22 bp, Homo sapiens
agggaagggcagggtctatgca

SEQ ID NO: 7976783 - DNA, 22 bp, Homo sapiens
agggaagggcagggtctatgca

SEQ ID NO: 7976784 - DNA, 22 bp, Homo sapiens
agggaagggcagggtctatgca

SEQ ID NO: 7976785 - DNA, 22 bp, Homo sapiens
agggaagggaaaaacactcgtc

SEQ ID NO: 7976786 - DNA, 23 bp, Homo sapiens
agggaagggggcttattccacag

SEQ ID NO: 7976787 - DNA, 23 bp, Homo sapiens
agggaagggggcttattccacag

SEQ ID NO: 7976788 - DNA, 22 bp, Homo sapiens
agggaagggcagggtctatgca

SEQ ID NO: 7976789 - DNA, 23 bp, Homo sapiens
agggaagggggcttattccacag

SEQ ID NO: 7976790 - DNA, 23 bp, Homo sapiens
agggaagggggcttattccacag

SEQ ID NO: 7976791 - DNA, 23 bp, Homo sapiens
agggaagggggcttattccacag

SEQ ID NO: 7976792 - DNA, 22 bp, Homo sapiens
agggaagtgataggacgtctct

SEQ ID NO: 7976793 - DNA, 22 bp, Homo sapiens
agggaagtgaatgacagatatc

SEQ ID NO: 7976794 - DNA, 22 bp, Homo sapiens
agggaagtgatggagttcgatc

SEQ ID NO: 7976795 - DNA, 22 bp, Homo sapiens
agggaagtgatggagttcgatc

SEQ ID NO: 7976796 - DNA, 22 bp, Homo sapiens
agggaagtggtctgggaacttg

SEQ ID NO: 7976797 - DNA, 22 bp, Homo sapiens
agggaagtggtctgggaacttg

SEQ ID NO: 7976798 - DNA, 19 bp, Homo sapiens
agggaatccggctgaggga

SEQ ID NO: 7976799 - DNA, 22 bp, Homo sapiens
agggaaggtagaggtcaccggc

SEQ ID NO: 7976800 - DNA, 22 bp, Homo sapiens
agggaaggtagaggtcaccggc

SEQ ID NO: 7976801 - DNA, 22 bp, Homo sapiens
agggaagtccatgggggcggtg

SEQ ID NO: 7976802 - DNA, 22 bp, Homo sapiens
agggaagtccatgggggcggtg

SEQ ID NO: 7976803 - DNA, 22 bp, Homo sapiens
agggaagtgaatgacagatatc

SEQ ID NO: 7976804 - DNA, 22 bp, Homo sapiens
agggaaggtagaggtcaccggc

SEQ ID NO: 7976805 - DNA, 22 bp, Homo sapiens
agggaaggtagaggtcaccggc

SEQ ID NO: 7976806 - DNA, 22 bp, Homo sapiens
cccagcctgatctcggccagct

SEQ ID NO: 7976807 - DNA, 22 bp, Homo sapiens
cccagcctgatctcggccagct

SEQ ID NO: 7976808 - DNA, 22 bp, Homo sapiens
cccagcctgatctcggccagct

SEQ ID NO: 7976809 - DNA, 22 bp, Homo sapiens
cccagcctgatctcggccagct

SEQ ID NO: 7976810 - DNA, 22 bp, Homo sapiens
cccagcctctgtttgctcctct

SEQ ID NO: 7976811 - DNA, 22 bp, Homo sapiens
cccagcctgatctcggccagct

SEQ ID NO: 7976812 - DNA, 22 bp, Homo sapiens
cccagcctgatctcggccagct

SEQ ID NO: 7976813 - DNA, 22 bp, Homo sapiens
cccagcctgatctcggccagct

SEQ ID NO: 7976814 - DNA, 22 bp, Homo sapiens
cccagcctgatctcggccagct

SEQ ID NO: 7976815 - DNA, 22 bp, Homo sapiens
cccagcctggtgcactgtgggg

SEQ ID NO: 7976816 - DNA, 22 bp, Homo sapiens
cccagcctggtgcactgtgggg

SEQ ID NO: 7976817 - DNA, 22 bp, Homo sapiens
cccagcctggtgcactgtgggg

SEQ ID NO: 7976818 - DNA, 22 bp, Homo sapiens
cccagcctggtgcactgtgggg

SEQ ID NO: 7976819 - DNA, 22 bp, Homo sapiens
cccagctccttggatgggcagg

SEQ ID NO: 7976820 - DNA, 22 bp, Homo sapiens
cccagctccttacagggccgaa

SEQ ID NO: 7976821 - DNA, 22 bp, Homo sapiens
cccagctccttggatgggcagg

SEQ ID NO: 7976822 - DNA, 22 bp, Homo sapiens
cccagcctggtgcactgtgggg

SEQ ID NO: 7976823 - DNA, 22 bp, Homo sapiens
cccagctccttgtttgcatctc

SEQ ID NO: 7976824 - DNA, 22 bp, Homo sapiens
cccagctccttgtttgcatctc

SEQ ID NO: 7976825 - DNA, 18 bp, Homo sapiens
cccagcctctcctttcta

SEQ ID NO: 7976826 - DNA, 18 bp, Homo sapiens
cccagcctctcctttcta

SEQ ID NO: 7976827 - DNA, 22 bp, Homo sapiens
cccagcctctggattctgccct

SEQ ID NO: 7976828 - DNA, 22 bp, Homo sapiens
cccagcctctgggctcacccaa

SEQ ID NO: 7976829 - DNA, 22 bp, Homo sapiens
cccagcctctgggttctgccgg

SEQ ID NO: 7976830 - DNA, 22 bp, Homo sapiens
cccagcctctgtttgctcctct

SEQ ID NO: 7976831 - DNA, 22 bp, Homo sapiens
cccagcctctgggctcacccaa

SEQ ID NO: 7976832 - DNA, 22 bp, Homo sapiens
cccagcctctgtttgctcctct

SEQ ID NO: 7976833 - DNA, 22 bp, Homo sapiens
cccagcctctgtttgctcctct

SEQ ID NO: 7976834 - DNA, 22 bp, Homo sapiens
cccagcctctgtttgctcctct

SEQ ID NO: 7976835 - DNA, 22 bp, Homo sapiens
cccagctctgcagacctgccct

SEQ ID NO: 7976836 - DNA, 22 bp, Homo sapiens
cccagctctgcagacctgccct

SEQ ID NO: 7976837 - DNA, 22 bp, Homo sapiens
cccagctctgcagacctgccct

SEQ ID NO: 7976838 - DNA, 22 bp, Homo sapiens
cccagctctgccatctacccac

SEQ ID NO: 7976839 - DNA, 22 bp, Homo sapiens
cccagctctgccatctacccac

SEQ ID NO: 7976840 - DNA, 22 bp, Homo sapiens
cccagctctgccatctacccac

SEQ ID NO: 7976841 - DNA, 22 bp, Homo sapiens
cccagctctaggagtggtggca

SEQ ID NO: 7976842 - DNA, 22 bp, Homo sapiens
cccagctctaggagtggtggca

SEQ ID NO: 7976843 - DNA, 22 bp, Homo sapiens
cccagctctcgcacttactagc

SEQ ID NO: 7976844 - DNA, 22 bp, Homo sapiens
cccagctctctgctcttagcct

SEQ ID NO: 7976845 - DNA, 22 bp, Homo sapiens
cccagctctctgctcttagcct

SEQ ID NO: 7976846 - DNA, 22 bp, Homo sapiens
cccagctctctcagttctgctt

SEQ ID NO: 7976847 - DNA, 22 bp, Homo sapiens
aggctgtgtttcttgcgttttc

SEQ ID NO: 7976848 - DNA, 22 bp, Homo sapiens
aggctgttctaggagagtggga

SEQ ID NO: 7976849 - DNA, 22 bp, Homo sapiens
aggctgtgtttcccctggagct

SEQ ID NO: 7976850 - DNA, 22 bp, Homo sapiens
aggctgtgtttcccctggagct

SEQ ID NO: 7976851 - DNA, 22 bp, Homo sapiens
aggctgtgtttcccctggagct

SEQ ID NO: 7976852 - DNA, 22 bp, Homo sapiens
aggctgttgagccccagcaagt

SEQ ID NO: 7976853 - DNA, 22 bp, Homo sapiens
aggctgttgcatgccacagata

SEQ ID NO: 7976854 - DNA, 22 bp, Homo sapiens
aggcttaacttaactttagagc

SEQ ID NO: 7976855 - DNA, 22 bp, Homo sapiens
aggcttaagcctgaggccccag

SEQ ID NO: 7976856 - DNA, 22 bp, Homo sapiens
aggcttaactttactgttatgc

SEQ ID NO: 7976857 - DNA, 22 bp, Homo sapiens
aggcttaacctgatcacatgag

SEQ ID NO: 7976858 - DNA, 22 bp, Homo sapiens
aggcttaaatgctcatatcagt

SEQ ID NO: 7976859 - DNA, 22 bp, Homo sapiens
aggctgtgtaaagtgctttccc

SEQ ID NO: 7976860 - DNA, 22 bp, Homo sapiens
aggctgtgtgctccttatgaga

SEQ ID NO: 7976861 - DNA, 22 bp, Homo sapiens
aggctgtgtggtcatggtggct

SEQ ID NO: 7976862 - DNA, 22 bp, Homo sapiens
aggctgtgtggtcatggtggct

SEQ ID NO: 7976863 - DNA, 22 bp, Homo sapiens
aggctgtgtggtcatggtggct

SEQ ID NO: 7976864 - DNA, 22 bp, Homo sapiens
aggctgtgtggtcatggtggct

SEQ ID NO: 7976865 - DNA, 22 bp, Homo sapiens
aggctgtgttctggttcttagc

SEQ ID NO: 7976866 - DNA, 22 bp, Homo sapiens
aggctgtgtggtcatggtggct

SEQ ID NO: 7976867 - DNA, 22 bp, Homo sapiens
aggctgtgtttaagtggtaatg

SEQ ID NO: 7976868 - DNA, 22 bp, Homo sapiens
aggctgtgtttaagtggtaatg

SEQ ID NO: 7976869 - DNA, 22 bp, Homo sapiens
aggctgtgtttcccctggagct

SEQ ID NO: 7976870 - DNA, 22 bp, Homo sapiens
ccatccttgtcatcttcatgtt

SEQ ID NO: 7976871 - DNA, 22 bp, Homo sapiens
ccatcgcttcaaatctcagact

SEQ ID NO: 7976872 - DNA, 22 bp, Homo sapiens
ccatccttggctcgctctctgt

SEQ ID NO: 7976873 - DNA, 22 bp, Homo sapiens
ccatctccaaataccatcacat

SEQ ID NO: 7976874 - DNA, 22 bp, Homo sapiens
ccatctccactgtccctgtcaa

SEQ ID NO: 7976875 - DNA, 22 bp, Homo sapiens
ccatctccactgtccctgtcaa

SEQ ID NO: 7976876 - DNA, 22 bp, Homo sapiens
ccatctccactgtccctgtcaa

SEQ ID NO: 7976877 - DNA, 22 bp, Homo sapiens
ccatctccactgtccctgtcaa

SEQ ID NO: 7976878 - DNA, 22 bp, Homo sapiens
ccatctccaaataccatcacat

SEQ ID NO: 7976879 - DNA, 21 bp, Homo sapiens
ccataatcttaggatcaaaat

SEQ ID NO: 7976880 - DNA, 21 bp, Homo sapiens
ccataatcttaggatcaaaat

SEQ ID NO: 7976881 - DNA, 22 bp, Homo sapiens
ccataattgggtagccatctga

SEQ ID NO: 7976882 - DNA, 21 bp, Homo sapiens
ccataattttgtttcagaagt

SEQ ID NO: 7976883 - DNA, 21 bp, Homo sapiens
ccataattttgtttcagaagt

SEQ ID NO: 7976884 - DNA, 22 bp, Homo sapiens
ccatcctgtctgtggcctcagg

SEQ ID NO: 7976885 - DNA, 22 bp, Homo sapiens
ccatcctgtctgtggcctcagg

SEQ ID NO: 7976886 - DNA, 22 bp, Homo sapiens
ccataatcatgtaagtaaattc

SEQ ID NO: 7976887 - DNA, 22 bp, Homo sapiens
ccatcctgtctgtggcctcagg

SEQ ID NO: 7976888 - DNA, 22 bp, Homo sapiens
ccatcctgtctgtggcctcagg

SEQ ID NO: 7976889 - DNA, 22 bp, Homo sapiens
ccatcctgtctgtggcctcagg

SEQ ID NO: 7976890 - DNA, 22 bp, Homo sapiens
ccataatctggctttgagagag

SEQ ID NO: 7976891 - DNA, 22 bp, Homo sapiens
ccataatctggctttgagagag

SEQ ID NO: 7976892 - DNA, 22 bp, Homo sapiens
ccataatcgtgtgttaaataat

SEQ ID NO: 7976893 - DNA, 22 bp, Homo sapiens
ccataatcgtgtgttaaataat

SEQ ID NO: 7976894 - DNA, 22 bp, Homo sapiens
ccataaggagccagacattcca

SEQ ID NO: 7976895 - DNA, 23 bp, Homo sapiens
ccataatcagggttgtggggtcc

SEQ ID NO: 7976896 - DNA, 22 bp, Homo sapiens
ccataatcatgtaagtaaattc

SEQ ID NO: 7976897 - DNA, 22 bp, Homo sapiens
ccagttttgccatggtaacact

SEQ ID NO: 7976898 - DNA, 22 bp, Homo sapiens
ccagtttgaggtttcaagatgt

SEQ ID NO: 7976899 - DNA, 20 bp, Homo sapiens
ccagtttctttcccagcctc

SEQ ID NO: 7976900 - DNA, 22 bp, Homo sapiens
ccataaagtaggaaacactaca

SEQ ID NO: 7976901 - DNA, 22 bp, Homo sapiens
ccagtttttccagtgctttctg

SEQ ID NO: 7976902 - DNA, 21 bp, Homo sapiens
ccataaacagatggtaactgt

SEQ ID NO: 7976903 - DNA, 22 bp, Homo sapiens
ccatgaattcactccatgctag

SEQ ID NO: 7976904 - DNA, 22 bp, Homo sapiens
ccatgacattttaattttcact

SEQ ID NO: 7976905 - DNA, 22 bp, Homo sapiens
ccatgagccagctctaagcaaa

SEQ ID NO: 7976906 - DNA, 22 bp, Homo sapiens
ccatgagccaggctgaggaagc

SEQ ID NO: 7976907 - DNA, 22 bp, Homo sapiens
ccatgagaagttagactagcca

SEQ ID NO: 7976908 - DNA, 22 bp, Homo sapiens
ccatgagtagcgatttcatttt

SEQ ID NO: 7976909 - DNA, 22 bp, Homo sapiens
ccatgatggctatccttgcttg

SEQ ID NO: 7976910 - DNA, 22 bp, Homo sapiens
ccatgattcctctaagacctct

SEQ ID NO: 7976911 - DNA, 22 bp, Homo sapiens
ccatcttgggtcactgcccccc

SEQ ID NO: 7976912 - DNA, 22 bp, Homo sapiens
ccatcttgggtcactgcccccc

SEQ ID NO: 7976913 - DNA, 22 bp, Homo sapiens
ccatgaattcactccatgctag

SEQ ID NO: 7976914 - DNA, 22 bp, Homo sapiens
ccatctgtatctgacaaattct

SEQ ID NO: 7976915 - DNA, 22 bp, Homo sapiens
ccatctggatctgtccactgac

SEQ ID NO: 7976916 - DNA, 22 bp, Homo sapiens
ccatctgtctcctcctcgaatt

SEQ ID NO: 7976917 - DNA, 22 bp, Homo sapiens
ccatctgtctcctgatctagct

SEQ ID NO: 7976918 - DNA, 22 bp, Homo sapiens
ccatcttaattctaaagacaaa

SEQ ID NO: 7976919 - DNA, 21 bp, Homo sapiens
ccatctgtgctcatatttgct

SEQ ID NO: 7976920 - DNA, 22 bp, Homo sapiens
ccatcttacttggagagccatt

SEQ ID NO: 7976921 - DNA, 22 bp, Homo sapiens
ccatcttaattctaaagacaaa

SEQ ID NO: 7976922 - DNA, 22 bp, Homo sapiens
ccatctgtatctgacaaattct

SEQ ID NO: 7976923 - DNA, 22 bp, Homo sapiens
ccatctggagcatttgacctgg

SEQ ID NO: 7976924 - DNA, 22 bp, Homo sapiens
ccatctggagcatttgacctgg

SEQ ID NO: 7976925 - DNA, 22 bp, Homo sapiens
ccatctccagtttattcttcct

SEQ ID NO: 7976926 - DNA, 22 bp, Homo sapiens
ccatctccactgtccctgtcaa

SEQ ID NO: 7976927 - DNA, 22 bp, Homo sapiens
cccagcagtgacccagtgatac

SEQ ID NO: 7976928 - DNA, 22 bp, Homo sapiens
cccagcagtgacccagtgatac

SEQ ID NO: 7976929 - DNA, 22 bp, Homo sapiens
cccagcagtggttctcaaactt

SEQ ID NO: 7976930 - DNA, 22 bp, Homo sapiens
cccagcagtgacccagtgatac

SEQ ID NO: 7976931 - DNA, 22 bp, Homo sapiens
cccagcagtgacccagtgatac

SEQ ID NO: 7976932 - DNA, 22 bp, Homo sapiens
cccagcagtgacccagtgatac

SEQ ID NO: 7976933 - DNA, 22 bp, Homo sapiens
cccagcagtgacccagtgatac

SEQ ID NO: 7976934 - DNA, 22 bp, Homo sapiens
cccagcagtagagctcatatgg

SEQ ID NO: 7976935 - DNA, 22 bp, Homo sapiens
cccagcagtacccaagcccttg

SEQ ID NO: 7976936 - DNA, 22 bp, Homo sapiens
cccagcagtacccaagcccttg

SEQ ID NO: 7976937 - DNA, 22 bp, Homo sapiens
cccagcagtgacccagtgatac

SEQ ID NO: 7976938 - DNA, 22 bp, Homo sapiens
cccagcagtgacccagtgatac

SEQ ID NO: 7976939 - DNA, 22 bp, Homo sapiens
cccagcagtagagctcatatgg

SEQ ID NO: 7976940 - DNA, 22 bp, Homo sapiens
cccagcagtagagctcatatgg

SEQ ID NO: 7976941 - DNA, 22 bp, Homo sapiens
cccagcagtagagctcatatgg

SEQ ID NO: 7976942 - DNA, 22 bp, Homo sapiens
cccagcaaggccagctcagggc

SEQ ID NO: 7976943 - DNA, 22 bp, Homo sapiens
cccagcaaggccagctcagggc

SEQ ID NO: 7976944 - DNA, 22 bp, Homo sapiens
cccagcacaggcaattccatac

SEQ ID NO: 7976945 - DNA, 22 bp, Homo sapiens
cccagcagtacccaagcccttg

SEQ ID NO: 7976946 - DNA, 22 bp, Homo sapiens
cccagcagtacccaagcccttg

SEQ ID NO: 7976947 - DNA, 22 bp, Homo sapiens
cccagcagtacccaagcccttg

SEQ ID NO: 7976948 - DNA, 22 bp, Homo sapiens
cccagcagtacccaagcccttg

SEQ ID NO: 7976949 - DNA, 22 bp, Homo sapiens
cccagcagtacccaagcccttg

SEQ ID NO: 7976950 - DNA, 22 bp, Homo sapiens
cccagcagtacccaagcccttg

SEQ ID NO: 7976951 - DNA, 22 bp, Homo sapiens
cccagcagtacccaagcccttg

SEQ ID NO: 7976952 - DNA, 22 bp, Homo sapiens
cccagcagtaaccagtggaaat

SEQ ID NO: 7976953 - DNA, 22 bp, Homo sapiens
cccagcactcagcaggctcata

SEQ ID NO: 7976954 - DNA, 22 bp, Homo sapiens
cccagcactcagcaggctcata

SEQ ID NO: 7976955 - DNA, 22 bp, Homo sapiens
cccagcactcagcaggctcata

SEQ ID NO: 7976956 - DNA, 22 bp, Homo sapiens
cccagcagtaaccagtggaaat

SEQ ID NO: 7976957 - DNA, 22 bp, Homo sapiens
cccagcactcagcaggctcata

SEQ ID NO: 7976958 - DNA, 22 bp, Homo sapiens
cccagcagtaaccagtggaaat

SEQ ID NO: 7976959 - DNA, 22 bp, Homo sapiens
cccagcctcagctttacttcca

SEQ ID NO: 7976960 - DNA, 22 bp, Homo sapiens
cccagcatctccaggcatggcc

SEQ ID NO: 7976961 - DNA, 22 bp, Homo sapiens
cccagcatcctcagggagcggg

SEQ ID NO: 7976962 - DNA, 22 bp, Homo sapiens
cccagcatcctcagggagcggg

SEQ ID NO: 7976963 - DNA, 22 bp, Homo sapiens
cccagcatcccagtgggcagca

SEQ ID NO: 7976964 - DNA, 22 bp, Homo sapiens
cccagcatcctcagggagcggg

SEQ ID NO: 7976965 - DNA, 22 bp, Homo sapiens
cccagcatcccagtgggcagca

SEQ ID NO: 7976966 - DNA, 22 bp, Homo sapiens
cccagcatcccagtgggcagca

SEQ ID NO: 7976967 - DNA, 22 bp, Homo sapiens
cccagcagtttgcttagagtga

SEQ ID NO: 7976968 - DNA, 22 bp, Homo sapiens
cccagcatcccagtgggcagca

SEQ ID NO: 7976969 - DNA, 22 bp, Homo sapiens
cccagcatcccagtgggcagca

SEQ ID NO: 7976970 - DNA, 22 bp, Homo sapiens
cccagcagttgttggtgcacat

SEQ ID NO: 7976971 - DNA, 22 bp, Homo sapiens
cccagcagttgttggtgcacat

SEQ ID NO: 7976972 - DNA, 22 bp, Homo sapiens
cccagcagttgttggtgcacat

SEQ ID NO: 7976973 - DNA, 22 bp, Homo sapiens
cccagcagttgttggtgcacat

SEQ ID NO: 7976974 - DNA, 22 bp, Homo sapiens
cccagcagtttgcttagagtga

SEQ ID NO: 7976975 - DNA, 22 bp, Homo sapiens
cccagcagtttgcttagagtga

SEQ ID NO: 7976976 - DNA, 22 bp, Homo sapiens
cccagcagtttgcttagagtga

SEQ ID NO: 7976977 - DNA, 22 bp, Homo sapiens
cccagcagtttgcttagagtga

SEQ ID NO: 7976978 - DNA, 22 bp, Homo sapiens
cccagcagtttgcttagagtga

SEQ ID NO: 7976979 - DNA, 22 bp, Homo sapiens
cccagcagtggttctcaaactt

SEQ ID NO: 7976980 - DNA, 22 bp, Homo sapiens
cccagcagtggttctcaaactt

SEQ ID NO: 7976981 - DNA, 22 bp, Homo sapiens
cccagcagtggttctcaaactt

SEQ ID NO: 7976982 - DNA, 22 bp, Homo sapiens
cccagcagtggttctcaaactt

SEQ ID NO: 7976983 - DNA, 22 bp, Homo sapiens
cccagcagtggttctcaaactt

SEQ ID NO: 7976984 - DNA, 22 bp, Homo sapiens
cccagcagttgttggtgcacat

SEQ ID NO: 7976985 - DNA, 22 bp, Homo sapiens
cccagcagttgttggtgcacat

SEQ ID NO: 7976986 - DNA, 22 bp, Homo sapiens
cccagcagttgttggtgcacat

SEQ ID NO: 7976987 - DNA, 22 bp, Homo sapiens
cccagcagttgttggtgcacat

SEQ ID NO: 7976988 - DNA, 22 bp, Homo sapiens
agggcagcccttctgggagggc

SEQ ID NO: 7976989 - DNA, 22 bp, Homo sapiens
agggcagcctctcagcctaggt

SEQ ID NO: 7976990 - DNA, 22 bp, Homo sapiens
agggcagcctctcagcctaggt

SEQ ID NO: 7976991 - DNA, 22 bp, Homo sapiens
agggcagcctctcagcctaggt

SEQ ID NO: 7976992 - DNA, 22 bp, Homo sapiens
agggcagcctctcagcctaggt

SEQ ID NO: 7976993 - DNA, 22 bp, Homo sapiens
agggcagcctctcagcctaggt

SEQ ID NO: 7976994 - DNA, 22 bp, Homo sapiens
agggcagcctctcagcctaggt

SEQ ID NO: 7976995 - DNA, 22 bp, Homo sapiens
agggcagcctgagtgctggccc

SEQ ID NO: 7976996 - DNA, 22 bp, Homo sapiens
agggcagcctgagtgctggccc

SEQ ID NO: 7976997 - DNA, 22 bp, Homo sapiens
agggcagcctctcagcctaggt

SEQ ID NO: 7976998 - DNA, 22 bp, Homo sapiens
agggcagcctgagtgctggccc

SEQ ID NO: 7976999 - DNA, 22 bp, Homo sapiens
agggcagcctctcagcctaggt

SEQ ID NO: 7977000 - DNA, 22 bp, Homo sapiens
agggcagcctctcagcctaggt

SEQ ID NO: 7977001 - DNA, 22 bp, Homo sapiens
agggcagcctgagtgctggccc

SEQ ID NO: 7977002 - DNA, 22 bp, Homo sapiens
agggcagcggtgcttgtgttat

SEQ ID NO: 7977003 - DNA, 22 bp, Homo sapiens
agggcagcctgagtgctggccc

SEQ ID NO: 7977004 - DNA, 22 bp, Homo sapiens
agggcagctaaggtgctgactg

SEQ ID NO: 7977005 - DNA, 22 bp, Homo sapiens
agggcagctaaggtgctgactg

SEQ ID NO: 7977006 - DNA, 22 bp, Homo sapiens
agggcagctaaggtgctgactg

SEQ ID NO: 7977007 - DNA, 22 bp, Homo sapiens
agggcagcggtgcttgtgttat

SEQ ID NO: 7977008 - DNA, 22 bp, Homo sapiens
agggcagcggtgcttgtgttat

SEQ ID NO: 7977009 - DNA, 22 bp, Homo sapiens
agggcagctctcacctctggcc

SEQ ID NO: 7977010 - DNA, 22 bp, Homo sapiens
agggcagctctcacctctggcc

SEQ ID NO: 7977011 - DNA, 22 bp, Homo sapiens
agggcagctctcacctctggcc

SEQ ID NO: 7977012 - DNA, 22 bp, Homo sapiens
agggcagctagctgtagaaaga

SEQ ID NO: 7977013 - DNA, 22 bp, Homo sapiens
agggcagctagctgtagaaaga

SEQ ID NO: 7977014 - DNA, 22 bp, Homo sapiens
agggcagctaaggtgctgactg

SEQ ID NO: 7977015 - DNA, 22 bp, Homo sapiens
agggcagctaaggtgctgactg

SEQ ID NO: 7977016 - DNA, 22 bp, Homo sapiens
agggcagctgtgagccactgtg

SEQ ID NO: 7977017 - DNA, 22 bp, Homo sapiens
agggcagctgtgagccactgtg

SEQ ID NO: 7977018 - DNA, 22 bp, Homo sapiens
agggcagctgtgagccactgtg

SEQ ID NO: 7977019 - DNA, 22 bp, Homo sapiens
agggcagctgtgagccactgtg

SEQ ID NO: 7977020 - DNA, 22 bp, Homo sapiens
agggcagctggaaggtggcttc

SEQ ID NO: 7977021 - DNA, 22 bp, Homo sapiens
agggcagctgtgagccactgtg

SEQ ID NO: 7977022 - DNA, 22 bp, Homo sapiens
agggcagctgtgagccactgtg

SEQ ID NO: 7977023 - DNA, 22 bp, Homo sapiens
agggcagctggaaggtggcttc

SEQ ID NO: 7977024 - DNA, 22 bp, Homo sapiens
agggcagctggaaggtggcttc

SEQ ID NO: 7977025 - DNA, 22 bp, Homo sapiens
agggcagctggaaggtggcttc

SEQ ID NO: 7977026 - DNA, 22 bp, Homo sapiens
agggcagctctcacctctggcc

SEQ ID NO: 7977027 - DNA, 22 bp, Homo sapiens
agggcagctctcacctctggcc

SEQ ID NO: 7977028 - DNA, 22 bp, Homo sapiens
agggcagctggaaggtggcttc

SEQ ID NO: 7977029 - DNA, 22 bp, Homo sapiens
agggcagctggaaggtggcttc

SEQ ID NO: 7977030 - DNA, 22 bp, Homo sapiens
agggcagctggaaggtggcttc

SEQ ID NO: 7977031 - DNA, 22 bp, Homo sapiens
agggcagctggaaggtggcttc

SEQ ID NO: 7977032 - DNA, 22 bp, Homo sapiens
agggcagctctcacctctggcc

SEQ ID NO: 7977033 - DNA, 22 bp, Homo sapiens
agggcagctggaaggtggcttc

SEQ ID NO: 7977034 - DNA, 22 bp, Homo sapiens
agggcagctgtgagccactgtg

SEQ ID NO: 7977035 - DNA, 22 bp, Homo sapiens
agggcagctgtgagccactgtg

SEQ ID NO: 7977036 - DNA, 22 bp, Homo sapiens
agggcagctgtgagccactgtg

SEQ ID NO: 7977037 - DNA, 22 bp, Homo sapiens
agggccagagtggcaaaagcct

SEQ ID NO: 7977038 - DNA, 22 bp, Homo sapiens
agggccagagtggcaaaagcct

SEQ ID NO: 7977039 - DNA, 22 bp, Homo sapiens
agggccagccgacttccagcct

SEQ ID NO: 7977040 - DNA, 22 bp, Homo sapiens
agggccagccccaccctctctg

SEQ ID NO: 7977041 - DNA, 22 bp, Homo sapiens
agggccagccccaccctctctg

SEQ ID NO: 7977042 - DNA, 22 bp, Homo sapiens
agggccagccccaccctctctg

SEQ ID NO: 7977043 - DNA, 21 bp, Homo sapiens
agggccagatcaccaaggagc

SEQ ID NO: 7977044 - DNA, 21 bp, Homo sapiens
agggccagatcaccaaggagc

SEQ ID NO: 7977045 - DNA, 21 bp, Homo sapiens
agggccagatcaccaaggagc

SEQ ID NO: 7977046 - DNA, 21 bp, Homo sapiens
agggccagatcaccaaggagc

SEQ ID NO: 7977047 - DNA, 22 bp, Homo sapiens
agggccagccccaccctctctg

SEQ ID NO: 7977048 - DNA, 22 bp, Homo sapiens
agggccagccccaccctctctg

SEQ ID NO: 7977049 - DNA, 22 bp, Homo sapiens
agggcagcagctcctcctagct

SEQ ID NO: 7977050 - DNA, 22 bp, Homo sapiens
agggcagcagctgtccctgaga

SEQ ID NO: 7977051 - DNA, 22 bp, Homo sapiens
agggcagcagctcctcctagct

SEQ ID NO: 7977052 - DNA, 22 bp, Homo sapiens
agggcagcagctcctcctagct

SEQ ID NO: 7977053 - DNA, 22 bp, Homo sapiens
agggcagcagctcctcctagct

SEQ ID NO: 7977054 - DNA, 22 bp, Homo sapiens
agggcagatggaacttccccga

SEQ ID NO: 7977055 - DNA, 22 bp, Homo sapiens
agggcagatggaacttccccga

SEQ ID NO: 7977056 - DNA, 22 bp, Homo sapiens
agggcagcattgcctttctcca

SEQ ID NO: 7977057 - DNA, 22 bp, Homo sapiens
agggcagcattgcctttctcca

SEQ ID NO: 7977058 - DNA, 22 bp, Homo sapiens
agggcagcagctgtccctgaga

SEQ ID NO: 7977059 - DNA, 22 bp, Homo sapiens
agggcagcattgcctttctcca

SEQ ID NO: 7977060 - DNA, 22 bp, Homo sapiens
agggcagcattgcctttctcca

SEQ ID NO: 7977061 - DNA, 22 bp, Homo sapiens
agggcagcccttctgggagggc

SEQ ID NO: 7977062 - DNA, 22 bp, Homo sapiens
agggcagcccttctgggagggc

SEQ ID NO: 7977063 - DNA, 22 bp, Homo sapiens
agggcagcccttctgggagggc

SEQ ID NO: 7977064 - DNA, 22 bp, Homo sapiens
agggcagcccttctgggagggc

SEQ ID NO: 7977065 - DNA, 22 bp, Homo sapiens
agggcagcccttctgggagggc

SEQ ID NO: 7977066 - DNA, 22 bp, Homo sapiens
agggcagccattgagggattct

SEQ ID NO: 7977067 - DNA, 22 bp, Homo sapiens
agggcagccattgagggattct

SEQ ID NO: 7977068 - DNA, 22 bp, Homo sapiens
agggcagccattgagggattct

SEQ ID NO: 7977069 - DNA, 22 bp, Homo sapiens
agggcagccattgagggattct

SEQ ID NO: 7977070 - DNA, 22 bp, Homo sapiens
agggcagccatgagccttcagg

SEQ ID NO: 7977071 - DNA, 22 bp, Homo sapiens
agggcagccatgagccttcagg

SEQ ID NO: 7977072 - DNA, 22 bp, Homo sapiens
agggcagccatgagccttcagg

SEQ ID NO: 7977073 - DNA, 22 bp, Homo sapiens
agggcagccatgagccttcagg

SEQ ID NO: 7977074 - DNA, 22 bp, Homo sapiens
agggcagccattgagggattct

SEQ ID NO: 7977075 - DNA, 22 bp, Homo sapiens
agggcagccatgagccttcagg

SEQ ID NO: 7977076 - DNA, 22 bp, Homo sapiens
agggaggagaatggactccttc

SEQ ID NO: 7977077 - DNA, 22 bp, Homo sapiens
agggaggagaatggactccttc

SEQ ID NO: 7977078 - DNA, 22 bp, Homo sapiens
agggaggagaatggactccttc

SEQ ID NO: 7977079 - DNA, 22 bp, Homo sapiens
agggaggagtcctcaaagtcat

SEQ ID NO: 7977080 - DNA, 22 bp, Homo sapiens
agggaggagaatggactccttc

SEQ ID NO: 7977081 - DNA, 22 bp, Homo sapiens
agggaggagaatggactccttc

SEQ ID NO: 7977082 - DNA, 22 bp, Homo sapiens
agggcagagggtgcctcacctg

SEQ ID NO: 7977083 - DNA, 22 bp, Homo sapiens
agggcagagggtgcctcacctg

SEQ ID NO: 7977084 - DNA, 22 bp, Homo sapiens
agggcagagggtgcctcacctg

SEQ ID NO: 7977085 - DNA, 22 bp, Homo sapiens
agggaggagtcctcaaagtcat

SEQ ID NO: 7977086 - DNA, 22 bp, Homo sapiens
agggaggagtcctcaaagtcat

SEQ ID NO: 7977087 - DNA, 22 bp, Homo sapiens
agggaggaaggatgttccaaag

SEQ ID NO: 7977088 - DNA, 22 bp, Homo sapiens
agggaggaaggatgttccaaag

SEQ ID NO: 7977089 - DNA, 22 bp, Homo sapiens
agggaggaaggatgttccaaag

SEQ ID NO: 7977090 - DNA, 22 bp, Homo sapiens
agggaggaaggatgttccaaag

SEQ ID NO: 7977091 - DNA, 22 bp, Homo sapiens
agggaggaccaatgtgtggtta

SEQ ID NO: 7977092 - DNA, 22 bp, Homo sapiens
agggaggaccaatgtgtggtta

SEQ ID NO: 7977093 - DNA, 22 bp, Homo sapiens
agggaggagaatggactccttc

SEQ ID NO: 7977094 - DNA, 22 bp, Homo sapiens
agggaggagaatggactccttc

SEQ ID NO: 7977095 - DNA, 22 bp, Homo sapiens
agggaggagaatggactccttc

SEQ ID NO: 7977096 - DNA, 22 bp, Homo sapiens
agggaggagaatggactccttc

SEQ ID NO: 7977097 - DNA, 22 bp, Homo sapiens
agggaggagaatggactccttc

SEQ ID NO: 7977098 - DNA, 22 bp, Homo sapiens
agggaggaccaatgtgtggtta

SEQ ID NO: 7977099 - DNA, 22 bp, Homo sapiens
agggaggaccaatgtgtggtta

SEQ ID NO: 7977100 - DNA, 22 bp, Homo sapiens
agggccagggaagctgtatttt

SEQ ID NO: 7977101 - DNA, 22 bp, Homo sapiens
agggccagggaagctgtatttt

SEQ ID NO: 7977102 - DNA, 22 bp, Homo sapiens
agggccagggaagctgtatttt

SEQ ID NO: 7977103 - DNA, 22 bp, Homo sapiens
agggccagggaagctgtatttt

SEQ ID NO: 7977104 - DNA, 22 bp, Homo sapiens
ccctggcccctcactccgaggc

SEQ ID NO: 7977105 - DNA, 22 bp, Homo sapiens
ccctggcccctcactccgaggc

SEQ ID NO: 7977106 - DNA, 22 bp, Homo sapiens
ccctggcccctcactccgaggc

SEQ ID NO: 7977107 - DNA, 21 bp, Homo sapiens
ccctgggatgggcttggactt

SEQ ID NO: 7977108 - DNA, 22 bp, Homo sapiens
ccctgggatggattggcaggaa

SEQ ID NO: 7977109 - DNA, 22 bp, Homo sapiens
ccctgggatggattggcaggaa

SEQ ID NO: 7977110 - DNA, 22 bp, Homo sapiens
ccctgggatggattggcaggaa

SEQ ID NO: 7977111 - DNA, 22 bp, Homo sapiens
ccctggcccctcactccgaggc

SEQ ID NO: 7977112 - DNA, 22 bp, Homo sapiens
agggccagggaaacgatcagca

SEQ ID NO: 7977113 - DNA, 22 bp, Homo sapiens
agggccagggaaacgatcagca

SEQ ID NO: 7977114 - DNA, 22 bp, Homo sapiens
agggccagggaaacgatcagca

SEQ ID NO: 7977115 - DNA, 22 bp, Homo sapiens
agggccagggaaacgatcagca

SEQ ID NO: 7977116 - DNA, 22 bp, Homo sapiens
agggccaggctcccatgtcagg

SEQ ID NO: 7977117 - DNA, 22 bp, Homo sapiens
agggccaggctcccatgtcagg

SEQ ID NO: 7977118 - DNA, 22 bp, Homo sapiens
agggccaggctcccatgtcagg

SEQ ID NO: 7977119 - DNA, 22 bp, Homo sapiens
ccctgggctcagagcaggtagc

SEQ ID NO: 7977120 - DNA, 22 bp, Homo sapiens
ccctgggcagtctgcacttcag

SEQ ID NO: 7977121 - DNA, 22 bp, Homo sapiens
ccctgggctcagagcaggtagc

SEQ ID NO: 7977122 - DNA, 22 bp, Homo sapiens
ccctgggctcagagcaggtagc

SEQ ID NO: 7977123 - DNA, 22 bp, Homo sapiens
ccctgggctcagagcaggtagc

SEQ ID NO: 7977124 - DNA, 22 bp, Homo sapiens
ccctggggagcaggcgaaggag

SEQ ID NO: 7977125 - DNA, 22 bp, Homo sapiens
ccctgggctcagagcaggtagc

SEQ ID NO: 7977126 - DNA, 22 bp, Homo sapiens
ccctggggctgagggatggccg

SEQ ID NO: 7977127 - DNA, 22 bp, Homo sapiens
ccctggggctgagggatggccg

SEQ ID NO: 7977128 - DNA, 22 bp, Homo sapiens
ccctggggctgagggatggccg

SEQ ID NO: 7977129 - DNA, 22 bp, Homo sapiens
ccctggggctgagggatggccg

SEQ ID NO: 7977130 - DNA, 22 bp, Homo sapiens
ccctggggagcaggcgaaggag

SEQ ID NO: 7977131 - DNA, 22 bp, Homo sapiens
ccctggggagcaggcgaaggag

SEQ ID NO: 7977132 - DNA, 22 bp, Homo sapiens
ccctggggagcaggcgaaggag

SEQ ID NO: 7977133 - DNA, 22 bp, Homo sapiens
ccctggggagcaggcgaaggag

SEQ ID NO: 7977134 - DNA, 22 bp, Homo sapiens
ccctgggattgccttggccttg

SEQ ID NO: 7977135 - DNA, 22 bp, Homo sapiens
ccctgggattgccttggccttg

SEQ ID NO: 7977136 - DNA, 22 bp, Homo sapiens
ccctgggcaagccctattttcc

SEQ ID NO: 7977137 - DNA, 22 bp, Homo sapiens
ccctgggcaagccctattttcc

SEQ ID NO: 7977138 - DNA, 22 bp, Homo sapiens
ccctgggcaccaggcctggtaa

SEQ ID NO: 7977139 - DNA, 22 bp, Homo sapiens
ccctgggcaccaggcctggtaa

SEQ ID NO: 7977140 - DNA, 22 bp, Homo sapiens
ccctgggcaccaggcctggtaa

SEQ ID NO: 7977141 - DNA, 22 bp, Homo sapiens
ccctgggcaccaggcctggtaa

SEQ ID NO: 7977142 - DNA, 22 bp, Homo sapiens
ccctgggcagtctgcacttcag

SEQ ID NO: 7977143 - DNA, 22 bp, Homo sapiens
ccctgggcaccaggcctggtaa

SEQ ID NO: 7977144 - DNA, 22 bp, Homo sapiens
ccctgggcagtctgcacttcag

SEQ ID NO: 7977145 - DNA, 22 bp, Homo sapiens
ccctgggcagtctgcacttcag

SEQ ID NO: 7977146 - DNA, 21 bp, Homo sapiens
agggccagatcaccaaggagc

SEQ ID NO: 7977147 - DNA, 22 bp, Homo sapiens
agggccagctagagccctcgcc

SEQ ID NO: 7977148 - DNA, 22 bp, Homo sapiens
agggccagctagagccctcgcc

SEQ ID NO: 7977149 - DNA, 22 bp, Homo sapiens
agggccagctagagccctcgcc

SEQ ID NO: 7977150 - DNA, 22 bp, Homo sapiens
agggccagctagagccctcgcc

SEQ ID NO: 7977151 - DNA, 22 bp, Homo sapiens
agggccagctagagccctcgcc

SEQ ID NO: 7977152 - DNA, 22 bp, Homo sapiens
agggccagctagagccctcgcc

SEQ ID NO: 7977153 - DNA, 22 bp, Homo sapiens
agggccagccgacttccagcct

SEQ ID NO: 7977154 - DNA, 22 bp, Homo sapiens
agggccagccgacttccagcct

SEQ ID NO: 7977155 - DNA, 22 bp, Homo sapiens
agggccagctagagccctcgcc

SEQ ID NO: 7977156 - DNA, 22 bp, Homo sapiens
agggccagctagagccctcgcc

SEQ ID NO: 7977157 - DNA, 22 bp, Homo sapiens
agggccagctgatgagaatgag

SEQ ID NO: 7977158 - DNA, 22 bp, Homo sapiens
agggccagctgatgagaatgag

SEQ ID NO: 7977159 - DNA, 22 bp, Homo sapiens
agggccagctgatgagaatgag

SEQ ID NO: 7977160 - DNA, 22 bp, Homo sapiens
agggccagctgatgagaatgag

SEQ ID NO: 7977161 - DNA, 22 bp, Homo sapiens
agggccagctgatgagaatgag

SEQ ID NO: 7977162 - DNA, 22 bp, Homo sapiens
agggccagctgatgagaatgag

SEQ ID NO: 7977163 - DNA, 22 bp, Homo sapiens
agggccagctgatgagaatgag

SEQ ID NO: 7977164 - DNA, 22 bp, Homo sapiens
agggccagctgatgagaatgag

SEQ ID NO: 7977165 - DNA, 22 bp, Homo sapiens
agggccagctgcagaattagca

SEQ ID NO: 7977166 - DNA, 22 bp, Homo sapiens
agggccagctgcagaattagca

SEQ ID NO: 7977167 - DNA, 22 bp, Homo sapiens
agggccagctgcagaattagca

SEQ ID NO: 7977168 - DNA, 18 bp, Homo sapiens
agggccagctgtgagtag

SEQ ID NO: 7977169 - DNA, 18 bp, Homo sapiens
agggccagctgtgagtag

SEQ ID NO: 7977170 - DNA, 18 bp, Homo sapiens
agggccagctgtgagtag

SEQ ID NO: 7977171 - DNA, 18 bp, Homo sapiens
agggccagctgtgagtag

SEQ ID NO: 7977172 - DNA, 18 bp, Homo sapiens
agggccagctgtgagtag

SEQ ID NO: 7977173 - DNA, 22 bp, Homo sapiens
agggccaggaacacctgaaggg

SEQ ID NO: 7977174 - DNA, 22 bp, Homo sapiens
agggccaggaacacctgaaggg

SEQ ID NO: 7977175 - DNA, 22 bp, Homo sapiens
agggccaggaacacctgaaggg

SEQ ID NO: 7977176 - DNA, 22 bp, Homo sapiens
agggccaggaacacctgaaggg

SEQ ID NO: 7977177 - DNA, 22 bp, Homo sapiens
agggccaggaacacctgaaggg

SEQ ID NO: 7977178 - DNA, 18 bp, Homo sapiens
agggccagctgtgagtag

SEQ ID NO: 7977179 - DNA, 22 bp, Homo sapiens
agggccaggaacacctgaaggg

SEQ ID NO: 7977180 - DNA, 22 bp, Homo sapiens
agggccaggaacacctgaaggg

SEQ ID NO: 7977181 - DNA, 22 bp, Homo sapiens
agggccaggatcacagccaaga

SEQ ID NO: 7977182 - DNA, 22 bp, Homo sapiens
agggccaggatcacagccaaga

SEQ ID NO: 7977183 - DNA, 22 bp, Homo sapiens
agggccaggatcacagccaaga

SEQ ID NO: 7977184 - DNA, 22 bp, Homo sapiens
agggccaggatcacagccaaga

SEQ ID NO: 7977185 - DNA, 19 bp, Homo sapiens
agggccaggattctggaac

SEQ ID NO: 7977186 - DNA, 19 bp, Homo sapiens
agggccaggattctggaac

SEQ ID NO: 7977187 - DNA, 19 bp, Homo sapiens
agggccaggattctggaac

SEQ ID NO: 7977188 - DNA, 22 bp, Homo sapiens
agggccaggatcacagccaaga

SEQ ID NO: 7977189 - DNA, 19 bp, Homo sapiens
agggccaggattctggaac

SEQ ID NO: 7977190 - DNA, 22 bp, Homo sapiens
agggccaggctcccatgtcagg

SEQ ID NO: 7977191 - DNA, 19 bp, Homo sapiens
agggccaggattctggaac

SEQ ID NO: 7977192 - DNA, 22 bp, Homo sapiens
cctagaatgtacttaatagatg

SEQ ID NO: 7977193 - DNA, 22 bp, Homo sapiens
cctagaatgtgcagacttaggg

SEQ ID NO: 7977194 - DNA, 22 bp, Homo sapiens
cccttcagggttaagtagaggg

SEQ ID NO: 7977195 - DNA, 22 bp, Homo sapiens
cctagaattataaacttattag

SEQ ID NO: 7977196 - DNA, 22 bp, Homo sapiens
cctagaattataaacttattag

SEQ ID NO: 7977197 - DNA, 22 bp, Homo sapiens
cctagaattataaacttattag

SEQ ID NO: 7977198 - DNA, 22 bp, Homo sapiens
cctagaatgtgcagacttaggg

SEQ ID NO: 7977199 - DNA, 22 bp, Homo sapiens
cctagaatgtgcagacttaggg

SEQ ID NO: 7977200 - DNA, 22 bp, Homo sapiens
cctagacattaagcttgggttt

SEQ ID NO: 7977201 - DNA, 22 bp, Homo sapiens
cctcaaataagttttatttatc

SEQ ID NO: 7977202 - DNA, 22 bp, Homo sapiens
cctcaaatagcccccagtctag

SEQ ID NO: 7977203 - DNA, 20 bp, Homo sapiens
cctcaaataagtgccagcat

SEQ ID NO: 7977204 - DNA, 22 bp, Homo sapiens
cctcaaagtagagggagatgag

SEQ ID NO: 7977205 - DNA, 22 bp, Homo sapiens
cccttcaagctctctgggtttt

SEQ ID NO: 7977206 - DNA, 22 bp, Homo sapiens
cccttcaagctctctgggtttt

SEQ ID NO: 7977207 - DNA, 23 bp, Homo sapiens
cccttcagcgagggcattaaggt

SEQ ID NO: 7977208 - DNA, 23 bp, Homo sapiens
cccttcagcgagggcattaaggt

SEQ ID NO: 7977209 - DNA, 22 bp, Homo sapiens
cccttagctccaaggggtttgg

SEQ ID NO: 7977210 - DNA, 22 bp, Homo sapiens
cccttagctcaatttcttgccc

SEQ ID NO: 7977211 - DNA, 22 bp, Homo sapiens
cccttcagctgagtgggacagc

SEQ ID NO: 7977212 - DNA, 23 bp, Homo sapiens
cccttcagcgagggcattaaggt

SEQ ID NO: 7977213 - DNA, 22 bp, Homo sapiens
cccttcagctgagtgggacagc

SEQ ID NO: 7977214 - DNA, 22 bp, Homo sapiens
cccttcagctgagtgggacagc

SEQ ID NO: 7977215 - DNA, 22 bp, Homo sapiens
cccttcagctgagtgggacagc

SEQ ID NO: 7977216 - DNA, 22 bp, Homo sapiens
cccttcagggttaagtagaggg

SEQ ID NO: 7977217 - DNA, 22 bp, Homo sapiens
cccttcagggttaagtagaggg

SEQ ID NO: 7977218 - DNA, 22 bp, Homo sapiens
cccttcagggttaagtagaggg

SEQ ID NO: 7977219 - DNA, 22 bp, Homo sapiens
cccttcagggttaagtagaggg

SEQ ID NO: 7977220 - DNA, 22 bp, Homo sapiens
ccctgttttaagttgatattga

SEQ ID NO: 7977221 - DNA, 22 bp, Homo sapiens
ccctgtttaagaaacctgtaaa

SEQ ID NO: 7977222 - DNA, 22 bp, Homo sapiens
ccctgtttatttttggagagaa

SEQ ID NO: 7977223 - DNA, 22 bp, Homo sapiens
ccctgtttggatggggacccag

SEQ ID NO: 7977224 - DNA, 22 bp, Homo sapiens
ccctgtttatttttggagagaa

SEQ ID NO: 7977225 - DNA, 21 bp, Homo sapiens
ccctgtgttccacagcagaca

SEQ ID NO: 7977226 - DNA, 21 bp, Homo sapiens
ccctgtgttccacagcagaca

SEQ ID NO: 7977227 - DNA, 21 bp, Homo sapiens
ccctgtgttccacagcagaca

SEQ ID NO: 7977228 - DNA, 17 bp, Homo sapiens
cccttagagcaaaagat

SEQ ID NO: 7977229 - DNA, 22 bp, Homo sapiens
cccttagagattctgtcagagt

SEQ ID NO: 7977230 - DNA, 22 bp, Homo sapiens
cccttagaacaacattagcata

SEQ ID NO: 7977231 - DNA, 22 bp, Homo sapiens
cccttagaattttgtagttatt

SEQ ID NO: 7977232 - DNA, 22 bp, Homo sapiens
cccttagagattctgtcagagt

SEQ ID NO: 7977233 - DNA, 22 bp, Homo sapiens
cccttacatcagctccttcacc

SEQ ID NO: 7977234 - DNA, 22 bp, Homo sapiens
cccttaaaggctttgcctctct

SEQ ID NO: 7977235 - DNA, 22 bp, Homo sapiens
cccttacatcagctccttcacc

SEQ ID NO: 7977236 - DNA, 17 bp, Homo sapiens
ccctgggtgagttctca

SEQ ID NO: 7977237 - DNA, 22 bp, Homo sapiens
ccctgtggttgctagggcacag

SEQ ID NO: 7977238 - DNA, 22 bp, Homo sapiens
ccctgtggttgctagggcacag

SEQ ID NO: 7977239 - DNA, 22 bp, Homo sapiens
ccctgtggttgctagggcacag

SEQ ID NO: 7977240 - DNA, 22 bp, Homo sapiens
ccctgtggttgctagggcacag

SEQ ID NO: 7977241 - DNA, 22 bp, Homo sapiens
ccctgtgtagttaactttccac

SEQ ID NO: 7977242 - DNA, 22 bp, Homo sapiens
ccctgtgtagttaactttccac

SEQ ID NO: 7977243 - DNA, 19 bp, Homo sapiens
ccctgggggtttctggtac

SEQ ID NO: 7977244 - DNA, 19 bp, Homo sapiens
ccctgggggtttctggtac

SEQ ID NO: 7977245 - DNA, 22 bp, Homo sapiens
ccctggggctgagggatggccg

SEQ ID NO: 7977246 - DNA, 22 bp, Homo sapiens
ccctggggctgagggatggccg

SEQ ID NO: 7977247 - DNA, 19 bp, Homo sapiens
cctcaagtatgaagaggcc

SEQ ID NO: 7977248 - DNA, 22 bp, Homo sapiens
cctcaaattgtcaaataagaat

SEQ ID NO: 7977249 - DNA, 20 bp, Homo sapiens
cctcaagcagactgacagct

SEQ ID NO: 7977250 - DNA, 21 bp, Homo sapiens
cctcaagtgcctcctgctgct

SEQ ID NO: 7977251 - DNA, 22 bp, Homo sapiens
cctcaagtcaattctgtctcgc

SEQ ID NO: 7977252 - DNA, 22 bp, Homo sapiens
cctcaagtcattccggagacct

SEQ ID NO: 7977253 - DNA, 22 bp, Homo sapiens
cctcaagttggaaataaaatgt

SEQ ID NO: 7977254 - DNA, 22 bp, Homo sapiens
cctcaagttggaaataaaatgt

SEQ ID NO: 7977255 - DNA, 21 bp, Homo sapiens
cctcaagtgcctcctgctgct

SEQ ID NO: 7977256 - DNA, 18 bp, Homo sapiens
cctcacagacttccatgt

SEQ ID NO: 7977257 - DNA, 18 bp, Homo sapiens
cctcacagacttccatgt

SEQ ID NO: 7977258 - DNA, 22 bp, Homo sapiens
cctcagacacagtcaagctttt

SEQ ID NO: 7977259 - DNA, 22 bp, Homo sapiens
cctcaagaacaatccaccatta

SEQ ID NO: 7977260 - DNA, 22 bp, Homo sapiens
cctcaagatgcactgaacatat

SEQ ID NO: 7977261 - DNA, 22 bp, Homo sapiens
cctcaaattgtcaaataagaat

SEQ ID NO: 7977262 - DNA, 22 bp, Homo sapiens
cctcaaattggcattaattaag

SEQ ID NO: 7977263 - DNA, 22 bp, Homo sapiens
cctcaaattgtcaaataagaat

SEQ ID NO: 7977264 - DNA, 22 bp, Homo sapiens
cctcaaattgtcaaataagaat

SEQ ID NO: 7977265 - DNA, 23 bp, Homo sapiens
cctcaaatgtagcctttttccca

SEQ ID NO: 7977266 - DNA, 22 bp, Homo sapiens
cctcaaatctttagagttattt

SEQ ID NO: 7977267 - DNA, 22 bp, Homo sapiens
cctcaaataagttttatttatc

SEQ ID NO: 7977268 - DNA, 22 bp, Homo sapiens
cctcaaatagcccccagtctag

SEQ ID NO: 7977269 - DNA, 23 bp, Homo sapiens
cctcaaatgtagcctttttccca

SEQ ID NO: 7977270 - DNA, 22 bp, Homo sapiens
cctcaaattgctcagcgtctag

SEQ ID NO: 7977271 - DNA, 22 bp, Homo sapiens
cctcagaccttgctagtagtct

SEQ ID NO: 7977272 - DNA, 22 bp, Homo sapiens
cctcagaccttgctagtagtct

SEQ ID NO: 7977273 - DNA, 22 bp, Homo sapiens
cctcagactcagtgcgttgtga

SEQ ID NO: 7977274 - DNA, 22 bp, Homo sapiens
cctcagacgcaggcctatgggc

SEQ ID NO: 7977275 - DNA, 22 bp, Homo sapiens
cctcaagttggaaataaaatgt

SEQ ID NO: 7977276 - DNA, 22 bp, Homo sapiens
cctcagacccctgctgagcttc

SEQ ID NO: 7977277 - DNA, 22 bp, Homo sapiens
cctcagaccccacagggcctgt

SEQ ID NO: 7977278 - DNA, 22 bp, Homo sapiens
cctcagacacagtcaagctttt

SEQ ID NO: 7977279 - DNA, 22 bp, Homo sapiens
cctcagagacagtaactggaat

SEQ ID NO: 7977280 - DNA, 22 bp, Homo sapiens
cctcagacttgataattgggtt

SEQ ID NO: 7977281 - DNA, 22 bp, Homo sapiens
cctcagagaaaggtatggctga

SEQ ID NO: 7977282 - DNA, 22 bp, Homo sapiens
cctcagagactgcatcttccct

SEQ ID NO: 7977283 - DNA, 22 bp, Homo sapiens
cctcagagactgcatcttccct

SEQ ID NO: 7977284 - DNA, 22 bp, Homo sapiens
cctcagagacagtaactggaat

SEQ ID NO: 7977285 - DNA, 23 bp, Homo sapiens
cctcagagaggcagagccacatg

SEQ ID NO: 7977286 - DNA, 23 bp, Homo sapiens
cctcagagaggcagagccacatg

SEQ ID NO: 7977287 - DNA, 22 bp, Homo sapiens
cctcagagcctccagaaggaat

SEQ ID NO: 7977288 - DNA, 20 bp, Homo sapiens
cctcagagcgcaggccccct

SEQ ID NO: 7977289 - DNA, 22 bp, Homo sapiens
cctcagagcctccagaaggaat

SEQ ID NO: 7977290 - DNA, 22 bp, Homo sapiens
cctcagagcctccagaaggaat

SEQ ID NO: 7977291 - DNA, 22 bp, Homo sapiens
cctcagagccatgcctgagttc

SEQ ID NO: 7977292 - DNA, 22 bp, Homo sapiens
cctctccttgcacccgtcccgc

SEQ ID NO: 7977293 - DNA, 22 bp, Homo sapiens
cctctcggcagcccatcttgtc

SEQ ID NO: 7977294 - DNA, 22 bp, Homo sapiens
cctctccttgcacccgtcccgc

SEQ ID NO: 7977295 - DNA, 22 bp, Homo sapiens
cctctctcagcttgctgcaact

SEQ ID NO: 7977296 - DNA, 22 bp, Homo sapiens
cctctctccaattttcacctca

SEQ ID NO: 7977297 - DNA, 22 bp, Homo sapiens
cctctctccaattttcacctca

SEQ ID NO: 7977298 - DNA, 22 bp, Homo sapiens
cctctctccaattttcacctca

SEQ ID NO: 7977299 - DNA, 22 bp, Homo sapiens
cctccccacccacggctggtgg

SEQ ID NO: 7977300 - DNA, 22 bp, Homo sapiens
cctccccacccacggctggtgg

SEQ ID NO: 7977301 - DNA, 22 bp, Homo sapiens
cctccccacccacggctggtgg

SEQ ID NO: 7977302 - DNA, 22 bp, Homo sapiens
cctccccacccacggctggtgg

SEQ ID NO: 7977303 - DNA, 22 bp, Homo sapiens
cctccccacccacggctggtgg

SEQ ID NO: 7977304 - DNA, 22 bp, Homo sapiens
cctccccacccacggctggtgg

SEQ ID NO: 7977305 - DNA, 22 bp, Homo sapiens
cctcgctgtgtgaccttgggtg

SEQ ID NO: 7977306 - DNA, 22 bp, Homo sapiens
cctcggagaaaggcagctccac

SEQ ID NO: 7977307 - DNA, 22 bp, Homo sapiens
cctcggaatctattctagttac

SEQ ID NO: 7977308 - DNA, 22 bp, Homo sapiens
cctctccttgcacccgtcccgc

SEQ ID NO: 7977309 - DNA, 22 bp, Homo sapiens
cctcccatccctgcaagagagc

SEQ ID NO: 7977310 - DNA, 22 bp, Homo sapiens
cctcccatggagctctgtccat

SEQ ID NO: 7977311 - DNA, 22 bp, Homo sapiens
cctcccatggagctctgtccat

SEQ ID NO: 7977312 - DNA, 22 bp, Homo sapiens
cctccccacagcccaggagact

SEQ ID NO: 7977313 - DNA, 22 bp, Homo sapiens
cctccccacagcccaggagact

SEQ ID NO: 7977314 - DNA, 22 bp, Homo sapiens
cctccccacagcccaggagact

SEQ ID NO: 7977315 - DNA, 22 bp, Homo sapiens
cctccccacagcccaggagact

SEQ ID NO: 7977316 - DNA, 22 bp, Homo sapiens
cctccccacagcccaggagact

SEQ ID NO: 7977317 - DNA, 22 bp, Homo sapiens
cctccccacagcccaggagact

SEQ ID NO: 7977318 - DNA, 22 bp, Homo sapiens
cctccccacagcccaggagact

SEQ ID NO: 7977319 - DNA, 22 bp, Homo sapiens
cctccccacagcccaggagact

SEQ ID NO: 7977320 - DNA, 23 bp, Homo sapiens
cctccccaccagactctaacata

SEQ ID NO: 7977321 - DNA, 23 bp, Homo sapiens
cctccccaccagactctaacata

SEQ ID NO: 7977322 - DNA, 23 bp, Homo sapiens
cctccccaccagactctaacata

SEQ ID NO: 7977323 - DNA, 23 bp, Homo sapiens
cctccccaccagactctaacata

SEQ ID NO: 7977324 - DNA, 23 bp, Homo sapiens
cctccccaccagactctaacata

SEQ ID NO: 7977325 - DNA, 22 bp, Homo sapiens
cctccccacaggccaaataggc

SEQ ID NO: 7977326 - DNA, 22 bp, Homo sapiens
cctccccacaggccaaataggc

SEQ ID NO: 7977327 - DNA, 22 bp, Homo sapiens
cctccccacaggccaaataggc

SEQ ID NO: 7977328 - DNA, 22 bp, Homo sapiens
cctcccaggcattgccattttc

SEQ ID NO: 7977329 - DNA, 22 bp, Homo sapiens
cctccaggccttgcaggttaac

SEQ ID NO: 7977330 - DNA, 22 bp, Homo sapiens
cctccaggccttgcaggttaac

SEQ ID NO: 7977331 - DNA, 22 bp, Homo sapiens
cctccaggccttgcaggttaac

SEQ ID NO: 7977332 - DNA, 22 bp, Homo sapiens
cctccaggccttgcaggttaac

SEQ ID NO: 7977333 - DNA, 22 bp, Homo sapiens
cctccaggctgaatatctagaa

SEQ ID NO: 7977334 - DNA, 22 bp, Homo sapiens
cctccaggctgaatatctagaa

SEQ ID NO: 7977335 - DNA, 22 bp, Homo sapiens
cctccaggataagtcagggcct

SEQ ID NO: 7977336 - DNA, 22 bp, Homo sapiens
cctccaggataagtcagggcct

SEQ ID NO: 7977337 - DNA, 22 bp, Homo sapiens
cctccaggataagtcagggcct

SEQ ID NO: 7977338 - DNA, 22 bp, Homo sapiens
cctccaggataagtcagggcct

SEQ ID NO: 7977339 - DNA, 22 bp, Homo sapiens
cctccaggataagtcagggcct

SEQ ID NO: 7977340 - DNA, 20 bp, Homo sapiens
cctccaggcacacccatgtg

SEQ ID NO: 7977341 - DNA, 20 bp, Homo sapiens
cctccaggcacacccatgtg

SEQ ID NO: 7977342 - DNA, 20 bp, Homo sapiens
cctccaggcacacccatgtg

SEQ ID NO: 7977343 - DNA, 20 bp, Homo sapiens
cctccaggcacacccatgtg

SEQ ID NO: 7977344 - DNA, 20 bp, Homo sapiens
cctccaggcacacccatgtg

SEQ ID NO: 7977345 - DNA, 22 bp, Homo sapiens
cctcagtgagatgctcagcgaa

SEQ ID NO: 7977346 - DNA, 22 bp, Homo sapiens
cctccagctgcctcagtctctt

SEQ ID NO: 7977347 - DNA, 22 bp, Homo sapiens
cctcagtgacctattgcattca

SEQ ID NO: 7977348 - DNA, 22 bp, Homo sapiens
cctcagtgagatgctcagcgaa

SEQ ID NO: 7977349 - DNA, 22 bp, Homo sapiens
cctcagtcttgaattagccaga

SEQ ID NO: 7977350 - DNA, 22 bp, Homo sapiens
cctcagtgacctattgcattca

SEQ ID NO: 7977351 - DNA, 22 bp, Homo sapiens
cctccaggaacttgagagacac

SEQ ID NO: 7977352 - DNA, 22 bp, Homo sapiens
cctccaggaacttgagagacac

SEQ ID NO: 7977353 - DNA, 22 bp, Homo sapiens
cctccaggaacttgagagacac

SEQ ID NO: 7977354 - DNA, 22 bp, Homo sapiens
cctccaggaacttgagagacac

SEQ ID NO: 7977355 - DNA, 22 bp, Homo sapiens
cctccagctgcctcagtctctt

SEQ ID NO: 7977356 - DNA, 22 bp, Homo sapiens
cctccagctgcctcagtctctt

SEQ ID NO: 7977357 - DNA, 22 bp, Homo sapiens
cctccaggaacttgagagacac

SEQ ID NO: 7977358 - DNA, 22 bp, Homo sapiens
cctccaggaacttgagagacac

SEQ ID NO: 7977359 - DNA, 22 bp, Homo sapiens
cctccaggaggaaatggaacac

SEQ ID NO: 7977360 - DNA, 22 bp, Homo sapiens
cctccaggaggaaatggaacac

SEQ ID NO: 7977361 - DNA, 22 bp, Homo sapiens
cctccaggataagtcagggcct

SEQ ID NO: 7977362 - DNA, 21 bp, Homo sapiens
cctccaggagcagagccctga

SEQ ID NO: 7977363 - DNA, 22 bp, Homo sapiens
cctccaggaggaaatggaacac

SEQ ID NO: 7977364 - DNA, 22 bp, Homo sapiens
cctccaggaggaaatggaacac

SEQ ID NO: 7977365 - DNA, 21 bp, Homo sapiens
cctccaggagcagagccctga

SEQ ID NO: 7977366 - DNA, 21 bp, Homo sapiens
cctccaggagcagagccctga

SEQ ID NO: 7977367 - DNA, 21 bp, Homo sapiens
cctccaggagcagagccctga

SEQ ID NO: 7977368 - DNA, 21 bp, Homo sapiens
cctccaggagcagagccctga

SEQ ID NO: 7977369 - DNA, 21 bp, Homo sapiens
cctccaggagcagagccctga

SEQ ID NO: 7977370 - DNA, 22 bp, Homo sapiens
cctccaggaacttgagagacac

SEQ ID NO: 7977371 - DNA, 21 bp, Homo sapiens
cctccaggagcagagccctga

SEQ ID NO: 7977372 - DNA, 18 bp, Homo sapiens
aggcagcagcatcttctc

SEQ ID NO: 7977373 - DNA, 18 bp, Homo sapiens
aggcagcagcatcttctc

SEQ ID NO: 7977374 - DNA, 18 bp, Homo sapiens
aggcagcagcatcttctc

SEQ ID NO: 7977375 - DNA, 18 bp, Homo sapiens
aggcagcagcatcttctc

SEQ ID NO: 7977376 - DNA, 18 bp, Homo sapiens
aggcagcagcatcttctc

SEQ ID NO: 7977377 - DNA, 18 bp, Homo sapiens
aggcagcagcatcttctc

SEQ ID NO: 7977378 - DNA, 18 bp, Homo sapiens
aggcagcagcatcttctc

SEQ ID NO: 7977379 - DNA, 22 bp, Homo sapiens
aggcagcagaggttgaggaaag

SEQ ID NO: 7977380 - DNA, 18 bp, Homo sapiens
aggcagcagcatcttctc

SEQ ID NO: 7977381 - DNA, 22 bp, Homo sapiens
aggcagcagccacaaggcctga

SEQ ID NO: 7977382 - DNA, 22 bp, Homo sapiens
aggcagcagccacaaggcctga

SEQ ID NO: 7977383 - DNA, 22 bp, Homo sapiens
aggcagcagccacaaggcctga

SEQ ID NO: 7977384 - DNA, 22 bp, Homo sapiens
aggcagcagccacaaggcctga

SEQ ID NO: 7977385 - DNA, 22 bp, Homo sapiens
aggcagcagcttgctggttgcc

SEQ ID NO: 7977386 - DNA, 22 bp, Homo sapiens
aggcagcagccacaaggcctga

SEQ ID NO: 7977387 - DNA, 22 bp, Homo sapiens
aggcagcagcttgctggttgcc

SEQ ID NO: 7977388 - DNA, 22 bp, Homo sapiens
aggcagcagccacaaggcctga

SEQ ID NO: 7977389 - DNA, 22 bp, Homo sapiens
aggcagcagaggttgaggaaag

SEQ ID NO: 7977390 - DNA, 22 bp, Homo sapiens
aggcagcagaggttgaggaaag

SEQ ID NO: 7977391 - DNA, 22 bp, Homo sapiens
aggcagcagaggttgaggaaag

SEQ ID NO: 7977392 - DNA, 22 bp, Homo sapiens
aggcagcagaggttgaggaaag

SEQ ID NO: 7977393 - DNA, 22 bp, Homo sapiens
aggcagcagaggttgaggaaag

SEQ ID NO: 7977394 - DNA, 22 bp, Homo sapiens
aggcagcagaggttgaggaaag

SEQ ID NO: 7977395 - DNA, 22 bp, Homo sapiens
aggcagcagaggttgaggaaag

SEQ ID NO: 7977396 - DNA, 22 bp, Homo sapiens
aggcagcagaggttgaggaaag

SEQ ID NO: 7977397 - DNA, 22 bp, Homo sapiens
aggcagcagactgttaatcaga

SEQ ID NO: 7977398 - DNA, 22 bp, Homo sapiens
aggcagcagaggttgaggaaag

SEQ ID NO: 7977399 - DNA, 22 bp, Homo sapiens
aggcagcagactgttaatcaga

SEQ ID NO: 7977400 - DNA, 22 bp, Homo sapiens
aggcagcagactgttaatcaga

SEQ ID NO: 7977401 - DNA, 22 bp, Homo sapiens
aggcagcagaaaacaaatggtt

SEQ ID NO: 7977402 - DNA, 22 bp, Homo sapiens
aggcagcagaaaacaaatggtt

SEQ ID NO: 7977403 - DNA, 22 bp, Homo sapiens
aggcagcagcttgctggttgcc

SEQ ID NO: 7977404 - DNA, 21 bp, Homo sapiens
aggcagcaggatccagggaca

SEQ ID NO: 7977405 - DNA, 22 bp, Homo sapiens
aggcagcagcttgctggttgcc

SEQ ID NO: 7977406 - DNA, 21 bp, Homo sapiens
aggcagcaggatccagggaca

SEQ ID NO: 7977407 - DNA, 22 bp, Homo sapiens
catttacagcagactgatgaaa

SEQ ID NO: 7977408 - DNA, 22 bp, Homo sapiens
aggcagcagcttgctggttgcc

SEQ ID NO: 7977409 - DNA, 22 bp, Homo sapiens
catttacagcagactgatgaaa

SEQ ID NO: 7977410 - DNA, 22 bp, Homo sapiens
catttacagtgagagtttttac

SEQ ID NO: 7977411 - DNA, 22 bp, Homo sapiens
catttacagtgagagtttttac

SEQ ID NO: 7977412 - DNA, 22 bp, Homo sapiens
catttacagtgagagtttttac

SEQ ID NO: 7977413 - DNA, 22 bp, Homo sapiens
catttacagtgagagtttttac

SEQ ID NO: 7977414 - DNA, 22 bp, Homo sapiens
catttacagcagactgatgaaa

SEQ ID NO: 7977415 - DNA, 22 bp, Homo sapiens
catttacagtgagagtttttac

SEQ ID NO: 7977416 - DNA, 22 bp, Homo sapiens
catttacagtgagagtttttac

SEQ ID NO: 7977417 - DNA, 22 bp, Homo sapiens
catttacataacagtaacgctg

SEQ ID NO: 7977418 - DNA, 22 bp, Homo sapiens
catttacataacagtaacgctg

SEQ ID NO: 7977419 - DNA, 22 bp, Homo sapiens
catttacataacagtaacgctg

SEQ ID NO: 7977420 - DNA, 22 bp, Homo sapiens
catttacataacagtaacgctg

SEQ ID NO: 7977421 - DNA, 22 bp, Homo sapiens
catttacataacagtaacgctg

SEQ ID NO: 7977422 - DNA, 22 bp, Homo sapiens
catttacataacagtaacgctg

SEQ ID NO: 7977423 - DNA, 21 bp, Homo sapiens
catttacatgacagattggtt

SEQ ID NO: 7977424 - DNA, 21 bp, Homo sapiens
catttacatgacagattggtt

SEQ ID NO: 7977425 - DNA, 21 bp, Homo sapiens
catttacatgacagattggtt

SEQ ID NO: 7977426 - DNA, 19 bp, Homo sapiens
aggcagcattctggggctt

SEQ ID NO: 7977427 - DNA, 19 bp, Homo sapiens
aggcagcattctggggctt

SEQ ID NO: 7977428 - DNA, 22 bp, Homo sapiens
aggcagcatttctgcttatcca

SEQ ID NO: 7977429 - DNA, 22 bp, Homo sapiens
aggcagcatttctgcttatcca

SEQ ID NO: 7977430 - DNA, 19 bp, Homo sapiens
aggcagcattctggggctt

SEQ ID NO: 7977431 - DNA, 22 bp, Homo sapiens
aggcagcagtcatgaggaaaga

SEQ ID NO: 7977432 - DNA, 19 bp, Homo sapiens
aggcagcattctggggctt

SEQ ID NO: 7977433 - DNA, 22 bp, Homo sapiens
aggcagcagtcatgaggaaaga

SEQ ID NO: 7977434 - DNA, 22 bp, Homo sapiens
aggcagcagtcatgaggaaaga

SEQ ID NO: 7977435 - DNA, 19 bp, Homo sapiens
aggcagcattctggggctt

SEQ ID NO: 7977436 - DNA, 19 bp, Homo sapiens
aggcagcattctggggctt

SEQ ID NO: 7977437 - DNA, 19 bp, Homo sapiens
aggcagcattctggggctt

SEQ ID NO: 7977438 - DNA, 19 bp, Homo sapiens
aggcagcattctggggctt

SEQ ID NO: 7977439 - DNA, 22 bp, Homo sapiens
catttacatttaaggttaatat

SEQ ID NO: 7977440 - DNA, 22 bp, Homo sapiens
catttacatttaaggttaatat

SEQ ID NO: 7977441 - DNA, 22 bp, Homo sapiens
catttacatttaaggttaatat

SEQ ID NO: 7977442 - DNA, 22 bp, Homo sapiens
aggcagcagtcatgaggaaaga

SEQ ID NO: 7977443 - DNA, 22 bp, Homo sapiens
aggcagcagtcatgaggaaaga

SEQ ID NO: 7977444 - DNA, 21 bp, Homo sapiens
catttacatgacagattggtt

SEQ ID NO: 7977445 - DNA, 22 bp, Homo sapiens
catttacatttaaggttaatat

SEQ ID NO: 7977446 - DNA, 22 bp, Homo sapiens
catttacatttaaggttaatat

SEQ ID NO: 7977447 - DNA, 22 bp, Homo sapiens
catttacatttaaggttaatat

SEQ ID NO: 7977448 - DNA, 22 bp, Homo sapiens
catttacatttaaggttaatat

SEQ ID NO: 7977449 - DNA, 22 bp, Homo sapiens
aggcagcatttgaatccaggtc

SEQ ID NO: 7977450 - DNA, 22 bp, Homo sapiens
aggcagcatttctgcttatcca

SEQ ID NO: 7977451 - DNA, 22 bp, Homo sapiens
aggcagcatttgaatccaggtc

SEQ ID NO: 7977452 - DNA, 22 bp, Homo sapiens
aggcagcatttgaatccaggtc

SEQ ID NO: 7977453 - DNA, 22 bp, Homo sapiens
aggcagcatttgaatccaggtc

SEQ ID NO: 7977454 - DNA, 22 bp, Homo sapiens
aggcagcatttgaatccaggtc

SEQ ID NO: 7977455 - DNA, 22 bp, Homo sapiens
aggcagccaatcagaggctgac

SEQ ID NO: 7977456 - DNA, 22 bp, Homo sapiens
aggcagccaatcagaggctgac

SEQ ID NO: 7977457 - DNA, 22 bp, Homo sapiens
aggcagccaatcagaggctgac

SEQ ID NO: 7977458 - DNA, 22 bp, Homo sapiens
aggcagccaatcagaggctgac

SEQ ID NO: 7977459 - DNA, 22 bp, Homo sapiens
aggcagccaatcagaggctgac

SEQ ID NO: 7977460 - DNA, 22 bp, Homo sapiens
aggcagccaatcagaggctgac

SEQ ID NO: 7977461 - DNA, 22 bp, Homo sapiens
aggcagccagttcaggtttctt

SEQ ID NO: 7977462 - DNA, 22 bp, Homo sapiens
aggcagccagttcaggtttctt

SEQ ID NO: 7977463 - DNA, 22 bp, Homo sapiens
aggcagccagttcaggtttctt

SEQ ID NO: 7977464 - DNA, 21 bp, Homo sapiens
aggcagccagtcatgctccct

SEQ ID NO: 7977465 - DNA, 22 bp, Homo sapiens
aggcagccagatggcagcctgc

SEQ ID NO: 7977466 - DNA, 21 bp, Homo sapiens
aggcagccagtcatgctccct

SEQ ID NO: 7977467 - DNA, 22 bp, Homo sapiens
aggcagccagatggcagcctgc

SEQ ID NO: 7977468 - DNA, 22 bp, Homo sapiens
aggcagccagatggcagcctgc

SEQ ID NO: 7977469 - DNA, 22 bp, Homo sapiens
aggcagccagatggcagcctgc

SEQ ID NO: 7977470 - DNA, 22 bp, Homo sapiens
aggcagccagatggcagcctgc

SEQ ID NO: 7977471 - DNA, 22 bp, Homo sapiens
aggcagccacatgagctcctga

SEQ ID NO: 7977472 - DNA, 22 bp, Homo sapiens
aggcagccacatgagctcctga

SEQ ID NO: 7977473 - DNA, 22 bp, Homo sapiens
aggcagccacatgagctcctga

SEQ ID NO: 7977474 - DNA, 22 bp, Homo sapiens
catggcctctctcctggaatgg

SEQ ID NO: 7977475 - DNA, 22 bp, Homo sapiens
catggcctgcctcctcctggtg

SEQ ID NO: 7977476 - DNA, 22 bp, Homo sapiens
catggcctgcctcctcctggtg

SEQ ID NO: 7977477 - DNA, 22 bp, Homo sapiens
catggcctgcctcctcctggtg

SEQ ID NO: 7977478 - DNA, 22 bp, Homo sapiens
catggccagggcagatggcagg

SEQ ID NO: 7977479 - DNA, 22 bp, Homo sapiens
catggccccaaatcccatgcat

SEQ ID NO: 7977480 - DNA, 22 bp, Homo sapiens
catggccctcttctggagcaat

SEQ ID NO: 7977481 - DNA, 22 bp, Homo sapiens
catggcctcaaaggactgcaga

SEQ ID NO: 7977482 - DNA, 22 bp, Homo sapiens
catggccttgagtgactgcact

SEQ ID NO: 7977483 - DNA, 22 bp, Homo sapiens
catggcggtcaggatgtaggtg

SEQ ID NO: 7977484 - DNA, 22 bp, Homo sapiens
catggcggtcaggatgtaggtg

SEQ ID NO: 7977485 - DNA, 22 bp, Homo sapiens
catggcggtcaggatgtaggtg

SEQ ID NO: 7977486 - DNA, 22 bp, Homo sapiens
catggcggtcaggatgtaggtg

SEQ ID NO: 7977487 - DNA, 22 bp, Homo sapiens
catggctcacaggatgggctag

SEQ ID NO: 7977488 - DNA, 21 bp, Homo sapiens
cattaagtaccagggcactgt

SEQ ID NO: 7977489 - DNA, 22 bp, Homo sapiens
cattaagatttttttctactgg

SEQ ID NO: 7977490 - DNA, 22 bp, Homo sapiens
cattaagatttttttctactgg

SEQ ID NO: 7977491 - DNA, 22 bp, Homo sapiens
catggctcggggacaggaggta

SEQ ID NO: 7977492 - DNA, 22 bp, Homo sapiens
catggctcacaggatgggctag

SEQ ID NO: 7977493 - DNA, 22 bp, Homo sapiens
cattattaattcagcacatgct

SEQ ID NO: 7977494 - DNA, 22 bp, Homo sapiens
cattattgccagccatactgaa

SEQ ID NO: 7977495 - DNA, 22 bp, Homo sapiens
cattatgttcagtagcttaaaa

SEQ ID NO: 7977496 - DNA, 22 bp, Homo sapiens
cattatgtgagtgattaattca

SEQ ID NO: 7977497 - DNA, 18 bp, Homo sapiens
cattatgtggttatagaa

SEQ ID NO: 7977498 - DNA, 22 bp, Homo sapiens
cattatgtgggaaaatgttctt

SEQ ID NO: 7977499 - DNA, 22 bp, Homo sapiens
cattatgtgcgtacatgtatct

SEQ ID NO: 7977500 - DNA, 22 bp, Homo sapiens
cattatgtgcgtacatgtatct

SEQ ID NO: 7977501 - DNA, 22 bp, Homo sapiens
cattatgtgcgtacatgtatct

SEQ ID NO: 7977502 - DNA, 22 bp, Homo sapiens
cattatgtgagtgattaattca

SEQ ID NO: 7977503 - DNA, 22 bp, Homo sapiens
cattatctgagagtgtcctaca

SEQ ID NO: 7977504 - DNA, 22 bp, Homo sapiens
cattatctgagagtgtcctaca

SEQ ID NO: 7977505 - DNA, 22 bp, Homo sapiens
cattatctgagagtgtcctaca

SEQ ID NO: 7977506 - DNA, 20 bp, Homo sapiens
cattatggttgggcacagtg

SEQ ID NO: 7977507 - DNA, 22 bp, Homo sapiens
cattatggcagccaggatattg

SEQ ID NO: 7977508 - DNA, 22 bp, Homo sapiens
cattatggaagacagtgtggtg

SEQ ID NO: 7977509 - DNA, 22 bp, Homo sapiens
cattatggaagtgaagagctct

SEQ ID NO: 7977510 - DNA, 22 bp, Homo sapiens
cattatgccaaagtagaaatat

SEQ ID NO: 7977511 - DNA, 22 bp, Homo sapiens
cattatgatggtaattttctct

SEQ ID NO: 7977512 - DNA, 22 bp, Homo sapiens
cattatgatggtaattttctct

SEQ ID NO: 7977513 - DNA, 22 bp, Homo sapiens
cattccttaacgtggggagtct

SEQ ID NO: 7977514 - DNA, 22 bp, Homo sapiens
cattccttaacgtggggagtct

SEQ ID NO: 7977515 - DNA, 19 bp, Homo sapiens
aggcagaggcttggctagc

SEQ ID NO: 7977516 - DNA, 16 bp, Homo sapiens
aggcagatattgagtg

SEQ ID NO: 7977517 - DNA, 19 bp, Homo sapiens
aggcagcacccagtccttg

SEQ ID NO: 7977518 - DNA, 22 bp, Homo sapiens
aggcagcagaaaacaaatggtt

SEQ ID NO: 7977519 - DNA, 22 bp, Homo sapiens
aggcagcagaaaacaaatggtt

SEQ ID NO: 7977520 - DNA, 19 bp, Homo sapiens
aggcagcacccagtccttg

SEQ ID NO: 7977521 - DNA, 19 bp, Homo sapiens
aggcagcacccagtccttg

SEQ ID NO: 7977522 - DNA, 22 bp, Homo sapiens
cattcctattatgtccctagtg

SEQ ID NO: 7977523 - DNA, 22 bp, Homo sapiens
cattcctaaccacatgtgggct

SEQ ID NO: 7977524 - DNA, 22 bp, Homo sapiens
cattcccttggggagttcatgc

SEQ ID NO: 7977525 - DNA, 18 bp, Homo sapiens
cattccccatctctgagc

SEQ ID NO: 7977526 - DNA, 22 bp, Homo sapiens
cattccctgtctcttcaatcct

SEQ ID NO: 7977527 - DNA, 22 bp, Homo sapiens
cattcccttggggagttcatgc

SEQ ID NO: 7977528 - DNA, 22 bp, Homo sapiens
cattcccatgactcctgctcag

SEQ ID NO: 7977529 - DNA, 22 bp, Homo sapiens
cattccagctctcatactctgg

SEQ ID NO: 7977530 - DNA, 21 bp, Homo sapiens
cattcctcccctgacgtcagc

SEQ ID NO: 7977531 - DNA, 21 bp, Homo sapiens
cattcctcggctcatagagga

SEQ ID NO: 7977532 - DNA, 21 bp, Homo sapiens
cattcctcggctcatagagga

SEQ ID NO: 7977533 - DNA, 21 bp, Homo sapiens
cattcctcggctcatagagga

SEQ ID NO: 7977534 - DNA, 22 bp, Homo sapiens
cattcaaacattaatttattca

SEQ ID NO: 7977535 - DNA, 22 bp, Homo sapiens
cattcaaaagctccatgtttgt

SEQ ID NO: 7977536 - DNA, 20 bp, Homo sapiens
cattattgtaatcagctgta

SEQ ID NO: 7977537 - DNA, 22 bp, Homo sapiens
cattcaaaatgggctgacctgt

SEQ ID NO: 7977538 - DNA, 22 bp, Homo sapiens
cattccaagtatatacatgata

SEQ ID NO: 7977539 - DNA, 22 bp, Homo sapiens
cattccaagtatatacatgata

SEQ ID NO: 7977540 - DNA, 22 bp, Homo sapiens
cattccagatgaggccaggccc

SEQ ID NO: 7977541 - DNA, 22 bp, Homo sapiens
cattccagctctcatactctgg

SEQ ID NO: 7977542 - DNA, 22 bp, Homo sapiens
cattccagagctgcctctgcta

SEQ ID NO: 7977543 - DNA, 22 bp, Homo sapiens
cattccagagctgcctctgcta

SEQ ID NO: 7977544 - DNA, 22 bp, Homo sapiens
cattcccacgtgttctttgctt

SEQ ID NO: 7977545 - DNA, 22 bp, Homo sapiens
cattccagctctcatactctgg

SEQ ID NO: 7977546 - DNA, 22 bp, Homo sapiens
cattcccatgactcctgctcag

SEQ ID NO: 7977547 - DNA, 22 bp, Homo sapiens
cattcccacgtgttctttgctt

SEQ ID NO: 7977548 - DNA, 22 bp, Homo sapiens
catgaaaatgtcaagttctgct

SEQ ID NO: 7977549 - DNA, 22 bp, Homo sapiens
catgaaaatgtcaagttctgct

SEQ ID NO: 7977550 - DNA, 22 bp, Homo sapiens
catgaaatatgctacctgtctt

SEQ ID NO: 7977551 - DNA, 22 bp, Homo sapiens
catgaaatatgctacctgtctt

SEQ ID NO: 7977552 - DNA, 22 bp, Homo sapiens
catgaaatattagtaactgttt

SEQ ID NO: 7977553 - DNA, 22 bp, Homo sapiens
catgaaatattagtaactgttt

SEQ ID NO: 7977554 - DNA, 17 bp, Homo sapiens
catctttaaaatcctga

SEQ ID NO: 7977555 - DNA, 17 bp, Homo sapiens
catctttaaaatcctga

SEQ ID NO: 7977556 - DNA, 22 bp, Homo sapiens
catgaaaatgtcaagttctgct

SEQ ID NO: 7977557 - DNA, 22 bp, Homo sapiens
aggaggcactcactctcagggt

SEQ ID NO: 7977558 - DNA, 22 bp, Homo sapiens
aggaggcagatgcttggctgta

SEQ ID NO: 7977559 - DNA, 22 bp, Homo sapiens
aggaggcagatgcttggctgta

SEQ ID NO: 7977560 - DNA, 17 bp, Homo sapiens
catctttaaaatcctga

SEQ ID NO: 7977561 - DNA, 22 bp, Homo sapiens
aggaggcactcactctcagggt

SEQ ID NO: 7977562 - DNA, 22 bp, Homo sapiens
aggaggcactcactctcagggt

SEQ ID NO: 7977563 - DNA, 22 bp, Homo sapiens
aggaggcactcactctcagggt

SEQ ID NO: 7977564 - DNA, 22 bp, Homo sapiens
aggaggcactcactctcagggt

SEQ ID NO: 7977565 - DNA, 22 bp, Homo sapiens
aggaggcactcactctcagggt

SEQ ID NO: 7977566 - DNA, 22 bp, Homo sapiens
aggaggcactcactctcagggt

SEQ ID NO: 7977567 - DNA, 22 bp, Homo sapiens
catgaaatgttagaattagaca

SEQ ID NO: 7977568 - DNA, 22 bp, Homo sapiens
catgaaatgttagaattagaca

SEQ ID NO: 7977569 - DNA, 22 bp, Homo sapiens
catgaaatgttagaattagaca

SEQ ID NO: 7977570 - DNA, 22 bp, Homo sapiens
catgaaatgttagaattagaca

SEQ ID NO: 7977571 - DNA, 22 bp, Homo sapiens
catgaaatgttagaattagaca

SEQ ID NO: 7977572 - DNA, 22 bp, Homo sapiens
catgaaatgtgttaatctcttg

SEQ ID NO: 7977573 - DNA, 22 bp, Homo sapiens
aggaggtgcgtggtgatcccct

SEQ ID NO: 7977574 - DNA, 22 bp, Homo sapiens
aggaggtgctagagaagatgtt

SEQ ID NO: 7977575 - DNA, 22 bp, Homo sapiens
catgaaattcagcaggtgagta

SEQ ID NO: 7977576 - DNA, 22 bp, Homo sapiens
catgaaatcacaagctgaggac

SEQ ID NO: 7977577 - DNA, 22 bp, Homo sapiens
catgaaatcacaagctgaggac

SEQ ID NO: 7977578 - DNA, 22 bp, Homo sapiens
catgaaatctgagtatgtttcc

SEQ ID NO: 7977579 - DNA, 22 bp, Homo sapiens
catgaaatctgagtatgtttcc

SEQ ID NO: 7977580 - DNA, 22 bp, Homo sapiens
catgaaatctgagtatgtttcc

SEQ ID NO: 7977581 - DNA, 22 bp, Homo sapiens
catgaaatgatatttgggtggg

SEQ ID NO: 7977582 - DNA, 22 bp, Homo sapiens
catgaaatggccaaccttcggc

SEQ ID NO: 7977583 - DNA, 22 bp, Homo sapiens
catgaaatgtgttaatctcttg

SEQ ID NO: 7977584 - DNA, 22 bp, Homo sapiens
catgaaatgtgttaatctcttg

SEQ ID NO: 7977585 - DNA, 22 bp, Homo sapiens
aggaggtggcctgagcgtgccc

SEQ ID NO: 7977586 - DNA, 22 bp, Homo sapiens
aggaggtggcctgagcgtgccc

SEQ ID NO: 7977587 - DNA, 22 bp, Homo sapiens
aggaggtggcctgagcgtgccc

SEQ ID NO: 7977588 - DNA, 22 bp, Homo sapiens
aggaggtggcctgagcgtgccc

SEQ ID NO: 7977589 - DNA, 22 bp, Homo sapiens
aggaggtggctgaacttgaggg

SEQ ID NO: 7977590 - DNA, 22 bp, Homo sapiens
aggaggtggcctgagcgtgccc

SEQ ID NO: 7977591 - DNA, 22 bp, Homo sapiens
aggaggtgtagatttcctgtca

SEQ ID NO: 7977592 - DNA, 22 bp, Homo sapiens
aggaggtggctgaacttgaggg

SEQ ID NO: 7977593 - DNA, 22 bp, Homo sapiens
aggaggtggctgaacttgaggg

SEQ ID NO: 7977594 - DNA, 22 bp, Homo sapiens
aggaggtggctgaacttgaggg

SEQ ID NO: 7977595 - DNA, 22 bp, Homo sapiens
aggaggtgctgtttgtcctgga

SEQ ID NO: 7977596 - DNA, 22 bp, Homo sapiens
aggaggtgctgtttgtcctgga

SEQ ID NO: 7977597 - DNA, 22 bp, Homo sapiens
aggaggtggcaactgtcgacag

SEQ ID NO: 7977598 - DNA, 22 bp, Homo sapiens
aggaggtggcctgagcgtgccc

SEQ ID NO: 7977599 - DNA, 22 bp, Homo sapiens
aggaggtggcctgagcgtgccc

SEQ ID NO: 7977600 - DNA, 22 bp, Homo sapiens
aggaggtgctagagaagatgtt

SEQ ID NO: 7977601 - DNA, 22 bp, Homo sapiens
aggaggtgctagagaagatgtt

SEQ ID NO: 7977602 - DNA, 22 bp, Homo sapiens
aggaggtgctagagaagatgtt

SEQ ID NO: 7977603 - DNA, 22 bp, Homo sapiens
aggaggtgctagagaagatgtt

SEQ ID NO: 7977604 - DNA, 22 bp, Homo sapiens
aggaggtgctgtttgtcctgga

SEQ ID NO: 7977605 - DNA, 22 bp, Homo sapiens
aggaggtgctgtttgtcctgga

SEQ ID NO: 7977606 - DNA, 22 bp, Homo sapiens
aggaggtgttgatagaaggttt

SEQ ID NO: 7977607 - DNA, 22 bp, Homo sapiens
aggaggtgttgatagaaggttt

SEQ ID NO: 7977608 - DNA, 22 bp, Homo sapiens
aggaggtgttgatagaaggttt

SEQ ID NO: 7977609 - DNA, 22 bp, Homo sapiens
catgagtgagtatctcaagata

SEQ ID NO: 7977610 - DNA, 22 bp, Homo sapiens
catgaggtgataaagctgggat

SEQ ID NO: 7977611 - DNA, 22 bp, Homo sapiens
catgcacagagcttggtcattg

SEQ ID NO: 7977612 - DNA, 22 bp, Homo sapiens
catgcacagagcttggtcattg

SEQ ID NO: 7977613 - DNA, 22 bp, Homo sapiens
catgcacagagcttggtcattg

SEQ ID NO: 7977614 - DNA, 22 bp, Homo sapiens
catgcacactgcaacaaggact

SEQ ID NO: 7977615 - DNA, 22 bp, Homo sapiens
catgagtgggcgccaggaagag

SEQ ID NO: 7977616 - DNA, 22 bp, Homo sapiens
catgagtgggcgccaggaagag

SEQ ID NO: 7977617 - DNA, 22 bp, Homo sapiens
catgagtgctatatgtgaagag

SEQ ID NO: 7977618 - DNA, 22 bp, Homo sapiens
catgcacattattcaaagccca

SEQ ID NO: 7977619 - DNA, 22 bp, Homo sapiens
catgcactctttgagaaggatg

SEQ ID NO: 7977620 - DNA, 22 bp, Homo sapiens
catgcacatgtggctatgtaat

SEQ ID NO: 7977621 - DNA, 22 bp, Homo sapiens
catgcacatgtggctatgtaat

SEQ ID NO: 7977622 - DNA, 22 bp, Homo sapiens
catgcacatgtggctatgtaat

SEQ ID NO: 7977623 - DNA, 22 bp, Homo sapiens
catgcactgatgcaaggtctgc

SEQ ID NO: 7977624 - DNA, 22 bp, Homo sapiens
catgcacatgcaatagtgcttt

SEQ ID NO: 7977625 - DNA, 22 bp, Homo sapiens
catgcacagtgatatctgaaga

SEQ ID NO: 7977626 - DNA, 22 bp, Homo sapiens
catgcacagtgatatctgaaga

SEQ ID NO: 7977627 - DNA, 22 bp, Homo sapiens
catgcacagtgatatctgaaga

SEQ ID NO: 7977628 - DNA, 22 bp, Homo sapiens
catgcacagagcttggtcattg

SEQ ID NO: 7977629 - DNA, 20 bp, Homo sapiens
catgcacagccatagcgcta

SEQ ID NO: 7977630 - DNA, 20 bp, Homo sapiens
catgcacagccatagcgcta

SEQ ID NO: 7977631 - DNA, 20 bp, Homo sapiens
catgccatgtctactgaggc

SEQ ID NO: 7977632 - DNA, 22 bp, Homo sapiens
catgccagttttgagatgcacc

SEQ ID NO: 7977633 - DNA, 22 bp, Homo sapiens
catgccatgtgtgaggagagga

SEQ ID NO: 7977634 - DNA, 22 bp, Homo sapiens
catgccagttttgagatgcacc

SEQ ID NO: 7977635 - DNA, 22 bp, Homo sapiens
catgccagttttgagatgcacc

SEQ ID NO: 7977636 - DNA, 23 bp, Homo sapiens
catgccagtttgtgcaggcagat

SEQ ID NO: 7977637 - DNA, 22 bp, Homo sapiens
catgccagggcttgctgcctgg

SEQ ID NO: 7977638 - DNA, 22 bp, Homo sapiens
catgccagggcttgctgcctgg

SEQ ID NO: 7977639 - DNA, 22 bp, Homo sapiens
catgcccagagctccgggcgcc

SEQ ID NO: 7977640 - DNA, 22 bp, Homo sapiens
catgccatttcttctctttatg

SEQ ID NO: 7977641 - DNA, 22 bp, Homo sapiens
catgccattaacattagctagc

SEQ ID NO: 7977642 - DNA, 22 bp, Homo sapiens
catgcctctgcagctgtttatt

SEQ ID NO: 7977643 - DNA, 17 bp, Homo sapiens
catgccccaggcttagc

SEQ ID NO: 7977644 - DNA, 17 bp, Homo sapiens
catgccccaggcttagc

SEQ ID NO: 7977645 - DNA, 20 bp, Homo sapiens
catgcctgctggtatctggc

SEQ ID NO: 7977646 - DNA, 20 bp, Homo sapiens
catgcctgctggtatctggc

SEQ ID NO: 7977647 - DNA, 22 bp, Homo sapiens
catgcctgtaatcccagcactt

SEQ ID NO: 7977648 - DNA, 22 bp, Homo sapiens
catgcctgtaatcccagctctt

SEQ ID NO: 7977649 - DNA, 22 bp, Homo sapiens
catgcctgtaatcccagctctt

SEQ ID NO: 7977650 - DNA, 22 bp, Homo sapiens
catgcctgtaatcccagctctt

SEQ ID NO: 7977651 - DNA, 22 bp, Homo sapiens
catgcaggcccgcctgaatggg

SEQ ID NO: 7977652 - DNA, 22 bp, Homo sapiens
catgcaggcccgcctgaatggg

SEQ ID NO: 7977653 - DNA, 22 bp, Homo sapiens
catgccaggattaggacccagc

SEQ ID NO: 7977654 - DNA, 22 bp, Homo sapiens
catgcaggcctatggagcagtg

SEQ ID NO: 7977655 - DNA, 22 bp, Homo sapiens
catgcaggcctatggagcagtg

SEQ ID NO: 7977656 - DNA, 22 bp, Homo sapiens
catgcaggcctatggagcagtg

SEQ ID NO: 7977657 - DNA, 22 bp, Homo sapiens
catgccagggcttgctgcctgg

SEQ ID NO: 7977658 - DNA, 22 bp, Homo sapiens
catgcaggaggaaaaagcagct

SEQ ID NO: 7977659 - DNA, 22 bp, Homo sapiens
catgcagcctgtgaacagtgtc

SEQ ID NO: 7977660 - DNA, 22 bp, Homo sapiens
catgcagatttgctgagataat

SEQ ID NO: 7977661 - DNA, 22 bp, Homo sapiens
catgcagcggcgtttggtttaa

SEQ ID NO: 7977662 - DNA, 22 bp, Homo sapiens
catgcaggcacccagagcccac

SEQ ID NO: 7977663 - DNA, 21 bp, Homo sapiens
catgcaggatttaacctagaa

SEQ ID NO: 7977664 - DNA, 22 bp, Homo sapiens
catgcaggaggaaaaagcagct

SEQ ID NO: 7977665 - DNA, 22 bp, Homo sapiens
catgcagcctgtgaacagtgtc

SEQ ID NO: 7977666 - DNA, 22 bp, Homo sapiens
catgcagcaggatctcattccc

SEQ ID NO: 7977667 - DNA, 22 bp, Homo sapiens
catgcagatttgctgagataat

SEQ ID NO: 7977668 - DNA, 22 bp, Homo sapiens
catgcagcagaataatgactat

SEQ ID NO: 7977669 - DNA, 22 bp, Homo sapiens
catgcagcagaataatgactat

SEQ ID NO: 7977670 - DNA, 22 bp, Homo sapiens
catgcagatttgctgagataat

SEQ ID NO: 7977671 - DNA, 22 bp, Homo sapiens
catgcagatttgctgagataat

SEQ ID NO: 7977672 - DNA, 21 bp, Homo sapiens
catgcagattctggagccaga

SEQ ID NO: 7977673 - DNA, 21 bp, Homo sapiens
catgcagattctggagccaga

SEQ ID NO: 7977674 - DNA, 22 bp, Homo sapiens
catgcagatgtcatgaggcatg

SEQ ID NO: 7977675 - DNA, 22 bp, Homo sapiens
catgcagatgtcatgaggcatg

SEQ ID NO: 7977676 - DNA, 22 bp, Homo sapiens
catgcagatatttttattgtgg

SEQ ID NO: 7977677 - DNA, 22 bp, Homo sapiens
catgcagataattatattgtgt

SEQ ID NO: 7977678 - DNA, 22 bp, Homo sapiens
catgcagagtttattaccatct

SEQ ID NO: 7977679 - DNA, 22 bp, Homo sapiens
catgcagagtttattaccatct

SEQ ID NO: 7977680 - DNA, 22 bp, Homo sapiens
catgcagatgtcatgaggcatg

SEQ ID NO: 7977681 - DNA, 22 bp, Homo sapiens
catgcagatctgagttctagct

SEQ ID NO: 7977682 - DNA, 22 bp, Homo sapiens
catgcagaggtgccacgaggct

SEQ ID NO: 7977683 - DNA, 22 bp, Homo sapiens
catgcagaggtgccacgaggct

SEQ ID NO: 7977684 - DNA, 22 bp, Homo sapiens
catgcactttgatggagagcgt

SEQ ID NO: 7977685 - DNA, 22 bp, Homo sapiens
aggcacaggaacaggaaaagag

SEQ ID NO: 7977686 - DNA, 22 bp, Homo sapiens
aggcacaggaacaggaaaagag

SEQ ID NO: 7977687 - DNA, 22 bp, Homo sapiens
aggcacaggaacaggaaaagag

SEQ ID NO: 7977688 - DNA, 22 bp, Homo sapiens
aggcacaggaacaggaaaagag

SEQ ID NO: 7977689 - DNA, 22 bp, Homo sapiens
aggcacaggaacaggaaaagag

SEQ ID NO: 7977690 - DNA, 22 bp, Homo sapiens
aggcacaggaacaggaaaagag

SEQ ID NO: 7977691 - DNA, 22 bp, Homo sapiens
aggcacaggaatgtcatccagt

SEQ ID NO: 7977692 - DNA, 22 bp, Homo sapiens
aggcacaggaacaggaaaagag

SEQ ID NO: 7977693 - DNA, 22 bp, Homo sapiens
aggcacaggaacaggaaaagag

SEQ ID NO: 7977694 - DNA, 22 bp, Homo sapiens
aggcacaggaacaggaaaagag

SEQ ID NO: 7977695 - DNA, 22 bp, Homo sapiens
aggcacagcctcccttcacatg

SEQ ID NO: 7977696 - DNA, 22 bp, Homo sapiens
aggcacagcctcccttcacatg

SEQ ID NO: 7977697 - DNA, 22 bp, Homo sapiens
aggcacagcctcccttcacatg

SEQ ID NO: 7977698 - DNA, 22 bp, Homo sapiens
aggcacagcctcccttcacatg

SEQ ID NO: 7977699 - DNA, 22 bp, Homo sapiens
aggcacagcctcccttcacatg

SEQ ID NO: 7977700 - DNA, 22 bp, Homo sapiens
aggcacagcctcccttcacatg

SEQ ID NO: 7977701 - DNA, 22 bp, Homo sapiens
aggcacagcctcccccaactcc

SEQ ID NO: 7977702 - DNA, 22 bp, Homo sapiens
aggcacagcctcccccaactcc

SEQ ID NO: 7977703 - DNA, 22 bp, Homo sapiens
aggcacagcctcccccaactcc

SEQ ID NO: 7977704 - DNA, 22 bp, Homo sapiens
aggcacagcctcccccaactcc

SEQ ID NO: 7977705 - DNA, 22 bp, Homo sapiens
aggcacagcacacctggccccc

SEQ ID NO: 7977706 - DNA, 22 bp, Homo sapiens
aggcacaaaagcagggtgacca

SEQ ID NO: 7977707 - DNA, 22 bp, Homo sapiens
catgcctgtatttctgatctat

SEQ ID NO: 7977708 - DNA, 23 bp, Homo sapiens
aggcaatgccctgctgagaactc

SEQ ID NO: 7977709 - DNA, 22 bp, Homo sapiens
aggcaatgcagatagatgaatg

SEQ ID NO: 7977710 - DNA, 22 bp, Homo sapiens
aggcaatggggcttcaggcagg

SEQ ID NO: 7977711 - DNA, 21 bp, Homo sapiens
aggcaattcgaagttgcagac

SEQ ID NO: 7977712 - DNA, 22 bp, Homo sapiens
aggcacaggaggtggtaagaag

SEQ ID NO: 7977713 - DNA, 22 bp, Homo sapiens
aggcacaggaggtggtaagaag

SEQ ID NO: 7977714 - DNA, 22 bp, Homo sapiens
aggcacaggaatgtcatccagt

SEQ ID NO: 7977715 - DNA, 22 bp, Homo sapiens
aggcacaggaatgtcatccagt

SEQ ID NO: 7977716 - DNA, 22 bp, Homo sapiens
aggcacaggaggtggtaagaag

SEQ ID NO: 7977717 - DNA, 22 bp, Homo sapiens
aggcacaggaggtggtaagaag

SEQ ID NO: 7977718 - DNA, 22 bp, Homo sapiens
aggcacaggaggtggtaagaag

SEQ ID NO: 7977719 - DNA, 22 bp, Homo sapiens
aggcacaggaggtggtaagaag

SEQ ID NO: 7977720 - DNA, 22 bp, Homo sapiens
aggcacaggaatgtcatccagt

SEQ ID NO: 7977721 - DNA, 22 bp, Homo sapiens
aggcacaggaatgtcatccagt

SEQ ID NO: 7977722 - DNA, 22 bp, Homo sapiens
aggcacaggaatgtcatccagt

SEQ ID NO: 7977723 - DNA, 22 bp, Homo sapiens
aggcacaggaatgtcatccagt

SEQ ID NO: 7977724 - DNA, 22 bp, Homo sapiens
aggcacaggaatgtcatccagt

SEQ ID NO: 7977725 - DNA, 22 bp, Homo sapiens
aggcacaggaatgtcatccagt

SEQ ID NO: 7977726 - DNA, 22 bp, Homo sapiens
aggcacaggaatgtcatccagt

SEQ ID NO: 7977727 - DNA, 22 bp, Homo sapiens
aggcacaggcctcagcacccag

SEQ ID NO: 7977728 - DNA, 22 bp, Homo sapiens
aggcacaggcctcagcacccag

SEQ ID NO: 7977729 - DNA, 22 bp, Homo sapiens
catggccaggccaagagagtac

SEQ ID NO: 7977730 - DNA, 22 bp, Homo sapiens
aggcacaggcctcagcacccag

SEQ ID NO: 7977731 - DNA, 22 bp, Homo sapiens
aggcacaggcctcagcacccag

SEQ ID NO: 7977732 - DNA, 22 bp, Homo sapiens
catggccagggcagatggcagg

SEQ ID NO: 7977733 - DNA, 22 bp, Homo sapiens
catggccaggcccagggcccag

SEQ ID NO: 7977734 - DNA, 19 bp, Homo sapiens
aggaaggaacctgagtctg

SEQ ID NO: 7977735 - DNA, 19 bp, Homo sapiens
aggaaggaacctgagtctg

SEQ ID NO: 7977736 - DNA, 19 bp, Homo sapiens
aggaaggaacctgagtctg

SEQ ID NO: 7977737 - DNA, 22 bp, Homo sapiens
aggaaggaagagacaccatttg

SEQ ID NO: 7977738 - DNA, 19 bp, Homo sapiens
aggaaggaacctgagtctg

SEQ ID NO: 7977739 - DNA, 19 bp, Homo sapiens
aggaaggaacctgagtctg

SEQ ID NO: 7977740 - DNA, 22 bp, Homo sapiens
aggaagctttatgaccagctaa

SEQ ID NO: 7977741 - DNA, 22 bp, Homo sapiens
aggaagcttggggcagggctac

SEQ ID NO: 7977742 - DNA, 22 bp, Homo sapiens
aggaagcttggggcagggctac

SEQ ID NO: 7977743 - DNA, 22 bp, Homo sapiens
aggaagcttgtgtgtattggtc

SEQ ID NO: 7977744 - DNA, 19 bp, Homo sapiens
aggaaggaacctgagtctg

SEQ ID NO: 7977745 - DNA, 22 bp, Homo sapiens
aggaagctttatgaccagctaa

SEQ ID NO: 7977746 - DNA, 19 bp, Homo sapiens
aggaaggaacctgagtctg

SEQ ID NO: 7977747 - DNA, 20 bp, Homo sapiens
aggaaggaagtttgcatgga

SEQ ID NO: 7977748 - DNA, 20 bp, Homo sapiens
aggaaggaagtttgcatgga

SEQ ID NO: 7977749 - DNA, 20 bp, Homo sapiens
aggaaggaagtttgcatgga

SEQ ID NO: 7977750 - DNA, 20 bp, Homo sapiens
aggaaggaagtttgcatgga

SEQ ID NO: 7977751 - DNA, 20 bp, Homo sapiens
aggaaggaagtttgcatgga

SEQ ID NO: 7977752 - DNA, 20 bp, Homo sapiens
aggaaggaagtttgcatgga

SEQ ID NO: 7977753 - DNA, 20 bp, Homo sapiens
aggaaggaagtttgcatgga

SEQ ID NO: 7977754 - DNA, 19 bp, Homo sapiens
aggaaggaacctgagtctg

SEQ ID NO: 7977755 - DNA, 22 bp, Homo sapiens
aggaaggaagagacaccatttg

SEQ ID NO: 7977756 - DNA, 22 bp, Homo sapiens
aggaaggaagagacaccatttg

SEQ ID NO: 7977757 - DNA, 22 bp, Homo sapiens
aggaaggaagagacaccatttg

SEQ ID NO: 7977758 - DNA, 22 bp, Homo sapiens
aggaaggaagagacaccatttg

SEQ ID NO: 7977759 - DNA, 22 bp, Homo sapiens
aggaaggactgcagcatttggt

SEQ ID NO: 7977760 - DNA, 22 bp, Homo sapiens
aggaaggactgcagcatttggt

SEQ ID NO: 7977761 - DNA, 22 bp, Homo sapiens
aggaaggactccatggtccgtc

SEQ ID NO: 7977762 - DNA, 22 bp, Homo sapiens
aggaaggactgcagcatttggt

SEQ ID NO: 7977763 - DNA, 20 bp, Homo sapiens
aggaaggaagtttgcatgga

SEQ ID NO: 7977764 - DNA, 22 bp, Homo sapiens
aggaagctggtgtgaggatgaa

SEQ ID NO: 7977765 - DNA, 22 bp, Homo sapiens
aggaagctggtgtgaggatgaa

SEQ ID NO: 7977766 - DNA, 22 bp, Homo sapiens
aggaagctggtgtgaggatgaa

SEQ ID NO: 7977767 - DNA, 22 bp, Homo sapiens
aggaagctggttacgaagggat

SEQ ID NO: 7977768 - DNA, 21 bp, Homo sapiens
aggaagctgcccagatagtag

SEQ ID NO: 7977769 - DNA, 22 bp, Homo sapiens
aggaagctgcctgggatgggaa

SEQ ID NO: 7977770 - DNA, 20 bp, Homo sapiens
aggaagctgagatgtagagg

SEQ ID NO: 7977771 - DNA, 22 bp, Homo sapiens
aggaagctctctgcttttaaga

SEQ ID NO: 7977772 - DNA, 22 bp, Homo sapiens
aggaagctgctaagaaacaatg

SEQ ID NO: 7977773 - DNA, 22 bp, Homo sapiens
aggaagctgctaagaaacaatg

SEQ ID NO: 7977774 - DNA, 22 bp, Homo sapiens
aggaagctgcctgggatgggaa

SEQ ID NO: 7977775 - DNA, 22 bp, Homo sapiens
aggaagctgggaaactgacatt

SEQ ID NO: 7977776 - DNA, 22 bp, Homo sapiens
aggaagctgggaaactgacatt

SEQ ID NO: 7977777 - DNA, 22 bp, Homo sapiens
aggacagcagccattggcagtc

SEQ ID NO: 7977778 - DNA, 22 bp, Homo sapiens
aggacagcagccattggcagtc

SEQ ID NO: 7977779 - DNA, 22 bp, Homo sapiens
aggacagcagccattggcagtc

SEQ ID NO: 7977780 - DNA, 20 bp, Homo sapiens
aggacagcagctgccacttg

SEQ ID NO: 7977781 - DNA, 21 bp, Homo sapiens
aggacagcaggagcatttatt

SEQ ID NO: 7977782 - DNA, 21 bp, Homo sapiens
aggacagcaggagcatttatt

SEQ ID NO: 7977783 - DNA, 21 bp, Homo sapiens
aggacagcaggagcatttatt

SEQ ID NO: 7977784 - DNA, 22 bp, Homo sapiens
aggacagcagtgctggcacttg

SEQ ID NO: 7977785 - DNA, 22 bp, Homo sapiens
aggacagcaaccgttattcaca

SEQ ID NO: 7977786 - DNA, 22 bp, Homo sapiens
aggacagcaaccgttattcaca

SEQ ID NO: 7977787 - DNA, 22 bp, Homo sapiens
aggacagcagccattggcagtc

SEQ ID NO: 7977788 - DNA, 22 bp, Homo sapiens
aggacagcaaccgttattcaca

SEQ ID NO: 7977789 - DNA, 22 bp, Homo sapiens
aggacagcaaccgttattcaca

SEQ ID NO: 7977790 - DNA, 22 bp, Homo sapiens
cagtcctgggcacagccctggg

SEQ ID NO: 7977791 - DNA, 22 bp, Homo sapiens
cagtcctgggcacagccctggg

SEQ ID NO: 7977792 - DNA, 20 bp, Homo sapiens
cagtcctgccccttggggac

SEQ ID NO: 7977793 - DNA, 22 bp, Homo sapiens
cagtcctgcccaggctgacaga

SEQ ID NO: 7977794 - DNA, 22 bp, Homo sapiens
cagtcctgcccaggctgacaga

SEQ ID NO: 7977795 - DNA, 20 bp, Homo sapiens
cagtcctgccccttggggac

SEQ ID NO: 7977796 - DNA, 22 bp, Homo sapiens
cagtcctgctagtgtgaaaagc

SEQ ID NO: 7977797 - DNA, 22 bp, Homo sapiens
cagtcctgctagtgtgaaaagc

SEQ ID NO: 7977798 - DNA, 22 bp, Homo sapiens
cagtcctgctagtgtgaaaagc

SEQ ID NO: 7977799 - DNA, 22 bp, Homo sapiens
cagtcctgctagtgtgaaaagc

SEQ ID NO: 7977800 - DNA, 22 bp, Homo sapiens
cagtcctgggcacagccctggg

SEQ ID NO: 7977801 - DNA, 22 bp, Homo sapiens
cagtcctgggagacttacccag

SEQ ID NO: 7977802 - DNA, 22 bp, Homo sapiens
cagtcctggagcccttcttggc

SEQ ID NO: 7977803 - DNA, 22 bp, Homo sapiens
cagtcctggagcccttcttggc

SEQ ID NO: 7977804 - DNA, 22 bp, Homo sapiens
cagtcctgctggccttccctgg

SEQ ID NO: 7977805 - DNA, 22 bp, Homo sapiens
cagtcctgctggccttccctgg

SEQ ID NO: 7977806 - DNA, 22 bp, Homo sapiens
cagtcctgctggccttccctgg

SEQ ID NO: 7977807 - DNA, 22 bp, Homo sapiens
cagtcctgctggccttccctgg

SEQ ID NO: 7977808 - DNA, 22 bp, Homo sapiens
cagtcctggagcccttcttggc

SEQ ID NO: 7977809 - DNA, 22 bp, Homo sapiens
cagtcctggagcccttcttggc

SEQ ID NO: 7977810 - DNA, 22 bp, Homo sapiens
cagtcctgctggccttccctgg

SEQ ID NO: 7977811 - DNA, 22 bp, Homo sapiens
cagtccatatgccataattctt

SEQ ID NO: 7977812 - DNA, 22 bp, Homo sapiens
cagtcctgagccaatcatgatg

SEQ ID NO: 7977813 - DNA, 22 bp, Homo sapiens
cagtcctgagccaatcatgatg

SEQ ID NO: 7977814 - DNA, 22 bp, Homo sapiens
cagtcctgagccaatcatgatg

SEQ ID NO: 7977815 - DNA, 22 bp, Homo sapiens
cagtcctgaatactggacggtg

SEQ ID NO: 7977816 - DNA, 22 bp, Homo sapiens
cagtcctgaatactggacggtg

SEQ ID NO: 7977817 - DNA, 22 bp, Homo sapiens
cagtcctgaatactggacggtg

SEQ ID NO: 7977818 - DNA, 22 bp, Homo sapiens
cagtcctgaatactggacggtg

SEQ ID NO: 7977819 - DNA, 22 bp, Homo sapiens
cagtcctctggagtgagggtga

SEQ ID NO: 7977820 - DNA, 17 bp, Homo sapiens
cagtcctctgctctaag

SEQ ID NO: 7977821 - DNA, 18 bp, Homo sapiens
cagtcccaaaccttagga

SEQ ID NO: 7977822 - DNA, 22 bp, Homo sapiens
cagtccagtgatttttccagtt

SEQ ID NO: 7977823 - DNA, 22 bp, Homo sapiens
cagtccagtgatttttccagtt

SEQ ID NO: 7977824 - DNA, 22 bp, Homo sapiens
aggaaggactgcagcatttggt

SEQ ID NO: 7977825 - DNA, 18 bp, Homo sapiens
cagtcccaaaccttagga

SEQ ID NO: 7977826 - DNA, 17 bp, Homo sapiens
cagtcctctgctctaag

SEQ ID NO: 7977827 - DNA, 22 bp, Homo sapiens
cagtcctgaggaagagctgctg

SEQ ID NO: 7977828 - DNA, 22 bp, Homo sapiens
cagtcctgaggaagagctgctg

SEQ ID NO: 7977829 - DNA, 22 bp, Homo sapiens
cagtcctgaggaagagctgctg

SEQ ID NO: 7977830 - DNA, 22 bp, Homo sapiens
cagtcctgaggaagagctgctg

SEQ ID NO: 7977831 - DNA, 22 bp, Homo sapiens
cagtcctgagctcctgggctga

SEQ ID NO: 7977832 - DNA, 22 bp, Homo sapiens
cagtcctgagctcctgggctga

SEQ ID NO: 7977833 - DNA, 22 bp, Homo sapiens
cagtcctgagctcctgggctga

SEQ ID NO: 7977834 - DNA, 22 bp, Homo sapiens
cagtcctgagctcctgggctga

SEQ ID NO: 7977835 - DNA, 22 bp, Homo sapiens
cagtcctgagctcctgggctga

SEQ ID NO: 7977836 - DNA, 20 bp, Homo sapiens
cagtcctgcaggcgggagaa

SEQ ID NO: 7977837 - DNA, 20 bp, Homo sapiens
cagtcctgcaggcgggagaa

SEQ ID NO: 7977838 - DNA, 21 bp, Homo sapiens
cagtcctgcaaataattcttt

SEQ ID NO: 7977839 - DNA, 20 bp, Homo sapiens
cagtcctgcaggcgggagaa

SEQ ID NO: 7977840 - DNA, 22 bp, Homo sapiens
aggacagcattttcagcatctc

SEQ ID NO: 7977841 - DNA, 22 bp, Homo sapiens
aggacagcatatgggaaccagt

SEQ ID NO: 7977842 - DNA, 22 bp, Homo sapiens
aggacagcatatgggaaccagt

SEQ ID NO: 7977843 - DNA, 22 bp, Homo sapiens
aggacagcagttggtgaggttc

SEQ ID NO: 7977844 - DNA, 22 bp, Homo sapiens
aggacagcagttggtgaggttc

SEQ ID NO: 7977845 - DNA, 22 bp, Homo sapiens
aggacagcagtgctggcacttg

SEQ ID NO: 7977846 - DNA, 22 bp, Homo sapiens
aggacagcattttcagcatctc

SEQ ID NO: 7977847 - DNA, 22 bp, Homo sapiens
aggacagcattttcagcatctc

SEQ ID NO: 7977848 - DNA, 22 bp, Homo sapiens
aggacagcattttcagcatctc

SEQ ID NO: 7977849 - DNA, 22 bp, Homo sapiens
aggacagcccccaacagcaaca

SEQ ID NO: 7977850 - DNA, 22 bp, Homo sapiens
aggacagcccccaacagcaaca

SEQ ID NO: 7977851 - DNA, 22 bp, Homo sapiens
aggacagcccccaacagcaaca

SEQ ID NO: 7977852 - DNA, 22 bp, Homo sapiens
aggacagcccccaacagcaaca

SEQ ID NO: 7977853 - DNA, 22 bp, Homo sapiens
aggacagcccttgagagcacat

SEQ ID NO: 7977854 - DNA, 21 bp, Homo sapiens
aggacaggaactggctgaata

SEQ ID NO: 7977855 - DNA, 21 bp, Homo sapiens
aggacaggaactggctgaata

SEQ ID NO: 7977856 - DNA, 21 bp, Homo sapiens
aggacaggaactggctgaata

SEQ ID NO: 7977857 - DNA, 21 bp, Homo sapiens
aggacaggaactggctgaata

SEQ ID NO: 7977858 - DNA, 21 bp, Homo sapiens
aggacaggaactggctgaata

SEQ ID NO: 7977859 - DNA, 21 bp, Homo sapiens
aggacaggaactggctgaata

SEQ ID NO: 7977860 - DNA, 22 bp, Homo sapiens
aggacagcccttgagagcacat

SEQ ID NO: 7977861 - DNA, 22 bp, Homo sapiens
aggacagcccttgagagcacat

SEQ ID NO: 7977862 - DNA, 21 bp, Homo sapiens
aggacaggaactggctgaata

SEQ ID NO: 7977863 - DNA, 21 bp, Homo sapiens
aggacaggaactggctgaata

SEQ ID NO: 7977864 - DNA, 22 bp, Homo sapiens
aggagaaagactggacagccaa

SEQ ID NO: 7977865 - DNA, 22 bp, Homo sapiens
aggagaaagactggacagccaa

SEQ ID NO: 7977866 - DNA, 22 bp, Homo sapiens
aggagaaagactggacagccaa

SEQ ID NO: 7977867 - DNA, 18 bp, Homo sapiens
aggagaaagggaccaggg

SEQ ID NO: 7977868 - DNA, 18 bp, Homo sapiens
aggagaaagggaccaggg

SEQ ID NO: 7977869 - DNA, 18 bp, Homo sapiens
aggagaaagggaccaggg

SEQ ID NO: 7977870 - DNA, 20 bp, Homo sapiens
aggagaaattcgggacacct

SEQ ID NO: 7977871 - DNA, 20 bp, Homo sapiens
aggagaaattcgggacacct

SEQ ID NO: 7977872 - DNA, 22 bp, Homo sapiens
aggagaaatccatcgagaatgg

SEQ ID NO: 7977873 - DNA, 22 bp, Homo sapiens
aggagaaatccatcgagaatgg

SEQ ID NO: 7977874 - DNA, 18 bp, Homo sapiens
aggagaaagggaccaggg

SEQ ID NO: 7977875 - DNA, 21 bp, Homo sapiens
aggagaaacacaggtcagccc

SEQ ID NO: 7977876 - DNA, 21 bp, Homo sapiens
aggagaaacacaggtcagccc

SEQ ID NO: 7977877 - DNA, 21 bp, Homo sapiens
aggagaaacacaggtcagccc

SEQ ID NO: 7977878 - DNA, 21 bp, Homo sapiens
aggagaaacacaggtcagccc

SEQ ID NO: 7977879 - DNA, 22 bp, Homo sapiens
aggacttttcatcagctatcct

SEQ ID NO: 7977880 - DNA, 22 bp, Homo sapiens
aggagaaaacagtgttttgcct

SEQ ID NO: 7977881 - DNA, 22 bp, Homo sapiens
aggactttagagccagaaagac

SEQ ID NO: 7977882 - DNA, 22 bp, Homo sapiens
aggactgacttttgccatgaaa

SEQ ID NO: 7977883 - DNA, 22 bp, Homo sapiens
aggacaggattccttgccttgc

SEQ ID NO: 7977884 - DNA, 22 bp, Homo sapiens
aggactgatgatggtgctgaca

SEQ ID NO: 7977885 - DNA, 22 bp, Homo sapiens
aggactttagagccagaaagac

SEQ ID NO: 7977886 - DNA, 22 bp, Homo sapiens
aggactgacttttgccatgaaa

SEQ ID NO: 7977887 - DNA, 22 bp, Homo sapiens
aggacaggattccttgccttgc

SEQ ID NO: 7977888 - DNA, 22 bp, Homo sapiens
cagtctctgtgccagatcctgg

SEQ ID NO: 7977889 - DNA, 22 bp, Homo sapiens
cagtctctgtcatctcatggga

SEQ ID NO: 7977890 - DNA, 22 bp, Homo sapiens
cagtctctgtcatctcatggga

SEQ ID NO: 7977891 - DNA, 22 bp, Homo sapiens
cagtctctggtgagttgacagt

SEQ ID NO: 7977892 - DNA, 22 bp, Homo sapiens
cagtctctgggaaagaggacag

SEQ ID NO: 7977893 - DNA, 22 bp, Homo sapiens
cagtctcttttcagctccatcc

SEQ ID NO: 7977894 - DNA, 22 bp, Homo sapiens
cagtctctttatccaccaagcc

SEQ ID NO: 7977895 - DNA, 22 bp, Homo sapiens
cagtctctgtgccagatcctgg

SEQ ID NO: 7977896 - DNA, 22 bp, Homo sapiens
cagtctctgtgccagatcctgg

SEQ ID NO: 7977897 - DNA, 22 bp, Homo sapiens
cagtctcttgcttcattagttg

SEQ ID NO: 7977898 - DNA, 22 bp, Homo sapiens
cagtctcttgcttcattagttg

SEQ ID NO: 7977899 - DNA, 22 bp, Homo sapiens
aggagaattaggaactcaagat

SEQ ID NO: 7977900 - DNA, 22 bp, Homo sapiens
cagtctcttttcagctccatcc

SEQ ID NO: 7977901 - DNA, 22 bp, Homo sapiens
cagtctcttttcagctccatcc

SEQ ID NO: 7977902 - DNA, 22 bp, Homo sapiens
cagtctcttttcagctccatcc

SEQ ID NO: 7977903 - DNA, 22 bp, Homo sapiens
aggagacagaatttaaatttgg

SEQ ID NO: 7977904 - DNA, 22 bp, Homo sapiens
aggagacagccaggggcctgag

SEQ ID NO: 7977905 - DNA, 22 bp, Homo sapiens
aggagacagaatttaaatttgg

SEQ ID NO: 7977906 - DNA, 22 bp, Homo sapiens
cagtctctcttgtagtgcagct

SEQ ID NO: 7977907 - DNA, 22 bp, Homo sapiens
cagtctctcttgtagtgcagct

SEQ ID NO: 7977908 - DNA, 22 bp, Homo sapiens
cagtctctctgaagtattaaga

SEQ ID NO: 7977909 - DNA, 22 bp, Homo sapiens
cagtctctggcagctgctggcc

SEQ ID NO: 7977910 - DNA, 22 bp, Homo sapiens
cagtctctcttgtagtgcagct

SEQ ID NO: 7977911 - DNA, 22 bp, Homo sapiens
cagtctctcttgtagtgcagct

SEQ ID NO: 7977912 - DNA, 22 bp, Homo sapiens
cagtctctctccttgcaggcgt

SEQ ID NO: 7977913 - DNA, 22 bp, Homo sapiens
cagtctctctccttgcaggcgt

SEQ ID NO: 7977914 - DNA, 22 bp, Homo sapiens
aggagaagccaagttgtgagca

SEQ ID NO: 7977915 - DNA, 22 bp, Homo sapiens
aggagaagccaagttgtgagca

SEQ ID NO: 7977916 - DNA, 22 bp, Homo sapiens
aggagaagccaagttgtgagca

SEQ ID NO: 7977917 - DNA, 22 bp, Homo sapiens
cagtctctctccttgcaggcgt

SEQ ID NO: 7977918 - DNA, 22 bp, Homo sapiens
aggagaagccaagttgtgagca

SEQ ID NO: 7977919 - DNA, 22 bp, Homo sapiens
aggagaagccaagttgtgagca

SEQ ID NO: 7977920 - DNA, 22 bp, Homo sapiens
aggagaagccaagttgtgagca

SEQ ID NO: 7977921 - DNA, 22 bp, Homo sapiens
aggagaagccaagttgtgagca

SEQ ID NO: 7977922 - DNA, 23 bp, Homo sapiens
aggagaagagatttccacatgca

SEQ ID NO: 7977923 - DNA, 23 bp, Homo sapiens
aggagaagagatttccacatgca

SEQ ID NO: 7977924 - DNA, 23 bp, Homo sapiens
aggagaagagatttccacatgca

SEQ ID NO: 7977925 - DNA, 23 bp, Homo sapiens
aggagaagagatttccacatgca

SEQ ID NO: 7977926 - DNA, 23 bp, Homo sapiens
aggagaagagatttccacatgca

SEQ ID NO: 7977927 - DNA, 23 bp, Homo sapiens
aggagaagagatttccacatgca

SEQ ID NO: 7977928 - DNA, 23 bp, Homo sapiens
aggagaagagatttccacatgca

SEQ ID NO: 7977929 - DNA, 23 bp, Homo sapiens
aggagaagagatttccacatgca

SEQ ID NO: 7977930 - DNA, 23 bp, Homo sapiens
aggagaagagatttccacatgca

SEQ ID NO: 7977931 - DNA, 19 bp, Homo sapiens
aggagaagactctctcccc

SEQ ID NO: 7977932 - DNA, 22 bp, Homo sapiens
aggaggaggtaagaaaagcata

SEQ ID NO: 7977933 - DNA, 22 bp, Homo sapiens
aggaggaggtgggacacagtga

SEQ ID NO: 7977934 - DNA, 22 bp, Homo sapiens
aggaggaggtgggacacagtga

SEQ ID NO: 7977935 - DNA, 22 bp, Homo sapiens
aggaggaggtaagaaaagcata

SEQ ID NO: 7977936 - DNA, 22 bp, Homo sapiens
aggaggaggtaagaaaagcata

SEQ ID NO: 7977937 - DNA, 22 bp, Homo sapiens
aggaggaggtaagaaaagcata

SEQ ID NO: 7977938 - DNA, 22 bp, Homo sapiens
aggaggaggtaagaaaagcata

SEQ ID NO: 7977939 - DNA, 22 bp, Homo sapiens
aggaggaggtgggacacagtga

SEQ ID NO: 7977940 - DNA, 22 bp, Homo sapiens
aggaggataagttagttgggta

SEQ ID NO: 7977941 - DNA, 22 bp, Homo sapiens
aggaggaggtgggacacagtga

SEQ ID NO: 7977942 - DNA, 22 bp, Homo sapiens
aggaggaggtgggacacagtga

SEQ ID NO: 7977943 - DNA, 22 bp, Homo sapiens
aggaggaggtgggacacagtga

SEQ ID NO: 7977944 - DNA, 22 bp, Homo sapiens
aggaggaggtgggacacagtga

SEQ ID NO: 7977945 - DNA, 22 bp, Homo sapiens
aggaggaggtgggacacagtga

SEQ ID NO: 7977946 - DNA, 22 bp, Homo sapiens
aggaggaggtgggacacagtga

SEQ ID NO: 7977947 - DNA, 17 bp, Homo sapiens
aggaggatcagagagta

SEQ ID NO: 7977948 - DNA, 17 bp, Homo sapiens
aggaggatcagagagta

SEQ ID NO: 7977949 - DNA, 17 bp, Homo sapiens
aggaggatcagagagta

SEQ ID NO: 7977950 - DNA, 22 bp, Homo sapiens
aggaggcaaaggtctctgataa

SEQ ID NO: 7977951 - DNA, 20 bp, Homo sapiens
aggaggcaatgtagataagc

SEQ ID NO: 7977952 - DNA, 20 bp, Homo sapiens
aggaggcaatgtagataagc

SEQ ID NO: 7977953 - DNA, 22 bp, Homo sapiens
aggaggcaactgagatttagaa

SEQ ID NO: 7977954 - DNA, 22 bp, Homo sapiens
aggaggcaaaggtctctgataa

SEQ ID NO: 7977955 - DNA, 22 bp, Homo sapiens
aggaggaggctggagtacaccc

SEQ ID NO: 7977956 - DNA, 22 bp, Homo sapiens
aggaggaggctggagtacaccc

SEQ ID NO: 7977957 - DNA, 22 bp, Homo sapiens
aggaggaggctggagtacaccc

SEQ ID NO: 7977958 - DNA, 21 bp, Homo sapiens
aggaggagagcttggcctacc

SEQ ID NO: 7977959 - DNA, 22 bp, Homo sapiens
aggaggagcagctttttgtctc

SEQ ID NO: 7977960 - DNA, 22 bp, Homo sapiens
aggaggaggctggagtacaccc

SEQ ID NO: 7977961 - DNA, 22 bp, Homo sapiens
aggaggaggctggagtacaccc

SEQ ID NO: 7977962 - DNA, 21 bp, Homo sapiens
aggaggagagcttggcctacc

SEQ ID NO: 7977963 - DNA, 21 bp, Homo sapiens
aggaggagagcttggcctacc

SEQ ID NO: 7977964 - DNA, 21 bp, Homo sapiens
aggaggagagcttggcctacc

SEQ ID NO: 7977965 - DNA, 21 bp, Homo sapiens
aggaggagagcttggcctacc

SEQ ID NO: 7977966 - DNA, 22 bp, Homo sapiens
aggaggagcagctttttgtctc

SEQ ID NO: 7977967 - DNA, 21 bp, Homo sapiens
aggaggagagcttggcctacc

SEQ ID NO: 7977968 - DNA, 22 bp, Homo sapiens
aggaggaatacaatccagcagc

SEQ ID NO: 7977969 - DNA, 22 bp, Homo sapiens
aggaggaatacaatccagcagc

SEQ ID NO: 7977970 - DNA, 22 bp, Homo sapiens
aggaggaattgacacagaagcc

SEQ ID NO: 7977971 - DNA, 22 bp, Homo sapiens
aggaggaatacaatccagcagc

SEQ ID NO: 7977972 - DNA, 22 bp, Homo sapiens
aggaggaatacaatccagcagc

SEQ ID NO: 7977973 - DNA, 22 bp, Homo sapiens
aggaggaatacaatccagcagc

SEQ ID NO: 7977974 - DNA, 22 bp, Homo sapiens
aggaggaatacaatccagcagc

SEQ ID NO: 7977975 - DNA, 22 bp, Homo sapiens
aggaggaattgacacagaagcc

SEQ ID NO: 7977976 - DNA, 22 bp, Homo sapiens
aggaggaattgacacagaagcc

SEQ ID NO: 7977977 - DNA, 22 bp, Homo sapiens
aggaggaattgacacagaagcc

SEQ ID NO: 7977978 - DNA, 22 bp, Homo sapiens
aggaggaattgacacagaagcc

SEQ ID NO: 7977979 - DNA, 22 bp, Homo sapiens
aggagctctgggcagggcctcc

SEQ ID NO: 7977980 - DNA, 22 bp, Homo sapiens
aggagctctgggcagggcctcc

SEQ ID NO: 7977981 - DNA, 22 bp, Homo sapiens
aggagctctgggcagggcctcc

SEQ ID NO: 7977982 - DNA, 22 bp, Homo sapiens
aggagctcttgatgcttgaggg

SEQ ID NO: 7977983 - DNA, 20 bp, Homo sapiens
aggagctctgtgctgggaag

SEQ ID NO: 7977984 - DNA, 22 bp, Homo sapiens
aggagctctgggcagggcctcc

SEQ ID NO: 7977985 - DNA, 22 bp, Homo sapiens
aggagctgaaacttctcatatg

SEQ ID NO: 7977986 - DNA, 22 bp, Homo sapiens
aggagctgaaacttctcatatg

SEQ ID NO: 7977987 - DNA, 20 bp, Homo sapiens
aggagctgaattagagggtt

SEQ ID NO: 7977988 - DNA, 20 bp, Homo sapiens
aggagctgaattagagggtt

SEQ ID NO: 7977989 - DNA, 20 bp, Homo sapiens
aggagctgaattagagggtt

SEQ ID NO: 7977990 - DNA, 22 bp, Homo sapiens
aggagctgaagtctctgcactc

SEQ ID NO: 7977991 - DNA, 20 bp, Homo sapiens
aggagctgaattagagggtt

SEQ ID NO: 7977992 - DNA, 22 bp, Homo sapiens
aggagctgagggagcgcccttg

SEQ ID NO: 7977993 - DNA, 20 bp, Homo sapiens
aggagctgaattagagggtt

SEQ ID NO: 7977994 - DNA, 22 bp, Homo sapiens
aggagctgagggagcgcccttg

SEQ ID NO: 7977995 - DNA, 22 bp, Homo sapiens
aggagctgagggagcgcccttg

SEQ ID NO: 7977996 - DNA, 22 bp, Homo sapiens
aggagctgagtcagcccgacag

SEQ ID NO: 7977997 - DNA, 22 bp, Homo sapiens
aggagctgagtcagcccgacag

SEQ ID NO: 7977998 - DNA, 22 bp, Homo sapiens
aggagctgagtcagcccgacag

SEQ ID NO: 7977999 - DNA, 22 bp, Homo sapiens
aggagctgataaaagggggtca

SEQ ID NO: 7978000 - DNA, 22 bp, Homo sapiens
aggagctgataaaagggggtca

SEQ ID NO: 7978001 - DNA, 22 bp, Homo sapiens
aggagctgataaaagggggtca

SEQ ID NO: 7978002 - DNA, 20 bp, Homo sapiens
aggaggaagaaagcacactg

SEQ ID NO: 7978003 - DNA, 22 bp, Homo sapiens
aggaggaaggcttcattaggtt

SEQ ID NO: 7978004 - DNA, 22 bp, Homo sapiens
aggagctgtgaatgggaggggt

SEQ ID NO: 7978005 - DNA, 21 bp, Homo sapiens
aggagctgtgtgcttcctttc

SEQ ID NO: 7978006 - DNA, 22 bp, Homo sapiens
aggaggaatacaatccagcagc

SEQ ID NO: 7978007 - DNA, 22 bp, Homo sapiens
aggagctgatagtctatggaga

SEQ ID NO: 7978008 - DNA, 22 bp, Homo sapiens
aggagctgatagtctatggaga

SEQ ID NO: 7978009 - DNA, 21 bp, Homo sapiens
aggagctgtgtgcttcctttc

SEQ ID NO: 7978010 - DNA, 22 bp, Homo sapiens
aggagctgatagtctatggaga

SEQ ID NO: 7978011 - DNA, 22 bp, Homo sapiens
aggagagaatgttccaggcttg

SEQ ID NO: 7978012 - DNA, 22 bp, Homo sapiens
aggagagaatgttccaggcttg

SEQ ID NO: 7978013 - DNA, 22 bp, Homo sapiens
aggagagaatgttccaggcttg

SEQ ID NO: 7978014 - DNA, 22 bp, Homo sapiens
aggagagaatgttccaggcttg

SEQ ID NO: 7978015 - DNA, 22 bp, Homo sapiens
aggagagaattactgggtgtca

SEQ ID NO: 7978016 - DNA, 22 bp, Homo sapiens
aggagagaattactgggtgtca

SEQ ID NO: 7978017 - DNA, 22 bp, Homo sapiens
aggagagaattactgggtgtca

SEQ ID NO: 7978018 - DNA, 22 bp, Homo sapiens
aggagagaattactgggtgtca

SEQ ID NO: 7978019 - DNA, 22 bp, Homo sapiens
aggagagaatgttccaggcttg

SEQ ID NO: 7978020 - DNA, 22 bp, Homo sapiens
aggagactgtgaattgactgtc

SEQ ID NO: 7978021 - DNA, 22 bp, Homo sapiens
aggagacagccaggggcctgag

SEQ ID NO: 7978022 - DNA, 22 bp, Homo sapiens
aggagactcagagacctggccg

SEQ ID NO: 7978023 - DNA, 22 bp, Homo sapiens
aggagagaatgttccaggcttg

SEQ ID NO: 7978024 - DNA, 22 bp, Homo sapiens
aggagagagaacacttgggtcc

SEQ ID NO: 7978025 - DNA, 22 bp, Homo sapiens
aggagagagaacacttgggtcc

SEQ ID NO: 7978026 - DNA, 22 bp, Homo sapiens
aggagagagaacacttgggtcc

SEQ ID NO: 7978027 - DNA, 22 bp, Homo sapiens
aggagagagctgagctttgctg

SEQ ID NO: 7978028 - DNA, 22 bp, Homo sapiens
aggagagagctgagctttgctg

SEQ ID NO: 7978029 - DNA, 22 bp, Homo sapiens
aggagagagctgagctttgctg

SEQ ID NO: 7978030 - DNA, 22 bp, Homo sapiens
aggagagaggttttaaatgggg

SEQ ID NO: 7978031 - DNA, 22 bp, Homo sapiens
aggagagcaggccagccgtccc

SEQ ID NO: 7978032 - DNA, 22 bp, Homo sapiens
aggagagcaggccagccgtccc

SEQ ID NO: 7978033 - DNA, 22 bp, Homo sapiens
aggagaggcatcaagaaaatcg

SEQ ID NO: 7978034 - DNA, 22 bp, Homo sapiens
aggagaggcatcaagaaaatcg

SEQ ID NO: 7978035 - DNA, 22 bp, Homo sapiens
aggagaggcatcaagaaaatcg

SEQ ID NO: 7978036 - DNA, 22 bp, Homo sapiens
aggagaggaatcattattacaa

SEQ ID NO: 7978037 - DNA, 22 bp, Homo sapiens
aggagaggcatcaagaaaatcg

SEQ ID NO: 7978038 - DNA, 22 bp, Homo sapiens
aggagaggaatcattattacaa

SEQ ID NO: 7978039 - DNA, 22 bp, Homo sapiens
aggagagctggtgtctggaatc

SEQ ID NO: 7978040 - DNA, 22 bp, Homo sapiens
aggagagcaggccagccgtccc

SEQ ID NO: 7978041 - DNA, 22 bp, Homo sapiens
aggagagcaggccagccgtccc

SEQ ID NO: 7978042 - DNA, 22 bp, Homo sapiens
aggagaggctctaactctgtgt

SEQ ID NO: 7978043 - DNA, 22 bp, Homo sapiens
aggagaggctctaactctgtgt

SEQ ID NO: 7978044 - DNA, 22 bp, Homo sapiens
aggagaggcatcaagaaaatcg

SEQ ID NO: 7978045 - DNA, 22 bp, Homo sapiens
aggagaggcatcaagaaaatcg

SEQ ID NO: 7978046 - DNA, 22 bp, Homo sapiens
aggagaggctctaactctgtgt

SEQ ID NO: 7978047 - DNA, 22 bp, Homo sapiens
aggagaggggtaggattaattt

SEQ ID NO: 7978048 - DNA, 22 bp, Homo sapiens
aggagagggtggcattaagttt

SEQ ID NO: 7978049 - DNA, 22 bp, Homo sapiens
aggagaggggtaggattaattt

SEQ ID NO: 7978050 - DNA, 22 bp, Homo sapiens
aggagaggggtaggattaattt

SEQ ID NO: 7978051 - DNA, 22 bp, Homo sapiens
aggagaggggtaggattaattt

SEQ ID NO: 7978052 - DNA, 22 bp, Homo sapiens
aggagccatgagcaggaggcaa

SEQ ID NO: 7978053 - DNA, 22 bp, Homo sapiens
aggagccatgagcaggaggcaa

SEQ ID NO: 7978054 - DNA, 22 bp, Homo sapiens
aggagccatgagcaggaggcaa

SEQ ID NO: 7978055 - DNA, 22 bp, Homo sapiens
aggagataagaggctggtgtgg

SEQ ID NO: 7978056 - DNA, 22 bp, Homo sapiens
aggagatcagcctccctgcaac

SEQ ID NO: 7978057 - DNA, 22 bp, Homo sapiens
aggagcctggctggcccacagg

SEQ ID NO: 7978058 - DNA, 22 bp, Homo sapiens
aggagccatgagcaggaggcaa

SEQ ID NO: 7978059 - DNA, 22 bp, Homo sapiens
aggagaggtctcccttccccag

SEQ ID NO: 7978060 - DNA, 22 bp, Homo sapiens
aggagagggtggcattaagttt

SEQ ID NO: 7978061 - DNA, 22 bp, Homo sapiens
aggagaggtctcccttccccag

SEQ ID NO: 7978062 - DNA, 22 bp, Homo sapiens
aggagaggtctcccttccccag

SEQ ID NO: 7978063 - DNA, 22 bp, Homo sapiens
aggagaggtctcccttccccag

SEQ ID NO: 7978064 - DNA, 22 bp, Homo sapiens
aggagagtcttgagtcactggt

SEQ ID NO: 7978065 - DNA, 22 bp, Homo sapiens
aggagagtaccattgggccgca

SEQ ID NO: 7978066 - DNA, 22 bp, Homo sapiens
aggagagttcacactggtcaga

SEQ ID NO: 7978067 - DNA, 22 bp, Homo sapiens
aggagagtcttgagtcactggt

SEQ ID NO: 7978068 - DNA, 19 bp, Homo sapiens
aggagccttgagcagtgag

SEQ ID NO: 7978069 - DNA, 19 bp, Homo sapiens
aggagccttgagcagtgag

SEQ ID NO: 7978070 - DNA, 22 bp, Homo sapiens
aggagcctgtgcctggcactcc

SEQ ID NO: 7978071 - DNA, 18 bp, Homo sapiens
aggagcctttgcactgga

SEQ ID NO: 7978072 - DNA, 18 bp, Homo sapiens
aggagcctttgcactgga

SEQ ID NO: 7978073 - DNA, 18 bp, Homo sapiens
aggagcctttgcactgga

SEQ ID NO: 7978074 - DNA, 18 bp, Homo sapiens
aggagcctttgcactgga

SEQ ID NO: 7978075 - DNA, 18 bp, Homo sapiens
aggagcggctgcggctgc

SEQ ID NO: 7978076 - DNA, 22 bp, Homo sapiens
aggagctcaaagatgccaggag

SEQ ID NO: 7978077 - DNA, 22 bp, Homo sapiens
aggagctagacttagatcttcc

SEQ ID NO: 7978078 - DNA, 22 bp, Homo sapiens
aggagctcagcctgcagggagc

SEQ ID NO: 7978079 - DNA, 22 bp, Homo sapiens
aggagctcagcctgcagggagc

SEQ ID NO: 7978080 - DNA, 22 bp, Homo sapiens
aggagctcagccattcatttga

SEQ ID NO: 7978081 - DNA, 22 bp, Homo sapiens
aggagctcagctaagttggaga

SEQ ID NO: 7978082 - DNA, 22 bp, Homo sapiens
aggagctcattgaagtggatga

SEQ ID NO: 7978083 - DNA, 22 bp, Homo sapiens
aggagctcattgaagtggatga

SEQ ID NO: 7978084 - DNA, 22 bp, Homo sapiens
aggagctcccgtgaggagacca

SEQ ID NO: 7978085 - DNA, 22 bp, Homo sapiens
aggagctccagcccagggaagt

SEQ ID NO: 7978086 - DNA, 21 bp, Homo sapiens
aggagctctccaaggacaaag

SEQ ID NO: 7978087 - DNA, 21 bp, Homo sapiens
aggagctctccaaggacaaag

SEQ ID NO: 7978088 - DNA, 22 bp, Homo sapiens
aggagctcccgtgaggagacca

SEQ ID NO: 7978089 - DNA, 22 bp, Homo sapiens
agcttgttttgttgaatactta

SEQ ID NO: 7978090 - DNA, 22 bp, Homo sapiens
agcttgttgttactgatgcatt

SEQ ID NO: 7978091 - DNA, 22 bp, Homo sapiens
agcttgttgttactgatgcatt

SEQ ID NO: 7978092 - DNA, 22 bp, Homo sapiens
agctttaaaaatccaatatcca

SEQ ID NO: 7978093 - DNA, 22 bp, Homo sapiens
agcttgttggggaaggagaaag

SEQ ID NO: 7978094 - DNA, 22 bp, Homo sapiens
agcttgttcaaatgcagaatac

SEQ ID NO: 7978095 - DNA, 22 bp, Homo sapiens
agcttgttataaatgcagaatg

SEQ ID NO: 7978096 - DNA, 22 bp, Homo sapiens
agcttgttagggcagtggtcgc

SEQ ID NO: 7978097 - DNA, 21 bp, Homo sapiens
agcttgttattaattcagaac

SEQ ID NO: 7978098 - DNA, 22 bp, Homo sapiens
agcttgttataaatgcagaatg

SEQ ID NO: 7978099 - DNA, 22 bp, Homo sapiens
agcttgtgctggaattacatgt

SEQ ID NO: 7978100 - DNA, 22 bp, Homo sapiens
agcttgtctttcaaaggagttt

SEQ ID NO: 7978101 - DNA, 21 bp, Homo sapiens
agcttgtgtgtatcacagtgt

SEQ ID NO: 7978102 - DNA, 21 bp, Homo sapiens
agcttgtgtgtatcacagtgt

SEQ ID NO: 7978103 - DNA, 21 bp, Homo sapiens
agcttgtgtgtatcacagtgt

SEQ ID NO: 7978104 - DNA, 22 bp, Homo sapiens
agcttgttagaaatgtagactc

SEQ ID NO: 7978105 - DNA, 22 bp, Homo sapiens
agcttgttagaaatgtagactc

SEQ ID NO: 7978106 - DNA, 22 bp, Homo sapiens
agcttgtgtttttctaagtatc

SEQ ID NO: 7978107 - DNA, 22 bp, Homo sapiens
agcttgtgtttttctaagtatc

SEQ ID NO: 7978108 - DNA, 22 bp, Homo sapiens
agcttgtgtttttctaagtatc

SEQ ID NO: 7978109 - DNA, 22 bp, Homo sapiens
agctttacctgccttggggcac

SEQ ID NO: 7978110 - DNA, 22 bp, Homo sapiens
agctttacctgccttggggcac

SEQ ID NO: 7978111 - DNA, 22 bp, Homo sapiens
agctttatagaaaggatcagtg

SEQ ID NO: 7978112 - DNA, 22 bp, Homo sapiens
agctttagagagccaagactca

SEQ ID NO: 7978113 - DNA, 22 bp, Homo sapiens
agctttagaattgttcagcaag

SEQ ID NO: 7978114 - DNA, 22 bp, Homo sapiens
agctttaaatcaatccagtgag

SEQ ID NO: 7978115 - DNA, 22 bp, Homo sapiens
agctttaaagcatatttctaag

SEQ ID NO: 7978116 - DNA, 22 bp, Homo sapiens
agctttaaagcatatttctaag

SEQ ID NO: 7978117 - DNA, 23 bp, Homo sapiens
agctttaaccctttcaggagcat

SEQ ID NO: 7978118 - DNA, 23 bp, Homo sapiens
agctttaaccctttcaggagcat

SEQ ID NO: 7978119 - DNA, 22 bp, Homo sapiens
agctttaaatcaatccagtgag

SEQ ID NO: 7978120 - DNA, 22 bp, Homo sapiens
agctttaaatcaatccagtgag

SEQ ID NO: 7978121 - DNA, 22 bp, Homo sapiens
agctttaaatcaatccagtgag

SEQ ID NO: 7978122 - DNA, 22 bp, Homo sapiens
agctttaaagcatatttctaag

SEQ ID NO: 7978123 - DNA, 22 bp, Homo sapiens
agctttaaaaatccaatatcca

SEQ ID NO: 7978124 - DNA, 22 bp, Homo sapiens
agctttaaagcatatttctaag

SEQ ID NO: 7978125 - DNA, 22 bp, Homo sapiens
agctttaaaaatccaatatcca

SEQ ID NO: 7978126 - DNA, 22 bp, Homo sapiens
agctttaaaaatccaatatcca

SEQ ID NO: 7978127 - DNA, 18 bp, Homo sapiens
agcttgtttttgccttct

SEQ ID NO: 7978128 - DNA, 22 bp, Homo sapiens
agctttatataaaagagtacat

SEQ ID NO: 7978129 - DNA, 22 bp, Homo sapiens
agctttatagaaaggatcagtg

SEQ ID NO: 7978130 - DNA, 22 bp, Homo sapiens
agctttatatgttgtttctcca

SEQ ID NO: 7978131 - DNA, 22 bp, Homo sapiens
agctttatatgttgtttctcca

SEQ ID NO: 7978132 - DNA, 22 bp, Homo sapiens
aggaaactaacttatctttata

SEQ ID NO: 7978133 - DNA, 22 bp, Homo sapiens
aggaaactaaagcccagagagg

SEQ ID NO: 7978134 - DNA, 22 bp, Homo sapiens
agctttatatgttgtttctcca

SEQ ID NO: 7978135 - DNA, 18 bp, Homo sapiens
aggaaagacgaagagggc

SEQ ID NO: 7978136 - DNA, 18 bp, Homo sapiens
aggaaagacgaagagggc

SEQ ID NO: 7978137 - DNA, 18 bp, Homo sapiens
aggaaagacgaagagggc

SEQ ID NO: 7978138 - DNA, 18 bp, Homo sapiens
aggaaagacgaagagggc

SEQ ID NO: 7978139 - DNA, 18 bp, Homo sapiens
aggaaagacgaagagggc

SEQ ID NO: 7978140 - DNA, 22 bp, Homo sapiens
aggaaagaagtacattctcatg

SEQ ID NO: 7978141 - DNA, 22 bp, Homo sapiens
aggaaactaacttatctttata

SEQ ID NO: 7978142 - DNA, 22 bp, Homo sapiens
aggaaagaagtacattctcatg

SEQ ID NO: 7978143 - DNA, 18 bp, Homo sapiens
aggaaagacgaagagggc

SEQ ID NO: 7978144 - DNA, 18 bp, Homo sapiens
aggaaagacgaagagggc

SEQ ID NO: 7978145 - DNA, 22 bp, Homo sapiens
aggaaagactggggccccagaa

SEQ ID NO: 7978146 - DNA, 22 bp, Homo sapiens
aggaaagactggggccccagaa

SEQ ID NO: 7978147 - DNA, 22 bp, Homo sapiens
aggaaagactggggccccagaa

SEQ ID NO: 7978148 - DNA, 18 bp, Homo sapiens
aggaaagacgaagagggc

SEQ ID NO: 7978149 - DNA, 18 bp, Homo sapiens
aggaaagacgaagagggc

SEQ ID NO: 7978150 - DNA, 22 bp, Homo sapiens
aggaaagatggaaggaggataa

SEQ ID NO: 7978151 - DNA, 22 bp, Homo sapiens
aggaaagatggaaggaggataa

SEQ ID NO: 7978152 - DNA, 22 bp, Homo sapiens
aggaaagatggaaggaggataa

SEQ ID NO: 7978153 - DNA, 22 bp, Homo sapiens
aggaaagatggaaggaggataa

SEQ ID NO: 7978154 - DNA, 22 bp, Homo sapiens
aggaaagactggggccccagaa

SEQ ID NO: 7978155 - DNA, 22 bp, Homo sapiens
aggaaagcaatggctgagaaca

SEQ ID NO: 7978156 - DNA, 23 bp, Homo sapiens
aggaaagcattcatttttaccat

SEQ ID NO: 7978157 - DNA, 22 bp, Homo sapiens
aggaaagccaatctctcttgac

SEQ ID NO: 7978158 - DNA, 22 bp, Homo sapiens
aggaaagcaatggctgagaaca

SEQ ID NO: 7978159 - DNA, 22 bp, Homo sapiens
aggaaagatggaaggaggataa

SEQ ID NO: 7978160 - DNA, 22 bp, Homo sapiens
aggaaagcttggcaaactaaat

SEQ ID NO: 7978161 - DNA, 21 bp, Homo sapiens
aggaaaggaagtccccagggt

SEQ ID NO: 7978162 - DNA, 22 bp, Homo sapiens
aggaaagcttggcaaactaaat

SEQ ID NO: 7978163 - DNA, 22 bp, Homo sapiens
aggaaagcttggcaaactaaat

SEQ ID NO: 7978164 - DNA, 20 bp, Homo sapiens
aggaaagcctgtgtgagtct

SEQ ID NO: 7978165 - DNA, 21 bp, Homo sapiens
aggaaaggaagtccccagggt

SEQ ID NO: 7978166 - DNA, 22 bp, Homo sapiens
cagggccactgtagatgaggag

SEQ ID NO: 7978167 - DNA, 21 bp, Homo sapiens
aggaaaggaagtccccagggt

SEQ ID NO: 7978168 - DNA, 22 bp, Homo sapiens
cagggccactgtagatgaggag

SEQ ID NO: 7978169 - DNA, 21 bp, Homo sapiens
aggaaaggaagtccccagggt

SEQ ID NO: 7978170 - DNA, 21 bp, Homo sapiens
aggaaaggaagtccccagggt

SEQ ID NO: 7978171 - DNA, 22 bp, Homo sapiens
aggaaagcttggcaaactaaat

SEQ ID NO: 7978172 - DNA, 21 bp, Homo sapiens
aggaaaggaagtccccagggt

SEQ ID NO: 7978173 - DNA, 22 bp, Homo sapiens
cagggccagagagggctggctg

SEQ ID NO: 7978174 - DNA, 22 bp, Homo sapiens
cagggccagagagggctggctg

SEQ ID NO: 7978175 - DNA, 22 bp, Homo sapiens
cagggccagagagggctggctg

SEQ ID NO: 7978176 - DNA, 22 bp, Homo sapiens
cagggccagagagggctggctg

SEQ ID NO: 7978177 - DNA, 22 bp, Homo sapiens
cagggccactgtagatgaggag

SEQ ID NO: 7978178 - DNA, 22 bp, Homo sapiens
cagggccagccatcctgctggg

SEQ ID NO: 7978179 - DNA, 22 bp, Homo sapiens
cagggccagccatcctgctggg

SEQ ID NO: 7978180 - DNA, 22 bp, Homo sapiens
cagggccagccatcctgctggg

SEQ ID NO: 7978181 - DNA, 22 bp, Homo sapiens
cagggccagccatcctgctggg

SEQ ID NO: 7978182 - DNA, 22 bp, Homo sapiens
cagggccagagagggctggctg

SEQ ID NO: 7978183 - DNA, 22 bp, Homo sapiens
cagggccagagagggctggctg

SEQ ID NO: 7978184 - DNA, 22 bp, Homo sapiens
cagggccagccgcagcatccac

SEQ ID NO: 7978185 - DNA, 22 bp, Homo sapiens
cagggccagcccgacgtggtgc

SEQ ID NO: 7978186 - DNA, 22 bp, Homo sapiens
cagggccagccgcagcatccac

SEQ ID NO: 7978187 - DNA, 22 bp, Homo sapiens
cagggccagccgcagcatccac

SEQ ID NO: 7978188 - DNA, 22 bp, Homo sapiens
cagggccagcgcccaggcccag

SEQ ID NO: 7978189 - DNA, 22 bp, Homo sapiens
cagggccagcccgacgtggtgc

SEQ ID NO: 7978190 - DNA, 22 bp, Homo sapiens
cagggccagcccactagcgagg

SEQ ID NO: 7978191 - DNA, 22 bp, Homo sapiens
cagggccagccatcctgctggg

SEQ ID NO: 7978192 - DNA, 22 bp, Homo sapiens
cagggccagccatcctgctggg

SEQ ID NO: 7978193 - DNA, 22 bp, Homo sapiens
cagggccagccatcctgctggg

SEQ ID NO: 7978194 - DNA, 22 bp, Homo sapiens
cagggccagcccactagcgagg

SEQ ID NO: 7978195 - DNA, 22 bp, Homo sapiens
aggaaatgtagtcctcatctcc

SEQ ID NO: 7978196 - DNA, 22 bp, Homo sapiens
aggaaatgtacaaatgaagatg

SEQ ID NO: 7978197 - DNA, 22 bp, Homo sapiens
aggaaatgtacaaatgaagatg

SEQ ID NO: 7978198 - DNA, 22 bp, Homo sapiens
aggaaatgtacaaatgaagatg

SEQ ID NO: 7978199 - DNA, 22 bp, Homo sapiens
aggaaatgtacaaatgaagatg

SEQ ID NO: 7978200 - DNA, 22 bp, Homo sapiens
aggaaatgtacaaatgaagatg

SEQ ID NO: 7978201 - DNA, 22 bp, Homo sapiens
aggaaatgtacaaatgaagatg

SEQ ID NO: 7978202 - DNA, 22 bp, Homo sapiens
aggaaatgtacaaatgaagatg

SEQ ID NO: 7978203 - DNA, 22 bp, Homo sapiens
aggaaatgggaatagatggtat

SEQ ID NO: 7978204 - DNA, 22 bp, Homo sapiens
aggaaattgagaatcagaataa

SEQ ID NO: 7978205 - DNA, 22 bp, Homo sapiens
aggaaattgagaatcagaataa

SEQ ID NO: 7978206 - DNA, 22 bp, Homo sapiens
aggaaattgagaatcagaataa

SEQ ID NO: 7978207 - DNA, 22 bp, Homo sapiens
aggaaatgtagtcctcatctcc

SEQ ID NO: 7978208 - DNA, 22 bp, Homo sapiens
aggaaattgtctttttccttgt

SEQ ID NO: 7978209 - DNA, 22 bp, Homo sapiens
aggaaattgggacacagagaaa

SEQ ID NO: 7978210 - DNA, 22 bp, Homo sapiens
aggaacaactgattcagtcaac

SEQ ID NO: 7978211 - DNA, 22 bp, Homo sapiens
aggaacaactgattcagtcaac

SEQ ID NO: 7978212 - DNA, 22 bp, Homo sapiens
aggaaattttgaatcagtgtct

SEQ ID NO: 7978213 - DNA, 22 bp, Homo sapiens
aggaacaactgattcagtcaac

SEQ ID NO: 7978214 - DNA, 22 bp, Homo sapiens
aggaacaagggagccttttctc

SEQ ID NO: 7978215 - DNA, 22 bp, Homo sapiens
aggaacaattgataaactcaca

SEQ ID NO: 7978216 - DNA, 22 bp, Homo sapiens
aggaacaattgataaactcaca

SEQ ID NO: 7978217 - DNA, 22 bp, Homo sapiens
aggaacaattgataaactcaca

SEQ ID NO: 7978218 - DNA, 22 bp, Homo sapiens
aggaacaattgataaactcaca

SEQ ID NO: 7978219 - DNA, 22 bp, Homo sapiens
aggaacaattgataaactcaca

SEQ ID NO: 7978220 - DNA, 22 bp, Homo sapiens
aggaacacaacttcctgagagc

SEQ ID NO: 7978221 - DNA, 22 bp, Homo sapiens
aggaacacaatgcttctgtgtg

SEQ ID NO: 7978222 - DNA, 22 bp, Homo sapiens
aggaacacatggacatttctga

SEQ ID NO: 7978223 - DNA, 22 bp, Homo sapiens
aggaacacatctttgtagcagg

SEQ ID NO: 7978224 - DNA, 22 bp, Homo sapiens
cagggccagcgcccaggcccag

SEQ ID NO: 7978225 - DNA, 22 bp, Homo sapiens
cagggccagcgcccaggcccag

SEQ ID NO: 7978226 - DNA, 22 bp, Homo sapiens
cagggccagcgcccaggcccag

SEQ ID NO: 7978227 - DNA, 22 bp, Homo sapiens
cagggccagcgcccaggcccag

SEQ ID NO: 7978228 - DNA, 22 bp, Homo sapiens
cagggccagcgtctcgggctat

SEQ ID NO: 7978229 - DNA, 22 bp, Homo sapiens
cagggccagcgtctcgggctat

SEQ ID NO: 7978230 - DNA, 23 bp, Homo sapiens
cagggccaggcagcagctgtcac

SEQ ID NO: 7978231 - DNA, 22 bp, Homo sapiens
aggaaaggcctttgcatttggt

SEQ ID NO: 7978232 - DNA, 22 bp, Homo sapiens
aggaaaggggtaggtgtggacg

SEQ ID NO: 7978233 - DNA, 22 bp, Homo sapiens
aggaaaggggtaggtgtggacg

SEQ ID NO: 7978234 - DNA, 22 bp, Homo sapiens
aggaaaggggtaggtgtggacg

SEQ ID NO: 7978235 - DNA, 22 bp, Homo sapiens
aggaaaggggtaggtgtggacg

SEQ ID NO: 7978236 - DNA, 22 bp, Homo sapiens
aggaaaggggtaggtgtggacg

SEQ ID NO: 7978237 - DNA, 22 bp, Homo sapiens
aggaaatgctgatgctcctgga

SEQ ID NO: 7978238 - DNA, 22 bp, Homo sapiens
aggaaatgcaggcaaatactct

SEQ ID NO: 7978239 - DNA, 22 bp, Homo sapiens
aggaaatgcaggcaaatactct

SEQ ID NO: 7978240 - DNA, 22 bp, Homo sapiens
aggaaatgccgcggctctcttt

SEQ ID NO: 7978241 - DNA, 22 bp, Homo sapiens
aggaaatgcaggcaaatactct

SEQ ID NO: 7978242 - DNA, 22 bp, Homo sapiens
aggaaataggaccagacaaagc

SEQ ID NO: 7978243 - DNA, 22 bp, Homo sapiens
aggaaataggaccagacaaagc

SEQ ID NO: 7978244 - DNA, 22 bp, Homo sapiens
aggaaataggaccagacaaagc

SEQ ID NO: 7978245 - DNA, 22 bp, Homo sapiens
aggaaataggaccagacaaagc

SEQ ID NO: 7978246 - DNA, 22 bp, Homo sapiens
aggaaataggaccagacaaagc

SEQ ID NO: 7978247 - DNA, 22 bp, Homo sapiens
aggaaataggaccagacaaagc

SEQ ID NO: 7978248 - DNA, 22 bp, Homo sapiens
aggaaataggaccagacaaagc

SEQ ID NO: 7978249 - DNA, 22 bp, Homo sapiens
aggaaataggaccagacaaagc

SEQ ID NO: 7978250 - DNA, 22 bp, Homo sapiens
aggaaataggaccagacaaagc

SEQ ID NO: 7978251 - DNA, 22 bp, Homo sapiens
aggaaataggaccagacaaagc

SEQ ID NO: 7978252 - DNA, 22 bp, Homo sapiens
aggaaatgcaggcaaatactct

SEQ ID NO: 7978253 - DNA, 22 bp, Homo sapiens
aggaactgaagacttttactgt

SEQ ID NO: 7978254 - DNA, 22 bp, Homo sapiens
aggaactagtgcaacaggagcg

SEQ ID NO: 7978255 - DNA, 22 bp, Homo sapiens
aggaactctgtctccagagttg

SEQ ID NO: 7978256 - DNA, 22 bp, Homo sapiens
aggaactgatgagcagccaggg

SEQ ID NO: 7978257 - DNA, 22 bp, Homo sapiens
aggaactgatgagcagccaggg

SEQ ID NO: 7978258 - DNA, 22 bp, Homo sapiens
aggaactgatgagcagccaggg

SEQ ID NO: 7978259 - DNA, 23 bp, Homo sapiens
aggaactgaggcctagggaggta

SEQ ID NO: 7978260 - DNA, 22 bp, Homo sapiens
aggaactgatgagcagccaggg

SEQ ID NO: 7978261 - DNA, 20 bp, Homo sapiens
aggaactggaagggaggaaa

SEQ ID NO: 7978262 - DNA, 22 bp, Homo sapiens
aggaactgggctcagcaaacat

SEQ ID NO: 7978263 - DNA, 22 bp, Homo sapiens
aggaactggatataatgtgaga

SEQ ID NO: 7978264 - DNA, 22 bp, Homo sapiens
aggaactgatttataactttag

SEQ ID NO: 7978265 - DNA, 23 bp, Homo sapiens
aggaactgcttcatttttgaaag

SEQ ID NO: 7978266 - DNA, 23 bp, Homo sapiens
aggaactgcttcatttttgaaag

SEQ ID NO: 7978267 - DNA, 22 bp, Homo sapiens
aggaacatctatcacataaacg

SEQ ID NO: 7978268 - DNA, 22 bp, Homo sapiens
aggaacattctcatttcctgcc

SEQ ID NO: 7978269 - DNA, 22 bp, Homo sapiens
aggaacagaagagcaatgcagg

SEQ ID NO: 7978270 - DNA, 22 bp, Homo sapiens
aggaacacttgtggaaacattc

SEQ ID NO: 7978271 - DNA, 22 bp, Homo sapiens
aggaacagaagagcaatgcagg

SEQ ID NO: 7978272 - DNA, 22 bp, Homo sapiens
aggaacagaagagcaatgcagg

SEQ ID NO: 7978273 - DNA, 22 bp, Homo sapiens
aggaacagaagagcaatgcagg

SEQ ID NO: 7978274 - DNA, 22 bp, Homo sapiens
aggaaccagaggttgagcaact

SEQ ID NO: 7978275 - DNA, 22 bp, Homo sapiens
aggaaccagaggttgagcaact

SEQ ID NO: 7978276 - DNA, 22 bp, Homo sapiens
aggaaccagaggttgagcaact

SEQ ID NO: 7978277 - DNA, 22 bp, Homo sapiens
aggaacctgagtctgatcattt

SEQ ID NO: 7978278 - DNA, 22 bp, Homo sapiens
aggaacctgagtctgatcattt

SEQ ID NO: 7978279 - DNA, 22 bp, Homo sapiens
aggaagcagcccatggatatag

SEQ ID NO: 7978280 - DNA, 22 bp, Homo sapiens
aggaagcagcccatggatatag

SEQ ID NO: 7978281 - DNA, 22 bp, Homo sapiens
aggaagaaaactaattagatgg

SEQ ID NO: 7978282 - DNA, 18 bp, Homo sapiens
aggaagcaggaggaaggc

SEQ ID NO: 7978283 - DNA, 18 bp, Homo sapiens
aggaagcaggaggaaggc

SEQ ID NO: 7978284 - DNA, 18 bp, Homo sapiens
aggaagcaggaggaaggc

SEQ ID NO: 7978285 - DNA, 18 bp, Homo sapiens
aggaagcaggaggaaggc

SEQ ID NO: 7978286 - DNA, 22 bp, Homo sapiens
aggaagctcaaagccatgatgt

SEQ ID NO: 7978287 - DNA, 18 bp, Homo sapiens
aggaagcaggaggaaggc

SEQ ID NO: 7978288 - DNA, 22 bp, Homo sapiens
aggaactgtcatgtattgctca

SEQ ID NO: 7978289 - DNA, 22 bp, Homo sapiens
aggaactggtgggaggtgattg

SEQ ID NO: 7978290 - DNA, 22 bp, Homo sapiens
aggaactggtgaagtgtagtga

SEQ ID NO: 7978291 - DNA, 22 bp, Homo sapiens
aggaactggggctattcaccct

SEQ ID NO: 7978292 - DNA, 22 bp, Homo sapiens
aggaactggggctattcaccct

SEQ ID NO: 7978293 - DNA, 22 bp, Homo sapiens
aggaactgggctcagcaaacat

SEQ ID NO: 7978294 - DNA, 22 bp, Homo sapiens
aggaactggggctattcaccct

SEQ ID NO: 7978295 - DNA, 22 bp, Homo sapiens
aggaagctcctggagagccagt

SEQ ID NO: 7978296 - DNA, 22 bp, Homo sapiens
aggaagctcctggagagccagt

SEQ ID NO: 7978297 - DNA, 22 bp, Homo sapiens
aggaagctccatgaaggcagag

SEQ ID NO: 7978298 - DNA, 22 bp, Homo sapiens
aggaagctcctggagagccagt

SEQ ID NO: 7978299 - DNA, 22 bp, Homo sapiens
aggaagctcattttgacatatc

SEQ ID NO: 7978300 - DNA, 22 bp, Homo sapiens
aggaagctcaaagccatgatgt

SEQ ID NO: 7978301 - DNA, 22 bp, Homo sapiens
aggaagctcaaagccatgatgt

SEQ ID NO: 7978302 - DNA, 22 bp, Homo sapiens
agcttgagttttggatgaagtg

SEQ ID NO: 7978303 - DNA, 22 bp, Homo sapiens
agcttgccagtcatatctgttt

SEQ ID NO: 7978304 - DNA, 22 bp, Homo sapiens
agcttgcacagagaatacagta

SEQ ID NO: 7978305 - DNA, 17 bp, Homo sapiens
agcttggagcagcatga

SEQ ID NO: 7978306 - DNA, 22 bp, Homo sapiens
agcttgggcaacacagcaagac

SEQ ID NO: 7978307 - DNA, 23 bp, Homo sapiens
agcttggaacaatgcaaatacag

SEQ ID NO: 7978308 - DNA, 23 bp, Homo sapiens
agcttggaacaatgcaaatacag

SEQ ID NO: 7978309 - DNA, 22 bp, Homo sapiens
agcttgctgtattttctggagg

SEQ ID NO: 7978310 - DNA, 22 bp, Homo sapiens
agcttgctgtattttctggagg

SEQ ID NO: 7978311 - DNA, 22 bp, Homo sapiens
agcttgtaacagacataaaaat

SEQ ID NO: 7978312 - DNA, 22 bp, Homo sapiens
agcttgtaacagacataaaaat

SEQ ID NO: 7978313 - DNA, 22 bp, Homo sapiens
agcttgtagaaggccacgagca

SEQ ID NO: 7978314 - DNA, 22 bp, Homo sapiens
agcttgtcacagacgtcaggca

SEQ ID NO: 7978315 - DNA, 22 bp, Homo sapiens
agcttgtagaaggccacgagca

SEQ ID NO: 7978316 - DNA, 22 bp, Homo sapiens
agcttgtctaaggacacagctt

SEQ ID NO: 7978317 - DNA, 22 bp, Homo sapiens
agcttgtcgggcctcagctccc

SEQ ID NO: 7978318 - DNA, 23 bp, Homo sapiens
agcttgtctcctggtgctgctag

SEQ ID NO: 7978319 - DNA, 22 bp, Homo sapiens
agcttgtcctccacccacactg

SEQ ID NO: 7978320 - DNA, 22 bp, Homo sapiens
agcttgtcccggtgctcacata

SEQ ID NO: 7978321 - DNA, 22 bp, Homo sapiens
agcttgtcagcagttaatgata

SEQ ID NO: 7978322 - DNA, 22 bp, Homo sapiens
agcttgtcacttaaggtctttg

SEQ ID NO: 7978323 - DNA, 22 bp, Homo sapiens
agcttggtggccctcctggctg

SEQ ID NO: 7978324 - DNA, 22 bp, Homo sapiens
agcttgggtgtgcctgcgagct

SEQ ID NO: 7978325 - DNA, 22 bp, Homo sapiens
agcttggtggccctcctggctg

SEQ ID NO: 7978326 - DNA, 22 bp, Homo sapiens
agcttggtgttgcctgcttgag

SEQ ID NO: 7978327 - DNA, 22 bp, Homo sapiens
agcttgggcaacacagcaagac

SEQ ID NO: 7978328 - DNA, 22 bp, Homo sapiens
agcttgggcaacacagcaagac

SEQ ID NO: 7978329 - DNA, 22 bp, Homo sapiens
agcttgggtgtgcctgcgagct

SEQ ID NO: 7978330 - DNA, 22 bp, Homo sapiens
agcttctgttcatcttccaggc

SEQ ID NO: 7978331 - DNA, 22 bp, Homo sapiens
agcttcttaagttcctgcagca

SEQ ID NO: 7978332 - DNA, 22 bp, Homo sapiens
agcttacagttcaatgacaaag

SEQ ID NO: 7978333 - DNA, 22 bp, Homo sapiens
agcttcttagttcacttttaat

SEQ ID NO: 7978334 - DNA, 22 bp, Homo sapiens
agcttcttaagttcctgcagca

SEQ ID NO: 7978335 - DNA, 22 bp, Homo sapiens
agcttgaaacgtaccaacattg

SEQ ID NO: 7978336 - DNA, 22 bp, Homo sapiens
agcttcttttaccaggaagttg

SEQ ID NO: 7978337 - DNA, 22 bp, Homo sapiens
agcttcttagttcacttttaat

SEQ ID NO: 7978338 - DNA, 22 bp, Homo sapiens
agcttgaacctaaaacaataat

SEQ ID NO: 7978339 - DNA, 22 bp, Homo sapiens
agcttgacagacagatggtagc

SEQ ID NO: 7978340 - DNA, 22 bp, Homo sapiens
agcttgacagacagatggtagc

SEQ ID NO: 7978341 - DNA, 22 bp, Homo sapiens
agcttgacagacagatggtagc

SEQ ID NO: 7978342 - DNA, 22 bp, Homo sapiens
agcttgaagccttggcgagatt

SEQ ID NO: 7978343 - DNA, 22 bp, Homo sapiens
agcttacagttcaatgacaaag

SEQ ID NO: 7978344 - DNA, 22 bp, Homo sapiens
agcttaatggaacttgctcaaa

SEQ ID NO: 7978345 - DNA, 22 bp, Homo sapiens
agcttaatggaacttgctcaaa

SEQ ID NO: 7978346 - DNA, 22 bp, Homo sapiens
agcttaaagtatttaaatttca

SEQ ID NO: 7978347 - DNA, 22 bp, Homo sapiens
agcttaaagccgccatctagta

SEQ ID NO: 7978348 - DNA, 22 bp, Homo sapiens
agcttaaactctttgaagttat

SEQ ID NO: 7978349 - DNA, 22 bp, Homo sapiens
agcttaaactctttgaagttat

SEQ ID NO: 7978350 - DNA, 22 bp, Homo sapiens
agctgtttttgtgggcatgtga

SEQ ID NO: 7978351 - DNA, 22 bp, Homo sapiens
agctgtttttgtctgctgatcc

SEQ ID NO: 7978352 - DNA, 22 bp, Homo sapiens
agctgtttttccagtctctgga

SEQ ID NO: 7978353 - DNA, 22 bp, Homo sapiens
agctgtttttccagtctctgga

SEQ ID NO: 7978354 - DNA, 21 bp, Homo sapiens
agctgtttgaagctatattgg

SEQ ID NO: 7978355 - DNA, 22 bp, Homo sapiens
agctgtttgtacttagatagta

SEQ ID NO: 7978356 - DNA, 23 bp, Homo sapiens
agctgtttcttgtgagttgagtg

SEQ ID NO: 7978357 - DNA, 21 bp, Homo sapiens
agctgtttgaagctatattgg

SEQ ID NO: 7978358 - DNA, 22 bp, Homo sapiens
agctgttttactcagaaacata

SEQ ID NO: 7978359 - DNA, 22 bp, Homo sapiens
agctgtttgtacttagatagta

SEQ ID NO: 7978360 - DNA, 22 bp, Homo sapiens
agctgttttctaatgcatttga

SEQ ID NO: 7978361 - DNA, 22 bp, Homo sapiens
agctgttttactggttgtataa

SEQ ID NO: 7978362 - DNA, 22 bp, Homo sapiens
agctgttttctaatgcatttga

SEQ ID NO: 7978363 - DNA, 22 bp, Homo sapiens
agctgttttcttctaggaagac

SEQ ID NO: 7978364 - DNA, 22 bp, Homo sapiens
agctgtttccataaatgagaca

SEQ ID NO: 7978365 - DNA, 23 bp, Homo sapiens
agctgtttcattattacaacacc

SEQ ID NO: 7978366 - DNA, 20 bp, Homo sapiens
agctgtttacatggatttct

SEQ ID NO: 7978367 - DNA, 22 bp, Homo sapiens
agctgtttaataaatgtctgtt

SEQ ID NO: 7978368 - DNA, 20 bp, Homo sapiens
agctgtttacatggatttct

SEQ ID NO: 7978369 - DNA, 18 bp, Homo sapiens
agctgttgttgactctgt

SEQ ID NO: 7978370 - DNA, 18 bp, Homo sapiens
agctgttgttgactctgt

SEQ ID NO: 7978371 - DNA, 22 bp, Homo sapiens
agctgttagttattgaagatgt

SEQ ID NO: 7978372 - DNA, 22 bp, Homo sapiens
agctgtgtttccagatggtagc

SEQ ID NO: 7978373 - DNA, 22 bp, Homo sapiens
agctgtgtttccagatggtagc

SEQ ID NO: 7978374 - DNA, 22 bp, Homo sapiens
agctgttccaggcctcattgct

SEQ ID NO: 7978375 - DNA, 22 bp, Homo sapiens
agctgtgttctggttgattcac

SEQ ID NO: 7978376 - DNA, 22 bp, Homo sapiens
agctgtgttattagaaacctgc

SEQ ID NO: 7978377 - DNA, 22 bp, Homo sapiens
agctgtgttattagaaacctgc

SEQ ID NO: 7978378 - DNA, 22 bp, Homo sapiens
agctgtgttctggttgattcac

SEQ ID NO: 7978379 - DNA, 22 bp, Homo sapiens
agctgttgaaaatggtgtccta

SEQ ID NO: 7978380 - DNA, 22 bp, Homo sapiens
agctgttccctcactgcagtca

SEQ ID NO: 7978381 - DNA, 22 bp, Homo sapiens
agctgttccctcactgcagtca

SEQ ID NO: 7978382 - DNA, 22 bp, Homo sapiens
agctgttgcagggatcagcacc

SEQ ID NO: 7978383 - DNA, 22 bp, Homo sapiens
agctgttgctgggaggagagaa

SEQ ID NO: 7978384 - DNA, 22 bp, Homo sapiens
agctgttgctgggaggagagaa

SEQ ID NO: 7978385 - DNA, 22 bp, Homo sapiens
agctgttggctggctgagctct

SEQ ID NO: 7978386 - DNA, 22 bp, Homo sapiens
agctgttggagtaaagcactta

SEQ ID NO: 7978387 - DNA, 22 bp, Homo sapiens
agctgttggctggctgagctct

SEQ ID NO: 7978388 - DNA, 22 bp, Homo sapiens
agctgttgtctgcaggagaagc

SEQ ID NO: 7978389 - DNA, 22 bp, Homo sapiens
agctgttgtctgcaggagaagc

SEQ ID NO: 7978390 - DNA, 22 bp, Homo sapiens
agctgtgtggtttgggcaaatt

SEQ ID NO: 7978391 - DNA, 22 bp, Homo sapiens
agctgtgtgtgaatttggccta

SEQ ID NO: 7978392 - DNA, 22 bp, Homo sapiens
agctgtgtgtgcttgggattat

SEQ ID NO: 7978393 - DNA, 22 bp, Homo sapiens
agctgtgttaggatgttaataa

SEQ ID NO: 7978394 - DNA, 22 bp, Homo sapiens
agctgtgtgtttgtcatgggcg

SEQ ID NO: 7978395 - DNA, 22 bp, Homo sapiens
agctgtgtgtttccactgagct

SEQ ID NO: 7978396 - DNA, 22 bp, Homo sapiens
agctgtgtggtgtctgacagct

SEQ ID NO: 7978397 - DNA, 22 bp, Homo sapiens
agctgtgtggtgtctgacagct

SEQ ID NO: 7978398 - DNA, 23 bp, Homo sapiens
agctgtgtggccttgggcaagtt

SEQ ID NO: 7978399 - DNA, 23 bp, Homo sapiens
agctgtgtgcgcgtccgggttct

SEQ ID NO: 7978400 - DNA, 22 bp, Homo sapiens
agctgtgtgcccatggtggagg

SEQ ID NO: 7978401 - DNA, 22 bp, Homo sapiens
agctgtgtgccaggggagatgt

SEQ ID NO: 7978402 - DNA, 22 bp, Homo sapiens
caggcctccactccacgcagac

SEQ ID NO: 7978403 - DNA, 22 bp, Homo sapiens
caggcctccactccacgcagac

SEQ ID NO: 7978404 - DNA, 22 bp, Homo sapiens
caggcctccactccacgcagac

SEQ ID NO: 7978405 - DNA, 22 bp, Homo sapiens
caggcctcatggtgtgtccttc

SEQ ID NO: 7978406 - DNA, 22 bp, Homo sapiens
caggcctcatggtgtgtccttc

SEQ ID NO: 7978407 - DNA, 22 bp, Homo sapiens
caggcctcatggtgtgtccttc

SEQ ID NO: 7978408 - DNA, 22 bp, Homo sapiens
caggcctcatggtgtgtccttc

SEQ ID NO: 7978409 - DNA, 22 bp, Homo sapiens
caggcctcaggggctcaggctg

SEQ ID NO: 7978410 - DNA, 22 bp, Homo sapiens
caggcctcaggggctcaggctg

SEQ ID NO: 7978411 - DNA, 22 bp, Homo sapiens
caggcctcaggggctcaggctg

SEQ ID NO: 7978412 - DNA, 22 bp, Homo sapiens
caggcctcaggggctcaggctg

SEQ ID NO: 7978413 - DNA, 22 bp, Homo sapiens
caggcctcaggggctcaggctg

SEQ ID NO: 7978414 - DNA, 22 bp, Homo sapiens
caggcctcagggctgtccgtag

SEQ ID NO: 7978415 - DNA, 22 bp, Homo sapiens
caggcctcagggctgtccgtag

SEQ ID NO: 7978416 - DNA, 22 bp, Homo sapiens
caggcctcaggggctcaggctg

SEQ ID NO: 7978417 - DNA, 22 bp, Homo sapiens
caggcctcagagagtggcgggg

SEQ ID NO: 7978418 - DNA, 22 bp, Homo sapiens
caggcctcagagagtggcgggg

SEQ ID NO: 7978419 - DNA, 22 bp, Homo sapiens
caggcctcagagagtggcgggg

SEQ ID NO: 7978420 - DNA, 22 bp, Homo sapiens
caggcctcaccagcggagctgc

SEQ ID NO: 7978421 - DNA, 22 bp, Homo sapiens
caggcctcaccagcggagctgc

SEQ ID NO: 7978422 - DNA, 22 bp, Homo sapiens
caggcctcaccagcggagctgc

SEQ ID NO: 7978423 - DNA, 22 bp, Homo sapiens
caggcctcaccagcggagctgc

SEQ ID NO: 7978424 - DNA, 22 bp, Homo sapiens
caggcctcaccagcggagctgc

SEQ ID NO: 7978425 - DNA, 21 bp, Homo sapiens
caggccgggtgagcaggcagc

SEQ ID NO: 7978426 - DNA, 21 bp, Homo sapiens
caggccgggtgagcaggcagc

SEQ ID NO: 7978427 - DNA, 22 bp, Homo sapiens
caggccggtgattctggatgta

SEQ ID NO: 7978428 - DNA, 22 bp, Homo sapiens
caggccggtgattctggatgta

SEQ ID NO: 7978429 - DNA, 23 bp, Homo sapiens
agctgggaattttctgaagcttt

SEQ ID NO: 7978430 - DNA, 23 bp, Homo sapiens
agctgggaattttctgaagcttt

SEQ ID NO: 7978431 - DNA, 22 bp, Homo sapiens
agctgggaagagttttctgcag

SEQ ID NO: 7978432 - DNA, 22 bp, Homo sapiens
agctgggaagagttttctgcag

SEQ ID NO: 7978433 - DNA, 22 bp, Homo sapiens
agctgggaagagttttctgcag

SEQ ID NO: 7978434 - DNA, 22 bp, Homo sapiens
agctgggaagagttttctgcag

SEQ ID NO: 7978435 - DNA, 22 bp, Homo sapiens
agctgggaagactggaagacag

SEQ ID NO: 7978436 - DNA, 22 bp, Homo sapiens
agctggcttttgtgaaggtttt

SEQ ID NO: 7978437 - DNA, 22 bp, Homo sapiens
agctggcttttgtgaaggtttt

SEQ ID NO: 7978438 - DNA, 22 bp, Homo sapiens
agctgggaagactggaagacag

SEQ ID NO: 7978439 - DNA, 22 bp, Homo sapiens
agctgggaagactggaagacag

SEQ ID NO: 7978440 - DNA, 23 bp, Homo sapiens
agctgggaattttctgaagcttt

SEQ ID NO: 7978441 - DNA, 23 bp, Homo sapiens
agctgggaattttctgaagcttt

SEQ ID NO: 7978442 - DNA, 23 bp, Homo sapiens
agctgggaattttctgaagcttt

SEQ ID NO: 7978443 - DNA, 23 bp, Homo sapiens
agctgggaattttctgaagcttt

SEQ ID NO: 7978444 - DNA, 22 bp, Homo sapiens
agctgggacagacaactatgtt

SEQ ID NO: 7978445 - DNA, 22 bp, Homo sapiens
agctgggactcaactgtctggg

SEQ ID NO: 7978446 - DNA, 22 bp, Homo sapiens
agctgggacagacaactatgtt

SEQ ID NO: 7978447 - DNA, 22 bp, Homo sapiens
agctgggacagacaactatgtt

SEQ ID NO: 7978448 - DNA, 23 bp, Homo sapiens
agctgggaattttctgaagcttt

SEQ ID NO: 7978449 - DNA, 21 bp, Homo sapiens
caggccccaggcctggggtgc

SEQ ID NO: 7978450 - DNA, 21 bp, Homo sapiens
caggccccaggcctggggtgc

SEQ ID NO: 7978451 - DNA, 22 bp, Homo sapiens
agctgggacagacaactatgtt

SEQ ID NO: 7978452 - DNA, 22 bp, Homo sapiens
caggccccattcctcttgggac

SEQ ID NO: 7978453 - DNA, 22 bp, Homo sapiens
agctgggacagacaactatgtt

SEQ ID NO: 7978454 - DNA, 22 bp, Homo sapiens
caggcctggttgagccctgaga

SEQ ID NO: 7978455 - DNA, 22 bp, Homo sapiens
caggcctggttgagccctgaga

SEQ ID NO: 7978456 - DNA, 22 bp, Homo sapiens
agctgtggcagcagccgtggca

SEQ ID NO: 7978457 - DNA, 22 bp, Homo sapiens
caggcctggttgagccctgaga

SEQ ID NO: 7978458 - DNA, 22 bp, Homo sapiens
caggcctggttgagccctgaga

SEQ ID NO: 7978459 - DNA, 22 bp, Homo sapiens
caggcctggttgagccctgaga

SEQ ID NO: 7978460 - DNA, 22 bp, Homo sapiens
caggcctgggttcaaatccctt

SEQ ID NO: 7978461 - DNA, 22 bp, Homo sapiens
caggcctggttgagccctgaga

SEQ ID NO: 7978462 - DNA, 22 bp, Homo sapiens
caggcctgggcttcggggctga

SEQ ID NO: 7978463 - DNA, 22 bp, Homo sapiens
caggcctgggcttcggggctga

SEQ ID NO: 7978464 - DNA, 22 bp, Homo sapiens
caggcctggggctggcttccag

SEQ ID NO: 7978465 - DNA, 22 bp, Homo sapiens
caggcctggggctggcttccag

SEQ ID NO: 7978466 - DNA, 22 bp, Homo sapiens
caggcctggggctggcttccag

SEQ ID NO: 7978467 - DNA, 22 bp, Homo sapiens
caggcctgggttcaaatccctt

SEQ ID NO: 7978468 - DNA, 22 bp, Homo sapiens
agctgtgtgactctaagcaagt

SEQ ID NO: 7978469 - DNA, 22 bp, Homo sapiens
agctgtgtgcatttgggtctca

SEQ ID NO: 7978470 - DNA, 22 bp, Homo sapiens
agctgtgtgcatttgggtctca

SEQ ID NO: 7978471 - DNA, 22 bp, Homo sapiens
agctgtgtgacctagggcaagc

SEQ ID NO: 7978472 - DNA, 22 bp, Homo sapiens
agctgtgtgactctaagcaagt

SEQ ID NO: 7978473 - DNA, 22 bp, Homo sapiens
agctgtgtgacctagggcaagc

SEQ ID NO: 7978474 - DNA, 22 bp, Homo sapiens
agctgtgtcctgaagacactgc

SEQ ID NO: 7978475 - DNA, 22 bp, Homo sapiens
agctgtgtagggaatcagagaa

SEQ ID NO: 7978476 - DNA, 22 bp, Homo sapiens
agctgtgtcatcctggaaaatg

SEQ ID NO: 7978477 - DNA, 22 bp, Homo sapiens
agctgtgtagggaatcagagaa

SEQ ID NO: 7978478 - DNA, 22 bp, Homo sapiens
agctgtggcagcagccgtggca

SEQ ID NO: 7978479 - DNA, 22 bp, Homo sapiens
agctgtggccagatgtgagcgg

SEQ ID NO: 7978480 - DNA, 22 bp, Homo sapiens
caggcctgggcttcggggctga

SEQ ID NO: 7978481 - DNA, 22 bp, Homo sapiens
caggcctgggcttcggggctga

SEQ ID NO: 7978482 - DNA, 22 bp, Homo sapiens
caggcctgggcttcggggctga

SEQ ID NO: 7978483 - DNA, 22 bp, Homo sapiens
caggcctgggcttcggggctga

SEQ ID NO: 7978484 - DNA, 22 bp, Homo sapiens
caggcctgggctgggtatcagg

SEQ ID NO: 7978485 - DNA, 22 bp, Homo sapiens
caggcctgggctgggtatcagg

SEQ ID NO: 7978486 - DNA, 22 bp, Homo sapiens
caggcctgggctgggtatcagg

SEQ ID NO: 7978487 - DNA, 22 bp, Homo sapiens
caggcctggctgcagctcgcct

SEQ ID NO: 7978488 - DNA, 22 bp, Homo sapiens
caggcctggctgcagctcgcct

SEQ ID NO: 7978489 - DNA, 22 bp, Homo sapiens
caggcctggctgcagctcgcct

SEQ ID NO: 7978490 - DNA, 22 bp, Homo sapiens
caggcctggctgcagctcgcct

SEQ ID NO: 7978491 - DNA, 22 bp, Homo sapiens
caggcctggctgcagctcgcct

SEQ ID NO: 7978492 - DNA, 22 bp, Homo sapiens
caggcctggctgcagctcgcct

SEQ ID NO: 7978493 - DNA, 22 bp, Homo sapiens
caggcctggcccccggcacacc

SEQ ID NO: 7978494 - DNA, 22 bp, Homo sapiens
caggcctggctgcagctcgcct

SEQ ID NO: 7978495 - DNA, 22 bp, Homo sapiens
caggcctggctgcagctcgcct

SEQ ID NO: 7978496 - DNA, 22 bp, Homo sapiens
caggcctggctgcagctcgcct

SEQ ID NO: 7978497 - DNA, 22 bp, Homo sapiens
caggcctggcccccggcacacc

SEQ ID NO: 7978498 - DNA, 22 bp, Homo sapiens
caggcctggcccccggcacacc

SEQ ID NO: 7978499 - DNA, 22 bp, Homo sapiens
caggcctggagtgcaatggcac

SEQ ID NO: 7978500 - DNA, 22 bp, Homo sapiens
caggcctggcccccggcacacc

SEQ ID NO: 7978501 - DNA, 22 bp, Homo sapiens
caggcctggagtgcaatggcac

SEQ ID NO: 7978502 - DNA, 22 bp, Homo sapiens
caggcctcccggtgcacactga

SEQ ID NO: 7978503 - DNA, 22 bp, Homo sapiens
caggcctcccggtgcacactga

SEQ ID NO: 7978504 - DNA, 22 bp, Homo sapiens
caggcctcccggtgcacactga

SEQ ID NO: 7978505 - DNA, 22 bp, Homo sapiens
caggcctcccggtgcacactga

SEQ ID NO: 7978506 - DNA, 22 bp, Homo sapiens
caggcctcccggtgcacactga

SEQ ID NO: 7978507 - DNA, 23 bp, Homo sapiens
agctgaggctgtgggtgtcagag

SEQ ID NO: 7978508 - DNA, 23 bp, Homo sapiens
agctgaggctgtgggtgtcagag

SEQ ID NO: 7978509 - DNA, 23 bp, Homo sapiens
agctgaggctgtgggtgtcagag

SEQ ID NO: 7978510 - DNA, 23 bp, Homo sapiens
agctgaggctgtgggtgtcagag

SEQ ID NO: 7978511 - DNA, 23 bp, Homo sapiens
agctgaggctgtgggtgtcagag

SEQ ID NO: 7978512 - DNA, 22 bp, Homo sapiens
agctgaggctctgagagggaag

SEQ ID NO: 7978513 - DNA, 22 bp, Homo sapiens
agctgaggctctgagagggaag

SEQ ID NO: 7978514 - DNA, 23 bp, Homo sapiens
agctgaggctgtgggtgtcagag

SEQ ID NO: 7978515 - DNA, 22 bp, Homo sapiens
agctgaggctctgagagggaag

SEQ ID NO: 7978516 - DNA, 22 bp, Homo sapiens
agctgcaggcctctcctgggga

SEQ ID NO: 7978517 - DNA, 22 bp, Homo sapiens
agctgcaggcctctcctgggga

SEQ ID NO: 7978518 - DNA, 21 bp, Homo sapiens
agctgcaggcctcccagggat

SEQ ID NO: 7978519 - DNA, 22 bp, Homo sapiens
agctgcaggcccatgctcagtc

SEQ ID NO: 7978520 - DNA, 21 bp, Homo sapiens
agctgcaggcctcccagggat

SEQ ID NO: 7978521 - DNA, 22 bp, Homo sapiens
agctgcagccctcctgcatggc

SEQ ID NO: 7978522 - DNA, 22 bp, Homo sapiens
agctgcagccctcctgcatggc

SEQ ID NO: 7978523 - DNA, 22 bp, Homo sapiens
agctgcaggcccatgctcagtc

SEQ ID NO: 7978524 - DNA, 22 bp, Homo sapiens
agctgaggcatgatgctatcag

SEQ ID NO: 7978525 - DNA, 22 bp, Homo sapiens
agctgaggcatgatgctatcag

SEQ ID NO: 7978526 - DNA, 23 bp, Homo sapiens
agctgaggcagaggggcattctc

SEQ ID NO: 7978527 - DNA, 22 bp, Homo sapiens
agctgaggcatgatgctatcag

SEQ ID NO: 7978528 - DNA, 22 bp, Homo sapiens
agctgaggcatgatgctatcag

SEQ ID NO: 7978529 - DNA, 22 bp, Homo sapiens
agctgaggcatggacaggctgc

SEQ ID NO: 7978530 - DNA, 22 bp, Homo sapiens
agctgaggcatggacaggctgc

SEQ ID NO: 7978531 - DNA, 22 bp, Homo sapiens
agctgaggcatgatgctatcag

SEQ ID NO: 7978532 - DNA, 23 bp, Homo sapiens
cagcttctttgggattctttata

SEQ ID NO: 7978533 - DNA, 23 bp, Homo sapiens
cagcttctttgggattctttata

SEQ ID NO: 7978534 - DNA, 23 bp, Homo sapiens
agctgaggcagaggggcattctc

SEQ ID NO: 7978535 - DNA, 23 bp, Homo sapiens
agctgaggcagaggggcattctc

SEQ ID NO: 7978536 - DNA, 22 bp, Homo sapiens
cagcttgcacacatattagacg

SEQ ID NO: 7978537 - DNA, 22 bp, Homo sapiens
cagcttgcactatattaaggag

SEQ ID NO: 7978538 - DNA, 22 bp, Homo sapiens
agctgaggcctgatttcgccgt

SEQ ID NO: 7978539 - DNA, 22 bp, Homo sapiens
agctgaggcctgatttcgccgt

SEQ ID NO: 7978540 - DNA, 22 bp, Homo sapiens
agctgaggccacgagtgaaggg

SEQ ID NO: 7978541 - DNA, 22 bp, Homo sapiens
agctgaggccacgagtgaaggg

SEQ ID NO: 7978542 - DNA, 22 bp, Homo sapiens
agctgaggccacgagtgaaggg

SEQ ID NO: 7978543 - DNA, 22 bp, Homo sapiens
agctgaggcatggacaggctgc

SEQ ID NO: 7978544 - DNA, 22 bp, Homo sapiens
agctgaggcatggacaggctgc

SEQ ID NO: 7978545 - DNA, 22 bp, Homo sapiens
cagctttgattctttctgccat

SEQ ID NO: 7978546 - DNA, 22 bp, Homo sapiens
cagctttgattctttctgccat

SEQ ID NO: 7978547 - DNA, 22 bp, Homo sapiens
cagctttgccaagtaaggtctt

SEQ ID NO: 7978548 - DNA, 22 bp, Homo sapiens
cagctttgcaggctggtcagtg

SEQ ID NO: 7978549 - DNA, 22 bp, Homo sapiens
cagctttgccctttgcccaatc

SEQ ID NO: 7978550 - DNA, 22 bp, Homo sapiens
cagctttggcccagtcgggagg

SEQ ID NO: 7978551 - DNA, 22 bp, Homo sapiens
cagctttggagtgtgagtgctg

SEQ ID NO: 7978552 - DNA, 16 bp, Homo sapiens
cagctttgtctcctcg

SEQ ID NO: 7978553 - DNA, 22 bp, Homo sapiens
cagctttgtcctgcaaacctga

SEQ ID NO: 7978554 - DNA, 22 bp, Homo sapiens
cagctttgtcatttgatttggg

SEQ ID NO: 7978555 - DNA, 22 bp, Homo sapiens
cagcttttaggactgtgagaaa

SEQ ID NO: 7978556 - DNA, 22 bp, Homo sapiens
cagcttttgcagacttcttgcc

SEQ ID NO: 7978557 - DNA, 22 bp, Homo sapiens
cagcttttgcagacttcttgcc

SEQ ID NO: 7978558 - DNA, 22 bp, Homo sapiens
cagcttttgcagacttcttgcc

SEQ ID NO: 7978559 - DNA, 22 bp, Homo sapiens
cagctttttagaatctagggca

SEQ ID NO: 7978560 - DNA, 22 bp, Homo sapiens
caggaaaaatgccaggagtcag

SEQ ID NO: 7978561 - DNA, 22 bp, Homo sapiens
cagctttgtgcaatgcagtctc

SEQ ID NO: 7978562 - DNA, 22 bp, Homo sapiens
cagctttgtggccttgacctcg

SEQ ID NO: 7978563 - DNA, 22 bp, Homo sapiens
cagcttttaggactgtgagaaa

SEQ ID NO: 7978564 - DNA, 22 bp, Homo sapiens
cagcttttaggactgtgagaaa

SEQ ID NO: 7978565 - DNA, 22 bp, Homo sapiens
cagctttgtgacttcggacaag

SEQ ID NO: 7978566 - DNA, 21 bp, Homo sapiens
cagctttgtctgtcttcgggg

SEQ ID NO: 7978567 - DNA, 22 bp, Homo sapiens
cagctttgtctgattcctcttt

SEQ ID NO: 7978568 - DNA, 22 bp, Homo sapiens
agctgcagtatgaggctggtgg

SEQ ID NO: 7978569 - DNA, 22 bp, Homo sapiens
agctgcagtatgaggctggtgg

SEQ ID NO: 7978570 - DNA, 22 bp, Homo sapiens
agctgcagtaaagctctccagg

SEQ ID NO: 7978571 - DNA, 21 bp, Homo sapiens
agctgcagtcaagccagaggt

SEQ ID NO: 7978572 - DNA, 21 bp, Homo sapiens
agctgcagtcaagccagaggt

SEQ ID NO: 7978573 - DNA, 21 bp, Homo sapiens
agctgcagtcaagccagaggt

SEQ ID NO: 7978574 - DNA, 21 bp, Homo sapiens
agctgcagtcaagccagaggt

SEQ ID NO: 7978575 - DNA, 21 bp, Homo sapiens
agctgcagtcaagccagaggt

SEQ ID NO: 7978576 - DNA, 22 bp, Homo sapiens
agctgcagtcaagctgggccac

SEQ ID NO: 7978577 - DNA, 22 bp, Homo sapiens
agctgcagtcaagctgggccac

SEQ ID NO: 7978578 - DNA, 22 bp, Homo sapiens
agctgcagtcaagctgggccac

SEQ ID NO: 7978579 - DNA, 22 bp, Homo sapiens
agctgcagtcaagctgggccac

SEQ ID NO: 7978580 - DNA, 21 bp, Homo sapiens
agctgcagtcaagccagaggt

SEQ ID NO: 7978581 - DNA, 21 bp, Homo sapiens
agctgcagtcaagccagaggt

SEQ ID NO: 7978582 - DNA, 22 bp, Homo sapiens
agctgcaggcgccggggccgat

SEQ ID NO: 7978583 - DNA, 22 bp, Homo sapiens
agctgcaggcctctcctgggga

SEQ ID NO: 7978584 - DNA, 22 bp, Homo sapiens
agctgcaggttcagcattccac

SEQ ID NO: 7978585 - DNA, 22 bp, Homo sapiens
agctgcaggttcagcattccac

SEQ ID NO: 7978586 - DNA, 22 bp, Homo sapiens
cagctctccaccctcctggttc

SEQ ID NO: 7978587 - DNA, 22 bp, Homo sapiens
cagctctcacacttagcttcta

SEQ ID NO: 7978588 - DNA, 22 bp, Homo sapiens
cagctctctaaggtcttgcttt

SEQ ID NO: 7978589 - DNA, 22 bp, Homo sapiens
cagctctcacacttagcttcta

SEQ ID NO: 7978590 - DNA, 22 bp, Homo sapiens
cagctctcacacttagcttcta

SEQ ID NO: 7978591 - DNA, 22 bp, Homo sapiens
cagctctcacaccctcctccca

SEQ ID NO: 7978592 - DNA, 22 bp, Homo sapiens
cagctctcacaccctcctccca

SEQ ID NO: 7978593 - DNA, 22 bp, Homo sapiens
cagctctcacaccctcctccca

SEQ ID NO: 7978594 - DNA, 23 bp, Homo sapiens
cagctcgcttttgttccctccct

SEQ ID NO: 7978595 - DNA, 22 bp, Homo sapiens
cagctcctgttggtcttgagga

SEQ ID NO: 7978596 - DNA, 22 bp, Homo sapiens
cagctcctgttggtcttgagga

SEQ ID NO: 7978597 - DNA, 22 bp, Homo sapiens
cagctcctgttggtcttgagga

SEQ ID NO: 7978598 - DNA, 22 bp, Homo sapiens
cagctctgaagaaaggtgtcta

SEQ ID NO: 7978599 - DNA, 22 bp, Homo sapiens
cagctctgacacagtacaaaat

SEQ ID NO: 7978600 - DNA, 22 bp, Homo sapiens
cagctctgacacagtacaaaat

SEQ ID NO: 7978601 - DNA, 22 bp, Homo sapiens
cagctgttgtcacctcacatcc

SEQ ID NO: 7978602 - DNA, 22 bp, Homo sapiens
cagctgttgtgatccatttacg

SEQ ID NO: 7978603 - DNA, 22 bp, Homo sapiens
cagctgttgtctctcacatatt

SEQ ID NO: 7978604 - DNA, 22 bp, Homo sapiens
cagctgttgtctctcacatatt

SEQ ID NO: 7978605 - DNA, 22 bp, Homo sapiens
cagctgttgtctctcacatatt

SEQ ID NO: 7978606 - DNA, 22 bp, Homo sapiens
cagctctgaagaaaggtgtcta

SEQ ID NO: 7978607 - DNA, 22 bp, Homo sapiens
cagctctgaagaaaggtgtcta

SEQ ID NO: 7978608 - DNA, 22 bp, Homo sapiens
cagctctctaaggtcttgcttt

SEQ ID NO: 7978609 - DNA, 21 bp, Homo sapiens
cagcttcttctgtgacctggt

SEQ ID NO: 7978610 - DNA, 22 bp, Homo sapiens
cagcttcttcagtcctggagct

SEQ ID NO: 7978611 - DNA, 22 bp, Homo sapiens
cagcttctttgggattctttat

SEQ ID NO: 7978612 - DNA, 22 bp, Homo sapiens
cagcttctttgggattctttat

SEQ ID NO: 7978613 - DNA, 22 bp, Homo sapiens
cagcttcttcagtcctggagct

SEQ ID NO: 7978614 - DNA, 22 bp, Homo sapiens
cagcttcttagtctttccttgt

SEQ ID NO: 7978615 - DNA, 22 bp, Homo sapiens
cagcttcttacgagctggtact

SEQ ID NO: 7978616 - DNA, 22 bp, Homo sapiens
cagcttctgtttctagcccctg

SEQ ID NO: 7978617 - DNA, 22 bp, Homo sapiens
cagcttctggcgtggagcctga

SEQ ID NO: 7978618 - DNA, 22 bp, Homo sapiens
cagcttctggcgtggagcctga

SEQ ID NO: 7978619 - DNA, 22 bp, Homo sapiens
cagcttctgtcctagaaactgg

SEQ ID NO: 7978620 - DNA, 22 bp, Homo sapiens
cagcttctggcgtggagcctga

SEQ ID NO: 7978621 - DNA, 22 bp, Homo sapiens
cagcttctgctcatggaggggt

SEQ ID NO: 7978622 - DNA, 22 bp, Homo sapiens
cagctgttgtgatccatttacg

SEQ ID NO: 7978623 - DNA, 22 bp, Homo sapiens
cagcttctgctcatggaggggt

SEQ ID NO: 7978624 - DNA, 22 bp, Homo sapiens
cagcttctgctcatggaggggt

SEQ ID NO: 7978625 - DNA, 22 bp, Homo sapiens
cagcttctggcgtggagcctga

SEQ ID NO: 7978626 - DNA, 22 bp, Homo sapiens
cagcttctgtttctagcccctg

SEQ ID NO: 7978627 - DNA, 22 bp, Homo sapiens
cagcttctgtttattgtgtgcc

SEQ ID NO: 7978628 - DNA, 22 bp, Homo sapiens
cagcttctgtttattgtgtgcc

SEQ ID NO: 7978629 - DNA, 22 bp, Homo sapiens
cagcttctgtctgattagcaag

SEQ ID NO: 7978630 - DNA, 22 bp, Homo sapiens
agctctgagttggggaggagca

SEQ ID NO: 7978631 - DNA, 22 bp, Homo sapiens
agctctgatctttacaacaaag

SEQ ID NO: 7978632 - DNA, 22 bp, Homo sapiens
agctcctgtgtgaagcctccct

SEQ ID NO: 7978633 - DNA, 22 bp, Homo sapiens
agctcctgtgtgaagcctccct

SEQ ID NO: 7978634 - DNA, 22 bp, Homo sapiens
agctcctgtgtgaagcctccct

SEQ ID NO: 7978635 - DNA, 22 bp, Homo sapiens
agctctcccatagggcaagatc

SEQ ID NO: 7978636 - DNA, 18 bp, Homo sapiens
agctctcccccacatgcc

SEQ ID NO: 7978637 - DNA, 18 bp, Homo sapiens
agctctcccccacatgcc

SEQ ID NO: 7978638 - DNA, 18 bp, Homo sapiens
agctctcccccacatgcc

SEQ ID NO: 7978639 - DNA, 22 bp, Homo sapiens
agctctctcatgacagtgcagt

SEQ ID NO: 7978640 - DNA, 22 bp, Homo sapiens
agctctctcatgacagtgcagt

SEQ ID NO: 7978641 - DNA, 22 bp, Homo sapiens
agctctcttccagatccacttg

SEQ ID NO: 7978642 - DNA, 22 bp, Homo sapiens
agctctcttgtgttctgtatgg

SEQ ID NO: 7978643 - DNA, 22 bp, Homo sapiens
cagctcctgcctgggcagctgt

SEQ ID NO: 7978644 - DNA, 22 bp, Homo sapiens
cagctcctgggccatctcctag

SEQ ID NO: 7978645 - DNA, 22 bp, Homo sapiens
cagctcctgcctgggcagctgt

SEQ ID NO: 7978646 - DNA, 22 bp, Homo sapiens
cagctcctgggccatctcctag

SEQ ID NO: 7978647 - DNA, 22 bp, Homo sapiens
cagctcctgggccatctcctag

SEQ ID NO: 7978648 - DNA, 22 bp, Homo sapiens
cagctcctgggccatctcctag

SEQ ID NO: 7978649 - DNA, 22 bp, Homo sapiens
cagctcctgttggtcttgagga

SEQ ID NO: 7978650 - DNA, 22 bp, Homo sapiens
cagctcctgttggtcttgagga

SEQ ID NO: 7978651 - DNA, 22 bp, Homo sapiens
agctctggaagccctggtagtt

SEQ ID NO: 7978652 - DNA, 22 bp, Homo sapiens
agctctggaactcccggctgct

SEQ ID NO: 7978653 - DNA, 22 bp, Homo sapiens
agctctggaagccctggtagtt

SEQ ID NO: 7978654 - DNA, 22 bp, Homo sapiens
agctctggaagccctggtagtt

SEQ ID NO: 7978655 - DNA, 22 bp, Homo sapiens
agctctggaagccctggtagtt

SEQ ID NO: 7978656 - DNA, 22 bp, Homo sapiens
cagctcctgcagctggctccca

SEQ ID NO: 7978657 - DNA, 22 bp, Homo sapiens
cagctcctgcctgggcagctgt

SEQ ID NO: 7978658 - DNA, 22 bp, Homo sapiens
agctctggaactcccggctgct

SEQ ID NO: 7978659 - DNA, 22 bp, Homo sapiens
agctctgcttcttgggaagatg

SEQ ID NO: 7978660 - DNA, 22 bp, Homo sapiens
agctctggaactcccggctgct

SEQ ID NO: 7978661 - DNA, 22 bp, Homo sapiens
agctctggaactcccggctgct

SEQ ID NO: 7978662 - DNA, 22 bp, Homo sapiens
agctctgccttgacaccttctc

SEQ ID NO: 7978663 - DNA, 22 bp, Homo sapiens
agctctgctactctgtggggtg

SEQ ID NO: 7978664 - DNA, 22 bp, Homo sapiens
agctctgcaggcacagctgagg

SEQ ID NO: 7978665 - DNA, 22 bp, Homo sapiens
agctctgcaggcacagctgagg

SEQ ID NO: 7978666 - DNA, 22 bp, Homo sapiens
agctctgcagcccagcaggtgg

SEQ ID NO: 7978667 - DNA, 22 bp, Homo sapiens
caggaggtgccctctagtggca

SEQ ID NO: 7978668 - DNA, 22 bp, Homo sapiens
caggaggttgagggtgcagtga

SEQ ID NO: 7978669 - DNA, 22 bp, Homo sapiens
caggaggttgagggtgcagtga

SEQ ID NO: 7978670 - DNA, 22 bp, Homo sapiens
caggaggtgacttccaggggtt

SEQ ID NO: 7978671 - DNA, 22 bp, Homo sapiens
caggaggtgaaggagaaccagt

SEQ ID NO: 7978672 - DNA, 22 bp, Homo sapiens
agctggccagcacctccaggtc

SEQ ID NO: 7978673 - DNA, 22 bp, Homo sapiens
caggaggtacatagattcagat

SEQ ID NO: 7978674 - DNA, 22 bp, Homo sapiens
caggaggtacatagattcagat

SEQ ID NO: 7978675 - DNA, 22 bp, Homo sapiens
caggaggtacatagattcagat

SEQ ID NO: 7978676 - DNA, 22 bp, Homo sapiens
caggaggtgaaggagaaccagt

SEQ ID NO: 7978677 - DNA, 22 bp, Homo sapiens
caggaggttgtaagagcaggcc

SEQ ID NO: 7978678 - DNA, 22 bp, Homo sapiens
caggaggttgtaagagcaggcc

SEQ ID NO: 7978679 - DNA, 22 bp, Homo sapiens
caggagtccagagtgtcatttt

SEQ ID NO: 7978680 - DNA, 22 bp, Homo sapiens
caggaggttgagggtgcagtga

SEQ ID NO: 7978681 - DNA, 22 bp, Homo sapiens
caggaggttggtagcagtagat

SEQ ID NO: 7978682 - DNA, 22 bp, Homo sapiens
caggaggttggtagcagtagat

SEQ ID NO: 7978683 - DNA, 22 bp, Homo sapiens
caggaggttgtaagagcaggcc

SEQ ID NO: 7978684 - DNA, 22 bp, Homo sapiens
caggaggttgtaagagcaggcc

SEQ ID NO: 7978685 - DNA, 22 bp, Homo sapiens
caggaggttggtagcagtagat

SEQ ID NO: 7978686 - DNA, 22 bp, Homo sapiens
agctggcattacaggagcatgc

SEQ ID NO: 7978687 - DNA, 22 bp, Homo sapiens
agctggcattacaggagcatgc

SEQ ID NO: 7978688 - DNA, 22 bp, Homo sapiens
agctggcattacaggagcatgc

SEQ ID NO: 7978689 - DNA, 22 bp, Homo sapiens
agctggcattacaggagcatgc

SEQ ID NO: 7978690 - DNA, 22 bp, Homo sapiens
agctggcattgaagaatggtta

SEQ ID NO: 7978691 - DNA, 22 bp, Homo sapiens
agctggcattgaagaatggtta

SEQ ID NO: 7978692 - DNA, 22 bp, Homo sapiens
agctggcattctccttgttatt

SEQ ID NO: 7978693 - DNA, 22 bp, Homo sapiens
agctggcattctccttgttatt

SEQ ID NO: 7978694 - DNA, 22 bp, Homo sapiens
agctggcatactttgctaggaa

SEQ ID NO: 7978695 - DNA, 22 bp, Homo sapiens
agctggcatcgagcatttgaac

SEQ ID NO: 7978696 - DNA, 22 bp, Homo sapiens
agctggcatctgaagtcagggc

SEQ ID NO: 7978697 - DNA, 22 bp, Homo sapiens
agctggcatctgaagtcagggc

SEQ ID NO: 7978698 - DNA, 22 bp, Homo sapiens
agctggcatctgaagtcagggc

SEQ ID NO: 7978699 - DNA, 22 bp, Homo sapiens
agctggcattgcagggagctgc

SEQ ID NO: 7978700 - DNA, 22 bp, Homo sapiens
agctggcattgcagggagctgc

SEQ ID NO: 7978701 - DNA, 20 bp, Homo sapiens
agctggccaattctattact

SEQ ID NO: 7978702 - DNA, 22 bp, Homo sapiens
agctggccagatgtcccaaaga

SEQ ID NO: 7978703 - DNA, 22 bp, Homo sapiens
agctggccagcacctccaggtc

SEQ ID NO: 7978704 - DNA, 22 bp, Homo sapiens
agctggcattgcagggagctgc

SEQ ID NO: 7978705 - DNA, 22 bp, Homo sapiens
agctggcattgcagggagctgc

SEQ ID NO: 7978706 - DNA, 22 bp, Homo sapiens
agctggcattgcagggagctgc

SEQ ID NO: 7978707 - DNA, 22 bp, Homo sapiens
agctggccagcacctccaggtc

SEQ ID NO: 7978708 - DNA, 22 bp, Homo sapiens
agctggccagcacctccaggtc

SEQ ID NO: 7978709 - DNA, 22 bp, Homo sapiens
agctggccagcacctccaggtc

SEQ ID NO: 7978710 - DNA, 22 bp, Homo sapiens
agctggccattgtgagtggcct

SEQ ID NO: 7978711 - DNA, 22 bp, Homo sapiens
caggagggtgtggaaaactggg

SEQ ID NO: 7978712 - DNA, 22 bp, Homo sapiens
caggagggtgtggaaaactggg

SEQ ID NO: 7978713 - DNA, 22 bp, Homo sapiens
caggagtccatctggcctggtg

SEQ ID NO: 7978714 - DNA, 22 bp, Homo sapiens
caggagtccctctggccagcat

SEQ ID NO: 7978715 - DNA, 22 bp, Homo sapiens
agctggcctccgggtgcctggg

SEQ ID NO: 7978716 - DNA, 22 bp, Homo sapiens
agctggcctccgggtgcctggg

SEQ ID NO: 7978717 - DNA, 22 bp, Homo sapiens
caggagtctctcttgagcccag

SEQ ID NO: 7978718 - DNA, 22 bp, Homo sapiens
agctggctggccccttcctgcc

SEQ ID NO: 7978719 - DNA, 22 bp, Homo sapiens
agctggctggccccttcctgcc

SEQ ID NO: 7978720 - DNA, 22 bp, Homo sapiens
agctggctggccccttcctgcc

SEQ ID NO: 7978721 - DNA, 22 bp, Homo sapiens
agctggctggccccttcctgcc

SEQ ID NO: 7978722 - DNA, 22 bp, Homo sapiens
agctggctggccccttcctgcc

SEQ ID NO: 7978723 - DNA, 22 bp, Homo sapiens
agctggctggccccttcctgcc

SEQ ID NO: 7978724 - DNA, 22 bp, Homo sapiens
agctggctggccccttcctgcc

SEQ ID NO: 7978725 - DNA, 22 bp, Homo sapiens
agctggctggccccttcctgcc

SEQ ID NO: 7978726 - DNA, 19 bp, Homo sapiens
agctggctcttctttgtct

SEQ ID NO: 7978727 - DNA, 21 bp, Homo sapiens
agctggcctggtttgagctcc

SEQ ID NO: 7978728 - DNA, 22 bp, Homo sapiens
agctggctgccttctccttagg

SEQ ID NO: 7978729 - DNA, 22 bp, Homo sapiens
agctggctgccttctccttagg

SEQ ID NO: 7978730 - DNA, 22 bp, Homo sapiens
agctggcttctctgcagacatt

SEQ ID NO: 7978731 - DNA, 22 bp, Homo sapiens
agctggcttctctgcagacatt

SEQ ID NO: 7978732 - DNA, 22 bp, Homo sapiens
agctggcttctctgcagacatt

SEQ ID NO: 7978733 - DNA, 22 bp, Homo sapiens
agctggcttctctgcagacatt

SEQ ID NO: 7978734 - DNA, 22 bp, Homo sapiens
agctggcttctctgcagacatt

SEQ ID NO: 7978735 - DNA, 22 bp, Homo sapiens
agctggcttcacaggcagtgtg

SEQ ID NO: 7978736 - DNA, 22 bp, Homo sapiens
agctggcttctctgcagacatt

SEQ ID NO: 7978737 - DNA, 22 bp, Homo sapiens
agctggcttctctgcagacatt

SEQ ID NO: 7978738 - DNA, 22 bp, Homo sapiens
agctggctgggtgccagtctcc

SEQ ID NO: 7978739 - DNA, 22 bp, Homo sapiens
agctggctgggtgccagtctcc

SEQ ID NO: 7978740 - DNA, 22 bp, Homo sapiens
agctggctgggtgccagtctcc

SEQ ID NO: 7978741 - DNA, 22 bp, Homo sapiens
agctggctgggtgccagtctcc

SEQ ID NO: 7978742 - DNA, 22 bp, Homo sapiens
agctggctgggtgccagtctcc

SEQ ID NO: 7978743 - DNA, 22 bp, Homo sapiens
agctggctgggtgccagtctcc

SEQ ID NO: 7978744 - DNA, 22 bp, Homo sapiens
agctggcttcacaggcagtgtg

SEQ ID NO: 7978745 - DNA, 22 bp, Homo sapiens
agctggctgggtgccagtctcc

SEQ ID NO: 7978746 - DNA, 22 bp, Homo sapiens
agctggcttcacaggcagtgtg

SEQ ID NO: 7978747 - DNA, 22 bp, Homo sapiens
agctggcttcacaggcagtgtg

SEQ ID NO: 7978748 - DNA, 22 bp, Homo sapiens
agctggcttcacaggcagtgtg

SEQ ID NO: 7978749 - DNA, 22 bp, Homo sapiens
agctggcttcacaggcagtgtg

SEQ ID NO: 7978750 - DNA, 22 bp, Homo sapiens
agctggctttgagctgggaggt

SEQ ID NO: 7978751 - DNA, 22 bp, Homo sapiens
agctggctttgagctgggaggt

SEQ ID NO: 7978752 - DNA, 22 bp, Homo sapiens
agctggctttgagctgggaggt

SEQ ID NO: 7978753 - DNA, 22 bp, Homo sapiens
agctggctttgagctgggaggt

SEQ ID NO: 7978754 - DNA, 22 bp, Homo sapiens
agctggctttgagctgggaggt

SEQ ID NO: 7978755 - DNA, 22 bp, Homo sapiens
agctggctttgagctgggaggt

SEQ ID NO: 7978756 - DNA, 22 bp, Homo sapiens
agctggctttgagctgggaggt

SEQ ID NO: 7978757 - DNA, 22 bp, Homo sapiens
agctggctttgagctgggaggt

SEQ ID NO: 7978758 - DNA, 22 bp, Homo sapiens
agctggctttatggttggctaa

SEQ ID NO: 7978759 - DNA, 22 bp, Homo sapiens
agctggctttgagctgggaggt

SEQ ID NO: 7978760 - DNA, 22 bp, Homo sapiens
agctggcttgcatgctaaggag

SEQ ID NO: 7978761 - DNA, 22 bp, Homo sapiens
agctggcttctctgcagacatt

SEQ ID NO: 7978762 - DNA, 22 bp, Homo sapiens
agctggcttgcatgctaaggag

SEQ ID NO: 7978763 - DNA, 22 bp, Homo sapiens
agctggcttgcatgctaaggag

SEQ ID NO: 7978764 - DNA, 22 bp, Homo sapiens
agctggctttatggttggctaa

SEQ ID NO: 7978765 - DNA, 22 bp, Homo sapiens
agctggctttatggttggctaa

SEQ ID NO: 7978766 - DNA, 22 bp, Homo sapiens
agctggctttatggttggctaa

SEQ ID NO: 7978767 - DNA, 22 bp, Homo sapiens
agctggctttatggttggctaa

SEQ ID NO: 7978768 - DNA, 22 bp, Homo sapiens
agctggctttatggttggctaa

SEQ ID NO: 7978769 - DNA, 22 bp, Homo sapiens
agctggaggataactcacttct

SEQ ID NO: 7978770 - DNA, 22 bp, Homo sapiens
agctggaggataactcacttct

SEQ ID NO: 7978771 - DNA, 22 bp, Homo sapiens
caggacagagcccagactgtgt

SEQ ID NO: 7978772 - DNA, 22 bp, Homo sapiens
agctggcaggtgaagatgattt

SEQ ID NO: 7978773 - DNA, 22 bp, Homo sapiens
agctggcaggtgaagatgattt

SEQ ID NO: 7978774 - DNA, 22 bp, Homo sapiens
agctggcagtatgactggtgac

SEQ ID NO: 7978775 - DNA, 22 bp, Homo sapiens
caggacagagcccagactgtgt

SEQ ID NO: 7978776 - DNA, 22 bp, Homo sapiens
caggacagagcccagactgtgt

SEQ ID NO: 7978777 - DNA, 22 bp, Homo sapiens
caggacagagcccagactgtgt

SEQ ID NO: 7978778 - DNA, 22 bp, Homo sapiens
caggacagagcccagactgtgt

SEQ ID NO: 7978779 - DNA, 22 bp, Homo sapiens
caggacagagcccagactgtgt

SEQ ID NO: 7978780 - DNA, 22 bp, Homo sapiens
caggacagagcccagactgtgt

SEQ ID NO: 7978781 - DNA, 22 bp, Homo sapiens
caggacagagcccagactgtgt

SEQ ID NO: 7978782 - DNA, 22 bp, Homo sapiens
caggacagagcccagactgtgt

SEQ ID NO: 7978783 - DNA, 22 bp, Homo sapiens
agctggcagtatgactggtgac

SEQ ID NO: 7978784 - DNA, 22 bp, Homo sapiens
agctggcagtatgactggtgac

SEQ ID NO: 7978785 - DNA, 22 bp, Homo sapiens
agctggcagtcatcctagtgag

SEQ ID NO: 7978786 - DNA, 22 bp, Homo sapiens
agctggcagtcatcctagtgag

SEQ ID NO: 7978787 - DNA, 22 bp, Homo sapiens
agctggcagtcatcctagtgag

SEQ ID NO: 7978788 - DNA, 22 bp, Homo sapiens
agctggcagtcatcctagtgag

SEQ ID NO: 7978789 - DNA, 22 bp, Homo sapiens
agctggcagtcatcctagtgag

SEQ ID NO: 7978790 - DNA, 22 bp, Homo sapiens
agctggcatactttgctaggaa

SEQ ID NO: 7978791 - DNA, 22 bp, Homo sapiens
agctggcagttgcgataatgca

SEQ ID NO: 7978792 - DNA, 22 bp, Homo sapiens
agctggcatactttgctaggaa

SEQ ID NO: 7978793 - DNA, 22 bp, Homo sapiens
agctggcatactttgctaggaa

SEQ ID NO: 7978794 - DNA, 21 bp, Homo sapiens
agctggcagtgcctggacctc

SEQ ID NO: 7978795 - DNA, 21 bp, Homo sapiens
agctggcagtgcctggacctc

SEQ ID NO: 7978796 - DNA, 21 bp, Homo sapiens
agctggcagtgcctggacctc

SEQ ID NO: 7978797 - DNA, 22 bp, Homo sapiens
agctggcagtcggccttgatgc

SEQ ID NO: 7978798 - DNA, 22 bp, Homo sapiens
caggacagaccaagatcgtgct

SEQ ID NO: 7978799 - DNA, 22 bp, Homo sapiens
caggacagaccaagatcgtgct

SEQ ID NO: 7978800 - DNA, 22 bp, Homo sapiens
caggacagaccaagatcgtgct

SEQ ID NO: 7978801 - DNA, 22 bp, Homo sapiens
caggacagaccaagatcgtgct

SEQ ID NO: 7978802 - DNA, 22 bp, Homo sapiens
caggacagaccaagatcgtgct

SEQ ID NO: 7978803 - DNA, 22 bp, Homo sapiens
caggacagacagaatgcctaac

SEQ ID NO: 7978804 - DNA, 22 bp, Homo sapiens
caggacagaccaagatcgtgct

SEQ ID NO: 7978805 - DNA, 22 bp, Homo sapiens
caggacagaccaagatcgtgct

SEQ ID NO: 7978806 - DNA, 22 bp, Homo sapiens
caggacagaccaagatcgtgct

SEQ ID NO: 7978807 - DNA, 19 bp, Homo sapiens
caggacagacttcaaagcc

SEQ ID NO: 7978808 - DNA, 22 bp, Homo sapiens
caggacagagcccagactgtgt

SEQ ID NO: 7978809 - DNA, 19 bp, Homo sapiens
caggacagacttcaaagcc

SEQ ID NO: 7978810 - DNA, 19 bp, Homo sapiens
caggacagacttcaaagcc

SEQ ID NO: 7978811 - DNA, 22 bp, Homo sapiens
caggacagaccaagatcgtgct

SEQ ID NO: 7978812 - DNA, 22 bp, Homo sapiens
caggacagaccaagatcgtgct

SEQ ID NO: 7978813 - DNA, 22 bp, Homo sapiens
caggacagaccaagatcgtgct

SEQ ID NO: 7978814 - DNA, 22 bp, Homo sapiens
caggacacttgttcttctctgc

SEQ ID NO: 7978815 - DNA, 22 bp, Homo sapiens
caggacagaaataaggaatata

SEQ ID NO: 7978816 - DNA, 22 bp, Homo sapiens
caggacagaaataaggaatata

SEQ ID NO: 7978817 - DNA, 22 bp, Homo sapiens
caggacagaaataaggaatata

SEQ ID NO: 7978818 - DNA, 22 bp, Homo sapiens
caggacagaaataaggaatata

SEQ ID NO: 7978819 - DNA, 22 bp, Homo sapiens
caggacagaaataaggaatata

SEQ ID NO: 7978820 - DNA, 22 bp, Homo sapiens
caggacagaaataaggaatata

SEQ ID NO: 7978821 - DNA, 22 bp, Homo sapiens
caggacagaaataaggaatata

SEQ ID NO: 7978822 - DNA, 22 bp, Homo sapiens
caggacagaaataaggaatata

SEQ ID NO: 7978823 - DNA, 22 bp, Homo sapiens
caggacagacagaatgcctaac

SEQ ID NO: 7978824 - DNA, 22 bp, Homo sapiens
caggacagacagaatgcctaac

SEQ ID NO: 7978825 - DNA, 22 bp, Homo sapiens
caggacagacagaatgcctaac

SEQ ID NO: 7978826 - DNA, 22 bp, Homo sapiens
caggacagacagaatgcctaac

SEQ ID NO: 7978827 - DNA, 22 bp, Homo sapiens
caggacagacagaatgcctaac

SEQ ID NO: 7978828 - DNA, 22 bp, Homo sapiens
caggacagacagaatgcctaac

SEQ ID NO: 7978829 - DNA, 22 bp, Homo sapiens
caggacagacagaatgcctaac

SEQ ID NO: 7978830 - DNA, 22 bp, Homo sapiens
agctgctctgggaaacagaagt

SEQ ID NO: 7978831 - DNA, 22 bp, Homo sapiens
agctgctctcagcagttccagg

SEQ ID NO: 7978832 - DNA, 22 bp, Homo sapiens
agctgctctcagcagttccagg

SEQ ID NO: 7978833 - DNA, 22 bp, Homo sapiens
agctgctctcagcagttccagg

SEQ ID NO: 7978834 - DNA, 20 bp, Homo sapiens
agctgctctcatccagacct

SEQ ID NO: 7978835 - DNA, 22 bp, Homo sapiens
agctgctcctttcctgcaggcg

SEQ ID NO: 7978836 - DNA, 22 bp, Homo sapiens
agctgctcgaagccggtggccc

SEQ ID NO: 7978837 - DNA, 22 bp, Homo sapiens
agctgctctcactggacgcctg

SEQ ID NO: 7978838 - DNA, 22 bp, Homo sapiens
agctgctctacatgatggggaa

SEQ ID NO: 7978839 - DNA, 22 bp, Homo sapiens
agctgctcgaagccggtggccc

SEQ ID NO: 7978840 - DNA, 22 bp, Homo sapiens
agctgctcgaagccggtggccc

SEQ ID NO: 7978841 - DNA, 22 bp, Homo sapiens
agctgctctacatgatggggaa

SEQ ID NO: 7978842 - DNA, 22 bp, Homo sapiens
agctgctgagccaggctgatgt

SEQ ID NO: 7978843 - DNA, 22 bp, Homo sapiens
agctgctgagccaggctgatgt

SEQ ID NO: 7978844 - DNA, 22 bp, Homo sapiens
agctgctgagccaggctgatgt

SEQ ID NO: 7978845 - DNA, 22 bp, Homo sapiens
agctgctgagccaggctgatgt

SEQ ID NO: 7978846 - DNA, 22 bp, Homo sapiens
agctgctgagagtctgccgggc

SEQ ID NO: 7978847 - DNA, 22 bp, Homo sapiens
agctgctgagagtctgccgggc

SEQ ID NO: 7978848 - DNA, 22 bp, Homo sapiens
agctgctgagagtctgccgggc

SEQ ID NO: 7978849 - DNA, 22 bp, Homo sapiens
agctgctgagagtctgccgggc

SEQ ID NO: 7978850 - DNA, 22 bp, Homo sapiens
agctgctgagagtctgccgggc

SEQ ID NO: 7978851 - DNA, 22 bp, Homo sapiens
agctgctgaatgacactgcaag

SEQ ID NO: 7978852 - DNA, 22 bp, Homo sapiens
agctgctgaatgacactgcaag

SEQ ID NO: 7978853 - DNA, 22 bp, Homo sapiens
agctgctgaatgacactgcaag

SEQ ID NO: 7978854 - DNA, 22 bp, Homo sapiens
agctgctgaatgacactgcaag

SEQ ID NO: 7978855 - DNA, 22 bp, Homo sapiens
agctgctgaatgacactgcaag

SEQ ID NO: 7978856 - DNA, 22 bp, Homo sapiens
agctgctgaagtgagagaattg

SEQ ID NO: 7978857 - DNA, 22 bp, Homo sapiens
agctgctgaatgacactgcaag

SEQ ID NO: 7978858 - DNA, 22 bp, Homo sapiens
agctgctctttgaaggacactt

SEQ ID NO: 7978859 - DNA, 22 bp, Homo sapiens
agctgctctttgaaggacactt

SEQ ID NO: 7978860 - DNA, 22 bp, Homo sapiens
agctgctctttgaaggacactt

SEQ ID NO: 7978861 - DNA, 22 bp, Homo sapiens
agctgctgaagtgagagaattg

SEQ ID NO: 7978862 - DNA, 22 bp, Homo sapiens
agctgctgaagtgagagaattg

SEQ ID NO: 7978863 - DNA, 22 bp, Homo sapiens
agctgctgaagtgagagaattg

SEQ ID NO: 7978864 - DNA, 22 bp, Homo sapiens
agctgctccttggctgtggttc

SEQ ID NO: 7978865 - DNA, 22 bp, Homo sapiens
agctgctccttggctgtggttc

SEQ ID NO: 7978866 - DNA, 22 bp, Homo sapiens
agctgctccttggctgtggttc

SEQ ID NO: 7978867 - DNA, 22 bp, Homo sapiens
agctgctcctttcctgcaggcg

SEQ ID NO: 7978868 - DNA, 22 bp, Homo sapiens
agctgctcctttcctgcaggcg

SEQ ID NO: 7978869 - DNA, 22 bp, Homo sapiens
agctgctcattcccagcacatg

SEQ ID NO: 7978870 - DNA, 22 bp, Homo sapiens
agctgctccaacccagcgggct

SEQ ID NO: 7978871 - DNA, 21 bp, Homo sapiens
agctgctccagggagctcagg

SEQ ID NO: 7978872 - DNA, 21 bp, Homo sapiens
agctgctccagggagctcagg

SEQ ID NO: 7978873 - DNA, 22 bp, Homo sapiens
agctgctcattcccagcacatg

SEQ ID NO: 7978874 - DNA, 22 bp, Homo sapiens
agctgctcattcccagcacatg

SEQ ID NO: 7978875 - DNA, 22 bp, Homo sapiens
agctgctccaacccagcgggct

SEQ ID NO: 7978876 - DNA, 22 bp, Homo sapiens
agctgcctggccggagccactg

SEQ ID NO: 7978877 - DNA, 22 bp, Homo sapiens
agctgcctggccggagccactg

SEQ ID NO: 7978878 - DNA, 22 bp, Homo sapiens
agctgcctggccggagccactg

SEQ ID NO: 7978879 - DNA, 22 bp, Homo sapiens
agctgcctggccggagccactg

SEQ ID NO: 7978880 - DNA, 22 bp, Homo sapiens
caggaaaaggagactttagcac

SEQ ID NO: 7978881 - DNA, 21 bp, Homo sapiens
caggaaaagcggaagtctagc

SEQ ID NO: 7978882 - DNA, 22 bp, Homo sapiens
agctgcctggagtcatttcctg

SEQ ID NO: 7978883 - DNA, 22 bp, Homo sapiens
caggaaaaggagactttagcac

SEQ ID NO: 7978884 - DNA, 22 bp, Homo sapiens
caggaaaaggagactttagcac

SEQ ID NO: 7978885 - DNA, 22 bp, Homo sapiens
caggaaaaggagactttagcac

SEQ ID NO: 7978886 - DNA, 22 bp, Homo sapiens
caggaaaaatgccaggagtcag

SEQ ID NO: 7978887 - DNA, 22 bp, Homo sapiens
caggaaaaatgccaggagtcag

SEQ ID NO: 7978888 - DNA, 22 bp, Homo sapiens
caggaaaaatgccaggagtcag

SEQ ID NO: 7978889 - DNA, 22 bp, Homo sapiens
caggaaaaatgccaggagtcag

SEQ ID NO: 7978890 - DNA, 21 bp, Homo sapiens
caggaaaagcggaagtctagc

SEQ ID NO: 7978891 - DNA, 21 bp, Homo sapiens
caggaaaagcggaagtctagc

SEQ ID NO: 7978892 - DNA, 21 bp, Homo sapiens
caggaaaagcggaagtctagc

SEQ ID NO: 7978893 - DNA, 22 bp, Homo sapiens
caggaaaaatgccaggagtcag

SEQ ID NO: 7978894 - DNA, 22 bp, Homo sapiens
agccacagcctgacttaactgt

SEQ ID NO: 7978895 - DNA, 22 bp, Homo sapiens
agccacagcctgacttaactgt

SEQ ID NO: 7978896 - DNA, 22 bp, Homo sapiens
agccacagcccacaggactctt

SEQ ID NO: 7978897 - DNA, 22 bp, Homo sapiens
agccacagcccacaggactctt

SEQ ID NO: 7978898 - DNA, 23 bp, Homo sapiens
agccacagccagagctatctcca

SEQ ID NO: 7978899 - DNA, 23 bp, Homo sapiens
agccacagccagagctatctcca

SEQ ID NO: 7978900 - DNA, 23 bp, Homo sapiens
agccacagccagagctatctcca

SEQ ID NO: 7978901 - DNA, 23 bp, Homo sapiens
agccacagccagagctatctcca

SEQ ID NO: 7978902 - DNA, 22 bp, Homo sapiens
agccacagcatgtgtgtatgta

SEQ ID NO: 7978903 - DNA, 22 bp, Homo sapiens
agccacagcatgtgtgtatgta

SEQ ID NO: 7978904 - DNA, 23 bp, Homo sapiens
agccacagccagagctatctcca

SEQ ID NO: 7978905 - DNA, 22 bp, Homo sapiens
agccacagcccacaggactctt

SEQ ID NO: 7978906 - DNA, 23 bp, Homo sapiens
agccacagccagagctatctcca

SEQ ID NO: 7978907 - DNA, 23 bp, Homo sapiens
agccacagccagagctatctcca

SEQ ID NO: 7978908 - DNA, 22 bp, Homo sapiens
agccacagcaacaagtgcaatt

SEQ ID NO: 7978909 - DNA, 22 bp, Homo sapiens
agccacagcacattgtaagaaa

SEQ ID NO: 7978910 - DNA, 22 bp, Homo sapiens
agccacagcacattgtaagaaa

SEQ ID NO: 7978911 - DNA, 22 bp, Homo sapiens
agccacagcaacaagtgcaatt

SEQ ID NO: 7978912 - DNA, 22 bp, Homo sapiens
agccacagaggttgatgtggtt

SEQ ID NO: 7978913 - DNA, 22 bp, Homo sapiens
agccacagcaacaagtgcaatt

SEQ ID NO: 7978914 - DNA, 22 bp, Homo sapiens
agccacagcacattgtaagaaa

SEQ ID NO: 7978915 - DNA, 22 bp, Homo sapiens
agccacagcatgtgtgtatgta

SEQ ID NO: 7978916 - DNA, 22 bp, Homo sapiens
agccacagcatgtgtgtatgta

SEQ ID NO: 7978917 - DNA, 22 bp, Homo sapiens
agccacagcacattgtaagaaa

SEQ ID NO: 7978918 - DNA, 22 bp, Homo sapiens
agccacagcacattgtaagaaa

SEQ ID NO: 7978919 - DNA, 22 bp, Homo sapiens
agccacagcacattgtaagaaa

SEQ ID NO: 7978920 - DNA, 22 bp, Homo sapiens
agccacagcgaacctctcttcc

SEQ ID NO: 7978921 - DNA, 22 bp, Homo sapiens
agccacagctccttggtggaga

SEQ ID NO: 7978922 - DNA, 22 bp, Homo sapiens
agccacagctccttggtggaga

SEQ ID NO: 7978923 - DNA, 22 bp, Homo sapiens
agccacagcgaacctctcttcc

SEQ ID NO: 7978924 - DNA, 22 bp, Homo sapiens
agccacagcgaacctctcttcc

SEQ ID NO: 7978925 - DNA, 23 bp, Homo sapiens
cagaaatgacagtaagcaccctg

SEQ ID NO: 7978926 - DNA, 22 bp, Homo sapiens
cagaaatgacaaagtaagagga

SEQ ID NO: 7978927 - DNA, 22 bp, Homo sapiens
cagaaatgacaaagtaagagga

SEQ ID NO: 7978928 - DNA, 22 bp, Homo sapiens
cagaaatgacaaagtaagagga

SEQ ID NO: 7978929 - DNA, 23 bp, Homo sapiens
cagaaatctgaaatctagaaatg

SEQ ID NO: 7978930 - DNA, 22 bp, Homo sapiens
agccacagctccttggtggaga

SEQ ID NO: 7978931 - DNA, 22 bp, Homo sapiens
agccacaggaaacagagacagc

SEQ ID NO: 7978932 - DNA, 23 bp, Homo sapiens
cagaaatctgaaatctagaaatg

SEQ ID NO: 7978933 - DNA, 23 bp, Homo sapiens
cagaaatctgaaatctagaaatg

SEQ ID NO: 7978934 - DNA, 22 bp, Homo sapiens
cagaactggcctttcatcagtc

SEQ ID NO: 7978935 - DNA, 22 bp, Homo sapiens
cagaactgagtctcatggccat

SEQ ID NO: 7978936 - DNA, 22 bp, Homo sapiens
cagaactgggcagggagcagag

SEQ ID NO: 7978937 - DNA, 22 bp, Homo sapiens
cagaactgacctctgattctag

SEQ ID NO: 7978938 - DNA, 22 bp, Homo sapiens
cagaaccttggtggtagggaca

SEQ ID NO: 7978939 - DNA, 22 bp, Homo sapiens
cagaacctgagagcacaatcct

SEQ ID NO: 7978940 - DNA, 22 bp, Homo sapiens
cagaacctgaacgtgaggtgga

SEQ ID NO: 7978941 - DNA, 22 bp, Homo sapiens
cagaacctgtgaatgtgttatc

SEQ ID NO: 7978942 - DNA, 22 bp, Homo sapiens
cagaacctgaacgtgaggtgga

SEQ ID NO: 7978943 - DNA, 22 bp, Homo sapiens
cagaacattgttttctcatctg

SEQ ID NO: 7978944 - DNA, 22 bp, Homo sapiens
cagaaccaggaactgatggaga

SEQ ID NO: 7978945 - DNA, 22 bp, Homo sapiens
cagaacattgttttctcatctg

SEQ ID NO: 7978946 - DNA, 22 bp, Homo sapiens
cactgaaacaggtattgctggt

SEQ ID NO: 7978947 - DNA, 22 bp, Homo sapiens
cactgaaaattagctttcctga

SEQ ID NO: 7978948 - DNA, 22 bp, Homo sapiens
cactgaaacaggtattgctggt

SEQ ID NO: 7978949 - DNA, 22 bp, Homo sapiens
cactctgtgattgcagcattcc

SEQ ID NO: 7978950 - DNA, 22 bp, Homo sapiens
cactctggttctgaacaggatc

SEQ ID NO: 7978951 - DNA, 22 bp, Homo sapiens
agccaaggacacggagcctcct

SEQ ID NO: 7978952 - DNA, 22 bp, Homo sapiens
agccaaggaaagccctttgctg

SEQ ID NO: 7978953 - DNA, 22 bp, Homo sapiens
agccacaaaggcttgcctcgga

SEQ ID NO: 7978954 - DNA, 22 bp, Homo sapiens
agccaaggaaagccctttgctg

SEQ ID NO: 7978955 - DNA, 21 bp, Homo sapiens
agccaagccttgggagccagg

SEQ ID NO: 7978956 - DNA, 21 bp, Homo sapiens
agccaagccttgggagccagg

SEQ ID NO: 7978957 - DNA, 21 bp, Homo sapiens
agccaagccttgggagccagg

SEQ ID NO: 7978958 - DNA, 22 bp, Homo sapiens
agccacacctgtcctgccagct

SEQ ID NO: 7978959 - DNA, 22 bp, Homo sapiens
agccaattgtccatctttagct

SEQ ID NO: 7978960 - DNA, 22 bp, Homo sapiens
agccaattgtccatctttagct

SEQ ID NO: 7978961 - DNA, 22 bp, Homo sapiens
agccacacctgtcctgccagct

SEQ ID NO: 7978962 - DNA, 19 bp, Homo sapiens
agccacagaacttgcagga

SEQ ID NO: 7978963 - DNA, 19 bp, Homo sapiens
agccacagaacttgcagga

SEQ ID NO: 7978964 - DNA, 19 bp, Homo sapiens
agccacagaacttgcagga

SEQ ID NO: 7978965 - DNA, 19 bp, Homo sapiens
agccacagaacttgcagga

SEQ ID NO: 7978966 - DNA, 19 bp, Homo sapiens
agccacagaacttgcagga

SEQ ID NO: 7978967 - DNA, 19 bp, Homo sapiens
agccacagaacttgcagga

SEQ ID NO: 7978968 - DNA, 19 bp, Homo sapiens
agccacagaacttgcagga

SEQ ID NO: 7978969 - DNA, 19 bp, Homo sapiens
agccacagaacttgcagga

SEQ ID NO: 7978970 - DNA, 22 bp, Homo sapiens
agccacagagagggagctgcaa

SEQ ID NO: 7978971 - DNA, 22 bp, Homo sapiens
agccacagagagggagctgcaa

SEQ ID NO: 7978972 - DNA, 22 bp, Homo sapiens
agccacagagagggagctgcaa

SEQ ID NO: 7978973 - DNA, 22 bp, Homo sapiens
agccacagagagggagctgcaa

SEQ ID NO: 7978974 - DNA, 22 bp, Homo sapiens
agccacagagagggagctgcaa

SEQ ID NO: 7978975 - DNA, 22 bp, Homo sapiens
agccacagagagggagctgcaa

SEQ ID NO: 7978976 - DNA, 22 bp, Homo sapiens
agccacagagagggagctgcaa

SEQ ID NO: 7978977 - DNA, 22 bp, Homo sapiens
agccacagagcaggagaccttt

SEQ ID NO: 7978978 - DNA, 22 bp, Homo sapiens
agccacagagcaggagaccttt

SEQ ID NO: 7978979 - DNA, 22 bp, Homo sapiens
agccacagagcaggagaccttt

SEQ ID NO: 7978980 - DNA, 22 bp, Homo sapiens
agccacagagcaggagaccttt

SEQ ID NO: 7978981 - DNA, 22 bp, Homo sapiens
agccacagaggttgatgtggtt

SEQ ID NO: 7978982 - DNA, 22 bp, Homo sapiens
agccacagaggttgatgtggtt

SEQ ID NO: 7978983 - DNA, 22 bp, Homo sapiens
agccacagaggttgatgtggtt

SEQ ID NO: 7978984 - DNA, 22 bp, Homo sapiens
agccacagaggttgatgtggtt

SEQ ID NO: 7978985 - DNA, 22 bp, Homo sapiens
agccacagaggttgatgtggtt

SEQ ID NO: 7978986 - DNA, 22 bp, Homo sapiens
agccacagaggttgatgtggtt

SEQ ID NO: 7978987 - DNA, 22 bp, Homo sapiens
agccacagagagggagctgcaa

SEQ ID NO: 7978988 - DNA, 22 bp, Homo sapiens
agccacagagagggagctgcaa

SEQ ID NO: 7978989 - DNA, 22 bp, Homo sapiens
agccacagagagggagctgcaa

SEQ ID NO: 7978990 - DNA, 22 bp, Homo sapiens
agccacagagcaggagaccttt

SEQ ID NO: 7978991 - DNA, 22 bp, Homo sapiens
agccacagagcaggagaccttt

SEQ ID NO: 7978992 - DNA, 22 bp, Homo sapiens
agccacagagcaggagaccttt

SEQ ID NO: 7978993 - DNA, 17 bp, Homo sapiens
cagaaggaagcatggca

SEQ ID NO: 7978994 - DNA, 17 bp, Homo sapiens
cagaaggaagcatggca

SEQ ID NO: 7978995 - DNA, 22 bp, Homo sapiens
cagaagctttgtctagtcttga

SEQ ID NO: 7978996 - DNA, 22 bp, Homo sapiens
cagaagctttgctcataaccat

SEQ ID NO: 7978997 - DNA, 22 bp, Homo sapiens
agccagctccctcccctgcagg

SEQ ID NO: 7978998 - DNA, 22 bp, Homo sapiens
agccagctccctcccctgcagg

SEQ ID NO: 7978999 - DNA, 17 bp, Homo sapiens
cagaaggaagcatggca

SEQ ID NO: 7979000 - DNA, 21 bp, Homo sapiens
agccagctatcacacagcatt

SEQ ID NO: 7979001 - DNA, 22 bp, Homo sapiens
agccagctctgagttgaagtac

SEQ ID NO: 7979002 - DNA, 22 bp, Homo sapiens
agccagctgcctttcacatctg

SEQ ID NO: 7979003 - DNA, 22 bp, Homo sapiens
agccagctctgagttgaagtac

SEQ ID NO: 7979004 - DNA, 22 bp, Homo sapiens
agccaggatggtctcgatcggc

SEQ ID NO: 7979005 - DNA, 22 bp, Homo sapiens
agccaggatggtctcgatcggc

SEQ ID NO: 7979006 - DNA, 22 bp, Homo sapiens
agccaggatggtctcgatcggc

SEQ ID NO: 7979007 - DNA, 22 bp, Homo sapiens
agccaggatggtctcgatcggc

SEQ ID NO: 7979008 - DNA, 22 bp, Homo sapiens
agccaggatggtctcgatcggc

SEQ ID NO: 7979009 - DNA, 22 bp, Homo sapiens
agccaggatggtctcgatcggc

SEQ ID NO: 7979010 - DNA, 22 bp, Homo sapiens
agccaggatggtctcgatcggc

SEQ ID NO: 7979011 - DNA, 22 bp, Homo sapiens
agccaggatggtctcgatcggc

SEQ ID NO: 7979012 - DNA, 22 bp, Homo sapiens
agccaggatcacccggggctgt

SEQ ID NO: 7979013 - DNA, 22 bp, Homo sapiens
agccaggatcacccggggctgt

SEQ ID NO: 7979014 - DNA, 22 bp, Homo sapiens
agccaggacgttgctcagctcc

SEQ ID NO: 7979015 - DNA, 22 bp, Homo sapiens
agccaggacgttgctcagctcc

SEQ ID NO: 7979016 - DNA, 22 bp, Homo sapiens
agccaggacgttgctcagctcc

SEQ ID NO: 7979017 - DNA, 22 bp, Homo sapiens
agccaggacgttgctcagctcc

SEQ ID NO: 7979018 - DNA, 22 bp, Homo sapiens
agccaggacatctctagctgct

SEQ ID NO: 7979019 - DNA, 22 bp, Homo sapiens
agccaggacatctctagctgct

SEQ ID NO: 7979020 - DNA, 22 bp, Homo sapiens
cagacagacagccgtggccacc

SEQ ID NO: 7979021 - DNA, 22 bp, Homo sapiens
cagacagacagccgtggccacc

SEQ ID NO: 7979022 - DNA, 22 bp, Homo sapiens
cagacagacagccgtggccacc

SEQ ID NO: 7979023 - DNA, 22 bp, Homo sapiens
cagacagacagccgtggccacc

SEQ ID NO: 7979024 - DNA, 22 bp, Homo sapiens
cagacagacagccgtggccacc

SEQ ID NO: 7979025 - DNA, 22 bp, Homo sapiens
agccaggcagggctctcgctct

SEQ ID NO: 7979026 - DNA, 22 bp, Homo sapiens
agccaggcagggctctcgctct

SEQ ID NO: 7979027 - DNA, 22 bp, Homo sapiens
cagacagaaggctccttgaggt

SEQ ID NO: 7979028 - DNA, 22 bp, Homo sapiens
cagacagaaggctccttgaggt

SEQ ID NO: 7979029 - DNA, 22 bp, Homo sapiens
agccaggcagggctctcgctct

SEQ ID NO: 7979030 - DNA, 22 bp, Homo sapiens
agccaggcagactctctttctt

SEQ ID NO: 7979031 - DNA, 22 bp, Homo sapiens
agccaggcagactctctttctt

SEQ ID NO: 7979032 - DNA, 22 bp, Homo sapiens
agccaggcagactctctttctt

SEQ ID NO: 7979033 - DNA, 22 bp, Homo sapiens
agccaggcagactctctttctt

SEQ ID NO: 7979034 - DNA, 21 bp, Homo sapiens
agccaggcaagcacccccact

SEQ ID NO: 7979035 - DNA, 21 bp, Homo sapiens
agccaggcaagcacccccact

SEQ ID NO: 7979036 - DNA, 21 bp, Homo sapiens
agccaggcaagcacccccact

SEQ ID NO: 7979037 - DNA, 21 bp, Homo sapiens
agccaggcaagcacccccact

SEQ ID NO: 7979038 - DNA, 22 bp, Homo sapiens
agccaggattggctgagcctta

SEQ ID NO: 7979039 - DNA, 21 bp, Homo sapiens
agccaggcaagcacccccact

SEQ ID NO: 7979040 - DNA, 22 bp, Homo sapiens
agccaggattggctgagcctta

SEQ ID NO: 7979041 - DNA, 22 bp, Homo sapiens
agccaggattggctgagcctta

SEQ ID NO: 7979042 - DNA, 22 bp, Homo sapiens
agccaggatggtctcgatcggc

SEQ ID NO: 7979043 - DNA, 22 bp, Homo sapiens
agccaggatggtctcgatcggc

SEQ ID NO: 7979044 - DNA, 23 bp, Homo sapiens
cagaagacagtctcaagacaagg

SEQ ID NO: 7979045 - DNA, 22 bp, Homo sapiens
cagaagactgcagggaagggac

SEQ ID NO: 7979046 - DNA, 22 bp, Homo sapiens
cagaagacgcctgggtgctgta

SEQ ID NO: 7979047 - DNA, 22 bp, Homo sapiens
cagaagactgcagggaagggac

SEQ ID NO: 7979048 - DNA, 22 bp, Homo sapiens
cagaagagatgaaatagtatta

SEQ ID NO: 7979049 - DNA, 22 bp, Homo sapiens
cagaagagatgaaatagtatta

SEQ ID NO: 7979050 - DNA, 22 bp, Homo sapiens
cagaagagatgaaatagtatta

SEQ ID NO: 7979051 - DNA, 22 bp, Homo sapiens
cagaagagatgaaatagtatta

SEQ ID NO: 7979052 - DNA, 22 bp, Homo sapiens
cagaagaatggtgtctgagctc

SEQ ID NO: 7979053 - DNA, 22 bp, Homo sapiens
cagaagaatggtgtctgagctc

SEQ ID NO: 7979054 - DNA, 22 bp, Homo sapiens
cagaagaaatcattatctggac

SEQ ID NO: 7979055 - DNA, 22 bp, Homo sapiens
cagaagaatggtgtctgagctc

SEQ ID NO: 7979056 - DNA, 23 bp, Homo sapiens
cagaagacagtctcaagacaagg

SEQ ID NO: 7979057 - DNA, 22 bp, Homo sapiens
cagaagaaagtggggagacaag

SEQ ID NO: 7979058 - DNA, 22 bp, Homo sapiens
cagaagaaagtggggagacaag

SEQ ID NO: 7979059 - DNA, 22 bp, Homo sapiens
cagaagaaagtggggagacaag

SEQ ID NO: 7979060 - DNA, 22 bp, Homo sapiens
cagaagaaatcattatctggac

SEQ ID NO: 7979061 - DNA, 22 bp, Homo sapiens
cagaagaaatcattatctggac

SEQ ID NO: 7979062 - DNA, 22 bp, Homo sapiens
cagaagaaagtggggagacaag

SEQ ID NO: 7979063 - DNA, 22 bp, Homo sapiens
cagaagaaagtggggagacaag

SEQ ID NO: 7979064 - DNA, 22 bp, Homo sapiens
cagaagaaagtggggagacaag

SEQ ID NO: 7979065 - DNA, 22 bp, Homo sapiens
cagaactgttataacagctgtt

SEQ ID NO: 7979066 - DNA, 22 bp, Homo sapiens
cagaacttcatattgacgttag

SEQ ID NO: 7979067 - DNA, 22 bp, Homo sapiens
cagaactgggctcgctctggtt

SEQ ID NO: 7979068 - DNA, 22 bp, Homo sapiens
cagaacttgatcagagctgaag

SEQ ID NO: 7979069 - DNA, 22 bp, Homo sapiens
cagaacttgctggacagcagat

SEQ ID NO: 7979070 - DNA, 22 bp, Homo sapiens
cagaagaaagtggggagacaag

SEQ ID NO: 7979071 - DNA, 22 bp, Homo sapiens
cagaacttggcaaagccgactg

SEQ ID NO: 7979072 - DNA, 22 bp, Homo sapiens
cagaagcattgactccttgctc

SEQ ID NO: 7979073 - DNA, 22 bp, Homo sapiens
cagaagcctaaatagtgcacca

SEQ ID NO: 7979074 - DNA, 22 bp, Homo sapiens
cagaagcctaaatagtgcacca

SEQ ID NO: 7979075 - DNA, 22 bp, Homo sapiens
cagaagcctaaatagtgcacca

SEQ ID NO: 7979076 - DNA, 22 bp, Homo sapiens
cagaagcattgactccttgctc

SEQ ID NO: 7979077 - DNA, 22 bp, Homo sapiens
cagaagcattgactccttgctc

SEQ ID NO: 7979078 - DNA, 22 bp, Homo sapiens
cagaagcattccagcaaatagt

SEQ ID NO: 7979079 - DNA, 22 bp, Homo sapiens
cagaagcattccagcaaatagt

SEQ ID NO: 7979080 - DNA, 22 bp, Homo sapiens
cagaagcattccagcaaatagt

SEQ ID NO: 7979081 - DNA, 22 bp, Homo sapiens
cagaagcattccagcaaatagt

SEQ ID NO: 7979082 - DNA, 22 bp, Homo sapiens
cagaagcattccagcaaatagt

SEQ ID NO: 7979083 - DNA, 22 bp, Homo sapiens
cagaagctgcagtgatctggga

SEQ ID NO: 7979084 - DNA, 22 bp, Homo sapiens
cagaagctgcagtgatctggga

SEQ ID NO: 7979085 - DNA, 22 bp, Homo sapiens
cagaagctgcagtgatctggga

SEQ ID NO: 7979086 - DNA, 22 bp, Homo sapiens
cagaagctgcagtgatctggga

SEQ ID NO: 7979087 - DNA, 22 bp, Homo sapiens
cagaagctggtacaaggcctag

SEQ ID NO: 7979088 - DNA, 22 bp, Homo sapiens
cagaagctgaggagtgaggcaa

SEQ ID NO: 7979089 - DNA, 22 bp, Homo sapiens
cagaagctgaggagtgaggcaa

SEQ ID NO: 7979090 - DNA, 19 bp, Homo sapiens
cagaagctgcagtcggata

SEQ ID NO: 7979091 - DNA, 19 bp, Homo sapiens
cagaagctgcagtcggata

SEQ ID NO: 7979092 - DNA, 19 bp, Homo sapiens
cagaagctgcagtcggata

SEQ ID NO: 7979093 - DNA, 22 bp, Homo sapiens
cagaagcctgcctcagatgcac

SEQ ID NO: 7979094 - DNA, 22 bp, Homo sapiens
cagaagcctgcctcagatgcac

SEQ ID NO: 7979095 - DNA, 22 bp, Homo sapiens
cagaagcctaaatagtgcacca

SEQ ID NO: 7979096 - DNA, 22 bp, Homo sapiens
cagaagctagcaggaaagtttt

SEQ ID NO: 7979097 - DNA, 22 bp, Homo sapiens
cagaagcctgcctcagatgcac

SEQ ID NO: 7979098 - DNA, 22 bp, Homo sapiens
agcccaggagtttgaggctgtg

SEQ ID NO: 7979099 - DNA, 22 bp, Homo sapiens
agcccaggagtttgaggctgtg

SEQ ID NO: 7979100 - DNA, 22 bp, Homo sapiens
agcccaggagtttgaggctgtg

SEQ ID NO: 7979101 - DNA, 22 bp, Homo sapiens
agcccaggagtttgaggctgtg

SEQ ID NO: 7979102 - DNA, 22 bp, Homo sapiens
agcccaggagtttgaggctgtg

SEQ ID NO: 7979103 - DNA, 22 bp, Homo sapiens
agcccaggagtttgaggctgtg

SEQ ID NO: 7979104 - DNA, 22 bp, Homo sapiens
agcccaggagtttgaggctgtg

SEQ ID NO: 7979105 - DNA, 22 bp, Homo sapiens
agcccaggagtttgaggctgtg

SEQ ID NO: 7979106 - DNA, 22 bp, Homo sapiens
agcccaggagtttgaggctgtg

SEQ ID NO: 7979107 - DNA, 22 bp, Homo sapiens
agcccaggagtccttaaggacc

SEQ ID NO: 7979108 - DNA, 22 bp, Homo sapiens
agcccaggagtccttaaggacc

SEQ ID NO: 7979109 - DNA, 22 bp, Homo sapiens
agcccaggagtttgaggctgtg

SEQ ID NO: 7979110 - DNA, 22 bp, Homo sapiens
cagagctggagcttgaatggag

SEQ ID NO: 7979111 - DNA, 22 bp, Homo sapiens
cagagctggagaagtggattta

SEQ ID NO: 7979112 - DNA, 22 bp, Homo sapiens
cagagctggagcttgaatggag

SEQ ID NO: 7979113 - DNA, 22 bp, Homo sapiens
cagagctggagaagtggattta

SEQ ID NO: 7979114 - DNA, 22 bp, Homo sapiens
cagagctggagcttgaatggag

SEQ ID NO: 7979115 - DNA, 22 bp, Homo sapiens
cagagctggagcttgaatggag

SEQ ID NO: 7979116 - DNA, 22 bp, Homo sapiens
cagagctggagggaaccctggc

SEQ ID NO: 7979117 - DNA, 22 bp, Homo sapiens
cagagctggagaagtggattta

SEQ ID NO: 7979118 - DNA, 22 bp, Homo sapiens
cagagctggacttaaatatatt

SEQ ID NO: 7979119 - DNA, 22 bp, Homo sapiens
cagagctgcttcccagtttgtg

SEQ ID NO: 7979120 - DNA, 22 bp, Homo sapiens
cagagctgcttcccagtttgtg

SEQ ID NO: 7979121 - DNA, 22 bp, Homo sapiens
cagagctgcttcccagtttgtg

SEQ ID NO: 7979122 - DNA, 22 bp, Homo sapiens
cagagctgcttcccagtttgtg

SEQ ID NO: 7979123 - DNA, 22 bp, Homo sapiens
agcccaggaggtggaggttgca

SEQ ID NO: 7979124 - DNA, 22 bp, Homo sapiens
agcccaggaggtggaggttgca

SEQ ID NO: 7979125 - DNA, 22 bp, Homo sapiens
agcccaggagtccttaaggacc

SEQ ID NO: 7979126 - DNA, 22 bp, Homo sapiens
agcccaggaggtggaggttgca

SEQ ID NO: 7979127 - DNA, 22 bp, Homo sapiens
agcccaggaggtggaggttgca

SEQ ID NO: 7979128 - DNA, 22 bp, Homo sapiens
agcccaggaggtggaggttgca

SEQ ID NO: 7979129 - DNA, 22 bp, Homo sapiens
agcccaggagcctttggagggt

SEQ ID NO: 7979130 - DNA, 22 bp, Homo sapiens
agcccaggaggtggaggttgca

SEQ ID NO: 7979131 - DNA, 22 bp, Homo sapiens
agcccaggagcctttggagggt

SEQ ID NO: 7979132 - DNA, 22 bp, Homo sapiens
agcccaggagcctttggagggt

SEQ ID NO: 7979133 - DNA, 22 bp, Homo sapiens
agcccaggagcctttggagggt

SEQ ID NO: 7979134 - DNA, 22 bp, Homo sapiens
agcccaggaatctgcatcttga

SEQ ID NO: 7979135 - DNA, 22 bp, Homo sapiens
agcccaggaatctgcatcttga

SEQ ID NO: 7979136 - DNA, 22 bp, Homo sapiens
agcccaggagcctttggagggt

SEQ ID NO: 7979137 - DNA, 22 bp, Homo sapiens
agcccaggagcctttggagggt

SEQ ID NO: 7979138 - DNA, 22 bp, Homo sapiens
agcccaggagcctttggagggt

SEQ ID NO: 7979139 - DNA, 22 bp, Homo sapiens
agcccaggaatctgcatcttga

SEQ ID NO: 7979140 - DNA, 22 bp, Homo sapiens
agcccaggaatctgcatcttga

SEQ ID NO: 7979141 - DNA, 22 bp, Homo sapiens
agcccaggaatctgcatcttga

SEQ ID NO: 7979142 - DNA, 22 bp, Homo sapiens
agcccaggaagttgaggcttgc

SEQ ID NO: 7979143 - DNA, 22 bp, Homo sapiens
agcccaggaagttgaggcttgc

SEQ ID NO: 7979144 - DNA, 22 bp, Homo sapiens
agcccaggaagttgaggcttgc

SEQ ID NO: 7979145 - DNA, 22 bp, Homo sapiens
agcccaggaagttgaggcttgc

SEQ ID NO: 7979146 - DNA, 22 bp, Homo sapiens
agcccagcctgattctacaccc

SEQ ID NO: 7979147 - DNA, 22 bp, Homo sapiens
agcccagcctgattctacaccc

SEQ ID NO: 7979148 - DNA, 22 bp, Homo sapiens
agcccagcctgattctacaccc

SEQ ID NO: 7979149 - DNA, 22 bp, Homo sapiens
agcccagctttgaaccatatca

SEQ ID NO: 7979150 - DNA, 22 bp, Homo sapiens
agcccaggaagttgaggcttgc

SEQ ID NO: 7979151 - DNA, 22 bp, Homo sapiens
agcccaggaagttgaggcttgc

SEQ ID NO: 7979152 - DNA, 22 bp, Homo sapiens
agcccggcttccccggttgcta

SEQ ID NO: 7979153 - DNA, 22 bp, Homo sapiens
agcccggcttccccggttgcta

SEQ ID NO: 7979154 - DNA, 22 bp, Homo sapiens
agcccggcttccccggttgcta

SEQ ID NO: 7979155 - DNA, 19 bp, Homo sapiens
agcccggagactcggaggc

SEQ ID NO: 7979156 - DNA, 22 bp, Homo sapiens
agcccggagccagtgcacctac

SEQ ID NO: 7979157 - DNA, 22 bp, Homo sapiens
agcccgagcgcacctgtggaaa

SEQ ID NO: 7979158 - DNA, 22 bp, Homo sapiens
agccccttgcacttccccacgc

SEQ ID NO: 7979159 - DNA, 22 bp, Homo sapiens
agccccttgctgccctctagag

SEQ ID NO: 7979160 - DNA, 22 bp, Homo sapiens
agccccttgcacttccccacgc

SEQ ID NO: 7979161 - DNA, 22 bp, Homo sapiens
agccccttgctgccctctagag

SEQ ID NO: 7979162 - DNA, 22 bp, Homo sapiens
agccccttgctgccctctagag

SEQ ID NO: 7979163 - DNA, 19 bp, Homo sapiens
agccccttggtactgtcct

SEQ ID NO: 7979164 - DNA, 19 bp, Homo sapiens
agccccttggtactgtcct

SEQ ID NO: 7979165 - DNA, 22 bp, Homo sapiens
agccccttggaacacagggctg

SEQ ID NO: 7979166 - DNA, 22 bp, Homo sapiens
agccctagagaaccagcctgtg

SEQ ID NO: 7979167 - DNA, 22 bp, Homo sapiens
agccctagagaaccagcctgtg

SEQ ID NO: 7979168 - DNA, 22 bp, Homo sapiens
agccctaaattatctttatttt

SEQ ID NO: 7979169 - DNA, 22 bp, Homo sapiens
agcccggcttccccggttgcta

SEQ ID NO: 7979170 - DNA, 22 bp, Homo sapiens
agcccggcttccccggttgcta

SEQ ID NO: 7979171 - DNA, 22 bp, Homo sapiens
agcccggcttccccggttgcta

SEQ ID NO: 7979172 - DNA, 22 bp, Homo sapiens
agcccggcttccccggttgcta

SEQ ID NO: 7979173 - DNA, 22 bp, Homo sapiens
agccctaaattatctttatttt

SEQ ID NO: 7979174 - DNA, 22 bp, Homo sapiens
agccctcaggctttgctgggcc

SEQ ID NO: 7979175 - DNA, 22 bp, Homo sapiens
agccctcatggaacagctccta

SEQ ID NO: 7979176 - DNA, 22 bp, Homo sapiens
agccctagagctggaggtcagt

SEQ ID NO: 7979177 - DNA, 22 bp, Homo sapiens
agccctcaggctttgctgggcc

SEQ ID NO: 7979178 - DNA, 19 bp, Homo sapiens
agcccccagacagcaggcc

SEQ ID NO: 7979179 - DNA, 23 bp, Homo sapiens
cagagctggctcagagctgcctg

SEQ ID NO: 7979180 - DNA, 23 bp, Homo sapiens
cagagctggctcagagctgcctg

SEQ ID NO: 7979181 - DNA, 23 bp, Homo sapiens
cagagctggctcagagctgcctg

SEQ ID NO: 7979182 - DNA, 23 bp, Homo sapiens
cagagctggctcagagctgcctg

SEQ ID NO: 7979183 - DNA, 23 bp, Homo sapiens
cagagctggctcagagctgcctg

SEQ ID NO: 7979184 - DNA, 19 bp, Homo sapiens
agcccccagacagcaggcc

SEQ ID NO: 7979185 - DNA, 22 bp, Homo sapiens
agcccctgtttttccagtcaga

SEQ ID NO: 7979186 - DNA, 22 bp, Homo sapiens
agcccctgtttttccagtcaga

SEQ ID NO: 7979187 - DNA, 22 bp, Homo sapiens
agccccttgcacttccccacgc

SEQ ID NO: 7979188 - DNA, 22 bp, Homo sapiens
cagagctggcggtgagaagaca

SEQ ID NO: 7979189 - DNA, 22 bp, Homo sapiens
cagagctggcctgtgatttttg

SEQ ID NO: 7979190 - DNA, 22 bp, Homo sapiens
cagagctggcggtgagaagaca

SEQ ID NO: 7979191 - DNA, 22 bp, Homo sapiens
cagagctggcggtgagaagaca

SEQ ID NO: 7979192 - DNA, 22 bp, Homo sapiens
cagagctggcggtgagaagaca

SEQ ID NO: 7979193 - DNA, 22 bp, Homo sapiens
cagagctggcggtgagaagaca

SEQ ID NO: 7979194 - DNA, 23 bp, Homo sapiens
cagagctggctcagagctgcctg

SEQ ID NO: 7979195 - DNA, 23 bp, Homo sapiens
cagagctggctcagagctgcctg

SEQ ID NO: 7979196 - DNA, 23 bp, Homo sapiens
cagagctggctcagagctgcctg

SEQ ID NO: 7979197 - DNA, 22 bp, Homo sapiens
cagagctggagggaaccctggc

SEQ ID NO: 7979198 - DNA, 22 bp, Homo sapiens
cagagctggcctgtgatttttg

SEQ ID NO: 7979199 - DNA, 22 bp, Homo sapiens
cagagctggagggaaccctggc

SEQ ID NO: 7979200 - DNA, 22 bp, Homo sapiens
cagagctggagggaaccctggc

SEQ ID NO: 7979201 - DNA, 22 bp, Homo sapiens
agccaggtgcagtggcacacac

SEQ ID NO: 7979202 - DNA, 22 bp, Homo sapiens
agccaggttaaaccacagtcaa

SEQ ID NO: 7979203 - DNA, 22 bp, Homo sapiens
agccaggttaaaccacagtcaa

SEQ ID NO: 7979204 - DNA, 22 bp, Homo sapiens
agccaggttgggccttttcttt

SEQ ID NO: 7979205 - DNA, 22 bp, Homo sapiens
agccaggtttctttagctgtca

SEQ ID NO: 7979206 - DNA, 22 bp, Homo sapiens
agccaggtttctttagctgtca

SEQ ID NO: 7979207 - DNA, 22 bp, Homo sapiens
agccaggtctaaggacatcagg

SEQ ID NO: 7979208 - DNA, 22 bp, Homo sapiens
agccaggtcaggaaaggtccca

SEQ ID NO: 7979209 - DNA, 22 bp, Homo sapiens
agccaggtcagctcaccctgct

SEQ ID NO: 7979210 - DNA, 22 bp, Homo sapiens
agccaggtcaggaaaggtccca

SEQ ID NO: 7979211 - DNA, 22 bp, Homo sapiens
agccaggtcagctcaccctgct

SEQ ID NO: 7979212 - DNA, 17 bp, Homo sapiens
agccaggtacaagtcca

SEQ ID NO: 7979213 - DNA, 22 bp, Homo sapiens
agccaggtactcttgtgaccat

SEQ ID NO: 7979214 - DNA, 20 bp, Homo sapiens
agccagggttctggatgcac

SEQ ID NO: 7979215 - DNA, 20 bp, Homo sapiens
agccagggttctggatgcac

SEQ ID NO: 7979216 - DNA, 20 bp, Homo sapiens
agccagggttctggatgcac

SEQ ID NO: 7979217 - DNA, 20 bp, Homo sapiens
agccagggttctggatgcac

SEQ ID NO: 7979218 - DNA, 20 bp, Homo sapiens
agccagggttctggatgcac

SEQ ID NO: 7979219 - DNA, 20 bp, Homo sapiens
agccagggttctggatgcac

SEQ ID NO: 7979220 - DNA, 20 bp, Homo sapiens
agccagggttctggatgcac

SEQ ID NO: 7979221 - DNA, 20 bp, Homo sapiens
agccagggttctggatgcac

SEQ ID NO: 7979222 - DNA, 22 bp, Homo sapiens
agccaggggattcatcagggac

SEQ ID NO: 7979223 - DNA, 23 bp, Homo sapiens
agccaggggatcttgggccctgg

SEQ ID NO: 7979224 - DNA, 23 bp, Homo sapiens
agccaggggatcttgggccctgg

SEQ ID NO: 7979225 - DNA, 23 bp, Homo sapiens
agccaggggatcttgggccctgg

SEQ ID NO: 7979226 - DNA, 22 bp, Homo sapiens
agccaggggattcatcagggac

SEQ ID NO: 7979227 - DNA, 22 bp, Homo sapiens
agccagggttagaagatagtca

SEQ ID NO: 7979228 - DNA, 22 bp, Homo sapiens
agccagggttagaagatagtca

SEQ ID NO: 7979229 - DNA, 22 bp, Homo sapiens
agccagggttagaagatagtca

SEQ ID NO: 7979230 - DNA, 22 bp, Homo sapiens
agccagggttagaagatagtca

SEQ ID NO: 7979231 - DNA, 22 bp, Homo sapiens
cagacagagtcttcccatcagt

SEQ ID NO: 7979232 - DNA, 22 bp, Homo sapiens
cagacagagtcttcccatcagt

SEQ ID NO: 7979233 - DNA, 22 bp, Homo sapiens
cagacagcaaatctgcttgcat

SEQ ID NO: 7979234 - DNA, 22 bp, Homo sapiens
cagacagcaaatctgcttgcat

SEQ ID NO: 7979235 - DNA, 22 bp, Homo sapiens
cagacagcaaatctgcttgcat

SEQ ID NO: 7979236 - DNA, 22 bp, Homo sapiens
cagacagcaaatctgcttgcat

SEQ ID NO: 7979237 - DNA, 22 bp, Homo sapiens
cagacagcaaatctgcttgcat

SEQ ID NO: 7979238 - DNA, 17 bp, Homo sapiens
cagacagatatcctggg

SEQ ID NO: 7979239 - DNA, 23 bp, Homo sapiens
agccaggggatcttgggccctgg

SEQ ID NO: 7979240 - DNA, 22 bp, Homo sapiens
cagacagctgctttcttgctgt

SEQ ID NO: 7979241 - DNA, 22 bp, Homo sapiens
cagacagctgctttcttgctgt

SEQ ID NO: 7979242 - DNA, 22 bp, Homo sapiens
cagacagctgctttcttgctgt

SEQ ID NO: 7979243 - DNA, 22 bp, Homo sapiens
cagacagcaaatctgcttgcat

SEQ ID NO: 7979244 - DNA, 22 bp, Homo sapiens
cagacagcaaatctgcttgcat

SEQ ID NO: 7979245 - DNA, 22 bp, Homo sapiens
cagacagcaggcctggatgtgt

SEQ ID NO: 7979246 - DNA, 22 bp, Homo sapiens
cagacagcgagcggaggggctt

SEQ ID NO: 7979247 - DNA, 22 bp, Homo sapiens
cagacagcgagcggaggggctt

SEQ ID NO: 7979248 - DNA, 22 bp, Homo sapiens
cagacagcgagcggaggggctt

SEQ ID NO: 7979249 - DNA, 22 bp, Homo sapiens
cagacagaggctgtatgagggc

SEQ ID NO: 7979250 - DNA, 22 bp, Homo sapiens
cagacagaggctgtatgagggc

SEQ ID NO: 7979251 - DNA, 22 bp, Homo sapiens
cagacagagctcacaagtcttt

SEQ ID NO: 7979252 - DNA, 22 bp, Homo sapiens
cagacagagctcacaagtcttt

SEQ ID NO: 7979253 - DNA, 22 bp, Homo sapiens
cagacagagctcacaagtcttt

SEQ ID NO: 7979254 - DNA, 22 bp, Homo sapiens
cagacagaggctgtatgagggc

SEQ ID NO: 7979255 - DNA, 22 bp, Homo sapiens
cagacagagtcttcccatcagt

SEQ ID NO: 7979256 - DNA, 22 bp, Homo sapiens
cagacagacctgcaagggcaca

SEQ ID NO: 7979257 - DNA, 22 bp, Homo sapiens
cagacagacctgcaagggcaca

SEQ ID NO: 7979258 - DNA, 22 bp, Homo sapiens
cagacagagctcacaagtcttt

SEQ ID NO: 7979259 - DNA, 16 bp, Homo sapiens
cagacagagaacaggg

SEQ ID NO: 7979260 - DNA, 22 bp, Homo sapiens
cagagcacacatgcatagagtg

SEQ ID NO: 7979261 - DNA, 22 bp, Homo sapiens
cagagcaacaccctttacatcg

SEQ ID NO: 7979262 - DNA, 22 bp, Homo sapiens
cagagcaccagtgggagacaag

SEQ ID NO: 7979263 - DNA, 22 bp, Homo sapiens
cagagcaccagtgggagacaag

SEQ ID NO: 7979264 - DNA, 22 bp, Homo sapiens
cagagcacagagcttgggacaa

SEQ ID NO: 7979265 - DNA, 22 bp, Homo sapiens
cagagatgggtcgcagagatgg

SEQ ID NO: 7979266 - DNA, 22 bp, Homo sapiens
cagagatgggtcgcagagatgg

SEQ ID NO: 7979267 - DNA, 22 bp, Homo sapiens
cagagatgtgatccagctgtct

SEQ ID NO: 7979268 - DNA, 22 bp, Homo sapiens
cagagatgtgatccagctgtct

SEQ ID NO: 7979269 - DNA, 22 bp, Homo sapiens
cagagattattataactaatta

SEQ ID NO: 7979270 - DNA, 22 bp, Homo sapiens
cagagatggcggctgttgtgtt

SEQ ID NO: 7979271 - DNA, 22 bp, Homo sapiens
cagagatggcggctgttgtgtt

SEQ ID NO: 7979272 - DNA, 22 bp, Homo sapiens
cagagatgaggtcgttactcag

SEQ ID NO: 7979273 - DNA, 22 bp, Homo sapiens
cagagatggggccagctgctcc

SEQ ID NO: 7979274 - DNA, 22 bp, Homo sapiens
cagagatggggccagctgctcc

SEQ ID NO: 7979275 - DNA, 22 bp, Homo sapiens
cagagatggggccagctgctcc

SEQ ID NO: 7979276 - DNA, 22 bp, Homo sapiens
cagagatggggccagctgctcc

SEQ ID NO: 7979277 - DNA, 22 bp, Homo sapiens
cagagagggcggccctggcttc

SEQ ID NO: 7979278 - DNA, 22 bp, Homo sapiens
cagagagggcggccctggcttc

SEQ ID NO: 7979279 - DNA, 22 bp, Homo sapiens
cagagagggcggccctggcttc

SEQ ID NO: 7979280 - DNA, 22 bp, Homo sapiens
cagagagggcggccctggcttc

SEQ ID NO: 7979281 - DNA, 22 bp, Homo sapiens
cagagagggcggccctggcttc

SEQ ID NO: 7979282 - DNA, 22 bp, Homo sapiens
cagagagggcggccctggcttc

SEQ ID NO: 7979283 - DNA, 22 bp, Homo sapiens
cagagagggcggccctggcttc

SEQ ID NO: 7979284 - DNA, 22 bp, Homo sapiens
cagagagggcggccctggcttc

SEQ ID NO: 7979285 - DNA, 22 bp, Homo sapiens
cagagagggagcagtagtctct

SEQ ID NO: 7979286 - DNA, 22 bp, Homo sapiens
cagagagggagcagtagtctct

SEQ ID NO: 7979287 - DNA, 22 bp, Homo sapiens
agccagtgcaacagcagtgaag

SEQ ID NO: 7979288 - DNA, 22 bp, Homo sapiens
agccagtgcaacagcagtgaag

SEQ ID NO: 7979289 - DNA, 22 bp, Homo sapiens
agccagtgattctgatgtactg

SEQ ID NO: 7979290 - DNA, 22 bp, Homo sapiens
agccagtgatgaagactctgga

SEQ ID NO: 7979291 - DNA, 22 bp, Homo sapiens
cagagagggagcagtagtctct

SEQ ID NO: 7979292 - DNA, 22 bp, Homo sapiens
cagagagggagcagtagtctct

SEQ ID NO: 7979293 - DNA, 22 bp, Homo sapiens
cagagagggagcagtagtctct

SEQ ID NO: 7979294 - DNA, 22 bp, Homo sapiens
cagagagggagcagtagtctct

SEQ ID NO: 7979295 - DNA, 19 bp, Homo sapiens
agccagtccaagttctgtc

SEQ ID NO: 7979296 - DNA, 22 bp, Homo sapiens
agccagtcggggccatgctggg

SEQ ID NO: 7979297 - DNA, 22 bp, Homo sapiens
agccagtagatcgggaggatgt

SEQ ID NO: 7979298 - DNA, 21 bp, Homo sapiens
agccagtctcagtactgtact

SEQ ID NO: 7979299 - DNA, 21 bp, Homo sapiens
agccagtctgttttctagtgc

SEQ ID NO: 7979300 - DNA, 22 bp, Homo sapiens
agccagtcttacgctcgttttt

SEQ ID NO: 7979301 - DNA, 19 bp, Homo sapiens
agccagtgagcctctgggt

SEQ ID NO: 7979302 - DNA, 19 bp, Homo sapiens
agccagtgagcctctgggt

SEQ ID NO: 7979303 - DNA, 22 bp, Homo sapiens
agccagtgacatacgattggga

SEQ ID NO: 7979304 - DNA, 19 bp, Homo sapiens
agccagtgagcctctgggt

SEQ ID NO: 7979305 - DNA, 22 bp, Homo sapiens
agccttggtcccgcgtcagcca

SEQ ID NO: 7979306 - DNA, 22 bp, Homo sapiens
agccttgggcaatttggacact

SEQ ID NO: 7979307 - DNA, 22 bp, Homo sapiens
agccttgggcaatttggacact

SEQ ID NO: 7979308 - DNA, 22 bp, Homo sapiens
agccttggccgtaaggtatgct

SEQ ID NO: 7979309 - DNA, 22 bp, Homo sapiens
agccttggccgtaaggtatgct

SEQ ID NO: 7979310 - DNA, 22 bp, Homo sapiens
agccttggccgtaaggtatgct

SEQ ID NO: 7979311 - DNA, 23 bp, Homo sapiens
agccttggaggttgaggctgcag

SEQ ID NO: 7979312 - DNA, 22 bp, Homo sapiens
agccttggactgaatactttag

SEQ ID NO: 7979313 - DNA, 23 bp, Homo sapiens
agccttggaggttgaggctgcag

SEQ ID NO: 7979314 - DNA, 23 bp, Homo sapiens
agccttggaggttgaggctgcag

SEQ ID NO: 7979315 - DNA, 22 bp, Homo sapiens
agcctttaacacttcacattga

SEQ ID NO: 7979316 - DNA, 22 bp, Homo sapiens
agccttgttgctaccagatgcc

SEQ ID NO: 7979317 - DNA, 22 bp, Homo sapiens
agcctttaacacttcacattga

SEQ ID NO: 7979318 - DNA, 22 bp, Homo sapiens
agcctttaactggataaagtgt

SEQ ID NO: 7979319 - DNA, 22 bp, Homo sapiens
agcctttaagcagcgcagcatt

SEQ ID NO: 7979320 - DNA, 22 bp, Homo sapiens
agccttgagttcaagtgctggc

SEQ ID NO: 7979321 - DNA, 22 bp, Homo sapiens
agccttgatcttggtaacagga

SEQ ID NO: 7979322 - DNA, 22 bp, Homo sapiens
agccttgcaaaatttttggcaa

SEQ ID NO: 7979323 - DNA, 22 bp, Homo sapiens
agccttgcagaataatttgaag

SEQ ID NO: 7979324 - DNA, 22 bp, Homo sapiens
agccttgcatgatttcattcat

SEQ ID NO: 7979325 - DNA, 22 bp, Homo sapiens
agccttgcatgatttcattcat

SEQ ID NO: 7979326 - DNA, 22 bp, Homo sapiens
agccttgcagaataatttgaag

SEQ ID NO: 7979327 - DNA, 22 bp, Homo sapiens
agccttgctttttcagtagcac

SEQ ID NO: 7979328 - DNA, 22 bp, Homo sapiens
agccttgctgcaattgttaaaa

SEQ ID NO: 7979329 - DNA, 22 bp, Homo sapiens
agccttgcctgggaaactgggt

SEQ ID NO: 7979330 - DNA, 22 bp, Homo sapiens
agccttctctgaaattctgttt

SEQ ID NO: 7979331 - DNA, 22 bp, Homo sapiens
agccttctaggatgtcatctgc

SEQ ID NO: 7979332 - DNA, 22 bp, Homo sapiens
agccttctctgaaattctgttt

SEQ ID NO: 7979333 - DNA, 22 bp, Homo sapiens
agccttctctgattctcctagt

SEQ ID NO: 7979334 - DNA, 22 bp, Homo sapiens
cagcaggagcagtcagactcct

SEQ ID NO: 7979335 - DNA, 22 bp, Homo sapiens
cagcaggagcagtcagactcct

SEQ ID NO: 7979336 - DNA, 22 bp, Homo sapiens
cagcaggagcagtcagactcct

SEQ ID NO: 7979337 - DNA, 22 bp, Homo sapiens
cagcaggagcagtcagactcct

SEQ ID NO: 7979338 - DNA, 22 bp, Homo sapiens
cagcaggagcagtcagactcct

SEQ ID NO: 7979339 - DNA, 22 bp, Homo sapiens
cagcaggagcagtcagactcct

SEQ ID NO: 7979340 - DNA, 22 bp, Homo sapiens
cagcaggagcagtcagactcct

SEQ ID NO: 7979341 - DNA, 22 bp, Homo sapiens
cagcaggaggcatggcttccct

SEQ ID NO: 7979342 - DNA, 23 bp, Homo sapiens
cagcaggagggtgcctgggctgc

SEQ ID NO: 7979343 - DNA, 23 bp, Homo sapiens
cagcaggagggtgcctgggctgc

SEQ ID NO: 7979344 - DNA, 23 bp, Homo sapiens
cagcaggagggtgcctgggctgc

SEQ ID NO: 7979345 - DNA, 23 bp, Homo sapiens
cagcaggagggtgcctgggctgc

SEQ ID NO: 7979346 - DNA, 23 bp, Homo sapiens
cagcaggagggtgcctgggctgc

SEQ ID NO: 7979347 - DNA, 23 bp, Homo sapiens
cagcaggagggtgcctgggctgc

SEQ ID NO: 7979348 - DNA, 23 bp, Homo sapiens
cagcaggagggtgcctgggctgc

SEQ ID NO: 7979349 - DNA, 22 bp, Homo sapiens
cagcaggaggcatggcttccct

SEQ ID NO: 7979350 - DNA, 22 bp, Homo sapiens
cagcaggaggcatggcttccct

SEQ ID NO: 7979351 - DNA, 22 bp, Homo sapiens
cagcaggacgtccaagtgctat

SEQ ID NO: 7979352 - DNA, 22 bp, Homo sapiens
cagcaggagcagtcagactcct

SEQ ID NO: 7979353 - DNA, 22 bp, Homo sapiens
cagcaggacgtccaagtgctat

SEQ ID NO: 7979354 - DNA, 22 bp, Homo sapiens
cagcaggacgtccaagtgctat

SEQ ID NO: 7979355 - DNA, 22 bp, Homo sapiens
cagcaggacgtccaagtgctat

SEQ ID NO: 7979356 - DNA, 22 bp, Homo sapiens
cagcaggacgtccaagtgctat

SEQ ID NO: 7979357 - DNA, 22 bp, Homo sapiens
cagcaggacccaggaatcctgc

SEQ ID NO: 7979358 - DNA, 22 bp, Homo sapiens
cagcaggacccaggaatcctgc

SEQ ID NO: 7979359 - DNA, 22 bp, Homo sapiens
cagcaggacccaggaatcctgc

SEQ ID NO: 7979360 - DNA, 22 bp, Homo sapiens
cagcaggacccaggaatcctgc

SEQ ID NO: 7979361 - DNA, 22 bp, Homo sapiens
cagcaggaccattgaggcatca

SEQ ID NO: 7979362 - DNA, 22 bp, Homo sapiens
agcctttaagctgccacagctg

SEQ ID NO: 7979363 - DNA, 22 bp, Homo sapiens
agcctttaaggaaaatgaataa

SEQ ID NO: 7979364 - DNA, 22 bp, Homo sapiens
agcctttacaagcattagctca

SEQ ID NO: 7979365 - DNA, 22 bp, Homo sapiens
agcctttatactgtgtaaggca

SEQ ID NO: 7979366 - DNA, 22 bp, Homo sapiens
agctcagaactgcagacatgtg

SEQ ID NO: 7979367 - DNA, 22 bp, Homo sapiens
agctcagaactgcagacatgtg

SEQ ID NO: 7979368 - DNA, 22 bp, Homo sapiens
agctcagaagcctatgcatagt

SEQ ID NO: 7979369 - DNA, 22 bp, Homo sapiens
agctcagaactgcagacatgtg

SEQ ID NO: 7979370 - DNA, 22 bp, Homo sapiens
agctcagaactgcagacatgtg

SEQ ID NO: 7979371 - DNA, 22 bp, Homo sapiens
agctcagaactgcagacatgtg

SEQ ID NO: 7979372 - DNA, 22 bp, Homo sapiens
agctcagaactgcagacatgtg

SEQ ID NO: 7979373 - DNA, 22 bp, Homo sapiens
agctcagaactgcagacatgtg

SEQ ID NO: 7979374 - DNA, 22 bp, Homo sapiens
agctcagaactgcagacatgtg

SEQ ID NO: 7979375 - DNA, 22 bp, Homo sapiens
agctcagaagcctatgcatagt

SEQ ID NO: 7979376 - DNA, 22 bp, Homo sapiens
agctcagaagcctatgcatagt

SEQ ID NO: 7979377 - DNA, 22 bp, Homo sapiens
agctcagaagcctatgcatagt

SEQ ID NO: 7979378 - DNA, 22 bp, Homo sapiens
agctcagaagggaggaaatgag

SEQ ID NO: 7979379 - DNA, 22 bp, Homo sapiens
agctcagaagggaggaaatgag

SEQ ID NO: 7979380 - DNA, 22 bp, Homo sapiens
cagccagagaaagggcactgcc

SEQ ID NO: 7979381 - DNA, 22 bp, Homo sapiens
cagccagaacctaggatgagct

SEQ ID NO: 7979382 - DNA, 22 bp, Homo sapiens
cagccagagaaagggcactgcc

SEQ ID NO: 7979383 - DNA, 22 bp, Homo sapiens
agctcagaagggaggaaatgag

SEQ ID NO: 7979384 - DNA, 22 bp, Homo sapiens
cagccagaacctaggatgagct

SEQ ID NO: 7979385 - DNA, 22 bp, Homo sapiens
agctcagaaatgccagtaggta

SEQ ID NO: 7979386 - DNA, 22 bp, Homo sapiens
agctcagaaatgccagtaggta

SEQ ID NO: 7979387 - DNA, 22 bp, Homo sapiens
agctcagaaatgccagtaggta

SEQ ID NO: 7979388 - DNA, 22 bp, Homo sapiens
agctcagaaatgccagtaggta

SEQ ID NO: 7979389 - DNA, 22 bp, Homo sapiens
agctcagaactgcagacatgtg

SEQ ID NO: 7979390 - DNA, 22 bp, Homo sapiens
agctcagaacctcctcatccca

SEQ ID NO: 7979391 - DNA, 22 bp, Homo sapiens
agctcagaacctcctcatccca

SEQ ID NO: 7979392 - DNA, 22 bp, Homo sapiens
agctcagaacctcctcatccca

SEQ ID NO: 7979393 - DNA, 22 bp, Homo sapiens
agctcagaaatgccagtaggta

SEQ ID NO: 7979394 - DNA, 22 bp, Homo sapiens
agctcaccacaacctccgcctc

SEQ ID NO: 7979395 - DNA, 22 bp, Homo sapiens
agctcacattctcatcagatgt

SEQ ID NO: 7979396 - DNA, 22 bp, Homo sapiens
agctcacagggagaaacgacca

SEQ ID NO: 7979397 - DNA, 21 bp, Homo sapiens
agctcacagttctgtcctgtc

SEQ ID NO: 7979398 - DNA, 22 bp, Homo sapiens
agctcacagtgtccttcctcaa

SEQ ID NO: 7979399 - DNA, 22 bp, Homo sapiens
agctaggataagcagagactgg

SEQ ID NO: 7979400 - DNA, 22 bp, Homo sapiens
agctaggagattttgtgaggct

SEQ ID NO: 7979401 - DNA, 22 bp, Homo sapiens
agctaggagattttgtgaggct

SEQ ID NO: 7979402 - DNA, 22 bp, Homo sapiens
agctaggagattttgtgaggct

SEQ ID NO: 7979403 - DNA, 22 bp, Homo sapiens
agctcaagttttcaaatattat

SEQ ID NO: 7979404 - DNA, 22 bp, Homo sapiens
agctcaagttttcaaatattat

SEQ ID NO: 7979405 - DNA, 22 bp, Homo sapiens
agctcaatgcaacctccgcctc

SEQ ID NO: 7979406 - DNA, 22 bp, Homo sapiens
agctcaatgcaacctccgcctc

SEQ ID NO: 7979407 - DNA, 22 bp, Homo sapiens
agctcacagaaatcctgcagga

SEQ ID NO: 7979408 - DNA, 18 bp, Homo sapiens
agctcacagatctgtttt

SEQ ID NO: 7979409 - DNA, 22 bp, Homo sapiens
agctcacagcctagcactgtga

SEQ ID NO: 7979410 - DNA, 22 bp, Homo sapiens
agctcacagcctagcactgtga

SEQ ID NO: 7979411 - DNA, 22 bp, Homo sapiens
cagcaggataggtttctttgga

SEQ ID NO: 7979412 - DNA, 22 bp, Homo sapiens
agctcaatttaaggcttggctt

SEQ ID NO: 7979413 - DNA, 22 bp, Homo sapiens
agctcacaagactccctcccct

SEQ ID NO: 7979414 - DNA, 22 bp, Homo sapiens
agctcacacctcatcagggtgg

SEQ ID NO: 7979415 - DNA, 22 bp, Homo sapiens
cagcaggataggtttctttgga

SEQ ID NO: 7979416 - DNA, 22 bp, Homo sapiens
cagcaggaggtgagtagcaggt

SEQ ID NO: 7979417 - DNA, 22 bp, Homo sapiens
cagcaggaggtgagtagcaggt

SEQ ID NO: 7979418 - DNA, 22 bp, Homo sapiens
cagcaggaggtgagtagcaggt

SEQ ID NO: 7979419 - DNA, 22 bp, Homo sapiens
cagcaggaggtgagtagcaggt

SEQ ID NO: 7979420 - DNA, 22 bp, Homo sapiens
cagcaggaggtgagtagcaggt

SEQ ID NO: 7979421 - DNA, 22 bp, Homo sapiens
cagcaggaggtgagatgtgacc

SEQ ID NO: 7979422 - DNA, 22 bp, Homo sapiens
cagcaggaggtgagatgtgacc

SEQ ID NO: 7979423 - DNA, 22 bp, Homo sapiens
cagcaggaggtgagtagcaggt

SEQ ID NO: 7979424 - DNA, 22 bp, Homo sapiens
cagcaggaggtgagtagcaggt

SEQ ID NO: 7979425 - DNA, 22 bp, Homo sapiens
cagcaggaggtgagatgtgacc

SEQ ID NO: 7979426 - DNA, 22 bp, Homo sapiens
cagcaggaggtgagatgtgacc

SEQ ID NO: 7979427 - DNA, 22 bp, Homo sapiens
cagcaggaggtgagatgtgacc

SEQ ID NO: 7979428 - DNA, 23 bp, Homo sapiens
cagcaggagggtgcctgggctgc

SEQ ID NO: 7979429 - DNA, 23 bp, Homo sapiens
cagcaggagggtgcctgggctgc

SEQ ID NO: 7979430 - DNA, 20 bp, Homo sapiens
agctcctctgcccattcttc

SEQ ID NO: 7979431 - DNA, 22 bp, Homo sapiens
cagccctggccccaggtggtct

SEQ ID NO: 7979432 - DNA, 22 bp, Homo sapiens
agctcctgaaaagcgcttgctt

SEQ ID NO: 7979433 - DNA, 22 bp, Homo sapiens
agctcctgaaaagcgcttgctt

SEQ ID NO: 7979434 - DNA, 22 bp, Homo sapiens
agctcctctagatctgccactt

SEQ ID NO: 7979435 - DNA, 22 bp, Homo sapiens
cagccctggccccaggtggtct

SEQ ID NO: 7979436 - DNA, 22 bp, Homo sapiens
cagccctggcctcttcgctttc

SEQ ID NO: 7979437 - DNA, 22 bp, Homo sapiens
cagccctggcctcttcgctttc

SEQ ID NO: 7979438 - DNA, 22 bp, Homo sapiens
cagccctggcctcttcgctttc

SEQ ID NO: 7979439 - DNA, 22 bp, Homo sapiens
cagccctggcctcttcgctttc

SEQ ID NO: 7979440 - DNA, 22 bp, Homo sapiens
cagccctggcgcccccagatct

SEQ ID NO: 7979441 - DNA, 22 bp, Homo sapiens
cagccctggcgcccccagatct

SEQ ID NO: 7979442 - DNA, 22 bp, Homo sapiens
cagccctggcgcccccagatct

SEQ ID NO: 7979443 - DNA, 22 bp, Homo sapiens
agctccctgcacgaccctgccc

SEQ ID NO: 7979444 - DNA, 22 bp, Homo sapiens
agctccctgcacgaccctgccc

SEQ ID NO: 7979445 - DNA, 21 bp, Homo sapiens
agctccctgtttcctcactct

SEQ ID NO: 7979446 - DNA, 21 bp, Homo sapiens
agctccctgtttcctcactct

SEQ ID NO: 7979447 - DNA, 21 bp, Homo sapiens
agctccctgtttcctcactct

SEQ ID NO: 7979448 - DNA, 21 bp, Homo sapiens
agctccctgtttcctcactct

SEQ ID NO: 7979449 - DNA, 22 bp, Homo sapiens
agctcctactctatgccagaca

SEQ ID NO: 7979450 - DNA, 21 bp, Homo sapiens
agctccctgtttcctcactct

SEQ ID NO: 7979451 - DNA, 21 bp, Homo sapiens
agctccctgtttcctcactct

SEQ ID NO: 7979452 - DNA, 22 bp, Homo sapiens
agctcctcctgtgccaggccag

SEQ ID NO: 7979453 - DNA, 22 bp, Homo sapiens
agctcctcctgagtgtctggga

SEQ ID NO: 7979454 - DNA, 22 bp, Homo sapiens
agctcctcctgagtgtctggga

SEQ ID NO: 7979455 - DNA, 22 bp, Homo sapiens
agctcctactctatgccagaca

SEQ ID NO: 7979456 - DNA, 22 bp, Homo sapiens
agctcctactctatgccagaca

SEQ ID NO: 7979457 - DNA, 19 bp, Homo sapiens
agctcctcacctctcgcgg

SEQ ID NO: 7979458 - DNA, 22 bp, Homo sapiens
cagccctggcgcccccagatct

SEQ ID NO: 7979459 - DNA, 22 bp, Homo sapiens
cagccctggcgcccccagatct

SEQ ID NO: 7979460 - DNA, 22 bp, Homo sapiens
cagccctggctagggcgagggc

SEQ ID NO: 7979461 - DNA, 22 bp, Homo sapiens
cagccctggctagggcgagggc

SEQ ID NO: 7979462 - DNA, 22 bp, Homo sapiens
cagccctggctagggcgagggc

SEQ ID NO: 7979463 - DNA, 22 bp, Homo sapiens
cagccctggctagggcgagggc

SEQ ID NO: 7979464 - DNA, 22 bp, Homo sapiens
cagccctggctagggcgagggc

SEQ ID NO: 7979465 - DNA, 22 bp, Homo sapiens
cagccctgggagttggggccga

SEQ ID NO: 7979466 - DNA, 22 bp, Homo sapiens
cagccctgggagttggggccga

SEQ ID NO: 7979467 - DNA, 22 bp, Homo sapiens
cagccctgggagttggggccga

SEQ ID NO: 7979468 - DNA, 22 bp, Homo sapiens
cagccctgggtccctgccctgg

SEQ ID NO: 7979469 - DNA, 22 bp, Homo sapiens
agctcctgtgtgaagcctccct

SEQ ID NO: 7979470 - DNA, 22 bp, Homo sapiens
agctcctgtgtgaagcctccct

SEQ ID NO: 7979471 - DNA, 22 bp, Homo sapiens
cagccctgggtccctgccctgg

SEQ ID NO: 7979472 - DNA, 22 bp, Homo sapiens
cagccctgggatcttagtgcct

SEQ ID NO: 7979473 - DNA, 22 bp, Homo sapiens
cagccctgggtccctgccctgg

SEQ ID NO: 7979474 - DNA, 22 bp, Homo sapiens
cagccctgggtccctgccctgg

SEQ ID NO: 7979475 - DNA, 22 bp, Homo sapiens
cagccctgggtccctgccctgg

SEQ ID NO: 7979476 - DNA, 22 bp, Homo sapiens
cagccctgggtccctgccctgg

SEQ ID NO: 7979477 - DNA, 22 bp, Homo sapiens
cagccctgggagttggggccga

SEQ ID NO: 7979478 - DNA, 22 bp, Homo sapiens
cagccctgggagttggggccga

SEQ ID NO: 7979479 - DNA, 22 bp, Homo sapiens
cagccctgggagttggggccga

SEQ ID NO: 7979480 - DNA, 22 bp, Homo sapiens
agctcccagcagagctggccac

SEQ ID NO: 7979481 - DNA, 22 bp, Homo sapiens
agctcccagcagagctggccac

SEQ ID NO: 7979482 - DNA, 23 bp, Homo sapiens
agctccagggaacaggcagtagg

SEQ ID NO: 7979483 - DNA, 22 bp, Homo sapiens
agctcccagagtcctctgccca

SEQ ID NO: 7979484 - DNA, 22 bp, Homo sapiens
agctcccaggcagtcatgagga

SEQ ID NO: 7979485 - DNA, 22 bp, Homo sapiens
agctcccaggcagtcatgagga

SEQ ID NO: 7979486 - DNA, 23 bp, Homo sapiens
agctccagggaacaggcagtagg

SEQ ID NO: 7979487 - DNA, 22 bp, Homo sapiens
agctccagggaaagagtggatc

SEQ ID NO: 7979488 - DNA, 23 bp, Homo sapiens
agctccagggaacaggcagtagg

SEQ ID NO: 7979489 - DNA, 23 bp, Homo sapiens
agctccagggaacaggcagtagg

SEQ ID NO: 7979490 - DNA, 22 bp, Homo sapiens
agctccagggaaagagtggatc

SEQ ID NO: 7979491 - DNA, 22 bp, Homo sapiens
agctccagggaaagagtggatc

SEQ ID NO: 7979492 - DNA, 22 bp, Homo sapiens
cagccagctggcactgtgagta

SEQ ID NO: 7979493 - DNA, 22 bp, Homo sapiens
cagccagctggcactgtgagta

SEQ ID NO: 7979494 - DNA, 22 bp, Homo sapiens
agctcccattatcttctgaaac

SEQ ID NO: 7979495 - DNA, 22 bp, Homo sapiens
agctcccctcgtttctctccat

SEQ ID NO: 7979496 - DNA, 22 bp, Homo sapiens
agctccccacgtctctgtcttt

SEQ ID NO: 7979497 - DNA, 22 bp, Homo sapiens
agctccccacgtctctgtcttt

SEQ ID NO: 7979498 - DNA, 22 bp, Homo sapiens
agctccctgagatgccacagca

SEQ ID NO: 7979499 - DNA, 22 bp, Homo sapiens
agctccctgagatgccacagca

SEQ ID NO: 7979500 - DNA, 22 bp, Homo sapiens
agctccctgagatgccacagca

SEQ ID NO: 7979501 - DNA, 22 bp, Homo sapiens
agctcccagtctcctctccatg

SEQ ID NO: 7979502 - DNA, 22 bp, Homo sapiens
agctcccagtctcctctccatg

SEQ ID NO: 7979503 - DNA, 22 bp, Homo sapiens
agctcccagggctgggcaagtt

SEQ ID NO: 7979504 - DNA, 22 bp, Homo sapiens
cagccagcctctcaaccatgca

SEQ ID NO: 7979505 - DNA, 22 bp, Homo sapiens
cagccagatcagggcaggggtt

SEQ ID NO: 7979506 - DNA, 22 bp, Homo sapiens
cagccagatcagggcaggggtt

SEQ ID NO: 7979507 - DNA, 22 bp, Homo sapiens
cagccagatcagggcaggggtt

SEQ ID NO: 7979508 - DNA, 22 bp, Homo sapiens
cagccagatcaaactcagatgt

SEQ ID NO: 7979509 - DNA, 22 bp, Homo sapiens
cagccagatcaaactcagatgt

SEQ ID NO: 7979510 - DNA, 22 bp, Homo sapiens
cagccagatcaaactcagatgt

SEQ ID NO: 7979511 - DNA, 22 bp, Homo sapiens
cagccagctcaggaaggatttt

SEQ ID NO: 7979512 - DNA, 22 bp, Homo sapiens
cagccagctgaatgtaccatga

SEQ ID NO: 7979513 - DNA, 22 bp, Homo sapiens
cagccagctggcactgtgagta

SEQ ID NO: 7979514 - DNA, 22 bp, Homo sapiens
cagccagcctctcaaccatgca

SEQ ID NO: 7979515 - DNA, 22 bp, Homo sapiens
cagccagcctctcaaccatgca

SEQ ID NO: 7979516 - DNA, 22 bp, Homo sapiens
cagccagctcaggaaggatttt

SEQ ID NO: 7979517 - DNA, 22 bp, Homo sapiens
cagccagaggggccagagtcgg

SEQ ID NO: 7979518 - DNA, 22 bp, Homo sapiens
cagccagaggctgcgaggggcc

SEQ ID NO: 7979519 - DNA, 22 bp, Homo sapiens
cagccagaggctgcgaggggcc

SEQ ID NO: 7979520 - DNA, 22 bp, Homo sapiens
cagccagaggggccagagtcgg

SEQ ID NO: 7979521 - DNA, 22 bp, Homo sapiens
cagccagaggggccagagtcgg

SEQ ID NO: 7979522 - DNA, 22 bp, Homo sapiens
cagccagaggggccagagtcgg

SEQ ID NO: 7979523 - DNA, 22 bp, Homo sapiens
cagccagatcaaactcagatgt

SEQ ID NO: 7979524 - DNA, 22 bp, Homo sapiens
cagccagagaggaaggaatgca

SEQ ID NO: 7979525 - DNA, 22 bp, Homo sapiens
cagccagaggctgcgaggggcc

SEQ ID NO: 7979526 - DNA, 22 bp, Homo sapiens
cagccagagaggaaggaatgca

SEQ ID NO: 7979527 - DNA, 22 bp, Homo sapiens
cagccagagaggaaggaatgca

SEQ ID NO: 7979528 - DNA, 22 bp, Homo sapiens
cagaggctcagatggccctggc

SEQ ID NO: 7979529 - DNA, 22 bp, Homo sapiens
cagaggctcagatggccctggc

SEQ ID NO: 7979530 - DNA, 22 bp, Homo sapiens
cagaggctcagatggccctggc

SEQ ID NO: 7979531 - DNA, 22 bp, Homo sapiens
cagaggctagactgtgcttcct

SEQ ID NO: 7979532 - DNA, 22 bp, Homo sapiens
cagaggctcaccagcctttcac

SEQ ID NO: 7979533 - DNA, 22 bp, Homo sapiens
cagaggctcaccagcctttcac

SEQ ID NO: 7979534 - DNA, 22 bp, Homo sapiens
cagaggctcaccagcctttcac

SEQ ID NO: 7979535 - DNA, 22 bp, Homo sapiens
cagaggctcagatggccctggc

SEQ ID NO: 7979536 - DNA, 22 bp, Homo sapiens
cagaggctcagatggccctggc

SEQ ID NO: 7979537 - DNA, 22 bp, Homo sapiens
cagaggctcttcctcactgccc

SEQ ID NO: 7979538 - DNA, 19 bp, Homo sapiens
cagcaagaatgaaggcata

SEQ ID NO: 7979539 - DNA, 22 bp, Homo sapiens
cagcaagaatcagacaacctca

SEQ ID NO: 7979540 - DNA, 22 bp, Homo sapiens
cagcacagagtattttattgat

SEQ ID NO: 7979541 - DNA, 20 bp, Homo sapiens
cagcacagagcttggctcta

SEQ ID NO: 7979542 - DNA, 22 bp, Homo sapiens
cagcacagcacagcggtgactc

SEQ ID NO: 7979543 - DNA, 22 bp, Homo sapiens
cagcacagcacagcggtgactc

SEQ ID NO: 7979544 - DNA, 22 bp, Homo sapiens
cagcacagcacagcggtgactc

SEQ ID NO: 7979545 - DNA, 22 bp, Homo sapiens
cagcacagcacagcggtgactc

SEQ ID NO: 7979546 - DNA, 22 bp, Homo sapiens
cagcacagcacagcggtgactc

SEQ ID NO: 7979547 - DNA, 22 bp, Homo sapiens
cagcacagctgaggggctgtct

SEQ ID NO: 7979548 - DNA, 19 bp, Homo sapiens
cagcaagaatgaaggcata

SEQ ID NO: 7979549 - DNA, 19 bp, Homo sapiens
cagcaagaatgaaggcata

SEQ ID NO: 7979550 - DNA, 22 bp, Homo sapiens
cagcacacagtgactcgcacct

SEQ ID NO: 7979551 - DNA, 20 bp, Homo sapiens
cagcacagagcttggctcta

SEQ ID NO: 7979552 - DNA, 20 bp, Homo sapiens
cagcacagagcttggctcta

SEQ ID NO: 7979553 - DNA, 20 bp, Homo sapiens
cagcacagagcttggctcta

SEQ ID NO: 7979554 - DNA, 22 bp, Homo sapiens
cagaggctaagatgagtgggtg

SEQ ID NO: 7979555 - DNA, 22 bp, Homo sapiens
cagaggctaagatgagtgggtg

SEQ ID NO: 7979556 - DNA, 22 bp, Homo sapiens
cagaggctaagatgagtgggtg

SEQ ID NO: 7979557 - DNA, 22 bp, Homo sapiens
cagaggctaagatgagtgggtg

SEQ ID NO: 7979558 - DNA, 22 bp, Homo sapiens
cagaggctaagatgagtgggtg

SEQ ID NO: 7979559 - DNA, 22 bp, Homo sapiens
cagaggctaagatgagtgggtg

SEQ ID NO: 7979560 - DNA, 22 bp, Homo sapiens
cagaggctaagggtagcttggg

SEQ ID NO: 7979561 - DNA, 22 bp, Homo sapiens
cagaggctaagggtagcttggg

SEQ ID NO: 7979562 - DNA, 22 bp, Homo sapiens
cagaggcctttctacagtgata

SEQ ID NO: 7979563 - DNA, 22 bp, Homo sapiens
cagaggcgaggcagctgaacct

SEQ ID NO: 7979564 - DNA, 22 bp, Homo sapiens
cagaggcgaggcagctgaacct

SEQ ID NO: 7979565 - DNA, 22 bp, Homo sapiens
cagaggctaagagtgtccaaag

SEQ ID NO: 7979566 - DNA, 22 bp, Homo sapiens
cagaggcctttctacagtgata

SEQ ID NO: 7979567 - DNA, 22 bp, Homo sapiens
cagaggcgaggcagctgaacct

SEQ ID NO: 7979568 - DNA, 22 bp, Homo sapiens
cagaggcctttctacagtgata

SEQ ID NO: 7979569 - DNA, 22 bp, Homo sapiens
agccctccatctgtgctcaggc

SEQ ID NO: 7979570 - DNA, 22 bp, Homo sapiens
agccctccatctgtgctcaggc

SEQ ID NO: 7979571 - DNA, 22 bp, Homo sapiens
agccctccatctgtgctcaggc

SEQ ID NO: 7979572 - DNA, 22 bp, Homo sapiens
agccctccatctgtgctcaggc

SEQ ID NO: 7979573 - DNA, 22 bp, Homo sapiens
cagcacaggcccctctctccca

SEQ ID NO: 7979574 - DNA, 22 bp, Homo sapiens
cagcacaggcccctctctccca

SEQ ID NO: 7979575 - DNA, 22 bp, Homo sapiens
cagcacaggcccctctctccca

SEQ ID NO: 7979576 - DNA, 22 bp, Homo sapiens
cagcacaggcctgtctttgtct

SEQ ID NO: 7979577 - DNA, 22 bp, Homo sapiens
cagcacaggcctgtctttgtct

SEQ ID NO: 7979578 - DNA, 22 bp, Homo sapiens
cagcacaggcctgtctttgtct

SEQ ID NO: 7979579 - DNA, 22 bp, Homo sapiens
cagcacagggacaatagcagat

SEQ ID NO: 7979580 - DNA, 22 bp, Homo sapiens
cagcacagggacaatagcagat

SEQ ID NO: 7979581 - DNA, 22 bp, Homo sapiens
cagcacagggacaatagcagat

SEQ ID NO: 7979582 - DNA, 22 bp, Homo sapiens
cagcacagggacaatagcagat

SEQ ID NO: 7979583 - DNA, 22 bp, Homo sapiens
cagcacagggacaatagcagat

SEQ ID NO: 7979584 - DNA, 22 bp, Homo sapiens
cagcacagggcttgagaggtgt

SEQ ID NO: 7979585 - DNA, 22 bp, Homo sapiens
cagcacagggcttgagaggtgt

SEQ ID NO: 7979586 - DNA, 22 bp, Homo sapiens
cagcacagggcttgagaggtgt

SEQ ID NO: 7979587 - DNA, 22 bp, Homo sapiens
cagcacaggcaggggaactata

SEQ ID NO: 7979588 - DNA, 22 bp, Homo sapiens
cagcacaggcaggggaactata

SEQ ID NO: 7979589 - DNA, 22 bp, Homo sapiens
cagcacaggaatatggtggaca

SEQ ID NO: 7979590 - DNA, 22 bp, Homo sapiens
cagcacaggaagtgggccttca

SEQ ID NO: 7979591 - DNA, 22 bp, Homo sapiens
cagcacaggaatatggtggaca

SEQ ID NO: 7979592 - DNA, 22 bp, Homo sapiens
cagcacaggaatatggtggaca

SEQ ID NO: 7979593 - DNA, 22 bp, Homo sapiens
cagcacaggaatatggtggaca

SEQ ID NO: 7979594 - DNA, 22 bp, Homo sapiens
cagcacaggaatatggtggaca

SEQ ID NO: 7979595 - DNA, 22 bp, Homo sapiens
cagcacagctgaggggctgtct

SEQ ID NO: 7979596 - DNA, 22 bp, Homo sapiens
cagcacagctgaggggctgtct

SEQ ID NO: 7979597 - DNA, 22 bp, Homo sapiens
cagcacagctgaggggctgtct

SEQ ID NO: 7979598 - DNA, 22 bp, Homo sapiens
cagcacagctgaggggctgtct

SEQ ID NO: 7979599 - DNA, 22 bp, Homo sapiens
cagcacaggaagtgggccttca

SEQ ID NO: 7979600 - DNA, 22 bp, Homo sapiens
agcctcagcacgcagctctgtg

SEQ ID NO: 7979601 - DNA, 22 bp, Homo sapiens
agcctcagcacgcagctctgtg

SEQ ID NO: 7979602 - DNA, 22 bp, Homo sapiens
agcctcagcacgcagctctgtg

SEQ ID NO: 7979603 - DNA, 23 bp, Homo sapiens
agcctcagccggtggcagaagtg

SEQ ID NO: 7979604 - DNA, 23 bp, Homo sapiens
agcctcagccggtggcagaagtg

SEQ ID NO: 7979605 - DNA, 23 bp, Homo sapiens
agcctcagccggtggcagaagtg

SEQ ID NO: 7979606 - DNA, 22 bp, Homo sapiens
agcctcagcacgcagctctgtg

SEQ ID NO: 7979607 - DNA, 23 bp, Homo sapiens
agcctcagccggtggcagaagtg

SEQ ID NO: 7979608 - DNA, 21 bp, Homo sapiens
agcctcaggttgttggttctt

SEQ ID NO: 7979609 - DNA, 22 bp, Homo sapiens
agcctcagggctctgcgcagac

SEQ ID NO: 7979610 - DNA, 22 bp, Homo sapiens
agcctcagggctctgcgcagac

SEQ ID NO: 7979611 - DNA, 23 bp, Homo sapiens
agcctcagccggtggcagaagtg

SEQ ID NO: 7979612 - DNA, 22 bp, Homo sapiens
agcctcagggctctgcgcagac

SEQ ID NO: 7979613 - DNA, 22 bp, Homo sapiens
agcctcagggctctgcgcagac

SEQ ID NO: 7979614 - DNA, 22 bp, Homo sapiens
agcctcagggctctgcgcagac

SEQ ID NO: 7979615 - DNA, 22 bp, Homo sapiens
cagcacaggtcagttttttaag

SEQ ID NO: 7979616 - DNA, 22 bp, Homo sapiens
cagcacagtacaaggcacggat

SEQ ID NO: 7979617 - DNA, 22 bp, Homo sapiens
cagcacagggcttgagaggtgt

SEQ ID NO: 7979618 - DNA, 22 bp, Homo sapiens
cagcacagggcttgagaggtgt

SEQ ID NO: 7979619 - DNA, 22 bp, Homo sapiens
cagcacagggcttgagaggtgt

SEQ ID NO: 7979620 - DNA, 22 bp, Homo sapiens
cagcacagtacaaggcacggat

SEQ ID NO: 7979621 - DNA, 22 bp, Homo sapiens
cagcacagtacaaggcacggat

SEQ ID NO: 7979622 - DNA, 22 bp, Homo sapiens
agcctcagcacgcagctctgtg

SEQ ID NO: 7979623 - DNA, 22 bp, Homo sapiens
agcctcagcacgcagctctgtg

SEQ ID NO: 7979624 - DNA, 22 bp, Homo sapiens
cagcacaggtcagttttttaag

SEQ ID NO: 7979625 - DNA, 22 bp, Homo sapiens
cagcacagtacaaggcacggat

SEQ ID NO: 7979626 - DNA, 22 bp, Homo sapiens
cagcacagtacaaggcacggat

SEQ ID NO: 7979627 - DNA, 22 bp, Homo sapiens
cagcacagtacaaggcacggat

SEQ ID NO: 7979628 - DNA, 23 bp, Homo sapiens
agccttcaggcaatgtcagtaga

SEQ ID NO: 7979629 - DNA, 22 bp, Homo sapiens
agccttcagtaaatccactgtg

SEQ ID NO: 7979630 - DNA, 22 bp, Homo sapiens
agccttcagtaaatccactgtg

SEQ ID NO: 7979631 - DNA, 22 bp, Homo sapiens
agccttcagtaaatccactgtg

SEQ ID NO: 7979632 - DNA, 22 bp, Homo sapiens
agccttcagtaagggcttagca

SEQ ID NO: 7979633 - DNA, 22 bp, Homo sapiens
agccttcagtaagggcttagca

SEQ ID NO: 7979634 - DNA, 22 bp, Homo sapiens
agccttcataatcttgggcttt

SEQ ID NO: 7979635 - DNA, 22 bp, Homo sapiens
agccttcagtaaatccactgtg

SEQ ID NO: 7979636 - DNA, 22 bp, Homo sapiens
agccttccaggtagatggcaca

SEQ ID NO: 7979637 - DNA, 22 bp, Homo sapiens
cagcagcattgctctggattcc

SEQ ID NO: 7979638 - DNA, 22 bp, Homo sapiens
cagcagcatgaattcgagccac

SEQ ID NO: 7979639 - DNA, 22 bp, Homo sapiens
agccttcagcagttcaggtgcc

SEQ ID NO: 7979640 - DNA, 22 bp, Homo sapiens
cagcagcatcaggtctgtggtt

SEQ ID NO: 7979641 - DNA, 22 bp, Homo sapiens
cagcagcatcaggtctgtggtt

SEQ ID NO: 7979642 - DNA, 22 bp, Homo sapiens
cagcagcagtggctgcagaaca

SEQ ID NO: 7979643 - DNA, 22 bp, Homo sapiens
cagcagcagtgttctagaatct

SEQ ID NO: 7979644 - DNA, 22 bp, Homo sapiens
cagcagcagtgttctagaatct

SEQ ID NO: 7979645 - DNA, 22 bp, Homo sapiens
cagcagcatgaattcgagccac

SEQ ID NO: 7979646 - DNA, 22 bp, Homo sapiens
cagcagcatgaattcgagccac

SEQ ID NO: 7979647 - DNA, 22 bp, Homo sapiens
cagcagcatcaggtctgtggtt

SEQ ID NO: 7979648 - DNA, 22 bp, Homo sapiens
cagcagcatgaattcgagccac

SEQ ID NO: 7979649 - DNA, 22 bp, Homo sapiens
cagcagcatcaggtctgtggtt

SEQ ID NO: 7979650 - DNA, 22 bp, Homo sapiens
cagcagcatgaattcgagccac

SEQ ID NO: 7979651 - DNA, 22 bp, Homo sapiens
cagcagcatgaattcgagccac

SEQ ID NO: 7979652 - DNA, 22 bp, Homo sapiens
cagcagcatgaattcgagccac

SEQ ID NO: 7979653 - DNA, 22 bp, Homo sapiens
cagcagcagtggctgcagaaca

SEQ ID NO: 7979654 - DNA, 22 bp, Homo sapiens
cagcagcagtggctgcagaaca

SEQ ID NO: 7979655 - DNA, 22 bp, Homo sapiens
cagcagcagtggctgcagaaca

SEQ ID NO: 7979656 - DNA, 22 bp, Homo sapiens
cagcagcagtggctgcagaaca

SEQ ID NO: 7979657 - DNA, 22 bp, Homo sapiens
cagcagcagtggctgcagaaca

SEQ ID NO: 7979658 - DNA, 22 bp, Homo sapiens
cagcagcaggcgcacggccgtc

SEQ ID NO: 7979659 - DNA, 22 bp, Homo sapiens
cagcagcaggcgcacggccgtc

SEQ ID NO: 7979660 - DNA, 22 bp, Homo sapiens
cagcagcaggcgcacggccgtc

SEQ ID NO: 7979661 - DNA, 22 bp, Homo sapiens
cagcagcagcttagtggtcccc

SEQ ID NO: 7979662 - DNA, 22 bp, Homo sapiens
cagcagcagcttagtggtcccc

SEQ ID NO: 7979663 - DNA, 22 bp, Homo sapiens
cagcagcagcttagtggtcccc

SEQ ID NO: 7979664 - DNA, 22 bp, Homo sapiens
cagcagcagcttagtggtcccc

SEQ ID NO: 7979665 - DNA, 22 bp, Homo sapiens
cagcagcagccccaggaaggtt

SEQ ID NO: 7979666 - DNA, 22 bp, Homo sapiens
cagcagcagccccaggaaggtt

SEQ ID NO: 7979667 - DNA, 22 bp, Homo sapiens
cagcagcagcttagtggtcccc

SEQ ID NO: 7979668 - DNA, 22 bp, Homo sapiens
cagcagaggttttgctccatga

SEQ ID NO: 7979669 - DNA, 22 bp, Homo sapiens
cagcagaggttttgctccatga

SEQ ID NO: 7979670 - DNA, 22 bp, Homo sapiens
cagcagaggttttgctccatga

SEQ ID NO: 7979671 - DNA, 22 bp, Homo sapiens
cagcagaggttttgctccatga

SEQ ID NO: 7979672 - DNA, 22 bp, Homo sapiens
agcctccatctcccatctgtga

SEQ ID NO: 7979673 - DNA, 22 bp, Homo sapiens
agcctccatctcccatctgtga

SEQ ID NO: 7979674 - DNA, 22 bp, Homo sapiens
cagcagaaatggattttgagat

SEQ ID NO: 7979675 - DNA, 22 bp, Homo sapiens
cagcagaaatggattttgagat

SEQ ID NO: 7979676 - DNA, 22 bp, Homo sapiens
cagcagaaatggattttgagat

SEQ ID NO: 7979677 - DNA, 22 bp, Homo sapiens
cagcagaaacccagcaaagcca

SEQ ID NO: 7979678 - DNA, 22 bp, Homo sapiens
agcctccatctcccatctgtga

SEQ ID NO: 7979679 - DNA, 22 bp, Homo sapiens
cagcagaaacccagcaaagcca

SEQ ID NO: 7979680 - DNA, 22 bp, Homo sapiens
cagcagagcttattaactaaaa

SEQ ID NO: 7979681 - DNA, 22 bp, Homo sapiens
cagcagagcttattaactaaaa

SEQ ID NO: 7979682 - DNA, 22 bp, Homo sapiens
cagcagagcttattaactaaaa

SEQ ID NO: 7979683 - DNA, 20 bp, Homo sapiens
cagcagaaatggggtgggaa

SEQ ID NO: 7979684 - DNA, 20 bp, Homo sapiens
cagcagaaatggggtgggaa

SEQ ID NO: 7979685 - DNA, 22 bp, Homo sapiens
cagcagagcttatgttgggtca

SEQ ID NO: 7979686 - DNA, 22 bp, Homo sapiens
agcctccaaatgtcaggtcccg

SEQ ID NO: 7979687 - DNA, 22 bp, Homo sapiens
agcctccacagatgcaaagggc

SEQ ID NO: 7979688 - DNA, 22 bp, Homo sapiens
agcctccacagatgcaaagggc

SEQ ID NO: 7979689 - DNA, 22 bp, Homo sapiens
agcctccaaatgtcaggtcccg

SEQ ID NO: 7979690 - DNA, 22 bp, Homo sapiens
agcctcagtttcaggcctcctc

SEQ ID NO: 7979691 - DNA, 22 bp, Homo sapiens
agcctccacagatgcaaagggc

SEQ ID NO: 7979692 - DNA, 22 bp, Homo sapiens
agcctcagtgtcaccatctacc

SEQ ID NO: 7979693 - DNA, 21 bp, Homo sapiens
agcctcaggttgttggttctt

SEQ ID NO: 7979694 - DNA, 22 bp, Homo sapiens
agcctcagtgtcaccatctacc

SEQ ID NO: 7979695 - DNA, 22 bp, Homo sapiens
agcctcagtgtcaccatctacc

SEQ ID NO: 7979696 - DNA, 22 bp, Homo sapiens
agcctcagtttcaggcctcctc

SEQ ID NO: 7979697 - DNA, 22 bp, Homo sapiens
agcctcagtgtcaccatctacc

SEQ ID NO: 7979698 - DNA, 22 bp, Homo sapiens
agcctcagtttcaggcctcctc

SEQ ID NO: 7979699 - DNA, 22 bp, Homo sapiens
cagcagaggcacgtctgtgaat

SEQ ID NO: 7979700 - DNA, 22 bp, Homo sapiens
cagcagaggcacgtctgtgaat

SEQ ID NO: 7979701 - DNA, 22 bp, Homo sapiens
cagcagaggcacgtctgtgaat

SEQ ID NO: 7979702 - DNA, 22 bp, Homo sapiens
cagcagaggcacgtctgtgaat

SEQ ID NO: 7979703 - DNA, 22 bp, Homo sapiens
cagcagaggcacgtctgtgaat

SEQ ID NO: 7979704 - DNA, 22 bp, Homo sapiens
cagcagagggagccattgaaat

SEQ ID NO: 7979705 - DNA, 22 bp, Homo sapiens
cagcagagggagccattgaaat

SEQ ID NO: 7979706 - DNA, 22 bp, Homo sapiens
cagcagaggcacgtctgtgaat

SEQ ID NO: 7979707 - DNA, 22 bp, Homo sapiens
cagcagaggaaagcaaatctaa

SEQ ID NO: 7979708 - DNA, 22 bp, Homo sapiens
cagcagaggaaagcaaatctaa

SEQ ID NO: 7979709 - DNA, 22 bp, Homo sapiens
cagcagaggaaagcaaatctaa

SEQ ID NO: 7979710 - DNA, 22 bp, Homo sapiens
cagcagaggtggttcacattgt

SEQ ID NO: 7979711 - DNA, 22 bp, Homo sapiens
cagcagaggttggaacagttct

SEQ ID NO: 7979712 - DNA, 22 bp, Homo sapiens
cagcagaggttggaacagttct

SEQ ID NO: 7979713 - DNA, 22 bp, Homo sapiens
cagcagaggtggttcacattgt

SEQ ID NO: 7979714 - DNA, 22 bp, Homo sapiens
cagcagagggagccattgaaat

SEQ ID NO: 7979715 - DNA, 22 bp, Homo sapiens
cagcagagggagccattgaaat

SEQ ID NO: 7979716 - DNA, 22 bp, Homo sapiens
caactggtaatctccacggtca

SEQ ID NO: 7979717 - DNA, 22 bp, Homo sapiens
caactggtggtcaaccttctgt

SEQ ID NO: 7979718 - DNA, 22 bp, Homo sapiens
caactgctgacaccatcactcc

SEQ ID NO: 7979719 - DNA, 22 bp, Homo sapiens
caactgctgacaccatcactcc

SEQ ID NO: 7979720 - DNA, 19 bp, Homo sapiens
caactgccccctcaaacat

SEQ ID NO: 7979721 - DNA, 22 bp, Homo sapiens
caactgtcacagctgatctgtt

SEQ ID NO: 7979722 - DNA, 22 bp, Homo sapiens
caacttcactgtgcctctagtt

SEQ ID NO: 7979723 - DNA, 17 bp, Homo sapiens
caacttcacaaactgtc

SEQ ID NO: 7979724 - DNA, 22 bp, Homo sapiens
caactgttataaatcaacagag

SEQ ID NO: 7979725 - DNA, 22 bp, Homo sapiens
caactgttataaatcaacagag

SEQ ID NO: 7979726 - DNA, 22 bp, Homo sapiens
caactgttataaatcaacagag

SEQ ID NO: 7979727 - DNA, 22 bp, Homo sapiens
caactgcttggaggaatactgc

SEQ ID NO: 7979728 - DNA, 22 bp, Homo sapiens
caactgtgaattttatgatacc

SEQ ID NO: 7979729 - DNA, 22 bp, Homo sapiens
caactccctgtggggtactggg

SEQ ID NO: 7979730 - DNA, 22 bp, Homo sapiens
caactcatgtccaactttcttt

SEQ ID NO: 7979731 - DNA, 22 bp, Homo sapiens
caactcatttattcaattttct

SEQ ID NO: 7979732 - DNA, 22 bp, Homo sapiens
caactcatttattcaattttct

SEQ ID NO: 7979733 - DNA, 19 bp, Homo sapiens
caactcttgatactgttag

SEQ ID NO: 7979734 - DNA, 22 bp, Homo sapiens
caactgagcagtagcgtctgga

SEQ ID NO: 7979735 - DNA, 22 bp, Homo sapiens
caactgccatacagctccatgg

SEQ ID NO: 7979736 - DNA, 21 bp, Homo sapiens
agcagacacttgtgaccttcc

SEQ ID NO: 7979737 - DNA, 22 bp, Homo sapiens
agcagacaccaggagtaaagaa

SEQ ID NO: 7979738 - DNA, 22 bp, Homo sapiens
agcagacaccaggagtaaagaa

SEQ ID NO: 7979739 - DNA, 22 bp, Homo sapiens
agcagacaattgcctggatgga

SEQ ID NO: 7979740 - DNA, 22 bp, Homo sapiens
agcagacaattgcctggatgga

SEQ ID NO: 7979741 - DNA, 22 bp, Homo sapiens
agcagacaattgcctggatgga

SEQ ID NO: 7979742 - DNA, 22 bp, Homo sapiens
agcagacaattgcctggatgga

SEQ ID NO: 7979743 - DNA, 22 bp, Homo sapiens
caactatatagaaattgattgt

SEQ ID NO: 7979744 - DNA, 22 bp, Homo sapiens
agcagacaacccagatgaccca

SEQ ID NO: 7979745 - DNA, 21 bp, Homo sapiens
agcagacacttgtgaccttcc

SEQ ID NO: 7979746 - DNA, 21 bp, Homo sapiens
agcagacacttgtgaccttcc

SEQ ID NO: 7979747 - DNA, 22 bp, Homo sapiens
caactcagactggattaaataa

SEQ ID NO: 7979748 - DNA, 22 bp, Homo sapiens
caactcaggcacctcatataag

SEQ ID NO: 7979749 - DNA, 22 bp, Homo sapiens
caactcatgtccaactttcttt

SEQ ID NO: 7979750 - DNA, 22 bp, Homo sapiens
caactcatgtccaactttcttt

SEQ ID NO: 7979751 - DNA, 22 bp, Homo sapiens
agcagaagtgccttagcaatca

SEQ ID NO: 7979752 - DNA, 22 bp, Homo sapiens
agcagaatggggctgggaatag

SEQ ID NO: 7979753 - DNA, 22 bp, Homo sapiens
agcagaatgtgtgtgacaagta

SEQ ID NO: 7979754 - DNA, 22 bp, Homo sapiens
agcagacaacccagatgaccca

SEQ ID NO: 7979755 - DNA, 22 bp, Homo sapiens
agcagacaacccagatgaccca

SEQ ID NO: 7979756 - DNA, 22 bp, Homo sapiens
agcagacaacccagatgaccca

SEQ ID NO: 7979757 - DNA, 22 bp, Homo sapiens
agcagacaattgcctggatgga

SEQ ID NO: 7979758 - DNA, 22 bp, Homo sapiens
agcagacaattgcctggatgga

SEQ ID NO: 7979759 - DNA, 22 bp, Homo sapiens
agcagcagaaagttgatggcag

SEQ ID NO: 7979760 - DNA, 22 bp, Homo sapiens
agcagcagaaagttgatggcag

SEQ ID NO: 7979761 - DNA, 22 bp, Homo sapiens
agcagcagaaagttgatggcag

SEQ ID NO: 7979762 - DNA, 22 bp, Homo sapiens
agcagcagaaagttgatggcag

SEQ ID NO: 7979763 - DNA, 22 bp, Homo sapiens
agcagcacctgtcctcgctgct

SEQ ID NO: 7979764 - DNA, 22 bp, Homo sapiens
agcagcacctgtcctcgctgct

SEQ ID NO: 7979765 - DNA, 22 bp, Homo sapiens
agcagcagaaagttgatggcag

SEQ ID NO: 7979766 - DNA, 22 bp, Homo sapiens
agcagcagaaagttgatggcag

SEQ ID NO: 7979767 - DNA, 22 bp, Homo sapiens
agcagcacatggggctggcaac

SEQ ID NO: 7979768 - DNA, 22 bp, Homo sapiens
agcagcacacgggagaaagaca

SEQ ID NO: 7979769 - DNA, 22 bp, Homo sapiens
agcagcacccagagccatgtct

SEQ ID NO: 7979770 - DNA, 22 bp, Homo sapiens
agcagcacccagagccatgtct

SEQ ID NO: 7979771 - DNA, 22 bp, Homo sapiens
agcagcacccagagccatgtct

SEQ ID NO: 7979772 - DNA, 22 bp, Homo sapiens
caaggcaggaagcctgtcttat

SEQ ID NO: 7979773 - DNA, 19 bp, Homo sapiens
agcagcagaagtgtgcctt

SEQ ID NO: 7979774 - DNA, 22 bp, Homo sapiens
caaggcaggaagcctgtcttat

SEQ ID NO: 7979775 - DNA, 22 bp, Homo sapiens
caaggcaggcagttcacttgag

SEQ ID NO: 7979776 - DNA, 22 bp, Homo sapiens
agcagcagaagggagacccagg

SEQ ID NO: 7979777 - DNA, 22 bp, Homo sapiens
agcagcagaagggagacccagg

SEQ ID NO: 7979778 - DNA, 22 bp, Homo sapiens
agcagcagaagggagacccagg

SEQ ID NO: 7979779 - DNA, 22 bp, Homo sapiens
agcagcagaagggagacccagg

SEQ ID NO: 7979780 - DNA, 22 bp, Homo sapiens
agcagcagaaggtttgcaccca

SEQ ID NO: 7979781 - DNA, 22 bp, Homo sapiens
agcagcagaagggagacccagg

SEQ ID NO: 7979782 - DNA, 22 bp, Homo sapiens
agcagcaataataaagtaatac

SEQ ID NO: 7979783 - DNA, 22 bp, Homo sapiens
agcagcaagtgtaactgaatat

SEQ ID NO: 7979784 - DNA, 22 bp, Homo sapiens
agcagcaagtgtaactgaatat

SEQ ID NO: 7979785 - DNA, 22 bp, Homo sapiens
agcagcaataataaagtaatac

SEQ ID NO: 7979786 - DNA, 22 bp, Homo sapiens
agcagcaatggaaagcaacaca

SEQ ID NO: 7979787 - DNA, 22 bp, Homo sapiens
agcagcaatggaaagcaacaca

SEQ ID NO: 7979788 - DNA, 22 bp, Homo sapiens
agcagcaattttcactgtcaat

SEQ ID NO: 7979789 - DNA, 22 bp, Homo sapiens
agcagcaattttcactgtcaat

SEQ ID NO: 7979790 - DNA, 22 bp, Homo sapiens
agcagcaatggaaagcaacaca

SEQ ID NO: 7979791 - DNA, 22 bp, Homo sapiens
agcagcaatggaaagcaacaca

SEQ ID NO: 7979792 - DNA, 18 bp, Homo sapiens
agcagcaatttgggatga

SEQ ID NO: 7979793 - DNA, 18 bp, Homo sapiens
agcagcaatttgggatga

SEQ ID NO: 7979794 - DNA, 22 bp, Homo sapiens
agcagcaattttcactgtcaat

SEQ ID NO: 7979795 - DNA, 22 bp, Homo sapiens
agcagcaattttcactgtcaat

SEQ ID NO: 7979796 - DNA, 22 bp, Homo sapiens
agcagcaattttcactgtcaat

SEQ ID NO: 7979797 - DNA, 21 bp, Homo sapiens
agcagagtgctttgactttgt

SEQ ID NO: 7979798 - DNA, 22 bp, Homo sapiens
agcagagtgccccatcacaagg

SEQ ID NO: 7979799 - DNA, 22 bp, Homo sapiens
caacttcagggaaacatgaagc

SEQ ID NO: 7979800 - DNA, 22 bp, Homo sapiens
agcagagtgtgaaggcagggct

SEQ ID NO: 7979801 - DNA, 21 bp, Homo sapiens
agcagagtgctttgactttgt

SEQ ID NO: 7979802 - DNA, 22 bp, Homo sapiens
agcagcaacttatttttcttat

SEQ ID NO: 7979803 - DNA, 22 bp, Homo sapiens
agcagagtgtgaaggcagggct

SEQ ID NO: 7979804 - DNA, 22 bp, Homo sapiens
agcagcaaggaacagaatggac

SEQ ID NO: 7979805 - DNA, 22 bp, Homo sapiens
caaggcagtgggctaggaacct

SEQ ID NO: 7979806 - DNA, 22 bp, Homo sapiens
caaggcagtgggctaggaacct

SEQ ID NO: 7979807 - DNA, 22 bp, Homo sapiens
caaggcagtgggctaggaacct

SEQ ID NO: 7979808 - DNA, 22 bp, Homo sapiens
caaggcagtgggctaggaacct

SEQ ID NO: 7979809 - DNA, 22 bp, Homo sapiens
caaggcagtgggctaggaacct

SEQ ID NO: 7979810 - DNA, 22 bp, Homo sapiens
caaggcagtccctactccctgc

SEQ ID NO: 7979811 - DNA, 22 bp, Homo sapiens
caaggcagtccctactccctgc

SEQ ID NO: 7979812 - DNA, 22 bp, Homo sapiens
caaggcagtccctactccctgc

SEQ ID NO: 7979813 - DNA, 22 bp, Homo sapiens
caaggcagttccccagagggct

SEQ ID NO: 7979814 - DNA, 22 bp, Homo sapiens
caaggcagttccccagagggct

SEQ ID NO: 7979815 - DNA, 22 bp, Homo sapiens
caaggcagtgggctaggaacct

SEQ ID NO: 7979816 - DNA, 22 bp, Homo sapiens
caaggcagttccccagagggct

SEQ ID NO: 7979817 - DNA, 22 bp, Homo sapiens
caaggcagttccccagagggct

SEQ ID NO: 7979818 - DNA, 22 bp, Homo sapiens
caaggcaggtctgaggaggttg

SEQ ID NO: 7979819 - DNA, 22 bp, Homo sapiens
caaggcaggtctgaggaggttg

SEQ ID NO: 7979820 - DNA, 22 bp, Homo sapiens
caaggcaggccagtttcaaggc

SEQ ID NO: 7979821 - DNA, 22 bp, Homo sapiens
caaggcaggcagttcacttgag

SEQ ID NO: 7979822 - DNA, 22 bp, Homo sapiens
caaggcaggtctgaggaggttg

SEQ ID NO: 7979823 - DNA, 22 bp, Homo sapiens
caaggcaggtctgaggaggttg

SEQ ID NO: 7979824 - DNA, 22 bp, Homo sapiens
caaggcaggtctgaggaggttg

SEQ ID NO: 7979825 - DNA, 22 bp, Homo sapiens
caaggcaggtctgaggaggttg

SEQ ID NO: 7979826 - DNA, 22 bp, Homo sapiens
caaggcagtccctactccctgc

SEQ ID NO: 7979827 - DNA, 22 bp, Homo sapiens
caaggcatgaaaggagtgagtg

SEQ ID NO: 7979828 - DNA, 22 bp, Homo sapiens
caaggcatgcaatgtcttcagg

SEQ ID NO: 7979829 - DNA, 22 bp, Homo sapiens
agcagcagggtgtaattgggca

SEQ ID NO: 7979830 - DNA, 22 bp, Homo sapiens
agcagcagggtgtaattgggca

SEQ ID NO: 7979831 - DNA, 22 bp, Homo sapiens
agcagcaggtgacctcgatgcc

SEQ ID NO: 7979832 - DNA, 22 bp, Homo sapiens
agcagcatagaagctgggagga

SEQ ID NO: 7979833 - DNA, 22 bp, Homo sapiens
agcagcaggtgacctcgatgcc

SEQ ID NO: 7979834 - DNA, 22 bp, Homo sapiens
agcagcatagaagctgggagga

SEQ ID NO: 7979835 - DNA, 22 bp, Homo sapiens
agcagcatagatgctatccgag

SEQ ID NO: 7979836 - DNA, 22 bp, Homo sapiens
agcagcatagaagctgggagga

SEQ ID NO: 7979837 - DNA, 22 bp, Homo sapiens
agcagcatagaagctgggagga

SEQ ID NO: 7979838 - DNA, 22 bp, Homo sapiens
agcagcatagatgctatccgag

SEQ ID NO: 7979839 - DNA, 22 bp, Homo sapiens
agcagcatagatgctatccgag

SEQ ID NO: 7979840 - DNA, 22 bp, Homo sapiens
agcagcatatcagagaaagtca

SEQ ID NO: 7979841 - DNA, 22 bp, Homo sapiens
agcagcatatcagagaaagtca

SEQ ID NO: 7979842 - DNA, 22 bp, Homo sapiens
agcagcatattgtgtcttcata

SEQ ID NO: 7979843 - DNA, 22 bp, Homo sapiens
agcagcatcaaccctcccgtgt

SEQ ID NO: 7979844 - DNA, 22 bp, Homo sapiens
agcagcatcaaccctcccgtgt

SEQ ID NO: 7979845 - DNA, 22 bp, Homo sapiens
agcagcatattgtgtcttcata

SEQ ID NO: 7979846 - DNA, 22 bp, Homo sapiens
agcagcatattgtgtcttcata

SEQ ID NO: 7979847 - DNA, 22 bp, Homo sapiens
agcagcatattgtgtcttcata

SEQ ID NO: 7979848 - DNA, 22 bp, Homo sapiens
agcagcatccccggcctccacc

SEQ ID NO: 7979849 - DNA, 21 bp, Homo sapiens
agcagcatcagcctcacctga

SEQ ID NO: 7979850 - DNA, 22 bp, Homo sapiens
agcagcatccccggcctccacc

SEQ ID NO: 7979851 - DNA, 22 bp, Homo sapiens
agcagcatctcttattgcagtg

SEQ ID NO: 7979852 - DNA, 22 bp, Homo sapiens
agcagcatctggttctgatgtg

SEQ ID NO: 7979853 - DNA, 22 bp, Homo sapiens
agcagcatccccggcctccacc

SEQ ID NO: 7979854 - DNA, 21 bp, Homo sapiens
agcagcatcagcctcacctga

SEQ ID NO: 7979855 - DNA, 22 bp, Homo sapiens
agcagcatcaaccctcccgtgt

SEQ ID NO: 7979856 - DNA, 22 bp, Homo sapiens
agcagcatattgtgtcttcata

SEQ ID NO: 7979857 - DNA, 21 bp, Homo sapiens
agcagcatcagcctcacctga

SEQ ID NO: 7979858 - DNA, 22 bp, Homo sapiens
caatgaaattgagatccagaga

SEQ ID NO: 7979859 - DNA, 22 bp, Homo sapiens
caatgaaattgagatccagaga

SEQ ID NO: 7979860 - DNA, 22 bp, Homo sapiens
caatgaaattgagatccagaga

SEQ ID NO: 7979861 - DNA, 22 bp, Homo sapiens
caatgaaattgagatccagaga

SEQ ID NO: 7979862 - DNA, 22 bp, Homo sapiens
caatgaaagcaactgcctataa

SEQ ID NO: 7979863 - DNA, 22 bp, Homo sapiens
caatgaaagcaactgcctataa

SEQ ID NO: 7979864 - DNA, 22 bp, Homo sapiens
caatgaaagcaactgcctataa

SEQ ID NO: 7979865 - DNA, 22 bp, Homo sapiens
caatgaaagcaactgcctataa

SEQ ID NO: 7979866 - DNA, 22 bp, Homo sapiens
caatgaaaatttaagttgcagc

SEQ ID NO: 7979867 - DNA, 22 bp, Homo sapiens
caatgaaaatttaagttgcagc

SEQ ID NO: 7979868 - DNA, 22 bp, Homo sapiens
caatgaaaatttaagttgcagc

SEQ ID NO: 7979869 - DNA, 22 bp, Homo sapiens
caatgaaaatgaggactcctgt

SEQ ID NO: 7979870 - DNA, 22 bp, Homo sapiens
caatgaaaatttaagttgcagc

SEQ ID NO: 7979871 - DNA, 22 bp, Homo sapiens
caatgaaaatttaagttgcagc

SEQ ID NO: 7979872 - DNA, 22 bp, Homo sapiens
caatgaaaatttaagttgcagc

SEQ ID NO: 7979873 - DNA, 22 bp, Homo sapiens
agcagcattctctggtatgggg

SEQ ID NO: 7979874 - DNA, 22 bp, Homo sapiens
agcagcattctctggtatgggg

SEQ ID NO: 7979875 - DNA, 20 bp, Homo sapiens
agcagcattgttctagagca

SEQ ID NO: 7979876 - DNA, 20 bp, Homo sapiens
agcagcattgttctagagca

SEQ ID NO: 7979877 - DNA, 22 bp, Homo sapiens
agcagcatttaagtttcttcta

SEQ ID NO: 7979878 - DNA, 22 bp, Homo sapiens
agcagcatttaaggatccaagt

SEQ ID NO: 7979879 - DNA, 20 bp, Homo sapiens
agcagcattgttctagagca

SEQ ID NO: 7979880 - DNA, 22 bp, Homo sapiens
agcagcattcctggcttctatc

SEQ ID NO: 7979881 - DNA, 20 bp, Homo sapiens
agcagcattgttctagagca

SEQ ID NO: 7979882 - DNA, 22 bp, Homo sapiens
caatgaaaatgaggactcctgt

SEQ ID NO: 7979883 - DNA, 22 bp, Homo sapiens
caatgaaaatgaggactcctgt

SEQ ID NO: 7979884 - DNA, 22 bp, Homo sapiens
agcagcatttaagtttcttcta

SEQ ID NO: 7979885 - DNA, 22 bp, Homo sapiens
caatcttacttttgaaaagtga

SEQ ID NO: 7979886 - DNA, 22 bp, Homo sapiens
caatctggtgaagcagaaaaat

SEQ ID NO: 7979887 - DNA, 22 bp, Homo sapiens
caatctgtacttgaaaaattat

SEQ ID NO: 7979888 - DNA, 22 bp, Homo sapiens
agcagcatctggttctgatgtg

SEQ ID NO: 7979889 - DNA, 22 bp, Homo sapiens
agcagcatcttctaagtaaggc

SEQ ID NO: 7979890 - DNA, 22 bp, Homo sapiens
agcagcatcttctaagtaaggc

SEQ ID NO: 7979891 - DNA, 22 bp, Homo sapiens
agcagcatctggttctgatgtg

SEQ ID NO: 7979892 - DNA, 22 bp, Homo sapiens
agcagcatcttctgttctccgc

SEQ ID NO: 7979893 - DNA, 22 bp, Homo sapiens
agcagcatcttctgttctccgc

SEQ ID NO: 7979894 - DNA, 22 bp, Homo sapiens
agcagcatcttctgttctccgc

SEQ ID NO: 7979895 - DNA, 22 bp, Homo sapiens
agcagcatgatgacagagtctc

SEQ ID NO: 7979896 - DNA, 22 bp, Homo sapiens
agcagcatgatgacagagtctc

SEQ ID NO: 7979897 - DNA, 22 bp, Homo sapiens
agcagcatggatgggcctcagc

SEQ ID NO: 7979898 - DNA, 22 bp, Homo sapiens
agcagcatggctgactaaagac

SEQ ID NO: 7979899 - DNA, 22 bp, Homo sapiens
agcagcatggctgactaaagac

SEQ ID NO: 7979900 - DNA, 22 bp, Homo sapiens
agcagcatggatgggcctcagc

SEQ ID NO: 7979901 - DNA, 22 bp, Homo sapiens
agcagcatggagaaaccgttca

SEQ ID NO: 7979902 - DNA, 22 bp, Homo sapiens
agcagcatgatgacagagtctc

SEQ ID NO: 7979903 - DNA, 22 bp, Homo sapiens
agcagcatgatgacagagtctc

SEQ ID NO: 7979904 - DNA, 22 bp, Homo sapiens
agcagcatgatgacagagtctc

SEQ ID NO: 7979905 - DNA, 22 bp, Homo sapiens
agcagcatgttgggatgtgaaa

SEQ ID NO: 7979906 - DNA, 22 bp, Homo sapiens
agcagcatgttgggatgtgaaa

SEQ ID NO: 7979907 - DNA, 22 bp, Homo sapiens
agcagcatgttgggatgtgaaa

SEQ ID NO: 7979908 - DNA, 22 bp, Homo sapiens
agcagcatgttcattacattat

SEQ ID NO: 7979909 - DNA, 22 bp, Homo sapiens
agcagcatgttcattacattat

SEQ ID NO: 7979910 - DNA, 22 bp, Homo sapiens
agcagcatgttcattacattat

SEQ ID NO: 7979911 - DNA, 22 bp, Homo sapiens
agcagcatgttcattacattat

SEQ ID NO: 7979912 - DNA, 22 bp, Homo sapiens
agcagcatgtatgagggtgaac

SEQ ID NO: 7979913 - DNA, 22 bp, Homo sapiens
agcagcatgtatgagggtgaac

SEQ ID NO: 7979914 - DNA, 22 bp, Homo sapiens
agcagcattaagggaactgcag

SEQ ID NO: 7979915 - DNA, 22 bp, Homo sapiens
agcagcattatgatatatctta

SEQ ID NO: 7979916 - DNA, 22 bp, Homo sapiens
agcagcattatgatatatctta

SEQ ID NO: 7979917 - DNA, 22 bp, Homo sapiens
agcagcattaagggaactgcag

SEQ ID NO: 7979918 - DNA, 22 bp, Homo sapiens
agcagcatgttgggatgtgaaa

SEQ ID NO: 7979919 - DNA, 22 bp, Homo sapiens
agcagcattcctggcttctatc

SEQ ID NO: 7979920 - DNA, 22 bp, Homo sapiens
agcagcattcctggcttctatc

SEQ ID NO: 7979921 - DNA, 22 bp, Homo sapiens
agcagcattatgatatatctta

SEQ ID NO: 7979922 - DNA, 22 bp, Homo sapiens
agcagcattatgatatatctta

SEQ ID NO: 7979923 - DNA, 22 bp, Homo sapiens
agcagaagaggtcttgttgctg

SEQ ID NO: 7979924 - DNA, 22 bp, Homo sapiens
agcagaagaggtcttgttgctg

SEQ ID NO: 7979925 - DNA, 17 bp, Homo sapiens
agcagaagtcagaggga

SEQ ID NO: 7979926 - DNA, 22 bp, Homo sapiens
agcagaagaggtcttgttgctg

SEQ ID NO: 7979927 - DNA, 17 bp, Homo sapiens
agcagaagtcagaggga

SEQ ID NO: 7979928 - DNA, 17 bp, Homo sapiens
agcagaagtcagaggga

SEQ ID NO: 7979929 - DNA, 17 bp, Homo sapiens
agcagaagtcagaggga

SEQ ID NO: 7979930 - DNA, 17 bp, Homo sapiens
agcagaagtcagaggga

SEQ ID NO: 7979931 - DNA, 22 bp, Homo sapiens
agcagaagtgccttagcaatca

SEQ ID NO: 7979932 - DNA, 22 bp, Homo sapiens
agcagaagtgccttagcaatca

SEQ ID NO: 7979933 - DNA, 22 bp, Homo sapiens
agcagaagtgccttagcaatca

SEQ ID NO: 7979934 - DNA, 22 bp, Homo sapiens
agcagaagtgccttagcaatca

SEQ ID NO: 7979935 - DNA, 22 bp, Homo sapiens
caaatgttttttagtataagta

SEQ ID NO: 7979936 - DNA, 22 bp, Homo sapiens
caaattaatgtgtctcaaaata

SEQ ID NO: 7979937 - DNA, 22 bp, Homo sapiens
caaattaatgtgtctcaaaata

SEQ ID NO: 7979938 - DNA, 22 bp, Homo sapiens
caaattaatgtgtctcaaaata

SEQ ID NO: 7979939 - DNA, 22 bp, Homo sapiens
caaattaatgtgtctcaaaata

SEQ ID NO: 7979940 - DNA, 22 bp, Homo sapiens
agcacttaagttaattgaactg

SEQ ID NO: 7979941 - DNA, 22 bp, Homo sapiens
agcagaagaaagccacatgact

SEQ ID NO: 7979942 - DNA, 22 bp, Homo sapiens
agcacttaactgacagtactat

SEQ ID NO: 7979943 - DNA, 22 bp, Homo sapiens
agcactgttatgggatgactta

SEQ ID NO: 7979944 - DNA, 22 bp, Homo sapiens
agcactgtggtggaagcatcaa

SEQ ID NO: 7979945 - DNA, 22 bp, Homo sapiens
agcactgtggtggaagcatcaa

SEQ ID NO: 7979946 - DNA, 22 bp, Homo sapiens
agcactgtggggaactcacaga

SEQ ID NO: 7979947 - DNA, 22 bp, Homo sapiens
agcactgttatgggatgactta

SEQ ID NO: 7979948 - DNA, 22 bp, Homo sapiens
agcactgttatgggatgactta

SEQ ID NO: 7979949 - DNA, 22 bp, Homo sapiens
agcactgtggtggaagcatcaa

SEQ ID NO: 7979950 - DNA, 22 bp, Homo sapiens
caaatgttaagacaggatcaag

SEQ ID NO: 7979951 - DNA, 22 bp, Homo sapiens
caaatgttagtgcccatccctc

SEQ ID NO: 7979952 - DNA, 22 bp, Homo sapiens
caaatgttattcattcttgttt

SEQ ID NO: 7979953 - DNA, 22 bp, Homo sapiens
caaatgttgactaagagggttt

SEQ ID NO: 7979954 - DNA, 22 bp, Homo sapiens
caaatgtttcttatctattgtt

SEQ ID NO: 7979955 - DNA, 22 bp, Homo sapiens
caaatgtttcttatctattgtt

SEQ ID NO: 7979956 - DNA, 22 bp, Homo sapiens
caaatgttgctgtaatgtttgt

SEQ ID NO: 7979957 - DNA, 22 bp, Homo sapiens
caaatgtttcttgaacaccaac

SEQ ID NO: 7979958 - DNA, 22 bp, Homo sapiens
caaatgtttcttgaacaccaac

SEQ ID NO: 7979959 - DNA, 22 bp, Homo sapiens
caaatgtttggtggcattttgt

SEQ ID NO: 7979960 - DNA, 22 bp, Homo sapiens
caaatgtttgcatcacagggca

SEQ ID NO: 7979961 - DNA, 22 bp, Homo sapiens
caaatgtttttattctacaaca

SEQ ID NO: 7979962 - DNA, 22 bp, Homo sapiens
caaatgtttttattctacaaca

SEQ ID NO: 7979963 - DNA, 22 bp, Homo sapiens
caaatgtttttattctacaaca

SEQ ID NO: 7979964 - DNA, 22 bp, Homo sapiens
caaatgttttttagtataagta

SEQ ID NO: 7979965 - DNA, 22 bp, Homo sapiens
caaatgttttttagtataagta

SEQ ID NO: 7979966 - DNA, 22 bp, Homo sapiens
caaatgcagtccctttgttgct

SEQ ID NO: 7979967 - DNA, 22 bp, Homo sapiens
caaatgcaggtcataacctgag

SEQ ID NO: 7979968 - DNA, 22 bp, Homo sapiens
caaatgcatagaaagatgaaac

SEQ ID NO: 7979969 - DNA, 22 bp, Homo sapiens
caaatgcatagaaagatgaaac

SEQ ID NO: 7979970 - DNA, 22 bp, Homo sapiens
caaatgcatagaaagatgaaac

SEQ ID NO: 7979971 - DNA, 22 bp, Homo sapiens
caaatgttaaatgtgttaagac

SEQ ID NO: 7979972 - DNA, 22 bp, Homo sapiens
caaatgttaaatgtgttaagac

SEQ ID NO: 7979973 - DNA, 22 bp, Homo sapiens
caaatgttaagacaggatcaag

SEQ ID NO: 7979974 - DNA, 22 bp, Homo sapiens
caaatgttaaatgtgttaagac

SEQ ID NO: 7979975 - DNA, 22 bp, Homo sapiens
caaatgttaaatgtgttaagac

SEQ ID NO: 7979976 - DNA, 22 bp, Homo sapiens
caaatgcaaaatataaccctgt

SEQ ID NO: 7979977 - DNA, 22 bp, Homo sapiens
caaatgatactgtttttagtct

SEQ ID NO: 7979978 - DNA, 22 bp, Homo sapiens
caaatgcaaaatataaccctgt

SEQ ID NO: 7979979 - DNA, 22 bp, Homo sapiens
caaatgatgcatggctagtgag

SEQ ID NO: 7979980 - DNA, 22 bp, Homo sapiens
caaatgcaggtcagcaggtgtc

SEQ ID NO: 7979981 - DNA, 22 bp, Homo sapiens
caaatgcaggtcagcaggtgtc

SEQ ID NO: 7979982 - DNA, 22 bp, Homo sapiens
caaatgcagattcaggagttct

SEQ ID NO: 7979983 - DNA, 22 bp, Homo sapiens
caaatgcaggtcagcaggtgtc

SEQ ID NO: 7979984 - DNA, 22 bp, Homo sapiens
caaatgcaggtcagcaggtgtc

SEQ ID NO: 7979985 - DNA, 22 bp, Homo sapiens
caaatgcaggtcataacctgag

SEQ ID NO: 7979986 - DNA, 22 bp, Homo sapiens
agcacagctgctgaatgataca

SEQ ID NO: 7979987 - DNA, 20 bp, Homo sapiens
agcacagcgcggtgttcctt

SEQ ID NO: 7979988 - DNA, 20 bp, Homo sapiens
agcacagcgcggtgttcctt

SEQ ID NO: 7979989 - DNA, 22 bp, Homo sapiens
agcacagcctctggtttctgac

SEQ ID NO: 7979990 - DNA, 22 bp, Homo sapiens
agcacagctgctgaatgataca

SEQ ID NO: 7979991 - DNA, 22 bp, Homo sapiens
agcacagctggaaaataaatca

SEQ ID NO: 7979992 - DNA, 22 bp, Homo sapiens
agcacagctgttcaacaggaat

SEQ ID NO: 7979993 - DNA, 22 bp, Homo sapiens
agcacagctgttcaacaggaat

SEQ ID NO: 7979994 - DNA, 22 bp, Homo sapiens
agcacagctgttcaacaggaat

SEQ ID NO: 7979995 - DNA, 21 bp, Homo sapiens
agcacagcatatccaatgtca

SEQ ID NO: 7979996 - DNA, 21 bp, Homo sapiens
agcacagcatatccaatgtca

SEQ ID NO: 7979997 - DNA, 22 bp, Homo sapiens
agcacagcagcgtctaaccgat

SEQ ID NO: 7979998 - DNA, 22 bp, Homo sapiens
agcacagcaccatcctggtacc

SEQ ID NO: 7979999 - DNA, 22 bp, Homo sapiens
agcacagcctctggtttctgac

SEQ ID NO: 7980000 - DNA, 21 bp, Homo sapiens
agcacagcatatccaatgtca

SEQ ID NO: 7980001 - DNA, 22 bp, Homo sapiens
agcacagcctctggtttctgac

SEQ ID NO: 7980002 - DNA, 21 bp, Homo sapiens
agcacagcatatccaatgtca

SEQ ID NO: 7980003 - DNA, 22 bp, Homo sapiens
agcacagccagctttattggcc

SEQ ID NO: 7980004 - DNA, 22 bp, Homo sapiens
caaatgatactgtttttagtct

SEQ ID NO: 7980005 - DNA, 22 bp, Homo sapiens
caaatattccaggtacatccct

SEQ ID NO: 7980006 - DNA, 22 bp, Homo sapiens
agcacagcttagcacctggcac

SEQ ID NO: 7980007 - DNA, 22 bp, Homo sapiens
agcacagcttagcacctggcac

SEQ ID NO: 7980008 - DNA, 22 bp, Homo sapiens
caaatattccaggtacatccct

SEQ ID NO: 7980009 - DNA, 22 bp, Homo sapiens
caaatgatagagccgattatca

SEQ ID NO: 7980010 - DNA, 22 bp, Homo sapiens
caaatgatagagccgattatca

SEQ ID NO: 7980011 - DNA, 22 bp, Homo sapiens
caaatgatccttgcaagctgtg

SEQ ID NO: 7980012 - DNA, 22 bp, Homo sapiens
caaatgatccttgcaagctgtg

SEQ ID NO: 7980013 - DNA, 22 bp, Homo sapiens
attttctcacaatgcagaagga

SEQ ID NO: 7980014 - DNA, 22 bp, Homo sapiens
attttctcacaatgcagaagga

SEQ ID NO: 7980015 - DNA, 22 bp, Homo sapiens
attttctattctgctggtttag

SEQ ID NO: 7980016 - DNA, 22 bp, Homo sapiens
attttctcacaatcctatgggg

SEQ ID NO: 7980017 - DNA, 22 bp, Homo sapiens
attttctcacaatcctatgggg

SEQ ID NO: 7980018 - DNA, 22 bp, Homo sapiens
attttctctcaaaccttaaaat

SEQ ID NO: 7980019 - DNA, 22 bp, Homo sapiens
attttctcacaatgcagaagga

SEQ ID NO: 7980020 - DNA, 22 bp, Homo sapiens
attttctctcaaaccttaaaat

SEQ ID NO: 7980021 - DNA, 22 bp, Homo sapiens
attttctctttgtatatgctag

SEQ ID NO: 7980022 - DNA, 22 bp, Homo sapiens
attttctctttgtatatgctag

SEQ ID NO: 7980023 - DNA, 22 bp, Homo sapiens
attttctctttgtatatgctag

SEQ ID NO: 7980024 - DNA, 22 bp, Homo sapiens
attttctctttgtatatgctag

SEQ ID NO: 7980025 - DNA, 21 bp, Homo sapiens
attttctctggatgatggtca

SEQ ID NO: 7980026 - DNA, 21 bp, Homo sapiens
attttctctggatgatggtca

SEQ ID NO: 7980027 - DNA, 22 bp, Homo sapiens
attttctatgttgtaattgtta

SEQ ID NO: 7980028 - DNA, 22 bp, Homo sapiens
attttctatgttgtaattgtta

SEQ ID NO: 7980029 - DNA, 22 bp, Homo sapiens
attttctattctgctggtttag

SEQ ID NO: 7980030 - DNA, 22 bp, Homo sapiens
attttctattctgctggtttag

SEQ ID NO: 7980031 - DNA, 22 bp, Homo sapiens
attttctatgttgtaattgtta

SEQ ID NO: 7980032 - DNA, 22 bp, Homo sapiens
attttctatgttgtaattgtta

SEQ ID NO: 7980033 - DNA, 22 bp, Homo sapiens
attttctatgttgtaattgtta

SEQ ID NO: 7980034 - DNA, 22 bp, Homo sapiens
attttctatgttgtaattgtta

SEQ ID NO: 7980035 - DNA, 22 bp, Homo sapiens
attttctatgttgtaattgtta

SEQ ID NO: 7980036 - DNA, 21 bp, Homo sapiens
agcaatttttcctcctctgca

SEQ ID NO: 7980037 - DNA, 22 bp, Homo sapiens
attttctgtaactatttctata

SEQ ID NO: 7980038 - DNA, 22 bp, Homo sapiens
attttctgtaactatttctata

SEQ ID NO: 7980039 - DNA, 22 bp, Homo sapiens
attttctgtaactatttctata

SEQ ID NO: 7980040 - DNA, 22 bp, Homo sapiens
agcacaaaagcagccacagatg

SEQ ID NO: 7980041 - DNA, 22 bp, Homo sapiens
attttctgagtccagaatttac

SEQ ID NO: 7980042 - DNA, 22 bp, Homo sapiens
attttctggttgaggtttaaca

SEQ ID NO: 7980043 - DNA, 23 bp, Homo sapiens
agcacagactagaaaggtctttc

SEQ ID NO: 7980044 - DNA, 23 bp, Homo sapiens
agcacagactagaaaggtctttc

SEQ ID NO: 7980045 - DNA, 23 bp, Homo sapiens
agcacagactagaaaggtctttc

SEQ ID NO: 7980046 - DNA, 19 bp, Homo sapiens
agcacagacaagaccagca

SEQ ID NO: 7980047 - DNA, 19 bp, Homo sapiens
agcacagacaagaccagca

SEQ ID NO: 7980048 - DNA, 19 bp, Homo sapiens
agcacagacaagaccagca

SEQ ID NO: 7980049 - DNA, 23 bp, Homo sapiens
agcacagactagaaaggtctttc

SEQ ID NO: 7980050 - DNA, 22 bp, Homo sapiens
agcacagactggtcccaggtct

SEQ ID NO: 7980051 - DNA, 22 bp, Homo sapiens
agcacagagaaactaagacatt

SEQ ID NO: 7980052 - DNA, 22 bp, Homo sapiens
agcacagactggtcccaggtct

SEQ ID NO: 7980053 - DNA, 22 bp, Homo sapiens
agcacagactggtcccaggtct

SEQ ID NO: 7980054 - DNA, 22 bp, Homo sapiens
agcacagagaaactaagacatt

SEQ ID NO: 7980055 - DNA, 22 bp, Homo sapiens
agcacagagaaactaagacatt

SEQ ID NO: 7980056 - DNA, 22 bp, Homo sapiens
agcacagagaaactaagacatt

SEQ ID NO: 7980057 - DNA, 22 bp, Homo sapiens
agcacagagaaactaagacatt

SEQ ID NO: 7980058 - DNA, 22 bp, Homo sapiens
agcacagagttgcagagagcgt

SEQ ID NO: 7980059 - DNA, 22 bp, Homo sapiens
agcacagataacatggagtgga

SEQ ID NO: 7980060 - DNA, 22 bp, Homo sapiens
agcacagataacatggagtgga

SEQ ID NO: 7980061 - DNA, 22 bp, Homo sapiens
agcacagataacatggagtgga

SEQ ID NO: 7980062 - DNA, 22 bp, Homo sapiens
agcacagagttgctcactgccg

SEQ ID NO: 7980063 - DNA, 22 bp, Homo sapiens
agcacagagttgctcactgccg

SEQ ID NO: 7980064 - DNA, 22 bp, Homo sapiens
agcacagatgcatgatcaccag

SEQ ID NO: 7980065 - DNA, 22 bp, Homo sapiens
agcacagatgcatgatcaccag

SEQ ID NO: 7980066 - DNA, 22 bp, Homo sapiens
agcacagataacatggagtgga

SEQ ID NO: 7980067 - DNA, 22 bp, Homo sapiens
agcacagataacatggagtgga

SEQ ID NO: 7980068 - DNA, 22 bp, Homo sapiens
agcacagatggatgtattcatt

SEQ ID NO: 7980069 - DNA, 22 bp, Homo sapiens
agcacagatggatgtattcatt

SEQ ID NO: 7980070 - DNA, 22 bp, Homo sapiens
agcacagatgtactttgagggg

SEQ ID NO: 7980071 - DNA, 22 bp, Homo sapiens
agcacagatgtgagtggaggct

SEQ ID NO: 7980072 - DNA, 22 bp, Homo sapiens
agcacagatgtgagtggaggct

SEQ ID NO: 7980073 - DNA, 22 bp, Homo sapiens
agcacagatgtgagtggaggct

SEQ ID NO: 7980074 - DNA, 22 bp, Homo sapiens
agcacagatgtgagtggaggct

SEQ ID NO: 7980075 - DNA, 22 bp, Homo sapiens
agcacagatgtactttgagggg

SEQ ID NO: 7980076 - DNA, 22 bp, Homo sapiens
agcacagattctgaagagtcct

SEQ ID NO: 7980077 - DNA, 22 bp, Homo sapiens
agcacagattctgaagagtcct

SEQ ID NO: 7980078 - DNA, 22 bp, Homo sapiens
agcacagattctgaagagtcct

SEQ ID NO: 7980079 - DNA, 22 bp, Homo sapiens
agcacagattctgaagagtcct

SEQ ID NO: 7980080 - DNA, 22 bp, Homo sapiens
agcacagattctgaagagtcct

SEQ ID NO: 7980081 - DNA, 22 bp, Homo sapiens
agcacagatgtgagtggaggct

SEQ ID NO: 7980082 - DNA, 22 bp, Homo sapiens
agcacagatttgtcaacataga

SEQ ID NO: 7980083 - DNA, 22 bp, Homo sapiens
agcacagatttgtcaacataga

SEQ ID NO: 7980084 - DNA, 22 bp, Homo sapiens
agcacagatttgtcaacataga

SEQ ID NO: 7980085 - DNA, 22 bp, Homo sapiens
agcacagattctgaagagtcct

SEQ ID NO: 7980086 - DNA, 22 bp, Homo sapiens
agcacagatttgtcaacataga

SEQ ID NO: 7980087 - DNA, 22 bp, Homo sapiens
agcacagcaagtgggttattaa

SEQ ID NO: 7980088 - DNA, 22 bp, Homo sapiens
agcacagagttgcagagagcgt

SEQ ID NO: 7980089 - DNA, 22 bp, Homo sapiens
agcacagagttgcagagagcgt

SEQ ID NO: 7980090 - DNA, 22 bp, Homo sapiens
agcacagagttgcagagagcgt

SEQ ID NO: 7980091 - DNA, 22 bp, Homo sapiens
agcacagagttgcagagagcgt

SEQ ID NO: 7980092 - DNA, 22 bp, Homo sapiens
agcacagagttgcagagagcgt

SEQ ID NO: 7980093 - DNA, 22 bp, Homo sapiens
agcacagagttgcagagagcgt

SEQ ID NO: 7980094 - DNA, 22 bp, Homo sapiens
agcacagagttgcagagagcgt

SEQ ID NO: 7980095 - DNA, 22 bp, Homo sapiens
agcacagagttgcagagagcgt

SEQ ID NO: 7980096 - DNA, 22 bp, Homo sapiens
agcacagaggtggaagtgtata

SEQ ID NO: 7980097 - DNA, 22 bp, Homo sapiens
agcacagaggtggaagtgtata

SEQ ID NO: 7980098 - DNA, 22 bp, Homo sapiens
agcacagagttgcagagagcgt

SEQ ID NO: 7980099 - DNA, 22 bp, Homo sapiens
agcacagagctcggggaatgga

SEQ ID NO: 7980100 - DNA, 22 bp, Homo sapiens
agcacagagctcggggaatgga

SEQ ID NO: 7980101 - DNA, 22 bp, Homo sapiens
agcacagagattatttacaaga

SEQ ID NO: 7980102 - DNA, 22 bp, Homo sapiens
agcacagagctaggagtggagg

SEQ ID NO: 7980103 - DNA, 22 bp, Homo sapiens
agcacagagctaggagtggagg

SEQ ID NO: 7980104 - DNA, 22 bp, Homo sapiens
agcacagagctaggagtggagg

SEQ ID NO: 7980105 - DNA, 22 bp, Homo sapiens
agcacagagattatttacaaga

SEQ ID NO: 7980106 - DNA, 22 bp, Homo sapiens
agcacagagctaggagtggagg

SEQ ID NO: 7980107 - DNA, 22 bp, Homo sapiens
agcacagagattatttacaaga

SEQ ID NO: 7980108 - DNA, 22 bp, Homo sapiens
agcacagagagctctaggtaaa

SEQ ID NO: 7980109 - DNA, 22 bp, Homo sapiens
agcacagagagctctaggtaaa

SEQ ID NO: 7980110 - DNA, 22 bp, Homo sapiens
agcacagagaagatttcaatta

SEQ ID NO: 7980111 - DNA, 22 bp, Homo sapiens
agcacagagaaactaagacatt

SEQ ID NO: 7980112 - DNA, 23 bp, Homo sapiens
agcagctgtggtttaccttagta

SEQ ID NO: 7980113 - DNA, 20 bp, Homo sapiens
agcagctgtgttttcatcct

SEQ ID NO: 7980114 - DNA, 23 bp, Homo sapiens
agcagctgtggtttaccttagta

SEQ ID NO: 7980115 - DNA, 20 bp, Homo sapiens
agcagctgtgttttcatcct

SEQ ID NO: 7980116 - DNA, 22 bp, Homo sapiens
agcagctgttagaaacaggaag

SEQ ID NO: 7980117 - DNA, 22 bp, Homo sapiens
agcagctgttagaaacaggaag

SEQ ID NO: 7980118 - DNA, 20 bp, Homo sapiens
agcagctgtgttttcatcct

SEQ ID NO: 7980119 - DNA, 20 bp, Homo sapiens
agcagctgtgttttcatcct

SEQ ID NO: 7980120 - DNA, 20 bp, Homo sapiens
agcagctgtgttttcatcct

SEQ ID NO: 7980121 - DNA, 22 bp, Homo sapiens
agcagctgtggggacaagggta

SEQ ID NO: 7980122 - DNA, 22 bp, Homo sapiens
agcagctgtgggcaatatgtaa

SEQ ID NO: 7980123 - DNA, 22 bp, Homo sapiens
agcagctgtggggacaagggta

SEQ ID NO: 7980124 - DNA, 22 bp, Homo sapiens
agcagctgtggggacaagggta

SEQ ID NO: 7980125 - DNA, 22 bp, Homo sapiens
agcagctgtggggacaagggta

SEQ ID NO: 7980126 - DNA, 22 bp, Homo sapiens
agcagctgtgggcaatatgtaa

SEQ ID NO: 7980127 - DNA, 22 bp, Homo sapiens
agcagctgtggggacaagggta

SEQ ID NO: 7980128 - DNA, 22 bp, Homo sapiens
agcagctgtggggacaagggta

SEQ ID NO: 7980129 - DNA, 23 bp, Homo sapiens
agcagctgtggtttaccttagta

SEQ ID NO: 7980130 - DNA, 23 bp, Homo sapiens
agcagctgtggtttaccttagta

SEQ ID NO: 7980131 - DNA, 23 bp, Homo sapiens
agcagctgtggtttaccttagta

SEQ ID NO: 7980132 - DNA, 23 bp, Homo sapiens
agcagctgtggtttaccttagta

SEQ ID NO: 7980133 - DNA, 22 bp, Homo sapiens
agcagctgttagaaacaggaag

SEQ ID NO: 7980134 - DNA, 22 bp, Homo sapiens
agcagctgttagaaacaggaag

SEQ ID NO: 7980135 - DNA, 22 bp, Homo sapiens
agcagctgttagaaacaggaag

SEQ ID NO: 7980136 - DNA, 22 bp, Homo sapiens
agcagctgtttgttgaattggt

SEQ ID NO: 7980137 - DNA, 22 bp, Homo sapiens
agcagctgtttgttgaattggt

SEQ ID NO: 7980138 - DNA, 22 bp, Homo sapiens
agcagctgtttgttgaattggt

SEQ ID NO: 7980139 - DNA, 22 bp, Homo sapiens
agcagctgttagaaacaggaag

SEQ ID NO: 7980140 - DNA, 22 bp, Homo sapiens
agcagctgtttgttgaattggt

SEQ ID NO: 7980141 - DNA, 22 bp, Homo sapiens
agcagctgtttgttgaattggt

SEQ ID NO: 7980142 - DNA, 22 bp, Homo sapiens
agcagctgtttgttgaattggt

SEQ ID NO: 7980143 - DNA, 22 bp, Homo sapiens
agcagctgtttgttgaattggt

SEQ ID NO: 7980144 - DNA, 19 bp, Homo sapiens
agcagcttaattttgtagc

SEQ ID NO: 7980145 - DNA, 22 bp, Homo sapiens
agcagctgtttgttgaattggt

SEQ ID NO: 7980146 - DNA, 19 bp, Homo sapiens
agcagcttaattttgtagc

SEQ ID NO: 7980147 - DNA, 22 bp, Homo sapiens
agcagcttacatgtggcctatc

SEQ ID NO: 7980148 - DNA, 22 bp, Homo sapiens
agcagcttatcttggagaggca

SEQ ID NO: 7980149 - DNA, 22 bp, Homo sapiens
agcagcttagggaattctccct

SEQ ID NO: 7980150 - DNA, 22 bp, Homo sapiens
agcagcttatcttggagaggca

SEQ ID NO: 7980151 - DNA, 22 bp, Homo sapiens
agcagcttcctgctcttcgcct

SEQ ID NO: 7980152 - DNA, 22 bp, Homo sapiens
agcagcttcagaggcgggcgca

SEQ ID NO: 7980153 - DNA, 22 bp, Homo sapiens
agcagcttcaattttctaagtg

SEQ ID NO: 7980154 - DNA, 22 bp, Homo sapiens
agcagcttcctgtttgcaggca

SEQ ID NO: 7980155 - DNA, 22 bp, Homo sapiens
agcagcttcctgctcttcgcct

SEQ ID NO: 7980156 - DNA, 22 bp, Homo sapiens
agcagcttctattttcttggtt

SEQ ID NO: 7980157 - DNA, 22 bp, Homo sapiens
agcagcttctttcactcctgga

SEQ ID NO: 7980158 - DNA, 22 bp, Homo sapiens
cacaggaagctgactgctggca

SEQ ID NO: 7980159 - DNA, 22 bp, Homo sapiens
cacaggaagctgactgctggca

SEQ ID NO: 7980160 - DNA, 22 bp, Homo sapiens
cacaggagctgtggggcagtgt

SEQ ID NO: 7980161 - DNA, 22 bp, Homo sapiens
cacaggagctgtggggcagtgt

SEQ ID NO: 7980162 - DNA, 22 bp, Homo sapiens
cacaggagctgtggggcagtgt

SEQ ID NO: 7980163 - DNA, 22 bp, Homo sapiens
cacaggaggaggccagagcgta

SEQ ID NO: 7980164 - DNA, 22 bp, Homo sapiens
cacaggagccctgaggcctccc

SEQ ID NO: 7980165 - DNA, 22 bp, Homo sapiens
cacaggagccctgaggcctccc

SEQ ID NO: 7980166 - DNA, 22 bp, Homo sapiens
cacaggagccctgaggcctccc

SEQ ID NO: 7980167 - DNA, 22 bp, Homo sapiens
cacaggagccctgaggcctccc

SEQ ID NO: 7980168 - DNA, 22 bp, Homo sapiens
cacaggagctgtggggcagtgt

SEQ ID NO: 7980169 - DNA, 22 bp, Homo sapiens
cacaggagccctgaggcctccc

SEQ ID NO: 7980170 - DNA, 18 bp, Homo sapiens
agcagctgtgccacactg

SEQ ID NO: 7980171 - DNA, 22 bp, Homo sapiens
agcagctgtggaaaagtaacta

SEQ ID NO: 7980172 - DNA, 22 bp, Homo sapiens
agcagctgtggaaaagtaacta

SEQ ID NO: 7980173 - DNA, 18 bp, Homo sapiens
agcagctgtgccacactg

SEQ ID NO: 7980174 - DNA, 18 bp, Homo sapiens
agcagctgtgccacactg

SEQ ID NO: 7980175 - DNA, 18 bp, Homo sapiens
agcagctgtgccacactg

SEQ ID NO: 7980176 - DNA, 18 bp, Homo sapiens
agcagctgtgccacactg

SEQ ID NO: 7980177 - DNA, 22 bp, Homo sapiens
agcagctgtggaaaagtaacta

SEQ ID NO: 7980178 - DNA, 23 bp, Homo sapiens
agcagctgtggagttttgcattt

SEQ ID NO: 7980179 - DNA, 23 bp, Homo sapiens
agcagctgtggagttttgcattt

SEQ ID NO: 7980180 - DNA, 23 bp, Homo sapiens
agcagctgtggagttttgcattt

SEQ ID NO: 7980181 - DNA, 23 bp, Homo sapiens
agcagctgtggagttttgcattt

SEQ ID NO: 7980182 - DNA, 23 bp, Homo sapiens
agcagctgtggagttttgcattt

SEQ ID NO: 7980183 - DNA, 23 bp, Homo sapiens
agcagctgtggagttttgcattt

SEQ ID NO: 7980184 - DNA, 22 bp, Homo sapiens
agcagctgtgggcaatatgtaa

SEQ ID NO: 7980185 - DNA, 22 bp, Homo sapiens
agcagctgtgggcaatatgtaa

SEQ ID NO: 7980186 - DNA, 22 bp, Homo sapiens
agcagctgtgggcaatatgtaa

SEQ ID NO: 7980187 - DNA, 18 bp, Homo sapiens
agcagctgtcagaatgcc

SEQ ID NO: 7980188 - DNA, 22 bp, Homo sapiens
agcagctgtcccttaacatcag

SEQ ID NO: 7980189 - DNA, 18 bp, Homo sapiens
agcagctgtgccacactg

SEQ ID NO: 7980190 - DNA, 22 bp, Homo sapiens
agcagctgtcccttaacatcag

SEQ ID NO: 7980191 - DNA, 18 bp, Homo sapiens
agcagctgtgccacactg

SEQ ID NO: 7980192 - DNA, 22 bp, Homo sapiens
agcagctgtcccttaacatcag

SEQ ID NO: 7980193 - DNA, 22 bp, Homo sapiens
agcagctgtcccttaacatcag

SEQ ID NO: 7980194 - DNA, 19 bp, Homo sapiens
agcagctgtagatagacac

SEQ ID NO: 7980195 - DNA, 19 bp, Homo sapiens
agcagctgtagatagacac

SEQ ID NO: 7980196 - DNA, 18 bp, Homo sapiens
agcagctgtcagaatgcc

SEQ ID NO: 7980197 - DNA, 19 bp, Homo sapiens
agcagctgtagatagacac

SEQ ID NO: 7980198 - DNA, 18 bp, Homo sapiens
agcagctgtcagaatgcc

SEQ ID NO: 7980199 - DNA, 18 bp, Homo sapiens
agcagctgtcagaatgcc

SEQ ID NO: 7980200 - DNA, 18 bp, Homo sapiens
agcagctgtcagaatgcc

SEQ ID NO: 7980201 - DNA, 18 bp, Homo sapiens
agcagctgtcagaatgcc

SEQ ID NO: 7980202 - DNA, 18 bp, Homo sapiens
agcagctgtcagaatgcc

SEQ ID NO: 7980203 - DNA, 21 bp, Homo sapiens
agcagctgggcaacatggagg

SEQ ID NO: 7980204 - DNA, 22 bp, Homo sapiens
agcagctgggctcagagctggg

SEQ ID NO: 7980205 - DNA, 22 bp, Homo sapiens
caatgataatggctgtatttat

SEQ ID NO: 7980206 - DNA, 21 bp, Homo sapiens
agcagctgggcaacatggagg

SEQ ID NO: 7980207 - DNA, 21 bp, Homo sapiens
agcagctgggcaacatggagg

SEQ ID NO: 7980208 - DNA, 22 bp, Homo sapiens
agcagctgggctcagagctggg

SEQ ID NO: 7980209 - DNA, 22 bp, Homo sapiens
agcagctgggctcagagctggg

SEQ ID NO: 7980210 - DNA, 22 bp, Homo sapiens
agcagctgggctcagagctggg

SEQ ID NO: 7980211 - DNA, 22 bp, Homo sapiens
agcagctgtactttcatctgtt

SEQ ID NO: 7980212 - DNA, 22 bp, Homo sapiens
agcagctgtactttcatctgtt

SEQ ID NO: 7980213 - DNA, 22 bp, Homo sapiens
agcagctgggctcagagctggg

SEQ ID NO: 7980214 - DNA, 22 bp, Homo sapiens
agcagctgtactttcatctgtt

SEQ ID NO: 7980215 - DNA, 22 bp, Homo sapiens
agcagctgtactttcatctgtt

SEQ ID NO: 7980216 - DNA, 22 bp, Homo sapiens
agcagctgtactttcatctgtt

SEQ ID NO: 7980217 - DNA, 22 bp, Homo sapiens
agcagctgtactttcatctgtt

SEQ ID NO: 7980218 - DNA, 19 bp, Homo sapiens
agcagctgtagatagacac

SEQ ID NO: 7980219 - DNA, 19 bp, Homo sapiens
agcagctgtagatagacac

SEQ ID NO: 7980220 - DNA, 19 bp, Homo sapiens
agcagctgtagatagacac

SEQ ID NO: 7980221 - DNA, 19 bp, Homo sapiens
agcagctgtagatagacac

SEQ ID NO: 7980222 - DNA, 22 bp, Homo sapiens
caatgacatggataatcatatt

SEQ ID NO: 7980223 - DNA, 22 bp, Homo sapiens
caatgacatctccctgctctaa

SEQ ID NO: 7980224 - DNA, 22 bp, Homo sapiens
caatgacatggataatcatatt

SEQ ID NO: 7980225 - DNA, 22 bp, Homo sapiens
caatgacatggataatcatatt

SEQ ID NO: 7980226 - DNA, 22 bp, Homo sapiens
caatgacaggttcatgactcct

SEQ ID NO: 7980227 - DNA, 22 bp, Homo sapiens
caatgacactctgcacagtgct

SEQ ID NO: 7980228 - DNA, 22 bp, Homo sapiens
cacagtatgatctaaagtaagt

SEQ ID NO: 7980229 - DNA, 22 bp, Homo sapiens
cacagtattcactgggcagatt

SEQ ID NO: 7980230 - DNA, 22 bp, Homo sapiens
cacagtatgatctaaagtaagt

SEQ ID NO: 7980231 - DNA, 22 bp, Homo sapiens
cacagtatgatctaaagtaagt

SEQ ID NO: 7980232 - DNA, 22 bp, Homo sapiens
cacagtatgatctaaagtaagt

SEQ ID NO: 7980233 - DNA, 22 bp, Homo sapiens
cacagtacttaattctctaaat

SEQ ID NO: 7980234 - DNA, 22 bp, Homo sapiens
cacagtatcttttgagtaagca

SEQ ID NO: 7980235 - DNA, 22 bp, Homo sapiens
cacagggcttctcatggggtgc

SEQ ID NO: 7980236 - DNA, 22 bp, Homo sapiens
cacagggcttctcatggggtgc

SEQ ID NO: 7980237 - DNA, 22 bp, Homo sapiens
cacagggctaaatgaagggttg

SEQ ID NO: 7980238 - DNA, 22 bp, Homo sapiens
cacagggctaaatgaagggttg

SEQ ID NO: 7980239 - DNA, 22 bp, Homo sapiens
cacagggccttgtgtgactgca

SEQ ID NO: 7980240 - DNA, 22 bp, Homo sapiens
cacagggctaaatgaagggttg

SEQ ID NO: 7980241 - DNA, 22 bp, Homo sapiens
cacagggctttgatggctgagt

SEQ ID NO: 7980242 - DNA, 22 bp, Homo sapiens
cacagggctttgatggctgagt

SEQ ID NO: 7980243 - DNA, 22 bp, Homo sapiens
cacagggcttctcatggggtgc

SEQ ID NO: 7980244 - DNA, 22 bp, Homo sapiens
cacagggcttctcatggggtgc

SEQ ID NO: 7980245 - DNA, 22 bp, Homo sapiens
cacaggctgcccgcagctggga

SEQ ID NO: 7980246 - DNA, 23 bp, Homo sapiens
cacaggctgcgcataagcttctc

SEQ ID NO: 7980247 - DNA, 22 bp, Homo sapiens
cacagggcaggtactctcagag

SEQ ID NO: 7980248 - DNA, 19 bp, Homo sapiens
cacagggcaggtctcatgt

SEQ ID NO: 7980249 - DNA, 19 bp, Homo sapiens
cacagggcaggtctcatgt

SEQ ID NO: 7980250 - DNA, 22 bp, Homo sapiens
cacagggcaggtactctcagag

SEQ ID NO: 7980251 - DNA, 22 bp, Homo sapiens
cacagggcagtgctgcccactc

SEQ ID NO: 7980252 - DNA, 22 bp, Homo sapiens
cacagggcagtgctgcccactc

SEQ ID NO: 7980253 - DNA, 22 bp, Homo sapiens
cacagggcagtgattgtccaca

SEQ ID NO: 7980254 - DNA, 19 bp, Homo sapiens
cacagggcaggtctcatgt

SEQ ID NO: 7980255 - DNA, 22 bp, Homo sapiens
cacagggcctggggcagctgct

SEQ ID NO: 7980256 - DNA, 22 bp, Homo sapiens
cacagggcctggggcagctgct

SEQ ID NO: 7980257 - DNA, 22 bp, Homo sapiens
cacagggcctggggcagctgct

SEQ ID NO: 7980258 - DNA, 22 bp, Homo sapiens
cacagggcctggggcagctgct

SEQ ID NO: 7980259 - DNA, 22 bp, Homo sapiens
cacagggcctggggcagctgct

SEQ ID NO: 7980260 - DNA, 22 bp, Homo sapiens
cacagggccttgtgtgactgca

SEQ ID NO: 7980261 - DNA, 22 bp, Homo sapiens
cacagggccttgtgtgactgca

SEQ ID NO: 7980262 - DNA, 22 bp, Homo sapiens
cacagggccttgtgtgactgca

SEQ ID NO: 7980263 - DNA, 22 bp, Homo sapiens
cacagggccactttcccagtaa

SEQ ID NO: 7980264 - DNA, 22 bp, Homo sapiens
cacagggcctggggcagctgct

SEQ ID NO: 7980265 - DNA, 22 bp, Homo sapiens
cacagggccactttcccagtaa

SEQ ID NO: 7980266 - DNA, 22 bp, Homo sapiens
cacagggcctggggcagctgct

SEQ ID NO: 7980267 - DNA, 22 bp, Homo sapiens
agcaggagaacactgtggctct

SEQ ID NO: 7980268 - DNA, 22 bp, Homo sapiens
agcaggagaacactgtggctct

SEQ ID NO: 7980269 - DNA, 22 bp, Homo sapiens
agcaggagaacactgtggctct

SEQ ID NO: 7980270 - DNA, 22 bp, Homo sapiens
agcaggagaacactgtggctct

SEQ ID NO: 7980271 - DNA, 22 bp, Homo sapiens
agcaggagaacactgtggctct

SEQ ID NO: 7980272 - DNA, 22 bp, Homo sapiens
cacaggaggttaggaagtggtc

SEQ ID NO: 7980273 - DNA, 22 bp, Homo sapiens
cacaggaggttaggaagtggtc

SEQ ID NO: 7980274 - DNA, 22 bp, Homo sapiens
cacaggagggagcgggcagcca

SEQ ID NO: 7980275 - DNA, 22 bp, Homo sapiens
cacaggagggagcgggcagcca

SEQ ID NO: 7980276 - DNA, 22 bp, Homo sapiens
cacaggagggagcgggcagcca

SEQ ID NO: 7980277 - DNA, 22 bp, Homo sapiens
cacaggagggagcgggcagcca

SEQ ID NO: 7980278 - DNA, 22 bp, Homo sapiens
cacaggaggttaggaagtggtc

SEQ ID NO: 7980279 - DNA, 22 bp, Homo sapiens
cacaggaggaggtgcccgggcc

SEQ ID NO: 7980280 - DNA, 22 bp, Homo sapiens
cacaggaggaggtgcccgggcc

SEQ ID NO: 7980281 - DNA, 22 bp, Homo sapiens
cacaggaggaggccagagcgta

SEQ ID NO: 7980282 - DNA, 22 bp, Homo sapiens
cacaggaggaggccagagcgta

SEQ ID NO: 7980283 - DNA, 22 bp, Homo sapiens
cacaggaggaggccagagcgta

SEQ ID NO: 7980284 - DNA, 22 bp, Homo sapiens
cacaggaggaggtgcccgggcc

SEQ ID NO: 7980285 - DNA, 22 bp, Homo sapiens
cacaggaggaggtgcccgggcc

SEQ ID NO: 7980286 - DNA, 22 bp, Homo sapiens
cacaggagggagcgggcagcca

SEQ ID NO: 7980287 - DNA, 22 bp, Homo sapiens
cacaggagggagcgggcagcca

SEQ ID NO: 7980288 - DNA, 22 bp, Homo sapiens
cacaggaggcaatggtaagatt

SEQ ID NO: 7980289 - DNA, 22 bp, Homo sapiens
agcaggagacatgggggtggtg

SEQ ID NO: 7980290 - DNA, 22 bp, Homo sapiens
agcaggagacatgggggtggtg

SEQ ID NO: 7980291 - DNA, 22 bp, Homo sapiens
agcaggagacatgggggtggtg

SEQ ID NO: 7980292 - DNA, 22 bp, Homo sapiens
agcaggagaacactgtggctct

SEQ ID NO: 7980293 - DNA, 22 bp, Homo sapiens
agcaggagaacactgtggctct

SEQ ID NO: 7980294 - DNA, 22 bp, Homo sapiens
agcaggagacatgggggtggtg

SEQ ID NO: 7980295 - DNA, 22 bp, Homo sapiens
agcaggagaacactgtggctct

SEQ ID NO: 7980296 - DNA, 22 bp, Homo sapiens
agcaggagacatgggggtggtg

SEQ ID NO: 7980297 - DNA, 22 bp, Homo sapiens
agcaggagagcagtgcgtggtc

SEQ ID NO: 7980298 - DNA, 22 bp, Homo sapiens
agcaggagagcagtgcgtggtc

SEQ ID NO: 7980299 - DNA, 22 bp, Homo sapiens
agcaggagagcagtgcgtggtc

SEQ ID NO: 7980300 - DNA, 22 bp, Homo sapiens
agcaggagcatttccatgattc

SEQ ID NO: 7980301 - DNA, 22 bp, Homo sapiens
agcaggagatggggcgtgatgt

SEQ ID NO: 7980302 - DNA, 22 bp, Homo sapiens
agcaggagatggggcgtgatgt

SEQ ID NO: 7980303 - DNA, 22 bp, Homo sapiens
agcaggagcatttccatgattc

SEQ ID NO: 7980304 - DNA, 22 bp, Homo sapiens
cacaggctgcccgcagctggga

SEQ ID NO: 7980305 - DNA, 22 bp, Homo sapiens
agcaggagatggggcgtgatgt

SEQ ID NO: 7980306 - DNA, 22 bp, Homo sapiens
agcaggagatggggcgtgatgt

SEQ ID NO: 7980307 - DNA, 22 bp, Homo sapiens
agcaggagagcagtgcgtggtc

SEQ ID NO: 7980308 - DNA, 22 bp, Homo sapiens
agcaggagagcagtgcgtggtc

SEQ ID NO: 7980309 - DNA, 22 bp, Homo sapiens
agcaggagagcagtgcgtggtc

SEQ ID NO: 7980310 - DNA, 22 bp, Homo sapiens
agcaggagagcagtgcgtggtc

SEQ ID NO: 7980311 - DNA, 22 bp, Homo sapiens
agcaggtgatgtgagtctggaa

SEQ ID NO: 7980312 - DNA, 22 bp, Homo sapiens
agcaggtgatgtgagtctggaa

SEQ ID NO: 7980313 - DNA, 22 bp, Homo sapiens
agcaggtgcatggcgagcgcgg

SEQ ID NO: 7980314 - DNA, 22 bp, Homo sapiens
agcaggtgatcgcgtgtgctcc

SEQ ID NO: 7980315 - DNA, 22 bp, Homo sapiens
agcaggtgatgtgagtctggaa

SEQ ID NO: 7980316 - DNA, 22 bp, Homo sapiens
agcaggtgatcgcgtgtgctcc

SEQ ID NO: 7980317 - DNA, 22 bp, Homo sapiens
agcaggtgatgtgagtctggaa

SEQ ID NO: 7980318 - DNA, 22 bp, Homo sapiens
cacatctgacttccagtgcagg

SEQ ID NO: 7980319 - DNA, 22 bp, Homo sapiens
cacatctgacttccagtgcagg

SEQ ID NO: 7980320 - DNA, 22 bp, Homo sapiens
cacatctgcgctctgcctcata

SEQ ID NO: 7980321 - DNA, 22 bp, Homo sapiens
cacatctgacttccagtgcagg

SEQ ID NO: 7980322 - DNA, 22 bp, Homo sapiens
cacatctgacttccagtgcagg

SEQ ID NO: 7980323 - DNA, 22 bp, Homo sapiens
cacatctgcgctctgcctcata

SEQ ID NO: 7980324 - DNA, 22 bp, Homo sapiens
cacatctgggttctcttcttca

SEQ ID NO: 7980325 - DNA, 22 bp, Homo sapiens
cacatctgctctgggcagcact

SEQ ID NO: 7980326 - DNA, 22 bp, Homo sapiens
cacatctgcgctctgcctcata

SEQ ID NO: 7980327 - DNA, 22 bp, Homo sapiens
cacatctgctctgggcagcact

SEQ ID NO: 7980328 - DNA, 22 bp, Homo sapiens
cacatcttcttaactccaaagt

SEQ ID NO: 7980329 - DNA, 22 bp, Homo sapiens
cacatctgggttctcttcttca

SEQ ID NO: 7980330 - DNA, 22 bp, Homo sapiens
cacatcttccagagtagctaaa

SEQ ID NO: 7980331 - DNA, 23 bp, Homo sapiens
agcaggtaggttgaaattttcct

SEQ ID NO: 7980332 - DNA, 21 bp, Homo sapiens
agcaggtaggcattcatactg

SEQ ID NO: 7980333 - DNA, 22 bp, Homo sapiens
cacatgaacatgctggaaaagc

SEQ ID NO: 7980334 - DNA, 22 bp, Homo sapiens
agcaggtatgacatagatatgt

SEQ ID NO: 7980335 - DNA, 22 bp, Homo sapiens
agcaggtataggaggtatcctg

SEQ ID NO: 7980336 - DNA, 22 bp, Homo sapiens
cacatcaggtagacctacagag

SEQ ID NO: 7980337 - DNA, 22 bp, Homo sapiens
cacatcaggtagacctacagag

SEQ ID NO: 7980338 - DNA, 22 bp, Homo sapiens
cacatcatagagactcaatcca

SEQ ID NO: 7980339 - DNA, 22 bp, Homo sapiens
cacatcatagagactcaatcca

SEQ ID NO: 7980340 - DNA, 22 bp, Homo sapiens
cacatcatgttaattcattaca

SEQ ID NO: 7980341 - DNA, 22 bp, Homo sapiens
cacatcatgttaattcattaca

SEQ ID NO: 7980342 - DNA, 22 bp, Homo sapiens
cacatccctggagttacccagt

SEQ ID NO: 7980343 - DNA, 22 bp, Homo sapiens
cacatcctatcagtcacggttt

SEQ ID NO: 7980344 - DNA, 22 bp, Homo sapiens
cacatccctggagttacccagt

SEQ ID NO: 7980345 - DNA, 19 bp, Homo sapiens
cacatcagcagggctgtgg

SEQ ID NO: 7980346 - DNA, 19 bp, Homo sapiens
cacatcagcagggctgtgg

SEQ ID NO: 7980347 - DNA, 22 bp, Homo sapiens
agcagggctctgccatgggccc

SEQ ID NO: 7980348 - DNA, 22 bp, Homo sapiens
cacatcaagcatccatgagttt

SEQ ID NO: 7980349 - DNA, 22 bp, Homo sapiens
cacatatttgatgaagctttgt

SEQ ID NO: 7980350 - DNA, 22 bp, Homo sapiens
cacatatttgatgaagctttgt

SEQ ID NO: 7980351 - DNA, 22 bp, Homo sapiens
cacatatttgatgaagctttgt

SEQ ID NO: 7980352 - DNA, 22 bp, Homo sapiens
agcagggctctgccatgggccc

SEQ ID NO: 7980353 - DNA, 22 bp, Homo sapiens
cacatattgtagttcaccagga

SEQ ID NO: 7980354 - DNA, 22 bp, Homo sapiens
cacatctgaaaagatgcacaag

SEQ ID NO: 7980355 - DNA, 22 bp, Homo sapiens
cacatctgaaaagatgcacaag

SEQ ID NO: 7980356 - DNA, 22 bp, Homo sapiens
cacatctatggagacagagagt

SEQ ID NO: 7980357 - DNA, 22 bp, Homo sapiens
cacatctagcttacaaaacagg

SEQ ID NO: 7980358 - DNA, 22 bp, Homo sapiens
cacatctactgatattccagga

SEQ ID NO: 7980359 - DNA, 22 bp, Homo sapiens
cacatcctgtgtaaacttggtg

SEQ ID NO: 7980360 - DNA, 22 bp, Homo sapiens
cacatccttcatactcagctct

SEQ ID NO: 7980361 - DNA, 22 bp, Homo sapiens
cacatctactgaatgagcagtg

SEQ ID NO: 7980362 - DNA, 22 bp, Homo sapiens
cacagtatttgtttttctgagt

SEQ ID NO: 7980363 - DNA, 22 bp, Homo sapiens
cacagtcaatgtagaaatatga

SEQ ID NO: 7980364 - DNA, 22 bp, Homo sapiens
cacagtcaatgtagaaatatga

SEQ ID NO: 7980365 - DNA, 20 bp, Homo sapiens
cacagtattcttccttaaaa

SEQ ID NO: 7980366 - DNA, 22 bp, Homo sapiens
cacagtattcactgggcagatt

SEQ ID NO: 7980367 - DNA, 22 bp, Homo sapiens
cacagtatgatctaaagtaagt

SEQ ID NO: 7980368 - DNA, 22 bp, Homo sapiens
cacagtatttgtttttctgagt

SEQ ID NO: 7980369 - DNA, 22 bp, Homo sapiens
cacagtcacatatctatgtgtg

SEQ ID NO: 7980370 - DNA, 22 bp, Homo sapiens
cacagtcacatatctatgtgtg

SEQ ID NO: 7980371 - DNA, 22 bp, Homo sapiens
cacagtcacatatctatgtgtg

SEQ ID NO: 7980372 - DNA, 22 bp, Homo sapiens
cacagtcaccttatcaggatgt

SEQ ID NO: 7980373 - DNA, 22 bp, Homo sapiens
cacagtcacatatctatgtgtg

SEQ ID NO: 7980374 - DNA, 22 bp, Homo sapiens
cacagtcaccttatcaggatgt

SEQ ID NO: 7980375 - DNA, 23 bp, Homo sapiens
cacagtcatttactttgccatca

SEQ ID NO: 7980376 - DNA, 22 bp, Homo sapiens
cacagtcagcctctagtagcat

SEQ ID NO: 7980377 - DNA, 23 bp, Homo sapiens
cacagtcatttactttgccatca

SEQ ID NO: 7980378 - DNA, 22 bp, Homo sapiens
agcagggcagtgcttcagctct

SEQ ID NO: 7980379 - DNA, 22 bp, Homo sapiens
agcagggcagtgcttcagctct

SEQ ID NO: 7980380 - DNA, 22 bp, Homo sapiens
agcagggcctctggcactggtc

SEQ ID NO: 7980381 - DNA, 22 bp, Homo sapiens
agcagggcctctggcactggtc

SEQ ID NO: 7980382 - DNA, 22 bp, Homo sapiens
agcagggcctctggcactggtc

SEQ ID NO: 7980383 - DNA, 22 bp, Homo sapiens
agcagggcctctggcactggtc

SEQ ID NO: 7980384 - DNA, 22 bp, Homo sapiens
agcagggcctgagtgacctaac

SEQ ID NO: 7980385 - DNA, 22 bp, Homo sapiens
cacagtccagactcctggagtt

SEQ ID NO: 7980386 - DNA, 22 bp, Homo sapiens
cacagtccagactcctggagtt

SEQ ID NO: 7980387 - DNA, 22 bp, Homo sapiens
cacagtccagactcctggagtt

SEQ ID NO: 7980388 - DNA, 22 bp, Homo sapiens
cacagtcccattcgagagtaat

SEQ ID NO: 7980389 - DNA, 16 bp, Homo sapiens
agcagggcgggaagga

SEQ ID NO: 7980390 - DNA, 16 bp, Homo sapiens
agcagggcgggaagga

SEQ ID NO: 7980391 - DNA, 22 bp, Homo sapiens
agcagggcctggcactcctggg

SEQ ID NO: 7980392 - DNA, 22 bp, Homo sapiens
agcagggcctggcactcctggg

SEQ ID NO: 7980393 - DNA, 22 bp, Homo sapiens
agcagggcctgagtgacctaac

SEQ ID NO: 7980394 - DNA, 22 bp, Homo sapiens
agcagggcctgagtgacctaac

SEQ ID NO: 7980395 - DNA, 22 bp, Homo sapiens
agcagggcctgagtgacctaac

SEQ ID NO: 7980396 - DNA, 22 bp, Homo sapiens
agcagggcctgagtgacctaac

SEQ ID NO: 7980397 - DNA, 22 bp, Homo sapiens
agcagggcctggcactcctggg

SEQ ID NO: 7980398 - DNA, 22 bp, Homo sapiens
agcagggcctggcactcctggg

SEQ ID NO: 7980399 - DNA, 22 bp, Homo sapiens
agcagggctccatttcactgcc

SEQ ID NO: 7980400 - DNA, 22 bp, Homo sapiens
agcagggctccatttcactgcc

SEQ ID NO: 7980401 - DNA, 22 bp, Homo sapiens
agcagggctccatttcactgcc

SEQ ID NO: 7980402 - DNA, 22 bp, Homo sapiens
agcagggctccatttcactgcc

SEQ ID NO: 7980403 - DNA, 22 bp, Homo sapiens
agcagggctcacattagtggat

SEQ ID NO: 7980404 - DNA, 22 bp, Homo sapiens
agcagggctcacattagtggat

SEQ ID NO: 7980405 - DNA, 22 bp, Homo sapiens
agcagggcctggcactcctggg

SEQ ID NO: 7980406 - DNA, 22 bp, Homo sapiens
agcagggctcacattagtggat

SEQ ID NO: 7980407 - DNA, 22 bp, Homo sapiens
agcagggctctgccatgggccc

SEQ ID NO: 7980408 - DNA, 22 bp, Homo sapiens
agcagggctctgccatgggccc

SEQ ID NO: 7980409 - DNA, 22 bp, Homo sapiens
agcagggctcctgaaagccgcg

SEQ ID NO: 7980410 - DNA, 22 bp, Homo sapiens
agcagggctcctgaaagccgcg

SEQ ID NO: 7980411 - DNA, 22 bp, Homo sapiens
agcagggctctgccatgggccc

SEQ ID NO: 7980412 - DNA, 22 bp, Homo sapiens
agcagggctcctgaaagccgcg

SEQ ID NO: 7980413 - DNA, 22 bp, Homo sapiens
agcagggctcctgaaagccgcg

SEQ ID NO: 7980414 - DNA, 22 bp, Homo sapiens
agcagggctcctgaaagccgcg

SEQ ID NO: 7980415 - DNA, 21 bp, Homo sapiens
agcaggtgctgttggaggaaa

SEQ ID NO: 7980416 - DNA, 21 bp, Homo sapiens
agcaggtgctgttggaggaaa

SEQ ID NO: 7980417 - DNA, 21 bp, Homo sapiens
agcaggtgctgttggaggaaa

SEQ ID NO: 7980418 - DNA, 21 bp, Homo sapiens
agcaggtgctgttggaggaaa

SEQ ID NO: 7980419 - DNA, 21 bp, Homo sapiens
agcaggtgctgttggaggaaa

SEQ ID NO: 7980420 - DNA, 18 bp, Homo sapiens
agcaggtgctgtttcttt

SEQ ID NO: 7980421 - DNA, 22 bp, Homo sapiens
agcaggtgcgttacttcactct

SEQ ID NO: 7980422 - DNA, 21 bp, Homo sapiens
agcaggtgctgttggaggaaa

SEQ ID NO: 7980423 - DNA, 22 bp, Homo sapiens
agcaggtgcgttacttcactct

SEQ ID NO: 7980424 - DNA, 22 bp, Homo sapiens
agcaggtgcgttacttcactct

SEQ ID NO: 7980425 - DNA, 22 bp, Homo sapiens
caccagggacaatgctaggggt

SEQ ID NO: 7980426 - DNA, 22 bp, Homo sapiens
caccagggacaatgctaggggt

SEQ ID NO: 7980427 - DNA, 22 bp, Homo sapiens
caccagggacaatgctaggggt

SEQ ID NO: 7980428 - DNA, 22 bp, Homo sapiens
caccagggacaatgctaggggt

SEQ ID NO: 7980429 - DNA, 22 bp, Homo sapiens
caccagggcagcagcctagtct

SEQ ID NO: 7980430 - DNA, 22 bp, Homo sapiens
caccaggctggagtgcagtggc

SEQ ID NO: 7980431 - DNA, 22 bp, Homo sapiens
caccagggacaatgctaggggt

SEQ ID NO: 7980432 - DNA, 22 bp, Homo sapiens
caccagggacaatgctaggggt

SEQ ID NO: 7980433 - DNA, 22 bp, Homo sapiens
agcaggtggacagaggaagaaa

SEQ ID NO: 7980434 - DNA, 22 bp, Homo sapiens
agcaggtggacagaggaagaaa

SEQ ID NO: 7980435 - DNA, 22 bp, Homo sapiens
agcaggtggacagaggaagaaa

SEQ ID NO: 7980436 - DNA, 22 bp, Homo sapiens
caccaggctggagtgcagtggc

SEQ ID NO: 7980437 - DNA, 22 bp, Homo sapiens
caccagggccccaggctgtgcc

SEQ ID NO: 7980438 - DNA, 22 bp, Homo sapiens
caccagggccccaggctgtgcc

SEQ ID NO: 7980439 - DNA, 22 bp, Homo sapiens
caccagggctctgagctctgaa

SEQ ID NO: 7980440 - DNA, 22 bp, Homo sapiens
caccagggctctgagctctgaa

SEQ ID NO: 7980441 - DNA, 22 bp, Homo sapiens
caccagggcagcagcctagtct

SEQ ID NO: 7980442 - DNA, 22 bp, Homo sapiens
caccagggcagcagcctagtct

SEQ ID NO: 7980443 - DNA, 22 bp, Homo sapiens
caccagggcagcagcctagtct

SEQ ID NO: 7980444 - DNA, 22 bp, Homo sapiens
caccagggccccaggctgtgcc

SEQ ID NO: 7980445 - DNA, 22 bp, Homo sapiens
caccagggctctgagctctgaa

SEQ ID NO: 7980446 - DNA, 22 bp, Homo sapiens
caccagggctctgagctctgaa

SEQ ID NO: 7980447 - DNA, 22 bp, Homo sapiens
caccagggctctgagctctgaa

SEQ ID NO: 7980448 - DNA, 22 bp, Homo sapiens
caccagggctctgagctctgaa

SEQ ID NO: 7980449 - DNA, 22 bp, Homo sapiens
caccaggggcagagaccaaagt

SEQ ID NO: 7980450 - DNA, 22 bp, Homo sapiens
caccagggctctgagctctgaa

SEQ ID NO: 7980451 - DNA, 22 bp, Homo sapiens
caccagggtacaatttcgcaga

SEQ ID NO: 7980452 - DNA, 22 bp, Homo sapiens
caccaggggcagagaccaaagt

SEQ ID NO: 7980453 - DNA, 22 bp, Homo sapiens
caccaggtgctggaggacatca

SEQ ID NO: 7980454 - DNA, 22 bp, Homo sapiens
agcagtttatcctcataatgga

SEQ ID NO: 7980455 - DNA, 22 bp, Homo sapiens
agcagttgtagtcatggaaaat

SEQ ID NO: 7980456 - DNA, 22 bp, Homo sapiens
agcagttcataaacattttgag

SEQ ID NO: 7980457 - DNA, 22 bp, Homo sapiens
agcagttatgttctataaagtc

SEQ ID NO: 7980458 - DNA, 22 bp, Homo sapiens
agcagttgtagtcatggaaaat

SEQ ID NO: 7980459 - DNA, 22 bp, Homo sapiens
agcagttgtagtcatggaaaat

SEQ ID NO: 7980460 - DNA, 22 bp, Homo sapiens
caccaggtgctggaggacatca

SEQ ID NO: 7980461 - DNA, 22 bp, Homo sapiens
caccaggtggaaatgtcacagc

SEQ ID NO: 7980462 - DNA, 22 bp, Homo sapiens
agcagtggcctggggctctgtg

SEQ ID NO: 7980463 - DNA, 22 bp, Homo sapiens
agcagtggctgacagacttacc

SEQ ID NO: 7980464 - DNA, 22 bp, Homo sapiens
agcataaaggcactagaaagag

SEQ ID NO: 7980465 - DNA, 22 bp, Homo sapiens
agcataaaggcactagaaagag

SEQ ID NO: 7980466 - DNA, 22 bp, Homo sapiens
agcataaaggacatttgtcact

SEQ ID NO: 7980467 - DNA, 22 bp, Homo sapiens
agcataaaggtcaacgttttag

SEQ ID NO: 7980468 - DNA, 22 bp, Homo sapiens
agcataaaggacatttgtcact

SEQ ID NO: 7980469 - DNA, 22 bp, Homo sapiens
agcataaactcagggacacaca

SEQ ID NO: 7980470 - DNA, 22 bp, Homo sapiens
agcataaaggacatttgtcact

SEQ ID NO: 7980471 - DNA, 22 bp, Homo sapiens
agcagtttttataacactggaa

SEQ ID NO: 7980472 - DNA, 22 bp, Homo sapiens
agcataaaataaatagtttgca

SEQ ID NO: 7980473 - DNA, 22 bp, Homo sapiens
agcataaaataaatagtttgca

SEQ ID NO: 7980474 - DNA, 22 bp, Homo sapiens
agcataaaataaatagtttgca

SEQ ID NO: 7980475 - DNA, 22 bp, Homo sapiens
agcataaactcagggacacaca

SEQ ID NO: 7980476 - DNA, 23 bp, Homo sapiens
agcataaacctctgtggctttag

SEQ ID NO: 7980477 - DNA, 23 bp, Homo sapiens
agcataaacctctgtggctttag

SEQ ID NO: 7980478 - DNA, 23 bp, Homo sapiens
agcataaacctctgtggctttag

SEQ ID NO: 7980479 - DNA, 22 bp, Homo sapiens
agcagtttggcccgagcagttc

SEQ ID NO: 7980480 - DNA, 22 bp, Homo sapiens
agcagtttggaaaatactagaa

SEQ ID NO: 7980481 - DNA, 22 bp, Homo sapiens
agcagtttggaaaatactagaa

SEQ ID NO: 7980482 - DNA, 22 bp, Homo sapiens
agcagttttagggagacacatt

SEQ ID NO: 7980483 - DNA, 22 bp, Homo sapiens
agcagtttgaatcaatggccag

SEQ ID NO: 7980484 - DNA, 20 bp, Homo sapiens
agcagtttcctaactcagct

SEQ ID NO: 7980485 - DNA, 20 bp, Homo sapiens
agcagtttcctaactcagct

SEQ ID NO: 7980486 - DNA, 22 bp, Homo sapiens
agcagtttatcctcataatgga

SEQ ID NO: 7980487 - DNA, 22 bp, Homo sapiens
agcataaaggtcaacgttttag

SEQ ID NO: 7980488 - DNA, 22 bp, Homo sapiens
agcataaaggtcaacgttttag

SEQ ID NO: 7980489 - DNA, 22 bp, Homo sapiens
agcataaaggtcaacgttttag

SEQ ID NO: 7980490 - DNA, 22 bp, Homo sapiens
agcataagttggtacagccact

SEQ ID NO: 7980491 - DNA, 22 bp, Homo sapiens
agcataagttggtacagccact

SEQ ID NO: 7980492 - DNA, 22 bp, Homo sapiens
agcataagttggtacagccact

SEQ ID NO: 7980493 - DNA, 22 bp, Homo sapiens
agcataagttggtacagccact

SEQ ID NO: 7980494 - DNA, 22 bp, Homo sapiens
agcataattcctgacacacaag

SEQ ID NO: 7980495 - DNA, 22 bp, Homo sapiens
agcataagttggtacagccact

SEQ ID NO: 7980496 - DNA, 22 bp, Homo sapiens
agcataattcctgacacacaag

SEQ ID NO: 7980497 - DNA, 22 bp, Homo sapiens
agcataattcctgacacacaag

SEQ ID NO: 7980498 - DNA, 22 bp, Homo sapiens
cactctgagcccaagcaggctg

SEQ ID NO: 7980499 - DNA, 20 bp, Homo sapiens
cactctgagggagtccatgt

SEQ ID NO: 7980500 - DNA, 22 bp, Homo sapiens
cactctgatggtttctgttcaa

SEQ ID NO: 7980501 - DNA, 22 bp, Homo sapiens
cactctgcagctgaagggctgg

SEQ ID NO: 7980502 - DNA, 22 bp, Homo sapiens
cactctgctgaaatcgccttgt

SEQ ID NO: 7980503 - DNA, 22 bp, Homo sapiens
cactctgcgctgggcgccagcg

SEQ ID NO: 7980504 - DNA, 22 bp, Homo sapiens
cactctgatggtttctgttcaa

SEQ ID NO: 7980505 - DNA, 22 bp, Homo sapiens
cactctgatggtttctgttcaa

SEQ ID NO: 7980506 - DNA, 22 bp, Homo sapiens
cactctgcagctgaagggctgg

SEQ ID NO: 7980507 - DNA, 22 bp, Homo sapiens
cactctgattccacaaggctcc

SEQ ID NO: 7980508 - DNA, 22 bp, Homo sapiens
cactctggttctgaacaggatc

SEQ ID NO: 7980509 - DNA, 22 bp, Homo sapiens
cactctgggggctgccgctgcc

SEQ ID NO: 7980510 - DNA, 22 bp, Homo sapiens
cactctgggggctgccgctgcc

SEQ ID NO: 7980511 - DNA, 22 bp, Homo sapiens
cactctgggctcttgtttcaga

SEQ ID NO: 7980512 - DNA, 22 bp, Homo sapiens
cactctggggatgcaaggagag

SEQ ID NO: 7980513 - DNA, 22 bp, Homo sapiens
cactctggggatgcaaggagag

SEQ ID NO: 7980514 - DNA, 22 bp, Homo sapiens
agagtggcctggcctggggcat

SEQ ID NO: 7980515 - DNA, 23 bp, Homo sapiens
agagtggcctactcacactcatt

SEQ ID NO: 7980516 - DNA, 23 bp, Homo sapiens
agagtggcctactcacactcatt

SEQ ID NO: 7980517 - DNA, 22 bp, Homo sapiens
agagtggcctggcctggggcat

SEQ ID NO: 7980518 - DNA, 17 bp, Homo sapiens
agagtggctaaggctca

SEQ ID NO: 7980519 - DNA, 17 bp, Homo sapiens
agagtggctaaggctca

SEQ ID NO: 7980520 - DNA, 22 bp, Homo sapiens
agagtggcctggcctggggcat

SEQ ID NO: 7980521 - DNA, 22 bp, Homo sapiens
agagtggctctgctgggcacag

SEQ ID NO: 7980522 - DNA, 22 bp, Homo sapiens
agagtggctctgctgggcacag

SEQ ID NO: 7980523 - DNA, 22 bp, Homo sapiens
atttaatgggtagacattgtta

SEQ ID NO: 7980524 - DNA, 22 bp, Homo sapiens
agagtggcccgttggcctgaac

SEQ ID NO: 7980525 - DNA, 22 bp, Homo sapiens
atttaatgggtagacattgtta

SEQ ID NO: 7980526 - DNA, 22 bp, Homo sapiens
atttaatgggtagacattgtta

SEQ ID NO: 7980527 - DNA, 23 bp, Homo sapiens
atttaatgctgagttgaatgtta

SEQ ID NO: 7980528 - DNA, 22 bp, Homo sapiens
atttaatgggtagacattgtta

SEQ ID NO: 7980529 - DNA, 23 bp, Homo sapiens
atttaatgctgagttgaatgtta

SEQ ID NO: 7980530 - DNA, 22 bp, Homo sapiens
atttaagattgcgtattcatgt

SEQ ID NO: 7980531 - DNA, 22 bp, Homo sapiens
atttaagggatttggagaccaa

SEQ ID NO: 7980532 - DNA, 22 bp, Homo sapiens
atttaagggatttggagaccaa

SEQ ID NO: 7980533 - DNA, 22 bp, Homo sapiens
atttaataccacttggtgcttt

SEQ ID NO: 7980534 - DNA, 23 bp, Homo sapiens
atttaatgctgagttgaatgtta

SEQ ID NO: 7980535 - DNA, 22 bp, Homo sapiens
atttaatgaggctgggggtgga

SEQ ID NO: 7980536 - DNA, 23 bp, Homo sapiens
atttaatgctgagttgaatgtta

SEQ ID NO: 7980537 - DNA, 18 bp, Homo sapiens
atttaatgaactgaaagc

SEQ ID NO: 7980538 - DNA, 18 bp, Homo sapiens
atttaatgaactgaaagc

SEQ ID NO: 7980539 - DNA, 22 bp, Homo sapiens
atttaagaggctgctagagtat

SEQ ID NO: 7980540 - DNA, 22 bp, Homo sapiens
atttaagaggctgctagagtat

SEQ ID NO: 7980541 - DNA, 22 bp, Homo sapiens
atttaagaggctgctagagtat

SEQ ID NO: 7980542 - DNA, 22 bp, Homo sapiens
atttaagattgcgtattcatgt

SEQ ID NO: 7980543 - DNA, 22 bp, Homo sapiens
atttaagattgcgtattcatgt

SEQ ID NO: 7980544 - DNA, 22 bp, Homo sapiens
atttaagattgcgtattcatgt

SEQ ID NO: 7980545 - DNA, 22 bp, Homo sapiens
atttaagattgcgtattcatgt

SEQ ID NO: 7980546 - DNA, 22 bp, Homo sapiens
atttaagactgacttcaccagt

SEQ ID NO: 7980547 - DNA, 22 bp, Homo sapiens
atttaagactgacttcaccagt

SEQ ID NO: 7980548 - DNA, 22 bp, Homo sapiens
atttaagactgacttcaccagt

SEQ ID NO: 7980549 - DNA, 22 bp, Homo sapiens
atttaacaagacagagaactgg

SEQ ID NO: 7980550 - DNA, 22 bp, Homo sapiens
atttaactttcagcccctcttc

SEQ ID NO: 7980551 - DNA, 22 bp, Homo sapiens
atttaaccccgatgtctccaaa

SEQ ID NO: 7980552 - DNA, 22 bp, Homo sapiens
attgttaataactattacattg

SEQ ID NO: 7980553 - DNA, 22 bp, Homo sapiens
attgttaataactattacattg

SEQ ID NO: 7980554 - DNA, 19 bp, Homo sapiens
attcttctcttcctgctgt

SEQ ID NO: 7980555 - DNA, 19 bp, Homo sapiens
attcttctcttcctgctgt

SEQ ID NO: 7980556 - DNA, 22 bp, Homo sapiens
attgttaataactattacattg

SEQ ID NO: 7980557 - DNA, 19 bp, Homo sapiens
attcttctcttcctgctgt

SEQ ID NO: 7980558 - DNA, 22 bp, Homo sapiens
atttaacaagacagagaactgg

SEQ ID NO: 7980559 - DNA, 22 bp, Homo sapiens
atttaaattttctgatggagag

SEQ ID NO: 7980560 - DNA, 22 bp, Homo sapiens
atttaaattttctgatggagag

SEQ ID NO: 7980561 - DNA, 22 bp, Homo sapiens
atttaaattttctgatggagag

SEQ ID NO: 7980562 - DNA, 18 bp, Homo sapiens
attgttaatagagtactt

SEQ ID NO: 7980563 - DNA, 22 bp, Homo sapiens
agagggtggtgaggcctggttc

SEQ ID NO: 7980564 - DNA, 22 bp, Homo sapiens
agaggtaagcagtggcaagtgc

SEQ ID NO: 7980565 - DNA, 22 bp, Homo sapiens
agaggtaattatagcctggccg

SEQ ID NO: 7980566 - DNA, 22 bp, Homo sapiens
agaggtagaaaataatggagag

SEQ ID NO: 7980567 - DNA, 22 bp, Homo sapiens
agagggtgggcacgtgatggat

SEQ ID NO: 7980568 - DNA, 22 bp, Homo sapiens
agagggtggtgaggcctggttc

SEQ ID NO: 7980569 - DNA, 22 bp, Homo sapiens
agagggtggtgaggcctggttc

SEQ ID NO: 7980570 - DNA, 22 bp, Homo sapiens
agagggtggtgaggcctggttc

SEQ ID NO: 7980571 - DNA, 22 bp, Homo sapiens
agagggtgggcacgtgatggat

SEQ ID NO: 7980572 - DNA, 22 bp, Homo sapiens
attcttcatcactaccttgtga

SEQ ID NO: 7980573 - DNA, 22 bp, Homo sapiens
agaggtatgtgtcagtgcttat

SEQ ID NO: 7980574 - DNA, 22 bp, Homo sapiens
agaggtatatattctccatatt

SEQ ID NO: 7980575 - DNA, 22 bp, Homo sapiens
agaggtatatattctccatatt

SEQ ID NO: 7980576 - DNA, 22 bp, Homo sapiens
agaggtagaggttgcagtgagc

SEQ ID NO: 7980577 - DNA, 22 bp, Homo sapiens
agaggtagaggttgcagtgagc

SEQ ID NO: 7980578 - DNA, 22 bp, Homo sapiens
attcttcatttactgttacttg

SEQ ID NO: 7980579 - DNA, 22 bp, Homo sapiens
attcttcctcatcaatctgtag

SEQ ID NO: 7980580 - DNA, 22 bp, Homo sapiens
attcttcattgttgattcatgt

SEQ ID NO: 7980581 - DNA, 22 bp, Homo sapiens
attcttcattgttgattcatgt

SEQ ID NO: 7980582 - DNA, 22 bp, Homo sapiens
attcttctcccttagggcccag

SEQ ID NO: 7980583 - DNA, 19 bp, Homo sapiens
attcttctcaaatatccat

SEQ ID NO: 7980584 - DNA, 19 bp, Homo sapiens
attcttctcaaatatccat

SEQ ID NO: 7980585 - DNA, 22 bp, Homo sapiens
attcttctctgggttgggttca

SEQ ID NO: 7980586 - DNA, 19 bp, Homo sapiens
attcttctcaaatatccat

SEQ ID NO: 7980587 - DNA, 22 bp, Homo sapiens
attcttctaatatgatcgtgtt

SEQ ID NO: 7980588 - DNA, 19 bp, Homo sapiens
attcttctcaaatatccat

SEQ ID NO: 7980589 - DNA, 22 bp, Homo sapiens
attcttcatggctgtgagtcct

SEQ ID NO: 7980590 - DNA, 22 bp, Homo sapiens
attcttcatcagagatgcacta

SEQ ID NO: 7980591 - DNA, 22 bp, Homo sapiens
attcttcatcagagatgcacta

SEQ ID NO: 7980592 - DNA, 22 bp, Homo sapiens
attcttcatgttgaagctgtca

SEQ ID NO: 7980593 - DNA, 22 bp, Homo sapiens
attcttcatgttgaagctgtca

SEQ ID NO: 7980594 - DNA, 23 bp, Homo sapiens
attcttcattatcttctagaaaa

SEQ ID NO: 7980595 - DNA, 22 bp, Homo sapiens
agagtggcttgctcagctagca

SEQ ID NO: 7980596 - DNA, 22 bp, Homo sapiens
agagtggcttgctcagctagca

SEQ ID NO: 7980597 - DNA, 22 bp, Homo sapiens
agagtggcttctttgacatgct

SEQ ID NO: 7980598 - DNA, 22 bp, Homo sapiens
agagtggcttctttgacatgct

SEQ ID NO: 7980599 - DNA, 22 bp, Homo sapiens
agagtggcttgctcagctagca

SEQ ID NO: 7980600 - DNA, 22 bp, Homo sapiens
agagtggcttgctcagctagca

SEQ ID NO: 7980601 - DNA, 22 bp, Homo sapiens
agagtgggacacgggcgctgtc

SEQ ID NO: 7980602 - DNA, 22 bp, Homo sapiens
agagtgggacacgggcgctgtc

SEQ ID NO: 7980603 - DNA, 22 bp, Homo sapiens
agagtgggacacgggcgctgtc

SEQ ID NO: 7980604 - DNA, 22 bp, Homo sapiens
agagtgggacacgggcgctgtc

SEQ ID NO: 7980605 - DNA, 22 bp, Homo sapiens
agagtggggaaggtgttgagaa

SEQ ID NO: 7980606 - DNA, 22 bp, Homo sapiens
agagtggggaaggtgttgagaa

SEQ ID NO: 7980607 - DNA, 22 bp, Homo sapiens
agagtggggaaggtgttgagaa

SEQ ID NO: 7980608 - DNA, 22 bp, Homo sapiens
agagtggggaaggtgttgagaa

SEQ ID NO: 7980609 - DNA, 22 bp, Homo sapiens
agagtggggaaggtgttgagaa

SEQ ID NO: 7980610 - DNA, 22 bp, Homo sapiens
agagtggggaaggtgttgagaa

SEQ ID NO: 7980611 - DNA, 22 bp, Homo sapiens
agagtgggcctctgagtcccag

SEQ ID NO: 7980612 - DNA, 22 bp, Homo sapiens
agagtgggcctctgagtcccag

SEQ ID NO: 7980613 - DNA, 22 bp, Homo sapiens
agagtgggcctctgagtcccag

SEQ ID NO: 7980614 - DNA, 22 bp, Homo sapiens
agagtgggcctctgagtcccag

SEQ ID NO: 7980615 - DNA, 22 bp, Homo sapiens
agagtgggcaggagcctcgact

SEQ ID NO: 7980616 - DNA, 22 bp, Homo sapiens
agagtgggcaggagcctcgact

SEQ ID NO: 7980617 - DNA, 22 bp, Homo sapiens
agagtgggcaggagcctcgact

SEQ ID NO: 7980618 - DNA, 22 bp, Homo sapiens
atttagcaagagtacaaaataa

SEQ ID NO: 7980619 - DNA, 17 bp, Homo sapiens
atttagcaagtagacag

SEQ ID NO: 7980620 - DNA, 22 bp, Homo sapiens
atttagcaagagtacaaaataa

SEQ ID NO: 7980621 - DNA, 22 bp, Homo sapiens
atttagcaagagtacaaaataa

SEQ ID NO: 7980622 - DNA, 22 bp, Homo sapiens
atttagcaaaaaatgatgaagc

SEQ ID NO: 7980623 - DNA, 22 bp, Homo sapiens
atttagagtgaaacattatgca

SEQ ID NO: 7980624 - DNA, 22 bp, Homo sapiens
atttagagaataagacataaat

SEQ ID NO: 7980625 - DNA, 22 bp, Homo sapiens
atttagagtgttcactctgagc

SEQ ID NO: 7980626 - DNA, 22 bp, Homo sapiens
atttagagtgaaacattatgca

SEQ ID NO: 7980627 - DNA, 22 bp, Homo sapiens
agagtggggacagggcctgtcc

SEQ ID NO: 7980628 - DNA, 23 bp, Homo sapiens
atttacaggttaaatgaaatcag

SEQ ID NO: 7980629 - DNA, 22 bp, Homo sapiens
atttagactctcacctccacct

SEQ ID NO: 7980630 - DNA, 22 bp, Homo sapiens
atttagacttcccagcactgtg

SEQ ID NO: 7980631 - DNA, 22 bp, Homo sapiens
atttagaagttggagggcaaga

SEQ ID NO: 7980632 - DNA, 22 bp, Homo sapiens
atttagaagttggagggcaaga

SEQ ID NO: 7980633 - DNA, 22 bp, Homo sapiens
atttagtagagaaattaagaaa

SEQ ID NO: 7980634 - DNA, 22 bp, Homo sapiens
atttagtaagtacttgttgaat

SEQ ID NO: 7980635 - DNA, 22 bp, Homo sapiens
atttaggtagctgtctaagtgt

SEQ ID NO: 7980636 - DNA, 22 bp, Homo sapiens
atttaggaatgttctgcacaaa

SEQ ID NO: 7980637 - DNA, 22 bp, Homo sapiens
atttaggaatgttctgcacaaa

SEQ ID NO: 7980638 - DNA, 22 bp, Homo sapiens
atttagcagtcctcctcacaat

SEQ ID NO: 7980639 - DNA, 22 bp, Homo sapiens
atttagcttacctcgttactga

SEQ ID NO: 7980640 - DNA, 22 bp, Homo sapiens
atttagcacacggcctggtaca

SEQ ID NO: 7980641 - DNA, 17 bp, Homo sapiens
atttagcaagtagacag

SEQ ID NO: 7980642 - DNA, 22 bp, Homo sapiens
atttagcacctccatctcaaca

SEQ ID NO: 7980643 - DNA, 22 bp, Homo sapiens
atttagcacctccatctcaaca

SEQ ID NO: 7980644 - DNA, 22 bp, Homo sapiens
atttagcacacggcctggtaca

SEQ ID NO: 7980645 - DNA, 22 bp, Homo sapiens
atttattatgggatttggctca

SEQ ID NO: 7980646 - DNA, 22 bp, Homo sapiens
atttattatgggatttggctca

SEQ ID NO: 7980647 - DNA, 22 bp, Homo sapiens
atttattatgggatttggctca

SEQ ID NO: 7980648 - DNA, 22 bp, Homo sapiens
atttagtttaggaaaagtaggt

SEQ ID NO: 7980649 - DNA, 22 bp, Homo sapiens
atttagtggctgtaatcacctt

SEQ ID NO: 7980650 - DNA, 22 bp, Homo sapiens
atttagtgatgcagtggattat

SEQ ID NO: 7980651 - DNA, 22 bp, Homo sapiens
atttagtgccttagccctcagg

SEQ ID NO: 7980652 - DNA, 22 bp, Homo sapiens
atttagtgaccagcactagaaa

SEQ ID NO: 7980653 - DNA, 22 bp, Homo sapiens
atttagtgtattctaatatgtg

SEQ ID NO: 7980654 - DNA, 22 bp, Homo sapiens
atttagtgtgtattgctattat

SEQ ID NO: 7980655 - DNA, 22 bp, Homo sapiens
atttagtgtgcctgggaatctg

SEQ ID NO: 7980656 - DNA, 22 bp, Homo sapiens
atttagtgtatcaatgtgatat

SEQ ID NO: 7980657 - DNA, 22 bp, Homo sapiens
atttattgaacactgactatgt

SEQ ID NO: 7980658 - DNA, 22 bp, Homo sapiens
atttattgaacactgactatgt

SEQ ID NO: 7980659 - DNA, 22 bp, Homo sapiens
atttattgaacactgactatgt

SEQ ID NO: 7980660 - DNA, 22 bp, Homo sapiens
atttattgaacactgactatgt

SEQ ID NO: 7980661 - DNA, 22 bp, Homo sapiens
atttattgaacactgactatgt

SEQ ID NO: 7980662 - DNA, 22 bp, Homo sapiens
atttattgaacactgactatgt

SEQ ID NO: 7980663 - DNA, 22 bp, Homo sapiens
atttattctccagatggcgaga

SEQ ID NO: 7980664 - DNA, 22 bp, Homo sapiens
atttattgaacactgactatgt

SEQ ID NO: 7980665 - DNA, 22 bp, Homo sapiens
atttattgaacactgactatgt

SEQ ID NO: 7980666 - DNA, 22 bp, Homo sapiens
atttattgaacactgactatgt

SEQ ID NO: 7980667 - DNA, 22 bp, Homo sapiens
atttattgaacactgactatgt

SEQ ID NO: 7980668 - DNA, 22 bp, Homo sapiens
atttattcctgattcctggctt

SEQ ID NO: 7980669 - DNA, 22 bp, Homo sapiens
atttattcctttatggctggag

SEQ ID NO: 7980670 - DNA, 22 bp, Homo sapiens
atttattctccagatggcgaga

SEQ ID NO: 7980671 - DNA, 22 bp, Homo sapiens
atttattgaacactgactatgt

SEQ ID NO: 7980672 - DNA, 22 bp, Homo sapiens
atttattattgtggttacttct

SEQ ID NO: 7980673 - DNA, 22 bp, Homo sapiens
atttattattgtggttacttct

SEQ ID NO: 7980674 - DNA, 22 bp, Homo sapiens
atttattattgtggttacttct

SEQ ID NO: 7980675 - DNA, 22 bp, Homo sapiens
atttattatgggatttggctca

SEQ ID NO: 7980676 - DNA, 22 bp, Homo sapiens
atttattattgtggttacttct

SEQ ID NO: 7980677 - DNA, 22 bp, Homo sapiens
atttattattgtggttacttct

SEQ ID NO: 7980678 - DNA, 22 bp, Homo sapiens
atttattattgtggttacttct

SEQ ID NO: 7980679 - DNA, 22 bp, Homo sapiens
atttattattgtggttacttct

SEQ ID NO: 7980680 - DNA, 22 bp, Homo sapiens
atttattattgtggttacttct

SEQ ID NO: 7980681 - DNA, 22 bp, Homo sapiens
atttattattgtggttacttct

SEQ ID NO: 7980682 - DNA, 22 bp, Homo sapiens
agatgaaaatacgtgactttaa

SEQ ID NO: 7980683 - DNA, 22 bp, Homo sapiens
agatgaaaatacgtgactttaa

SEQ ID NO: 7980684 - DNA, 22 bp, Homo sapiens
agatgaaaatacgtgactttaa

SEQ ID NO: 7980685 - DNA, 22 bp, Homo sapiens
agatgaaagatttttatagaga

SEQ ID NO: 7980686 - DNA, 22 bp, Homo sapiens
agatgaaagatttttatagaga

SEQ ID NO: 7980687 - DNA, 22 bp, Homo sapiens
agatgaaagatttttatagaga

SEQ ID NO: 7980688 - DNA, 18 bp, Homo sapiens
agatgaaagcaaatgaca

SEQ ID NO: 7980689 - DNA, 18 bp, Homo sapiens
agatgaaagcaaatgaca

SEQ ID NO: 7980690 - DNA, 18 bp, Homo sapiens
agatgaaagcaaatgaca

SEQ ID NO: 7980691 - DNA, 18 bp, Homo sapiens
agatgaaagcaaatgaca

SEQ ID NO: 7980692 - DNA, 22 bp, Homo sapiens
agatgaaagatttttatagaga

SEQ ID NO: 7980693 - DNA, 22 bp, Homo sapiens
atttattgaagcttattacgtt

SEQ ID NO: 7980694 - DNA, 22 bp, Homo sapiens
atttattgaagcttattacgtt

SEQ ID NO: 7980695 - DNA, 22 bp, Homo sapiens
atttattgaagcttattacgtt

SEQ ID NO: 7980696 - DNA, 22 bp, Homo sapiens
atttattgaagcttattacgtt

SEQ ID NO: 7980697 - DNA, 22 bp, Homo sapiens
agatccagggttggatttgcat

SEQ ID NO: 7980698 - DNA, 22 bp, Homo sapiens
atttattgaagcttattacgtt

SEQ ID NO: 7980699 - DNA, 22 bp, Homo sapiens
agatccagggttggatttgcat

SEQ ID NO: 7980700 - DNA, 21 bp, Homo sapiens
agatccagtgccataaggccc

SEQ ID NO: 7980701 - DNA, 22 bp, Homo sapiens
agatcttttggttattataaga

SEQ ID NO: 7980702 - DNA, 22 bp, Homo sapiens
agatcttttggttattataaga

SEQ ID NO: 7980703 - DNA, 22 bp, Homo sapiens
agatcttttggttattataaga

SEQ ID NO: 7980704 - DNA, 22 bp, Homo sapiens
agatgaaaagataagcagcaat

SEQ ID NO: 7980705 - DNA, 22 bp, Homo sapiens
agatgaaaagataagcagcaat

SEQ ID NO: 7980706 - DNA, 22 bp, Homo sapiens
agatgaaaagataagcagcaat

SEQ ID NO: 7980707 - DNA, 22 bp, Homo sapiens
agatgaagatatctgcaggggc

SEQ ID NO: 7980708 - DNA, 22 bp, Homo sapiens
agatgaagatatctgcaggggc

SEQ ID NO: 7980709 - DNA, 22 bp, Homo sapiens
agatgaagatatctgcaggggc

SEQ ID NO: 7980710 - DNA, 22 bp, Homo sapiens
agatgaagatatctgcaggggc

SEQ ID NO: 7980711 - DNA, 22 bp, Homo sapiens
agatgaagactcaggagcaggt

SEQ ID NO: 7980712 - DNA, 23 bp, Homo sapiens
agatgaaagcttcccatcacagt

SEQ ID NO: 7980713 - DNA, 22 bp, Homo sapiens
agatgaagactcaggagcaggt

SEQ ID NO: 7980714 - DNA, 22 bp, Homo sapiens
agatgaagactcaggagcaggt

SEQ ID NO: 7980715 - DNA, 23 bp, Homo sapiens
agatgaaagcttcccatcacagt

SEQ ID NO: 7980716 - DNA, 22 bp, Homo sapiens
agatgaaatttgtgttgagttg

SEQ ID NO: 7980717 - DNA, 22 bp, Homo sapiens
agatgaaatttgtgttgagttg

SEQ ID NO: 7980718 - DNA, 22 bp, Homo sapiens
agatgacaaatcaggggacggg

SEQ ID NO: 7980719 - DNA, 22 bp, Homo sapiens
atttcattgaagttaattcttc

SEQ ID NO: 7980720 - DNA, 22 bp, Homo sapiens
atttcattgaagttaattcttc

SEQ ID NO: 7980721 - DNA, 22 bp, Homo sapiens
agatgaagatgccactaagacc

SEQ ID NO: 7980722 - DNA, 22 bp, Homo sapiens
atttcattgaagttaattcttc

SEQ ID NO: 7980723 - DNA, 22 bp, Homo sapiens
agatgacaaatcaggggacggg

SEQ ID NO: 7980724 - DNA, 22 bp, Homo sapiens
agatgaatccacacatggcaaa

SEQ ID NO: 7980725 - DNA, 21 bp, Homo sapiens
atttccaagggtacctaagat

SEQ ID NO: 7980726 - DNA, 19 bp, Homo sapiens
atttccaagaattggagag

SEQ ID NO: 7980727 - DNA, 22 bp, Homo sapiens
atttccaaaaccacttattgcc

SEQ ID NO: 7980728 - DNA, 22 bp, Homo sapiens
atttcattgaagttaattcttc

SEQ ID NO: 7980729 - DNA, 22 bp, Homo sapiens
atttccaactacccctccattt

SEQ ID NO: 7980730 - DNA, 22 bp, Homo sapiens
atttccaagaaagctttaggat

SEQ ID NO: 7980731 - DNA, 22 bp, Homo sapiens
atttccaatttcatccatgtcc

SEQ ID NO: 7980732 - DNA, 22 bp, Homo sapiens
atttccaccggctcaggaagtt

SEQ ID NO: 7980733 - DNA, 22 bp, Homo sapiens
agatgggcgcgctgctctgatg

SEQ ID NO: 7980734 - DNA, 22 bp, Homo sapiens
agatgggcgcgctgctctgatg

SEQ ID NO: 7980735 - DNA, 19 bp, Homo sapiens
agatggggaagagtgtgag

SEQ ID NO: 7980736 - DNA, 22 bp, Homo sapiens
agatggtagactatggaacgta

SEQ ID NO: 7980737 - DNA, 22 bp, Homo sapiens
agatggtagactatggaacgta

SEQ ID NO: 7980738 - DNA, 22 bp, Homo sapiens
agatggtcaaggatactgttca

SEQ ID NO: 7980739 - DNA, 22 bp, Homo sapiens
agatggtcaaggatactgttca

SEQ ID NO: 7980740 - DNA, 22 bp, Homo sapiens
agatggtccatctattttctat

SEQ ID NO: 7980741 - DNA, 22 bp, Homo sapiens
agatggtccatctattttctat

SEQ ID NO: 7980742 - DNA, 20 bp, Homo sapiens
agatggtgaaggccagggag

SEQ ID NO: 7980743 - DNA, 20 bp, Homo sapiens
agatggtgaaggccagggag

SEQ ID NO: 7980744 - DNA, 22 bp, Homo sapiens
agatggtcttttgagtaatgaa

SEQ ID NO: 7980745 - DNA, 22 bp, Homo sapiens
agatggtcttcataagttttaa

SEQ ID NO: 7980746 - DNA, 22 bp, Homo sapiens
agatggtcttttgagtaatgaa

SEQ ID NO: 7980747 - DNA, 22 bp, Homo sapiens
agatggtccatgcacagatatg

SEQ ID NO: 7980748 - DNA, 22 bp, Homo sapiens
agatggtccatgcacagatatg

SEQ ID NO: 7980749 - DNA, 22 bp, Homo sapiens
agatggtctagttgaaccatat

SEQ ID NO: 7980750 - DNA, 22 bp, Homo sapiens
agatggtctagttgaaccatat

SEQ ID NO: 7980751 - DNA, 22 bp, Homo sapiens
agatggtctggttatttttagt

SEQ ID NO: 7980752 - DNA, 22 bp, Homo sapiens
agatggtctggttatttttagt

SEQ ID NO: 7980753 - DNA, 22 bp, Homo sapiens
agatggtcttcataagttttaa

SEQ ID NO: 7980754 - DNA, 22 bp, Homo sapiens
agatggtgatagagctgggatt

SEQ ID NO: 7980755 - DNA, 22 bp, Homo sapiens
agatggtgatagagctgggatt

SEQ ID NO: 7980756 - DNA, 22 bp, Homo sapiens
agatggtgatagagctgggatt

SEQ ID NO: 7980757 - DNA, 22 bp, Homo sapiens
agatggtgagggcagaagtaac

SEQ ID NO: 7980758 - DNA, 22 bp, Homo sapiens
agatggtgagggcagaagtaac

SEQ ID NO: 7980759 - DNA, 22 bp, Homo sapiens
agatggtggactatctgacttg

SEQ ID NO: 7980760 - DNA, 22 bp, Homo sapiens
agatggtggactatctgacttg

SEQ ID NO: 7980761 - DNA, 22 bp, Homo sapiens
agatggtggactatctgacttg

SEQ ID NO: 7980762 - DNA, 20 bp, Homo sapiens
agatggtgggctggaacacc

SEQ ID NO: 7980763 - DNA, 20 bp, Homo sapiens
agatggtgggctggaacacc

SEQ ID NO: 7980764 - DNA, 22 bp, Homo sapiens
agatggtgtttccccaggtgga

SEQ ID NO: 7980765 - DNA, 22 bp, Homo sapiens
agatggtgtttccccaggtgga

SEQ ID NO: 7980766 - DNA, 22 bp, Homo sapiens
agatggttatcttttctttgta

SEQ ID NO: 7980767 - DNA, 22 bp, Homo sapiens
agatgtagtagtgggtctttta

SEQ ID NO: 7980768 - DNA, 22 bp, Homo sapiens
agatgtaagaccttcatgaggg

SEQ ID NO: 7980769 - DNA, 22 bp, Homo sapiens
agatgtaagaccttcatgaggg

SEQ ID NO: 7980770 - DNA, 22 bp, Homo sapiens
agatgtaaactctcatgtcatt

SEQ ID NO: 7980771 - DNA, 22 bp, Homo sapiens
agcaaacagtgtgctaagaaat

SEQ ID NO: 7980772 - DNA, 22 bp, Homo sapiens
agcaaacagtgtgctaagaaat

SEQ ID NO: 7980773 - DNA, 22 bp, Homo sapiens
agcaaacagtgtgctaagaaat

SEQ ID NO: 7980774 - DNA, 22 bp, Homo sapiens
agcaaacattcagcagattggc

SEQ ID NO: 7980775 - DNA, 22 bp, Homo sapiens
agcaaacagtgtgctaagaaat

SEQ ID NO: 7980776 - DNA, 22 bp, Homo sapiens
agcaaacagtgtgctaagaaat

SEQ ID NO: 7980777 - DNA, 22 bp, Homo sapiens
agcaaacagtgtgctaagaaat

SEQ ID NO: 7980778 - DNA, 22 bp, Homo sapiens
agcaaacagtgtgctaagaaat

SEQ ID NO: 7980779 - DNA, 22 bp, Homo sapiens
agcaaacagtgtgctaagaaat

SEQ ID NO: 7980780 - DNA, 22 bp, Homo sapiens
agcaaaataaggtaatttattg

SEQ ID NO: 7980781 - DNA, 20 bp, Homo sapiens
agcaaaatgcaagattttca

SEQ ID NO: 7980782 - DNA, 20 bp, Homo sapiens
agcaaaatgcaagattttca

SEQ ID NO: 7980783 - DNA, 20 bp, Homo sapiens
agcaaaatgcaagattttca

SEQ ID NO: 7980784 - DNA, 22 bp, Homo sapiens
agcaaaataaggtaatttattg

SEQ ID NO: 7980785 - DNA, 22 bp, Homo sapiens
agcaaaataaggtaatttattg

SEQ ID NO: 7980786 - DNA, 22 bp, Homo sapiens
agcaaaataaggtaatttattg

SEQ ID NO: 7980787 - DNA, 22 bp, Homo sapiens
agcaaaataaggtaatttattg

SEQ ID NO: 7980788 - DNA, 22 bp, Homo sapiens
agcaaaataaggtaatttattg

SEQ ID NO: 7980789 - DNA, 20 bp, Homo sapiens
agcaaacaggctccaccaga

SEQ ID NO: 7980790 - DNA, 22 bp, Homo sapiens
agcaaacagatgtctcctttag

SEQ ID NO: 7980791 - DNA, 20 bp, Homo sapiens
agcaaacaggctccaccaga

SEQ ID NO: 7980792 - DNA, 20 bp, Homo sapiens
agcaaaatgcaagattttca

SEQ ID NO: 7980793 - DNA, 20 bp, Homo sapiens
agcaaaatgcaagattttca

SEQ ID NO: 7980794 - DNA, 22 bp, Homo sapiens
atttgctttaaggtataaaagg

SEQ ID NO: 7980795 - DNA, 22 bp, Homo sapiens
atttgctttaaggtataaaagg

SEQ ID NO: 7980796 - DNA, 22 bp, Homo sapiens
atttgctttaaggtataaaagg

SEQ ID NO: 7980797 - DNA, 22 bp, Homo sapiens
atttgcttgttcaccagtactt

SEQ ID NO: 7980798 - DNA, 22 bp, Homo sapiens
atttgctttcaggtataaaagg

SEQ ID NO: 7980799 - DNA, 22 bp, Homo sapiens
atttgctttcaggtataaaagg

SEQ ID NO: 7980800 - DNA, 22 bp, Homo sapiens
atttgctttcaggtataaaagg

SEQ ID NO: 7980801 - DNA, 22 bp, Homo sapiens
atttgctttcccttccctgaca

SEQ ID NO: 7980802 - DNA, 22 bp, Homo sapiens
agatttcaatgtgagcattagt

SEQ ID NO: 7980803 - DNA, 22 bp, Homo sapiens
agatttcaggttggggcagaag

SEQ ID NO: 7980804 - DNA, 22 bp, Homo sapiens
agcaaaagatagattaacaaga

SEQ ID NO: 7980805 - DNA, 17 bp, Homo sapiens
agcaaaagtatcaaagc

SEQ ID NO: 7980806 - DNA, 17 bp, Homo sapiens
agcaaaagtatcaaagc

SEQ ID NO: 7980807 - DNA, 17 bp, Homo sapiens
agcaaaagtatcaaagc

SEQ ID NO: 7980808 - DNA, 22 bp, Homo sapiens
agatttccatctttttcatgtg

SEQ ID NO: 7980809 - DNA, 17 bp, Homo sapiens
agcaaaagtatcaaagc

SEQ ID NO: 7980810 - DNA, 17 bp, Homo sapiens
agcaaaagtatcaaagc

SEQ ID NO: 7980811 - DNA, 17 bp, Homo sapiens
agcaaaagtatcaaagc

SEQ ID NO: 7980812 - DNA, 22 bp, Homo sapiens
agcaaaataaggtaatttattg

SEQ ID NO: 7980813 - DNA, 22 bp, Homo sapiens
agatgtctgtaattctaagcat

SEQ ID NO: 7980814 - DNA, 22 bp, Homo sapiens
agatgtctgtaattctaagcat

SEQ ID NO: 7980815 - DNA, 23 bp, Homo sapiens
agatgtcttagaaactgaagctg

SEQ ID NO: 7980816 - DNA, 19 bp, Homo sapiens
agatgtctatttgactatc

SEQ ID NO: 7980817 - DNA, 22 bp, Homo sapiens
agatgtctcactcagttctcat

SEQ ID NO: 7980818 - DNA, 22 bp, Homo sapiens
agatgtctcccatggttttgac

SEQ ID NO: 7980819 - DNA, 19 bp, Homo sapiens
agatgtctatttgactatc

SEQ ID NO: 7980820 - DNA, 22 bp, Homo sapiens
agatgtgcctccaaggggtgca

SEQ ID NO: 7980821 - DNA, 22 bp, Homo sapiens
agatgtgagaatcaagtgacca

SEQ ID NO: 7980822 - DNA, 22 bp, Homo sapiens
agatgtgagaatcaagtgacca

SEQ ID NO: 7980823 - DNA, 22 bp, Homo sapiens
agatgtgagtggctgtacagtg

SEQ ID NO: 7980824 - DNA, 22 bp, Homo sapiens
agatgtgagaatcaagtgacca

SEQ ID NO: 7980825 - DNA, 20 bp, Homo sapiens
atttgctgagctttttctcc

SEQ ID NO: 7980826 - DNA, 20 bp, Homo sapiens
atttgctgagctttttctcc

SEQ ID NO: 7980827 - DNA, 22 bp, Homo sapiens
agatgtggaacactagactgct

SEQ ID NO: 7980828 - DNA, 19 bp, Homo sapiens
agatgtggagtttgatttc

SEQ ID NO: 7980829 - DNA, 22 bp, Homo sapiens
agatgtggatcctagggtagaa

SEQ ID NO: 7980830 - DNA, 22 bp, Homo sapiens
atttgcttagattcagcacttt

SEQ ID NO: 7980831 - DNA, 22 bp, Homo sapiens
atttgctgtgtgctttagagac

SEQ ID NO: 7980832 - DNA, 22 bp, Homo sapiens
atttgcttctgctaaacaactt

SEQ ID NO: 7980833 - DNA, 22 bp, Homo sapiens
atttgcttctgctaaacaactt

SEQ ID NO: 7980834 - DNA, 22 bp, Homo sapiens
atttgcttctgtgaaatcaagt

SEQ ID NO: 7980835 - DNA, 22 bp, Homo sapiens
atttgcttctagtcagttccat

SEQ ID NO: 7980836 - DNA, 22 bp, Homo sapiens
atttgcttctagtcagttccat

SEQ ID NO: 7980837 - DNA, 22 bp, Homo sapiens
atttgcttatctccacagttgt

SEQ ID NO: 7980838 - DNA, 22 bp, Homo sapiens
atttgcttatctccacagttgt

SEQ ID NO: 7980839 - DNA, 22 bp, Homo sapiens
atttgcttagattcagcacttt

SEQ ID NO: 7980840 - DNA, 22 bp, Homo sapiens
atttgcttagattcagcacttt

SEQ ID NO: 7980841 - DNA, 22 bp, Homo sapiens
atttgcttcctaatactcatat

SEQ ID NO: 7980842 - DNA, 22 bp, Homo sapiens
atttgcttcatagatctgtgga

SEQ ID NO: 7980843 - DNA, 22 bp, Homo sapiens
atttgcttatctccacagttgt

SEQ ID NO: 7980844 - DNA, 19 bp, Homo sapiens
atttgcttgtctgctctgc

SEQ ID NO: 7980845 - DNA, 19 bp, Homo sapiens
atttgcttgtctgctctgc

SEQ ID NO: 7980846 - DNA, 22 bp, Homo sapiens
atttgcttgtaaatgtatgcct

SEQ ID NO: 7980847 - DNA, 22 bp, Homo sapiens
atttgcttgtaaatgtatgcct

SEQ ID NO: 7980848 - DNA, 22 bp, Homo sapiens
atttgcttgtcctggtgactgt

SEQ ID NO: 7980849 - DNA, 22 bp, Homo sapiens
atttgcttgtcctggtgactgt

SEQ ID NO: 7980850 - DNA, 22 bp, Homo sapiens
atttgcttgtaaatgtatgcct

SEQ ID NO: 7980851 - DNA, 22 bp, Homo sapiens
atttgcttgactatggcttgca

SEQ ID NO: 7980852 - DNA, 22 bp, Homo sapiens
atttgcttgactatggcttgca

SEQ ID NO: 7980853 - DNA, 22 bp, Homo sapiens
atttgcttgtaaatgtatgcct

SEQ ID NO: 7980854 - DNA, 22 bp, Homo sapiens
attctctgttcaaggatggtga

SEQ ID NO: 7980855 - DNA, 22 bp, Homo sapiens
attctctgtttccaagatgaaa

SEQ ID NO: 7980856 - DNA, 22 bp, Homo sapiens
attctctgtttccaagatgaaa

SEQ ID NO: 7980857 - DNA, 22 bp, Homo sapiens
attctggacaaggcaagctcct

SEQ ID NO: 7980858 - DNA, 22 bp, Homo sapiens
attctctgtgtctgctttccca

SEQ ID NO: 7980859 - DNA, 22 bp, Homo sapiens
attctctgtgtctgctttccca

SEQ ID NO: 7980860 - DNA, 22 bp, Homo sapiens
attctctgtggtgatgctggtg

SEQ ID NO: 7980861 - DNA, 22 bp, Homo sapiens
attctctgtggtgatgctggtg

SEQ ID NO: 7980862 - DNA, 22 bp, Homo sapiens
attcaggagtgtgccaggaagg

SEQ ID NO: 7980863 - DNA, 22 bp, Homo sapiens
attcagctgatggtatttaaat

SEQ ID NO: 7980864 - DNA, 22 bp, Homo sapiens
attcagctctgaatcagcagac

SEQ ID NO: 7980865 - DNA, 22 bp, Homo sapiens
attcagcttcaatgtcttcacc

SEQ ID NO: 7980866 - DNA, 22 bp, Homo sapiens
attcagggaggaaaggggcctc

SEQ ID NO: 7980867 - DNA, 22 bp, Homo sapiens
attcagctaagtgcttcatgct

SEQ ID NO: 7980868 - DNA, 22 bp, Homo sapiens
attcagcattggcaccatggat

SEQ ID NO: 7980869 - DNA, 22 bp, Homo sapiens
attctggacaaggcaagctcct

SEQ ID NO: 7980870 - DNA, 22 bp, Homo sapiens
attctggacaaggcaagctcct

SEQ ID NO: 7980871 - DNA, 22 bp, Homo sapiens
attctggacaatgagaaactgg

SEQ ID NO: 7980872 - DNA, 22 bp, Homo sapiens
attctggatattacttatctat

SEQ ID NO: 7980873 - DNA, 22 bp, Homo sapiens
attctggattatcagtccacca

SEQ ID NO: 7980874 - DNA, 22 bp, Homo sapiens
attctgggaactttgtctctca

SEQ ID NO: 7980875 - DNA, 22 bp, Homo sapiens
attctgggaactttgtctctca

SEQ ID NO: 7980876 - DNA, 22 bp, Homo sapiens
attctggggctggttattttga

SEQ ID NO: 7980877 - DNA, 22 bp, Homo sapiens
attctgggtttttgtcttctgt

SEQ ID NO: 7980878 - DNA, 22 bp, Homo sapiens
attctgtaattgaactgtgttg

SEQ ID NO: 7980879 - DNA, 22 bp, Homo sapiens
attctgtaattgaactgtgttg

SEQ ID NO: 7980880 - DNA, 22 bp, Homo sapiens
attctgtatggaaaagcactat

SEQ ID NO: 7980881 - DNA, 22 bp, Homo sapiens
attctgtatggaaaagcactat

SEQ ID NO: 7980882 - DNA, 22 bp, Homo sapiens
attctgtcagatcttactggat

SEQ ID NO: 7980883 - DNA, 21 bp, Homo sapiens
agagggagagtggcccttcca

SEQ ID NO: 7980884 - DNA, 22 bp, Homo sapiens
attctgtcagatcttactggat

SEQ ID NO: 7980885 - DNA, 23 bp, Homo sapiens
agagggagatgtttttctcaaga

SEQ ID NO: 7980886 - DNA, 23 bp, Homo sapiens
agagggagatgtttttctcaaga

SEQ ID NO: 7980887 - DNA, 22 bp, Homo sapiens
attctgtatttggatataaggg

SEQ ID NO: 7980888 - DNA, 22 bp, Homo sapiens
attctgtatttctaataagatc

SEQ ID NO: 7980889 - DNA, 22 bp, Homo sapiens
attctgtatggggaaactagag

SEQ ID NO: 7980890 - DNA, 22 bp, Homo sapiens
attctgtatggggaaactagag

SEQ ID NO: 7980891 - DNA, 22 bp, Homo sapiens
attctgtatttctaataagatc

SEQ ID NO: 7980892 - DNA, 22 bp, Homo sapiens
agagggtgctggagagacattg

SEQ ID NO: 7980893 - DNA, 22 bp, Homo sapiens
agagggtgctggagagacattg

SEQ ID NO: 7980894 - DNA, 22 bp, Homo sapiens
agagggtgggcacgtgatggat

SEQ ID NO: 7980895 - DNA, 22 bp, Homo sapiens
agagggtgggcacgtgatggat

SEQ ID NO: 7980896 - DNA, 22 bp, Homo sapiens
agagggtgggcacgtgatggat

SEQ ID NO: 7980897 - DNA, 22 bp, Homo sapiens
agagggtgggcacgtgatggat

SEQ ID NO: 7980898 - DNA, 22 bp, Homo sapiens
agagggtgggcacgtgatggat

SEQ ID NO: 7980899 - DNA, 23 bp, Homo sapiens
agagggtgcaacatggggatcta

SEQ ID NO: 7980900 - DNA, 23 bp, Homo sapiens
agagggtgcaacatggggatcta

SEQ ID NO: 7980901 - DNA, 22 bp, Homo sapiens
agagggtgagcaggtacacatg

SEQ ID NO: 7980902 - DNA, 22 bp, Homo sapiens
agagggtgagcaggtacacatg

SEQ ID NO: 7980903 - DNA, 22 bp, Homo sapiens
agagggtgctggagagacattg

SEQ ID NO: 7980904 - DNA, 22 bp, Homo sapiens
agagggtgaatgagatagaaaa

SEQ ID NO: 7980905 - DNA, 22 bp, Homo sapiens
agagggtagaagacagggttgc

SEQ ID NO: 7980906 - DNA, 22 bp, Homo sapiens
agagggtatgagtggggctaaa

SEQ ID NO: 7980907 - DNA, 22 bp, Homo sapiens
agagggtgaatgagatagaaaa

SEQ ID NO: 7980908 - DNA, 22 bp, Homo sapiens
agagggtgaatgagatagaaaa

SEQ ID NO: 7980909 - DNA, 22 bp, Homo sapiens
agagggtgaatgagatagaaaa

SEQ ID NO: 7980910 - DNA, 22 bp, Homo sapiens
agaggggctcatatcctgtcat

SEQ ID NO: 7980911 - DNA, 22 bp, Homo sapiens
agagggcagcagcaacaactct

SEQ ID NO: 7980912 - DNA, 22 bp, Homo sapiens
agaggggctcatatcctgtcat

SEQ ID NO: 7980913 - DNA, 22 bp, Homo sapiens
agagggagctttatttttctgt

SEQ ID NO: 7980914 - DNA, 22 bp, Homo sapiens
agagggagctttatttttctgt

SEQ ID NO: 7980915 - DNA, 22 bp, Homo sapiens
agagggagtgaaatggaataga

SEQ ID NO: 7980916 - DNA, 22 bp, Homo sapiens
agagggagcccagtcatagctg

SEQ ID NO: 7980917 - DNA, 22 bp, Homo sapiens
agagggagcccagtcatagctg

SEQ ID NO: 7980918 - DNA, 22 bp, Homo sapiens
agagggagtgaaatggaataga

SEQ ID NO: 7980919 - DNA, 22 bp, Homo sapiens
agagggagtgaaatggaataga

SEQ ID NO: 7980920 - DNA, 22 bp, Homo sapiens
agagggagtgaaatggaataga

SEQ ID NO: 7980921 - DNA, 22 bp, Homo sapiens
agagggatcaccctgtttctgg

SEQ ID NO: 7980922 - DNA, 22 bp, Homo sapiens
agagggatcaccctgtttctgg

SEQ ID NO: 7980923 - DNA, 22 bp, Homo sapiens
agagggcaagtgtagtccagta

SEQ ID NO: 7980924 - DNA, 22 bp, Homo sapiens
agagggcaagtgtagtccagta

SEQ ID NO: 7980925 - DNA, 22 bp, Homo sapiens
agagggcaagtgtagtccagta

SEQ ID NO: 7980926 - DNA, 22 bp, Homo sapiens
agagggcaagtgtagtccagta

SEQ ID NO: 7980927 - DNA, 22 bp, Homo sapiens
attcacacacatttagagcaga

SEQ ID NO: 7980928 - DNA, 22 bp, Homo sapiens
attcacactgtatacacaggat

SEQ ID NO: 7980929 - DNA, 22 bp, Homo sapiens
attcacactgtatacacaggat

SEQ ID NO: 7980930 - DNA, 22 bp, Homo sapiens
attcacagaatagttttaccag

SEQ ID NO: 7980931 - DNA, 22 bp, Homo sapiens
attcacactttacttctttcca

SEQ ID NO: 7980932 - DNA, 22 bp, Homo sapiens
attcacagagtggttagtggta

SEQ ID NO: 7980933 - DNA, 22 bp, Homo sapiens
attcacagagtggttagtggta

SEQ ID NO: 7980934 - DNA, 22 bp, Homo sapiens
attcacagaatagttttaccag

SEQ ID NO: 7980935 - DNA, 22 bp, Homo sapiens
attcacagagtggttagtggta

SEQ ID NO: 7980936 - DNA, 22 bp, Homo sapiens
attcaaagtaataaccagaact

SEQ ID NO: 7980937 - DNA, 22 bp, Homo sapiens
attcaaagtaataaccagaact

SEQ ID NO: 7980938 - DNA, 22 bp, Homo sapiens
attatagagggttacagttaat

SEQ ID NO: 7980939 - DNA, 22 bp, Homo sapiens
attcaaagcccagtaaacattg

SEQ ID NO: 7980940 - DNA, 22 bp, Homo sapiens
attcaaagcccagtaaacattg

SEQ ID NO: 7980941 - DNA, 22 bp, Homo sapiens
attataaagaacatgtgtgtgg

SEQ ID NO: 7980942 - DNA, 22 bp, Homo sapiens
attataaagaacatgtgtgtgg

SEQ ID NO: 7980943 - DNA, 22 bp, Homo sapiens
attataaagaacatgtgtgtgg

SEQ ID NO: 7980944 - DNA, 22 bp, Homo sapiens
attataaagaacatgtgtgtgg

SEQ ID NO: 7980945 - DNA, 22 bp, Homo sapiens
attataaagaacatgtgtgtgg

SEQ ID NO: 7980946 - DNA, 22 bp, Homo sapiens
attataaagaacatgtgtgtgg

SEQ ID NO: 7980947 - DNA, 22 bp, Homo sapiens
attataaagaacatgtgtgtgg

SEQ ID NO: 7980948 - DNA, 22 bp, Homo sapiens
attataaagaacatgtgtgtgg

SEQ ID NO: 7980949 - DNA, 22 bp, Homo sapiens
attataaagaacatgtgtgtgg

SEQ ID NO: 7980950 - DNA, 22 bp, Homo sapiens
attataaacctttgagggtggg

SEQ ID NO: 7980951 - DNA, 22 bp, Homo sapiens
attataaagaacatgtgtgtgg

SEQ ID NO: 7980952 - DNA, 22 bp, Homo sapiens
attataaacctttgagggtggg

SEQ ID NO: 7980953 - DNA, 22 bp, Homo sapiens
attataaacctttgagggtggg

SEQ ID NO: 7980954 - DNA, 22 bp, Homo sapiens
attataaacctttgagggtggg

SEQ ID NO: 7980955 - DNA, 22 bp, Homo sapiens
attataaatattttctaggggt

SEQ ID NO: 7980956 - DNA, 22 bp, Homo sapiens
attataaatattttctaggggt

SEQ ID NO: 7980957 - DNA, 22 bp, Homo sapiens
attataaatattttctaggggt

SEQ ID NO: 7980958 - DNA, 22 bp, Homo sapiens
attataaatattttctaggggt

SEQ ID NO: 7980959 - DNA, 22 bp, Homo sapiens
attatacaaggctggtgcctaa

SEQ ID NO: 7980960 - DNA, 22 bp, Homo sapiens
attataaatattttctaggggt

SEQ ID NO: 7980961 - DNA, 22 bp, Homo sapiens
attataaatattttctaggggt

SEQ ID NO: 7980962 - DNA, 22 bp, Homo sapiens
attataaatattttctaggggt

SEQ ID NO: 7980963 - DNA, 22 bp, Homo sapiens
attatacattttgtgtagagat

SEQ ID NO: 7980964 - DNA, 22 bp, Homo sapiens
attatacattttgtgtagagat

SEQ ID NO: 7980965 - DNA, 22 bp, Homo sapiens
attatacattttgtgtagagat

SEQ ID NO: 7980966 - DNA, 22 bp, Homo sapiens
attatacattttgtgtagagat

SEQ ID NO: 7980967 - DNA, 22 bp, Homo sapiens
attatacattttgtgtagagat

SEQ ID NO: 7980968 - DNA, 22 bp, Homo sapiens
attatagagggttacagttaat

SEQ ID NO: 7980969 - DNA, 22 bp, Homo sapiens
attcacagtttcctcatattct

SEQ ID NO: 7980970 - DNA, 22 bp, Homo sapiens
attcagagtctgcacaacagca

SEQ ID NO: 7980971 - DNA, 22 bp, Homo sapiens
attcacagttcattagctgtaa

SEQ ID NO: 7980972 - DNA, 22 bp, Homo sapiens
attcacagtttcctcatattct

SEQ ID NO: 7980973 - DNA, 22 bp, Homo sapiens
attcacagttactgctgaacca

SEQ ID NO: 7980974 - DNA, 22 bp, Homo sapiens
attcacagttactgctgaacca

SEQ ID NO: 7980975 - DNA, 22 bp, Homo sapiens
attcacagttactgctgaacca

SEQ ID NO: 7980976 - DNA, 22 bp, Homo sapiens
attcacagttactgctgaacca

SEQ ID NO: 7980977 - DNA, 22 bp, Homo sapiens
attcacagtatggacgaaatga

SEQ ID NO: 7980978 - DNA, 21 bp, Homo sapiens
attcacaggtatcctctccct

SEQ ID NO: 7980979 - DNA, 21 bp, Homo sapiens
attcacaggtatcctctccct

SEQ ID NO: 7980980 - DNA, 22 bp, Homo sapiens
attcacagggctttccgcatgg

SEQ ID NO: 7980981 - DNA, 22 bp, Homo sapiens
attcacagggctttccgcatgg

SEQ ID NO: 7980982 - DNA, 22 bp, Homo sapiens
attcacagggacaatgggagag

SEQ ID NO: 7980983 - DNA, 22 bp, Homo sapiens
attcagcattcatttccaactt

SEQ ID NO: 7980984 - DNA, 19 bp, Homo sapiens
attcagcattctgcacttc

SEQ ID NO: 7980985 - DNA, 22 bp, Homo sapiens
attcagcattcattatgcgcca

SEQ ID NO: 7980986 - DNA, 22 bp, Homo sapiens
attcagcagttcctgcttcagt

SEQ ID NO: 7980987 - DNA, 22 bp, Homo sapiens
attcagcagttcctgcttcagt

SEQ ID NO: 7980988 - DNA, 22 bp, Homo sapiens
attcagcagttcctgcttcagt

SEQ ID NO: 7980989 - DNA, 22 bp, Homo sapiens
attcagcagccatggcttctga

SEQ ID NO: 7980990 - DNA, 22 bp, Homo sapiens
attcagcaaacatttattgtgt

SEQ ID NO: 7980991 - DNA, 22 bp, Homo sapiens
attcagcaaacatttattgtgt

SEQ ID NO: 7980992 - DNA, 22 bp, Homo sapiens
attcagcaatgagcttggattt

SEQ ID NO: 7980993 - DNA, 22 bp, Homo sapiens
attcagcacaatttggccaata

SEQ ID NO: 7980994 - DNA, 22 bp, Homo sapiens
attcagcacatctttgtacagc

SEQ ID NO: 7980995 - DNA, 22 bp, Homo sapiens
attcagattggtttaagctagt

SEQ ID NO: 7980996 - DNA, 22 bp, Homo sapiens
attcagattggtttaagctagt

SEQ ID NO: 7980997 - DNA, 22 bp, Homo sapiens
attcacagtttcctcatattct

SEQ ID NO: 7980998 - DNA, 22 bp, Homo sapiens
attcagatcatatttatagctt

SEQ ID NO: 7980999 - DNA, 22 bp, Homo sapiens
attcagcaaacatttattatct

SEQ ID NO: 7981000 - DNA, 22 bp, Homo sapiens
attcagcaaacatttattatct

SEQ ID NO: 7981001 - DNA, 22 bp, Homo sapiens
atgtgtgtacacacgtgactct

SEQ ID NO: 7981002 - DNA, 22 bp, Homo sapiens
atgtgtgtacacacgtgactct

SEQ ID NO: 7981003 - DNA, 22 bp, Homo sapiens
atgtgtgtacacacgtgactct

SEQ ID NO: 7981004 - DNA, 22 bp, Homo sapiens
atgtgtgtacacacgtgactct

SEQ ID NO: 7981005 - DNA, 22 bp, Homo sapiens
atgtgtgtacacacgtgactct

SEQ ID NO: 7981006 - DNA, 22 bp, Homo sapiens
atgtgtgtacacacgtgactct

SEQ ID NO: 7981007 - DNA, 22 bp, Homo sapiens
atgtgtgtaaacaagtataatt

SEQ ID NO: 7981008 - DNA, 22 bp, Homo sapiens
atgtgtgtaaacaagtataatt

SEQ ID NO: 7981009 - DNA, 22 bp, Homo sapiens
atgtgtgtacacacgtgactct

SEQ ID NO: 7981010 - DNA, 22 bp, Homo sapiens
atgttaaataatcccttaaagc

SEQ ID NO: 7981011 - DNA, 22 bp, Homo sapiens
atgttaaagatggtgggaaatt

SEQ ID NO: 7981012 - DNA, 22 bp, Homo sapiens
atgttaaagatggtgggaaatt

SEQ ID NO: 7981013 - DNA, 22 bp, Homo sapiens
atgttaaagatggtgggaaatt

SEQ ID NO: 7981014 - DNA, 22 bp, Homo sapiens
atgtgtgtacacacgtgactct

SEQ ID NO: 7981015 - DNA, 22 bp, Homo sapiens
atgtgtgtacacacgtgactct

SEQ ID NO: 7981016 - DNA, 22 bp, Homo sapiens
atgtgtgtaaacaagtataatt

SEQ ID NO: 7981017 - DNA, 22 bp, Homo sapiens
atgtgtgtaaacaagtataatt

SEQ ID NO: 7981018 - DNA, 22 bp, Homo sapiens
atgtgtgtaaacaagtataatt

SEQ ID NO: 7981019 - DNA, 23 bp, Homo sapiens
atgtgtgggaggtcagagagcca

SEQ ID NO: 7981020 - DNA, 22 bp, Homo sapiens
atgtgtgctcttgagccttcac

SEQ ID NO: 7981021 - DNA, 21 bp, Homo sapiens
atgtgtgctagaggactactg

SEQ ID NO: 7981022 - DNA, 22 bp, Homo sapiens
atgtgtgctcttgagccttcac

SEQ ID NO: 7981023 - DNA, 21 bp, Homo sapiens
atgtgtgctagaggactactg

SEQ ID NO: 7981024 - DNA, 22 bp, Homo sapiens
atgtgtgctacaggtgtgggaa

SEQ ID NO: 7981025 - DNA, 22 bp, Homo sapiens
atgtgtatccatctgtctattt

SEQ ID NO: 7981026 - DNA, 22 bp, Homo sapiens
atgtgtatccatctgtctattt

SEQ ID NO: 7981027 - DNA, 22 bp, Homo sapiens
atgtcttctaagctctaagctg

SEQ ID NO: 7981028 - DNA, 22 bp, Homo sapiens
atgtcttctctgtaggtaaatt

SEQ ID NO: 7981029 - DNA, 22 bp, Homo sapiens
atgtgtatccatctgtctattt

SEQ ID NO: 7981030 - DNA, 22 bp, Homo sapiens
atgtgtcttggagttttaatgt

SEQ ID NO: 7981031 - DNA, 22 bp, Homo sapiens
atgtgtcttggagttttaatgt

SEQ ID NO: 7981032 - DNA, 22 bp, Homo sapiens
atgtgtctttcaaggtatagaa

SEQ ID NO: 7981033 - DNA, 18 bp, Homo sapiens
atgtgtctttcttgtttg

SEQ ID NO: 7981034 - DNA, 22 bp, Homo sapiens
atgtgtctttgagactctgcta

SEQ ID NO: 7981035 - DNA, 22 bp, Homo sapiens
atgtgtctttcaaggtatagaa

SEQ ID NO: 7981036 - DNA, 22 bp, Homo sapiens
atgtgtctttcaaggtatagaa

SEQ ID NO: 7981037 - DNA, 18 bp, Homo sapiens
atgtgtctttcttgtttg

SEQ ID NO: 7981038 - DNA, 22 bp, Homo sapiens
atgtgtctttgagactctgcta

SEQ ID NO: 7981039 - DNA, 22 bp, Homo sapiens
atgtgtgcatattctgccacct

SEQ ID NO: 7981040 - DNA, 22 bp, Homo sapiens
atgtgtgcaatgctattttggc

SEQ ID NO: 7981041 - DNA, 22 bp, Homo sapiens
atgtgtgcatattctgccacct

SEQ ID NO: 7981042 - DNA, 22 bp, Homo sapiens
atgtgtgcatcaatgatagatc

SEQ ID NO: 7981043 - DNA, 22 bp, Homo sapiens
atgtgtgcatcaatgatagatc

SEQ ID NO: 7981044 - DNA, 22 bp, Homo sapiens
atgtgtgctacaggtgtgggaa

SEQ ID NO: 7981045 - DNA, 22 bp, Homo sapiens
atgtgtgcgggaaggaaagtga

SEQ ID NO: 7981046 - DNA, 22 bp, Homo sapiens
atgtgtgcctgagtgatggact

SEQ ID NO: 7981047 - DNA, 22 bp, Homo sapiens
atgtgtgcctgagtgatggact

SEQ ID NO: 7981048 - DNA, 22 bp, Homo sapiens
atgtgtgccccttttactcttt

SEQ ID NO: 7981049 - DNA, 22 bp, Homo sapiens
atgtgtgcatgttagagagagt

SEQ ID NO: 7981050 - DNA, 22 bp, Homo sapiens
atgtgtgcatgttagagagagt

SEQ ID NO: 7981051 - DNA, 22 bp, Homo sapiens
atgtttatgttgggctatattt

SEQ ID NO: 7981052 - DNA, 22 bp, Homo sapiens
atgttacacataggcataaatg

SEQ ID NO: 7981053 - DNA, 22 bp, Homo sapiens
atgtttatgttgggctatattt

SEQ ID NO: 7981054 - DNA, 22 bp, Homo sapiens
atgttacacataggcataaatg

SEQ ID NO: 7981055 - DNA, 22 bp, Homo sapiens
atgttacacataggcataaatg

SEQ ID NO: 7981056 - DNA, 22 bp, Homo sapiens
atgttacacataggcataaatg

SEQ ID NO: 7981057 - DNA, 22 bp, Homo sapiens
atgttacaattcaaaatgctgc

SEQ ID NO: 7981058 - DNA, 22 bp, Homo sapiens
atgttacaattcaaaatgctgc

SEQ ID NO: 7981059 - DNA, 22 bp, Homo sapiens
atgttacaatccaacaaaatta

SEQ ID NO: 7981060 - DNA, 22 bp, Homo sapiens
atgtttgactgagtttggcaga

SEQ ID NO: 7981061 - DNA, 22 bp, Homo sapiens
atgtttgactgagtttggcaga

SEQ ID NO: 7981062 - DNA, 23 bp, Homo sapiens
atgtttgcagtaacccatcctgg

SEQ ID NO: 7981063 - DNA, 23 bp, Homo sapiens
atgtttgcagtaacccatcctgg

SEQ ID NO: 7981064 - DNA, 22 bp, Homo sapiens
atgtttctgtcctacgagataa

SEQ ID NO: 7981065 - DNA, 22 bp, Homo sapiens
atgtttgaaattgtaagtatat

SEQ ID NO: 7981066 - DNA, 22 bp, Homo sapiens
atgtttctgtcctacgagataa

SEQ ID NO: 7981067 - DNA, 22 bp, Homo sapiens
atgtttctgagtgtatatacat

SEQ ID NO: 7981068 - DNA, 22 bp, Homo sapiens
atgtttctgaagtttacagata

SEQ ID NO: 7981069 - DNA, 22 bp, Homo sapiens
atgttaaatggtttattattaa

SEQ ID NO: 7981070 - DNA, 22 bp, Homo sapiens
atgttaaatggtttattattaa

SEQ ID NO: 7981071 - DNA, 22 bp, Homo sapiens
atgttaaatggtttattattaa

SEQ ID NO: 7981072 - DNA, 22 bp, Homo sapiens
atgttaaatagccatttgtttg

SEQ ID NO: 7981073 - DNA, 20 bp, Homo sapiens
atgttaaatagcatttagag

SEQ ID NO: 7981074 - DNA, 20 bp, Homo sapiens
atgttaaatagcatttagag

SEQ ID NO: 7981075 - DNA, 20 bp, Homo sapiens
atgttaaatagcatttagag

SEQ ID NO: 7981076 - DNA, 22 bp, Homo sapiens
atgttaaatagccatttgtttg

SEQ ID NO: 7981077 - DNA, 17 bp, Homo sapiens
atgttaatttcacattt

SEQ ID NO: 7981078 - DNA, 22 bp, Homo sapiens
atgttaagttactgaaatgaga

SEQ ID NO: 7981079 - DNA, 22 bp, Homo sapiens
atgttaagtttagcaggctagg

SEQ ID NO: 7981080 - DNA, 22 bp, Homo sapiens
atgttacaaatcctacaggtag

SEQ ID NO: 7981081 - DNA, 22 bp, Homo sapiens
atgttacaaatcctacaggtag

SEQ ID NO: 7981082 - DNA, 22 bp, Homo sapiens
atgttacaatccaacaaaatta

SEQ ID NO: 7981083 - DNA, 22 bp, Homo sapiens
atgttacaatccaacaaaatta

SEQ ID NO: 7981084 - DNA, 22 bp, Homo sapiens
atgttacaatccaacaaaatta

SEQ ID NO: 7981085 - DNA, 22 bp, Homo sapiens
atgttacaatccaacaaaatta

SEQ ID NO: 7981086 - DNA, 22 bp, Homo sapiens
atgttacaaccctgaggagccg

SEQ ID NO: 7981087 - DNA, 22 bp, Homo sapiens
atgttacaaccctgaggagccg

SEQ ID NO: 7981088 - DNA, 23 bp, Homo sapiens
atgttaagaaggtagttaggata

SEQ ID NO: 7981089 - DNA, 23 bp, Homo sapiens
atgttaagtgaaataggccagga

SEQ ID NO: 7981090 - DNA, 22 bp, Homo sapiens
atgttaagaatgcagacaaatg

SEQ ID NO: 7981091 - DNA, 22 bp, Homo sapiens
atgttaagaatgcagacaaatg

SEQ ID NO: 7981092 - DNA, 22 bp, Homo sapiens
atgttaaatggtttattattaa

SEQ ID NO: 7981093 - DNA, 22 bp, Homo sapiens
attacagtaacagctacaatgc

SEQ ID NO: 7981094 - DNA, 22 bp, Homo sapiens
attacagtagcaaaagaccgga

SEQ ID NO: 7981095 - DNA, 22 bp, Homo sapiens
attaaatactgcaggctaagca

SEQ ID NO: 7981096 - DNA, 22 bp, Homo sapiens
attaaatactgcaggctaagca

SEQ ID NO: 7981097 - DNA, 22 bp, Homo sapiens
attaaatactgcaggctaagca

SEQ ID NO: 7981098 - DNA, 22 bp, Homo sapiens
attaaatactgcaggctaagca

SEQ ID NO: 7981099 - DNA, 22 bp, Homo sapiens
attaaagtgaagttctcagatg

SEQ ID NO: 7981100 - DNA, 22 bp, Homo sapiens
attagattgtaaatgttttcac

SEQ ID NO: 7981101 - DNA, 22 bp, Homo sapiens
attagatgtgtttaagtagaga

SEQ ID NO: 7981102 - DNA, 22 bp, Homo sapiens
attaaatactgcaggctaagca

SEQ ID NO: 7981103 - DNA, 22 bp, Homo sapiens
attacagtggacagctatgcac

SEQ ID NO: 7981104 - DNA, 22 bp, Homo sapiens
attagcaacatggtgaatatgt

SEQ ID NO: 7981105 - DNA, 22 bp, Homo sapiens
attagcaacatggtgaatatgt

SEQ ID NO: 7981106 - DNA, 22 bp, Homo sapiens
attagcaacatggtgaatatgt

SEQ ID NO: 7981107 - DNA, 22 bp, Homo sapiens
attagcaaaacaacttttctat

SEQ ID NO: 7981108 - DNA, 22 bp, Homo sapiens
attagcaactgtcttgaaaaca

SEQ ID NO: 7981109 - DNA, 22 bp, Homo sapiens
attagcaactgtcttgaaaaca

SEQ ID NO: 7981110 - DNA, 22 bp, Homo sapiens
attagcaactcttatgtaagca

SEQ ID NO: 7981111 - DNA, 22 bp, Homo sapiens
attagcaaggcagcatcaggca

SEQ ID NO: 7981112 - DNA, 22 bp, Homo sapiens
attagcaaggttcatgagaaga

SEQ ID NO: 7981113 - DNA, 21 bp, Homo sapiens
attagcaaggggaggcctcag

SEQ ID NO: 7981114 - DNA, 21 bp, Homo sapiens
attagcaaggggaggcctcag

SEQ ID NO: 7981115 - DNA, 22 bp, Homo sapiens
attagcaagttgttatcctttg

SEQ ID NO: 7981116 - DNA, 22 bp, Homo sapiens
attagcaagttgttatcctttg

SEQ ID NO: 7981117 - DNA, 22 bp, Homo sapiens
attataaacctttgagggtggg

SEQ ID NO: 7981118 - DNA, 22 bp, Homo sapiens
attataaacctttgagggtggg

SEQ ID NO: 7981119 - DNA, 22 bp, Homo sapiens
attataaacctttgagggtggg

SEQ ID NO: 7981120 - DNA, 22 bp, Homo sapiens
attagctgacctctaaggagcc

SEQ ID NO: 7981121 - DNA, 22 bp, Homo sapiens
attagctgtgacgaggcattgt

SEQ ID NO: 7981122 - DNA, 22 bp, Homo sapiens
attagctgttgtgaaaggggtg

SEQ ID NO: 7981123 - DNA, 20 bp, Homo sapiens
attagctcaggtgaggtcat

SEQ ID NO: 7981124 - DNA, 20 bp, Homo sapiens
attagctcaggtgaggtcat

SEQ ID NO: 7981125 - DNA, 20 bp, Homo sapiens
attagctcaggtgaggtcat

SEQ ID NO: 7981126 - DNA, 22 bp, Homo sapiens
attagcatgccaagcttttaga

SEQ ID NO: 7981127 - DNA, 22 bp, Homo sapiens
attagcatattaaatagtcatt

SEQ ID NO: 7981128 - DNA, 22 bp, Homo sapiens
attagcatattaaatagtcatt

SEQ ID NO: 7981129 - DNA, 22 bp, Homo sapiens
attagcacataagaggtatagg

SEQ ID NO: 7981130 - DNA, 22 bp, Homo sapiens
attagcagctttctggtctcta

SEQ ID NO: 7981131 - DNA, 22 bp, Homo sapiens
attagcaatggtggtattagga

SEQ ID NO: 7981132 - DNA, 22 bp, Homo sapiens
attagcaatctgcaatggctgt

SEQ ID NO: 7981133 - DNA, 22 bp, Homo sapiens
attagcaatcacgcagtcattt

SEQ ID NO: 7981134 - DNA, 22 bp, Homo sapiens
attagcaattgccctgtgcaat

SEQ ID NO: 7981135 - DNA, 22 bp, Homo sapiens
attagcaattgccctgtgcaat

SEQ ID NO: 7981136 - DNA, 22 bp, Homo sapiens
attagcaattgccctgtgcaat

SEQ ID NO: 7981137 - DNA, 22 bp, Homo sapiens
attagcaattgtttcattgatc

SEQ ID NO: 7981138 - DNA, 22 bp, Homo sapiens
attaaacaatgtaaagttcttg

SEQ ID NO: 7981139 - DNA, 22 bp, Homo sapiens
attaaactgagcaaattaacat

SEQ ID NO: 7981140 - DNA, 22 bp, Homo sapiens
attaaacaatgtaaagttcttg

SEQ ID NO: 7981141 - DNA, 22 bp, Homo sapiens
attaaacaatgtaaagttcttg

SEQ ID NO: 7981142 - DNA, 22 bp, Homo sapiens
atgttttaccctttgcacaaac

SEQ ID NO: 7981143 - DNA, 22 bp, Homo sapiens
atgttttaaatatgtgtgtaaa

SEQ ID NO: 7981144 - DNA, 22 bp, Homo sapiens
attaaagaaacccagcatgtga

SEQ ID NO: 7981145 - DNA, 22 bp, Homo sapiens
attaaagaaacccagcatgtga

SEQ ID NO: 7981146 - DNA, 22 bp, Homo sapiens
attaaagaaacccagcatgtga

SEQ ID NO: 7981147 - DNA, 22 bp, Homo sapiens
attaaagaaacccagcatgtga

SEQ ID NO: 7981148 - DNA, 22 bp, Homo sapiens
attaaagaaacccagcatgtga

SEQ ID NO: 7981149 - DNA, 22 bp, Homo sapiens
attaaagctatccagtcatgaa

SEQ ID NO: 7981150 - DNA, 22 bp, Homo sapiens
attaaagctatccagtcatgaa

SEQ ID NO: 7981151 - DNA, 22 bp, Homo sapiens
attaaagacagcagatggatgg

SEQ ID NO: 7981152 - DNA, 22 bp, Homo sapiens
attaaagctatccagtcatgaa

SEQ ID NO: 7981153 - DNA, 22 bp, Homo sapiens
atgtttgttgaacatctactgc

SEQ ID NO: 7981154 - DNA, 22 bp, Homo sapiens
atgtttgttgaacatctactgc

SEQ ID NO: 7981155 - DNA, 22 bp, Homo sapiens
atgtttgtgtttcccattcagg

SEQ ID NO: 7981156 - DNA, 22 bp, Homo sapiens
atgtttgttgatcatttatgaa

SEQ ID NO: 7981157 - DNA, 22 bp, Homo sapiens
atgtttgttgatcatttatgaa

SEQ ID NO: 7981158 - DNA, 22 bp, Homo sapiens
atgtttgttgatcatttatgaa

SEQ ID NO: 7981159 - DNA, 22 bp, Homo sapiens
atgtttgttgaacatctactgc

SEQ ID NO: 7981160 - DNA, 22 bp, Homo sapiens
atgtttgtcaggattgtaatta

SEQ ID NO: 7981161 - DNA, 22 bp, Homo sapiens
atgtttgtaggtaagtgacact

SEQ ID NO: 7981162 - DNA, 22 bp, Homo sapiens
atgtttgtgttacactctgcag

SEQ ID NO: 7981163 - DNA, 22 bp, Homo sapiens
atgtttgtgttacactctgcag

SEQ ID NO: 7981164 - DNA, 22 bp, Homo sapiens
atgtttgtgggataaacaaatg

SEQ ID NO: 7981165 - DNA, 22 bp, Homo sapiens
atgtacatactgcattttcaaa

SEQ ID NO: 7981166 - DNA, 22 bp, Homo sapiens
atgtacatactgcattttcaaa

SEQ ID NO: 7981167 - DNA, 22 bp, Homo sapiens
atgtcaaatcagttttatcaga

SEQ ID NO: 7981168 - DNA, 22 bp, Homo sapiens
atgtcaaatcagttttatcaga

SEQ ID NO: 7981169 - DNA, 22 bp, Homo sapiens
atgtcaaatcagttttatcaga

SEQ ID NO: 7981170 - DNA, 22 bp, Homo sapiens
atgtcaaatcagttttatcaga

SEQ ID NO: 7981171 - DNA, 21 bp, Homo sapiens
atgtcaaatgctttattttat

SEQ ID NO: 7981172 - DNA, 23 bp, Homo sapiens
atgtccaaagggattcgtctgat

SEQ ID NO: 7981173 - DNA, 22 bp, Homo sapiens
atgtcaaatgctgcaaactcat

SEQ ID NO: 7981174 - DNA, 22 bp, Homo sapiens
atgtacatactgcattttcaaa

SEQ ID NO: 7981175 - DNA, 21 bp, Homo sapiens
atgtcaaatgctttattttat

SEQ ID NO: 7981176 - DNA, 22 bp, Homo sapiens
atgtccaatttcagagtctcat

SEQ ID NO: 7981177 - DNA, 22 bp, Homo sapiens
atgtccagaagggtcccctgtt

SEQ ID NO: 7981178 - DNA, 22 bp, Homo sapiens
atgtccagaagggtcccctgtt

SEQ ID NO: 7981179 - DNA, 22 bp, Homo sapiens
atgtccagagaacatttgcttt

SEQ ID NO: 7981180 - DNA, 22 bp, Homo sapiens
atgtccagccaaccactggatt

SEQ ID NO: 7981181 - DNA, 22 bp, Homo sapiens
atgtccagccaaccactggatt

SEQ ID NO: 7981182 - DNA, 22 bp, Homo sapiens
atgtccagccaaccactggatt

SEQ ID NO: 7981183 - DNA, 22 bp, Homo sapiens
atgtccagagtgtcctggaaag

SEQ ID NO: 7981184 - DNA, 22 bp, Homo sapiens
atgtccagctcatgatactatc

SEQ ID NO: 7981185 - DNA, 22 bp, Homo sapiens
atgtccagccaaccactggatt

SEQ ID NO: 7981186 - DNA, 22 bp, Homo sapiens
atgtccagagtaaagcacattc

SEQ ID NO: 7981187 - DNA, 22 bp, Homo sapiens
atgtccagcatgacacattctc

SEQ ID NO: 7981188 - DNA, 22 bp, Homo sapiens
atgtccagagtaaagcacattc

SEQ ID NO: 7981189 - DNA, 22 bp, Homo sapiens
atgtccagagaacatttgcttt

SEQ ID NO: 7981190 - DNA, 22 bp, Homo sapiens
atgtccagagaacatttgcttt

SEQ ID NO: 7981191 - DNA, 22 bp, Homo sapiens
atgtccagaggcttggtcccca

SEQ ID NO: 7981192 - DNA, 22 bp, Homo sapiens
atgtccagaggcttggtcccca

SEQ ID NO: 7981193 - DNA, 22 bp, Homo sapiens
atgtccagagccggcctgctga

SEQ ID NO: 7981194 - DNA, 22 bp, Homo sapiens
atgtccagagccggcctgctga

SEQ ID NO: 7981195 - DNA, 22 bp, Homo sapiens
atgtccagagggttttattttg

SEQ ID NO: 7981196 - DNA, 22 bp, Homo sapiens
atgtccagaggcttggtcccca

SEQ ID NO: 7981197 - DNA, 22 bp, Homo sapiens
atgtccagaggtgagtcagagc

SEQ ID NO: 7981198 - DNA, 22 bp, Homo sapiens
atgtccagaggtgagtcagagc

SEQ ID NO: 7981199 - DNA, 22 bp, Homo sapiens
atgtacagtttctagactcaaa

SEQ ID NO: 7981200 - DNA, 22 bp, Homo sapiens
atgtacagtttctagactcaaa

SEQ ID NO: 7981201 - DNA, 22 bp, Homo sapiens
atgtacagtggaaactaacaaa

SEQ ID NO: 7981202 - DNA, 22 bp, Homo sapiens
atgtacagtggaaactaacaaa

SEQ ID NO: 7981203 - DNA, 22 bp, Homo sapiens
atgtacagtggaaactaacaaa

SEQ ID NO: 7981204 - DNA, 22 bp, Homo sapiens
atgtacataaaatgtataatga

SEQ ID NO: 7981205 - DNA, 22 bp, Homo sapiens
atgtacataaaatgtataatga

SEQ ID NO: 7981206 - DNA, 22 bp, Homo sapiens
atgtacagccacttcacagtta

SEQ ID NO: 7981207 - DNA, 22 bp, Homo sapiens
atgtacaggatggtgctcatct

SEQ ID NO: 7981208 - DNA, 22 bp, Homo sapiens
atgtacagccacttcacagtta

SEQ ID NO: 7981209 - DNA, 22 bp, Homo sapiens
atgtacagccacttcacagtta

SEQ ID NO: 7981210 - DNA, 22 bp, Homo sapiens
atgtacagccacttcacagtta

SEQ ID NO: 7981211 - DNA, 22 bp, Homo sapiens
atgtacaggatggtgctcatct

SEQ ID NO: 7981212 - DNA, 22 bp, Homo sapiens
atgtctgtggcattatatgttt

SEQ ID NO: 7981213 - DNA, 22 bp, Homo sapiens
atgtctgtggcattatatgttt

SEQ ID NO: 7981214 - DNA, 22 bp, Homo sapiens
atgtctgtggcattatatgttt

SEQ ID NO: 7981215 - DNA, 22 bp, Homo sapiens
atgtctgtgtgatcttggataa

SEQ ID NO: 7981216 - DNA, 22 bp, Homo sapiens
atgtctgttcattattaactgc

SEQ ID NO: 7981217 - DNA, 22 bp, Homo sapiens
atgtctgttaatcgaccctaat

SEQ ID NO: 7981218 - DNA, 22 bp, Homo sapiens
atgtctgtgtgatcttggataa

SEQ ID NO: 7981219 - DNA, 22 bp, Homo sapiens
atgtctgtgttatctgtagaat

SEQ ID NO: 7981220 - DNA, 22 bp, Homo sapiens
atgtctgtctttgtactccaca

SEQ ID NO: 7981221 - DNA, 22 bp, Homo sapiens
atgtctgtcccctagccctgat

SEQ ID NO: 7981222 - DNA, 18 bp, Homo sapiens
atgtctgtgcactggata

SEQ ID NO: 7981223 - DNA, 22 bp, Homo sapiens
atgtctgtctttgtactccaca

SEQ ID NO: 7981224 - DNA, 22 bp, Homo sapiens
atgtctgtctatagccatgaga

SEQ ID NO: 7981225 - DNA, 22 bp, Homo sapiens
atgtctgtggcaattgttgatg

SEQ ID NO: 7981226 - DNA, 22 bp, Homo sapiens
atgtctgtggcaattgttgatg

SEQ ID NO: 7981227 - DNA, 18 bp, Homo sapiens
atgtctgtgcactggata

SEQ ID NO: 7981228 - DNA, 18 bp, Homo sapiens
atgtctgtgcactggata

SEQ ID NO: 7981229 - DNA, 22 bp, Homo sapiens
atgtctgtggcaattgttgatg

SEQ ID NO: 7981230 - DNA, 22 bp, Homo sapiens
atgtctgtttatccttcaagat

SEQ ID NO: 7981231 - DNA, 22 bp, Homo sapiens
atgtctgtttgctgagcccggc

SEQ ID NO: 7981232 - DNA, 22 bp, Homo sapiens
atgtctgtttgctgagcccggc

SEQ ID NO: 7981233 - DNA, 22 bp, Homo sapiens
atgtctgtttatccttcaagat

SEQ ID NO: 7981234 - DNA, 22 bp, Homo sapiens
atgtctgttttcatatcagata

SEQ ID NO: 7981235 - DNA, 22 bp, Homo sapiens
atgtctgttttcatatcagata

SEQ ID NO: 7981236 - DNA, 22 bp, Homo sapiens
atgtctgttttcatatcagata

SEQ ID NO: 7981237 - DNA, 22 bp, Homo sapiens
atgtcttctaagctctaagctg

SEQ ID NO: 7981238 - DNA, 22 bp, Homo sapiens
atgtcttcatagcttatatcca

SEQ ID NO: 7981239 - DNA, 22 bp, Homo sapiens
atgtcttcatagcttatatcca

SEQ ID NO: 7981240 - DNA, 22 bp, Homo sapiens
atgtcttcatagcttatatcca

SEQ ID NO: 7981241 - DNA, 19 bp, Homo sapiens
atgtctgttgaatttcata

SEQ ID NO: 7981242 - DNA, 19 bp, Homo sapiens
atgtctgttgaatttcata

SEQ ID NO: 7981243 - DNA, 19 bp, Homo sapiens
atgtctgttgaatttcata

SEQ ID NO: 7981244 - DNA, 22 bp, Homo sapiens
atgtctgtttatccttcaagat

SEQ ID NO: 7981245 - DNA, 19 bp, Homo sapiens
atgtctgttgaatttcata

SEQ ID NO: 7981246 - DNA, 22 bp, Homo sapiens
atgtctgttcattattaactgc

SEQ ID NO: 7981247 - DNA, 21 bp, Homo sapiens
atgtctgttctttctggcagg

SEQ ID NO: 7981248 - DNA, 21 bp, Homo sapiens
atgtctgttctgattggtgcg

SEQ ID NO: 7981249 - DNA, 22 bp, Homo sapiens
atgtccaggaagtcttaactca

SEQ ID NO: 7981250 - DNA, 22 bp, Homo sapiens
atgtccaggatctatccccaga

SEQ ID NO: 7981251 - DNA, 22 bp, Homo sapiens
atgtccaggatctatccccaga

SEQ ID NO: 7981252 - DNA, 22 bp, Homo sapiens
atgtccagctcatgatactatc

SEQ ID NO: 7981253 - DNA, 22 bp, Homo sapiens
atgtccagctcatgatactatc

SEQ ID NO: 7981254 - DNA, 22 bp, Homo sapiens
atgtccagggctttagcggggc

SEQ ID NO: 7981255 - DNA, 22 bp, Homo sapiens
atgtccagggcacacagcagtg

SEQ ID NO: 7981256 - DNA, 22 bp, Homo sapiens
atgtccagggcacacagcagtg

SEQ ID NO: 7981257 - DNA, 22 bp, Homo sapiens
atgtccagtttctacacacata

SEQ ID NO: 7981258 - DNA, 23 bp, Homo sapiens
atgtccagtttacttcaggatga

SEQ ID NO: 7981259 - DNA, 20 bp, Homo sapiens
atgtccagtgactggaccat

SEQ ID NO: 7981260 - DNA, 20 bp, Homo sapiens
atgtccagtgactggaccat

SEQ ID NO: 7981261 - DNA, 23 bp, Homo sapiens
atgtccagtttacttcaggatga

SEQ ID NO: 7981262 - DNA, 20 bp, Homo sapiens
atgtccagtgactggaccat

SEQ ID NO: 7981263 - DNA, 20 bp, Homo sapiens
atgtccagtgactggaccat

SEQ ID NO: 7981264 - DNA, 22 bp, Homo sapiens
atgtccagtacttctaaatggt

SEQ ID NO: 7981265 - DNA, 22 bp, Homo sapiens
atgtccagggggcttgactggt

SEQ ID NO: 7981266 - DNA, 22 bp, Homo sapiens
atgtccagggggcttgactggt

SEQ ID NO: 7981267 - DNA, 22 bp, Homo sapiens
atgtccagtacttctaaatggt

SEQ ID NO: 7981268 - DNA, 22 bp, Homo sapiens
atgtctgtacgagttacaatgg

SEQ ID NO: 7981269 - DNA, 22 bp, Homo sapiens
atgtctgtatgtggagaggggt

SEQ ID NO: 7981270 - DNA, 22 bp, Homo sapiens
atgtctgtatgtggagaggggt

SEQ ID NO: 7981271 - DNA, 22 bp, Homo sapiens
atgtctgtatgtggagaggggt

SEQ ID NO: 7981272 - DNA, 22 bp, Homo sapiens
atgtctgtcatcttccaggaag

SEQ ID NO: 7981273 - DNA, 22 bp, Homo sapiens
atgtctgtcatcttccaggaag

SEQ ID NO: 7981274 - DNA, 22 bp, Homo sapiens
atgtctgtacgagttacaatgg

SEQ ID NO: 7981275 - DNA, 22 bp, Homo sapiens
atgtctgtccaaccctgcaggg

SEQ ID NO: 7981276 - DNA, 22 bp, Homo sapiens
atgtctgtcccctagccctgat

SEQ ID NO: 7981277 - DNA, 22 bp, Homo sapiens
atgtcccaagatacagctagag

SEQ ID NO: 7981278 - DNA, 22 bp, Homo sapiens
atgtccagggcacacagcagtg

SEQ ID NO: 7981279 - DNA, 19 bp, Homo sapiens
atgtcccaccgcccctgag

SEQ ID NO: 7981280 - DNA, 22 bp, Homo sapiens
atgtcccaagatacagctagag

SEQ ID NO: 7981281 - DNA, 22 bp, Homo sapiens
atgtcccagctgagagacaact

SEQ ID NO: 7981282 - DNA, 22 bp, Homo sapiens
atgtctgtacgagttacaatgg

SEQ ID NO: 7981283 - DNA, 22 bp, Homo sapiens
atgtctgtacgagttacaatgg

SEQ ID NO: 7981284 - DNA, 22 bp, Homo sapiens
atgggaggcaaagatcgcagaa

SEQ ID NO: 7981285 - DNA, 22 bp, Homo sapiens
atgggaggcaaagatcgcagaa

SEQ ID NO: 7981286 - DNA, 22 bp, Homo sapiens
atgggaggcaaagatcgcagaa

SEQ ID NO: 7981287 - DNA, 22 bp, Homo sapiens
atgggaggcaaagatcgcagaa

SEQ ID NO: 7981288 - DNA, 22 bp, Homo sapiens
atgggaggcagacactaagttc

SEQ ID NO: 7981289 - DNA, 22 bp, Homo sapiens
atgggaggcagacactaagttc

SEQ ID NO: 7981290 - DNA, 22 bp, Homo sapiens
atgggaggatgctcgggtgctc

SEQ ID NO: 7981291 - DNA, 22 bp, Homo sapiens
atgggaggatgctcgggtgctc

SEQ ID NO: 7981292 - DNA, 22 bp, Homo sapiens
atgggaggatgctcgggtgctc

SEQ ID NO: 7981293 - DNA, 22 bp, Homo sapiens
atgggaggatcacttgaggcca

SEQ ID NO: 7981294 - DNA, 22 bp, Homo sapiens
atgggaggatgctcgggtgctc

SEQ ID NO: 7981295 - DNA, 22 bp, Homo sapiens
atgggaggcaaagatcgcagaa

SEQ ID NO: 7981296 - DNA, 22 bp, Homo sapiens
atgggaggatgctcgggtgctc

SEQ ID NO: 7981297 - DNA, 22 bp, Homo sapiens
atgggaggcagacactaagttc

SEQ ID NO: 7981298 - DNA, 22 bp, Homo sapiens
atgggaggcagcagagcccagc

SEQ ID NO: 7981299 - DNA, 22 bp, Homo sapiens
atgggaggcagcagagcccagc

SEQ ID NO: 7981300 - DNA, 22 bp, Homo sapiens
atgggaggcagcagagcccagc

SEQ ID NO: 7981301 - DNA, 22 bp, Homo sapiens
atgggaggcaggctcagaaccg

SEQ ID NO: 7981302 - DNA, 22 bp, Homo sapiens
atgggaggcaggctcagaaccg

SEQ ID NO: 7981303 - DNA, 22 bp, Homo sapiens
atgggtggagggtgacacggat

SEQ ID NO: 7981304 - DNA, 22 bp, Homo sapiens
atgggaggcaggctcagaaccg

SEQ ID NO: 7981305 - DNA, 22 bp, Homo sapiens
atgggaggcaggctcagaaccg

SEQ ID NO: 7981306 - DNA, 22 bp, Homo sapiens
atgggaggaagagaagatgtct

SEQ ID NO: 7981307 - DNA, 22 bp, Homo sapiens
atggctgtgttgttcctctgaa

SEQ ID NO: 7981308 - DNA, 22 bp, Homo sapiens
atgggaggaaggaggcccttga

SEQ ID NO: 7981309 - DNA, 22 bp, Homo sapiens
atgggaggaaggaggcccttga

SEQ ID NO: 7981310 - DNA, 22 bp, Homo sapiens
atgggaggatcacttgaggcca

SEQ ID NO: 7981311 - DNA, 22 bp, Homo sapiens
atgggaggatcacttgaggcca

SEQ ID NO: 7981312 - DNA, 22 bp, Homo sapiens
atgggaggatcacttgaggcca

SEQ ID NO: 7981313 - DNA, 22 bp, Homo sapiens
atgggaggatcacttgaggcca

SEQ ID NO: 7981314 - DNA, 22 bp, Homo sapiens
atgggaggatcacttgaggcca

SEQ ID NO: 7981315 - DNA, 22 bp, Homo sapiens
atgggaggaaggaggcccttga

SEQ ID NO: 7981316 - DNA, 22 bp, Homo sapiens
atggctgtaaattcagagatgg

SEQ ID NO: 7981317 - DNA, 22 bp, Homo sapiens
atggctggtttgagctttagca

SEQ ID NO: 7981318 - DNA, 22 bp, Homo sapiens
atggctgtccagtttctagaga

SEQ ID NO: 7981319 - DNA, 22 bp, Homo sapiens
atggctgtccagtttctagaga

SEQ ID NO: 7981320 - DNA, 22 bp, Homo sapiens
atggctgtcacgccactgtgag

SEQ ID NO: 7981321 - DNA, 22 bp, Homo sapiens
atggctgtgcagagattgggaa

SEQ ID NO: 7981322 - DNA, 19 bp, Homo sapiens
atggctgtgttccagtaaa

SEQ ID NO: 7981323 - DNA, 22 bp, Homo sapiens
atggctgtgagcaggcagcttc

SEQ ID NO: 7981324 - DNA, 22 bp, Homo sapiens
atggctgtgaaatggtaggtgg

SEQ ID NO: 7981325 - DNA, 20 bp, Homo sapiens
atgtaaaagacagggagtag

SEQ ID NO: 7981326 - DNA, 20 bp, Homo sapiens
atgtaaaagacagggagtag

SEQ ID NO: 7981327 - DNA, 20 bp, Homo sapiens
atgtaaaagacagggagtag

SEQ ID NO: 7981328 - DNA, 20 bp, Homo sapiens
atgtaaaagacagggagtag

SEQ ID NO: 7981329 - DNA, 22 bp, Homo sapiens
atggttttgtcctctttggttc

SEQ ID NO: 7981330 - DNA, 22 bp, Homo sapiens
atggttttatttctctatagct

SEQ ID NO: 7981331 - DNA, 22 bp, Homo sapiens
atggttttcctctgctgcttaa

SEQ ID NO: 7981332 - DNA, 22 bp, Homo sapiens
atggttttagaatcaggaaaaa

SEQ ID NO: 7981333 - DNA, 22 bp, Homo sapiens
atggtttgtgtggcccagatga

SEQ ID NO: 7981334 - DNA, 22 bp, Homo sapiens
atggtttgtgtggcccagatga

SEQ ID NO: 7981335 - DNA, 22 bp, Homo sapiens
atggttttagaatcaggaaaaa

SEQ ID NO: 7981336 - DNA, 22 bp, Homo sapiens
atggtttgtgtggcccagatga

SEQ ID NO: 7981337 - DNA, 22 bp, Homo sapiens
atggtttgtaacccaatactcc

SEQ ID NO: 7981338 - DNA, 22 bp, Homo sapiens
atggtttgtaacccaatactcc

SEQ ID NO: 7981339 - DNA, 22 bp, Homo sapiens
atggtttattgctttaatgaaa

SEQ ID NO: 7981340 - DNA, 22 bp, Homo sapiens
atggtttatcctttaccagtcg

SEQ ID NO: 7981341 - DNA, 22 bp, Homo sapiens
atggtttataatctaggtgtga

SEQ ID NO: 7981342 - DNA, 22 bp, Homo sapiens
atgggtggccccgtgtgcagtc

SEQ ID NO: 7981343 - DNA, 22 bp, Homo sapiens
atgggtggccccgtgtgcagtc

SEQ ID NO: 7981344 - DNA, 22 bp, Homo sapiens
atgggtgtgaaaatggtcatct

SEQ ID NO: 7981345 - DNA, 22 bp, Homo sapiens
atgggtgtgaaaatggtcatct

SEQ ID NO: 7981346 - DNA, 20 bp, Homo sapiens
atgtaaaattataaggctga

SEQ ID NO: 7981347 - DNA, 22 bp, Homo sapiens
atgtaaacaaggttattgtcca

SEQ ID NO: 7981348 - DNA, 22 bp, Homo sapiens
atgtaaacactcactgtgcccc

SEQ ID NO: 7981349 - DNA, 22 bp, Homo sapiens
atgtaaactactgactacacta

SEQ ID NO: 7981350 - DNA, 22 bp, Homo sapiens
atgtaaactactgactacacta

SEQ ID NO: 7981351 - DNA, 20 bp, Homo sapiens
atgtaaaattataaggctga

SEQ ID NO: 7981352 - DNA, 20 bp, Homo sapiens
atgtaaaattataaggctga

SEQ ID NO: 7981353 - DNA, 20 bp, Homo sapiens
atgtaaaattataaggctga

SEQ ID NO: 7981354 - DNA, 22 bp, Homo sapiens
atgtaaaagattattttcctgt

SEQ ID NO: 7981355 - DNA, 22 bp, Homo sapiens
atgtaaaagattattttcctgt

SEQ ID NO: 7981356 - DNA, 22 bp, Homo sapiens
atgtacacacaagtttgcacgc

SEQ ID NO: 7981357 - DNA, 22 bp, Homo sapiens
atgtacacacaagtttgcacgc

SEQ ID NO: 7981358 - DNA, 22 bp, Homo sapiens
atgtacacatacagtggagtgg

SEQ ID NO: 7981359 - DNA, 22 bp, Homo sapiens
atgtacacatacagtggagtgg

SEQ ID NO: 7981360 - DNA, 22 bp, Homo sapiens
atgtacacacacatctttgcgt

SEQ ID NO: 7981361 - DNA, 22 bp, Homo sapiens
atgtacaccaggtgaagatgaa

SEQ ID NO: 7981362 - DNA, 22 bp, Homo sapiens
atgtacaccaggtgaagatgaa

SEQ ID NO: 7981363 - DNA, 22 bp, Homo sapiens
atgtacactttggaagagtcac

SEQ ID NO: 7981364 - DNA, 22 bp, Homo sapiens
atgtacactttggaagagtcac

SEQ ID NO: 7981365 - DNA, 22 bp, Homo sapiens
atgtacacatgcatgcatgtgc

SEQ ID NO: 7981366 - DNA, 22 bp, Homo sapiens
atgtacacatgcatgcatgtgc

SEQ ID NO: 7981367 - DNA, 23 bp, Homo sapiens
atgtaaacttcagagtcattgcc

SEQ ID NO: 7981368 - DNA, 22 bp, Homo sapiens
atgtaaacttagataagcagta

SEQ ID NO: 7981369 - DNA, 22 bp, Homo sapiens
atgtaaactttaccagctctga

SEQ ID NO: 7981370 - DNA, 21 bp, Homo sapiens
atggctggtggctcagcctcc

SEQ ID NO: 7981371 - DNA, 21 bp, Homo sapiens
atggctggtggctcagcctcc

SEQ ID NO: 7981372 - DNA, 22 bp, Homo sapiens
atggctggtgatactggagtga

SEQ ID NO: 7981373 - DNA, 22 bp, Homo sapiens
atggctggtgatactggagtga

SEQ ID NO: 7981374 - DNA, 22 bp, Homo sapiens
atggctggtgatactggagtga

SEQ ID NO: 7981375 - DNA, 22 bp, Homo sapiens
atggctggtctcccatggaaaa

SEQ ID NO: 7981376 - DNA, 22 bp, Homo sapiens
atggctggtctcccatggaaaa

SEQ ID NO: 7981377 - DNA, 22 bp, Homo sapiens
atggctggtctcccatggaaaa

SEQ ID NO: 7981378 - DNA, 22 bp, Homo sapiens
atggctggtctcccatggaaaa

SEQ ID NO: 7981379 - DNA, 22 bp, Homo sapiens
atggctggtgatactggagtga

SEQ ID NO: 7981380 - DNA, 22 bp, Homo sapiens
atggctgggttcttctataggt

SEQ ID NO: 7981381 - DNA, 22 bp, Homo sapiens
atggctggtagtgaattaatct

SEQ ID NO: 7981382 - DNA, 22 bp, Homo sapiens
atggctgggtcaccatcagggt

SEQ ID NO: 7981383 - DNA, 22 bp, Homo sapiens
atggctgggatggggtagagaa

SEQ ID NO: 7981384 - DNA, 22 bp, Homo sapiens
atggctgggatggggtagagaa

SEQ ID NO: 7981385 - DNA, 22 bp, Homo sapiens
atggctgggatggggtagagaa

SEQ ID NO: 7981386 - DNA, 22 bp, Homo sapiens
atggctgggatttcctttgcgt

SEQ ID NO: 7981387 - DNA, 22 bp, Homo sapiens
atggctgggatggggtagagaa

SEQ ID NO: 7981388 - DNA, 22 bp, Homo sapiens
atggctgggaggagagtatgat

SEQ ID NO: 7981389 - DNA, 22 bp, Homo sapiens
atggctgggatgcttctagcaa

SEQ ID NO: 7981390 - DNA, 22 bp, Homo sapiens
atggctgggaggagagtatgat

SEQ ID NO: 7981391 - DNA, 22 bp, Homo sapiens
atggctgggtcaccatcagggt

SEQ ID NO: 7981392 - DNA, 22 bp, Homo sapiens
atggctgggtcaccatcagggt

SEQ ID NO: 7981393 - DNA, 22 bp, Homo sapiens
atggctgggcttttagtcagat

SEQ ID NO: 7981394 - DNA, 22 bp, Homo sapiens
atggctgggatttcctttgcgt

SEQ ID NO: 7981395 - DNA, 22 bp, Homo sapiens
atggcagcatagtggcaagtta

SEQ ID NO: 7981396 - DNA, 22 bp, Homo sapiens
atggcagcatagtggcaagtta

SEQ ID NO: 7981397 - DNA, 22 bp, Homo sapiens
atggcagcagtttggagtcttt

SEQ ID NO: 7981398 - DNA, 22 bp, Homo sapiens
atggcagcagtttggagtcttt

SEQ ID NO: 7981399 - DNA, 22 bp, Homo sapiens
atggcagcagtttggagtcttt

SEQ ID NO: 7981400 - DNA, 22 bp, Homo sapiens
atggcagcatagtggcaagtta

SEQ ID NO: 7981401 - DNA, 22 bp, Homo sapiens
atggcagcatagtggcaagtta

SEQ ID NO: 7981402 - DNA, 22 bp, Homo sapiens
atggcagcatgggattggtaga

SEQ ID NO: 7981403 - DNA, 22 bp, Homo sapiens
atggcagcatgggattggtaga

SEQ ID NO: 7981404 - DNA, 22 bp, Homo sapiens
atggcagcatgggattggtaga

SEQ ID NO: 7981405 - DNA, 22 bp, Homo sapiens
atggcagcatgggattggtaga

SEQ ID NO: 7981406 - DNA, 22 bp, Homo sapiens
atggcagcatgggattggtaga

SEQ ID NO: 7981407 - DNA, 19 bp, Homo sapiens
atggcagcagcagctctcc

SEQ ID NO: 7981408 - DNA, 22 bp, Homo sapiens
atggcagcaaatgtctggctgg

SEQ ID NO: 7981409 - DNA, 22 bp, Homo sapiens
atggcagcaaatgtctggctgg

SEQ ID NO: 7981410 - DNA, 19 bp, Homo sapiens
atggcagcagcagctctcc

SEQ ID NO: 7981411 - DNA, 22 bp, Homo sapiens
atggcagcagctttagctgtgg

SEQ ID NO: 7981412 - DNA, 22 bp, Homo sapiens
atggcagcagctttagctgtgg

SEQ ID NO: 7981413 - DNA, 22 bp, Homo sapiens
atggcagcagggcttgattatg

SEQ ID NO: 7981414 - DNA, 22 bp, Homo sapiens
atggcagcagggcttgattatg

SEQ ID NO: 7981415 - DNA, 22 bp, Homo sapiens
atggcagcagtccattgcctca

SEQ ID NO: 7981416 - DNA, 22 bp, Homo sapiens
atggcagcagtccattgcctca

SEQ ID NO: 7981417 - DNA, 22 bp, Homo sapiens
atggctggctgagcctggttat

SEQ ID NO: 7981418 - DNA, 22 bp, Homo sapiens
atggctggctttacttgctttg

SEQ ID NO: 7981419 - DNA, 22 bp, Homo sapiens
atggctggcgtcattgtgtggg

SEQ ID NO: 7981420 - DNA, 22 bp, Homo sapiens
atggctggcgtcattgtgtggg

SEQ ID NO: 7981421 - DNA, 21 bp, Homo sapiens
atggctcaggccatcaatgga

SEQ ID NO: 7981422 - DNA, 18 bp, Homo sapiens
atggctcaggaatggctt

SEQ ID NO: 7981423 - DNA, 22 bp, Homo sapiens
atggctggcatgtgcataacgg

SEQ ID NO: 7981424 - DNA, 18 bp, Homo sapiens
atggctcaggaatggctt

SEQ ID NO: 7981425 - DNA, 18 bp, Homo sapiens
atggctcaggaatggctt

SEQ ID NO: 7981426 - DNA, 22 bp, Homo sapiens
atggcagcctgaacacttcctg

SEQ ID NO: 7981427 - DNA, 22 bp, Homo sapiens
atggctcagcgcctttctgtgg

SEQ ID NO: 7981428 - DNA, 22 bp, Homo sapiens
atggcagcctgagcagaggaat

SEQ ID NO: 7981429 - DNA, 22 bp, Homo sapiens
atggcagccagtgttggaggaa

SEQ ID NO: 7981430 - DNA, 22 bp, Homo sapiens
atggcagcccacgatggcaatg

SEQ ID NO: 7981431 - DNA, 22 bp, Homo sapiens
atggcagcccacgatggcaatg

SEQ ID NO: 7981432 - DNA, 22 bp, Homo sapiens
atggcagccagtgttggaggaa

SEQ ID NO: 7981433 - DNA, 22 bp, Homo sapiens
atggcagccagtgttggaggaa

SEQ ID NO: 7981434 - DNA, 22 bp, Homo sapiens
atggcagccagtgttggaggaa

SEQ ID NO: 7981435 - DNA, 22 bp, Homo sapiens
atggagttctgccagcgctgct

SEQ ID NO: 7981436 - DNA, 22 bp, Homo sapiens
atggagttctgccagcgctgct

SEQ ID NO: 7981437 - DNA, 22 bp, Homo sapiens
atggagttctgccagcgctgct

SEQ ID NO: 7981438 - DNA, 22 bp, Homo sapiens
atggagtgtcaccttcctggtt

SEQ ID NO: 7981439 - DNA, 22 bp, Homo sapiens
atggagtgtcaccttcctggtt

SEQ ID NO: 7981440 - DNA, 22 bp, Homo sapiens
atggagtgtggccaggcagtaa

SEQ ID NO: 7981441 - DNA, 22 bp, Homo sapiens
atggagtgtggccaggcagtaa

SEQ ID NO: 7981442 - DNA, 22 bp, Homo sapiens
atggagtgcctgtggcagtggg

SEQ ID NO: 7981443 - DNA, 22 bp, Homo sapiens
atggagtgctgttgatcaaggt

SEQ ID NO: 7981444 - DNA, 22 bp, Homo sapiens
atggagtgctgttgatcaaggt

SEQ ID NO: 7981445 - DNA, 22 bp, Homo sapiens
atggagtggggactgcagtgga

SEQ ID NO: 7981446 - DNA, 22 bp, Homo sapiens
atggagtgggccaattttagtg

SEQ ID NO: 7981447 - DNA, 22 bp, Homo sapiens
atggagtgggccaattttagtg

SEQ ID NO: 7981448 - DNA, 22 bp, Homo sapiens
atggagtgcctgtggcagtggg

SEQ ID NO: 7981449 - DNA, 22 bp, Homo sapiens
atggagtctacaaagtgttgga

SEQ ID NO: 7981450 - DNA, 21 bp, Homo sapiens
atggagtcaggggaatgggcc

SEQ ID NO: 7981451 - DNA, 22 bp, Homo sapiens
atggagtacttttttggattag

SEQ ID NO: 7981452 - DNA, 22 bp, Homo sapiens
atggagtaatattaacatgtta

SEQ ID NO: 7981453 - DNA, 22 bp, Homo sapiens
atggagtacagggaaatatgat

SEQ ID NO: 7981454 - DNA, 22 bp, Homo sapiens
atggaggtgtttgataatttgg

SEQ ID NO: 7981455 - DNA, 20 bp, Homo sapiens
atggaggtggatgtgactgc

SEQ ID NO: 7981456 - DNA, 22 bp, Homo sapiens
atggaggtggaagaatgagtta

SEQ ID NO: 7981457 - DNA, 22 bp, Homo sapiens
atggaggtggaagaatgagtta

SEQ ID NO: 7981458 - DNA, 20 bp, Homo sapiens
atggaggtggatgtgactgc

SEQ ID NO: 7981459 - DNA, 19 bp, Homo sapiens
atggaggtctttatatctt

SEQ ID NO: 7981460 - DNA, 22 bp, Homo sapiens
atggaggtgatgttaatgatgc

SEQ ID NO: 7981461 - DNA, 22 bp, Homo sapiens
atggaggtgatgttaatgatgc

SEQ ID NO: 7981462 - DNA, 22 bp, Homo sapiens
atggaggtggaagaatgagtta

SEQ ID NO: 7981463 - DNA, 22 bp, Homo sapiens
atggaggtgccaggtgtgaggg

SEQ ID NO: 7981464 - DNA, 22 bp, Homo sapiens
atggacagtgtgaagcagatag

SEQ ID NO: 7981465 - DNA, 22 bp, Homo sapiens
atggcagatggctggagcaggt

SEQ ID NO: 7981466 - DNA, 22 bp, Homo sapiens
atggcagcaaatgtctggctgg

SEQ ID NO: 7981467 - DNA, 22 bp, Homo sapiens
atggcagcaaagaggccttctt

SEQ ID NO: 7981468 - DNA, 22 bp, Homo sapiens
atggcagcaaagaggccttctt

SEQ ID NO: 7981469 - DNA, 22 bp, Homo sapiens
atggcagagtcctaagccttta

SEQ ID NO: 7981470 - DNA, 22 bp, Homo sapiens
atggcagagggattgaacagct

SEQ ID NO: 7981471 - DNA, 22 bp, Homo sapiens
atggcagatccacagtttgaag

SEQ ID NO: 7981472 - DNA, 22 bp, Homo sapiens
atggcagagtcctaagccttta

SEQ ID NO: 7981473 - DNA, 18 bp, Homo sapiens
atggcagatgataagtgc

SEQ ID NO: 7981474 - DNA, 22 bp, Homo sapiens
atggcagatggctggagcaggt

SEQ ID NO: 7981475 - DNA, 22 bp, Homo sapiens
atggcagatggctggagcaggt

SEQ ID NO: 7981476 - DNA, 22 bp, Homo sapiens
atggcagatggctggagcaggt

SEQ ID NO: 7981477 - DNA, 22 bp, Homo sapiens
atggcagatggctggagcaggt

SEQ ID NO: 7981478 - DNA, 22 bp, Homo sapiens
atggataatcatgaactttgag

SEQ ID NO: 7981479 - DNA, 22 bp, Homo sapiens
atggataagaacaaatatctga

SEQ ID NO: 7981480 - DNA, 22 bp, Homo sapiens
atggataagtcaaagagtatcc

SEQ ID NO: 7981481 - DNA, 22 bp, Homo sapiens
atggataagtcaaagagtatcc

SEQ ID NO: 7981482 - DNA, 22 bp, Homo sapiens
atggagtttggggtcaaatact

SEQ ID NO: 7981483 - DNA, 22 bp, Homo sapiens
atggagttctgccagcgctgct

SEQ ID NO: 7981484 - DNA, 22 bp, Homo sapiens
atggagttctgccagcgctgct

SEQ ID NO: 7981485 - DNA, 22 bp, Homo sapiens
atggagttctgccagcgctgct

SEQ ID NO: 7981486 - DNA, 22 bp, Homo sapiens
agactcaagcagataggaatta

SEQ ID NO: 7981487 - DNA, 22 bp, Homo sapiens
agactcaagactgcagaagacg

SEQ ID NO: 7981488 - DNA, 22 bp, Homo sapiens
agactagagagatataatatgg

SEQ ID NO: 7981489 - DNA, 22 bp, Homo sapiens
agactagtctgaaggttttttt

SEQ ID NO: 7981490 - DNA, 22 bp, Homo sapiens
agactacatatgccacatgaag

SEQ ID NO: 7981491 - DNA, 22 bp, Homo sapiens
agactacatatgccacatgaag

SEQ ID NO: 7981492 - DNA, 22 bp, Homo sapiens
agactacattatgacagcattt

SEQ ID NO: 7981493 - DNA, 22 bp, Homo sapiens
agactacattatgacagcattt

SEQ ID NO: 7981494 - DNA, 22 bp, Homo sapiens
agactactctgttttatatctt

SEQ ID NO: 7981495 - DNA, 22 bp, Homo sapiens
agactagagagatataatatgg

SEQ ID NO: 7981496 - DNA, 22 bp, Homo sapiens
agactacatatgccacatgaag

SEQ ID NO: 7981497 - DNA, 22 bp, Homo sapiens
agactacatatgccacatgaag

SEQ ID NO: 7981498 - DNA, 22 bp, Homo sapiens
agactctgaggagccctgagac

SEQ ID NO: 7981499 - DNA, 22 bp, Homo sapiens
agactctgaggagccctgagac

SEQ ID NO: 7981500 - DNA, 22 bp, Homo sapiens
atggacagtactgagtggacta

SEQ ID NO: 7981501 - DNA, 22 bp, Homo sapiens
agactctaactcatgccattgc

SEQ ID NO: 7981502 - DNA, 22 bp, Homo sapiens
agactccaggagggaggctgct

SEQ ID NO: 7981503 - DNA, 22 bp, Homo sapiens
agactcctcggaccaatcagcg

SEQ ID NO: 7981504 - DNA, 22 bp, Homo sapiens
agactcctcggaccaatcagcg

SEQ ID NO: 7981505 - DNA, 22 bp, Homo sapiens
agactcctgctacataccttcc

SEQ ID NO: 7981506 - DNA, 22 bp, Homo sapiens
atggaaatatctttagagctta

SEQ ID NO: 7981507 - DNA, 22 bp, Homo sapiens
atggaaatcaggttcatccaag

SEQ ID NO: 7981508 - DNA, 22 bp, Homo sapiens
atggaaatatctttagagctta

SEQ ID NO: 7981509 - DNA, 22 bp, Homo sapiens
atggaaatatctttagagctta

SEQ ID NO: 7981510 - DNA, 22 bp, Homo sapiens
atggaaatatctttagagctta

SEQ ID NO: 7981511 - DNA, 22 bp, Homo sapiens
atggaaatatctttagagctta

SEQ ID NO: 7981512 - DNA, 23 bp, Homo sapiens
atggaaatagcatgtgtcattta

SEQ ID NO: 7981513 - DNA, 23 bp, Homo sapiens
atggaaatagcatgtgtcattta

SEQ ID NO: 7981514 - DNA, 23 bp, Homo sapiens
atggaaatagcatgtgtcattta

SEQ ID NO: 7981515 - DNA, 22 bp, Homo sapiens
atggaaatcaggttcatccaag

SEQ ID NO: 7981516 - DNA, 22 bp, Homo sapiens
atggaaatccaagtcaccgtag

SEQ ID NO: 7981517 - DNA, 22 bp, Homo sapiens
atggaaatcaggttcatccaag

SEQ ID NO: 7981518 - DNA, 22 bp, Homo sapiens
atggaaatcaggttcatccaag

SEQ ID NO: 7981519 - DNA, 22 bp, Homo sapiens
atggaaatcaggttcatccaag

SEQ ID NO: 7981520 - DNA, 22 bp, Homo sapiens
atggaaatccaagtcaccgtag

SEQ ID NO: 7981521 - DNA, 22 bp, Homo sapiens
atggaaatcgatgtctaagtta

SEQ ID NO: 7981522 - DNA, 22 bp, Homo sapiens
agactaaaagaaggaagctacc

SEQ ID NO: 7981523 - DNA, 22 bp, Homo sapiens
agacggctggcagtgagcggct

SEQ ID NO: 7981524 - DNA, 22 bp, Homo sapiens
agacggcacctgggcagcttac

SEQ ID NO: 7981525 - DNA, 22 bp, Homo sapiens
agactaactttttgctctatca

SEQ ID NO: 7981526 - DNA, 22 bp, Homo sapiens
agactaaatagttacaggtagg

SEQ ID NO: 7981527 - DNA, 22 bp, Homo sapiens
agactaaataatgatttactgg

SEQ ID NO: 7981528 - DNA, 22 bp, Homo sapiens
atggaaatcgatgtctaagtta

SEQ ID NO: 7981529 - DNA, 22 bp, Homo sapiens
agacgcggtggtgcatgcctgt

SEQ ID NO: 7981530 - DNA, 22 bp, Homo sapiens
agacgctattttgaggggtcta

SEQ ID NO: 7981531 - DNA, 22 bp, Homo sapiens
agacgctattttgaggggtcta

SEQ ID NO: 7981532 - DNA, 22 bp, Homo sapiens
agacggattacctgaggtcagg

SEQ ID NO: 7981533 - DNA, 22 bp, Homo sapiens
agacggattacctgaggtcagg

SEQ ID NO: 7981534 - DNA, 22 bp, Homo sapiens
agacggaatttcatcatgttag

SEQ ID NO: 7981535 - DNA, 23 bp, Homo sapiens
agacggactccagggtgttgtat

SEQ ID NO: 7981536 - DNA, 22 bp, Homo sapiens
atggaaagccagtgttccatca

SEQ ID NO: 7981537 - DNA, 22 bp, Homo sapiens
atggaaaggctgtggaaactta

SEQ ID NO: 7981538 - DNA, 22 bp, Homo sapiens
atggaaatacagccagagcaga

SEQ ID NO: 7981539 - DNA, 23 bp, Homo sapiens
atggaaatagcatgtgtcattta

SEQ ID NO: 7981540 - DNA, 22 bp, Homo sapiens
atggaaatacagccagagcaga

SEQ ID NO: 7981541 - DNA, 22 bp, Homo sapiens
atggaaatacagccagagcaga

SEQ ID NO: 7981542 - DNA, 22 bp, Homo sapiens
atggaaatacacaagaggtttc

SEQ ID NO: 7981543 - DNA, 19 bp, Homo sapiens
atggaaaattgtactcaat

SEQ ID NO: 7981544 - DNA, 19 bp, Homo sapiens
atggaaaattgtactcaat

SEQ ID NO: 7981545 - DNA, 19 bp, Homo sapiens
atggaaaattgtactcaat

SEQ ID NO: 7981546 - DNA, 19 bp, Homo sapiens
atggaaaatgccagactga

SEQ ID NO: 7981547 - DNA, 19 bp, Homo sapiens
atggaaaatgccagactga

SEQ ID NO: 7981548 - DNA, 19 bp, Homo sapiens
atggaaaattgtactcaat

SEQ ID NO: 7981549 - DNA, 19 bp, Homo sapiens
atggaaaattgtactcaat

SEQ ID NO: 7981550 - DNA, 19 bp, Homo sapiens
atggaaaattgtactcaat

SEQ ID NO: 7981551 - DNA, 19 bp, Homo sapiens
atggaaaatgccagactga

SEQ ID NO: 7981552 - DNA, 22 bp, Homo sapiens
atgcttggcagagttctttttc

SEQ ID NO: 7981553 - DNA, 22 bp, Homo sapiens
atggaaaagggtctttcatttc

SEQ ID NO: 7981554 - DNA, 22 bp, Homo sapiens
atgcttggatgctgccatggga

SEQ ID NO: 7981555 - DNA, 22 bp, Homo sapiens
atgcttgcccatgtttctgaag

SEQ ID NO: 7981556 - DNA, 22 bp, Homo sapiens
atgcagggttctgggctagaga

SEQ ID NO: 7981557 - DNA, 22 bp, Homo sapiens
atgcagggttctgggctagaga

SEQ ID NO: 7981558 - DNA, 22 bp, Homo sapiens
atgcttgagccagaaacagaaa

SEQ ID NO: 7981559 - DNA, 22 bp, Homo sapiens
atgcttgagccagaaacagaaa

SEQ ID NO: 7981560 - DNA, 22 bp, Homo sapiens
atgcttgatcttcatagcattt

SEQ ID NO: 7981561 - DNA, 22 bp, Homo sapiens
atgcttgatcttcatagcattt

SEQ ID NO: 7981562 - DNA, 22 bp, Homo sapiens
atgcagggtctccgtgtgacga

SEQ ID NO: 7981563 - DNA, 22 bp, Homo sapiens
atgcagggtctccgtgtgacga

SEQ ID NO: 7981564 - DNA, 22 bp, Homo sapiens
atgcagggtctccgtgtgacga

SEQ ID NO: 7981565 - DNA, 23 bp, Homo sapiens
atgcagggttacagggctgactt

SEQ ID NO: 7981566 - DNA, 23 bp, Homo sapiens
atgcagggttacagggctgactt

SEQ ID NO: 7981567 - DNA, 22 bp, Homo sapiens
atgcaggggccgcctggccagg

SEQ ID NO: 7981568 - DNA, 22 bp, Homo sapiens
atgcaggggccgcctggccagg

SEQ ID NO: 7981569 - DNA, 22 bp, Homo sapiens
atgcaggggccgcctggccagg

SEQ ID NO: 7981570 - DNA, 22 bp, Homo sapiens
atgcaggggctgtgttttgggt

SEQ ID NO: 7981571 - DNA, 22 bp, Homo sapiens
atgcaggggccgcctggccagg

SEQ ID NO: 7981572 - DNA, 22 bp, Homo sapiens
atgcaggggcagcagagcctgg

SEQ ID NO: 7981573 - DNA, 22 bp, Homo sapiens
atgcagggattaaatgactgcc

SEQ ID NO: 7981574 - DNA, 22 bp, Homo sapiens
atgcagggattaaatgactgcc

SEQ ID NO: 7981575 - DNA, 22 bp, Homo sapiens
atgcagggattaaatgactgcc

SEQ ID NO: 7981576 - DNA, 22 bp, Homo sapiens
atgcaggggcagcagagcctgg

SEQ ID NO: 7981577 - DNA, 22 bp, Homo sapiens
agaagaatttctctcatgattt

SEQ ID NO: 7981578 - DNA, 22 bp, Homo sapiens
agaagacagagtctacattcta

SEQ ID NO: 7981579 - DNA, 22 bp, Homo sapiens
agaagacagagtctacattcta

SEQ ID NO: 7981580 - DNA, 22 bp, Homo sapiens
agaagacagagtctacattcta

SEQ ID NO: 7981581 - DNA, 22 bp, Homo sapiens
agaagacagagtctacattcta

SEQ ID NO: 7981582 - DNA, 22 bp, Homo sapiens
agaagacagagtctacattcta

SEQ ID NO: 7981583 - DNA, 22 bp, Homo sapiens
agaagagaaatagtgccactgt

SEQ ID NO: 7981584 - DNA, 22 bp, Homo sapiens
agaagagaaatagtgccactgt

SEQ ID NO: 7981585 - DNA, 22 bp, Homo sapiens
agaagagaactgccaaacactt

SEQ ID NO: 7981586 - DNA, 22 bp, Homo sapiens
agaagagaactgccaaacactt

SEQ ID NO: 7981587 - DNA, 22 bp, Homo sapiens
agaagagaactgccaaacactt

SEQ ID NO: 7981588 - DNA, 22 bp, Homo sapiens
agaagagaactgccaaacactt

SEQ ID NO: 7981589 - DNA, 22 bp, Homo sapiens
agaagagaactgccaaacactt

SEQ ID NO: 7981590 - DNA, 22 bp, Homo sapiens
agaagagaaatagtgccactgt

SEQ ID NO: 7981591 - DNA, 22 bp, Homo sapiens
agaagagaaatagtgccactgt

SEQ ID NO: 7981592 - DNA, 22 bp, Homo sapiens
agaagagaaatagtgccactgt

SEQ ID NO: 7981593 - DNA, 22 bp, Homo sapiens
agaagagaactgccaaacactt

SEQ ID NO: 7981594 - DNA, 22 bp, Homo sapiens
agaagaatacttgatgttcatg

SEQ ID NO: 7981595 - DNA, 22 bp, Homo sapiens
agaagaatttctctcatgattt

SEQ ID NO: 7981596 - DNA, 22 bp, Homo sapiens
agaagaatacttgatgttcatg

SEQ ID NO: 7981597 - DNA, 22 bp, Homo sapiens
agaagaatacttgatgttcatg

SEQ ID NO: 7981598 - DNA, 22 bp, Homo sapiens
agaagaacttagctttctatct

SEQ ID NO: 7981599 - DNA, 22 bp, Homo sapiens
agaagaatacttgatgttcatg

SEQ ID NO: 7981600 - DNA, 22 bp, Homo sapiens
agaagaaatgtgaaggccactg

SEQ ID NO: 7981601 - DNA, 22 bp, Homo sapiens
agaagaaatgtgaaggccactg

SEQ ID NO: 7981602 - DNA, 22 bp, Homo sapiens
agaagaaatgtgaaggccactg

SEQ ID NO: 7981603 - DNA, 22 bp, Homo sapiens
agaagaaatgtgaaggccactg

SEQ ID NO: 7981604 - DNA, 22 bp, Homo sapiens
agaagaggggtgtccctgtggc

SEQ ID NO: 7981605 - DNA, 22 bp, Homo sapiens
agaagaggggtgtccctgtggc

SEQ ID NO: 7981606 - DNA, 22 bp, Homo sapiens
agaagaggggtgtccctgtggc

SEQ ID NO: 7981607 - DNA, 20 bp, Homo sapiens
agaagaggatacaaccaggc

SEQ ID NO: 7981608 - DNA, 20 bp, Homo sapiens
agaagaggatacaaccaggc

SEQ ID NO: 7981609 - DNA, 22 bp, Homo sapiens
agaagatgactttggagttgga

SEQ ID NO: 7981610 - DNA, 22 bp, Homo sapiens
agaagagtagtaacagaaatta

SEQ ID NO: 7981611 - DNA, 22 bp, Homo sapiens
agaagagtagtaacagaaatta

SEQ ID NO: 7981612 - DNA, 22 bp, Homo sapiens
agaagaggggtgtccctgtggc

SEQ ID NO: 7981613 - DNA, 22 bp, Homo sapiens
agaagatgactttggagttgga

SEQ ID NO: 7981614 - DNA, 22 bp, Homo sapiens
agaagatgtcactgcagacagc

SEQ ID NO: 7981615 - DNA, 22 bp, Homo sapiens
agaagatgtcactgcagacagc

SEQ ID NO: 7981616 - DNA, 20 bp, Homo sapiens
agaagaggatacaaccaggc

SEQ ID NO: 7981617 - DNA, 20 bp, Homo sapiens
agaagaggatacaaccaggc

SEQ ID NO: 7981618 - DNA, 22 bp, Homo sapiens
agaagagcctggggaccatggc

SEQ ID NO: 7981619 - DNA, 22 bp, Homo sapiens
agaagagcctggggaccatggc

SEQ ID NO: 7981620 - DNA, 22 bp, Homo sapiens
agaagagccactgttgacggca

SEQ ID NO: 7981621 - DNA, 22 bp, Homo sapiens
agaagagccctttaagggggaa

SEQ ID NO: 7981622 - DNA, 22 bp, Homo sapiens
agaagagccctttaagggggaa

SEQ ID NO: 7981623 - DNA, 22 bp, Homo sapiens
agaagagcctggggaccatggc

SEQ ID NO: 7981624 - DNA, 22 bp, Homo sapiens
agaagagagtcctaccccatac

SEQ ID NO: 7981625 - DNA, 22 bp, Homo sapiens
agaagagagtcctaccccatac

SEQ ID NO: 7981626 - DNA, 22 bp, Homo sapiens
agaagagagtcctaccccatac

SEQ ID NO: 7981627 - DNA, 22 bp, Homo sapiens
agaagagagtcctaccccatac

SEQ ID NO: 7981628 - DNA, 22 bp, Homo sapiens
agaagagagtcctaccccatac

SEQ ID NO: 7981629 - DNA, 21 bp, Homo sapiens
agaagagaagcaggaccctct

SEQ ID NO: 7981630 - DNA, 21 bp, Homo sapiens
agaagagaagcaggaccctct

SEQ ID NO: 7981631 - DNA, 21 bp, Homo sapiens
agaagagaagcaggaccctct

SEQ ID NO: 7981632 - DNA, 21 bp, Homo sapiens
agaagagaagcaggaccctct

SEQ ID NO: 7981633 - DNA, 19 bp, Homo sapiens
atctttagcaactttcaaa

SEQ ID NO: 7981634 - DNA, 19 bp, Homo sapiens
atctttagcaactttcaaa

SEQ ID NO: 7981635 - DNA, 22 bp, Homo sapiens
atctttagcattactttattca

SEQ ID NO: 7981636 - DNA, 22 bp, Homo sapiens
atctttagcattactttattca

SEQ ID NO: 7981637 - DNA, 22 bp, Homo sapiens
atctttaggcaagttacttaac

SEQ ID NO: 7981638 - DNA, 21 bp, Homo sapiens
atctttagccatccaatcaga

SEQ ID NO: 7981639 - DNA, 21 bp, Homo sapiens
atctttagccatccaatcaga

SEQ ID NO: 7981640 - DNA, 22 bp, Homo sapiens
atctttaggaacctaacctatt

SEQ ID NO: 7981641 - DNA, 22 bp, Homo sapiens
atctttaggaacctaacctatt

SEQ ID NO: 7981642 - DNA, 22 bp, Homo sapiens
atctttaggcaagttacttaac

SEQ ID NO: 7981643 - DNA, 19 bp, Homo sapiens
atctttagggatgtggctt

SEQ ID NO: 7981644 - DNA, 19 bp, Homo sapiens
atctttagggatgtggctt

SEQ ID NO: 7981645 - DNA, 22 bp, Homo sapiens
atctttagtagaggaatatatt

SEQ ID NO: 7981646 - DNA, 22 bp, Homo sapiens
atctttagtagaggaatatatt

SEQ ID NO: 7981647 - DNA, 22 bp, Homo sapiens
atctttaggcaagttacttaac

SEQ ID NO: 7981648 - DNA, 22 bp, Homo sapiens
atctttagtagaggaatatatt

SEQ ID NO: 7981649 - DNA, 22 bp, Homo sapiens
atctttagtagaggaatatatt

SEQ ID NO: 7981650 - DNA, 22 bp, Homo sapiens
atctttagagtcatctgagtgt

SEQ ID NO: 7981651 - DNA, 22 bp, Homo sapiens
atctttagagtcatctgagtgt

SEQ ID NO: 7981652 - DNA, 22 bp, Homo sapiens
atctttagacaggaagcaatca

SEQ ID NO: 7981653 - DNA, 22 bp, Homo sapiens
atctttagacaggaagcaatca

SEQ ID NO: 7981654 - DNA, 22 bp, Homo sapiens
atctttagacaggaagcaatca

SEQ ID NO: 7981655 - DNA, 22 bp, Homo sapiens
atctttaccaccaaagaatgct

SEQ ID NO: 7981656 - DNA, 22 bp, Homo sapiens
atctttagattagaaactctaa

SEQ ID NO: 7981657 - DNA, 22 bp, Homo sapiens
atctttagattagaaactctaa

SEQ ID NO: 7981658 - DNA, 22 bp, Homo sapiens
atctttagattagaaactctaa

SEQ ID NO: 7981659 - DNA, 19 bp, Homo sapiens
atctttagcaactttcaaa

SEQ ID NO: 7981660 - DNA, 19 bp, Homo sapiens
atctttagcaactttcaaa

SEQ ID NO: 7981661 - DNA, 22 bp, Homo sapiens
atctttaccaccaaagaatgct

SEQ ID NO: 7981662 - DNA, 22 bp, Homo sapiens
atctttaccaccaaagaatgct

SEQ ID NO: 7981663 - DNA, 22 bp, Homo sapiens
atctttacaagaaattctttta

SEQ ID NO: 7981664 - DNA, 22 bp, Homo sapiens
atctttacaagaaattctttta

SEQ ID NO: 7981665 - DNA, 22 bp, Homo sapiens
atctttacagtgtaagtgcaga

SEQ ID NO: 7981666 - DNA, 22 bp, Homo sapiens
atctttaaagacatgtgaactt

SEQ ID NO: 7981667 - DNA, 22 bp, Homo sapiens
atctttaatttggatcagggcc

SEQ ID NO: 7981668 - DNA, 22 bp, Homo sapiens
atctttaatttggatcagggcc

SEQ ID NO: 7981669 - DNA, 22 bp, Homo sapiens
atctttaatttggatcagggcc

SEQ ID NO: 7981670 - DNA, 22 bp, Homo sapiens
atcttgttataagagataatgg

SEQ ID NO: 7981671 - DNA, 22 bp, Homo sapiens
atcttgttaaaaagcagattct

SEQ ID NO: 7981672 - DNA, 22 bp, Homo sapiens
atcttgttaaaatgcagattct

SEQ ID NO: 7981673 - DNA, 22 bp, Homo sapiens
atcttgttaaagtgcagattct

SEQ ID NO: 7981674 - DNA, 22 bp, Homo sapiens
atcttgttaaagtgcagatttt

SEQ ID NO: 7981675 - DNA, 18 bp, Homo sapiens
atcttgtttttggattaa

SEQ ID NO: 7981676 - DNA, 22 bp, Homo sapiens
atcttgttataagagataatgg

SEQ ID NO: 7981677 - DNA, 22 bp, Homo sapiens
atcttgttataagagataatgg

SEQ ID NO: 7981678 - DNA, 22 bp, Homo sapiens
atcttgttaaaatgcagaaact

SEQ ID NO: 7981679 - DNA, 22 bp, Homo sapiens
atcttggtgcgacaacaaacta

SEQ ID NO: 7981680 - DNA, 22 bp, Homo sapiens
atcttgtgactggtttttaaat

SEQ ID NO: 7981681 - DNA, 22 bp, Homo sapiens
atcttggggactgtctcttgta

SEQ ID NO: 7981682 - DNA, 22 bp, Homo sapiens
agaagcacaggtaaagtgattt

SEQ ID NO: 7981683 - DNA, 22 bp, Homo sapiens
atcttattgctgttgccagata

SEQ ID NO: 7981684 - DNA, 22 bp, Homo sapiens
atcttgggacatgtgctctggg

SEQ ID NO: 7981685 - DNA, 20 bp, Homo sapiens
atcttgggattgagattgcc

SEQ ID NO: 7981686 - DNA, 20 bp, Homo sapiens
atcttgggattgagattgcc

SEQ ID NO: 7981687 - DNA, 22 bp, Homo sapiens
atcttgggccacaatgagccga

SEQ ID NO: 7981688 - DNA, 19 bp, Homo sapiens
agaagcaccagtcattcct

SEQ ID NO: 7981689 - DNA, 19 bp, Homo sapiens
agaagcaccagtcattcct

SEQ ID NO: 7981690 - DNA, 22 bp, Homo sapiens
atcttatgagacccataaagat

SEQ ID NO: 7981691 - DNA, 22 bp, Homo sapiens
atcttatgttgtattcaaaatc

SEQ ID NO: 7981692 - DNA, 22 bp, Homo sapiens
agaagcaaggtctgtcagtata

SEQ ID NO: 7981693 - DNA, 22 bp, Homo sapiens
agaagcaaggtctgtcagtata

SEQ ID NO: 7981694 - DNA, 22 bp, Homo sapiens
agaagcaaggtctgtcagtata

SEQ ID NO: 7981695 - DNA, 22 bp, Homo sapiens
agaagatttaggttgacgctat

SEQ ID NO: 7981696 - DNA, 22 bp, Homo sapiens
agaagatttaggttgacgctat

SEQ ID NO: 7981697 - DNA, 23 bp, Homo sapiens
agaagcaatgctttttttcctct

SEQ ID NO: 7981698 - DNA, 18 bp, Homo sapiens
agaagcacaagatgtctt

SEQ ID NO: 7981699 - DNA, 23 bp, Homo sapiens
agaagcaatgctttttttcctct

SEQ ID NO: 7981700 - DNA, 23 bp, Homo sapiens
agaagcaatgctttttttcctct

SEQ ID NO: 7981701 - DNA, 22 bp, Homo sapiens
agaagcacacctgacctctagc

SEQ ID NO: 7981702 - DNA, 22 bp, Homo sapiens
agaagcacaccagtagacaggg

SEQ ID NO: 7981703 - DNA, 22 bp, Homo sapiens
agaagcacaccagtagacaggg

SEQ ID NO: 7981704 - DNA, 22 bp, Homo sapiens
agaagcacaggtaaagtgattt

SEQ ID NO: 7981705 - DNA, 22 bp, Homo sapiens
agaagcacaggtaaagtgattt

SEQ ID NO: 7981706 - DNA, 22 bp, Homo sapiens
agaagcacaggtaaagtgattt

SEQ ID NO: 7981707 - DNA, 22 bp, Homo sapiens
agaagcacaccagtagacaggg

SEQ ID NO: 7981708 - DNA, 22 bp, Homo sapiens
agaagcacaccagtagacaggg

SEQ ID NO: 7981709 - DNA, 22 bp, Homo sapiens
agaagcacaccagtagacaggg

SEQ ID NO: 7981710 - DNA, 22 bp, Homo sapiens
agaagcacaccagtagacaggg

SEQ ID NO: 7981711 - DNA, 18 bp, Homo sapiens
agaagcacaagatgtctt

SEQ ID NO: 7981712 - DNA, 22 bp, Homo sapiens
atctttagtcaggcgtgggtat

SEQ ID NO: 7981713 - DNA, 22 bp, Homo sapiens
atctttagtcaggcgtgggtat

SEQ ID NO: 7981714 - DNA, 22 bp, Homo sapiens
atctttagtgtgaatttattga

SEQ ID NO: 7981715 - DNA, 22 bp, Homo sapiens
atctttatatatctcctctgaa

SEQ ID NO: 7981716 - DNA, 22 bp, Homo sapiens
atctttagtgtgaatttattga

SEQ ID NO: 7981717 - DNA, 21 bp, Homo sapiens
atctttattacgcagagaaga

SEQ ID NO: 7981718 - DNA, 22 bp, Homo sapiens
agaaggcatcagaagtgtgtag

SEQ ID NO: 7981719 - DNA, 22 bp, Homo sapiens
agaaggccaagaagaagcctat

SEQ ID NO: 7981720 - DNA, 22 bp, Homo sapiens
agaaggccaagaagaagcctat

SEQ ID NO: 7981721 - DNA, 22 bp, Homo sapiens
agaaggccaagaagaagcctat

SEQ ID NO: 7981722 - DNA, 20 bp, Homo sapiens
agaaggcattcctcattctt

SEQ ID NO: 7981723 - DNA, 22 bp, Homo sapiens
agaaggccagatggacggggct

SEQ ID NO: 7981724 - DNA, 22 bp, Homo sapiens
agaaggccaatagggtgcactg

SEQ ID NO: 7981725 - DNA, 22 bp, Homo sapiens
agaaggccagatggacggggct

SEQ ID NO: 7981726 - DNA, 22 bp, Homo sapiens
agaaggccccatgaacactgca

SEQ ID NO: 7981727 - DNA, 22 bp, Homo sapiens
agaaggccccatgaacactgca

SEQ ID NO: 7981728 - DNA, 22 bp, Homo sapiens
agaaggcctaacttgggggcaa

SEQ ID NO: 7981729 - DNA, 22 bp, Homo sapiens
agaaggctaaagaaacagattg

SEQ ID NO: 7981730 - DNA, 22 bp, Homo sapiens
agaaggctaaagaaacagattg

SEQ ID NO: 7981731 - DNA, 22 bp, Homo sapiens
agaaggctaaagaaacagattg

SEQ ID NO: 7981732 - DNA, 22 bp, Homo sapiens
agaaggctcactaagagtgact

SEQ ID NO: 7981733 - DNA, 22 bp, Homo sapiens
agaaggctcactaagagtgact

SEQ ID NO: 7981734 - DNA, 22 bp, Homo sapiens
agaaggctcactaagagtgact

SEQ ID NO: 7981735 - DNA, 22 bp, Homo sapiens
agaagtttgttatgtaaacaaa

SEQ ID NO: 7981736 - DNA, 22 bp, Homo sapiens
agaagtttgttatgtaaacaaa

SEQ ID NO: 7981737 - DNA, 22 bp, Homo sapiens
agaatacaattgttcagtaata

SEQ ID NO: 7981738 - DNA, 22 bp, Homo sapiens
agaatacaattgttcagtaata

SEQ ID NO: 7981739 - DNA, 22 bp, Homo sapiens
agaatacaattgttcagtaata

SEQ ID NO: 7981740 - DNA, 22 bp, Homo sapiens
agaatacaattgttcagtaata

SEQ ID NO: 7981741 - DNA, 22 bp, Homo sapiens
agaatacaattgttcagtaata

SEQ ID NO: 7981742 - DNA, 22 bp, Homo sapiens
agaatacaattgttcagtaata

SEQ ID NO: 7981743 - DNA, 22 bp, Homo sapiens
agaatacagtaggagcctgggc

SEQ ID NO: 7981744 - DNA, 22 bp, Homo sapiens
agaatacagtatgcaaaaagat

SEQ ID NO: 7981745 - DNA, 22 bp, Homo sapiens
agaatacagtatgcaaaaagat

SEQ ID NO: 7981746 - DNA, 22 bp, Homo sapiens
agaatacagtaggagcctgggc

SEQ ID NO: 7981747 - DNA, 22 bp, Homo sapiens
agaatacaattgttcagtaata

SEQ ID NO: 7981748 - DNA, 23 bp, Homo sapiens
agaatacaggctttgtataggca

SEQ ID NO: 7981749 - DNA, 22 bp, Homo sapiens
agaaggctggccatggtgccct

SEQ ID NO: 7981750 - DNA, 22 bp, Homo sapiens
agaagtttggtccttttcaagg

SEQ ID NO: 7981751 - DNA, 22 bp, Homo sapiens
agaaggctgagactgggatgaa

SEQ ID NO: 7981752 - DNA, 22 bp, Homo sapiens
agaaggctgagactgggatgaa

SEQ ID NO: 7981753 - DNA, 22 bp, Homo sapiens
agaaggctgaagaagatccgtt

SEQ ID NO: 7981754 - DNA, 22 bp, Homo sapiens
agaaggctgagactgggatgaa

SEQ ID NO: 7981755 - DNA, 22 bp, Homo sapiens
agaaggctggccatggtgccct

SEQ ID NO: 7981756 - DNA, 22 bp, Homo sapiens
agaaggctcatttgactgcatt

SEQ ID NO: 7981757 - DNA, 22 bp, Homo sapiens
agaaggctcatttgactgcatt

SEQ ID NO: 7981758 - DNA, 19 bp, Homo sapiens
agaaggctcctgttggaga

SEQ ID NO: 7981759 - DNA, 22 bp, Homo sapiens
agaaggctcatttgactgcatt

SEQ ID NO: 7981760 - DNA, 19 bp, Homo sapiens
agaaggctcctgttggaga

SEQ ID NO: 7981761 - DNA, 19 bp, Homo sapiens
agaaggctcctgttggaga

SEQ ID NO: 7981762 - DNA, 22 bp, Homo sapiens
agaaggctgaagaagatccgtt

SEQ ID NO: 7981763 - DNA, 22 bp, Homo sapiens
agaaggctgagactgggatgaa

SEQ ID NO: 7981764 - DNA, 22 bp, Homo sapiens
agaatcactggaattgtttttt

SEQ ID NO: 7981765 - DNA, 22 bp, Homo sapiens
atctttgtgctaatgtagttct

SEQ ID NO: 7981766 - DNA, 20 bp, Homo sapiens
atctttgtctctgtagttgt

SEQ ID NO: 7981767 - DNA, 22 bp, Homo sapiens
atctttgtgaatctcaacttgg

SEQ ID NO: 7981768 - DNA, 22 bp, Homo sapiens
atctttggtgcttggtgctccc

SEQ ID NO: 7981769 - DNA, 22 bp, Homo sapiens
atctttggtgcttggtgctccc

SEQ ID NO: 7981770 - DNA, 22 bp, Homo sapiens
atctttggtgcatgatactttg

SEQ ID NO: 7981771 - DNA, 22 bp, Homo sapiens
atctttggtgcatgatactttg

SEQ ID NO: 7981772 - DNA, 22 bp, Homo sapiens
atctttgtcactctactgtcta

SEQ ID NO: 7981773 - DNA, 22 bp, Homo sapiens
atctttgtcactctactgtcta

SEQ ID NO: 7981774 - DNA, 19 bp, Homo sapiens
atctttgggtcctgaaggg

SEQ ID NO: 7981775 - DNA, 19 bp, Homo sapiens
atctttgggtcctgaaggg

SEQ ID NO: 7981776 - DNA, 22 bp, Homo sapiens
atctttgggtacaaacttgcct

SEQ ID NO: 7981777 - DNA, 19 bp, Homo sapiens
atctttgggtcctgaaggg

SEQ ID NO: 7981778 - DNA, 22 bp, Homo sapiens
atctttggggcatccaggaaaa

SEQ ID NO: 7981779 - DNA, 22 bp, Homo sapiens
atctttgggcaatgatgaggga

SEQ ID NO: 7981780 - DNA, 22 bp, Homo sapiens
atctttgggtacaaacttgcct

SEQ ID NO: 7981781 - DNA, 22 bp, Homo sapiens
atctttggggcatccaggaaaa

SEQ ID NO: 7981782 - DNA, 22 bp, Homo sapiens
atctttggtactattcttatca

SEQ ID NO: 7981783 - DNA, 22 bp, Homo sapiens
atctttggtactattcttatca

SEQ ID NO: 7981784 - DNA, 22 bp, Homo sapiens
atctttggtactattcttatca

SEQ ID NO: 7981785 - DNA, 22 bp, Homo sapiens
atctttggtcttgagtgcatct

SEQ ID NO: 7981786 - DNA, 22 bp, Homo sapiens
atctttggtcttgagtgcatct

SEQ ID NO: 7981787 - DNA, 22 bp, Homo sapiens
atctttggtgcatgatactttg

SEQ ID NO: 7981788 - DNA, 22 bp, Homo sapiens
atctttggtgcatgatactttg

SEQ ID NO: 7981789 - DNA, 22 bp, Homo sapiens
atctttggtcttgagtgcatct

SEQ ID NO: 7981790 - DNA, 22 bp, Homo sapiens
agaatataaagataattctgtt

SEQ ID NO: 7981791 - DNA, 22 bp, Homo sapiens
agaatataaagataattctgtt

SEQ ID NO: 7981792 - DNA, 22 bp, Homo sapiens
agaatataaagataattctgtt

SEQ ID NO: 7981793 - DNA, 22 bp, Homo sapiens
agaatagttttacttttctatg

SEQ ID NO: 7981794 - DNA, 22 bp, Homo sapiens
agaatagtggcaatgactgcac

SEQ ID NO: 7981795 - DNA, 22 bp, Homo sapiens
agaatataaagataattctgtt

SEQ ID NO: 7981796 - DNA, 22 bp, Homo sapiens
agaatagagaaaaaggttattt

SEQ ID NO: 7981797 - DNA, 22 bp, Homo sapiens
agaatagagaaaaaggttattt

SEQ ID NO: 7981798 - DNA, 22 bp, Homo sapiens
agaatagagaaaaaggttattt

SEQ ID NO: 7981799 - DNA, 22 bp, Homo sapiens
agaatagaattctcatagaatt

SEQ ID NO: 7981800 - DNA, 22 bp, Homo sapiens
agaatactaggcttcagaaagg

SEQ ID NO: 7981801 - DNA, 22 bp, Homo sapiens
agaatactaggcttcagaaagg

SEQ ID NO: 7981802 - DNA, 22 bp, Homo sapiens
agaatacccatcccttcaactc

SEQ ID NO: 7981803 - DNA, 22 bp, Homo sapiens
agaataccataatatagaaaga

SEQ ID NO: 7981804 - DNA, 22 bp, Homo sapiens
agaatactaggcttcagaaagg

SEQ ID NO: 7981805 - DNA, 22 bp, Homo sapiens
agaatacttgggaatgggttaa

SEQ ID NO: 7981806 - DNA, 22 bp, Homo sapiens
agaatactaggcttcagaaagg

SEQ ID NO: 7981807 - DNA, 22 bp, Homo sapiens
agaatactaggcttcagaaagg

SEQ ID NO: 7981808 - DNA, 22 bp, Homo sapiens
agaatagaattctcatagaatt

SEQ ID NO: 7981809 - DNA, 22 bp, Homo sapiens
agaatacagtatgcaaaaagat

SEQ ID NO: 7981810 - DNA, 22 bp, Homo sapiens
agaatacagtatgcaaaaagat

SEQ ID NO: 7981811 - DNA, 22 bp, Homo sapiens
agaatacagtatgcaaaaagat

SEQ ID NO: 7981812 - DNA, 22 bp, Homo sapiens
agaatacagtatgcaaaaagat

SEQ ID NO: 7981813 - DNA, 22 bp, Homo sapiens
agaatacagttcagtaatggat

SEQ ID NO: 7981814 - DNA, 22 bp, Homo sapiens
agaatacagttcagtaatggat

SEQ ID NO: 7981815 - DNA, 22 bp, Homo sapiens
agaatacagttcagtaatggat

SEQ ID NO: 7981816 - DNA, 22 bp, Homo sapiens
agaatacagtatgcaaaaagat

SEQ ID NO: 7981817 - DNA, 22 bp, Homo sapiens
agaatacagttcagtaatggat

SEQ ID NO: 7981818 - DNA, 22 bp, Homo sapiens
agaatacatcaatctattttct

SEQ ID NO: 7981819 - DNA, 22 bp, Homo sapiens
agaatacatcaatctattttct

SEQ ID NO: 7981820 - DNA, 22 bp, Homo sapiens
agaatacatcaatctattttct

SEQ ID NO: 7981821 - DNA, 22 bp, Homo sapiens
agaatacatctagtgctgcatg

SEQ ID NO: 7981822 - DNA, 22 bp, Homo sapiens
agaatacatctagtgctgcatg

SEQ ID NO: 7981823 - DNA, 22 bp, Homo sapiens
agaatacatctagtgctgcatg

SEQ ID NO: 7981824 - DNA, 22 bp, Homo sapiens
agaatacatctagtgctgcatg

SEQ ID NO: 7981825 - DNA, 22 bp, Homo sapiens
agaatacatctagtgctgcatg

SEQ ID NO: 7981826 - DNA, 22 bp, Homo sapiens
agaatacatctagtgctgcatg

SEQ ID NO: 7981827 - DNA, 22 bp, Homo sapiens
agacacagtgctgggtgctgag

SEQ ID NO: 7981828 - DNA, 22 bp, Homo sapiens
agacacagtgctgggtgctgag

SEQ ID NO: 7981829 - DNA, 22 bp, Homo sapiens
agacacagtataagcacaacaa

SEQ ID NO: 7981830 - DNA, 22 bp, Homo sapiens
agacacagtgctgggtgctgag

SEQ ID NO: 7981831 - DNA, 22 bp, Homo sapiens
agacacagtgctgggtgctgag

SEQ ID NO: 7981832 - DNA, 22 bp, Homo sapiens
agacacagtctgtctggaggag

SEQ ID NO: 7981833 - DNA, 22 bp, Homo sapiens
agacacagtctgtctggaggag

SEQ ID NO: 7981834 - DNA, 22 bp, Homo sapiens
agacacagtgttgaaggctagt

SEQ ID NO: 7981835 - DNA, 22 bp, Homo sapiens
agacacagtgttgaaggctagt

SEQ ID NO: 7981836 - DNA, 22 bp, Homo sapiens
agacacagtttgggatgggttg

SEQ ID NO: 7981837 - DNA, 22 bp, Homo sapiens
agacacataggaccacactgtg

SEQ ID NO: 7981838 - DNA, 23 bp, Homo sapiens
agacacataggagcagctattgg

SEQ ID NO: 7981839 - DNA, 23 bp, Homo sapiens
agacacataggagcagctattgg

SEQ ID NO: 7981840 - DNA, 22 bp, Homo sapiens
agacacataggaccacactgtg

SEQ ID NO: 7981841 - DNA, 22 bp, Homo sapiens
agacacataggaccacactgtg

SEQ ID NO: 7981842 - DNA, 22 bp, Homo sapiens
agacaggcagcagatggagtgt

SEQ ID NO: 7981843 - DNA, 22 bp, Homo sapiens
agacaggcagcagatggagtgt

SEQ ID NO: 7981844 - DNA, 22 bp, Homo sapiens
agacaggcatgaggctggattg

SEQ ID NO: 7981845 - DNA, 22 bp, Homo sapiens
agacaggcagggcatggaaaaa

SEQ ID NO: 7981846 - DNA, 22 bp, Homo sapiens
agacacatcttaggttgtcagg

SEQ ID NO: 7981847 - DNA, 22 bp, Homo sapiens
agacacagctgcaggaggtggg

SEQ ID NO: 7981848 - DNA, 22 bp, Homo sapiens
agacacaggattctgcatttct

SEQ ID NO: 7981849 - DNA, 22 bp, Homo sapiens
agacacaggattctgcatttct

SEQ ID NO: 7981850 - DNA, 21 bp, Homo sapiens
agacacaggggttgctggggt

SEQ ID NO: 7981851 - DNA, 21 bp, Homo sapiens
agacacaggggttgctggggt

SEQ ID NO: 7981852 - DNA, 22 bp, Homo sapiens
agacacagctaccataatacca

SEQ ID NO: 7981853 - DNA, 22 bp, Homo sapiens
agacacagctaccataatacca

SEQ ID NO: 7981854 - DNA, 22 bp, Homo sapiens
agacacagcagtgcctgcctca

SEQ ID NO: 7981855 - DNA, 22 bp, Homo sapiens
agacacagctaccataatacca

SEQ ID NO: 7981856 - DNA, 22 bp, Homo sapiens
agacacagctgcaggaggtggg

SEQ ID NO: 7981857 - DNA, 22 bp, Homo sapiens
agacacagtctgtctggaggag

SEQ ID NO: 7981858 - DNA, 22 bp, Homo sapiens
agacacagtataagcacaacaa

SEQ ID NO: 7981859 - DNA, 22 bp, Homo sapiens
agacacagtctgtctggaggag

SEQ ID NO: 7981860 - DNA, 22 bp, Homo sapiens
agacacagtctgtctggaggag

SEQ ID NO: 7981861 - DNA, 22 bp, Homo sapiens
agacacagtctgtctggaggag

SEQ ID NO: 7981862 - DNA, 22 bp, Homo sapiens
agacacaggtgtaatttctgct

SEQ ID NO: 7981863 - DNA, 22 bp, Homo sapiens
agacacagtacttgccctcatg

SEQ ID NO: 7981864 - DNA, 22 bp, Homo sapiens
agacacagtacttgccctcatg

SEQ ID NO: 7981865 - DNA, 22 bp, Homo sapiens
agacacaggtgtaatttctgct

SEQ ID NO: 7981866 - DNA, 22 bp, Homo sapiens
agacacaggtgtaatttctgct

SEQ ID NO: 7981867 - DNA, 22 bp, Homo sapiens
agacacagtataagcacaacaa

SEQ ID NO: 7981868 - DNA, 22 bp, Homo sapiens
agacacagtataagcacaacaa

SEQ ID NO: 7981869 - DNA, 21 bp, Homo sapiens
agacaggtcagggagaggtga

SEQ ID NO: 7981870 - DNA, 22 bp, Homo sapiens
agacaggtgttttacaacttcg

SEQ ID NO: 7981871 - DNA, 22 bp, Homo sapiens
agacaggtgctcgcccaagtcc

SEQ ID NO: 7981872 - DNA, 21 bp, Homo sapiens
agacaggtcagggagaggtga

SEQ ID NO: 7981873 - DNA, 22 bp, Homo sapiens
agacaggtagcaggacagatat

SEQ ID NO: 7981874 - DNA, 22 bp, Homo sapiens
agacaggtagcaggacagatat

SEQ ID NO: 7981875 - DNA, 21 bp, Homo sapiens
agacagtaactcttctactcc

SEQ ID NO: 7981876 - DNA, 21 bp, Homo sapiens
agacagtaactcttctactcc

SEQ ID NO: 7981877 - DNA, 21 bp, Homo sapiens
agacagtaactcttctactcc

SEQ ID NO: 7981878 - DNA, 22 bp, Homo sapiens
agacagtatgatatatgaatac

SEQ ID NO: 7981879 - DNA, 22 bp, Homo sapiens
agacagtatgatatatgaatac

SEQ ID NO: 7981880 - DNA, 22 bp, Homo sapiens
agacagtatgatatatgaatac

SEQ ID NO: 7981881 - DNA, 22 bp, Homo sapiens
agacagtatgatatatgaatac

SEQ ID NO: 7981882 - DNA, 22 bp, Homo sapiens
agacagtatgatatatgaatac

SEQ ID NO: 7981883 - DNA, 22 bp, Homo sapiens
agacagtgataccttgggatgt

SEQ ID NO: 7981884 - DNA, 22 bp, Homo sapiens
agacagtgatggacaggcagac

SEQ ID NO: 7981885 - DNA, 22 bp, Homo sapiens
agacagtgatggacaggcagac

SEQ ID NO: 7981886 - DNA, 22 bp, Homo sapiens
agacagtgatggacaggcagac

SEQ ID NO: 7981887 - DNA, 22 bp, Homo sapiens
agacagtgatgtaagcaggagt

SEQ ID NO: 7981888 - DNA, 22 bp, Homo sapiens
agacagtgatgtaagcaggagt

SEQ ID NO: 7981889 - DNA, 22 bp, Homo sapiens
agacagtgatgtaagcaggagt

SEQ ID NO: 7981890 - DNA, 22 bp, Homo sapiens
agacagtgataccttgggatgt

SEQ ID NO: 7981891 - DNA, 17 bp, Homo sapiens
agacagtgagtgccttg

SEQ ID NO: 7981892 - DNA, 17 bp, Homo sapiens
agacagtgagtgccttg

SEQ ID NO: 7981893 - DNA, 17 bp, Homo sapiens
agacagtgagtgccttg

SEQ ID NO: 7981894 - DNA, 22 bp, Homo sapiens
agacagtgagaatgagttgaaa

SEQ ID NO: 7981895 - DNA, 22 bp, Homo sapiens
agacagtgagaatgagttgaaa

SEQ ID NO: 7981896 - DNA, 22 bp, Homo sapiens
agacagtatgatatatgaatac

SEQ ID NO: 7981897 - DNA, 22 bp, Homo sapiens
agacagtgaggcagagcttccg

SEQ ID NO: 7981898 - DNA, 22 bp, Homo sapiens
agacagtgaggcagagcttccg

SEQ ID NO: 7981899 - DNA, 22 bp, Homo sapiens
atgcaggagttggaaaaaatga

SEQ ID NO: 7981900 - DNA, 22 bp, Homo sapiens
atgcaggatgcagaggggcccg

SEQ ID NO: 7981901 - DNA, 22 bp, Homo sapiens
atgcaggagttcgaggctgtat

SEQ ID NO: 7981902 - DNA, 22 bp, Homo sapiens
atgcaggagttcgaggctgtat

SEQ ID NO: 7981903 - DNA, 22 bp, Homo sapiens
agacagtgctatcccatctgtg

SEQ ID NO: 7981904 - DNA, 22 bp, Homo sapiens
agacagtgcaagaagagcaggc

SEQ ID NO: 7981905 - DNA, 22 bp, Homo sapiens
agacagtgctatcccatctgtg

SEQ ID NO: 7981906 - DNA, 22 bp, Homo sapiens
agacagtgcaagaagagcaggc

SEQ ID NO: 7981907 - DNA, 22 bp, Homo sapiens
agacagtgcaagaagagcaggc

SEQ ID NO: 7981908 - DNA, 22 bp, Homo sapiens
agacagtgcaagaagagcaggc

SEQ ID NO: 7981909 - DNA, 22 bp, Homo sapiens
agacagtgcaagaagagcaggc

SEQ ID NO: 7981910 - DNA, 22 bp, Homo sapiens
agacagtgattcttcacatttc

SEQ ID NO: 7981911 - DNA, 22 bp, Homo sapiens
agacagtgattcttcacatttc

SEQ ID NO: 7981912 - DNA, 22 bp, Homo sapiens
atgcaggagttcgaggctgtat

SEQ ID NO: 7981913 - DNA, 22 bp, Homo sapiens
atgcaggattagaaagttgcct

SEQ ID NO: 7981914 - DNA, 22 bp, Homo sapiens
atgcaggatgtcaacgcatcct

SEQ ID NO: 7981915 - DNA, 22 bp, Homo sapiens
atgcaggatgtcaacgcatcct

SEQ ID NO: 7981916 - DNA, 21 bp, Homo sapiens
atgcaggctgctcagaagcaa

SEQ ID NO: 7981917 - DNA, 21 bp, Homo sapiens
atgcaggctgctcagaagcaa

SEQ ID NO: 7981918 - DNA, 21 bp, Homo sapiens
atgcaggctgctcagaagcaa

SEQ ID NO: 7981919 - DNA, 22 bp, Homo sapiens
atgcaggcagacactgtgggca

SEQ ID NO: 7981920 - DNA, 22 bp, Homo sapiens
atgcagggaggtaagaggtgcc

SEQ ID NO: 7981921 - DNA, 22 bp, Homo sapiens
atgcagggaggtaagaggtgcc

SEQ ID NO: 7981922 - DNA, 22 bp, Homo sapiens
atgcagggaggtaagaggtgcc

SEQ ID NO: 7981923 - DNA, 22 bp, Homo sapiens
atgcagggacctttgctttggt

SEQ ID NO: 7981924 - DNA, 21 bp, Homo sapiens
atgcaggctgctcagaagcaa

SEQ ID NO: 7981925 - DNA, 22 bp, Homo sapiens
agaatgtctaagtgttcagccc

SEQ ID NO: 7981926 - DNA, 22 bp, Homo sapiens
agaatgtgaagattttgaatta

SEQ ID NO: 7981927 - DNA, 22 bp, Homo sapiens
agaatgtgatatagtgatatgt

SEQ ID NO: 7981928 - DNA, 22 bp, Homo sapiens
agaatgtgggggaaaagagtgt

SEQ ID NO: 7981929 - DNA, 22 bp, Homo sapiens
agaatgtgttattagagaagga

SEQ ID NO: 7981930 - DNA, 22 bp, Homo sapiens
agaatgtgttattagagaagga

SEQ ID NO: 7981931 - DNA, 22 bp, Homo sapiens
agaatgtgttttaacatgggaa

SEQ ID NO: 7981932 - DNA, 22 bp, Homo sapiens
agaatgtttctgtggttcacaa

SEQ ID NO: 7981933 - DNA, 22 bp, Homo sapiens
agaatgttgatagcacctattt

SEQ ID NO: 7981934 - DNA, 22 bp, Homo sapiens
agaatgttgatagcacctattt

SEQ ID NO: 7981935 - DNA, 22 bp, Homo sapiens
agaatgctccagagctgaaaga

SEQ ID NO: 7981936 - DNA, 22 bp, Homo sapiens
agaatgcttcctttgaaactga

SEQ ID NO: 7981937 - DNA, 22 bp, Homo sapiens
agaatgctcttcaaaatctagc

SEQ ID NO: 7981938 - DNA, 22 bp, Homo sapiens
agaatgctcttcaaaatctagc

SEQ ID NO: 7981939 - DNA, 22 bp, Homo sapiens
agaatgcattttgtgtagctat

SEQ ID NO: 7981940 - DNA, 19 bp, Homo sapiens
agaatgcatttctgctgtc

SEQ ID NO: 7981941 - DNA, 22 bp, Homo sapiens
agaatgcattttgtgtagctat

SEQ ID NO: 7981942 - DNA, 22 bp, Homo sapiens
agaatgctttggatatattgga

SEQ ID NO: 7981943 - DNA, 22 bp, Homo sapiens
agaatgctttggatatattgga

SEQ ID NO: 7981944 - DNA, 20 bp, Homo sapiens
agaatgctttttgcattgca

SEQ ID NO: 7981945 - DNA, 22 bp, Homo sapiens
agaatgggggctacaggccaca

SEQ ID NO: 7981946 - DNA, 22 bp, Homo sapiens
agaatgtaagaatgcaaagatt

SEQ ID NO: 7981947 - DNA, 22 bp, Homo sapiens
agaatgtagtcttggagattta

SEQ ID NO: 7981948 - DNA, 22 bp, Homo sapiens
agaatcttgtttcttgtgtgtt

SEQ ID NO: 7981949 - DNA, 22 bp, Homo sapiens
agaatgaattaatcaactggaa

SEQ ID NO: 7981950 - DNA, 22 bp, Homo sapiens
agaatgaagatgacttcggaga

SEQ ID NO: 7981951 - DNA, 22 bp, Homo sapiens
agaatctttctgaatgactgtg

SEQ ID NO: 7981952 - DNA, 22 bp, Homo sapiens
agaatctttctgaatgactgtg

SEQ ID NO: 7981953 - DNA, 22 bp, Homo sapiens
agaatcagatgaagactcctgc

SEQ ID NO: 7981954 - DNA, 22 bp, Homo sapiens
agaatgatcctgttcagtcggt

SEQ ID NO: 7981955 - DNA, 22 bp, Homo sapiens
agaatgatagctagtatttact

SEQ ID NO: 7981956 - DNA, 22 bp, Homo sapiens
agaatgataatgccatgatgga

SEQ ID NO: 7981957 - DNA, 22 bp, Homo sapiens
agaatgaattaatcaactggaa

SEQ ID NO: 7981958 - DNA, 22 bp, Homo sapiens
agaatgcatctaaaagcagaga

SEQ ID NO: 7981959 - DNA, 22 bp, Homo sapiens
agaatgcatctaaaagcagaga

SEQ ID NO: 7981960 - DNA, 22 bp, Homo sapiens
agaatgcatctaaaagcagaga

SEQ ID NO: 7981961 - DNA, 22 bp, Homo sapiens
agaatgcatctaaaagcagaga

SEQ ID NO: 7981962 - DNA, 22 bp, Homo sapiens
agaatgcagtttgaaataaggt

SEQ ID NO: 7981963 - DNA, 22 bp, Homo sapiens
agaatgcagtttgaaataaggt

SEQ ID NO: 7981964 - DNA, 22 bp, Homo sapiens
agaatgcagtttgaaataaggt

SEQ ID NO: 7981965 - DNA, 22 bp, Homo sapiens
agaatgattttggacaatatgg

SEQ ID NO: 7981966 - DNA, 17 bp, Homo sapiens
agaatgcaaagcaggct

SEQ ID NO: 7981967 - DNA, 17 bp, Homo sapiens
agaatgcaaagcaggct

SEQ ID NO: 7981968 - DNA, 22 bp, Homo sapiens
agaatgcagcttgccagtatct

SEQ ID NO: 7981969 - DNA, 22 bp, Homo sapiens
agaatgcaagataaactttatt

SEQ ID NO: 7981970 - DNA, 22 bp, Homo sapiens
agaatgcaagataaactttatt

SEQ ID NO: 7981971 - DNA, 22 bp, Homo sapiens
agacaatatataattttagttg

SEQ ID NO: 7981972 - DNA, 22 bp, Homo sapiens
agacaatacatttattcccttt

SEQ ID NO: 7981973 - DNA, 22 bp, Homo sapiens
agacaatatataattttagttg

SEQ ID NO: 7981974 - DNA, 22 bp, Homo sapiens
agacaatacatttattcccttt

SEQ ID NO: 7981975 - DNA, 20 bp, Homo sapiens
agaattcttaccctttgatg

SEQ ID NO: 7981976 - DNA, 22 bp, Homo sapiens
agacaatacatttattcccttt

SEQ ID NO: 7981977 - DNA, 22 bp, Homo sapiens
agaattctgttcttcgggtgtg

SEQ ID NO: 7981978 - DNA, 22 bp, Homo sapiens
agaattctggagttgggaggaa

SEQ ID NO: 7981979 - DNA, 22 bp, Homo sapiens
agaattctccttcagggcagga

SEQ ID NO: 7981980 - DNA, 22 bp, Homo sapiens
agaattctccacgctcagggtc

SEQ ID NO: 7981981 - DNA, 22 bp, Homo sapiens
agaattctgacaatagaattgg

SEQ ID NO: 7981982 - DNA, 22 bp, Homo sapiens
agaattctgacaatagaattgg

SEQ ID NO: 7981983 - DNA, 22 bp, Homo sapiens
agaattctcttccattgaaaca

SEQ ID NO: 7981984 - DNA, 22 bp, Homo sapiens
agaattctccttcagggcagga

SEQ ID NO: 7981985 - DNA, 22 bp, Homo sapiens
agaattacagcttttagaatag

SEQ ID NO: 7981986 - DNA, 22 bp, Homo sapiens
agaattacataaatacatgaat

SEQ ID NO: 7981987 - DNA, 22 bp, Homo sapiens
agaattacataaatacatgaat

SEQ ID NO: 7981988 - DNA, 18 bp, Homo sapiens
agaattaccaaagtgctt

SEQ ID NO: 7981989 - DNA, 22 bp, Homo sapiens
agaattagaggccatgtacttg

SEQ ID NO: 7981990 - DNA, 22 bp, Homo sapiens
agaattagctgggcagattcct

SEQ ID NO: 7981991 - DNA, 23 bp, Homo sapiens
agaattccagtttcttatgtcac

SEQ ID NO: 7981992 - DNA, 22 bp, Homo sapiens
agaattagtcacaattatagga

SEQ ID NO: 7981993 - DNA, 18 bp, Homo sapiens
agaattattcttgtcctc

SEQ ID NO: 7981994 - DNA, 18 bp, Homo sapiens
agaattattcttgtcctc

SEQ ID NO: 7981995 - DNA, 19 bp, Homo sapiens
agacacacttacgtggaat

SEQ ID NO: 7981996 - DNA, 19 bp, Homo sapiens
agacacacttacgtggaat

SEQ ID NO: 7981997 - DNA, 22 bp, Homo sapiens
agacaatttttggttttgcaag

SEQ ID NO: 7981998 - DNA, 22 bp, Homo sapiens
agacaatttcaaagtaatatta

SEQ ID NO: 7981999 - DNA, 22 bp, Homo sapiens
agacaatttcaaagtaatatta

SEQ ID NO: 7982000 - DNA, 22 bp, Homo sapiens
agacaatttcaaagtaatatta

SEQ ID NO: 7982001 - DNA, 22 bp, Homo sapiens
agacacagaacacaaaagcata

SEQ ID NO: 7982002 - DNA, 22 bp, Homo sapiens
agacacagaacacaaaagcata

SEQ ID NO: 7982003 - DNA, 19 bp, Homo sapiens
agacacacttgatatgtgt

SEQ ID NO: 7982004 - DNA, 22 bp, Homo sapiens
agacacagcaataactactgtt

SEQ ID NO: 7982005 - DNA, 22 bp, Homo sapiens
agacacagaagttgctgttggg

SEQ ID NO: 7982006 - DNA, 22 bp, Homo sapiens
agacacagcaataactactgtt

SEQ ID NO: 7982007 - DNA, 22 bp, Homo sapiens
agacacagcagtgcctgcctca

SEQ ID NO: 7982008 - DNA, 22 bp, Homo sapiens
agacacagaagttgctgttggg

SEQ ID NO: 7982009 - DNA, 22 bp, Homo sapiens
agacacagatggtacctgagcc

SEQ ID NO: 7982010 - DNA, 22 bp, Homo sapiens
agacacagaagttgctgttggg

SEQ ID NO: 7982011 - DNA, 22 bp, Homo sapiens
agacacagaagttgctgttggg

SEQ ID NO: 7982012 - DNA, 23 bp, Homo sapiens
acctggctgctcaacctgcaggg

SEQ ID NO: 7982013 - DNA, 22 bp, Homo sapiens
acctggctgagaacgtgcagct

SEQ ID NO: 7982014 - DNA, 23 bp, Homo sapiens
acctggctgctcaacctgcaggg

SEQ ID NO: 7982015 - DNA, 23 bp, Homo sapiens
acctggctgctcaacctgcaggg

SEQ ID NO: 7982016 - DNA, 22 bp, Homo sapiens
aggtagctatccagacgctgaa

SEQ ID NO: 7982017 - DNA, 22 bp, Homo sapiens
aggtagctagtcctttaagtta

SEQ ID NO: 7982018 - DNA, 22 bp, Homo sapiens
aggtagcgcaatttcctgggac

SEQ ID NO: 7982019 - DNA, 22 bp, Homo sapiens
aggtagctaaaacaggcttttg

SEQ ID NO: 7982020 - DNA, 22 bp, Homo sapiens
acctggctggttgtgattccca

SEQ ID NO: 7982021 - DNA, 23 bp, Homo sapiens
acctggctgctcaacctgcaggg

SEQ ID NO: 7982022 - DNA, 22 bp, Homo sapiens
acctggctggttgtgattccca

SEQ ID NO: 7982023 - DNA, 22 bp, Homo sapiens
acctgggttgctggcgtgaggg

SEQ ID NO: 7982024 - DNA, 22 bp, Homo sapiens
acctgtcaagtccagcgcaaca

SEQ ID NO: 7982025 - DNA, 22 bp, Homo sapiens
acctgtacaattcctgcactga

SEQ ID NO: 7982026 - DNA, 22 bp, Homo sapiens
acctggttcctcctcactgctg

SEQ ID NO: 7982027 - DNA, 22 bp, Homo sapiens
acctggtaactctccaggggag

SEQ ID NO: 7982028 - DNA, 22 bp, Homo sapiens
acctgtttaccctgggctcccc

SEQ ID NO: 7982029 - DNA, 22 bp, Homo sapiens
acctgtgttttccctcagtttc

SEQ ID NO: 7982030 - DNA, 22 bp, Homo sapiens
acctgtgcaaagactggtcagg

SEQ ID NO: 7982031 - DNA, 22 bp, Homo sapiens
acctgtctgcatgatctaaaac

SEQ ID NO: 7982032 - DNA, 23 bp, Homo sapiens
acctgtctgcctcccaccatcaa

SEQ ID NO: 7982033 - DNA, 22 bp, Homo sapiens
acctgtctgcatgatctaaaac

SEQ ID NO: 7982034 - DNA, 23 bp, Homo sapiens
acctgtctgcctcccaccatcaa

SEQ ID NO: 7982035 - DNA, 23 bp, Homo sapiens
acctgtctgcctcccaccatcaa

SEQ ID NO: 7982036 - DNA, 22 bp, Homo sapiens
acctgtctgggctacatttgca

SEQ ID NO: 7982037 - DNA, 22 bp, Homo sapiens
acctgtctgggctacatttgca

SEQ ID NO: 7982038 - DNA, 22 bp, Homo sapiens
acctgtctataaaagtgaatac

SEQ ID NO: 7982039 - DNA, 22 bp, Homo sapiens
acctgtctataaaagtgaatac

SEQ ID NO: 7982040 - DNA, 22 bp, Homo sapiens
acctgtctataaaagtgaatac

SEQ ID NO: 7982041 - DNA, 22 bp, Homo sapiens
acctgtcatgtcaatgttcagt

SEQ ID NO: 7982042 - DNA, 22 bp, Homo sapiens
aggtagaaggaccagaatttat

SEQ ID NO: 7982043 - DNA, 22 bp, Homo sapiens
aggtagaggcctccaggcagca

SEQ ID NO: 7982044 - DNA, 22 bp, Homo sapiens
aggtactgaaaaaatgtttgca

SEQ ID NO: 7982045 - DNA, 22 bp, Homo sapiens
aggtactgaaaaaatgtttgca

SEQ ID NO: 7982046 - DNA, 22 bp, Homo sapiens
aggtagaagagcaaggaataac

SEQ ID NO: 7982047 - DNA, 22 bp, Homo sapiens
aggtagcatattccagacttgt

SEQ ID NO: 7982048 - DNA, 22 bp, Homo sapiens
aggtagcatattccagacttgt

SEQ ID NO: 7982049 - DNA, 22 bp, Homo sapiens
aggtagcacagcctgagtccag

SEQ ID NO: 7982050 - DNA, 22 bp, Homo sapiens
aggtagcagcctagcagggact

SEQ ID NO: 7982051 - DNA, 22 bp, Homo sapiens
aggtagcagcctagcagggact

SEQ ID NO: 7982052 - DNA, 22 bp, Homo sapiens
aggtagaggcctccaggcagca

SEQ ID NO: 7982053 - DNA, 22 bp, Homo sapiens
aggtagattacttaccttttct

SEQ ID NO: 7982054 - DNA, 22 bp, Homo sapiens
aggtagcaagacacctgctttt

SEQ ID NO: 7982055 - DNA, 22 bp, Homo sapiens
aggtacatggggtgtgtgcacg

SEQ ID NO: 7982056 - DNA, 22 bp, Homo sapiens
aggtacatggggtgtgtgcacg

SEQ ID NO: 7982057 - DNA, 22 bp, Homo sapiens
aggtacatggggtgtgtgcacg

SEQ ID NO: 7982058 - DNA, 22 bp, Homo sapiens
aggtacatggggtgtgtgcacg

SEQ ID NO: 7982059 - DNA, 22 bp, Homo sapiens
aggtacagtagacagacagtta

SEQ ID NO: 7982060 - DNA, 23 bp, Homo sapiens
aggtacatatacttggaggtcag

SEQ ID NO: 7982061 - DNA, 21 bp, Homo sapiens
aggtaccaaaagcctgcatga

SEQ ID NO: 7982062 - DNA, 21 bp, Homo sapiens
aggtaccaaaagcctgcatga

SEQ ID NO: 7982063 - DNA, 22 bp, Homo sapiens
aggtacatggggtgtgtgcacg

SEQ ID NO: 7982064 - DNA, 22 bp, Homo sapiens
aggtactaccagggattttcag

SEQ ID NO: 7982065 - DNA, 22 bp, Homo sapiens
aggtaccatatgcgggagcaac

SEQ ID NO: 7982066 - DNA, 22 bp, Homo sapiens
aggtaccaaaagcctttttctg

SEQ ID NO: 7982067 - DNA, 22 bp, Homo sapiens
acctgccttctcaaggacatga

SEQ ID NO: 7982068 - DNA, 22 bp, Homo sapiens
acctgccttctcaaggacatga

SEQ ID NO: 7982069 - DNA, 22 bp, Homo sapiens
acctgccttctcaaggacatga

SEQ ID NO: 7982070 - DNA, 22 bp, Homo sapiens
acctgccttctcaaggacatga

SEQ ID NO: 7982071 - DNA, 22 bp, Homo sapiens
acctgctgaggagggggaatta

SEQ ID NO: 7982072 - DNA, 22 bp, Homo sapiens
acctgctgtcttgggggaatgc

SEQ ID NO: 7982073 - DNA, 22 bp, Homo sapiens
acctgctttattcctcctgcct

SEQ ID NO: 7982074 - DNA, 22 bp, Homo sapiens
acctgctttgtagtgtttgctg

SEQ ID NO: 7982075 - DNA, 22 bp, Homo sapiens
acctggaacttggtcatttttc

SEQ ID NO: 7982076 - DNA, 22 bp, Homo sapiens
acctgcttgagccagtatgaga

SEQ ID NO: 7982077 - DNA, 22 bp, Homo sapiens
acctccctgcctcttggcgtca

SEQ ID NO: 7982078 - DNA, 22 bp, Homo sapiens
acctgcccacacttccttccca

SEQ ID NO: 7982079 - DNA, 22 bp, Homo sapiens
acctgccttctcaaggacatga

SEQ ID NO: 7982080 - DNA, 22 bp, Homo sapiens
acctgcccggggacattccttt

SEQ ID NO: 7982081 - DNA, 22 bp, Homo sapiens
acctgcccggggacattccttt

SEQ ID NO: 7982082 - DNA, 22 bp, Homo sapiens
acctgcccagactcagatccta

SEQ ID NO: 7982083 - DNA, 22 bp, Homo sapiens
acctggacacctgctgtcatct

SEQ ID NO: 7982084 - DNA, 22 bp, Homo sapiens
acctggacacctgctgtcatct

SEQ ID NO: 7982085 - DNA, 22 bp, Homo sapiens
acctggacacctgctgtcatct

SEQ ID NO: 7982086 - DNA, 22 bp, Homo sapiens
acctggaagtgggtgctatggc

SEQ ID NO: 7982087 - DNA, 22 bp, Homo sapiens
acctggaatggggttgagagct

SEQ ID NO: 7982088 - DNA, 22 bp, Homo sapiens
acctggacacctgctgtcatct

SEQ ID NO: 7982089 - DNA, 22 bp, Homo sapiens
acctggacacctgctgtcatct

SEQ ID NO: 7982090 - DNA, 22 bp, Homo sapiens
acctggacacctgctgtcatct

SEQ ID NO: 7982091 - DNA, 22 bp, Homo sapiens
acctggacctgccacctatgag

SEQ ID NO: 7982092 - DNA, 22 bp, Homo sapiens
acctggacacctgctgtcatct

SEQ ID NO: 7982093 - DNA, 20 bp, Homo sapiens
acctggagacagcactctgg

SEQ ID NO: 7982094 - DNA, 22 bp, Homo sapiens
acctggacctgccacctatgag

SEQ ID NO: 7982095 - DNA, 20 bp, Homo sapiens
acctggagacagcactctgg

SEQ ID NO: 7982096 - DNA, 22 bp, Homo sapiens
acctggagatccatggtgtcga

SEQ ID NO: 7982097 - DNA, 22 bp, Homo sapiens
aggtacagtagacagacagtta

SEQ ID NO: 7982098 - DNA, 22 bp, Homo sapiens
aggtacagtagacagacagtta

SEQ ID NO: 7982099 - DNA, 20 bp, Homo sapiens
agggtggggacgttctgact

SEQ ID NO: 7982100 - DNA, 20 bp, Homo sapiens
agggtggggacgttctgact

SEQ ID NO: 7982101 - DNA, 20 bp, Homo sapiens
agggtggggacgttctgact

SEQ ID NO: 7982102 - DNA, 20 bp, Homo sapiens
agggtggggacgttctgact

SEQ ID NO: 7982103 - DNA, 20 bp, Homo sapiens
agggtggggacgttctgact

SEQ ID NO: 7982104 - DNA, 20 bp, Homo sapiens
agggtggggacgttctgact

SEQ ID NO: 7982105 - DNA, 22 bp, Homo sapiens
agggtgggctagactcttcccc

SEQ ID NO: 7982106 - DNA, 22 bp, Homo sapiens
agggtgggctagactcttcccc

SEQ ID NO: 7982107 - DNA, 22 bp, Homo sapiens
agggtgggctagactcttcccc

SEQ ID NO: 7982108 - DNA, 22 bp, Homo sapiens
agggtgggctagactcttcccc

SEQ ID NO: 7982109 - DNA, 22 bp, Homo sapiens
agggtgcgttctatgagaatct

SEQ ID NO: 7982110 - DNA, 22 bp, Homo sapiens
agggtgcctggaagccactcac

SEQ ID NO: 7982111 - DNA, 22 bp, Homo sapiens
agggctttacttctcagttcta

SEQ ID NO: 7982112 - DNA, 22 bp, Homo sapiens
agggcttgtggtcgtggctgtg

SEQ ID NO: 7982113 - DNA, 22 bp, Homo sapiens
agggcttgttaacatagagatt

SEQ ID NO: 7982114 - DNA, 22 bp, Homo sapiens
agggcttgtggtcgtggctgtg

SEQ ID NO: 7982115 - DNA, 22 bp, Homo sapiens
agggcttgttaacatagagatt

SEQ ID NO: 7982116 - DNA, 22 bp, Homo sapiens
agggcttgccattgcctgttag

SEQ ID NO: 7982117 - DNA, 22 bp, Homo sapiens
agggcttgtagggtggctgtag

SEQ ID NO: 7982118 - DNA, 22 bp, Homo sapiens
agggcttgtggtcgtggctgtg

SEQ ID NO: 7982119 - DNA, 22 bp, Homo sapiens
agggcttgtagggtggctgtag

SEQ ID NO: 7982120 - DNA, 22 bp, Homo sapiens
agggctggtatgtccatgaaag

SEQ ID NO: 7982121 - DNA, 22 bp, Homo sapiens
agggctggtatgtccatgaaag

SEQ ID NO: 7982122 - DNA, 22 bp, Homo sapiens
agggctggtatgtccatgaaag

SEQ ID NO: 7982123 - DNA, 22 bp, Homo sapiens
agggctggtatgtccatgaaag

SEQ ID NO: 7982124 - DNA, 22 bp, Homo sapiens
agggctggtatgtccatgaaag

SEQ ID NO: 7982125 - DNA, 22 bp, Homo sapiens
agggctggtatgtccatgaaag

SEQ ID NO: 7982126 - DNA, 22 bp, Homo sapiens
accctcagctggagattgaatt

SEQ ID NO: 7982127 - DNA, 22 bp, Homo sapiens
accctcagagtaggcactgctg

SEQ ID NO: 7982128 - DNA, 22 bp, Homo sapiens
accctcagagtaggcactgctg

SEQ ID NO: 7982129 - DNA, 22 bp, Homo sapiens
agggctggtatgtccatgaaag

SEQ ID NO: 7982130 - DNA, 22 bp, Homo sapiens
accctcagcttcttggattaat

SEQ ID NO: 7982131 - DNA, 22 bp, Homo sapiens
accctcaggcagaatgtattct

SEQ ID NO: 7982132 - DNA, 22 bp, Homo sapiens
agggctgtttttcagtgtgtga

SEQ ID NO: 7982133 - DNA, 22 bp, Homo sapiens
agggctgtgtttgcaccctctg

SEQ ID NO: 7982134 - DNA, 22 bp, Homo sapiens
agggctgtgtccctaggggagc

SEQ ID NO: 7982135 - DNA, 22 bp, Homo sapiens
agggctgtgtccctaggggagc

SEQ ID NO: 7982136 - DNA, 22 bp, Homo sapiens
agggctgtcagactgaggaggc

SEQ ID NO: 7982137 - DNA, 22 bp, Homo sapiens
agggctgtaccatcaggttcct

SEQ ID NO: 7982138 - DNA, 22 bp, Homo sapiens
agggctgtcagactgaggaggc

SEQ ID NO: 7982139 - DNA, 22 bp, Homo sapiens
agggctgtttttggcacctggg

SEQ ID NO: 7982140 - DNA, 22 bp, Homo sapiens
agggctgtttttggcacctggg

SEQ ID NO: 7982141 - DNA, 22 bp, Homo sapiens
agggcttgacaagggctggagc

SEQ ID NO: 7982142 - DNA, 22 bp, Homo sapiens
agggcttgacaagggctggagc

SEQ ID NO: 7982143 - DNA, 22 bp, Homo sapiens
agggcttgcagaaatgagaaat

SEQ ID NO: 7982144 - DNA, 22 bp, Homo sapiens
agggcttgacaagggctggagc

SEQ ID NO: 7982145 - DNA, 22 bp, Homo sapiens
acctcccagctctgagcttggg

SEQ ID NO: 7982146 - DNA, 22 bp, Homo sapiens
acctcccagctctgagcttggg

SEQ ID NO: 7982147 - DNA, 22 bp, Homo sapiens
acctccccacatggtagtgagt

SEQ ID NO: 7982148 - DNA, 22 bp, Homo sapiens
acctccccacatggtagtgagt

SEQ ID NO: 7982149 - DNA, 22 bp, Homo sapiens
agggttaattggtgtcctgagg

SEQ ID NO: 7982150 - DNA, 22 bp, Homo sapiens
acctcccagctctgagcttggg

SEQ ID NO: 7982151 - DNA, 19 bp, Homo sapiens
agggttacccgctgccacc

SEQ ID NO: 7982152 - DNA, 22 bp, Homo sapiens
agggtgtgttctcctatgagaa

SEQ ID NO: 7982153 - DNA, 22 bp, Homo sapiens
agggtgtgttctcctatgagaa

SEQ ID NO: 7982154 - DNA, 22 bp, Homo sapiens
agggtgtgttctcctatgagaa

SEQ ID NO: 7982155 - DNA, 22 bp, Homo sapiens
agggtgtgctgttgggtctttc

SEQ ID NO: 7982156 - DNA, 22 bp, Homo sapiens
agggtgtgctgttgggtctttc

SEQ ID NO: 7982157 - DNA, 22 bp, Homo sapiens
agggtggggtgctacatcttta

SEQ ID NO: 7982158 - DNA, 22 bp, Homo sapiens
agggtggtatttaacaactgga

SEQ ID NO: 7982159 - DNA, 22 bp, Homo sapiens
agggtggggtgctacatcttta

SEQ ID NO: 7982160 - DNA, 22 bp, Homo sapiens
agggtggggtgctacatcttta

SEQ ID NO: 7982161 - DNA, 22 bp, Homo sapiens
agggtggtggcgatgaggacat

SEQ ID NO: 7982162 - DNA, 22 bp, Homo sapiens
agggtggtggcgatgaggacat

SEQ ID NO: 7982163 - DNA, 22 bp, Homo sapiens
agggtgtcagccacggaatggg

SEQ ID NO: 7982164 - DNA, 22 bp, Homo sapiens
agggtggttcttttagtggaag

SEQ ID NO: 7982165 - DNA, 22 bp, Homo sapiens
agggtggttcttttagtggaag

SEQ ID NO: 7982166 - DNA, 20 bp, Homo sapiens
agggtggggacgttctgact

SEQ ID NO: 7982167 - DNA, 22 bp, Homo sapiens
agggtggggtgctacatcttta

SEQ ID NO: 7982168 - DNA, 20 bp, Homo sapiens
agggtggggacgttctgact

SEQ ID NO: 7982169 - DNA, 22 bp, Homo sapiens
agggtggggtgctacatcttta

SEQ ID NO: 7982170 - DNA, 22 bp, Homo sapiens
agggtggggtgctacatcttta

SEQ ID NO: 7982171 - DNA, 22 bp, Homo sapiens
agggtggggtgctacatcttta

SEQ ID NO: 7982172 - DNA, 22 bp, Homo sapiens
agggtggggtgctacatcttta

SEQ ID NO: 7982173 - DNA, 20 bp, Homo sapiens
agggtggggacgttctgact

SEQ ID NO: 7982174 - DNA, 22 bp, Homo sapiens
acctccccacatggtagtgagt

SEQ ID NO: 7982175 - DNA, 22 bp, Homo sapiens
acctccccattaggtcacccac

SEQ ID NO: 7982176 - DNA, 22 bp, Homo sapiens
acctccccattaggtcacccac

SEQ ID NO: 7982177 - DNA, 22 bp, Homo sapiens
acctccccattaggtcacccac

SEQ ID NO: 7982178 - DNA, 22 bp, Homo sapiens
acctccccattaggtcacccac

SEQ ID NO: 7982179 - DNA, 22 bp, Homo sapiens
acctccccattaggtcacccac

SEQ ID NO: 7982180 - DNA, 18 bp, Homo sapiens
acctccccattttctgaa

SEQ ID NO: 7982181 - DNA, 18 bp, Homo sapiens
acctccccattttctgaa

SEQ ID NO: 7982182 - DNA, 22 bp, Homo sapiens
acctccccgggagcagcctcct

SEQ ID NO: 7982183 - DNA, 22 bp, Homo sapiens
acctccccgggagcagcctcct

SEQ ID NO: 7982184 - DNA, 22 bp, Homo sapiens
acctcccctcaccaatctggtt

SEQ ID NO: 7982185 - DNA, 22 bp, Homo sapiens
acctccccgggagcagcctcct

SEQ ID NO: 7982186 - DNA, 22 bp, Homo sapiens
acctccccgggagcagcctcct

SEQ ID NO: 7982187 - DNA, 22 bp, Homo sapiens
acctccccgggagcagcctcct

SEQ ID NO: 7982188 - DNA, 22 bp, Homo sapiens
acctcccctcaccaatctggtt

SEQ ID NO: 7982189 - DNA, 22 bp, Homo sapiens
acctcccctcaccaatctggtt

SEQ ID NO: 7982190 - DNA, 22 bp, Homo sapiens
acctcccctgactcgaaaccca

SEQ ID NO: 7982191 - DNA, 22 bp, Homo sapiens
acctcccctgactcgaaaccca

SEQ ID NO: 7982192 - DNA, 22 bp, Homo sapiens
acctccctaagggtccagctta

SEQ ID NO: 7982193 - DNA, 22 bp, Homo sapiens
acctccctcgccgtccactctg

SEQ ID NO: 7982194 - DNA, 21 bp, Homo sapiens
acctccctcgagcaaccagca

SEQ ID NO: 7982195 - DNA, 22 bp, Homo sapiens
acctccctcgccgtccactctg

SEQ ID NO: 7982196 - DNA, 20 bp, Homo sapiens
acctccctctgtgggtggga

SEQ ID NO: 7982197 - DNA, 22 bp, Homo sapiens
acctccctcgccgtccactctg

SEQ ID NO: 7982198 - DNA, 21 bp, Homo sapiens
acctccctcgagcaaccagca

SEQ ID NO: 7982199 - DNA, 22 bp, Homo sapiens
acgtgtgtatgagtgtacatat

SEQ ID NO: 7982200 - DNA, 22 bp, Homo sapiens
acgtgtgtatgagtgtacatat

SEQ ID NO: 7982201 - DNA, 22 bp, Homo sapiens
acgtggcggccgccgtgagcgg

SEQ ID NO: 7982202 - DNA, 22 bp, Homo sapiens
acgtggcggccgccgtgagcgg

SEQ ID NO: 7982203 - DNA, 22 bp, Homo sapiens
acgggccttctcttcaggcgag

SEQ ID NO: 7982204 - DNA, 22 bp, Homo sapiens
acgggccttctcttcaggcgag

SEQ ID NO: 7982205 - DNA, 22 bp, Homo sapiens
acgggctgggacggggaagctc

SEQ ID NO: 7982206 - DNA, 22 bp, Homo sapiens
acgggctgggacggggaagctc

SEQ ID NO: 7982207 - DNA, 23 bp, Homo sapiens
acgggagggctgtttgcttggtg

SEQ ID NO: 7982208 - DNA, 20 bp, Homo sapiens
acgtgtgtgtgcacgcgcgc

SEQ ID NO: 7982209 - DNA, 22 bp, Homo sapiens
acgtgtgtgacattgggaacgt

SEQ ID NO: 7982210 - DNA, 22 bp, Homo sapiens
acgtgtgttggtcagggggccc

SEQ ID NO: 7982211 - DNA, 22 bp, Homo sapiens
acgtgtgtgacattgggaacgt

SEQ ID NO: 7982212 - DNA, 20 bp, Homo sapiens
acgtgtgtgtgcacgcgcgc

SEQ ID NO: 7982213 - DNA, 22 bp, Homo sapiens
acgtgtgtttaacaaacctgca

SEQ ID NO: 7982214 - DNA, 22 bp, Homo sapiens
acgtgtgtttaacaaacctgca

SEQ ID NO: 7982215 - DNA, 22 bp, Homo sapiens
acgttaaacatttagcatagta

SEQ ID NO: 7982216 - DNA, 22 bp, Homo sapiens
acgttaaacatttagcatagta

SEQ ID NO: 7982217 - DNA, 22 bp, Homo sapiens
actaaaaactactgccaatagc

SEQ ID NO: 7982218 - DNA, 22 bp, Homo sapiens
actaaaaactactgccaatagc

SEQ ID NO: 7982219 - DNA, 22 bp, Homo sapiens
actaaaaactactgccaatagc

SEQ ID NO: 7982220 - DNA, 19 bp, Homo sapiens
actaaaaatgatgtttgag

SEQ ID NO: 7982221 - DNA, 19 bp, Homo sapiens
actaaaaatgatgtttgag

SEQ ID NO: 7982222 - DNA, 19 bp, Homo sapiens
actaaaaatgatgtttgag

SEQ ID NO: 7982223 - DNA, 22 bp, Homo sapiens
actaaaaactactgccaatagc

SEQ ID NO: 7982224 - DNA, 22 bp, Homo sapiens
actaaaaactactgccaatagc

SEQ ID NO: 7982225 - DNA, 22 bp, Homo sapiens
acgtttgttgatggattactag

SEQ ID NO: 7982226 - DNA, 22 bp, Homo sapiens
acgttttctagagaatatgcag

SEQ ID NO: 7982227 - DNA, 22 bp, Homo sapiens
actaaaaactactgccaatagc

SEQ ID NO: 7982228 - DNA, 22 bp, Homo sapiens
acgtttatggagtgcctatcat

SEQ ID NO: 7982229 - DNA, 22 bp, Homo sapiens
acgttatatctgaaaaaagtga

SEQ ID NO: 7982230 - DNA, 22 bp, Homo sapiens
acgttagaaaagcaggagctca

SEQ ID NO: 7982231 - DNA, 19 bp, Homo sapiens
actaaaaatgatgtttgag

SEQ ID NO: 7982232 - DNA, 19 bp, Homo sapiens
actaaaaatgatgtttgag

SEQ ID NO: 7982233 - DNA, 19 bp, Homo sapiens
actaaaaatgatgtttgag

SEQ ID NO: 7982234 - DNA, 19 bp, Homo sapiens
actaaaaatgatgtttgag

SEQ ID NO: 7982235 - DNA, 22 bp, Homo sapiens
actaaaacagtggctagtagac

SEQ ID NO: 7982236 - DNA, 19 bp, Homo sapiens
actaaaaatgatgtttgag

SEQ ID NO: 7982237 - DNA, 19 bp, Homo sapiens
actaaaaatgatgtttgag

SEQ ID NO: 7982238 - DNA, 19 bp, Homo sapiens
actaaaaatgatgtttgag

SEQ ID NO: 7982239 - DNA, 22 bp, Homo sapiens
actaaacacatgagattcctgc

SEQ ID NO: 7982240 - DNA, 22 bp, Homo sapiens
actaaaacatagccagtcagtg

SEQ ID NO: 7982241 - DNA, 22 bp, Homo sapiens
actaaactgaagcatgaaaagg

SEQ ID NO: 7982242 - DNA, 22 bp, Homo sapiens
actaaaacagtggctagtagac

SEQ ID NO: 7982243 - DNA, 22 bp, Homo sapiens
actaaaacagtggctagtagac

SEQ ID NO: 7982244 - DNA, 22 bp, Homo sapiens
actaaaacagtggctagtagac

SEQ ID NO: 7982245 - DNA, 22 bp, Homo sapiens
actaaagatgtctaaatatatt

SEQ ID NO: 7982246 - DNA, 22 bp, Homo sapiens
actaaactgttcatcagcatct

SEQ ID NO: 7982247 - DNA, 22 bp, Homo sapiens
actaaagaacagttcgttcatg

SEQ ID NO: 7982248 - DNA, 22 bp, Homo sapiens
actaaagaagccaaagttttct

SEQ ID NO: 7982249 - DNA, 22 bp, Homo sapiens
actaaagaacagttcgttcatg

SEQ ID NO: 7982250 - DNA, 22 bp, Homo sapiens
actaaagctcacagagttgaac

SEQ ID NO: 7982251 - DNA, 19 bp, Homo sapiens
actaaagcaataactattt

SEQ ID NO: 7982252 - DNA, 19 bp, Homo sapiens
actaaagcaataactattt

SEQ ID NO: 7982253 - DNA, 22 bp, Homo sapiens
actaaagctcacagagttgaac

SEQ ID NO: 7982254 - DNA, 22 bp, Homo sapiens
actaaagctcacagagttgaac

SEQ ID NO: 7982255 - DNA, 22 bp, Homo sapiens
actaaagctcacagagttgaac

SEQ ID NO: 7982256 - DNA, 22 bp, Homo sapiens
actaaagtatctcctatttcat

SEQ ID NO: 7982257 - DNA, 22 bp, Homo sapiens
actaaagtcagactgcattgat

SEQ ID NO: 7982258 - DNA, 22 bp, Homo sapiens
actaaagtatggaagtgaataa

SEQ ID NO: 7982259 - DNA, 22 bp, Homo sapiens
accttcaattatttttgttcca

SEQ ID NO: 7982260 - DNA, 22 bp, Homo sapiens
accttcagacatcaactatctc

SEQ ID NO: 7982261 - DNA, 22 bp, Homo sapiens
accttcagacatcaactatctc

SEQ ID NO: 7982262 - DNA, 19 bp, Homo sapiens
accttcagagtggcacaaa

SEQ ID NO: 7982263 - DNA, 19 bp, Homo sapiens
accttcagagtggcacaaa

SEQ ID NO: 7982264 - DNA, 21 bp, Homo sapiens
accttcagtgttctcagctgc

SEQ ID NO: 7982265 - DNA, 22 bp, Homo sapiens
accttcaggtgagcacacagat

SEQ ID NO: 7982266 - DNA, 21 bp, Homo sapiens
accttcagtgttctcagctgc

SEQ ID NO: 7982267 - DNA, 22 bp, Homo sapiens
acgggccttctcttcaggcgag

SEQ ID NO: 7982268 - DNA, 21 bp, Homo sapiens
acgggaatgaacatggtggag

SEQ ID NO: 7982269 - DNA, 21 bp, Homo sapiens
acgggaatgaacatggtggag

SEQ ID NO: 7982270 - DNA, 22 bp, Homo sapiens
accttccaggaatctgccagat

SEQ ID NO: 7982271 - DNA, 22 bp, Homo sapiens
accttcaaactagatagaagtt

SEQ ID NO: 7982272 - DNA, 22 bp, Homo sapiens
accttattttgaaatagattgt

SEQ ID NO: 7982273 - DNA, 22 bp, Homo sapiens
accttattttgaaatagattgt

SEQ ID NO: 7982274 - DNA, 22 bp, Homo sapiens
accttcaactcaaagtgtccca

SEQ ID NO: 7982275 - DNA, 22 bp, Homo sapiens
accttcaactcaaagtgtccca

SEQ ID NO: 7982276 - DNA, 22 bp, Homo sapiens
accttattaaaatgatgatgta

SEQ ID NO: 7982277 - DNA, 22 bp, Homo sapiens
accttattcttgcccttagatg

SEQ ID NO: 7982278 - DNA, 22 bp, Homo sapiens
accttatttggaaatataatta

SEQ ID NO: 7982279 - DNA, 22 bp, Homo sapiens
accttattttgaaatagattgt

SEQ ID NO: 7982280 - DNA, 21 bp, Homo sapiens
accttcaagccagaggtggtc

SEQ ID NO: 7982281 - DNA, 21 bp, Homo sapiens
accttcaagccagaggtggtc

SEQ ID NO: 7982282 - DNA, 22 bp, Homo sapiens
accttcaagaaacatttccttg

SEQ ID NO: 7982283 - DNA, 22 bp, Homo sapiens
accttcaagattgtgggtcaat

SEQ ID NO: 7982284 - DNA, 22 bp, Homo sapiens
accttcaagaaacatttccttg

SEQ ID NO: 7982285 - DNA, 22 bp, Homo sapiens
accttcaatgaaaataatagtc

SEQ ID NO: 7982286 - DNA, 22 bp, Homo sapiens
accttcaatgaaaataatagtc

SEQ ID NO: 7982287 - DNA, 22 bp, Homo sapiens
accttcaagtatgtgggctgaa

SEQ ID NO: 7982288 - DNA, 22 bp, Homo sapiens
acctgttttagtctttaatcat

SEQ ID NO: 7982289 - DNA, 22 bp, Homo sapiens
acctgtttgttaagaaagcttc

SEQ ID NO: 7982290 - DNA, 22 bp, Homo sapiens
acctgttttcctatctagattg

SEQ ID NO: 7982291 - DNA, 22 bp, Homo sapiens
acctgttttcctatctagattg

SEQ ID NO: 7982292 - DNA, 22 bp, Homo sapiens
acctgttttcagaaaatgcaga

SEQ ID NO: 7982293 - DNA, 22 bp, Homo sapiens
acctgtttggaggaggtgttag

SEQ ID NO: 7982294 - DNA, 22 bp, Homo sapiens
acctgtttctctctgagttact

SEQ ID NO: 7982295 - DNA, 22 bp, Homo sapiens
acctgtttgtgtccattagtga

SEQ ID NO: 7982296 - DNA, 22 bp, Homo sapiens
acctgtttgtgtttggactgca

SEQ ID NO: 7982297 - DNA, 22 bp, Homo sapiens
acctgtttacctgcacctgttt

SEQ ID NO: 7982298 - DNA, 22 bp, Homo sapiens
acctgtttagaaagcttatgag

SEQ ID NO: 7982299 - DNA, 22 bp, Homo sapiens
acctgtttagaaagcttatgag

SEQ ID NO: 7982300 - DNA, 22 bp, Homo sapiens
accttaaaggccgaagtaaaga

SEQ ID NO: 7982301 - DNA, 22 bp, Homo sapiens
accttaaaggccgaagtaaaga

SEQ ID NO: 7982302 - DNA, 22 bp, Homo sapiens
accttaaaggccgaagtaaaga

SEQ ID NO: 7982303 - DNA, 22 bp, Homo sapiens
accttaaatgtgacatagtcta

SEQ ID NO: 7982304 - DNA, 22 bp, Homo sapiens
accttaaaactgacacatggag

SEQ ID NO: 7982305 - DNA, 22 bp, Homo sapiens
accttaaaactgacacatggag

SEQ ID NO: 7982306 - DNA, 22 bp, Homo sapiens
accttaaactttacagccaagt

SEQ ID NO: 7982307 - DNA, 22 bp, Homo sapiens
accttaaaggccgaagtaaaga

SEQ ID NO: 7982308 - DNA, 22 bp, Homo sapiens
accttaaaactgacacatggag

SEQ ID NO: 7982309 - DNA, 22 bp, Homo sapiens
accttaaaggccgaagtaaaga

SEQ ID NO: 7982310 - DNA, 22 bp, Homo sapiens
accttaaactttacagccaagt

SEQ ID NO: 7982311 - DNA, 19 bp, Homo sapiens
accttacagaaacaggcat

SEQ ID NO: 7982312 - DNA, 22 bp, Homo sapiens
accttaaatgtgacatagtcta

SEQ ID NO: 7982313 - DNA, 22 bp, Homo sapiens
accttagaaaatcaaaattaga

SEQ ID NO: 7982314 - DNA, 22 bp, Homo sapiens
accttacatgcttttttcctca

SEQ ID NO: 7982315 - DNA, 22 bp, Homo sapiens
accttaagatcaaacattcttt

SEQ ID NO: 7982316 - DNA, 22 bp, Homo sapiens
accttagaaaatcaaaattaga

SEQ ID NO: 7982317 - DNA, 22 bp, Homo sapiens
accttagaaagtgacaaacgaa

SEQ ID NO: 7982318 - DNA, 22 bp, Homo sapiens
accttagaccagcaagatattt

SEQ ID NO: 7982319 - DNA, 21 bp, Homo sapiens
accttagagagaaagccatca

SEQ ID NO: 7982320 - DNA, 22 bp, Homo sapiens
actatataagattggcattttt

SEQ ID NO: 7982321 - DNA, 22 bp, Homo sapiens
actatataagattggcattttt

SEQ ID NO: 7982322 - DNA, 22 bp, Homo sapiens
actatatacacattatcttgtt

SEQ ID NO: 7982323 - DNA, 22 bp, Homo sapiens
actatatacacattatcttgtt

SEQ ID NO: 7982324 - DNA, 22 bp, Homo sapiens
actatagactgagtttgttcta

SEQ ID NO: 7982325 - DNA, 22 bp, Homo sapiens
actatagactgagtttgttcta

SEQ ID NO: 7982326 - DNA, 20 bp, Homo sapiens
actatagcatattcagaaag

SEQ ID NO: 7982327 - DNA, 22 bp, Homo sapiens
actatatgtgaaggtagaattt

SEQ ID NO: 7982328 - DNA, 22 bp, Homo sapiens
actatcttccttatgcctatca

SEQ ID NO: 7982329 - DNA, 22 bp, Homo sapiens
actatctcttttgtctgcagct

SEQ ID NO: 7982330 - DNA, 22 bp, Homo sapiens
actatatacacattatcttgtt

SEQ ID NO: 7982331 - DNA, 22 bp, Homo sapiens
actatatacacattatcttgtt

SEQ ID NO: 7982332 - DNA, 22 bp, Homo sapiens
actattagcatatcatgaatgg

SEQ ID NO: 7982333 - DNA, 22 bp, Homo sapiens
actatcttccttatgcctatca

SEQ ID NO: 7982334 - DNA, 22 bp, Homo sapiens
actatgaaagtataatattgaa

SEQ ID NO: 7982335 - DNA, 22 bp, Homo sapiens
actatgaatagccagatagtga

SEQ ID NO: 7982336 - DNA, 22 bp, Homo sapiens
actatgaatagccagatagtga

SEQ ID NO: 7982337 - DNA, 19 bp, Homo sapiens
actatgcatttatttgttt

SEQ ID NO: 7982338 - DNA, 22 bp, Homo sapiens
actatgaatccacattgatttt

SEQ ID NO: 7982339 - DNA, 22 bp, Homo sapiens
actaaatatttgagaggtgtag

SEQ ID NO: 7982340 - DNA, 18 bp, Homo sapiens
actagtgagcaagctagg

SEQ ID NO: 7982341 - DNA, 22 bp, Homo sapiens
actagtgtccttatataagagg

SEQ ID NO: 7982342 - DNA, 22 bp, Homo sapiens
actaaatagttttgacagaaca

SEQ ID NO: 7982343 - DNA, 22 bp, Homo sapiens
actaaatagttttgacagaaca

SEQ ID NO: 7982344 - DNA, 22 bp, Homo sapiens
actaaatagttttgacagaaca

SEQ ID NO: 7982345 - DNA, 22 bp, Homo sapiens
actagtttatgctcagatgtct

SEQ ID NO: 7982346 - DNA, 22 bp, Homo sapiens
actagtttatgctcagatgtct

SEQ ID NO: 7982347 - DNA, 22 bp, Homo sapiens
actagtgtccttatataagagg

SEQ ID NO: 7982348 - DNA, 22 bp, Homo sapiens
actagtttattacagttccact

SEQ ID NO: 7982349 - DNA, 22 bp, Homo sapiens
actagtttattacagttccact

SEQ ID NO: 7982350 - DNA, 22 bp, Homo sapiens
actagtttattacagttccact

SEQ ID NO: 7982351 - DNA, 22 bp, Homo sapiens
actaaatagttttgacagaaca

SEQ ID NO: 7982352 - DNA, 22 bp, Homo sapiens
actaaatagttttgacagaaca

SEQ ID NO: 7982353 - DNA, 22 bp, Homo sapiens
actaaatagcctctggtagttg

SEQ ID NO: 7982354 - DNA, 22 bp, Homo sapiens
actaaatacacacatttgttca

SEQ ID NO: 7982355 - DNA, 22 bp, Homo sapiens
actaaatacacacatttgttca

SEQ ID NO: 7982356 - DNA, 22 bp, Homo sapiens
actaaatacacacatttgttca

SEQ ID NO: 7982357 - DNA, 22 bp, Homo sapiens
actaaagtgttggagaatgagg

SEQ ID NO: 7982358 - DNA, 22 bp, Homo sapiens
actaaagtgttggagaatgagg

SEQ ID NO: 7982359 - DNA, 22 bp, Homo sapiens
actaaagtgttggagaatgagg

SEQ ID NO: 7982360 - DNA, 22 bp, Homo sapiens
actaaagttcacggtcagcttt

SEQ ID NO: 7982361 - DNA, 22 bp, Homo sapiens
actaaagtgcacccctttgaga

SEQ ID NO: 7982362 - DNA, 22 bp, Homo sapiens
actaaagtcatcaaagaacttt

SEQ ID NO: 7982363 - DNA, 22 bp, Homo sapiens
actaaagtcatcaaagaacttt

SEQ ID NO: 7982364 - DNA, 22 bp, Homo sapiens
actaaagtcatcaaagaacttt

SEQ ID NO: 7982365 - DNA, 22 bp, Homo sapiens
actcattgggaaagtgctctct

SEQ ID NO: 7982366 - DNA, 22 bp, Homo sapiens
actcatttaaacatttactgaa

SEQ ID NO: 7982367 - DNA, 22 bp, Homo sapiens
actcatgtcctaggagtaaagc

SEQ ID NO: 7982368 - DNA, 22 bp, Homo sapiens
actcattaaataggatgatttt

SEQ ID NO: 7982369 - DNA, 22 bp, Homo sapiens
actcattgaaacttaagatcta

SEQ ID NO: 7982370 - DNA, 22 bp, Homo sapiens
actcacaggactctgcatatag

SEQ ID NO: 7982371 - DNA, 19 bp, Homo sapiens
actcaggcttcctctgagg

SEQ ID NO: 7982372 - DNA, 19 bp, Homo sapiens
actcagggaaaggagaatt

SEQ ID NO: 7982373 - DNA, 19 bp, Homo sapiens
actcaggcttcctctgagg

SEQ ID NO: 7982374 - DNA, 18 bp, Homo sapiens
actcacagcagaagaagg

SEQ ID NO: 7982375 - DNA, 22 bp, Homo sapiens
actcacagcagactatgaggga

SEQ ID NO: 7982376 - DNA, 22 bp, Homo sapiens
actcacagactgcaggtttatt

SEQ ID NO: 7982377 - DNA, 22 bp, Homo sapiens
actcacagaataggcatgatgg

SEQ ID NO: 7982378 - DNA, 22 bp, Homo sapiens
actcacagactgcaggtttatt

SEQ ID NO: 7982379 - DNA, 22 bp, Homo sapiens
actcacagaataggcatgatgg

SEQ ID NO: 7982380 - DNA, 22 bp, Homo sapiens
actcacaagtgatgtgaatggc

SEQ ID NO: 7982381 - DNA, 22 bp, Homo sapiens
actcacagaataggcatgatgg

SEQ ID NO: 7982382 - DNA, 22 bp, Homo sapiens
actcacaagtgatgtgaatggc

SEQ ID NO: 7982383 - DNA, 23 bp, Homo sapiens
actcacaaagcaggatcatgttg

SEQ ID NO: 7982384 - DNA, 23 bp, Homo sapiens
actcacaaagcaggatcatgttg

SEQ ID NO: 7982385 - DNA, 22 bp, Homo sapiens
actcaatgttctcatagcacct

SEQ ID NO: 7982386 - DNA, 19 bp, Homo sapiens
actcaagtctaatgaaatc

SEQ ID NO: 7982387 - DNA, 18 bp, Homo sapiens
actcaagggtggagagaa

SEQ ID NO: 7982388 - DNA, 18 bp, Homo sapiens
actcaagggtggagagaa

SEQ ID NO: 7982389 - DNA, 22 bp, Homo sapiens
actcaagatagggaaagtacaa

SEQ ID NO: 7982390 - DNA, 22 bp, Homo sapiens
actcaacagggaacaagatcag

SEQ ID NO: 7982391 - DNA, 22 bp, Homo sapiens
actcaacagggaacaagatcag

SEQ ID NO: 7982392 - DNA, 22 bp, Homo sapiens
actcaacagggaacaagatcag

SEQ ID NO: 7982393 - DNA, 22 bp, Homo sapiens
actcaaatttgtcaactgaagc

SEQ ID NO: 7982394 - DNA, 22 bp, Homo sapiens
actcaaatttgtcaactgaagc

SEQ ID NO: 7982395 - DNA, 23 bp, Homo sapiens
actcaaatttcgcttggagttca

SEQ ID NO: 7982396 - DNA, 22 bp, Homo sapiens
actcaaatagctgcccctagtg

SEQ ID NO: 7982397 - DNA, 20 bp, Homo sapiens
actcaaatcacctgcctcaa

SEQ ID NO: 7982398 - DNA, 22 bp, Homo sapiens
actattcaggctccatctggta

SEQ ID NO: 7982399 - DNA, 22 bp, Homo sapiens
actattcacctttcatgcagga

SEQ ID NO: 7982400 - DNA, 22 bp, Homo sapiens
actattcaagtgctcattcaga

SEQ ID NO: 7982401 - DNA, 22 bp, Homo sapiens
actcaaatagcaacggtgagaa

SEQ ID NO: 7982402 - DNA, 23 bp, Homo sapiens
actcaaaatttggcatttgagga

SEQ ID NO: 7982403 - DNA, 23 bp, Homo sapiens
actcaaaatttggcatttgagga

SEQ ID NO: 7982404 - DNA, 22 bp, Homo sapiens
actcaaaagaccagagagctga

SEQ ID NO: 7982405 - DNA, 22 bp, Homo sapiens
actgcaacctccgcctgccagg

SEQ ID NO: 7982406 - DNA, 22 bp, Homo sapiens
actgcaacctccgcctgccagg

SEQ ID NO: 7982407 - DNA, 22 bp, Homo sapiens
actgcaacctccgcctgccagg

SEQ ID NO: 7982408 - DNA, 22 bp, Homo sapiens
actgcaacctccgcctgccagg

SEQ ID NO: 7982409 - DNA, 22 bp, Homo sapiens
actgcaacctccgcctgccagg

SEQ ID NO: 7982410 - DNA, 22 bp, Homo sapiens
actgcaacctccgcctgccagg

SEQ ID NO: 7982411 - DNA, 22 bp, Homo sapiens
actgcaacctccgcctgccagg

SEQ ID NO: 7982412 - DNA, 22 bp, Homo sapiens
actgcaacctccgcctgccagg

SEQ ID NO: 7982413 - DNA, 22 bp, Homo sapiens
actgcacaaggcctggacacac

SEQ ID NO: 7982414 - DNA, 22 bp, Homo sapiens
actgcaaggaggtggggtatca

SEQ ID NO: 7982415 - DNA, 22 bp, Homo sapiens
actgcacacacagaatttaggg

SEQ ID NO: 7982416 - DNA, 22 bp, Homo sapiens
actgcacacatgtttaagtgga

SEQ ID NO: 7982417 - DNA, 22 bp, Homo sapiens
actgcacagatgaagctgtaaa

SEQ ID NO: 7982418 - DNA, 22 bp, Homo sapiens
actgcctgtagctcttcatctc

SEQ ID NO: 7982419 - DNA, 23 bp, Homo sapiens
actgcctgtgccgatctctctca

SEQ ID NO: 7982420 - DNA, 22 bp, Homo sapiens
actgcctgtgcactggtctttt

SEQ ID NO: 7982421 - DNA, 22 bp, Homo sapiens
actgcacacctccagggcacta

SEQ ID NO: 7982422 - DNA, 22 bp, Homo sapiens
actgcacacctccagggcacta

SEQ ID NO: 7982423 - DNA, 22 bp, Homo sapiens
actgcacagaagaaactatcaa

SEQ ID NO: 7982424 - DNA, 22 bp, Homo sapiens
actgcaacctccacctcctggg

SEQ ID NO: 7982425 - DNA, 22 bp, Homo sapiens
actgcaacctccacctcctggg

SEQ ID NO: 7982426 - DNA, 22 bp, Homo sapiens
actgcaacctccacctcctggg

SEQ ID NO: 7982427 - DNA, 22 bp, Homo sapiens
actgcaacctccacctcctggg

SEQ ID NO: 7982428 - DNA, 22 bp, Homo sapiens
actgcaacctccacctcctggg

SEQ ID NO: 7982429 - DNA, 22 bp, Homo sapiens
actgcaacctccacctcctggg

SEQ ID NO: 7982430 - DNA, 22 bp, Homo sapiens
actgcaacctccacctcctggg

SEQ ID NO: 7982431 - DNA, 22 bp, Homo sapiens
actgcaacctccacctcctggg

SEQ ID NO: 7982432 - DNA, 22 bp, Homo sapiens
actgcaacctccacctcctggg

SEQ ID NO: 7982433 - DNA, 22 bp, Homo sapiens
actgcaacacctcctgggttca

SEQ ID NO: 7982434 - DNA, 22 bp, Homo sapiens
actgcaacacctcctgggttca

SEQ ID NO: 7982435 - DNA, 22 bp, Homo sapiens
actgcaacacctcctgggttca

SEQ ID NO: 7982436 - DNA, 22 bp, Homo sapiens
actgcaacacctcctgggttca

SEQ ID NO: 7982437 - DNA, 22 bp, Homo sapiens
actgcaacacctcctgggttca

SEQ ID NO: 7982438 - DNA, 22 bp, Homo sapiens
actgcaaagggaagccctttct

SEQ ID NO: 7982439 - DNA, 22 bp, Homo sapiens
actgcaaagggaagccctttct

SEQ ID NO: 7982440 - DNA, 22 bp, Homo sapiens
actgcaaagggaagccctttct

SEQ ID NO: 7982441 - DNA, 22 bp, Homo sapiens
actgcaaagggaagccctttct

SEQ ID NO: 7982442 - DNA, 22 bp, Homo sapiens
actgcaaagggaagccctttct

SEQ ID NO: 7982443 - DNA, 21 bp, Homo sapiens
actgcaaacagcagagactga

SEQ ID NO: 7982444 - DNA, 21 bp, Homo sapiens
actgcaaacagcagagactga

SEQ ID NO: 7982445 - DNA, 22 bp, Homo sapiens
actgatttggttagagggccag

SEQ ID NO: 7982446 - DNA, 22 bp, Homo sapiens
actgcaaaaatgggtgcattca

SEQ ID NO: 7982447 - DNA, 22 bp, Homo sapiens
actgatttttcaggagggcctt

SEQ ID NO: 7982448 - DNA, 22 bp, Homo sapiens
actgaattagggaacactgaac

SEQ ID NO: 7982449 - DNA, 22 bp, Homo sapiens
actgaattcctctttcttatcc

SEQ ID NO: 7982450 - DNA, 22 bp, Homo sapiens
actgagggtgcacaggcaggca

SEQ ID NO: 7982451 - DNA, 22 bp, Homo sapiens
actgaattagggaacactgaac

SEQ ID NO: 7982452 - DNA, 22 bp, Homo sapiens
actgaattacagtctgcatttt

SEQ ID NO: 7982453 - DNA, 21 bp, Homo sapiens
actgaatgtgtccaagctgag

SEQ ID NO: 7982454 - DNA, 22 bp, Homo sapiens
actgaatatattccattgcatg

SEQ ID NO: 7982455 - DNA, 22 bp, Homo sapiens
actgaatgaggggtgatctggg

SEQ ID NO: 7982456 - DNA, 22 bp, Homo sapiens
actgaatagtgctgcattgtac

SEQ ID NO: 7982457 - DNA, 22 bp, Homo sapiens
actgaagttcatacaacagact

SEQ ID NO: 7982458 - DNA, 22 bp, Homo sapiens
actgaagttcatacaacagact

SEQ ID NO: 7982459 - DNA, 22 bp, Homo sapiens
actgaagttcatacaacagact

SEQ ID NO: 7982460 - DNA, 22 bp, Homo sapiens
actgaataatggtctgtgatct

SEQ ID NO: 7982461 - DNA, 22 bp, Homo sapiens
actgaataaggtgaatgctctg

SEQ ID NO: 7982462 - DNA, 22 bp, Homo sapiens
actgaataatggtctgtgatct

SEQ ID NO: 7982463 - DNA, 22 bp, Homo sapiens
actgaatagaaatgctcatagg

SEQ ID NO: 7982464 - DNA, 22 bp, Homo sapiens
actgaatagaaatgctcatagg

SEQ ID NO: 7982465 - DNA, 22 bp, Homo sapiens
actgaatagcccttctgtctcc

SEQ ID NO: 7982466 - DNA, 22 bp, Homo sapiens
actgaagtccacacatgtagga

SEQ ID NO: 7982467 - DNA, 22 bp, Homo sapiens
actgaagtccacacatgtagga

SEQ ID NO: 7982468 - DNA, 22 bp, Homo sapiens
actgaagtccacacatgtagga

SEQ ID NO: 7982469 - DNA, 22 bp, Homo sapiens
actgaagtccacacatgtagga

SEQ ID NO: 7982470 - DNA, 22 bp, Homo sapiens
actgaaggtctcagcaaggatg

SEQ ID NO: 7982471 - DNA, 22 bp, Homo sapiens
actgatggcccaccttggtctc

SEQ ID NO: 7982472 - DNA, 22 bp, Homo sapiens
actgatgttaaccctctcttct

SEQ ID NO: 7982473 - DNA, 22 bp, Homo sapiens
actgatgttcagccatgttctg

SEQ ID NO: 7982474 - DNA, 23 bp, Homo sapiens
actgattaacatgtgtgatattc

SEQ ID NO: 7982475 - DNA, 22 bp, Homo sapiens
actgattacacgagttctgact

SEQ ID NO: 7982476 - DNA, 22 bp, Homo sapiens
actgattacacgagttctgact

SEQ ID NO: 7982477 - DNA, 22 bp, Homo sapiens
actgattgcattcatagggttt

SEQ ID NO: 7982478 - DNA, 22 bp, Homo sapiens
actgattgcattcatagggttt

SEQ ID NO: 7982479 - DNA, 22 bp, Homo sapiens
actgatttcagggatgagaaga

SEQ ID NO: 7982480 - DNA, 22 bp, Homo sapiens
actgatttcagggatgagaaga

SEQ ID NO: 7982481 - DNA, 22 bp, Homo sapiens
actgatttcagggatgagaaga

SEQ ID NO: 7982482 - DNA, 22 bp, Homo sapiens
actgatttcagggatgagaaga

SEQ ID NO: 7982483 - DNA, 22 bp, Homo sapiens
actgattcaagttatgcatctt

SEQ ID NO: 7982484 - DNA, 22 bp, Homo sapiens
actgattatgcgtactctctac

SEQ ID NO: 7982485 - DNA, 22 bp, Homo sapiens
actgatctgttttcagattctg

SEQ ID NO: 7982486 - DNA, 22 bp, Homo sapiens
actgatgaaaactaataaatta

SEQ ID NO: 7982487 - DNA, 22 bp, Homo sapiens
actgaggtaattgtgaggatta

SEQ ID NO: 7982488 - DNA, 22 bp, Homo sapiens
actgagggtttttatactcttt

SEQ ID NO: 7982489 - DNA, 22 bp, Homo sapiens
actgatcacatagatatattcc

SEQ ID NO: 7982490 - DNA, 22 bp, Homo sapiens
actgatggcccaccttggtctc

SEQ ID NO: 7982491 - DNA, 22 bp, Homo sapiens
actgatgagagttagtgctagt

SEQ ID NO: 7982492 - DNA, 22 bp, Homo sapiens
actgatgagtaggcagacaagg

SEQ ID NO: 7982493 - DNA, 22 bp, Homo sapiens
actgatgaaaggtaagactcca

SEQ ID NO: 7982494 - DNA, 22 bp, Homo sapiens
actgatgaagagtaccactgtt

SEQ ID NO: 7982495 - DNA, 22 bp, Homo sapiens
actgatgaagagtaccactgtt

SEQ ID NO: 7982496 - DNA, 22 bp, Homo sapiens
actgctttagacctagagctct

SEQ ID NO: 7982497 - DNA, 23 bp, Homo sapiens
agtggctgagagtgtttcatatg

SEQ ID NO: 7982498 - DNA, 22 bp, Homo sapiens
actgctttaaaaaagcaagctt

SEQ ID NO: 7982499 - DNA, 22 bp, Homo sapiens
actgcttctccaatgaattaga

SEQ ID NO: 7982500 - DNA, 22 bp, Homo sapiens
actgcttacttctagaactctt

SEQ ID NO: 7982501 - DNA, 22 bp, Homo sapiens
actgcttacttctagaactctt

SEQ ID NO: 7982502 - DNA, 22 bp, Homo sapiens
actgctgtgatctgatgtaatt

SEQ ID NO: 7982503 - DNA, 22 bp, Homo sapiens
actgcttacccggcctgacttc

SEQ ID NO: 7982504 - DNA, 22 bp, Homo sapiens
agtggctgatgtaggcagtggg

SEQ ID NO: 7982505 - DNA, 22 bp, Homo sapiens
agtggctgatgtaggcagtggg

SEQ ID NO: 7982506 - DNA, 22 bp, Homo sapiens
agtggctgattacaaactgagt

SEQ ID NO: 7982507 - DNA, 22 bp, Homo sapiens
agtggctgatgtaggcagtggg

SEQ ID NO: 7982508 - DNA, 22 bp, Homo sapiens
agtggctgatgtaggcagtggg

SEQ ID NO: 7982509 - DNA, 22 bp, Homo sapiens
agtggctgatgtaggcagtggg

SEQ ID NO: 7982510 - DNA, 22 bp, Homo sapiens
agtggctgatgtaggcagtggg

SEQ ID NO: 7982511 - DNA, 22 bp, Homo sapiens
agtggctgatgtaggcagtggg

SEQ ID NO: 7982512 - DNA, 22 bp, Homo sapiens
agtggctgagtgactgtgactc

SEQ ID NO: 7982513 - DNA, 20 bp, Homo sapiens
agtggctgatggaaagaagc

SEQ ID NO: 7982514 - DNA, 22 bp, Homo sapiens
agtggctgagtgactgtgactc

SEQ ID NO: 7982515 - DNA, 22 bp, Homo sapiens
agtggctgagtgactgtgactc

SEQ ID NO: 7982516 - DNA, 22 bp, Homo sapiens
agtggctgagtgactgtgactc

SEQ ID NO: 7982517 - DNA, 22 bp, Homo sapiens
agtggctgagtgactgtgactc

SEQ ID NO: 7982518 - DNA, 23 bp, Homo sapiens
agtggctgagagtgtttcatatg

SEQ ID NO: 7982519 - DNA, 22 bp, Homo sapiens
actgctattgatgtcacacttt

SEQ ID NO: 7982520 - DNA, 22 bp, Homo sapiens
actgctcaaggatctggtaggg

SEQ ID NO: 7982521 - DNA, 22 bp, Homo sapiens
actgctcaaggatctggtaggg

SEQ ID NO: 7982522 - DNA, 22 bp, Homo sapiens
actgctcaaggatctggtaggg

SEQ ID NO: 7982523 - DNA, 22 bp, Homo sapiens
actgctctctttgcaggggcta

SEQ ID NO: 7982524 - DNA, 22 bp, Homo sapiens
actgctccaccctggggcccag

SEQ ID NO: 7982525 - DNA, 22 bp, Homo sapiens
actgctctctttgcaggggcta

SEQ ID NO: 7982526 - DNA, 22 bp, Homo sapiens
actgctgactaaacagctccat

SEQ ID NO: 7982527 - DNA, 22 bp, Homo sapiens
actgctgagagcaatcccaaac

SEQ ID NO: 7982528 - DNA, 23 bp, Homo sapiens
actgctgtctttgaagtgcttga

SEQ ID NO: 7982529 - DNA, 23 bp, Homo sapiens
actgctgtctttgaagtgcttga

SEQ ID NO: 7982530 - DNA, 22 bp, Homo sapiens
actgctgtgatctgatgtaatt

SEQ ID NO: 7982531 - DNA, 20 bp, Homo sapiens
actgctgtagaccatctgca

SEQ ID NO: 7982532 - DNA, 22 bp, Homo sapiens
actgctggaaacccagaatggt

SEQ ID NO: 7982533 - DNA, 22 bp, Homo sapiens
actgctggaaacccagaatggt

SEQ ID NO: 7982534 - DNA, 22 bp, Homo sapiens
actgctgattttaggactgtta

SEQ ID NO: 7982535 - DNA, 22 bp, Homo sapiens
actgctgcaggtccagcccctt

SEQ ID NO: 7982536 - DNA, 22 bp, Homo sapiens
actgctgatttagctttgtggg

SEQ ID NO: 7982537 - DNA, 22 bp, Homo sapiens
actgctgattattgaagtagag

SEQ ID NO: 7982538 - DNA, 22 bp, Homo sapiens
actgctgatataagaaaagatt

SEQ ID NO: 7982539 - DNA, 22 bp, Homo sapiens
actgctgagcacacaagagtgt

SEQ ID NO: 7982540 - DNA, 22 bp, Homo sapiens
actgctgagcacacaagagtgt

SEQ ID NO: 7982541 - DNA, 22 bp, Homo sapiens
actggcagccacaactggcagg

SEQ ID NO: 7982542 - DNA, 22 bp, Homo sapiens
actggcagccacaactggcagg

SEQ ID NO: 7982543 - DNA, 22 bp, Homo sapiens
actggcagccacaactggcagg

SEQ ID NO: 7982544 - DNA, 22 bp, Homo sapiens
actggcagccacaactggcagg

SEQ ID NO: 7982545 - DNA, 22 bp, Homo sapiens
actggcagccacaactggcagg

SEQ ID NO: 7982546 - DNA, 22 bp, Homo sapiens
actggcagcagcagcccttggg

SEQ ID NO: 7982547 - DNA, 22 bp, Homo sapiens
actggcagcagcagcccttggg

SEQ ID NO: 7982548 - DNA, 22 bp, Homo sapiens
actggcagaggttggacaccat

SEQ ID NO: 7982549 - DNA, 22 bp, Homo sapiens
actggcagaggttggacaccat

SEQ ID NO: 7982550 - DNA, 22 bp, Homo sapiens
actggcagaggttggacaccat

SEQ ID NO: 7982551 - DNA, 22 bp, Homo sapiens
actggcagagggaaaaccattc

SEQ ID NO: 7982552 - DNA, 22 bp, Homo sapiens
actggcagaggatagcactaat

SEQ ID NO: 7982553 - DNA, 22 bp, Homo sapiens
actggcagaggatagcactaat

SEQ ID NO: 7982554 - DNA, 22 bp, Homo sapiens
actggcagaactggtgattgtc

SEQ ID NO: 7982555 - DNA, 22 bp, Homo sapiens
actggcagaacgtgatgcgggt

SEQ ID NO: 7982556 - DNA, 19 bp, Homo sapiens
actggcaaaaaaggttaat

SEQ ID NO: 7982557 - DNA, 22 bp, Homo sapiens
actggcagagaccctgatggcc

SEQ ID NO: 7982558 - DNA, 22 bp, Homo sapiens
actggcagaattgaatagttgt

SEQ ID NO: 7982559 - DNA, 22 bp, Homo sapiens
actggcagagaccctgatggcc

SEQ ID NO: 7982560 - DNA, 22 bp, Homo sapiens
actggcagagaccctgatggcc

SEQ ID NO: 7982561 - DNA, 22 bp, Homo sapiens
actggcagaattgaatagttgt

SEQ ID NO: 7982562 - DNA, 22 bp, Homo sapiens
agtggctgctggagtggagatg

SEQ ID NO: 7982563 - DNA, 22 bp, Homo sapiens
agtggctgctggagtggagatg

SEQ ID NO: 7982564 - DNA, 22 bp, Homo sapiens
agtggctgctgactttaataca

SEQ ID NO: 7982565 - DNA, 22 bp, Homo sapiens
agtggctgctgactttaataca

SEQ ID NO: 7982566 - DNA, 22 bp, Homo sapiens
agtggctgctggagtggagatg

SEQ ID NO: 7982567 - DNA, 22 bp, Homo sapiens
agtggctgctggagtggagatg

SEQ ID NO: 7982568 - DNA, 22 bp, Homo sapiens
agtggctgccaagagcaatgct

SEQ ID NO: 7982569 - DNA, 22 bp, Homo sapiens
agtggctgccaagatataattc

SEQ ID NO: 7982570 - DNA, 22 bp, Homo sapiens
agtggctgctatgatcaggaca

SEQ ID NO: 7982571 - DNA, 22 bp, Homo sapiens
agtggctgctatgatcaggaca

SEQ ID NO: 7982572 - DNA, 22 bp, Homo sapiens
agtggctgctatgatcaggaca

SEQ ID NO: 7982573 - DNA, 22 bp, Homo sapiens
actggattctcttacacagatg

SEQ ID NO: 7982574 - DNA, 22 bp, Homo sapiens
actggattctcttacacagatg

SEQ ID NO: 7982575 - DNA, 22 bp, Homo sapiens
actggattgggaaagtacttca

SEQ ID NO: 7982576 - DNA, 19 bp, Homo sapiens
actggcaaaaaaggttaat

SEQ ID NO: 7982577 - DNA, 22 bp, Homo sapiens
actggattgggaaagtacttca

SEQ ID NO: 7982578 - DNA, 22 bp, Homo sapiens
actggatggtgtcatgagcagc

SEQ ID NO: 7982579 - DNA, 22 bp, Homo sapiens
actggatggtgtcatgagcagc

SEQ ID NO: 7982580 - DNA, 22 bp, Homo sapiens
actggattccattgtgcaaaga

SEQ ID NO: 7982581 - DNA, 20 bp, Homo sapiens
actggatctggctggagctg

SEQ ID NO: 7982582 - DNA, 22 bp, Homo sapiens
actggatctaattggttatagt

SEQ ID NO: 7982583 - DNA, 22 bp, Homo sapiens
actggatgaggggaaagagaca

SEQ ID NO: 7982584 - DNA, 22 bp, Homo sapiens
actggatgaggggaaagagaca

SEQ ID NO: 7982585 - DNA, 22 bp, Homo sapiens
actggataggcgtcccgagagg

SEQ ID NO: 7982586 - DNA, 22 bp, Homo sapiens
actggatcagaatctgattttt

SEQ ID NO: 7982587 - DNA, 22 bp, Homo sapiens
agtggctggaattgcaggtgcg

SEQ ID NO: 7982588 - DNA, 22 bp, Homo sapiens
agtggctgcttctggttgctcc

SEQ ID NO: 7982589 - DNA, 22 bp, Homo sapiens
agtggctgcttctggttgctcc

SEQ ID NO: 7982590 - DNA, 22 bp, Homo sapiens
actggacagaggaaatatggag

SEQ ID NO: 7982591 - DNA, 22 bp, Homo sapiens
agtctgggagggatgccagtgt

SEQ ID NO: 7982592 - DNA, 22 bp, Homo sapiens
agtctgggagggatgccagtgt

SEQ ID NO: 7982593 - DNA, 22 bp, Homo sapiens
agtctgggcatttaggatgttg

SEQ ID NO: 7982594 - DNA, 22 bp, Homo sapiens
agtctgggagggatgccagtgt

SEQ ID NO: 7982595 - DNA, 22 bp, Homo sapiens
agtctgggctgtctgcaggagt

SEQ ID NO: 7982596 - DNA, 22 bp, Homo sapiens
agtctgggctgtctgcaggagt

SEQ ID NO: 7982597 - DNA, 22 bp, Homo sapiens
agtctgggctgtctgcaggagt

SEQ ID NO: 7982598 - DNA, 22 bp, Homo sapiens
agtctgggcatttaggatgttg

SEQ ID NO: 7982599 - DNA, 21 bp, Homo sapiens
agtctggggaagggatcccag

SEQ ID NO: 7982600 - DNA, 21 bp, Homo sapiens
agtctggggaagggatcccag

SEQ ID NO: 7982601 - DNA, 22 bp, Homo sapiens
agtctggggtctggtagaacga

SEQ ID NO: 7982602 - DNA, 22 bp, Homo sapiens
agtctggggtctggtagaacga

SEQ ID NO: 7982603 - DNA, 22 bp, Homo sapiens
agtctgggctgtctgcaggagt

SEQ ID NO: 7982604 - DNA, 22 bp, Homo sapiens
agtctgggctgtctgcaggagt

SEQ ID NO: 7982605 - DNA, 22 bp, Homo sapiens
agtctgggctgtctgcaggagt

SEQ ID NO: 7982606 - DNA, 22 bp, Homo sapiens
agtctgggtggctgagctacag

SEQ ID NO: 7982607 - DNA, 22 bp, Homo sapiens
agtctgggtggctgagctacag

SEQ ID NO: 7982608 - DNA, 22 bp, Homo sapiens
agtctgggtggctgagctacag

SEQ ID NO: 7982609 - DNA, 22 bp, Homo sapiens
agtctggggtctggtagaacga

SEQ ID NO: 7982610 - DNA, 22 bp, Homo sapiens
agtctggggtctggtagaacga

SEQ ID NO: 7982611 - DNA, 22 bp, Homo sapiens
agtctgggtgtgaatgaacttg

SEQ ID NO: 7982612 - DNA, 22 bp, Homo sapiens
agtctgggtgtgaatgaacttg

SEQ ID NO: 7982613 - DNA, 22 bp, Homo sapiens
agtctgggtgtgaatgaacttg

SEQ ID NO: 7982614 - DNA, 22 bp, Homo sapiens
agtctggtaatgtagctcaacc

SEQ ID NO: 7982615 - DNA, 22 bp, Homo sapiens
agtctggtaaactgaaaaatat

SEQ ID NO: 7982616 - DNA, 22 bp, Homo sapiens
agtctgggtgtgaatgaacttg

SEQ ID NO: 7982617 - DNA, 22 bp, Homo sapiens
agtctggtggtattttgtagtg

SEQ ID NO: 7982618 - DNA, 19 bp, Homo sapiens
agtctggtggcgtgcatgt

SEQ ID NO: 7982619 - DNA, 22 bp, Homo sapiens
agtctggtgctcgctctgcttc

SEQ ID NO: 7982620 - DNA, 22 bp, Homo sapiens
agtctggtgagaacataaatag

SEQ ID NO: 7982621 - DNA, 22 bp, Homo sapiens
agtctggtctgttcatgggtca

SEQ ID NO: 7982622 - DNA, 22 bp, Homo sapiens
agtctggtcatctgattctttt

SEQ ID NO: 7982623 - DNA, 22 bp, Homo sapiens
agtctggtattggtctttaatc

SEQ ID NO: 7982624 - DNA, 22 bp, Homo sapiens
agtctggtagaggaagaggcct

SEQ ID NO: 7982625 - DNA, 22 bp, Homo sapiens
agtctggtgttctcacactagt

SEQ ID NO: 7982626 - DNA, 22 bp, Homo sapiens
agtctggtgtatgaaagtgaat

SEQ ID NO: 7982627 - DNA, 22 bp, Homo sapiens
actcttcatacagtcatctaat

SEQ ID NO: 7982628 - DNA, 22 bp, Homo sapiens
actcttcatgctatgctcaact

SEQ ID NO: 7982629 - DNA, 22 bp, Homo sapiens
actcttcatccctttatcagga

SEQ ID NO: 7982630 - DNA, 22 bp, Homo sapiens
actcttcagtacaataatatct

SEQ ID NO: 7982631 - DNA, 22 bp, Homo sapiens
agtctcttgcacattgtattaa

SEQ ID NO: 7982632 - DNA, 22 bp, Homo sapiens
agtctggatttagaggtgggcc

SEQ ID NO: 7982633 - DNA, 22 bp, Homo sapiens
agtctcttcctcatgcatatgt

SEQ ID NO: 7982634 - DNA, 22 bp, Homo sapiens
agtctcttccttcaaggctggt

SEQ ID NO: 7982635 - DNA, 22 bp, Homo sapiens
agtctcttattccctattgctg

SEQ ID NO: 7982636 - DNA, 22 bp, Homo sapiens
agtctcttaattttttctaagt

SEQ ID NO: 7982637 - DNA, 17 bp, Homo sapiens
agtctgggacctgcgtg

SEQ ID NO: 7982638 - DNA, 22 bp, Homo sapiens
agtctggctttttgatgagctt

SEQ ID NO: 7982639 - DNA, 20 bp, Homo sapiens
agtctggcacctattcctgt

SEQ ID NO: 7982640 - DNA, 22 bp, Homo sapiens
agtctgggaactgggaacgttt

SEQ ID NO: 7982641 - DNA, 22 bp, Homo sapiens
agtctggccttgccttgtcgag

SEQ ID NO: 7982642 - DNA, 22 bp, Homo sapiens
agtctggctttttgatgagctt

SEQ ID NO: 7982643 - DNA, 20 bp, Homo sapiens
agtctggcatgatgcaggca

SEQ ID NO: 7982644 - DNA, 20 bp, Homo sapiens
agtctggcacctattcctgt

SEQ ID NO: 7982645 - DNA, 22 bp, Homo sapiens
agtctgggagaaggtgagatta

SEQ ID NO: 7982646 - DNA, 22 bp, Homo sapiens
agtctgggagaaggtgagatta

SEQ ID NO: 7982647 - DNA, 22 bp, Homo sapiens
agtctgggagaaggtgagatta

SEQ ID NO: 7982648 - DNA, 17 bp, Homo sapiens
agtctgggacctgcgtg

SEQ ID NO: 7982649 - DNA, 17 bp, Homo sapiens
agtctgggacctgcgtg

SEQ ID NO: 7982650 - DNA, 22 bp, Homo sapiens
agtctgggagaaggtgagatta

SEQ ID NO: 7982651 - DNA, 22 bp, Homo sapiens
actgaaatgaaatctatcatct

SEQ ID NO: 7982652 - DNA, 22 bp, Homo sapiens
actgaaatgaaatctatcatct

SEQ ID NO: 7982653 - DNA, 22 bp, Homo sapiens
actgaaatggggacagtcctta

SEQ ID NO: 7982654 - DNA, 22 bp, Homo sapiens
actgaaatatttagaagtgaag

SEQ ID NO: 7982655 - DNA, 22 bp, Homo sapiens
actgaacaccatttataacatt

SEQ ID NO: 7982656 - DNA, 22 bp, Homo sapiens
actgaacaccatttataacatt

SEQ ID NO: 7982657 - DNA, 22 bp, Homo sapiens
actgaacacttttgaaagatta

SEQ ID NO: 7982658 - DNA, 22 bp, Homo sapiens
actgaacaccatttataacatt

SEQ ID NO: 7982659 - DNA, 22 bp, Homo sapiens
actgaacagcctgaggagtcac

SEQ ID NO: 7982660 - DNA, 22 bp, Homo sapiens
actgaaagtccagcatggtaca

SEQ ID NO: 7982661 - DNA, 22 bp, Homo sapiens
actgaaagtccagcatggtaca

SEQ ID NO: 7982662 - DNA, 22 bp, Homo sapiens
actgaaatactgctcttggatt

SEQ ID NO: 7982663 - DNA, 22 bp, Homo sapiens
actgaaatactgctcttggatt

SEQ ID NO: 7982664 - DNA, 22 bp, Homo sapiens
actgaaatactgctcttggatt

SEQ ID NO: 7982665 - DNA, 23 bp, Homo sapiens
actgaaaggatcctagcagagac

SEQ ID NO: 7982666 - DNA, 22 bp, Homo sapiens
actcttcatgctatgctcaact

SEQ ID NO: 7982667 - DNA, 22 bp, Homo sapiens
actcttcatgctatgctcaact

SEQ ID NO: 7982668 - DNA, 22 bp, Homo sapiens
actcttcattcaagtatgcaaa

SEQ ID NO: 7982669 - DNA, 22 bp, Homo sapiens
actcttcattcaagtatgcaaa

SEQ ID NO: 7982670 - DNA, 22 bp, Homo sapiens
actcttcattcaagtatgcaaa

SEQ ID NO: 7982671 - DNA, 22 bp, Homo sapiens
actcttcattcaagtatgcaaa

SEQ ID NO: 7982672 - DNA, 22 bp, Homo sapiens
actgaaaatgaattagaaacag

SEQ ID NO: 7982673 - DNA, 22 bp, Homo sapiens
actgaaaatgaattagaaacag

SEQ ID NO: 7982674 - DNA, 22 bp, Homo sapiens
actgaacatatgcaagaccatt

SEQ ID NO: 7982675 - DNA, 22 bp, Homo sapiens
actgaagaacgcatcagtggtt

SEQ ID NO: 7982676 - DNA, 22 bp, Homo sapiens
actgaagaacgcatcagtggtt

SEQ ID NO: 7982677 - DNA, 18 bp, Homo sapiens
actgaagatgcaagacct

SEQ ID NO: 7982678 - DNA, 18 bp, Homo sapiens
actgaagatgcaagacct

SEQ ID NO: 7982679 - DNA, 22 bp, Homo sapiens
actgaagagcgtgctatgctca

SEQ ID NO: 7982680 - DNA, 22 bp, Homo sapiens
actgaagagaagcattttctgc

SEQ ID NO: 7982681 - DNA, 22 bp, Homo sapiens
actgaagacctcctgtcagcgg

SEQ ID NO: 7982682 - DNA, 22 bp, Homo sapiens
actgaagacctcctgtcagcgg

SEQ ID NO: 7982683 - DNA, 22 bp, Homo sapiens
actgaagacctcctgtcagcgg

SEQ ID NO: 7982684 - DNA, 22 bp, Homo sapiens
actgaagggtaatgtgggagcc

SEQ ID NO: 7982685 - DNA, 22 bp, Homo sapiens
actgaaggtctcagcaaggatg

SEQ ID NO: 7982686 - DNA, 22 bp, Homo sapiens
actgaagggtaatgtgggagcc

SEQ ID NO: 7982687 - DNA, 22 bp, Homo sapiens
actgaaggcttaactctttcat

SEQ ID NO: 7982688 - DNA, 22 bp, Homo sapiens
actgaaggctttcccaaggtca

SEQ ID NO: 7982689 - DNA, 22 bp, Homo sapiens
actgaaggctttcccaaggtca

SEQ ID NO: 7982690 - DNA, 22 bp, Homo sapiens
actgaaggctttcccaaggtca

SEQ ID NO: 7982691 - DNA, 22 bp, Homo sapiens
actgaaggaaagcctttgcatg

SEQ ID NO: 7982692 - DNA, 22 bp, Homo sapiens
actgaaggaagcgggcaggggt

SEQ ID NO: 7982693 - DNA, 22 bp, Homo sapiens
actgaaggaagcgggcaggggt

SEQ ID NO: 7982694 - DNA, 22 bp, Homo sapiens
actgaaggaagcgggcaggggt

SEQ ID NO: 7982695 - DNA, 22 bp, Homo sapiens
actgaaggaaacttttgtgttt

SEQ ID NO: 7982696 - DNA, 22 bp, Homo sapiens
actgaaggaaacttttgtgttt

SEQ ID NO: 7982697 - DNA, 22 bp, Homo sapiens
actgaaggaaagcctttgcatg

SEQ ID NO: 7982698 - DNA, 22 bp, Homo sapiens
actgaaggaaacttttgtgttt

SEQ ID NO: 7982699 - DNA, 22 bp, Homo sapiens
actgaagctgggcgatgcctcc

SEQ ID NO: 7982700 - DNA, 22 bp, Homo sapiens
actgaagctgggcgatgcctcc

SEQ ID NO: 7982701 - DNA, 22 bp, Homo sapiens
actgaagccagagggaggacat

SEQ ID NO: 7982702 - DNA, 22 bp, Homo sapiens
actgaagccagagggaggacat

SEQ ID NO: 7982703 - DNA, 22 bp, Homo sapiens
actgaagcttgggtggaactta

SEQ ID NO: 7982704 - DNA, 22 bp, Homo sapiens
actgaagcttgggtggaactta

SEQ ID NO: 7982705 - DNA, 22 bp, Homo sapiens
actgaaggaaacttttgtgttt

SEQ ID NO: 7982706 - DNA, 19 bp, Homo sapiens
actgaagcagggactgaaa

SEQ ID NO: 7982707 - DNA, 19 bp, Homo sapiens
actgaagcagggactgaaa

SEQ ID NO: 7982708 - DNA, 23 bp, Homo sapiens
actgaagatgtcttagtggccct

SEQ ID NO: 7982709 - DNA, 22 bp, Homo sapiens
actgaagcacatttgccatgaa

SEQ ID NO: 7982710 - DNA, 22 bp, Homo sapiens
actccagggctccaccccagat

SEQ ID NO: 7982711 - DNA, 22 bp, Homo sapiens
actccagggctccaccccagat

SEQ ID NO: 7982712 - DNA, 22 bp, Homo sapiens
actccagggctccaccccagat

SEQ ID NO: 7982713 - DNA, 19 bp, Homo sapiens
actccagggatgacagaag

SEQ ID NO: 7982714 - DNA, 19 bp, Homo sapiens
actccagggatgacagaag

SEQ ID NO: 7982715 - DNA, 19 bp, Homo sapiens
actccagggatgacagaag

SEQ ID NO: 7982716 - DNA, 22 bp, Homo sapiens
actccagggaggtgagtgtgcg

SEQ ID NO: 7982717 - DNA, 22 bp, Homo sapiens
actccaggcatctgcttctgct

SEQ ID NO: 7982718 - DNA, 22 bp, Homo sapiens
actccaggcatctgcttctgct

SEQ ID NO: 7982719 - DNA, 22 bp, Homo sapiens
actccagggaggtgagtgtgcg

SEQ ID NO: 7982720 - DNA, 22 bp, Homo sapiens
actccaggcatctgcttctgct

SEQ ID NO: 7982721 - DNA, 22 bp, Homo sapiens
actccaggcatctgcttctgct

SEQ ID NO: 7982722 - DNA, 22 bp, Homo sapiens
actccaggatgtagaatcagag

SEQ ID NO: 7982723 - DNA, 22 bp, Homo sapiens
actccaggatgtagaatcagag

SEQ ID NO: 7982724 - DNA, 22 bp, Homo sapiens
actccaggaaacttaggggaaa

SEQ ID NO: 7982725 - DNA, 22 bp, Homo sapiens
actccagacacagacactatga

SEQ ID NO: 7982726 - DNA, 22 bp, Homo sapiens
actccagagctcacatgtctaa

SEQ ID NO: 7982727 - DNA, 22 bp, Homo sapiens
actccagagctcacatgtctaa

SEQ ID NO: 7982728 - DNA, 22 bp, Homo sapiens
actccagaggcagctgtgctga

SEQ ID NO: 7982729 - DNA, 22 bp, Homo sapiens
actccagaggcagctgtgctga

SEQ ID NO: 7982730 - DNA, 22 bp, Homo sapiens
actccagatgataagggacagt

SEQ ID NO: 7982731 - DNA, 22 bp, Homo sapiens
actccagatgataagggacagt

SEQ ID NO: 7982732 - DNA, 22 bp, Homo sapiens
actccagatgataagggacagt

SEQ ID NO: 7982733 - DNA, 22 bp, Homo sapiens
actccagatgataagggacagt

SEQ ID NO: 7982734 - DNA, 22 bp, Homo sapiens
actcattttataacactgtagt

SEQ ID NO: 7982735 - DNA, 22 bp, Homo sapiens
actcatttgcatgatgtgctat

SEQ ID NO: 7982736 - DNA, 22 bp, Homo sapiens
actcatttgacactttaaactg

SEQ ID NO: 7982737 - DNA, 21 bp, Homo sapiens
actcatttgtctgcatctaat

SEQ ID NO: 7982738 - DNA, 21 bp, Homo sapiens
actcatttgtctgcatctaat

SEQ ID NO: 7982739 - DNA, 22 bp, Homo sapiens
actcattttataacactgtagt

SEQ ID NO: 7982740 - DNA, 22 bp, Homo sapiens
actcattttataacactgtagt

SEQ ID NO: 7982741 - DNA, 22 bp, Homo sapiens
actcatttttactgcaattgag

SEQ ID NO: 7982742 - DNA, 22 bp, Homo sapiens
actccaaaacctgcggcttggt

SEQ ID NO: 7982743 - DNA, 21 bp, Homo sapiens
actccaaacaagttaagctgt

SEQ ID NO: 7982744 - DNA, 22 bp, Homo sapiens
actcatttaaacatttactgaa

SEQ ID NO: 7982745 - DNA, 22 bp, Homo sapiens
actcatttgacactttaaactg

SEQ ID NO: 7982746 - DNA, 22 bp, Homo sapiens
actcatttgacactttaaactg

SEQ ID NO: 7982747 - DNA, 22 bp, Homo sapiens
actcatttgcatgatgtgctat

SEQ ID NO: 7982748 - DNA, 22 bp, Homo sapiens
actcatttttactgcaattgag

SEQ ID NO: 7982749 - DNA, 22 bp, Homo sapiens
actccaaggccacatgcattcc

SEQ ID NO: 7982750 - DNA, 22 bp, Homo sapiens
actccacaccacgggggccgcc

SEQ ID NO: 7982751 - DNA, 22 bp, Homo sapiens
actccaaggccacatgcattcc

SEQ ID NO: 7982752 - DNA, 22 bp, Homo sapiens
actccacaccacgggggccgcc

SEQ ID NO: 7982753 - DNA, 22 bp, Homo sapiens
actccacaccacgggggccgcc

SEQ ID NO: 7982754 - DNA, 22 bp, Homo sapiens
actccacaccacgggggccgcc

SEQ ID NO: 7982755 - DNA, 22 bp, Homo sapiens
actccacaccacgggggccgcc

SEQ ID NO: 7982756 - DNA, 22 bp, Homo sapiens
actccacaccacgggggccgcc

SEQ ID NO: 7982757 - DNA, 22 bp, Homo sapiens
actccacaccacgggggccgcc

SEQ ID NO: 7982758 - DNA, 22 bp, Homo sapiens
actccacatttgaacacagttc

SEQ ID NO: 7982759 - DNA, 22 bp, Homo sapiens
actccacatttgaacacagttc

SEQ ID NO: 7982760 - DNA, 22 bp, Homo sapiens
actccacatttgaacacagttc

SEQ ID NO: 7982761 - DNA, 22 bp, Homo sapiens
actccagaatcctagggtcagc

SEQ ID NO: 7982762 - DNA, 22 bp, Homo sapiens
actccagaatcctagggtcagc

SEQ ID NO: 7982763 - DNA, 22 bp, Homo sapiens
actccagaatcctagggtcagc

SEQ ID NO: 7982764 - DNA, 22 bp, Homo sapiens
actccagaatcctagggtcagc

SEQ ID NO: 7982765 - DNA, 22 bp, Homo sapiens
actccagggctgaacgaggccc

SEQ ID NO: 7982766 - DNA, 22 bp, Homo sapiens
actccagggctgaacgaggccc

SEQ ID NO: 7982767 - DNA, 22 bp, Homo sapiens
actccagggctgaacgaggccc

SEQ ID NO: 7982768 - DNA, 22 bp, Homo sapiens
actccaggggttgctatttaca

SEQ ID NO: 7982769 - DNA, 22 bp, Homo sapiens
actccaggggttgctatttaca

SEQ ID NO: 7982770 - DNA, 22 bp, Homo sapiens
actccaggggttgctatttaca

SEQ ID NO: 7982771 - DNA, 22 bp, Homo sapiens
actccagggcttctatgatggt

SEQ ID NO: 7982772 - DNA, 22 bp, Homo sapiens
actccagggctccatcccttgt

SEQ ID NO: 7982773 - DNA, 22 bp, Homo sapiens
actccagggctccatcccttgt

SEQ ID NO: 7982774 - DNA, 22 bp, Homo sapiens
actccagggctccaccccagat

SEQ ID NO: 7982775 - DNA, 22 bp, Homo sapiens
actccagggctccatcccttgt

SEQ ID NO: 7982776 - DNA, 20 bp, Homo sapiens
agtctctgcaacatagtgca

SEQ ID NO: 7982777 - DNA, 22 bp, Homo sapiens
agtctctgaggttcagatgcct

SEQ ID NO: 7982778 - DNA, 22 bp, Homo sapiens
agtctctgaggttcagatgcct

SEQ ID NO: 7982779 - DNA, 19 bp, Homo sapiens
agtctctgaggcctaagtt

SEQ ID NO: 7982780 - DNA, 22 bp, Homo sapiens
agtctctcttgggtgtggtttg

SEQ ID NO: 7982781 - DNA, 22 bp, Homo sapiens
agtctctcttgggtgtggtttg

SEQ ID NO: 7982782 - DNA, 22 bp, Homo sapiens
agtctctgaggttcagatgcct

SEQ ID NO: 7982783 - DNA, 22 bp, Homo sapiens
agtctacaaatcaccttgtcct

SEQ ID NO: 7982784 - DNA, 22 bp, Homo sapiens
agtctctctcctcgtggtaacc

SEQ ID NO: 7982785 - DNA, 22 bp, Homo sapiens
agtctctcttgggtgtggtttg

SEQ ID NO: 7982786 - DNA, 22 bp, Homo sapiens
agtctacaacgcaagcaacatg

SEQ ID NO: 7982787 - DNA, 23 bp, Homo sapiens
agtcctttttataaaattgagga

SEQ ID NO: 7982788 - DNA, 22 bp, Homo sapiens
agtcgcagacatggtccccttt

SEQ ID NO: 7982789 - DNA, 22 bp, Homo sapiens
agtctaatgtttgtaaaatcat

SEQ ID NO: 7982790 - DNA, 22 bp, Homo sapiens
agtctacaaagaaaagttattg

SEQ ID NO: 7982791 - DNA, 22 bp, Homo sapiens
agtctcttaaagacagtgttga

SEQ ID NO: 7982792 - DNA, 22 bp, Homo sapiens
agtctctgttccagggcttcag

SEQ ID NO: 7982793 - DNA, 22 bp, Homo sapiens
agtctctgggcatggttgtgac

SEQ ID NO: 7982794 - DNA, 22 bp, Homo sapiens
agtctctggggaggagtggaaa

SEQ ID NO: 7982795 - DNA, 22 bp, Homo sapiens
agtctctggggaggagtggaaa

SEQ ID NO: 7982796 - DNA, 20 bp, Homo sapiens
agtctctgtagtgcctgaga

SEQ ID NO: 7982797 - DNA, 20 bp, Homo sapiens
agtctctgtagtgcctgaga

SEQ ID NO: 7982798 - DNA, 22 bp, Homo sapiens
agtctctgcatgcctgctgtgc

SEQ ID NO: 7982799 - DNA, 22 bp, Homo sapiens
agtctctgcatgatgcagcaca

SEQ ID NO: 7982800 - DNA, 22 bp, Homo sapiens
agtctctgcatgatgcagcaca

SEQ ID NO: 7982801 - DNA, 22 bp, Homo sapiens
agtctctgcatgatgcagcaca

SEQ ID NO: 7982802 - DNA, 22 bp, Homo sapiens
agtctctgccagcttgtcctct

SEQ ID NO: 7982803 - DNA, 22 bp, Homo sapiens
agtctctggactgggagatggc

SEQ ID NO: 7982804 - DNA, 22 bp, Homo sapiens
agtctctggactgggagatggc

SEQ ID NO: 7982805 - DNA, 22 bp, Homo sapiens
agtctctggactgggagatggc

SEQ ID NO: 7982806 - DNA, 22 bp, Homo sapiens
agaaaataaattgatggtggaa

SEQ ID NO: 7982807 - DNA, 22 bp, Homo sapiens
agaaaataaattgatggtggaa

SEQ ID NO: 7982808 - DNA, 22 bp, Homo sapiens
agaaaataaattgatggtggaa

SEQ ID NO: 7982809 - DNA, 22 bp, Homo sapiens
agaaaataaattgatggtggaa

SEQ ID NO: 7982810 - DNA, 22 bp, Homo sapiens
agaaaataaattgatggtggaa

SEQ ID NO: 7982811 - DNA, 22 bp, Homo sapiens
agaaaataaattgatggtggaa

SEQ ID NO: 7982812 - DNA, 22 bp, Homo sapiens
agaaaattagattttactgtgt

SEQ ID NO: 7982813 - DNA, 22 bp, Homo sapiens
agaaaattagattttactgtgt

SEQ ID NO: 7982814 - DNA, 22 bp, Homo sapiens
agaaaattagattttactgtgt

SEQ ID NO: 7982815 - DNA, 22 bp, Homo sapiens
agaaaattagattttactgtgt

SEQ ID NO: 7982816 - DNA, 22 bp, Homo sapiens
agaaaattagattttactgtgt

SEQ ID NO: 7982817 - DNA, 22 bp, Homo sapiens
agaaaatttaaagagacacaca

SEQ ID NO: 7982818 - DNA, 22 bp, Homo sapiens
agaaaatttaaagagacacaca

SEQ ID NO: 7982819 - DNA, 22 bp, Homo sapiens
atatctttcaaagccaaaagta

SEQ ID NO: 7982820 - DNA, 22 bp, Homo sapiens
atatctttgtatggttcagcag

SEQ ID NO: 7982821 - DNA, 22 bp, Homo sapiens
atatctttgtttttgccaagat

SEQ ID NO: 7982822 - DNA, 22 bp, Homo sapiens
atatcttttagagcaagcttgt

SEQ ID NO: 7982823 - DNA, 22 bp, Homo sapiens
atatcttttagagcaagcttgt

SEQ ID NO: 7982824 - DNA, 22 bp, Homo sapiens
atatgaaaatgttttagctgta

SEQ ID NO: 7982825 - DNA, 22 bp, Homo sapiens
atatcttttagagcaagcttgt

SEQ ID NO: 7982826 - DNA, 22 bp, Homo sapiens
agaaaatttaaagagacacaca

SEQ ID NO: 7982827 - DNA, 22 bp, Homo sapiens
agaaaatttaaagagacacaca

SEQ ID NO: 7982828 - DNA, 22 bp, Homo sapiens
agaaaatttaaagagacacaca

SEQ ID NO: 7982829 - DNA, 22 bp, Homo sapiens
agaaaatttattcatgttagtt

SEQ ID NO: 7982830 - DNA, 22 bp, Homo sapiens
agaaaatttattcatgttagtt

SEQ ID NO: 7982831 - DNA, 22 bp, Homo sapiens
agaaacagaaccaggtgtcatt

SEQ ID NO: 7982832 - DNA, 22 bp, Homo sapiens
agaaacagaaccaggtgtcatt

SEQ ID NO: 7982833 - DNA, 22 bp, Homo sapiens
agaaacagaaccaggtgtcatt

SEQ ID NO: 7982834 - DNA, 22 bp, Homo sapiens
agaaacaacttgtttctcttgc

SEQ ID NO: 7982835 - DNA, 22 bp, Homo sapiens
agaaacagaaccaggtgtcatt

SEQ ID NO: 7982836 - DNA, 22 bp, Homo sapiens
agaaacagaagggaaagctttt

SEQ ID NO: 7982837 - DNA, 22 bp, Homo sapiens
agaaacaaggtgtaggttgacc

SEQ ID NO: 7982838 - DNA, 22 bp, Homo sapiens
agaaacaaggtgtaggttgacc

SEQ ID NO: 7982839 - DNA, 22 bp, Homo sapiens
agaaacaaggtgtaggttgacc

SEQ ID NO: 7982840 - DNA, 22 bp, Homo sapiens
agaaacaaggtgtaggttgacc

SEQ ID NO: 7982841 - DNA, 22 bp, Homo sapiens
agaaacaacttgtttctcttgc

SEQ ID NO: 7982842 - DNA, 22 bp, Homo sapiens
agaaacaacttgtttctcttgc

SEQ ID NO: 7982843 - DNA, 22 bp, Homo sapiens
agaaacaacttgtttctcttgc

SEQ ID NO: 7982844 - DNA, 22 bp, Homo sapiens
atatatttgagaatattcatga

SEQ ID NO: 7982845 - DNA, 22 bp, Homo sapiens
atatatttgagaatattcatga

SEQ ID NO: 7982846 - DNA, 22 bp, Homo sapiens
atatattttgaatagcctctgt

SEQ ID NO: 7982847 - DNA, 22 bp, Homo sapiens
atatattttgaatagcctctgt

SEQ ID NO: 7982848 - DNA, 22 bp, Homo sapiens
atatattttgaatagcctctgt

SEQ ID NO: 7982849 - DNA, 22 bp, Homo sapiens
atatccaccattctgcaccttc

SEQ ID NO: 7982850 - DNA, 22 bp, Homo sapiens
atatccagcagcaggtgagtat

SEQ ID NO: 7982851 - DNA, 19 bp, Homo sapiens
atatccttgagaaagggaa

SEQ ID NO: 7982852 - DNA, 22 bp, Homo sapiens
atatccttgagacgtggctact

SEQ ID NO: 7982853 - DNA, 22 bp, Homo sapiens
atatcctttactgtgtcacaga

SEQ ID NO: 7982854 - DNA, 22 bp, Homo sapiens
atatcctttactgtgtcacaga

SEQ ID NO: 7982855 - DNA, 22 bp, Homo sapiens
atatcctttactgtgtcacaga

SEQ ID NO: 7982856 - DNA, 22 bp, Homo sapiens
atatctgtgtttcccttttgct

SEQ ID NO: 7982857 - DNA, 18 bp, Homo sapiens
atatctgtgggatggaga

SEQ ID NO: 7982858 - DNA, 22 bp, Homo sapiens
atatctgtggagggcttacaaa

SEQ ID NO: 7982859 - DNA, 22 bp, Homo sapiens
atatcttggccccaggatttta

SEQ ID NO: 7982860 - DNA, 22 bp, Homo sapiens
atatcttggccccaggatttta

SEQ ID NO: 7982861 - DNA, 22 bp, Homo sapiens
atatatttactctcctgttgca

SEQ ID NO: 7982862 - DNA, 22 bp, Homo sapiens
atatatttactctcctgttgca

SEQ ID NO: 7982863 - DNA, 22 bp, Homo sapiens
atatatttactctcctgttgca

SEQ ID NO: 7982864 - DNA, 22 bp, Homo sapiens
atatatttactctcctgttgca

SEQ ID NO: 7982865 - DNA, 22 bp, Homo sapiens
atatatttactctcctgttgca

SEQ ID NO: 7982866 - DNA, 22 bp, Homo sapiens
atatatttgagaatattcatga

SEQ ID NO: 7982867 - DNA, 22 bp, Homo sapiens
atatatttgagaatattcatga

SEQ ID NO: 7982868 - DNA, 22 bp, Homo sapiens
atatatttgagaatattcatga

SEQ ID NO: 7982869 - DNA, 22 bp, Homo sapiens
atatatttgagaatattcatga

SEQ ID NO: 7982870 - DNA, 22 bp, Homo sapiens
atatatttgagaatattcatga

SEQ ID NO: 7982871 - DNA, 22 bp, Homo sapiens
atatatttgagaatattcatga

SEQ ID NO: 7982872 - DNA, 22 bp, Homo sapiens
atatatttgagaatattcatga

SEQ ID NO: 7982873 - DNA, 22 bp, Homo sapiens
atatatttgagaatattcatga

SEQ ID NO: 7982874 - DNA, 22 bp, Homo sapiens
atatatttgagaatattcatga

SEQ ID NO: 7982875 - DNA, 22 bp, Homo sapiens
atatatttgagaatattcatga

SEQ ID NO: 7982876 - DNA, 22 bp, Homo sapiens
atatatttgagaatattcatga

SEQ ID NO: 7982877 - DNA, 22 bp, Homo sapiens
atatatttgagaatattcatga

SEQ ID NO: 7982878 - DNA, 22 bp, Homo sapiens
atatatttgagaatattcatga

SEQ ID NO: 7982879 - DNA, 22 bp, Homo sapiens
atatatttgagaatattcatga

SEQ ID NO: 7982880 - DNA, 22 bp, Homo sapiens
atatacacatgtgtatacattt

SEQ ID NO: 7982881 - DNA, 22 bp, Homo sapiens
atatacacatgtgtatacattt

SEQ ID NO: 7982882 - DNA, 22 bp, Homo sapiens
atatacacatgtgtatacattt

SEQ ID NO: 7982883 - DNA, 22 bp, Homo sapiens
atatacacatgtgtatacattt

SEQ ID NO: 7982884 - DNA, 22 bp, Homo sapiens
atatacacatctttttaaatat

SEQ ID NO: 7982885 - DNA, 22 bp, Homo sapiens
atatacacatgtgtatacattt

SEQ ID NO: 7982886 - DNA, 21 bp, Homo sapiens
actttgggaggtgtgaggggc

SEQ ID NO: 7982887 - DNA, 21 bp, Homo sapiens
actttgggcactttcctgccc

SEQ ID NO: 7982888 - DNA, 22 bp, Homo sapiens
actttgggcacagtgaggccag

SEQ ID NO: 7982889 - DNA, 22 bp, Homo sapiens
actttgggtaagccaggtgcta

SEQ ID NO: 7982890 - DNA, 20 bp, Homo sapiens
actttggggtctttctcaga

SEQ ID NO: 7982891 - DNA, 20 bp, Homo sapiens
actttggggtctttctcaga

SEQ ID NO: 7982892 - DNA, 22 bp, Homo sapiens
actttggggatctacggctgga

SEQ ID NO: 7982893 - DNA, 21 bp, Homo sapiens
actttgggcactttcctgccc

SEQ ID NO: 7982894 - DNA, 22 bp, Homo sapiens
actttggggaacttttctcctc

SEQ ID NO: 7982895 - DNA, 22 bp, Homo sapiens
actttggggaacttttctcctc

SEQ ID NO: 7982896 - DNA, 19 bp, Homo sapiens
actttggtgattagaggga

SEQ ID NO: 7982897 - DNA, 22 bp, Homo sapiens
actttggtgatacagatacggc

SEQ ID NO: 7982898 - DNA, 22 bp, Homo sapiens
actttggtcttagaggaggaat

SEQ ID NO: 7982899 - DNA, 22 bp, Homo sapiens
actttggtcttagaggaggaat

SEQ ID NO: 7982900 - DNA, 22 bp, Homo sapiens
actttggtgaatcagttttgtt

SEQ ID NO: 7982901 - DNA, 22 bp, Homo sapiens
actttggtctctgcccctggtg

SEQ ID NO: 7982902 - DNA, 17 bp, Homo sapiens
actttggtcctgtgctc

SEQ ID NO: 7982903 - DNA, 22 bp, Homo sapiens
actttggtcccatgtgtgtaaa

SEQ ID NO: 7982904 - DNA, 22 bp, Homo sapiens
actttgggtaagttgattaatc

SEQ ID NO: 7982905 - DNA, 22 bp, Homo sapiens
actttgggtaagccaggtgcta

SEQ ID NO: 7982906 - DNA, 22 bp, Homo sapiens
actttggtttccctgttcgtaa

SEQ ID NO: 7982907 - DNA, 22 bp, Homo sapiens
actttgtaaattgttgtgactc

SEQ ID NO: 7982908 - DNA, 22 bp, Homo sapiens
actttgtaatagtttaaggtca

SEQ ID NO: 7982909 - DNA, 22 bp, Homo sapiens
actttggttcacagctgttcat

SEQ ID NO: 7982910 - DNA, 20 bp, Homo sapiens
actttggttattgggaccat

SEQ ID NO: 7982911 - DNA, 22 bp, Homo sapiens
actttggtgcgaagtcacttta

SEQ ID NO: 7982912 - DNA, 19 bp, Homo sapiens
actttggtgattagaggga

SEQ ID NO: 7982913 - DNA, 22 bp, Homo sapiens
actttggttataggagccaaaa

SEQ ID NO: 7982914 - DNA, 22 bp, Homo sapiens
actttgtaggtttcagtgaaac

SEQ ID NO: 7982915 - DNA, 22 bp, Homo sapiens
atatataacctggataaggctt

SEQ ID NO: 7982916 - DNA, 22 bp, Homo sapiens
atatataacctggataaggctt

SEQ ID NO: 7982917 - DNA, 22 bp, Homo sapiens
atatataacctggataaggctt

SEQ ID NO: 7982918 - DNA, 22 bp, Homo sapiens
actttgtataagacaataaaga

SEQ ID NO: 7982919 - DNA, 22 bp, Homo sapiens
actttgtataagacaataaaga

SEQ ID NO: 7982920 - DNA, 22 bp, Homo sapiens
atatataacctggataaggctt

SEQ ID NO: 7982921 - DNA, 22 bp, Homo sapiens
atatattcttaaagaatctgac

SEQ ID NO: 7982922 - DNA, 22 bp, Homo sapiens
atatattacaaaagaggaagga

SEQ ID NO: 7982923 - DNA, 22 bp, Homo sapiens
atatattacaaaagaggaagga

SEQ ID NO: 7982924 - DNA, 22 bp, Homo sapiens
atatattcttaaagaatctgac

SEQ ID NO: 7982925 - DNA, 22 bp, Homo sapiens
atatattggtgtcagaaagagt

SEQ ID NO: 7982926 - DNA, 22 bp, Homo sapiens
atatattgtatctttcatgggg

SEQ ID NO: 7982927 - DNA, 22 bp, Homo sapiens
atatattgtatctttcatgggg

SEQ ID NO: 7982928 - DNA, 22 bp, Homo sapiens
atatattgtatctttcatgggg

SEQ ID NO: 7982929 - DNA, 22 bp, Homo sapiens
atatacacagagcttatggtga

SEQ ID NO: 7982930 - DNA, 22 bp, Homo sapiens
atatacacatctttttaaatat

SEQ ID NO: 7982931 - DNA, 22 bp, Homo sapiens
atatacacatctttttaaatat

SEQ ID NO: 7982932 - DNA, 22 bp, Homo sapiens
atatacacatctttttaaatat

SEQ ID NO: 7982933 - DNA, 22 bp, Homo sapiens
atatacacatctttttaaatat

SEQ ID NO: 7982934 - DNA, 22 bp, Homo sapiens
atatacaaagggcaacctcgct

SEQ ID NO: 7982935 - DNA, 22 bp, Homo sapiens
atatacaaagggcaacctcgct

SEQ ID NO: 7982936 - DNA, 22 bp, Homo sapiens
atatacaaagggcaacctcgct

SEQ ID NO: 7982937 - DNA, 22 bp, Homo sapiens
atatacaaagggcaacctcgct

SEQ ID NO: 7982938 - DNA, 22 bp, Homo sapiens
atataatttttggttagctcaa

SEQ ID NO: 7982939 - DNA, 22 bp, Homo sapiens
atataatttttggttagctcaa

SEQ ID NO: 7982940 - DNA, 22 bp, Homo sapiens
atataattgttctgaagtgttt

SEQ ID NO: 7982941 - DNA, 22 bp, Homo sapiens
atataattgttctgaagtgttt

SEQ ID NO: 7982942 - DNA, 22 bp, Homo sapiens
atataattgttctgaagtgttt

SEQ ID NO: 7982943 - DNA, 22 bp, Homo sapiens
atataattgttctgaagtgttt

SEQ ID NO: 7982944 - DNA, 22 bp, Homo sapiens
atataattctcaggtttgacta

SEQ ID NO: 7982945 - DNA, 22 bp, Homo sapiens
atataattgttctgaagtgttt

SEQ ID NO: 7982946 - DNA, 22 bp, Homo sapiens
atataatttttggttagctcaa

SEQ ID NO: 7982947 - DNA, 22 bp, Homo sapiens
atataatttagaaggggaaaca

SEQ ID NO: 7982948 - DNA, 22 bp, Homo sapiens
atataattctcaggtttgacta

SEQ ID NO: 7982949 - DNA, 22 bp, Homo sapiens
atataattctcaggtttgacta

SEQ ID NO: 7982950 - DNA, 22 bp, Homo sapiens
atataattaatttagctgcctc

SEQ ID NO: 7982951 - DNA, 22 bp, Homo sapiens
atataattctcaggtttgacta

SEQ ID NO: 7982952 - DNA, 22 bp, Homo sapiens
atagtttacaaaaatgatgcat

SEQ ID NO: 7982953 - DNA, 22 bp, Homo sapiens
atagtttacaaaaatgatgcat

SEQ ID NO: 7982954 - DNA, 22 bp, Homo sapiens
atagtttacaaaaatgatgcat

SEQ ID NO: 7982955 - DNA, 22 bp, Homo sapiens
atagtttaaggaactatgcgat

SEQ ID NO: 7982956 - DNA, 22 bp, Homo sapiens
acttggttctaactagtgtata

SEQ ID NO: 7982957 - DNA, 22 bp, Homo sapiens
acttggttctaactagtgtata

SEQ ID NO: 7982958 - DNA, 22 bp, Homo sapiens
acttggttgatgtcataaggtt

SEQ ID NO: 7982959 - DNA, 22 bp, Homo sapiens
acttggttctaactagtgtata

SEQ ID NO: 7982960 - DNA, 22 bp, Homo sapiens
acttggtggcgaacgagggtca

SEQ ID NO: 7982961 - DNA, 22 bp, Homo sapiens
atataatagtttcataaaggct

SEQ ID NO: 7982962 - DNA, 22 bp, Homo sapiens
atataatagtttcataaaggct

SEQ ID NO: 7982963 - DNA, 22 bp, Homo sapiens
atataatagtttcataaaggct

SEQ ID NO: 7982964 - DNA, 22 bp, Homo sapiens
atataatagtttcataaaggct

SEQ ID NO: 7982965 - DNA, 22 bp, Homo sapiens
acttgggtcacatgacctacct

SEQ ID NO: 7982966 - DNA, 22 bp, Homo sapiens
acttggtggaacgtgtatttta

SEQ ID NO: 7982967 - DNA, 22 bp, Homo sapiens
acttggtgaagtcaggtgatta

SEQ ID NO: 7982968 - DNA, 22 bp, Homo sapiens
acttgggatttcagatgctgtg

SEQ ID NO: 7982969 - DNA, 22 bp, Homo sapiens
acttgggccatcccatagtcaa

SEQ ID NO: 7982970 - DNA, 22 bp, Homo sapiens
acttgggctggagtgccgagga

SEQ ID NO: 7982971 - DNA, 23 bp, Homo sapiens
acttgggcctcacaaatgttagc

SEQ ID NO: 7982972 - DNA, 22 bp, Homo sapiens
acttgggagggtgtgggcagct

SEQ ID NO: 7982973 - DNA, 22 bp, Homo sapiens
acttgggagggtgtgggcagct

SEQ ID NO: 7982974 - DNA, 22 bp, Homo sapiens
acttgggagggtgtgggcagct

SEQ ID NO: 7982975 - DNA, 22 bp, Homo sapiens
acttgggatggtggccagagcg

SEQ ID NO: 7982976 - DNA, 22 bp, Homo sapiens
atcatttatgccccaattagat

SEQ ID NO: 7982977 - DNA, 22 bp, Homo sapiens
atcatttatgccccaattagat

SEQ ID NO: 7982978 - DNA, 22 bp, Homo sapiens
atcatttacaatgaaagcctga

SEQ ID NO: 7982979 - DNA, 22 bp, Homo sapiens
atcatttaaaacaagtctctat

SEQ ID NO: 7982980 - DNA, 22 bp, Homo sapiens
atcatttacaaactcagcattg

SEQ ID NO: 7982981 - DNA, 22 bp, Homo sapiens
atcatttacaaactcagcattg

SEQ ID NO: 7982982 - DNA, 22 bp, Homo sapiens
atcattctgatggtcaatgcta

SEQ ID NO: 7982983 - DNA, 21 bp, Homo sapiens
atcattctggaaaattcaagc

SEQ ID NO: 7982984 - DNA, 21 bp, Homo sapiens
atcattctggaaaattcaagc

SEQ ID NO: 7982985 - DNA, 22 bp, Homo sapiens
atcattgaatataagtgctatt

SEQ ID NO: 7982986 - DNA, 22 bp, Homo sapiens
atcatttaaaacaagtctctat

SEQ ID NO: 7982987 - DNA, 22 bp, Homo sapiens
atcattgtaaataatgctgcca

SEQ ID NO: 7982988 - DNA, 22 bp, Homo sapiens
atcattggaggcactgtgcagt

SEQ ID NO: 7982989 - DNA, 21 bp, Homo sapiens
atcattgcagagcacattaaa

SEQ ID NO: 7982990 - DNA, 22 bp, Homo sapiens
atcattggaggcactgtgcagt

SEQ ID NO: 7982991 - DNA, 23 bp, Homo sapiens
atcattctccaatctggagcagg

SEQ ID NO: 7982992 - DNA, 23 bp, Homo sapiens
atcattctccaatctggagcagg

SEQ ID NO: 7982993 - DNA, 22 bp, Homo sapiens
atcattctattgttgagctgcc

SEQ ID NO: 7982994 - DNA, 20 bp, Homo sapiens
atcatctttacaatgtcagt

SEQ ID NO: 7982995 - DNA, 20 bp, Homo sapiens
atcatctttacaatgtcagt

SEQ ID NO: 7982996 - DNA, 22 bp, Homo sapiens
atcattctctgcttgagcactc

SEQ ID NO: 7982997 - DNA, 23 bp, Homo sapiens
atcattctccaatctggagcagg

SEQ ID NO: 7982998 - DNA, 22 bp, Homo sapiens
atcattctctgcttgagcactc

SEQ ID NO: 7982999 - DNA, 22 bp, Homo sapiens
atcattctgatggtcaatgcta

SEQ ID NO: 7983000 - DNA, 22 bp, Homo sapiens
atcattctgatggtcaatgcta

SEQ ID NO: 7983001 - DNA, 22 bp, Homo sapiens
atcattctgatggtcaatgcta

SEQ ID NO: 7983002 - DNA, 19 bp, Homo sapiens
atcagcaaggtaggatgtg

SEQ ID NO: 7983003 - DNA, 22 bp, Homo sapiens
atcagcaaggcaatcactgcag

SEQ ID NO: 7983004 - DNA, 22 bp, Homo sapiens
atcagcaaggcaatcactgcag

SEQ ID NO: 7983005 - DNA, 22 bp, Homo sapiens
atcagcaaggcaatcactgcag

SEQ ID NO: 7983006 - DNA, 22 bp, Homo sapiens
atcatcttgctttctgtttact

SEQ ID NO: 7983007 - DNA, 22 bp, Homo sapiens
atcagcaagtcctgttaattct

SEQ ID NO: 7983008 - DNA, 20 bp, Homo sapiens
atcatctttacaatgtcagt

SEQ ID NO: 7983009 - DNA, 22 bp, Homo sapiens
atcagcaagtcctgttaattct

SEQ ID NO: 7983010 - DNA, 22 bp, Homo sapiens
atcagcaagatgtaatttctat

SEQ ID NO: 7983011 - DNA, 22 bp, Homo sapiens
atcagcaagattgtgtcttgta

SEQ ID NO: 7983012 - DNA, 22 bp, Homo sapiens
atcagcaagattgtgtcttgta

SEQ ID NO: 7983013 - DNA, 22 bp, Homo sapiens
atcagcaagcatggttaggtgt

SEQ ID NO: 7983014 - DNA, 22 bp, Homo sapiens
atcagcaagcatttattgagtg

SEQ ID NO: 7983015 - DNA, 22 bp, Homo sapiens
atcagcaagcatttattgagtg

SEQ ID NO: 7983016 - DNA, 22 bp, Homo sapiens
atcagcaaaaatgccttcagaa

SEQ ID NO: 7983017 - DNA, 22 bp, Homo sapiens
atcagcaaaaatgccttcagaa

SEQ ID NO: 7983018 - DNA, 22 bp, Homo sapiens
atcagcaaaaatgccttcagaa

SEQ ID NO: 7983019 - DNA, 21 bp, Homo sapiens
atcagcaaatgcctgtctccc

SEQ ID NO: 7983020 - DNA, 21 bp, Homo sapiens
atcagcaaatgcctgtctccc

SEQ ID NO: 7983021 - DNA, 20 bp, Homo sapiens
atcagcaactgccactcagt

SEQ ID NO: 7983022 - DNA, 20 bp, Homo sapiens
atcagcaactgccactcagt

SEQ ID NO: 7983023 - DNA, 22 bp, Homo sapiens
atcagcaagatgtaatttctat

SEQ ID NO: 7983024 - DNA, 22 bp, Homo sapiens
atcagcaagatgtaatttctat

SEQ ID NO: 7983025 - DNA, 22 bp, Homo sapiens
atccagagaggttaggtgacat

SEQ ID NO: 7983026 - DNA, 22 bp, Homo sapiens
atccagaggcactgccctttgt

SEQ ID NO: 7983027 - DNA, 22 bp, Homo sapiens
atccagagttatatccaagcag

SEQ ID NO: 7983028 - DNA, 22 bp, Homo sapiens
atccagagttatatccaagcag

SEQ ID NO: 7983029 - DNA, 22 bp, Homo sapiens
atccagagtgtaattctccatg

SEQ ID NO: 7983030 - DNA, 22 bp, Homo sapiens
atccagagtgtaattctccatg

SEQ ID NO: 7983031 - DNA, 22 bp, Homo sapiens
atccagagtggccttctttcca

SEQ ID NO: 7983032 - DNA, 22 bp, Homo sapiens
atccagcacttgttcatgtgaa

SEQ ID NO: 7983033 - DNA, 23 bp, Homo sapiens
atccagcctgggggtttaaccac

SEQ ID NO: 7983034 - DNA, 22 bp, Homo sapiens
atccagccagtgtggatgactt

SEQ ID NO: 7983035 - DNA, 22 bp, Homo sapiens
agaaccttccatcactccctac

SEQ ID NO: 7983036 - DNA, 22 bp, Homo sapiens
agaaccttccatcactccctac

SEQ ID NO: 7983037 - DNA, 22 bp, Homo sapiens
agaaccttcagcttgcaacaag

SEQ ID NO: 7983038 - DNA, 22 bp, Homo sapiens
agaaccttccatcactccctac

SEQ ID NO: 7983039 - DNA, 22 bp, Homo sapiens
agaaccttgatcttggacttct

SEQ ID NO: 7983040 - DNA, 21 bp, Homo sapiens
agaaccttggatgccattgca

SEQ ID NO: 7983041 - DNA, 22 bp, Homo sapiens
agaacctttctttagaaattca

SEQ ID NO: 7983042 - DNA, 22 bp, Homo sapiens
agaacctttctttagaaattca

SEQ ID NO: 7983043 - DNA, 22 bp, Homo sapiens
agaaccttggtgagtctaacct

SEQ ID NO: 7983044 - DNA, 22 bp, Homo sapiens
atccagacagtctggtgccaga

SEQ ID NO: 7983045 - DNA, 22 bp, Homo sapiens
atccagacagtctggtgccaga

SEQ ID NO: 7983046 - DNA, 22 bp, Homo sapiens
atccagagacccaaggacagaa

SEQ ID NO: 7983047 - DNA, 22 bp, Homo sapiens
atccagagacccaaggacagaa

SEQ ID NO: 7983048 - DNA, 22 bp, Homo sapiens
atccagagactggggctgggat

SEQ ID NO: 7983049 - DNA, 22 bp, Homo sapiens
atccacttggctggttgttcta

SEQ ID NO: 7983050 - DNA, 22 bp, Homo sapiens
atccacttggctggttgttcta

SEQ ID NO: 7983051 - DNA, 22 bp, Homo sapiens
atccagaacacctgtatcacca

SEQ ID NO: 7983052 - DNA, 22 bp, Homo sapiens
atccagaacacctgtatcacca

SEQ ID NO: 7983053 - DNA, 22 bp, Homo sapiens
atccagaatgtcttgctggaga

SEQ ID NO: 7983054 - DNA, 22 bp, Homo sapiens
atccagaatgtcttgctggaga

SEQ ID NO: 7983055 - DNA, 22 bp, Homo sapiens
atccagaatgtcttgctggaga

SEQ ID NO: 7983056 - DNA, 22 bp, Homo sapiens
atccagaagcatgtgtaatttg

SEQ ID NO: 7983057 - DNA, 22 bp, Homo sapiens
atcatttgtgcatagtaacaga

SEQ ID NO: 7983058 - DNA, 22 bp, Homo sapiens
atcatttgtgcatagtaacaga

SEQ ID NO: 7983059 - DNA, 22 bp, Homo sapiens
atcatttgtgcatagtaacaga

SEQ ID NO: 7983060 - DNA, 22 bp, Homo sapiens
atcattttatggctgagaggac

SEQ ID NO: 7983061 - DNA, 22 bp, Homo sapiens
atccacttgccactgtatagtt

SEQ ID NO: 7983062 - DNA, 22 bp, Homo sapiens
atcatttgcctcaagtgaaagt

SEQ ID NO: 7983063 - DNA, 22 bp, Homo sapiens
atcatttgcctcaagtgaaagt

SEQ ID NO: 7983064 - DNA, 22 bp, Homo sapiens
atcatttgcctcaagtgaaagt

SEQ ID NO: 7983065 - DNA, 22 bp, Homo sapiens
atcatttgcctcaagtgaaagt

SEQ ID NO: 7983066 - DNA, 22 bp, Homo sapiens
atcatttgaacagaatttgttt

SEQ ID NO: 7983067 - DNA, 22 bp, Homo sapiens
atcatttggggaattgtggaca

SEQ ID NO: 7983068 - DNA, 22 bp, Homo sapiens
atcatttccctttagatcacaa

SEQ ID NO: 7983069 - DNA, 22 bp, Homo sapiens
atcatttccctttagatcacaa

SEQ ID NO: 7983070 - DNA, 22 bp, Homo sapiens
atcatttccctttagatcacaa

SEQ ID NO: 7983071 - DNA, 22 bp, Homo sapiens
agaaacatcattggaacacaag

SEQ ID NO: 7983072 - DNA, 22 bp, Homo sapiens
agaaacatattcagtgagtaat

SEQ ID NO: 7983073 - DNA, 22 bp, Homo sapiens
agaaacagcattagcatcaatt

SEQ ID NO: 7983074 - DNA, 22 bp, Homo sapiens
agaaacatattcagtgagtaat

SEQ ID NO: 7983075 - DNA, 22 bp, Homo sapiens
agaaacatattcagtgagtaat

SEQ ID NO: 7983076 - DNA, 22 bp, Homo sapiens
agaaacatcattggaacacaag

SEQ ID NO: 7983077 - DNA, 22 bp, Homo sapiens
agaaacatcattggaacacaag

SEQ ID NO: 7983078 - DNA, 22 bp, Homo sapiens
agaaacatcattggaacacaag

SEQ ID NO: 7983079 - DNA, 22 bp, Homo sapiens
agaaacatcattgtttggtatt

SEQ ID NO: 7983080 - DNA, 22 bp, Homo sapiens
agaaacagaagggaaagctttt

SEQ ID NO: 7983081 - DNA, 20 bp, Homo sapiens
agaaacagcacaattctgtt

SEQ ID NO: 7983082 - DNA, 20 bp, Homo sapiens
agaaacagcacaattctgtt

SEQ ID NO: 7983083 - DNA, 20 bp, Homo sapiens
agaaacagcacaattctgtt

SEQ ID NO: 7983084 - DNA, 22 bp, Homo sapiens
agaaacagaagggaaagctttt

SEQ ID NO: 7983085 - DNA, 22 bp, Homo sapiens
agaaacagcattagcatcaatt

SEQ ID NO: 7983086 - DNA, 22 bp, Homo sapiens
agaaacagcattagcatcaatt

SEQ ID NO: 7983087 - DNA, 20 bp, Homo sapiens
agaaacagcacaattctgtt

SEQ ID NO: 7983088 - DNA, 22 bp, Homo sapiens
agaaacagcattagcatcaatt

SEQ ID NO: 7983089 - DNA, 22 bp, Homo sapiens
agaaacagcattagcatcaatt

SEQ ID NO: 7983090 - DNA, 21 bp, Homo sapiens
atcacattggctgttattatt

SEQ ID NO: 7983091 - DNA, 21 bp, Homo sapiens
atcacattggctgttattatt

SEQ ID NO: 7983092 - DNA, 22 bp, Homo sapiens
atcacattgccagtgattaccc

SEQ ID NO: 7983093 - DNA, 21 bp, Homo sapiens
atcacattggctgttattatt

SEQ ID NO: 7983094 - DNA, 22 bp, Homo sapiens
atcacattgccagtgattaccc

SEQ ID NO: 7983095 - DNA, 22 bp, Homo sapiens
atcacaaaggctgcttcatgat

SEQ ID NO: 7983096 - DNA, 22 bp, Homo sapiens
atcacaaaggctgcttcatgat

SEQ ID NO: 7983097 - DNA, 22 bp, Homo sapiens
agaaacatttagattatatgtc

SEQ ID NO: 7983098 - DNA, 22 bp, Homo sapiens
agaaacatttagattatatgtc

SEQ ID NO: 7983099 - DNA, 21 bp, Homo sapiens
agaaacatgatcaaaggaacc

SEQ ID NO: 7983100 - DNA, 22 bp, Homo sapiens
agaaacatcttggcaactggaa

SEQ ID NO: 7983101 - DNA, 22 bp, Homo sapiens
agaaacatttagattatatgtc

SEQ ID NO: 7983102 - DNA, 21 bp, Homo sapiens
agaaacatgatcaaaggaacc

SEQ ID NO: 7983103 - DNA, 21 bp, Homo sapiens
agaaacatgatcaaaggaacc

SEQ ID NO: 7983104 - DNA, 22 bp, Homo sapiens
agaaacatcctgctttccattt

SEQ ID NO: 7983105 - DNA, 22 bp, Homo sapiens
agaaacatcctgctttccattt

SEQ ID NO: 7983106 - DNA, 22 bp, Homo sapiens
agaaacatcctgctttccattt

SEQ ID NO: 7983107 - DNA, 22 bp, Homo sapiens
agaaacatcgcttagtcctcat

SEQ ID NO: 7983108 - DNA, 22 bp, Homo sapiens
agaaacatcctgctttccattt

SEQ ID NO: 7983109 - DNA, 22 bp, Homo sapiens
agaaacatcctgctttccattt

SEQ ID NO: 7983110 - DNA, 22 bp, Homo sapiens
agaaacatcgcttagtcctcat

SEQ ID NO: 7983111 - DNA, 22 bp, Homo sapiens
agaaacatcgcttagtcctcat

SEQ ID NO: 7983112 - DNA, 22 bp, Homo sapiens
agaaacatcgcttagtcctcat

SEQ ID NO: 7983113 - DNA, 22 bp, Homo sapiens
agaaacatcgcttagtcctcat

SEQ ID NO: 7983114 - DNA, 22 bp, Homo sapiens
agaaacatcgcttagtcctcat

SEQ ID NO: 7983115 - DNA, 22 bp, Homo sapiens
agaaacatcgcttagtcctcat

SEQ ID NO: 7983116 - DNA, 22 bp, Homo sapiens
atcagagtgtaagttctttcct

SEQ ID NO: 7983117 - DNA, 21 bp, Homo sapiens
atcagagtacgcatgcgctga

SEQ ID NO: 7983118 - DNA, 22 bp, Homo sapiens
atcagagtcagaggctagagct

SEQ ID NO: 7983119 - DNA, 22 bp, Homo sapiens
atcagagtcagaggctagagct

SEQ ID NO: 7983120 - DNA, 21 bp, Homo sapiens
atcagagtacgcatgcgctga

SEQ ID NO: 7983121 - DNA, 22 bp, Homo sapiens
atcagagtagttgttgcccaga

SEQ ID NO: 7983122 - DNA, 22 bp, Homo sapiens
atcagaggttatgtggagggga

SEQ ID NO: 7983123 - DNA, 22 bp, Homo sapiens
atcagaggtgagggagagcccc

SEQ ID NO: 7983124 - DNA, 22 bp, Homo sapiens
atcagaggtggaactggggact

SEQ ID NO: 7983125 - DNA, 22 bp, Homo sapiens
atcagaggtgagggagagcccc

SEQ ID NO: 7983126 - DNA, 20 bp, Homo sapiens
atcagaggatagggaagtgg

SEQ ID NO: 7983127 - DNA, 22 bp, Homo sapiens
atcagagggtgagatggagaaa

SEQ ID NO: 7983128 - DNA, 22 bp, Homo sapiens
atcagaggtactttccattttt

SEQ ID NO: 7983129 - DNA, 22 bp, Homo sapiens
atcagagggtgagatggagaaa

SEQ ID NO: 7983130 - DNA, 22 bp, Homo sapiens
atcactgtggaaaactgtatgg

SEQ ID NO: 7983131 - DNA, 22 bp, Homo sapiens
atcactgtcgtcatctgagatt

SEQ ID NO: 7983132 - DNA, 22 bp, Homo sapiens
atcactgtcgtcatctgagatt

SEQ ID NO: 7983133 - DNA, 22 bp, Homo sapiens
atcactgtggaaaactgtatgg

SEQ ID NO: 7983134 - DNA, 22 bp, Homo sapiens
atcactgtggcccaaaacctca

SEQ ID NO: 7983135 - DNA, 22 bp, Homo sapiens
atcagaggaagacgacggaatg

SEQ ID NO: 7983136 - DNA, 22 bp, Homo sapiens
atcagagctgcattttagagcc

SEQ ID NO: 7983137 - DNA, 22 bp, Homo sapiens
atcactgtgtatgtatatgcag

SEQ ID NO: 7983138 - DNA, 22 bp, Homo sapiens
atcactgtggcccaaaacctca

SEQ ID NO: 7983139 - DNA, 22 bp, Homo sapiens
atcactgaaatactgaaattac

SEQ ID NO: 7983140 - DNA, 22 bp, Homo sapiens
atcactatgggcattatattta

SEQ ID NO: 7983141 - DNA, 22 bp, Homo sapiens
atcactgatacctttattttca

SEQ ID NO: 7983142 - DNA, 22 bp, Homo sapiens
atcactgatacctttattttca

SEQ ID NO: 7983143 - DNA, 22 bp, Homo sapiens
atcacgtgctgagagtgttatt

SEQ ID NO: 7983144 - DNA, 22 bp, Homo sapiens
atcaccaaggctttaggaattt

SEQ ID NO: 7983145 - DNA, 21 bp, Homo sapiens
atcaccagcagaagctgcaga

SEQ ID NO: 7983146 - DNA, 22 bp, Homo sapiens
atcacatttatagtggcacgca

SEQ ID NO: 7983147 - DNA, 22 bp, Homo sapiens
atcacattgttagcatagactg

SEQ ID NO: 7983148 - DNA, 22 bp, Homo sapiens
atcacattgttagcatagactg

SEQ ID NO: 7983149 - DNA, 23 bp, Homo sapiens
atcaccagcggaagctgcagacc

SEQ ID NO: 7983150 - DNA, 22 bp, Homo sapiens
atcaccaggcaaaatgtcagag

SEQ ID NO: 7983151 - DNA, 22 bp, Homo sapiens
atcaccactacaaacatcattg

SEQ ID NO: 7983152 - DNA, 22 bp, Homo sapiens
atcaccaggcaaaatgtcagag

SEQ ID NO: 7983153 - DNA, 22 bp, Homo sapiens
acttcattgtaatattatagca

SEQ ID NO: 7983154 - DNA, 22 bp, Homo sapiens
acttccaaaacacagcatggca

SEQ ID NO: 7983155 - DNA, 22 bp, Homo sapiens
acttcattgtaatattatagca

SEQ ID NO: 7983156 - DNA, 22 bp, Homo sapiens
acttccaaaacacagcatggca

SEQ ID NO: 7983157 - DNA, 22 bp, Homo sapiens
acttccaaagaagtgattacag

SEQ ID NO: 7983158 - DNA, 22 bp, Homo sapiens
acttccaaagaagtgattacag

SEQ ID NO: 7983159 - DNA, 22 bp, Homo sapiens
acttcattgctaagaacaaggt

SEQ ID NO: 7983160 - DNA, 22 bp, Homo sapiens
acttcattcattttcacgaatg

SEQ ID NO: 7983161 - DNA, 22 bp, Homo sapiens
acttcatgttgtttacaactta

SEQ ID NO: 7983162 - DNA, 22 bp, Homo sapiens
acttcatagaatgagcttggaa

SEQ ID NO: 7983163 - DNA, 22 bp, Homo sapiens
acttcagtgtggtataaaacgt

SEQ ID NO: 7983164 - DNA, 22 bp, Homo sapiens
acttcagcccagaggaagggat

SEQ ID NO: 7983165 - DNA, 22 bp, Homo sapiens
acttcatgaacatgtggcctgt

SEQ ID NO: 7983166 - DNA, 22 bp, Homo sapiens
acttcatattgtttccactaga

SEQ ID NO: 7983167 - DNA, 22 bp, Homo sapiens
acttccagagggtgtggaaata

SEQ ID NO: 7983168 - DNA, 22 bp, Homo sapiens
acttccagatggccccatctaa

SEQ ID NO: 7983169 - DNA, 22 bp, Homo sapiens
acttccagagggtgtggaaata

SEQ ID NO: 7983170 - DNA, 22 bp, Homo sapiens
acttccagacctgtgcttgctc

SEQ ID NO: 7983171 - DNA, 22 bp, Homo sapiens
acttccagagggtgtggaaata

SEQ ID NO: 7983172 - DNA, 22 bp, Homo sapiens
acttccagaattagaatttaag

SEQ ID NO: 7983173 - DNA, 22 bp, Homo sapiens
acttccagacctgtgcttgctc

SEQ ID NO: 7983174 - DNA, 22 bp, Homo sapiens
acttccagaattagaatttaag

SEQ ID NO: 7983175 - DNA, 22 bp, Homo sapiens
acttccagaattagaatttaag

SEQ ID NO: 7983176 - DNA, 22 bp, Homo sapiens
acttccagaattagaatttaag

SEQ ID NO: 7983177 - DNA, 22 bp, Homo sapiens
acttccagaacaggtacatttt

SEQ ID NO: 7983178 - DNA, 22 bp, Homo sapiens
acttccagaattagaatttaag

SEQ ID NO: 7983179 - DNA, 22 bp, Homo sapiens
acttccagaaatgatttaattt

SEQ ID NO: 7983180 - DNA, 22 bp, Homo sapiens
acttccagaaatgatttaattt

SEQ ID NO: 7983181 - DNA, 22 bp, Homo sapiens
acttccagaacaggtacatttt

SEQ ID NO: 7983182 - DNA, 22 bp, Homo sapiens
acttccaagtttattcatgtga

SEQ ID NO: 7983183 - DNA, 17 bp, Homo sapiens
acttccaagcattgctg

SEQ ID NO: 7983184 - DNA, 22 bp, Homo sapiens
acttccaagtgacattcatatc

SEQ ID NO: 7983185 - DNA, 22 bp, Homo sapiens
acttccaacttcagtcctgagc

SEQ ID NO: 7983186 - DNA, 22 bp, Homo sapiens
acttccaaataccatcacattg

SEQ ID NO: 7983187 - DNA, 22 bp, Homo sapiens
acttccaaataccatcacattg

SEQ ID NO: 7983188 - DNA, 22 bp, Homo sapiens
acttccaaataccatcacattg

SEQ ID NO: 7983189 - DNA, 22 bp, Homo sapiens
acttccaaaacacagcatggca

SEQ ID NO: 7983190 - DNA, 22 bp, Homo sapiens
acttccaaataccatcacattg

SEQ ID NO: 7983191 - DNA, 22 bp, Homo sapiens
acttctttcacaatgtttctag

SEQ ID NO: 7983192 - DNA, 22 bp, Homo sapiens
acttctttcacaatgtttctag

SEQ ID NO: 7983193 - DNA, 22 bp, Homo sapiens
acttctttcacaatgtttctag

SEQ ID NO: 7983194 - DNA, 22 bp, Homo sapiens
acttccagatggccccatctaa

SEQ ID NO: 7983195 - DNA, 22 bp, Homo sapiens
acttctttcacaatgtttctag

SEQ ID NO: 7983196 - DNA, 22 bp, Homo sapiens
acttcttttcaaatcatgcaaa

SEQ ID NO: 7983197 - DNA, 22 bp, Homo sapiens
acttcttttcaaatcatgcaaa

SEQ ID NO: 7983198 - DNA, 22 bp, Homo sapiens
acttgatttttataataaatgg

SEQ ID NO: 7983199 - DNA, 22 bp, Homo sapiens
acttgatttttataataaatgg

SEQ ID NO: 7983200 - DNA, 22 bp, Homo sapiens
acttgattttgaacctttctac

SEQ ID NO: 7983201 - DNA, 22 bp, Homo sapiens
acttgcaggatcctctgcctga

SEQ ID NO: 7983202 - DNA, 22 bp, Homo sapiens
acttgcatatatccctccacat

SEQ ID NO: 7983203 - DNA, 22 bp, Homo sapiens
acttgcaaggttgcagttagaa

SEQ ID NO: 7983204 - DNA, 22 bp, Homo sapiens
acttgcagctaccatcattcca

SEQ ID NO: 7983205 - DNA, 23 bp, Homo sapiens
acttggaagcagtgaacaacttt

SEQ ID NO: 7983206 - DNA, 23 bp, Homo sapiens
acttggaagcagtgaacaacttt

SEQ ID NO: 7983207 - DNA, 22 bp, Homo sapiens
acttggagagataatcccatat

SEQ ID NO: 7983208 - DNA, 22 bp, Homo sapiens
acttggaatattgcgtttttgc

SEQ ID NO: 7983209 - DNA, 22 bp, Homo sapiens
acttggagagcattgctgggga

SEQ ID NO: 7983210 - DNA, 22 bp, Homo sapiens
acttggagagcattgctgggga

SEQ ID NO: 7983211 - DNA, 22 bp, Homo sapiens
acttggagagataatcccatat

SEQ ID NO: 7983212 - DNA, 22 bp, Homo sapiens
acttggagagcattgctgggga

SEQ ID NO: 7983213 - DNA, 22 bp, Homo sapiens
acttggagggagctgggtggaa

SEQ ID NO: 7983214 - DNA, 22 bp, Homo sapiens
acttggatatgttcactagacc

SEQ ID NO: 7983215 - DNA, 22 bp, Homo sapiens
acttggagggagctgggtggaa

SEQ ID NO: 7983216 - DNA, 22 bp, Homo sapiens
acttggatatgttcactagacc

SEQ ID NO: 7983217 - DNA, 21 bp, Homo sapiens
acttggcagaacgcagaaggc

SEQ ID NO: 7983218 - DNA, 22 bp, Homo sapiens
acttggcaagtatctataaagt

SEQ ID NO: 7983219 - DNA, 22 bp, Homo sapiens
acttggccttatttccacagaa

SEQ ID NO: 7983220 - DNA, 21 bp, Homo sapiens
acttggccaggcccccacctg

SEQ ID NO: 7983221 - DNA, 22 bp, Homo sapiens
acttggctcagataccatgccc

SEQ ID NO: 7983222 - DNA, 22 bp, Homo sapiens
acttggctagagccaggaggct

SEQ ID NO: 7983223 - DNA, 22 bp, Homo sapiens
acttggctgggagagttgaaga

SEQ ID NO: 7983224 - DNA, 22 bp, Homo sapiens
acttggctgcagagaacgtgtg

SEQ ID NO: 7983225 - DNA, 22 bp, Homo sapiens
acttggctttagtagtaactga

SEQ ID NO: 7983226 - DNA, 22 bp, Homo sapiens
acttggcttttccatctctgca

SEQ ID NO: 7983227 - DNA, 20 bp, Homo sapiens
acttggaactcatttttctt

SEQ ID NO: 7983228 - DNA, 20 bp, Homo sapiens
acttggaactcatttttctt

SEQ ID NO: 7983229 - DNA, 22 bp, Homo sapiens
acttggaaagatgcaacacagt

SEQ ID NO: 7983230 - DNA, 22 bp, Homo sapiens
acttggaaaattcaaaatggca

SEQ ID NO: 7983231 - DNA, 22 bp, Homo sapiens
acttggaaaattcaaaatggca

SEQ ID NO: 7983232 - DNA, 22 bp, Homo sapiens
acttgctcaatgcttgaagcca

SEQ ID NO: 7983233 - DNA, 22 bp, Homo sapiens
acttgcctgttacatttctagt

SEQ ID NO: 7983234 - DNA, 20 bp, Homo sapiens
acttgctgggctttgttacc

SEQ ID NO: 7983235 - DNA, 22 bp, Homo sapiens
acttgctcaatgcttgaagcca

SEQ ID NO: 7983236 - DNA, 22 bp, Homo sapiens
acttgctggtggcatttacagt

SEQ ID NO: 7983237 - DNA, 22 bp, Homo sapiens
acttgcttagtttgcaacagag

SEQ ID NO: 7983238 - DNA, 22 bp, Homo sapiens
acttgccagctaaagcctggtg

SEQ ID NO: 7983239 - DNA, 22 bp, Homo sapiens
acttgccccagaattgctgctg

SEQ ID NO: 7983240 - DNA, 22 bp, Homo sapiens
acttgccccagaattgctgctg

SEQ ID NO: 7983241 - DNA, 22 bp, Homo sapiens
acttgcatgttatttttatagg

SEQ ID NO: 7983242 - DNA, 22 bp, Homo sapiens
acttcacagaaattttatgagg

SEQ ID NO: 7983243 - DNA, 22 bp, Homo sapiens
acttcacagaaattttatgagg

SEQ ID NO: 7983244 - DNA, 22 bp, Homo sapiens
acttcacaaagagatcatctaa

SEQ ID NO: 7983245 - DNA, 22 bp, Homo sapiens
acttcacaaagagatcatctaa

SEQ ID NO: 7983246 - DNA, 22 bp, Homo sapiens
acttcacaaagagatcatctaa

SEQ ID NO: 7983247 - DNA, 22 bp, Homo sapiens
acttcacaaagagatcatctaa

SEQ ID NO: 7983248 - DNA, 22 bp, Homo sapiens
acttcaaattttcagaagaaat

SEQ ID NO: 7983249 - DNA, 22 bp, Homo sapiens
acttcaaattttcagaagaaat

SEQ ID NO: 7983250 - DNA, 22 bp, Homo sapiens
acttcaaattttcagaagaaat

SEQ ID NO: 7983251 - DNA, 17 bp, Homo sapiens
acttcaagttcagtgac

SEQ ID NO: 7983252 - DNA, 22 bp, Homo sapiens
acttcacaaagagatcatctaa

SEQ ID NO: 7983253 - DNA, 22 bp, Homo sapiens
acttcaaattttcagaagaaat

SEQ ID NO: 7983254 - DNA, 22 bp, Homo sapiens
acttcacagatatttatttggt

SEQ ID NO: 7983255 - DNA, 22 bp, Homo sapiens
acttcacagaaattttatgagg

SEQ ID NO: 7983256 - DNA, 22 bp, Homo sapiens
acttcacaggttttcataaaac

SEQ ID NO: 7983257 - DNA, 22 bp, Homo sapiens
acttcacaggttttcataaaac

SEQ ID NO: 7983258 - DNA, 22 bp, Homo sapiens
acttcacaggttttcataaaac

SEQ ID NO: 7983259 - DNA, 22 bp, Homo sapiens
acttcacagatatttatttggt

SEQ ID NO: 7983260 - DNA, 22 bp, Homo sapiens
acttcacaggttttcataaaac

SEQ ID NO: 7983261 - DNA, 22 bp, Homo sapiens
acttcacaggttttcataaaac

SEQ ID NO: 7983262 - DNA, 22 bp, Homo sapiens
acttcacattagctaaaaggga

SEQ ID NO: 7983263 - DNA, 22 bp, Homo sapiens
acttcacattagctaaaaggga

SEQ ID NO: 7983264 - DNA, 22 bp, Homo sapiens
acttcagagttagttatagacc

SEQ ID NO: 7983265 - DNA, 22 bp, Homo sapiens
acttcagagaaagagggaattc

SEQ ID NO: 7983266 - DNA, 22 bp, Homo sapiens
acttcagaaaatgttgaatgtt

SEQ ID NO: 7983267 - DNA, 22 bp, Homo sapiens
acttcacatttgcaagtcttgg

SEQ ID NO: 7983268 - DNA, 22 bp, Homo sapiens
acttcaaaaataagtgagaggt

SEQ ID NO: 7983269 - DNA, 22 bp, Homo sapiens
acttatttcatggatcataatg

SEQ ID NO: 7983270 - DNA, 22 bp, Homo sapiens
acttagaattaaatatttttgg

SEQ ID NO: 7983271 - DNA, 22 bp, Homo sapiens
acttagaattaaatatttttgg

SEQ ID NO: 7983272 - DNA, 22 bp, Homo sapiens
acttagaatatgttcaagattt

SEQ ID NO: 7983273 - DNA, 20 bp, Homo sapiens
actgttagtatacttgtgcc

SEQ ID NO: 7983274 - DNA, 18 bp, Homo sapiens
actgttatctgataaggc

SEQ ID NO: 7983275 - DNA, 22 bp, Homo sapiens
acttcaaacaattaacagagaa

SEQ ID NO: 7983276 - DNA, 22 bp, Homo sapiens
acttagaattaaatatttttgg

SEQ ID NO: 7983277 - DNA, 22 bp, Homo sapiens
acttcaaacaattaacagagaa

SEQ ID NO: 7983278 - DNA, 22 bp, Homo sapiens
acttcaaacaattaacagagaa

SEQ ID NO: 7983279 - DNA, 22 bp, Homo sapiens
acttcaaacaattaacagagaa

SEQ ID NO: 7983280 - DNA, 22 bp, Homo sapiens
acttcaaaatgagtttcctggt

SEQ ID NO: 7983281 - DNA, 22 bp, Homo sapiens
acttcaaatgtgacaatgtgaa

SEQ ID NO: 7983282 - DNA, 19 bp, Homo sapiens
acttcaaatcttagagaaa

SEQ ID NO: 7983283 - DNA, 22 bp, Homo sapiens
acttcaaatctcttgaaagcaa

SEQ ID NO: 7983284 - DNA, 22 bp, Homo sapiens
actgtgtggaaatttgtgaggg

SEQ ID NO: 7983285 - DNA, 22 bp, Homo sapiens
actgtgtggaaatttgtgaggg

SEQ ID NO: 7983286 - DNA, 22 bp, Homo sapiens
actgtgtgctggacatgatgtt

SEQ ID NO: 7983287 - DNA, 22 bp, Homo sapiens
actgtgtgctggacatgatgtt

SEQ ID NO: 7983288 - DNA, 20 bp, Homo sapiens
actgtgtgatctggaaagct

SEQ ID NO: 7983289 - DNA, 22 bp, Homo sapiens
actgtgtgccctgacgccaggg

SEQ ID NO: 7983290 - DNA, 20 bp, Homo sapiens
actgtgtgatctggaaagct

SEQ ID NO: 7983291 - DNA, 20 bp, Homo sapiens
actgtgtgatctggaaagct

SEQ ID NO: 7983292 - DNA, 22 bp, Homo sapiens
actgtgtgactgttattactgt

SEQ ID NO: 7983293 - DNA, 22 bp, Homo sapiens
actgtgtcattgatcagaaaca

SEQ ID NO: 7983294 - DNA, 22 bp, Homo sapiens
actgtgtcattgaacatggaaa

SEQ ID NO: 7983295 - DNA, 22 bp, Homo sapiens
actgtgtcctatttccttgaca

SEQ ID NO: 7983296 - DNA, 22 bp, Homo sapiens
actgtgtcctatttccttgaca

SEQ ID NO: 7983297 - DNA, 22 bp, Homo sapiens
actgtgtcctcatgtggcagaa

SEQ ID NO: 7983298 - DNA, 22 bp, Homo sapiens
actgtgtcctcatgtggcagaa

SEQ ID NO: 7983299 - DNA, 22 bp, Homo sapiens
actgtgtcctcatgtggcagaa

SEQ ID NO: 7983300 - DNA, 22 bp, Homo sapiens
actgtgtcctatttccttgaca

SEQ ID NO: 7983301 - DNA, 22 bp, Homo sapiens
actgtgtgaaacatcaatgtgt

SEQ ID NO: 7983302 - DNA, 22 bp, Homo sapiens
actgtgtctcacagtggtacca

SEQ ID NO: 7983303 - DNA, 22 bp, Homo sapiens
actgtgtctcattcatcattgt

SEQ ID NO: 7983304 - DNA, 22 bp, Homo sapiens
actgtgtctagcaccacgtgtc

SEQ ID NO: 7983305 - DNA, 22 bp, Homo sapiens
actgtgtctcacagtggtacca

SEQ ID NO: 7983306 - DNA, 22 bp, Homo sapiens
actgtgtgactgttattactgt

SEQ ID NO: 7983307 - DNA, 18 bp, Homo sapiens
actgtgtgaattagctcc

SEQ ID NO: 7983308 - DNA, 22 bp, Homo sapiens
actgtgttgccttcccccagcc

SEQ ID NO: 7983309 - DNA, 22 bp, Homo sapiens
actgtgttcacacttacaaatg

SEQ ID NO: 7983310 - DNA, 22 bp, Homo sapiens
actgtgttgtctcaacctgacc

SEQ ID NO: 7983311 - DNA, 22 bp, Homo sapiens
actgtgttaaatacagagatgg

SEQ ID NO: 7983312 - DNA, 22 bp, Homo sapiens
actgtgtgtttgtctagcacag

SEQ ID NO: 7983313 - DNA, 22 bp, Homo sapiens
actgtgttaaatacagagatgg

SEQ ID NO: 7983314 - DNA, 22 bp, Homo sapiens
actgtgtggaccactctgaggc

SEQ ID NO: 7983315 - DNA, 22 bp, Homo sapiens
actgtgtggaccactctgaggc

SEQ ID NO: 7983316 - DNA, 22 bp, Homo sapiens
actgtgtttctgaaacaagagg

SEQ ID NO: 7983317 - DNA, 22 bp, Homo sapiens
actgttaaagtaattaattgtc

SEQ ID NO: 7983318 - DNA, 22 bp, Homo sapiens
actgttaaagtaattaattgtc

SEQ ID NO: 7983319 - DNA, 22 bp, Homo sapiens
actgttagatgctaagcaaatg

SEQ ID NO: 7983320 - DNA, 20 bp, Homo sapiens
actgttagtatacttgtgcc

SEQ ID NO: 7983321 - DNA, 22 bp, Homo sapiens
actgttagccttccataacaca

SEQ ID NO: 7983322 - DNA, 22 bp, Homo sapiens
agtttacagatgctacaggagc

SEQ ID NO: 7983323 - DNA, 22 bp, Homo sapiens
agtttacagatgctacaggagc

SEQ ID NO: 7983324 - DNA, 22 bp, Homo sapiens
agtttacagttctcatcgcaac

SEQ ID NO: 7983325 - DNA, 22 bp, Homo sapiens
agtttacagatgctacaggagc

SEQ ID NO: 7983326 - DNA, 22 bp, Homo sapiens
agtttacactatgaaaagacta

SEQ ID NO: 7983327 - DNA, 22 bp, Homo sapiens
agtttacactatgaaaagacta

SEQ ID NO: 7983328 - DNA, 22 bp, Homo sapiens
agtttacactatgaaaagacta

SEQ ID NO: 7983329 - DNA, 22 bp, Homo sapiens
agtttacacttttgattcttat

SEQ ID NO: 7983330 - DNA, 19 bp, Homo sapiens
actggcagtttctgcatgg

SEQ ID NO: 7983331 - DNA, 19 bp, Homo sapiens
actggcagtttctgcatgg

SEQ ID NO: 7983332 - DNA, 22 bp, Homo sapiens
actggcagtttgagaatgcatt

SEQ ID NO: 7983333 - DNA, 22 bp, Homo sapiens
actggcagtttgagaatgcatt

SEQ ID NO: 7983334 - DNA, 22 bp, Homo sapiens
actggcagtgtcgtttacatga

SEQ ID NO: 7983335 - DNA, 19 bp, Homo sapiens
actggcagtttctgcatgg

SEQ ID NO: 7983336 - DNA, 22 bp, Homo sapiens
agttgcagccttcaggagaccc

SEQ ID NO: 7983337 - DNA, 22 bp, Homo sapiens
agttgctcaatgtggctgtgga

SEQ ID NO: 7983338 - DNA, 21 bp, Homo sapiens
agtttacaactgtccagcccc

SEQ ID NO: 7983339 - DNA, 21 bp, Homo sapiens
agtttacaactgtccagcccc

SEQ ID NO: 7983340 - DNA, 22 bp, Homo sapiens
actggcagtagagggagcgcat

SEQ ID NO: 7983341 - DNA, 22 bp, Homo sapiens
actggcagtagagggagcgcat

SEQ ID NO: 7983342 - DNA, 22 bp, Homo sapiens
actggcaggtccatcgcccttt

SEQ ID NO: 7983343 - DNA, 22 bp, Homo sapiens
actggcagggggagccccgaga

SEQ ID NO: 7983344 - DNA, 19 bp, Homo sapiens
actggcagggctgcggtgg

SEQ ID NO: 7983345 - DNA, 19 bp, Homo sapiens
actggcagggctgcggtgg

SEQ ID NO: 7983346 - DNA, 22 bp, Homo sapiens
actggcagtagagggagcgcat

SEQ ID NO: 7983347 - DNA, 22 bp, Homo sapiens
actggcagtagagggagcgcat

SEQ ID NO: 7983348 - DNA, 22 bp, Homo sapiens
actggcagtggcagcagaaaga

SEQ ID NO: 7983349 - DNA, 22 bp, Homo sapiens
actggcagtggcagcagaaaga

SEQ ID NO: 7983350 - DNA, 22 bp, Homo sapiens
actggcagtggcagcagaaaga

SEQ ID NO: 7983351 - DNA, 22 bp, Homo sapiens
actggcagctgtaggatgcatg

SEQ ID NO: 7983352 - DNA, 20 bp, Homo sapiens
actggcagcctgcctgctgt

SEQ ID NO: 7983353 - DNA, 20 bp, Homo sapiens
actggcagcctgcctgctgt

SEQ ID NO: 7983354 - DNA, 22 bp, Homo sapiens
actggcaggctgctggccggcg

SEQ ID NO: 7983355 - DNA, 22 bp, Homo sapiens
actggcaggctgctggccggcg

SEQ ID NO: 7983356 - DNA, 22 bp, Homo sapiens
actggcaggctgctggccggcg

SEQ ID NO: 7983357 - DNA, 22 bp, Homo sapiens
actggcaggctgctggccggcg

SEQ ID NO: 7983358 - DNA, 22 bp, Homo sapiens
actggcagctgtaggatgcatg

SEQ ID NO: 7983359 - DNA, 19 bp, Homo sapiens
actggcagctgtagtctgt

SEQ ID NO: 7983360 - DNA, 22 bp, Homo sapiens
agtttacatcttcaatctcatt

SEQ ID NO: 7983361 - DNA, 22 bp, Homo sapiens
agtttacatcttcaatctcatt

SEQ ID NO: 7983362 - DNA, 22 bp, Homo sapiens
agtttacatcttcaatctcatt

SEQ ID NO: 7983363 - DNA, 22 bp, Homo sapiens
agtttacatcttcaatctcatt

SEQ ID NO: 7983364 - DNA, 22 bp, Homo sapiens
agtttacataaaaaggcagagg

SEQ ID NO: 7983365 - DNA, 22 bp, Homo sapiens
agtttacataaaaaggcagagg

SEQ ID NO: 7983366 - DNA, 22 bp, Homo sapiens
agtttacagttctcatcgcaac

SEQ ID NO: 7983367 - DNA, 22 bp, Homo sapiens
agtttacataaaaaggcagagg

SEQ ID NO: 7983368 - DNA, 22 bp, Homo sapiens
agtttacatatttgtcggagtc

SEQ ID NO: 7983369 - DNA, 22 bp, Homo sapiens
agtttacatgacgtgtatttca

SEQ ID NO: 7983370 - DNA, 22 bp, Homo sapiens
agtttacatgacgtgtatttca

SEQ ID NO: 7983371 - DNA, 22 bp, Homo sapiens
agtttactctggtgacaattta

SEQ ID NO: 7983372 - DNA, 22 bp, Homo sapiens
agtttacccactgttgaaatta

SEQ ID NO: 7983373 - DNA, 22 bp, Homo sapiens
agtttatgaaacacagatttga

SEQ ID NO: 7983374 - DNA, 22 bp, Homo sapiens
agtttatgattttatgtaagta

SEQ ID NO: 7983375 - DNA, 22 bp, Homo sapiens
agtttagtataccagtacatct

SEQ ID NO: 7983376 - DNA, 22 bp, Homo sapiens
agtttaggcaggctcctatggt

SEQ ID NO: 7983377 - DNA, 22 bp, Homo sapiens
agtttaggaaacaattacctta

SEQ ID NO: 7983378 - DNA, 22 bp, Homo sapiens
agtttagcatttgaagttattc

SEQ ID NO: 7983379 - DNA, 19 bp, Homo sapiens
agtttagagagactctaaa

SEQ ID NO: 7983380 - DNA, 22 bp, Homo sapiens
agtttagacaaagtcttgcatt

SEQ ID NO: 7983381 - DNA, 22 bp, Homo sapiens
agtttagacaaagtcttgcatt

SEQ ID NO: 7983382 - DNA, 22 bp, Homo sapiens
agtttagaagaggaacttgtta

SEQ ID NO: 7983383 - DNA, 22 bp, Homo sapiens
actgtaaaatacataagtattg

SEQ ID NO: 7983384 - DNA, 22 bp, Homo sapiens
actgtaaaactgctttggaaac

SEQ ID NO: 7983385 - DNA, 22 bp, Homo sapiens
actgtaaaatacataagtattg

SEQ ID NO: 7983386 - DNA, 22 bp, Homo sapiens
actgtaaaatgagatatgtata

SEQ ID NO: 7983387 - DNA, 22 bp, Homo sapiens
actgtaaaatgagatatgtata

SEQ ID NO: 7983388 - DNA, 22 bp, Homo sapiens
actgtaaaatgagatatgtata

SEQ ID NO: 7983389 - DNA, 22 bp, Homo sapiens
actgtaaaatgagatatgtata

SEQ ID NO: 7983390 - DNA, 22 bp, Homo sapiens
actgtaaagagaactgtgggct

SEQ ID NO: 7983391 - DNA, 22 bp, Homo sapiens
actgtaaagaagtaagtatggg

SEQ ID NO: 7983392 - DNA, 22 bp, Homo sapiens
agtttatgtaaaattagtaatg

SEQ ID NO: 7983393 - DNA, 19 bp, Homo sapiens
agtttatgcagatactggt

SEQ ID NO: 7983394 - DNA, 22 bp, Homo sapiens
agtttatgtaaaattagtaatg

SEQ ID NO: 7983395 - DNA, 19 bp, Homo sapiens
agtttatgcagatactggt

SEQ ID NO: 7983396 - DNA, 22 bp, Homo sapiens
actggtttgtctattgtcattc

SEQ ID NO: 7983397 - DNA, 22 bp, Homo sapiens
actggttttccaggttacttct

SEQ ID NO: 7983398 - DNA, 17 bp, Homo sapiens
actggttttggcagcat

SEQ ID NO: 7983399 - DNA, 22 bp, Homo sapiens
actggtttttccatatgagatg

SEQ ID NO: 7983400 - DNA, 22 bp, Homo sapiens
actggtttttccatatgagatg

SEQ ID NO: 7983401 - DNA, 22 bp, Homo sapiens
actggtttttctcatgaaaatg

SEQ ID NO: 7983402 - DNA, 22 bp, Homo sapiens
actgtaaaacaggtttcatcat

SEQ ID NO: 7983403 - DNA, 22 bp, Homo sapiens
actgtgtattcctatatagtaa

SEQ ID NO: 7983404 - DNA, 22 bp, Homo sapiens
actgtgtattctaatgactaaa

SEQ ID NO: 7983405 - DNA, 22 bp, Homo sapiens
actgtggttacctcttgtctta

SEQ ID NO: 7983406 - DNA, 20 bp, Homo sapiens
actgtgtaaacatgattcat

SEQ ID NO: 7983407 - DNA, 20 bp, Homo sapiens
actgtgtaaacatgattcat

SEQ ID NO: 7983408 - DNA, 22 bp, Homo sapiens
actgtgtatgatatgtactggg

SEQ ID NO: 7983409 - DNA, 22 bp, Homo sapiens
actgtgggtgagggcaaatcaa

SEQ ID NO: 7983410 - DNA, 21 bp, Homo sapiens
actgtgggtctgaccacctgg

SEQ ID NO: 7983411 - DNA, 22 bp, Homo sapiens
actgtgggtcccagctgtgtct

SEQ ID NO: 7983412 - DNA, 22 bp, Homo sapiens
actgtggggttcctggtacttg

SEQ ID NO: 7983413 - DNA, 22 bp, Homo sapiens
actgtgccacaattcaccaggg

SEQ ID NO: 7983414 - DNA, 22 bp, Homo sapiens
agtttctaacatatagcattgg

SEQ ID NO: 7983415 - DNA, 22 bp, Homo sapiens
actgtgccttcttattgggtcc

SEQ ID NO: 7983416 - DNA, 21 bp, Homo sapiens
actgtgccaggcacaaaaaca

SEQ ID NO: 7983417 - DNA, 22 bp, Homo sapiens
actgtgctatctactgaattat

SEQ ID NO: 7983418 - DNA, 22 bp, Homo sapiens
actgtgcctttcacttgcactt

SEQ ID NO: 7983419 - DNA, 22 bp, Homo sapiens
actgtgcctttcacttgcactt

SEQ ID NO: 7983420 - DNA, 22 bp, Homo sapiens
actgtgccttcagttttggggt

SEQ ID NO: 7983421 - DNA, 22 bp, Homo sapiens
actgtgccttcttattgggtcc

SEQ ID NO: 7983422 - DNA, 22 bp, Homo sapiens
agtttccttgggcatttgttta

SEQ ID NO: 7983423 - DNA, 22 bp, Homo sapiens
agtttcctcatgttaatatgga

SEQ ID NO: 7983424 - DNA, 22 bp, Homo sapiens
agtttctaacatatagcattgg

SEQ ID NO: 7983425 - DNA, 22 bp, Homo sapiens
agtttcctgggagattcttaca

SEQ ID NO: 7983426 - DNA, 22 bp, Homo sapiens
agtttcctcatgttaatatgga

SEQ ID NO: 7983427 - DNA, 22 bp, Homo sapiens
agtttccttggattcaatttgg

SEQ ID NO: 7983428 - DNA, 22 bp, Homo sapiens
agtttcctcatctgtaaaatga

SEQ ID NO: 7983429 - DNA, 22 bp, Homo sapiens
agtttcctcatgttaatatgga

SEQ ID NO: 7983430 - DNA, 21 bp, Homo sapiens
agtttcctcatctgcatagga

SEQ ID NO: 7983431 - DNA, 21 bp, Homo sapiens
agtttcctcatctgcatagga

SEQ ID NO: 7983432 - DNA, 22 bp, Homo sapiens
agtttcccttgcaaacccattt

SEQ ID NO: 7983433 - DNA, 21 bp, Homo sapiens
agtttcctcaactgcagaagg

SEQ ID NO: 7983434 - DNA, 21 bp, Homo sapiens
agtttcctcaactgcagaagg

SEQ ID NO: 7983435 - DNA, 22 bp, Homo sapiens
agtttcccaagcagatatcatc

SEQ ID NO: 7983436 - DNA, 22 bp, Homo sapiens
agtttcccccttcacagcttaa

SEQ ID NO: 7983437 - DNA, 19 bp, Homo sapiens
agtttccctggagacatca

SEQ ID NO: 7983438 - DNA, 19 bp, Homo sapiens
agtttccctggagacatca

SEQ ID NO: 7983439 - DNA, 23 bp, Homo sapiens
agtttccacccagggtagaaggg

SEQ ID NO: 7983440 - DNA, 22 bp, Homo sapiens
agtttcatttcttagtaccagt

SEQ ID NO: 7983441 - DNA, 22 bp, Homo sapiens
agtttcatttcttagtaccagt

SEQ ID NO: 7983442 - DNA, 22 bp, Homo sapiens
agtttcatttcttagtaccagt

SEQ ID NO: 7983443 - DNA, 22 bp, Homo sapiens
actgtgagagtttttctaggag

SEQ ID NO: 7983444 - DNA, 22 bp, Homo sapiens
actgtgagagaggttcttggta

SEQ ID NO: 7983445 - DNA, 22 bp, Homo sapiens
agtttcatgtagccatatttac

SEQ ID NO: 7983446 - DNA, 22 bp, Homo sapiens
agtttcattgagatgtttgcta

SEQ ID NO: 7983447 - DNA, 22 bp, Homo sapiens
agtttcattgagatgtttgcta

SEQ ID NO: 7983448 - DNA, 22 bp, Homo sapiens
agtttcatgtagccatatttac

SEQ ID NO: 7983449 - DNA, 22 bp, Homo sapiens
actgtgaaagctaacatcttag

SEQ ID NO: 7983450 - DNA, 22 bp, Homo sapiens
actgtgaaagctaacatcttag

SEQ ID NO: 7983451 - DNA, 17 bp, Homo sapiens
actgtcttttacaccct

SEQ ID NO: 7983452 - DNA, 22 bp, Homo sapiens
actgtgaacggactgaagccca

SEQ ID NO: 7983453 - DNA, 22 bp, Homo sapiens
actgtgaacggactgaagccca

SEQ ID NO: 7983454 - DNA, 22 bp, Homo sapiens
actgtgaacggactgaagccca

SEQ ID NO: 7983455 - DNA, 22 bp, Homo sapiens
actgtgaacggactgaagccca

SEQ ID NO: 7983456 - DNA, 22 bp, Homo sapiens
actgtgaacggactgaagccca

SEQ ID NO: 7983457 - DNA, 22 bp, Homo sapiens
actgtgaacggactgaagccca

SEQ ID NO: 7983458 - DNA, 21 bp, Homo sapiens
actgtgaagatgctataaact

SEQ ID NO: 7983459 - DNA, 21 bp, Homo sapiens
actgtgaagatgctataaact

SEQ ID NO: 7983460 - DNA, 22 bp, Homo sapiens
actgtgaatcactactagtaga

SEQ ID NO: 7983461 - DNA, 22 bp, Homo sapiens
actgtgaatcactactagtaga

SEQ ID NO: 7983462 - DNA, 22 bp, Homo sapiens
actgtgaatcactactagtaga

SEQ ID NO: 7983463 - DNA, 22 bp, Homo sapiens
actgtctttgagctggaggagg

SEQ ID NO: 7983464 - DNA, 22 bp, Homo sapiens
actgtctttattagaatcttat

SEQ ID NO: 7983465 - DNA, 22 bp, Homo sapiens
actgtctttattagaatcttat

SEQ ID NO: 7983466 - DNA, 22 bp, Homo sapiens
actgtcttgtgttaaagaacca

SEQ ID NO: 7983467 - DNA, 22 bp, Homo sapiens
actgtcttgttccaagactaaa

SEQ ID NO: 7983468 - DNA, 22 bp, Homo sapiens
actgtcttgttccaagactaaa

SEQ ID NO: 7983469 - DNA, 22 bp, Homo sapiens
actgtcttgctatgagctccca

SEQ ID NO: 7983470 - DNA, 22 bp, Homo sapiens
actgtcttgtgttaaagaacca

SEQ ID NO: 7983471 - DNA, 22 bp, Homo sapiens
actgtcttgctatgagctccca

SEQ ID NO: 7983472 - DNA, 22 bp, Homo sapiens
actgtcttccaggtctggaggt

SEQ ID NO: 7983473 - DNA, 22 bp, Homo sapiens
actgtcttcatatctgtgtctc

SEQ ID NO: 7983474 - DNA, 22 bp, Homo sapiens
actgtcatgatcgaagatgtca

SEQ ID NO: 7983475 - DNA, 22 bp, Homo sapiens
actgtcatcttgtaagcaatgt

SEQ ID NO: 7983476 - DNA, 22 bp, Homo sapiens
actgtaaattacataagaacag

SEQ ID NO: 7983477 - DNA, 22 bp, Homo sapiens
actgtaaattacataagaacag

SEQ ID NO: 7983478 - DNA, 22 bp, Homo sapiens
actgtaaagcttttctcatgcg

SEQ ID NO: 7983479 - DNA, 22 bp, Homo sapiens
actgtaaagaggtgtatcttta

SEQ ID NO: 7983480 - DNA, 22 bp, Homo sapiens
actgtaaaggtgattagaagtt

SEQ ID NO: 7983481 - DNA, 22 bp, Homo sapiens
actgtctgctggcccctggtta

SEQ ID NO: 7983482 - DNA, 20 bp, Homo sapiens
actgtctggggacctcatta

SEQ ID NO: 7983483 - DNA, 22 bp, Homo sapiens
actgtctggaggcagagaggga

SEQ ID NO: 7983484 - DNA, 22 bp, Homo sapiens
actgtaaattacataagaacag

SEQ ID NO: 7983485 - DNA, 22 bp, Homo sapiens
actgtctggatggaagccagcg

SEQ ID NO: 7983486 - DNA, 22 bp, Homo sapiens
actgtcttcaaatgaatatatt

SEQ ID NO: 7983487 - DNA, 22 bp, Homo sapiens
actgtcttcaaatgaatatatt

SEQ ID NO: 7983488 - DNA, 22 bp, Homo sapiens
actgtctgtctcccaattatgc

SEQ ID NO: 7983489 - DNA, 22 bp, Homo sapiens
actgtctgtgccagatgctggg

SEQ ID NO: 7983490 - DNA, 22 bp, Homo sapiens
acagcttcgaggatctcatccc

SEQ ID NO: 7983491 - DNA, 22 bp, Homo sapiens
acagcttcgaggatctcatccc

SEQ ID NO: 7983492 - DNA, 23 bp, Homo sapiens
acagcttcctactttgctgctgc

SEQ ID NO: 7983493 - DNA, 23 bp, Homo sapiens
acagcttcctactttgctgctgc

SEQ ID NO: 7983494 - DNA, 22 bp, Homo sapiens
acaggcaggtaatttacatatt

SEQ ID NO: 7983495 - DNA, 22 bp, Homo sapiens
acaggcaggtaatttacatatt

SEQ ID NO: 7983496 - DNA, 22 bp, Homo sapiens
acaggcaggtaatttacatatt

SEQ ID NO: 7983497 - DNA, 22 bp, Homo sapiens
acaggcaggtaatttacatatt

SEQ ID NO: 7983498 - DNA, 22 bp, Homo sapiens
acaggcaggtaatttacatatt

SEQ ID NO: 7983499 - DNA, 22 bp, Homo sapiens
acaggcaggtaatttacatatt

SEQ ID NO: 7983500 - DNA, 22 bp, Homo sapiens
acaggcaggtaatttacatatt

SEQ ID NO: 7983501 - DNA, 22 bp, Homo sapiens
acaggcccagctcttcaccaga

SEQ ID NO: 7983502 - DNA, 22 bp, Homo sapiens
acaggcctacgaagtcaggtgc

SEQ ID NO: 7983503 - DNA, 22 bp, Homo sapiens
acaggccataaaggcaggccct

SEQ ID NO: 7983504 - DNA, 22 bp, Homo sapiens
acaggccataaaggcaggccct

SEQ ID NO: 7983505 - DNA, 22 bp, Homo sapiens
acaggccataaaggcaggccct

SEQ ID NO: 7983506 - DNA, 22 bp, Homo sapiens
acagctgtgttttataatcagc

SEQ ID NO: 7983507 - DNA, 22 bp, Homo sapiens
acagctgtgttttataatcagc

SEQ ID NO: 7983508 - DNA, 22 bp, Homo sapiens
acagctgtggtctccttagtgt

SEQ ID NO: 7983509 - DNA, 22 bp, Homo sapiens
acagctgtggggactcttgccc

SEQ ID NO: 7983510 - DNA, 22 bp, Homo sapiens
acagctgtggggactcttgccc

SEQ ID NO: 7983511 - DNA, 22 bp, Homo sapiens
acagctgtgggctctgcatata

SEQ ID NO: 7983512 - DNA, 22 bp, Homo sapiens
acagcttcacccattatccctg

SEQ ID NO: 7983513 - DNA, 22 bp, Homo sapiens
acagcttcacccattatccctg

SEQ ID NO: 7983514 - DNA, 22 bp, Homo sapiens
acagcttccagtattcttgaaa

SEQ ID NO: 7983515 - DNA, 22 bp, Homo sapiens
acagcttagccagtcaagctct

SEQ ID NO: 7983516 - DNA, 23 bp, Homo sapiens
acagctgttgaaatttcagtggg

SEQ ID NO: 7983517 - DNA, 22 bp, Homo sapiens
acagctgtgaagcaagcactct

SEQ ID NO: 7983518 - DNA, 22 bp, Homo sapiens
acagctgtgaagcaagcactct

SEQ ID NO: 7983519 - DNA, 22 bp, Homo sapiens
acagctgtgaaaatccacagga

SEQ ID NO: 7983520 - DNA, 21 bp, Homo sapiens
acagctgtcttagcttgggct

SEQ ID NO: 7983521 - DNA, 22 bp, Homo sapiens
acagctgtgaaaatccacagga

SEQ ID NO: 7983522 - DNA, 22 bp, Homo sapiens
agctgggtgaaggcagatggct

SEQ ID NO: 7983523 - DNA, 22 bp, Homo sapiens
acagctgtattcaagttgcaag

SEQ ID NO: 7983524 - DNA, 22 bp, Homo sapiens
agctgggtcttgggccaggaga

SEQ ID NO: 7983525 - DNA, 22 bp, Homo sapiens
agctgggtgaaggcagatggct

SEQ ID NO: 7983526 - DNA, 22 bp, Homo sapiens
acagctgtgatttctatcatga

SEQ ID NO: 7983527 - DNA, 22 bp, Homo sapiens
acagctgtggccacttgcatcc

SEQ ID NO: 7983528 - DNA, 22 bp, Homo sapiens
acagctgtgggctctgcatata

SEQ ID NO: 7983529 - DNA, 22 bp, Homo sapiens
acagctgtgggctctgcatata

SEQ ID NO: 7983530 - DNA, 22 bp, Homo sapiens
acagctgtgggctctgcatata

SEQ ID NO: 7983531 - DNA, 22 bp, Homo sapiens
acagctgtgagggtcacttgta

SEQ ID NO: 7983532 - DNA, 22 bp, Homo sapiens
acagctgtgacttagagaagtt

SEQ ID NO: 7983533 - DNA, 22 bp, Homo sapiens
acagctgtgacttagagaagtt

SEQ ID NO: 7983534 - DNA, 22 bp, Homo sapiens
acagctgtgaagcaagcactct

SEQ ID NO: 7983535 - DNA, 22 bp, Homo sapiens
acagctgtgacttagagaagtt

SEQ ID NO: 7983536 - DNA, 22 bp, Homo sapiens
acagctgtgacttagagaagtt

SEQ ID NO: 7983537 - DNA, 22 bp, Homo sapiens
agctttatcttcacctgggaat

SEQ ID NO: 7983538 - DNA, 22 bp, Homo sapiens
agctttatcttcacctgggaat

SEQ ID NO: 7983539 - DNA, 22 bp, Homo sapiens
agctttatcccttgcccatcga

SEQ ID NO: 7983540 - DNA, 22 bp, Homo sapiens
agctttatgaggagaccttagt

SEQ ID NO: 7983541 - DNA, 22 bp, Homo sapiens
agctttatgcttcctacaagct

SEQ ID NO: 7983542 - DNA, 22 bp, Homo sapiens
agctttatgcttcctacaagct

SEQ ID NO: 7983543 - DNA, 22 bp, Homo sapiens
agctttatcacaatattggcta

SEQ ID NO: 7983544 - DNA, 22 bp, Homo sapiens
acaggcctggggtacaagttct

SEQ ID NO: 7983545 - DNA, 22 bp, Homo sapiens
agctttatcagaggagtctcta

SEQ ID NO: 7983546 - DNA, 22 bp, Homo sapiens
agctttatcagaggagtctcta

SEQ ID NO: 7983547 - DNA, 22 bp, Homo sapiens
acaggcctggaaaggaaggagt

SEQ ID NO: 7983548 - DNA, 22 bp, Homo sapiens
acaggcctggaaaggaaggagt

SEQ ID NO: 7983549 - DNA, 22 bp, Homo sapiens
acaggcctggaaaggaaggagt

SEQ ID NO: 7983550 - DNA, 22 bp, Homo sapiens
acaggcctggggtacaagttct

SEQ ID NO: 7983551 - DNA, 22 bp, Homo sapiens
acaggcctgggttcaaatttgg

SEQ ID NO: 7983552 - DNA, 22 bp, Homo sapiens
acaggcctgggttcaaatttgg

SEQ ID NO: 7983553 - DNA, 22 bp, Homo sapiens
acaggcctggtgctgctgacag

SEQ ID NO: 7983554 - DNA, 18 bp, Homo sapiens
acaggcctcagtcctgca

SEQ ID NO: 7983555 - DNA, 22 bp, Homo sapiens
acaggcctcccatccggagccc

SEQ ID NO: 7983556 - DNA, 22 bp, Homo sapiens
acaggcctcccatccggagccc

SEQ ID NO: 7983557 - DNA, 22 bp, Homo sapiens
acaggcctgacacacagagggc

SEQ ID NO: 7983558 - DNA, 22 bp, Homo sapiens
acaggcctgacacacagagggc

SEQ ID NO: 7983559 - DNA, 22 bp, Homo sapiens
acaggcctgacacacagagggc

SEQ ID NO: 7983560 - DNA, 22 bp, Homo sapiens
acaggcctcccatccggagccc

SEQ ID NO: 7983561 - DNA, 22 bp, Homo sapiens
acaggcctggaaaggaaggagt

SEQ ID NO: 7983562 - DNA, 17 bp, Homo sapiens
acaggcctgcttgcact

SEQ ID NO: 7983563 - DNA, 22 bp, Homo sapiens
acaggcctgatgttatcctatt

SEQ ID NO: 7983564 - DNA, 17 bp, Homo sapiens
acaggcctgcttgcact

SEQ ID NO: 7983565 - DNA, 22 bp, Homo sapiens
acaggcctgatgccttggctgg

SEQ ID NO: 7983566 - DNA, 22 bp, Homo sapiens
acaggcctgatgccttggctgg

SEQ ID NO: 7983567 - DNA, 22 bp, Homo sapiens
acaggcctgagattttgcattt

SEQ ID NO: 7983568 - DNA, 22 bp, Homo sapiens
acaggcctgagattttgcattt

SEQ ID NO: 7983569 - DNA, 18 bp, Homo sapiens
acaggcctcagtcctgca

SEQ ID NO: 7983570 - DNA, 18 bp, Homo sapiens
acaggcctcagtcctgca

SEQ ID NO: 7983571 - DNA, 22 bp, Homo sapiens
acaggcctcaaatagggtgcct

SEQ ID NO: 7983572 - DNA, 22 bp, Homo sapiens
acaggcctcaaatagggtgcct

SEQ ID NO: 7983573 - DNA, 22 bp, Homo sapiens
acaggcctcaaatagggtgcct

SEQ ID NO: 7983574 - DNA, 22 bp, Homo sapiens
acaggcctcaagacacccaggt

SEQ ID NO: 7983575 - DNA, 22 bp, Homo sapiens
acaggcctagctaatgctttcc

SEQ ID NO: 7983576 - DNA, 22 bp, Homo sapiens
acaggcctcaagacacccaggt

SEQ ID NO: 7983577 - DNA, 22 bp, Homo sapiens
acaggcctcaagacacccaggt

SEQ ID NO: 7983578 - DNA, 22 bp, Homo sapiens
acaggcctagggtcaatttcct

SEQ ID NO: 7983579 - DNA, 22 bp, Homo sapiens
acaggcctagggtcaatttcct

SEQ ID NO: 7983580 - DNA, 22 bp, Homo sapiens
acaggcctatgttccattgcag

SEQ ID NO: 7983581 - DNA, 22 bp, Homo sapiens
acaggcctatgttccattgcag

SEQ ID NO: 7983582 - DNA, 22 bp, Homo sapiens
acaggcctcaaatagggtgcct

SEQ ID NO: 7983583 - DNA, 22 bp, Homo sapiens
acaggcctagctaatgctttcc

SEQ ID NO: 7983584 - DNA, 22 bp, Homo sapiens
acaggcccagctcttcaccaga

SEQ ID NO: 7983585 - DNA, 22 bp, Homo sapiens
acaggcctagctaatgctttcc

SEQ ID NO: 7983586 - DNA, 22 bp, Homo sapiens
acaggcctacgaagtcaggtgc

SEQ ID NO: 7983587 - DNA, 22 bp, Homo sapiens
acaggcctacgaagtcaggtgc

SEQ ID NO: 7983588 - DNA, 22 bp, Homo sapiens
acaggcctacgaagtcaggtgc

SEQ ID NO: 7983589 - DNA, 22 bp, Homo sapiens
aggaagggctgtttctccaaga

SEQ ID NO: 7983590 - DNA, 22 bp, Homo sapiens
aggaagggctgtttctccaaga

SEQ ID NO: 7983591 - DNA, 22 bp, Homo sapiens
aggaagggctgtttctccaaga

SEQ ID NO: 7983592 - DNA, 22 bp, Homo sapiens
aggaagggctgtttctccaaga

SEQ ID NO: 7983593 - DNA, 22 bp, Homo sapiens
aggaagggctgtttctccaaga

SEQ ID NO: 7983594 - DNA, 22 bp, Homo sapiens
aggaatgacttgtagctctgag

SEQ ID NO: 7983595 - DNA, 22 bp, Homo sapiens
aggaatgacttgtagctctgag

SEQ ID NO: 7983596 - DNA, 22 bp, Homo sapiens
aggaatgatagtaaaagagaat

SEQ ID NO: 7983597 - DNA, 22 bp, Homo sapiens
aggaatgacttgtagctctgag

SEQ ID NO: 7983598 - DNA, 22 bp, Homo sapiens
aggaatgattcaagacttggct

SEQ ID NO: 7983599 - DNA, 22 bp, Homo sapiens
aggaatgatagtaaaagagaat

SEQ ID NO: 7983600 - DNA, 22 bp, Homo sapiens
aggaatgatagtaaaagagaat

SEQ ID NO: 7983601 - DNA, 22 bp, Homo sapiens
acaggctgttggggtccagggt

SEQ ID NO: 7983602 - DNA, 18 bp, Homo sapiens
acaggctgtgggaatggt

SEQ ID NO: 7983603 - DNA, 18 bp, Homo sapiens
acaggctgtgggaatggt

SEQ ID NO: 7983604 - DNA, 18 bp, Homo sapiens
acaggctgtgggaatggt

SEQ ID NO: 7983605 - DNA, 18 bp, Homo sapiens
acaggctgtgggaatggt

SEQ ID NO: 7983606 - DNA, 18 bp, Homo sapiens
acaggctgtgggaatggt

SEQ ID NO: 7983607 - DNA, 22 bp, Homo sapiens
acaggctggtttgtaaaagatg

SEQ ID NO: 7983608 - DNA, 22 bp, Homo sapiens
acaggctggtttgtaaaagatg

SEQ ID NO: 7983609 - DNA, 22 bp, Homo sapiens
acaggctggtttgtaaaagatg

SEQ ID NO: 7983610 - DNA, 22 bp, Homo sapiens
acaggctgtacttctaatcatc

SEQ ID NO: 7983611 - DNA, 22 bp, Homo sapiens
acaggctgtacttctaatcatc

SEQ ID NO: 7983612 - DNA, 22 bp, Homo sapiens
acaggctgtacttctaatcatc

SEQ ID NO: 7983613 - DNA, 19 bp, Homo sapiens
aggaatggaattaattctg

SEQ ID NO: 7983614 - DNA, 19 bp, Homo sapiens
aggaatggaattaattctg

SEQ ID NO: 7983615 - DNA, 19 bp, Homo sapiens
aggaatggaattaattctg

SEQ ID NO: 7983616 - DNA, 19 bp, Homo sapiens
aggaatggaattaattctg

SEQ ID NO: 7983617 - DNA, 21 bp, Homo sapiens
aggaatgctgaggctcacttt

SEQ ID NO: 7983618 - DNA, 19 bp, Homo sapiens
aggaatggaattaattctg

SEQ ID NO: 7983619 - DNA, 19 bp, Homo sapiens
aggaatggaattaattctg

SEQ ID NO: 7983620 - DNA, 19 bp, Homo sapiens
aggaatggaattaattctg

SEQ ID NO: 7983621 - DNA, 19 bp, Homo sapiens
aggaatggaattaattctg

SEQ ID NO: 7983622 - DNA, 19 bp, Homo sapiens
aggaatggaattaattctg

SEQ ID NO: 7983623 - DNA, 23 bp, Homo sapiens
aggaatggctagaagtgtgaccc

SEQ ID NO: 7983624 - DNA, 23 bp, Homo sapiens
aggaatggctagaagtgtgaccc

SEQ ID NO: 7983625 - DNA, 22 bp, Homo sapiens
aggaatggttatggggatagta

SEQ ID NO: 7983626 - DNA, 22 bp, Homo sapiens
aggaatggttatggggatagta

SEQ ID NO: 7983627 - DNA, 22 bp, Homo sapiens
aggaatggtgctcagcagaaat

SEQ ID NO: 7983628 - DNA, 22 bp, Homo sapiens
aggaatgtcatagaataatcat

SEQ ID NO: 7983629 - DNA, 14 bp, Homo sapiens
aggaatgtcctagg

SEQ ID NO: 7983630 - DNA, 22 bp, Homo sapiens
aggaatgtcatagaataatcat

SEQ ID NO: 7983631 - DNA, 22 bp, Homo sapiens
aggaatgtcaagtagatgtgcg

SEQ ID NO: 7983632 - DNA, 22 bp, Homo sapiens
aggaatgtcaagtagatgtgcg

SEQ ID NO: 7983633 - DNA, 22 bp, Homo sapiens
aggaatgtattgacctgttgca

SEQ ID NO: 7983634 - DNA, 22 bp, Homo sapiens
aggaatgtattgacctgttgca

SEQ ID NO: 7983635 - DNA, 22 bp, Homo sapiens
aggaatgtattattccttctgg

SEQ ID NO: 7983636 - DNA, 22 bp, Homo sapiens
aggaatgtattgacctgttgca

SEQ ID NO: 7983637 - DNA, 22 bp, Homo sapiens
aggaatgtagtttgagtagaaa

SEQ ID NO: 7983638 - DNA, 22 bp, Homo sapiens
aggaatgtattattccttctgg

SEQ ID NO: 7983639 - DNA, 22 bp, Homo sapiens
aggaatgtaatagtgtggctca

SEQ ID NO: 7983640 - DNA, 22 bp, Homo sapiens
aggaatgtaatagtgtggctca

SEQ ID NO: 7983641 - DNA, 22 bp, Homo sapiens
aggaatgtagtttgagtagaaa

SEQ ID NO: 7983642 - DNA, 22 bp, Homo sapiens
aggaatgtaacaggagtaaaaa

SEQ ID NO: 7983643 - DNA, 22 bp, Homo sapiens
aggaatgtaacaggagtaaaaa

SEQ ID NO: 7983644 - DNA, 22 bp, Homo sapiens
aggaatgtaatagtgtggctca

SEQ ID NO: 7983645 - DNA, 22 bp, Homo sapiens
aggaatgtaaatctagatttta

SEQ ID NO: 7983646 - DNA, 22 bp, Homo sapiens
aggaatgtaaatctagatttta

SEQ ID NO: 7983647 - DNA, 22 bp, Homo sapiens
aggaatggttatggggatagta

SEQ ID NO: 7983648 - DNA, 22 bp, Homo sapiens
aggaatggttatggggatagta

SEQ ID NO: 7983649 - DNA, 22 bp, Homo sapiens
agctttatgggagcttagataa

SEQ ID NO: 7983650 - DNA, 22 bp, Homo sapiens
agctttatgggagcttagataa

SEQ ID NO: 7983651 - DNA, 22 bp, Homo sapiens
agctttatgggagcttagataa

SEQ ID NO: 7983652 - DNA, 22 bp, Homo sapiens
agctttatgggagcttagataa

SEQ ID NO: 7983653 - DNA, 22 bp, Homo sapiens
acaggctgcccgctccccacct

SEQ ID NO: 7983654 - DNA, 22 bp, Homo sapiens
acaggctgcccgctccccacct

SEQ ID NO: 7983655 - DNA, 22 bp, Homo sapiens
acaggctgccacttgcatccaa

SEQ ID NO: 7983656 - DNA, 22 bp, Homo sapiens
agctttatgaggagaccttagt

SEQ ID NO: 7983657 - DNA, 22 bp, Homo sapiens
acaggctgccacttgcatccaa

SEQ ID NO: 7983658 - DNA, 22 bp, Homo sapiens
acaggctctggggcaggatggc

SEQ ID NO: 7983659 - DNA, 22 bp, Homo sapiens
acaggctctggggcaggatggc

SEQ ID NO: 7983660 - DNA, 22 bp, Homo sapiens
acaggctgcctaccaagtatca

SEQ ID NO: 7983661 - DNA, 22 bp, Homo sapiens
acaggctgctgagccatttgct

SEQ ID NO: 7983662 - DNA, 22 bp, Homo sapiens
acaggctgctgagccatttgct

SEQ ID NO: 7983663 - DNA, 22 bp, Homo sapiens
acaggctgctgagccatttgct

SEQ ID NO: 7983664 - DNA, 22 bp, Homo sapiens
acaggctgcctaccaagtatca

SEQ ID NO: 7983665 - DNA, 22 bp, Homo sapiens
acaggctgcctaccaagtatca

SEQ ID NO: 7983666 - DNA, 22 bp, Homo sapiens
acaggctgcccgctccccacct

SEQ ID NO: 7983667 - DNA, 22 bp, Homo sapiens
acaggctgcccgctccccacct

SEQ ID NO: 7983668 - DNA, 22 bp, Homo sapiens
acaggctgcccgctccccacct

SEQ ID NO: 7983669 - DNA, 22 bp, Homo sapiens
acaggctggtggtcctggccat

SEQ ID NO: 7983670 - DNA, 22 bp, Homo sapiens
acaggctggtggtcctggccat

SEQ ID NO: 7983671 - DNA, 22 bp, Homo sapiens
acaggctggtggtcctggccat

SEQ ID NO: 7983672 - DNA, 22 bp, Homo sapiens
acaggctggtggtcctggccat

SEQ ID NO: 7983673 - DNA, 22 bp, Homo sapiens
acaggctggtggtcctggccat

SEQ ID NO: 7983674 - DNA, 22 bp, Homo sapiens
acaggctggtggtcctggccat

SEQ ID NO: 7983675 - DNA, 22 bp, Homo sapiens
acaggctggtggtcctggccat

SEQ ID NO: 7983676 - DNA, 22 bp, Homo sapiens
acaggctggtggtcctggccat

SEQ ID NO: 7983677 - DNA, 22 bp, Homo sapiens
acaggctggtggtcctggccat

SEQ ID NO: 7983678 - DNA, 22 bp, Homo sapiens
acaggctggtggtcctggccat

SEQ ID NO: 7983679 - DNA, 22 bp, Homo sapiens
acaggctgggcgcttcctgcgg

SEQ ID NO: 7983680 - DNA, 22 bp, Homo sapiens
acaggctgggcgcttcctgcgg

SEQ ID NO: 7983681 - DNA, 22 bp, Homo sapiens
acaggctgggcgcttcctgcgg

SEQ ID NO: 7983682 - DNA, 22 bp, Homo sapiens
acaggctgggcgcttcctgcgg

SEQ ID NO: 7983683 - DNA, 22 bp, Homo sapiens
acaggctgggcgcttcctgcgg

SEQ ID NO: 7983684 - DNA, 22 bp, Homo sapiens
acaggctgggcgcttcctgcgg

SEQ ID NO: 7983685 - DNA, 22 bp, Homo sapiens
acaggctgggcgcttcctgcgg

SEQ ID NO: 7983686 - DNA, 22 bp, Homo sapiens
acaggctgggcgcttcctgcgg

SEQ ID NO: 7983687 - DNA, 22 bp, Homo sapiens
acaggctgctgggctccgtgct

SEQ ID NO: 7983688 - DNA, 22 bp, Homo sapiens
acaggctgctgggctccgtgct

SEQ ID NO: 7983689 - DNA, 22 bp, Homo sapiens
acaggctgctgggctccgtgct

SEQ ID NO: 7983690 - DNA, 22 bp, Homo sapiens
acaggctgctgggctccgtgct

SEQ ID NO: 7983691 - DNA, 22 bp, Homo sapiens
acaggctgctgggctccgtgct

SEQ ID NO: 7983692 - DNA, 22 bp, Homo sapiens
acaggctgctgggctccgtgct

SEQ ID NO: 7983693 - DNA, 22 bp, Homo sapiens
acaggctggaggaggaccaaga

SEQ ID NO: 7983694 - DNA, 22 bp, Homo sapiens
acaggctgctgggctccgtgct

SEQ ID NO: 7983695 - DNA, 22 bp, Homo sapiens
acaggctgctgggctccgtgct

SEQ ID NO: 7983696 - DNA, 22 bp, Homo sapiens
acaggctgggcgcttcctgcgg

SEQ ID NO: 7983697 - DNA, 22 bp, Homo sapiens
acaggctggaggaggaccaaga

SEQ ID NO: 7983698 - DNA, 22 bp, Homo sapiens
acagcagaataatgagtaatag

SEQ ID NO: 7983699 - DNA, 22 bp, Homo sapiens
acagcactttacttctcagtga

SEQ ID NO: 7983700 - DNA, 22 bp, Homo sapiens
acagcagacacaggcacgctgt

SEQ ID NO: 7983701 - DNA, 22 bp, Homo sapiens
acagcagacacaggcacgctgt

SEQ ID NO: 7983702 - DNA, 22 bp, Homo sapiens
acagcagacacaggcacgctgt

SEQ ID NO: 7983703 - DNA, 22 bp, Homo sapiens
acagcagaataatgagtaatag

SEQ ID NO: 7983704 - DNA, 22 bp, Homo sapiens
acagcacttattcagcacagtg

SEQ ID NO: 7983705 - DNA, 23 bp, Homo sapiens
acagcacccatgtcatctggctc

SEQ ID NO: 7983706 - DNA, 22 bp, Homo sapiens
acagcacaggagttgaatgggc

SEQ ID NO: 7983707 - DNA, 22 bp, Homo sapiens
acagcacaggagttgaatgggc

SEQ ID NO: 7983708 - DNA, 23 bp, Homo sapiens
acagcacccatgtcatctggctc

SEQ ID NO: 7983709 - DNA, 22 bp, Homo sapiens
agctgccagcatcccggaaggg

SEQ ID NO: 7983710 - DNA, 22 bp, Homo sapiens
agctgccagcatcccggaaggg

SEQ ID NO: 7983711 - DNA, 22 bp, Homo sapiens
agctgcaggcccatgctcagtc

SEQ ID NO: 7983712 - DNA, 22 bp, Homo sapiens
agctgcaggcccatgctcagtc

SEQ ID NO: 7983713 - DNA, 22 bp, Homo sapiens
agctgcaggcccatgctcagtc

SEQ ID NO: 7983714 - DNA, 22 bp, Homo sapiens
acagcagacagtcggcttcctg

SEQ ID NO: 7983715 - DNA, 21 bp, Homo sapiens
acagcagacaggcttaggacc

SEQ ID NO: 7983716 - DNA, 21 bp, Homo sapiens
acagcagacaggcttaggacc

SEQ ID NO: 7983717 - DNA, 22 bp, Homo sapiens
acagcagacagtcggcttcctg

SEQ ID NO: 7983718 - DNA, 22 bp, Homo sapiens
acagcagacattgggtgattga

SEQ ID NO: 7983719 - DNA, 22 bp, Homo sapiens
acagcagacagtcggcttcctg

SEQ ID NO: 7983720 - DNA, 17 bp, Homo sapiens
agctgccagggagtgtg

SEQ ID NO: 7983721 - DNA, 17 bp, Homo sapiens
agctgccagggagtgtg

SEQ ID NO: 7983722 - DNA, 22 bp, Homo sapiens
agctgccagggactgggcatgg

SEQ ID NO: 7983723 - DNA, 22 bp, Homo sapiens
agctgccaggcccctgagaacc

SEQ ID NO: 7983724 - DNA, 22 bp, Homo sapiens
agctgccaggcccctgagaacc

SEQ ID NO: 7983725 - DNA, 22 bp, Homo sapiens
agctgccaggcccctgagaacc

SEQ ID NO: 7983726 - DNA, 22 bp, Homo sapiens
agctgccatcagcctttggatg

SEQ ID NO: 7983727 - DNA, 22 bp, Homo sapiens
agctgccatccgaggtgtcaga

SEQ ID NO: 7983728 - DNA, 17 bp, Homo sapiens
agctgccagggagtgtg

SEQ ID NO: 7983729 - DNA, 22 bp, Homo sapiens
agctgccatcctgttcagcacc

SEQ ID NO: 7983730 - DNA, 22 bp, Homo sapiens
agctgccatctgaagaactgca

SEQ ID NO: 7983731 - DNA, 21 bp, Homo sapiens
agctgcccagagtagggaagg

SEQ ID NO: 7983732 - DNA, 22 bp, Homo sapiens
agctgcccagataggaggaggc

SEQ ID NO: 7983733 - DNA, 22 bp, Homo sapiens
agctgccatctgaagaactgca

SEQ ID NO: 7983734 - DNA, 22 bp, Homo sapiens
agctgccatctgaagaactgca

SEQ ID NO: 7983735 - DNA, 22 bp, Homo sapiens
agctgcccaatcctgcagggcg

SEQ ID NO: 7983736 - DNA, 22 bp, Homo sapiens
agctgcccaatcctgcagggcg

SEQ ID NO: 7983737 - DNA, 19 bp, Homo sapiens
agctgcctgtgcgcgcccg

SEQ ID NO: 7983738 - DNA, 19 bp, Homo sapiens
agctgcctgtgcgcgcccg

SEQ ID NO: 7983739 - DNA, 22 bp, Homo sapiens
agctgcctgtgctgggagccca

SEQ ID NO: 7983740 - DNA, 22 bp, Homo sapiens
agctgcctgtgctgggagccca

SEQ ID NO: 7983741 - DNA, 22 bp, Homo sapiens
agctgcctgtcctaggccatca

SEQ ID NO: 7983742 - DNA, 22 bp, Homo sapiens
agctgcctgtcctaggccatca

SEQ ID NO: 7983743 - DNA, 20 bp, Homo sapiens
agctgccttcattttctaga

SEQ ID NO: 7983744 - DNA, 20 bp, Homo sapiens
agctgccttcattttctaga

SEQ ID NO: 7983745 - DNA, 22 bp, Homo sapiens
agctgccttatggagtatgaaa

SEQ ID NO: 7983746 - DNA, 22 bp, Homo sapiens
agctgccttatggagtatgaaa

SEQ ID NO: 7983747 - DNA, 22 bp, Homo sapiens
agctgccttaaattactttgtg

SEQ ID NO: 7983748 - DNA, 22 bp, Homo sapiens
agctgcctgtgtagaaccatct

SEQ ID NO: 7983749 - DNA, 22 bp, Homo sapiens
agctgccttaaattactttgtg

SEQ ID NO: 7983750 - DNA, 22 bp, Homo sapiens
agctgcccccagggctgtgctt

SEQ ID NO: 7983751 - DNA, 22 bp, Homo sapiens
agctgcccccagggctgtgctt

SEQ ID NO: 7983752 - DNA, 22 bp, Homo sapiens
agctgccccatgagaggcaggt

SEQ ID NO: 7983753 - DNA, 22 bp, Homo sapiens
agctgccccatgagaggcaggt

SEQ ID NO: 7983754 - DNA, 22 bp, Homo sapiens
agctgccccatgagaggcaggt

SEQ ID NO: 7983755 - DNA, 22 bp, Homo sapiens
agctgcccaggttcattgggcc

SEQ ID NO: 7983756 - DNA, 22 bp, Homo sapiens
agctgcccaggttcattgggcc

SEQ ID NO: 7983757 - DNA, 22 bp, Homo sapiens
agctgcccaggttcattgggcc

SEQ ID NO: 7983758 - DNA, 22 bp, Homo sapiens
agctgcctgtcctaggccatca

SEQ ID NO: 7983759 - DNA, 22 bp, Homo sapiens
agctgcctgtaaaatgtgtgat

SEQ ID NO: 7983760 - DNA, 22 bp, Homo sapiens
agctgcctgtaaaatgtgtgat

SEQ ID NO: 7983761 - DNA, 22 bp, Homo sapiens
agctgcctgtaaaatgtgtgat

SEQ ID NO: 7983762 - DNA, 22 bp, Homo sapiens
agctgcctgggcttgtacacct

SEQ ID NO: 7983763 - DNA, 22 bp, Homo sapiens
agctgcccccagggctgtgctt

SEQ ID NO: 7983764 - DNA, 22 bp, Homo sapiens
agctgcctgggcttgtacacct

SEQ ID NO: 7983765 - DNA, 15 bp, Homo sapiens
agctgcctgggtgct

SEQ ID NO: 7983766 - DNA, 22 bp, Homo sapiens
agctgccttttgagaaagctca

SEQ ID NO: 7983767 - DNA, 22 bp, Homo sapiens
agctgcctttgcatcactttaa

SEQ ID NO: 7983768 - DNA, 21 bp, Homo sapiens
agctgcctttagagagaacca

SEQ ID NO: 7983769 - DNA, 22 bp, Homo sapiens
agctgcctttgcatcactttaa

SEQ ID NO: 7983770 - DNA, 22 bp, Homo sapiens
agctgcctttgcatcactttaa

SEQ ID NO: 7983771 - DNA, 22 bp, Homo sapiens
agctgctagttcctgttctcac

SEQ ID NO: 7983772 - DNA, 22 bp, Homo sapiens
agctgccttttgagaaagctca

SEQ ID NO: 7983773 - DNA, 22 bp, Homo sapiens
agctgctactgctctgccagag

SEQ ID NO: 7983774 - DNA, 17 bp, Homo sapiens
agctgccttgcttgagc

SEQ ID NO: 7983775 - DNA, 17 bp, Homo sapiens
agctgccttgcttgagc

SEQ ID NO: 7983776 - DNA, 21 bp, Homo sapiens
agctgcctttagagagaacca

SEQ ID NO: 7983777 - DNA, 17 bp, Homo sapiens
agctgccttgcttgagc

SEQ ID NO: 7983778 - DNA, 22 bp, Homo sapiens
agctgccttccctctcattagg

SEQ ID NO: 7983779 - DNA, 20 bp, Homo sapiens
agctgccttcattttctaga

SEQ ID NO: 7983780 - DNA, 22 bp, Homo sapiens
agctgccttccctctcattagg

SEQ ID NO: 7983781 - DNA, 22 bp, Homo sapiens
acagccttgggttctctggggg

SEQ ID NO: 7983782 - DNA, 22 bp, Homo sapiens
acagcctgctgcctgcttcttg

SEQ ID NO: 7983783 - DNA, 22 bp, Homo sapiens
acagcctgctgcctgcttcttg

SEQ ID NO: 7983784 - DNA, 22 bp, Homo sapiens
acagcctgctgcctgcttcttg

SEQ ID NO: 7983785 - DNA, 22 bp, Homo sapiens
acagcctgctgcctgcttcttg

SEQ ID NO: 7983786 - DNA, 22 bp, Homo sapiens
agctgctatctccagatgtttg

SEQ ID NO: 7983787 - DNA, 19 bp, Homo sapiens
agctggggcggtgtgtgtt

SEQ ID NO: 7983788 - DNA, 19 bp, Homo sapiens
agctggggcggtgtgtgtt

SEQ ID NO: 7983789 - DNA, 22 bp, Homo sapiens
agctggggctgcagagaacagg

SEQ ID NO: 7983790 - DNA, 22 bp, Homo sapiens
agctggggctgcagagaacagg

SEQ ID NO: 7983791 - DNA, 22 bp, Homo sapiens
agctggggctgcagagaacagg

SEQ ID NO: 7983792 - DNA, 22 bp, Homo sapiens
agctggggctgcagagaacagg

SEQ ID NO: 7983793 - DNA, 22 bp, Homo sapiens
agctgggcaccccgctgcgtct

SEQ ID NO: 7983794 - DNA, 20 bp, Homo sapiens
agctgggcaattatgactat

SEQ ID NO: 7983795 - DNA, 20 bp, Homo sapiens
agctgggcaattatgactat

SEQ ID NO: 7983796 - DNA, 20 bp, Homo sapiens
agctgggcaattatgactat

SEQ ID NO: 7983797 - DNA, 20 bp, Homo sapiens
agctgggcaattatgactat

SEQ ID NO: 7983798 - DNA, 20 bp, Homo sapiens
agctgggcaattatgactat

SEQ ID NO: 7983799 - DNA, 22 bp, Homo sapiens
acagctgccaagacagagcagg

SEQ ID NO: 7983800 - DNA, 22 bp, Homo sapiens
acagctgccaagacagagcagg

SEQ ID NO: 7983801 - DNA, 22 bp, Homo sapiens
acagctgccaagacagagcagg

SEQ ID NO: 7983802 - DNA, 23 bp, Homo sapiens
agctgggcaaggatccgggctcc

SEQ ID NO: 7983803 - DNA, 23 bp, Homo sapiens
agctgggcaaggatccgggctcc

SEQ ID NO: 7983804 - DNA, 23 bp, Homo sapiens
agctgggcaaggatccgggctcc

SEQ ID NO: 7983805 - DNA, 23 bp, Homo sapiens
acagctgcacctggccgcctggc

SEQ ID NO: 7983806 - DNA, 23 bp, Homo sapiens
acagctgcacctggccgcctggc

SEQ ID NO: 7983807 - DNA, 22 bp, Homo sapiens
acagctgcatgatggtccagat

SEQ ID NO: 7983808 - DNA, 22 bp, Homo sapiens
acagctgcacttgaagcaggtt

SEQ ID NO: 7983809 - DNA, 22 bp, Homo sapiens
acagctgcatgatggtccagat

SEQ ID NO: 7983810 - DNA, 22 bp, Homo sapiens
acagctgcacttgaagcaggtt

SEQ ID NO: 7983811 - DNA, 22 bp, Homo sapiens
acagctgcacttgaagcaggtt

SEQ ID NO: 7983812 - DNA, 22 bp, Homo sapiens
acagctgcacttgaagcaggtt

SEQ ID NO: 7983813 - DNA, 22 bp, Homo sapiens
acagctgcatgatggtccagat

SEQ ID NO: 7983814 - DNA, 22 bp, Homo sapiens
acagctgcattcttaacaggaa

SEQ ID NO: 7983815 - DNA, 22 bp, Homo sapiens
acagctgcatgatggtccagat

SEQ ID NO: 7983816 - DNA, 22 bp, Homo sapiens
acagctgcatgatggtccagat

SEQ ID NO: 7983817 - DNA, 22 bp, Homo sapiens
acagctgcattcttaacaggaa

SEQ ID NO: 7983818 - DNA, 22 bp, Homo sapiens
acagctgcattcttaacaggaa

SEQ ID NO: 7983819 - DNA, 23 bp, Homo sapiens
acagctgcacctggccgcctggc

SEQ ID NO: 7983820 - DNA, 23 bp, Homo sapiens
acagctgcacctggccgcctggc

SEQ ID NO: 7983821 - DNA, 22 bp, Homo sapiens
acagctgcacactgaacttggt

SEQ ID NO: 7983822 - DNA, 22 bp, Homo sapiens
acagctgcacactgaacttggt

SEQ ID NO: 7983823 - DNA, 22 bp, Homo sapiens
acagctgcacactgaacttggt

SEQ ID NO: 7983824 - DNA, 22 bp, Homo sapiens
acagctgcaaattgttagagga

SEQ ID NO: 7983825 - DNA, 22 bp, Homo sapiens
acagctgcaaattgttagagga

SEQ ID NO: 7983826 - DNA, 22 bp, Homo sapiens
acagctgcacactgaacttggt

SEQ ID NO: 7983827 - DNA, 22 bp, Homo sapiens
acagctgcaaattgttagagga

SEQ ID NO: 7983828 - DNA, 22 bp, Homo sapiens
agctggggctgcagagaacagg

SEQ ID NO: 7983829 - DNA, 22 bp, Homo sapiens
acagctgccaagacagagcagg

SEQ ID NO: 7983830 - DNA, 22 bp, Homo sapiens
agctggggctgcagagaacagg

SEQ ID NO: 7983831 - DNA, 22 bp, Homo sapiens
agctggggctgtggttgtgatt

SEQ ID NO: 7983832 - DNA, 22 bp, Homo sapiens
agctggggctgtggttgtgatt

SEQ ID NO: 7983833 - DNA, 22 bp, Homo sapiens
agctggggctgtggttgtgatt

SEQ ID NO: 7983834 - DNA, 22 bp, Homo sapiens
agctggggctgtggttgtgatt

SEQ ID NO: 7983835 - DNA, 22 bp, Homo sapiens
agctgggggtagtgagaaataa

SEQ ID NO: 7983836 - DNA, 22 bp, Homo sapiens
agctgggggtagtgagaaataa

SEQ ID NO: 7983837 - DNA, 22 bp, Homo sapiens
agctgggggtagtgagaaataa

SEQ ID NO: 7983838 - DNA, 22 bp, Homo sapiens
agctgggggttggataagggta

SEQ ID NO: 7983839 - DNA, 22 bp, Homo sapiens
agctggggttgcacacattttg

SEQ ID NO: 7983840 - DNA, 22 bp, Homo sapiens
agctggggttgcacacattttg

SEQ ID NO: 7983841 - DNA, 22 bp, Homo sapiens
agctgggggttggataagggta

SEQ ID NO: 7983842 - DNA, 22 bp, Homo sapiens
agctggggttgcacacattttg

SEQ ID NO: 7983843 - DNA, 22 bp, Homo sapiens
agctgggtacagcctgtgccta

SEQ ID NO: 7983844 - DNA, 22 bp, Homo sapiens
agctgggtacagcctgtgccta

SEQ ID NO: 7983845 - DNA, 22 bp, Homo sapiens
agctgggtacagcctgtgccta

SEQ ID NO: 7983846 - DNA, 22 bp, Homo sapiens
agctgggtactgatgtcttcag

SEQ ID NO: 7983847 - DNA, 22 bp, Homo sapiens
agctgggtactgatgtcttcag

SEQ ID NO: 7983848 - DNA, 22 bp, Homo sapiens
agctgggtccctctgctgatgg

SEQ ID NO: 7983849 - DNA, 22 bp, Homo sapiens
acagctatagacgatgtataga

SEQ ID NO: 7983850 - DNA, 22 bp, Homo sapiens
acagctatctgactttgactca

SEQ ID NO: 7983851 - DNA, 22 bp, Homo sapiens
acagctcactcacagggctagt

SEQ ID NO: 7983852 - DNA, 22 bp, Homo sapiens
acagctatgacagatggataat

SEQ ID NO: 7983853 - DNA, 22 bp, Homo sapiens
acagctatagacgatgtataga

SEQ ID NO: 7983854 - DNA, 22 bp, Homo sapiens
acagctatagacgatgtataga

SEQ ID NO: 7983855 - DNA, 22 bp, Homo sapiens
acagctaggtcttcagcacttt

SEQ ID NO: 7983856 - DNA, 22 bp, Homo sapiens
acagctactctgcagataaatc

SEQ ID NO: 7983857 - DNA, 22 bp, Homo sapiens
acagctactctgcagataaatc

SEQ ID NO: 7983858 - DNA, 22 bp, Homo sapiens
acagctcagacatcactgctct

SEQ ID NO: 7983859 - DNA, 22 bp, Homo sapiens
acagctcagacatcactgctct

SEQ ID NO: 7983860 - DNA, 22 bp, Homo sapiens
acagctcactcacagggctagt

SEQ ID NO: 7983861 - DNA, 22 bp, Homo sapiens
acagctcatttgtaaaacggag

SEQ ID NO: 7983862 - DNA, 22 bp, Homo sapiens
acagctcctaacaaaggctctc

SEQ ID NO: 7983863 - DNA, 22 bp, Homo sapiens
acagctcagacatcactgctct

SEQ ID NO: 7983864 - DNA, 22 bp, Homo sapiens
acagctcagacatcactgctct

SEQ ID NO: 7983865 - DNA, 22 bp, Homo sapiens
acagctcagacatcactgctct

SEQ ID NO: 7983866 - DNA, 22 bp, Homo sapiens
acagctactctgcagataaatc

SEQ ID NO: 7983867 - DNA, 22 bp, Homo sapiens
acagctactctgcagataaatc

SEQ ID NO: 7983868 - DNA, 22 bp, Homo sapiens
acagctactctgcagataaatc

SEQ ID NO: 7983869 - DNA, 22 bp, Homo sapiens
acagctacatggaatttcattt

SEQ ID NO: 7983870 - DNA, 22 bp, Homo sapiens
acagctacatcaaactcagaag

SEQ ID NO: 7983871 - DNA, 22 bp, Homo sapiens
acagctacatcaaactcagaag

SEQ ID NO: 7983872 - DNA, 22 bp, Homo sapiens
acagctaatccccctagattct

SEQ ID NO: 7983873 - DNA, 22 bp, Homo sapiens
acagctacatcaaactcagaag

SEQ ID NO: 7983874 - DNA, 22 bp, Homo sapiens
acagctaatccccctagattct

SEQ ID NO: 7983875 - DNA, 22 bp, Homo sapiens
acagcgggaatgtggtaggtgg

SEQ ID NO: 7983876 - DNA, 22 bp, Homo sapiens
acagctaacttaaactaaccta

SEQ ID NO: 7983877 - DNA, 22 bp, Homo sapiens
acagctaacttaaactaaccta

SEQ ID NO: 7983878 - DNA, 22 bp, Homo sapiens
acagcgagaatgtaaggagccc

SEQ ID NO: 7983879 - DNA, 22 bp, Homo sapiens
acagcgagaaactaaacagggg

SEQ ID NO: 7983880 - DNA, 22 bp, Homo sapiens
acagcgggaatgtggtaggtgg

SEQ ID NO: 7983881 - DNA, 22 bp, Homo sapiens
acagcgagaatgtaaggagccc

SEQ ID NO: 7983882 - DNA, 22 bp, Homo sapiens
acagctcctaacaaaggctctc

SEQ ID NO: 7983883 - DNA, 22 bp, Homo sapiens
acagctcatttgtaaaacggag

SEQ ID NO: 7983884 - DNA, 22 bp, Homo sapiens
acagctcagacatcactgctct

SEQ ID NO: 7983885 - DNA, 22 bp, Homo sapiens
acagctcctactgaagccatgt

SEQ ID NO: 7983886 - DNA, 22 bp, Homo sapiens
acagctctccctcagagaaatg

SEQ ID NO: 7983887 - DNA, 22 bp, Homo sapiens
acagctcctggggctttaatgg

SEQ ID NO: 7983888 - DNA, 22 bp, Homo sapiens
acagctcctggggctttaatgg

SEQ ID NO: 7983889 - DNA, 22 bp, Homo sapiens
acagctcctactgaagccatgt

SEQ ID NO: 7983890 - DNA, 22 bp, Homo sapiens
acagctcctggggctttaatgg

SEQ ID NO: 7983891 - DNA, 22 bp, Homo sapiens
acagctctccctcagagaaatg

SEQ ID NO: 7983892 - DNA, 22 bp, Homo sapiens
acagctctgggtgcaggaggtg

SEQ ID NO: 7983893 - DNA, 22 bp, Homo sapiens
acagctgatagttacctctgtc

SEQ ID NO: 7983894 - DNA, 22 bp, Homo sapiens
acagctgattggatcaaggaca

SEQ ID NO: 7983895 - DNA, 22 bp, Homo sapiens
acagctgaacaagatagtgtca

SEQ ID NO: 7983896 - DNA, 22 bp, Homo sapiens
acagctgaacaagatagtgtca

SEQ ID NO: 7983897 - DNA, 22 bp, Homo sapiens
acagctgaaaccagggatctgg

SEQ ID NO: 7983898 - DNA, 22 bp, Homo sapiens
acagctcttcttcaagcctggc

SEQ ID NO: 7983899 - DNA, 22 bp, Homo sapiens
acagctcttaggcagaaccaac

SEQ ID NO: 7983900 - DNA, 22 bp, Homo sapiens
acagctcttaggcagaaccaac

SEQ ID NO: 7983901 - DNA, 18 bp, Homo sapiens
acagggagggcgctgggg

SEQ ID NO: 7983902 - DNA, 18 bp, Homo sapiens
acagggagggcgctgggg

SEQ ID NO: 7983903 - DNA, 18 bp, Homo sapiens
acagggagggcgctgggg

SEQ ID NO: 7983904 - DNA, 18 bp, Homo sapiens
acagggagggcgctgggg

SEQ ID NO: 7983905 - DNA, 18 bp, Homo sapiens
acagggagggcgctgggg

SEQ ID NO: 7983906 - DNA, 18 bp, Homo sapiens
acagggagggcgctgggg

SEQ ID NO: 7983907 - DNA, 18 bp, Homo sapiens
acagggagggcgctgggg

SEQ ID NO: 7983908 - DNA, 18 bp, Homo sapiens
acagggagggcgctgggg

SEQ ID NO: 7983909 - DNA, 18 bp, Homo sapiens
acagggagggcgctgggg

SEQ ID NO: 7983910 - DNA, 18 bp, Homo sapiens
acagggagggcgctgggg

SEQ ID NO: 7983911 - DNA, 22 bp, Homo sapiens
acagggagtgcaattcatattg

SEQ ID NO: 7983912 - DNA, 22 bp, Homo sapiens
acagggagtgcaattcatattg

SEQ ID NO: 7983913 - DNA, 22 bp, Homo sapiens
acagggagtctgaggggatagt

SEQ ID NO: 7983914 - DNA, 22 bp, Homo sapiens
acagggagtctgaggggatagt

SEQ ID NO: 7983915 - DNA, 22 bp, Homo sapiens
acagggagtctgaggggatagt

SEQ ID NO: 7983916 - DNA, 22 bp, Homo sapiens
acagggagtctgaggggatagt

SEQ ID NO: 7983917 - DNA, 22 bp, Homo sapiens
acagggagtctgaggggatagt

SEQ ID NO: 7983918 - DNA, 22 bp, Homo sapiens
acagggagtctgaggggatagt

SEQ ID NO: 7983919 - DNA, 22 bp, Homo sapiens
acagggagtctgaggggatagt

SEQ ID NO: 7983920 - DNA, 18 bp, Homo sapiens
acagggatggggtaagtg

SEQ ID NO: 7983921 - DNA, 22 bp, Homo sapiens
acagggcaacctctgggagact

SEQ ID NO: 7983922 - DNA, 22 bp, Homo sapiens
acagggcaacctctgggagact

SEQ ID NO: 7983923 - DNA, 22 bp, Homo sapiens
acagggcaacctctgggagact

SEQ ID NO: 7983924 - DNA, 22 bp, Homo sapiens
acagggcaacctctgggagact

SEQ ID NO: 7983925 - DNA, 22 bp, Homo sapiens
acagggcaacctctgggagact

SEQ ID NO: 7983926 - DNA, 22 bp, Homo sapiens
acagggcaacctctgggagact

SEQ ID NO: 7983927 - DNA, 22 bp, Homo sapiens
acaggtggagtggttagcaggc

SEQ ID NO: 7983928 - DNA, 22 bp, Homo sapiens
acaggtggacacagcagcagtc

SEQ ID NO: 7983929 - DNA, 22 bp, Homo sapiens
acaggtggaggctttaggaggt

SEQ ID NO: 7983930 - DNA, 22 bp, Homo sapiens
acaggtggcataggcagtttga

SEQ ID NO: 7983931 - DNA, 22 bp, Homo sapiens
acaggtggcagaagcatttact

SEQ ID NO: 7983932 - DNA, 22 bp, Homo sapiens
acaggtggcactgctgttactc

SEQ ID NO: 7983933 - DNA, 22 bp, Homo sapiens
acagggtggggatggtgagctt

SEQ ID NO: 7983934 - DNA, 22 bp, Homo sapiens
acagggcacctgaggtaggaag

SEQ ID NO: 7983935 - DNA, 22 bp, Homo sapiens
acagggcacctgaggtaggaag

SEQ ID NO: 7983936 - DNA, 22 bp, Homo sapiens
acagggtggggatggtgagctt

SEQ ID NO: 7983937 - DNA, 22 bp, Homo sapiens
acagggcacctgaggtaggaag

SEQ ID NO: 7983938 - DNA, 22 bp, Homo sapiens
acagggcacctgaggtaggaag

SEQ ID NO: 7983939 - DNA, 22 bp, Homo sapiens
acagggcacctgaggtaggaag

SEQ ID NO: 7983940 - DNA, 22 bp, Homo sapiens
acaggtggacacagcagcagtc

SEQ ID NO: 7983941 - DNA, 22 bp, Homo sapiens
acaggtggacacagcagcagtc

SEQ ID NO: 7983942 - DNA, 22 bp, Homo sapiens
acaggtggacacagcagcagtc

SEQ ID NO: 7983943 - DNA, 22 bp, Homo sapiens
acaggtggacacagcagcagtc

SEQ ID NO: 7983944 - DNA, 22 bp, Homo sapiens
acagggttgtggccttaaaggc

SEQ ID NO: 7983945 - DNA, 22 bp, Homo sapiens
acagggcacctgaggtaggaag

SEQ ID NO: 7983946 - DNA, 22 bp, Homo sapiens
acaggtggtctttgctcctttt

SEQ ID NO: 7983947 - DNA, 22 bp, Homo sapiens
acaggtggtctttgctcctttt

SEQ ID NO: 7983948 - DNA, 22 bp, Homo sapiens
acaggtggtctttgctcctttt

SEQ ID NO: 7983949 - DNA, 22 bp, Homo sapiens
acaggtgtaaaacccaggatgg

SEQ ID NO: 7983950 - DNA, 22 bp, Homo sapiens
acaggtgtaaaacccaggatgg

SEQ ID NO: 7983951 - DNA, 22 bp, Homo sapiens
acaggtgtaaaacccaggatgg

SEQ ID NO: 7983952 - DNA, 22 bp, Homo sapiens
aggagctggagtccaggcaagt

SEQ ID NO: 7983953 - DNA, 22 bp, Homo sapiens
aggagctggagtccaggcaagt

SEQ ID NO: 7983954 - DNA, 22 bp, Homo sapiens
aggagctggagtccaggcaagt

SEQ ID NO: 7983955 - DNA, 22 bp, Homo sapiens
aggagctggagtccaggcaagt

SEQ ID NO: 7983956 - DNA, 21 bp, Homo sapiens
aggagctgtgttagctggtcg

SEQ ID NO: 7983957 - DNA, 21 bp, Homo sapiens
aggagctgtgtgcttcctttc

SEQ ID NO: 7983958 - DNA, 21 bp, Homo sapiens
aggagctgtgttagctggtcg

SEQ ID NO: 7983959 - DNA, 21 bp, Homo sapiens
aggagctgtgttagctggtcg

SEQ ID NO: 7983960 - DNA, 21 bp, Homo sapiens
aggagctgtgttagctggtcg

SEQ ID NO: 7983961 - DNA, 21 bp, Homo sapiens
aggagctgtgttagctggtcg

SEQ ID NO: 7983962 - DNA, 21 bp, Homo sapiens
aggagctgtgttagctggtcg

SEQ ID NO: 7983963 - DNA, 22 bp, Homo sapiens
aggagcttcagagagaacctgg

SEQ ID NO: 7983964 - DNA, 20 bp, Homo sapiens
aggaggaaaaaatgacgagc

SEQ ID NO: 7983965 - DNA, 20 bp, Homo sapiens
aggaggaaaaaatgacgagc

SEQ ID NO: 7983966 - DNA, 20 bp, Homo sapiens
aggaggaaaaaatgacgagc

SEQ ID NO: 7983967 - DNA, 22 bp, Homo sapiens
aggagctgttttgttcagcaaa

SEQ ID NO: 7983968 - DNA, 22 bp, Homo sapiens
aggagctgttttgttcagcaaa

SEQ ID NO: 7983969 - DNA, 22 bp, Homo sapiens
acaggtggccccgagggagtgg

SEQ ID NO: 7983970 - DNA, 22 bp, Homo sapiens
acaggtggcataggcagtttga

SEQ ID NO: 7983971 - DNA, 22 bp, Homo sapiens
acaggtggcttattggctgatt

SEQ ID NO: 7983972 - DNA, 22 bp, Homo sapiens
acaggtggcttattggctgatt

SEQ ID NO: 7983973 - DNA, 22 bp, Homo sapiens
acaggtggcttattggctgatt

SEQ ID NO: 7983974 - DNA, 22 bp, Homo sapiens
acaggtggcttattggctgatt

SEQ ID NO: 7983975 - DNA, 22 bp, Homo sapiens
acaggtggcttattggctgatt

SEQ ID NO: 7983976 - DNA, 22 bp, Homo sapiens
acaggtggcttattggctgatt

SEQ ID NO: 7983977 - DNA, 22 bp, Homo sapiens
acaggtggtaaaatggactgtc

SEQ ID NO: 7983978 - DNA, 22 bp, Homo sapiens
acaggtggtagagtggaaagag

SEQ ID NO: 7983979 - DNA, 22 bp, Homo sapiens
acaggtggtaaaatggactgtc

SEQ ID NO: 7983980 - DNA, 22 bp, Homo sapiens
acaggtggtaaaatggactgtc

SEQ ID NO: 7983981 - DNA, 22 bp, Homo sapiens
acaggtgggcttaagagtcggc

SEQ ID NO: 7983982 - DNA, 22 bp, Homo sapiens
acaggtggggcacttggagcct

SEQ ID NO: 7983983 - DNA, 22 bp, Homo sapiens
acaggtggggaggctgaggttc

SEQ ID NO: 7983984 - DNA, 22 bp, Homo sapiens
aggagtgcaaatagtccagaga

SEQ ID NO: 7983985 - DNA, 22 bp, Homo sapiens
aggagtgcaaatagtccagaga

SEQ ID NO: 7983986 - DNA, 22 bp, Homo sapiens
aggagtgagtgtcctcagcaga

SEQ ID NO: 7983987 - DNA, 22 bp, Homo sapiens
aggagtgctgcaagttgacaga

SEQ ID NO: 7983988 - DNA, 22 bp, Homo sapiens
aggagtgccttttcatgagtgt

SEQ ID NO: 7983989 - DNA, 22 bp, Homo sapiens
aggagtgccttttcatgagtgt

SEQ ID NO: 7983990 - DNA, 22 bp, Homo sapiens
acagtgaggacagggactgtgt

SEQ ID NO: 7983991 - DNA, 22 bp, Homo sapiens
aggagtggaattactgggttct

SEQ ID NO: 7983992 - DNA, 22 bp, Homo sapiens
acagtgaggacagggactgtgt

SEQ ID NO: 7983993 - DNA, 22 bp, Homo sapiens
aggagtgctgcaagttgacaga

SEQ ID NO: 7983994 - DNA, 22 bp, Homo sapiens
aggagtggaattactgggttct

SEQ ID NO: 7983995 - DNA, 22 bp, Homo sapiens
aggagtgctgcaagttgacaga

SEQ ID NO: 7983996 - DNA, 22 bp, Homo sapiens
aggagtggaattactgggttct

SEQ ID NO: 7983997 - DNA, 22 bp, Homo sapiens
aggagtggaattactgggttct

SEQ ID NO: 7983998 - DNA, 22 bp, Homo sapiens
aggagtctgttgaaatgtctat

SEQ ID NO: 7983999 - DNA, 22 bp, Homo sapiens
aggagtctgttgaaatgtctat

SEQ ID NO: 7984000 - DNA, 22 bp, Homo sapiens
aggagtgagctttggggtcaga

SEQ ID NO: 7984001 - DNA, 22 bp, Homo sapiens
aggagtgagtgtcctcagcaga

SEQ ID NO: 7984002 - DNA, 22 bp, Homo sapiens
aggagtcctcatgtctgtgcga

SEQ ID NO: 7984003 - DNA, 20 bp, Homo sapiens
aggagtccctgtgctctctc

SEQ ID NO: 7984004 - DNA, 20 bp, Homo sapiens
aggagtccctgtgctctctc

SEQ ID NO: 7984005 - DNA, 22 bp, Homo sapiens
aggagtccatgagcagctagag

SEQ ID NO: 7984006 - DNA, 22 bp, Homo sapiens
acagtacaagcatgatacataa

SEQ ID NO: 7984007 - DNA, 22 bp, Homo sapiens
acagtacaagcatgatacataa

SEQ ID NO: 7984008 - DNA, 22 bp, Homo sapiens
acagtacaagcatgatacataa

SEQ ID NO: 7984009 - DNA, 22 bp, Homo sapiens
acagtacaagcatgatacataa

SEQ ID NO: 7984010 - DNA, 22 bp, Homo sapiens
acagtacaagcatgatacataa

SEQ ID NO: 7984011 - DNA, 22 bp, Homo sapiens
acagtacaccactgtgtacagt

SEQ ID NO: 7984012 - DNA, 22 bp, Homo sapiens
aggagggtcatgttgaagtgta

SEQ ID NO: 7984013 - DNA, 22 bp, Homo sapiens
aggagggtcatgttgaagtgta

SEQ ID NO: 7984014 - DNA, 22 bp, Homo sapiens
aggagggtgatccgggctggtc

SEQ ID NO: 7984015 - DNA, 22 bp, Homo sapiens
aggagggtgatccgggctggtc

SEQ ID NO: 7984016 - DNA, 22 bp, Homo sapiens
acagtacaagcaatgcattttt

SEQ ID NO: 7984017 - DNA, 22 bp, Homo sapiens
acagtacaagcatgatacataa

SEQ ID NO: 7984018 - DNA, 22 bp, Homo sapiens
acagtacaaaacccaccagagg

SEQ ID NO: 7984019 - DNA, 22 bp, Homo sapiens
acagtaattgtgtacgaggaca

SEQ ID NO: 7984020 - DNA, 22 bp, Homo sapiens
acagtacaagcaatgcattttt

SEQ ID NO: 7984021 - DNA, 22 bp, Homo sapiens
acagtacaagcaatgcattttt

SEQ ID NO: 7984022 - DNA, 22 bp, Homo sapiens
aggagtcaggaccaaatggaaa

SEQ ID NO: 7984023 - DNA, 19 bp, Homo sapiens
aggagtcaggaacttcctt

SEQ ID NO: 7984024 - DNA, 22 bp, Homo sapiens
aggagggtgatccgggctggtc

SEQ ID NO: 7984025 - DNA, 22 bp, Homo sapiens
aggagtcactcagggcttcatc

SEQ ID NO: 7984026 - DNA, 22 bp, Homo sapiens
aggagggtgatccgggctggtc

SEQ ID NO: 7984027 - DNA, 22 bp, Homo sapiens
aggagggtgatccgggctggtc

SEQ ID NO: 7984028 - DNA, 22 bp, Homo sapiens
aggaggaaaaaggccacagcaa

SEQ ID NO: 7984029 - DNA, 22 bp, Homo sapiens
aggaggaaaaaggccacagcaa

SEQ ID NO: 7984030 - DNA, 22 bp, Homo sapiens
aggaggaaaaaggccacagcaa

SEQ ID NO: 7984031 - DNA, 22 bp, Homo sapiens
aggaggaaaaaggccacagcaa

SEQ ID NO: 7984032 - DNA, 22 bp, Homo sapiens
aggaggaaaaaggccacagcaa

SEQ ID NO: 7984033 - DNA, 22 bp, Homo sapiens
aggaggaaaaaggccacagcaa

SEQ ID NO: 7984034 - DNA, 22 bp, Homo sapiens
aggaggaaaaaggccacagcaa

SEQ ID NO: 7984035 - DNA, 22 bp, Homo sapiens
aggaggaaagaaggcccccagc

SEQ ID NO: 7984036 - DNA, 21 bp, Homo sapiens
aggaggaacccgtggctgggc

SEQ ID NO: 7984037 - DNA, 22 bp, Homo sapiens
aggaggaaagaaggcccccagc

SEQ ID NO: 7984038 - DNA, 23 bp, Homo sapiens
aggaggaaaagttatctgctgag

SEQ ID NO: 7984039 - DNA, 23 bp, Homo sapiens
aggaggaaaagttatctgctgag

SEQ ID NO: 7984040 - DNA, 22 bp, Homo sapiens
aggaggaactcagaaagaaggt

SEQ ID NO: 7984041 - DNA, 20 bp, Homo sapiens
aggaggaagaaagcacactg

SEQ ID NO: 7984042 - DNA, 22 bp, Homo sapiens
acagtaaatcaacagaatatct

SEQ ID NO: 7984043 - DNA, 20 bp, Homo sapiens
aggaggaagaaagcacactg

SEQ ID NO: 7984044 - DNA, 21 bp, Homo sapiens
acagtaaattccctgcaaaga

SEQ ID NO: 7984045 - DNA, 22 bp, Homo sapiens
aggaggaactcagaaagaaggt

SEQ ID NO: 7984046 - DNA, 22 bp, Homo sapiens
aggaggaactcagaaagaaggt

SEQ ID NO: 7984047 - DNA, 22 bp, Homo sapiens
aggaggaactcagaaagaaggt

SEQ ID NO: 7984048 - DNA, 22 bp, Homo sapiens
aggaggaactcagaaagaaggt

SEQ ID NO: 7984049 - DNA, 21 bp, Homo sapiens
aggaggaacccgtggctgggc

SEQ ID NO: 7984050 - DNA, 21 bp, Homo sapiens
aggaggaacccgtggctgggc

SEQ ID NO: 7984051 - DNA, 21 bp, Homo sapiens
aggaggaacccgtggctgggc

SEQ ID NO: 7984052 - DNA, 21 bp, Homo sapiens
acagtaaattccctgcaaaga

SEQ ID NO: 7984053 - DNA, 22 bp, Homo sapiens
acagtaacaaatggcctgagga

SEQ ID NO: 7984054 - DNA, 21 bp, Homo sapiens
acagtaaattccctgcaaaga

SEQ ID NO: 7984055 - DNA, 22 bp, Homo sapiens
acagtaacacctactctgtccc

SEQ ID NO: 7984056 - DNA, 21 bp, Homo sapiens
acagtaaattccctgcaaaga

SEQ ID NO: 7984057 - DNA, 22 bp, Homo sapiens
acagtaacagtctatttctcag

SEQ ID NO: 7984058 - DNA, 22 bp, Homo sapiens
acagtaactcttttaccctcct

SEQ ID NO: 7984059 - DNA, 22 bp, Homo sapiens
acagtaacctctcctctgaagg

SEQ ID NO: 7984060 - DNA, 22 bp, Homo sapiens
acagtaagcggggttggagggc

SEQ ID NO: 7984061 - DNA, 21 bp, Homo sapiens
acagtaagacagggcatttgc

SEQ ID NO: 7984062 - DNA, 22 bp, Homo sapiens
acagtaatattgatgctcgtca

SEQ ID NO: 7984063 - DNA, 22 bp, Homo sapiens
acagtaatcatatgattttctc

SEQ ID NO: 7984064 - DNA, 22 bp, Homo sapiens
acagtaatgcatacaagttagt

SEQ ID NO: 7984065 - DNA, 22 bp, Homo sapiens
acagtaatgcatacaagttagt

SEQ ID NO: 7984066 - DNA, 22 bp, Homo sapiens
acagtaatctgggaacttgtta

SEQ ID NO: 7984067 - DNA, 22 bp, Homo sapiens
acagtaattgtgaacttaacgt

SEQ ID NO: 7984068 - DNA, 22 bp, Homo sapiens
acagtaattaaggtctgaaacg

SEQ ID NO: 7984069 - DNA, 22 bp, Homo sapiens
acagtaattaaggtctgaaacg

SEQ ID NO: 7984070 - DNA, 22 bp, Homo sapiens
acagtaatgcatacaagttagt

SEQ ID NO: 7984071 - DNA, 22 bp, Homo sapiens
acagtaattaaacattctgatt

SEQ ID NO: 7984072 - DNA, 22 bp, Homo sapiens
acagtaattaaacattctgatt

SEQ ID NO: 7984073 - DNA, 22 bp, Homo sapiens
aggcagcatccagaggagaatg

SEQ ID NO: 7984074 - DNA, 22 bp, Homo sapiens
aggcagcatccagaggagaatg

SEQ ID NO: 7984075 - DNA, 21 bp, Homo sapiens
aggcagcatctgatttatatg

SEQ ID NO: 7984076 - DNA, 21 bp, Homo sapiens
aggcagcatctgatttatatg

SEQ ID NO: 7984077 - DNA, 22 bp, Homo sapiens
aggcagcatgctctgcttctac

SEQ ID NO: 7984078 - DNA, 22 bp, Homo sapiens
aggcagcatccagaggagaatg

SEQ ID NO: 7984079 - DNA, 22 bp, Homo sapiens
aggcagcatgggcccagagtcc

SEQ ID NO: 7984080 - DNA, 22 bp, Homo sapiens
aggcagcatgctctgcttctac

SEQ ID NO: 7984081 - DNA, 22 bp, Homo sapiens
aggcagcatgctctgcttctac

SEQ ID NO: 7984082 - DNA, 22 bp, Homo sapiens
aggcagcatgctctgcttctac

SEQ ID NO: 7984083 - DNA, 21 bp, Homo sapiens
aggcagcatctgatttatatg

SEQ ID NO: 7984084 - DNA, 22 bp, Homo sapiens
aggcagcatgctctgcttctac

SEQ ID NO: 7984085 - DNA, 22 bp, Homo sapiens
aggcagcatgctctgcttctac

SEQ ID NO: 7984086 - DNA, 22 bp, Homo sapiens
aggcagcagtgataagatagga

SEQ ID NO: 7984087 - DNA, 22 bp, Homo sapiens
aggcagcagtgataagatagga

SEQ ID NO: 7984088 - DNA, 22 bp, Homo sapiens
aggcagcatccagaggagaatg

SEQ ID NO: 7984089 - DNA, 22 bp, Homo sapiens
aggcagcatccagaggagaatg

SEQ ID NO: 7984090 - DNA, 22 bp, Homo sapiens
aggcagcatccagaggagaatg

SEQ ID NO: 7984091 - DNA, 22 bp, Homo sapiens
aggcagcaattgaaatcattgt

SEQ ID NO: 7984092 - DNA, 22 bp, Homo sapiens
aggcagcaattgaaatcattgt

SEQ ID NO: 7984093 - DNA, 22 bp, Homo sapiens
aggcagcaatgaatgaaatgga

SEQ ID NO: 7984094 - DNA, 19 bp, Homo sapiens
aggcagcacccagtccttg

SEQ ID NO: 7984095 - DNA, 19 bp, Homo sapiens
aggcagcacccagtccttg

SEQ ID NO: 7984096 - DNA, 19 bp, Homo sapiens
aggcagcacccagtccttg

SEQ ID NO: 7984097 - DNA, 19 bp, Homo sapiens
aggcagcacccagtccttg

SEQ ID NO: 7984098 - DNA, 22 bp, Homo sapiens
aggcagcagtgataagatagga

SEQ ID NO: 7984099 - DNA, 22 bp, Homo sapiens
aggcagcattcaggggtgatga

SEQ ID NO: 7984100 - DNA, 22 bp, Homo sapiens
acagtttgccctgacattctcc

SEQ ID NO: 7984101 - DNA, 22 bp, Homo sapiens
acagtttggcaaatgtcccaca

SEQ ID NO: 7984102 - DNA, 22 bp, Homo sapiens
acagtttggcgtgattgatagt

SEQ ID NO: 7984103 - DNA, 22 bp, Homo sapiens
acagtttgccctgacattctcc

SEQ ID NO: 7984104 - DNA, 22 bp, Homo sapiens
acagtttggcgtgattgatagt

SEQ ID NO: 7984105 - DNA, 19 bp, Homo sapiens
acagtttgggaaatgagca

SEQ ID NO: 7984106 - DNA, 22 bp, Homo sapiens
acagtttggttgctacagtaaa

SEQ ID NO: 7984107 - DNA, 17 bp, Homo sapiens
acagtttgtcattctaa

SEQ ID NO: 7984108 - DNA, 22 bp, Homo sapiens
acagtttggttgctacagtaaa

SEQ ID NO: 7984109 - DNA, 22 bp, Homo sapiens
aggcagcatgggccccagctcc

SEQ ID NO: 7984110 - DNA, 22 bp, Homo sapiens
aggcagcatgggccccagctcc

SEQ ID NO: 7984111 - DNA, 22 bp, Homo sapiens
aggcagcatgggcccagagtcc

SEQ ID NO: 7984112 - DNA, 22 bp, Homo sapiens
aggcagcatgggcccagagtcc

SEQ ID NO: 7984113 - DNA, 22 bp, Homo sapiens
aggcagcatgggccccagctcc

SEQ ID NO: 7984114 - DNA, 22 bp, Homo sapiens
aggcagcatgggcccagagtcc

SEQ ID NO: 7984115 - DNA, 22 bp, Homo sapiens
aggcagcatgggcccagagtcc

SEQ ID NO: 7984116 - DNA, 22 bp, Homo sapiens
aggcagcatgggcccagagtcc

SEQ ID NO: 7984117 - DNA, 22 bp, Homo sapiens
aggcagcatgggcccagagtcc

SEQ ID NO: 7984118 - DNA, 22 bp, Homo sapiens
aggcagcatgggcccagagtcc

SEQ ID NO: 7984119 - DNA, 22 bp, Homo sapiens
aggcagcattcaggggtgatga

SEQ ID NO: 7984120 - DNA, 22 bp, Homo sapiens
aggcagcattcaggggtgatga

SEQ ID NO: 7984121 - DNA, 22 bp, Homo sapiens
aggcagcatgggccccagctcc

SEQ ID NO: 7984122 - DNA, 22 bp, Homo sapiens
aggcagcatgggccccagctcc

SEQ ID NO: 7984123 - DNA, 16 bp, Homo sapiens
aggcagcatgttagtg

SEQ ID NO: 7984124 - DNA, 22 bp, Homo sapiens
aggcagcatgggccccagctcc

SEQ ID NO: 7984125 - DNA, 22 bp, Homo sapiens
aggcagcatgggccccagctcc

SEQ ID NO: 7984126 - DNA, 21 bp, Homo sapiens
acagttttaaggagcacatgg

SEQ ID NO: 7984127 - DNA, 21 bp, Homo sapiens
acagttttaaggagcacatgg

SEQ ID NO: 7984128 - DNA, 21 bp, Homo sapiens
acagttttaaggagcacatgg

SEQ ID NO: 7984129 - DNA, 22 bp, Homo sapiens
acagtttgttccttttcattgc

SEQ ID NO: 7984130 - DNA, 22 bp, Homo sapiens
acagtttgtgttggccatgggc

SEQ ID NO: 7984131 - DNA, 22 bp, Homo sapiens
acagttttttcaacattggaat

SEQ ID NO: 7984132 - DNA, 22 bp, Homo sapiens
acataaaggtgactaacatctt

SEQ ID NO: 7984133 - DNA, 22 bp, Homo sapiens
acataaagtactgagagactct

SEQ ID NO: 7984134 - DNA, 22 bp, Homo sapiens
acataaatagattattgggagg

SEQ ID NO: 7984135 - DNA, 22 bp, Homo sapiens
acataaatagattattgggagg

SEQ ID NO: 7984136 - DNA, 22 bp, Homo sapiens
acataaatagattattgggagg

SEQ ID NO: 7984137 - DNA, 22 bp, Homo sapiens
acataaatagattattgggagg

SEQ ID NO: 7984138 - DNA, 22 bp, Homo sapiens
acataaatagattattgggagg

SEQ ID NO: 7984139 - DNA, 22 bp, Homo sapiens
acataaatagattattgggagg

SEQ ID NO: 7984140 - DNA, 22 bp, Homo sapiens
aggcagctggaggcagagacta

SEQ ID NO: 7984141 - DNA, 22 bp, Homo sapiens
aggcagctggaggcagagacta

SEQ ID NO: 7984142 - DNA, 22 bp, Homo sapiens
aggcagctggaggcagagacta

SEQ ID NO: 7984143 - DNA, 22 bp, Homo sapiens
aggcagctggcaaattctagag

SEQ ID NO: 7984144 - DNA, 21 bp, Homo sapiens
aggcaggattcaaacacagag

SEQ ID NO: 7984145 - DNA, 22 bp, Homo sapiens
aggcagctggcaaattctagag

SEQ ID NO: 7984146 - DNA, 22 bp, Homo sapiens
aggcagctggcaaattctagag

SEQ ID NO: 7984147 - DNA, 22 bp, Homo sapiens
aggcagctggcaaattctagag

SEQ ID NO: 7984148 - DNA, 22 bp, Homo sapiens
aggcaggcaagttcatatgagg

SEQ ID NO: 7984149 - DNA, 22 bp, Homo sapiens
aggcaggcaaccacctgggaag

SEQ ID NO: 7984150 - DNA, 22 bp, Homo sapiens
aggcaggcaaccacctgggaag

SEQ ID NO: 7984151 - DNA, 22 bp, Homo sapiens
aggcaggcaagttcatatgagg

SEQ ID NO: 7984152 - DNA, 22 bp, Homo sapiens
aggcaggcaagttcatatgagg

SEQ ID NO: 7984153 - DNA, 22 bp, Homo sapiens
aggcaggcactccggaagtgtc

SEQ ID NO: 7984154 - DNA, 22 bp, Homo sapiens
aggcaggcactccggaagtgtc

SEQ ID NO: 7984155 - DNA, 22 bp, Homo sapiens
aggcaggcactccggaagtgtc

SEQ ID NO: 7984156 - DNA, 22 bp, Homo sapiens
aggcaggcacacttcctccagg

SEQ ID NO: 7984157 - DNA, 22 bp, Homo sapiens
aggcaggcacacttcctccagg

SEQ ID NO: 7984158 - DNA, 22 bp, Homo sapiens
aggcaggcacacttcctccagg

SEQ ID NO: 7984159 - DNA, 22 bp, Homo sapiens
aggcaggcaaccacctgggaag

SEQ ID NO: 7984160 - DNA, 22 bp, Homo sapiens
aggcaggcaaccacctgggaag

SEQ ID NO: 7984161 - DNA, 22 bp, Homo sapiens
aggcaggcaaccacctgggaag

SEQ ID NO: 7984162 - DNA, 22 bp, Homo sapiens
aggcaggcaaccacctgggaag

SEQ ID NO: 7984163 - DNA, 22 bp, Homo sapiens
aggcaggcaaccacctgggaag

SEQ ID NO: 7984164 - DNA, 22 bp, Homo sapiens
aggcaggcaaccacctgggaag

SEQ ID NO: 7984165 - DNA, 22 bp, Homo sapiens
aggcaggcaaccacctgggaag

SEQ ID NO: 7984166 - DNA, 22 bp, Homo sapiens
aggcaggattgctgacaacaat

SEQ ID NO: 7984167 - DNA, 22 bp, Homo sapiens
aggcaggattgctgacaacaat

SEQ ID NO: 7984168 - DNA, 22 bp, Homo sapiens
aggcaggattgctgacaacaat

SEQ ID NO: 7984169 - DNA, 22 bp, Homo sapiens
aggcaggattgctgacaacaat

SEQ ID NO: 7984170 - DNA, 22 bp, Homo sapiens
aggcaggattgctgacaacaat

SEQ ID NO: 7984171 - DNA, 22 bp, Homo sapiens
aggcaggattgctgacaacaat

SEQ ID NO: 7984172 - DNA, 20 bp, Homo sapiens
acagtgtttttgagtagagc

SEQ ID NO: 7984173 - DNA, 22 bp, Homo sapiens
acagttaactggagagcgagtt

SEQ ID NO: 7984174 - DNA, 22 bp, Homo sapiens
acagtgttttagaaaagcttga

SEQ ID NO: 7984175 - DNA, 22 bp, Homo sapiens
acagtgttttagaaaagcttga

SEQ ID NO: 7984176 - DNA, 22 bp, Homo sapiens
acagtgttttgtctggcagggc

SEQ ID NO: 7984177 - DNA, 22 bp, Homo sapiens
acagtgcacatcctgagtgatt

SEQ ID NO: 7984178 - DNA, 22 bp, Homo sapiens
acagtgcacatcctgagtgatt

SEQ ID NO: 7984179 - DNA, 22 bp, Homo sapiens
acagtgcacatcctgagtgatt

SEQ ID NO: 7984180 - DNA, 22 bp, Homo sapiens
acagtgttctgctttttaatcc

SEQ ID NO: 7984181 - DNA, 22 bp, Homo sapiens
acagtgttctgctttttaatcc

SEQ ID NO: 7984182 - DNA, 22 bp, Homo sapiens
acagtgttttagaaaagcttga

SEQ ID NO: 7984183 - DNA, 22 bp, Homo sapiens
acagtgttttagaaaagcttga

SEQ ID NO: 7984184 - DNA, 22 bp, Homo sapiens
acagtgcaaacttttgtctcct

SEQ ID NO: 7984185 - DNA, 22 bp, Homo sapiens
acagtgcaaacttttgtctcct

SEQ ID NO: 7984186 - DNA, 22 bp, Homo sapiens
acagtgcaaacttttgtctcct

SEQ ID NO: 7984187 - DNA, 22 bp, Homo sapiens
acagtgcaaataggactgtctt

SEQ ID NO: 7984188 - DNA, 22 bp, Homo sapiens
acagtgcaaataggactgtctt

SEQ ID NO: 7984189 - DNA, 22 bp, Homo sapiens
acagtgcaaacttttgtctcct

SEQ ID NO: 7984190 - DNA, 22 bp, Homo sapiens
acagtgcacatcctgagtgatt

SEQ ID NO: 7984191 - DNA, 22 bp, Homo sapiens
acagtgcacatcctgagtgatt

SEQ ID NO: 7984192 - DNA, 22 bp, Homo sapiens
acagtgcacatcctgagtgatt

SEQ ID NO: 7984193 - DNA, 22 bp, Homo sapiens
acagtgcaaataggactgtctt

SEQ ID NO: 7984194 - DNA, 22 bp, Homo sapiens
acagtgcaaataggactgtctt

SEQ ID NO: 7984195 - DNA, 22 bp, Homo sapiens
acagtgcaaataggactgtctt

SEQ ID NO: 7984196 - DNA, 22 bp, Homo sapiens
acagtgcaaataggactgtctt

SEQ ID NO: 7984197 - DNA, 22 bp, Homo sapiens
acagtgatgccgggcgagaatg

SEQ ID NO: 7984198 - DNA, 22 bp, Homo sapiens
acagtgatgagccggctgaggc

SEQ ID NO: 7984199 - DNA, 22 bp, Homo sapiens
acagtgatgagggaattttgtg

SEQ ID NO: 7984200 - DNA, 22 bp, Homo sapiens
acagtgataaaatttcacatgt

SEQ ID NO: 7984201 - DNA, 22 bp, Homo sapiens
acagtgataaaatttcacatgt

SEQ ID NO: 7984202 - DNA, 22 bp, Homo sapiens
acagtgaggacagggactgtgt

SEQ ID NO: 7984203 - DNA, 22 bp, Homo sapiens
acagtgataaaatttcacatgt

SEQ ID NO: 7984204 - DNA, 22 bp, Homo sapiens
acagtgatatttttactcaaat

SEQ ID NO: 7984205 - DNA, 22 bp, Homo sapiens
acagtgatcttttagttggaac

SEQ ID NO: 7984206 - DNA, 22 bp, Homo sapiens
acagtgatcagttactgtctgt

SEQ ID NO: 7984207 - DNA, 22 bp, Homo sapiens
acagtgattttaggatagatgg

SEQ ID NO: 7984208 - DNA, 22 bp, Homo sapiens
acagtgcaaaccctcgggaaag

SEQ ID NO: 7984209 - DNA, 22 bp, Homo sapiens
acagtgcaaaccctcgggaaag

SEQ ID NO: 7984210 - DNA, 22 bp, Homo sapiens
acagtgcaaaccctcgggaaag

SEQ ID NO: 7984211 - DNA, 22 bp, Homo sapiens
acagtgcaaaccctcgggaaag

SEQ ID NO: 7984212 - DNA, 22 bp, Homo sapiens
acagtgcaaaccctcgggaaag

SEQ ID NO: 7984213 - DNA, 22 bp, Homo sapiens
acagtgattctgcaaaccatat

SEQ ID NO: 7984214 - DNA, 22 bp, Homo sapiens
acagtgattctgcaaaccatat

SEQ ID NO: 7984215 - DNA, 22 bp, Homo sapiens
acagttattttcccagcattta

SEQ ID NO: 7984216 - DNA, 22 bp, Homo sapiens
acagttattttcccagcattta

SEQ ID NO: 7984217 - DNA, 22 bp, Homo sapiens
acagttcaagacatcagtatga

SEQ ID NO: 7984218 - DNA, 22 bp, Homo sapiens
acagttcaagacatcagtatga

SEQ ID NO: 7984219 - DNA, 22 bp, Homo sapiens
acagttcactttttatatcaaa

SEQ ID NO: 7984220 - DNA, 22 bp, Homo sapiens
acagttcagacaagtgttccat

SEQ ID NO: 7984221 - DNA, 22 bp, Homo sapiens
acagttcaagtcttagacaaca

SEQ ID NO: 7984222 - DNA, 22 bp, Homo sapiens
acagttattctttatgcaacca

SEQ ID NO: 7984223 - DNA, 22 bp, Homo sapiens
acagttatttactgcataaact

SEQ ID NO: 7984224 - DNA, 22 bp, Homo sapiens
acagttatttactgcataaact

SEQ ID NO: 7984225 - DNA, 22 bp, Homo sapiens
acagttatctttgaaatagaga

SEQ ID NO: 7984226 - DNA, 22 bp, Homo sapiens
acagttatctttgaaatagaga

SEQ ID NO: 7984227 - DNA, 22 bp, Homo sapiens
acagttattctttatgcaacca

SEQ ID NO: 7984228 - DNA, 23 bp, Homo sapiens
acagttatagctgtgaataacat

SEQ ID NO: 7984229 - DNA, 23 bp, Homo sapiens
acagttatagctgtgaataacat

SEQ ID NO: 7984230 - DNA, 23 bp, Homo sapiens
acagttatagctgtgaataacat

SEQ ID NO: 7984231 - DNA, 22 bp, Homo sapiens
acagttagtgagatgtctgttt

SEQ ID NO: 7984232 - DNA, 22 bp, Homo sapiens
acagttagtgagatgtctgttt

SEQ ID NO: 7984233 - DNA, 23 bp, Homo sapiens
acagttatagctgtgaataacat

SEQ ID NO: 7984234 - DNA, 23 bp, Homo sapiens
acagttatagctgtgaataacat

SEQ ID NO: 7984235 - DNA, 22 bp, Homo sapiens
acagttatctttgaaatagaga

SEQ ID NO: 7984236 - DNA, 22 bp, Homo sapiens
acagttatctttgaaatagaga

SEQ ID NO: 7984237 - DNA, 22 bp, Homo sapiens
acagttagaaagtggcagaacc

SEQ ID NO: 7984238 - DNA, 22 bp, Homo sapiens
acagttaggcttatgtctgtag

SEQ ID NO: 7984239 - DNA, 22 bp, Homo sapiens
acagttaggcttatgtctgtag

SEQ ID NO: 7984240 - DNA, 22 bp, Homo sapiens
acagttagggactataatcatt

SEQ ID NO: 7984241 - DNA, 22 bp, Homo sapiens
acagttaggtcctaaaattctg

SEQ ID NO: 7984242 - DNA, 22 bp, Homo sapiens
acagttaggtcctaaaattctg

SEQ ID NO: 7984243 - DNA, 22 bp, Homo sapiens
acagttacattccagcaacatc

SEQ ID NO: 7984244 - DNA, 22 bp, Homo sapiens
acagttaattgttgttgggtgt

SEQ ID NO: 7984245 - DNA, 22 bp, Homo sapiens
acagttaatatgtgacagaact

SEQ ID NO: 7984246 - DNA, 22 bp, Homo sapiens
acagttaattaacattaagggg

SEQ ID NO: 7984247 - DNA, 22 bp, Homo sapiens
acagttaatcaaatggcatatg

SEQ ID NO: 7984248 - DNA, 22 bp, Homo sapiens
acagttaatcaaatggcatatg

SEQ ID NO: 7984249 - DNA, 22 bp, Homo sapiens
acagttaatatgtgacagaact

SEQ ID NO: 7984250 - DNA, 22 bp, Homo sapiens
acagttaaggaaatggaggttc

SEQ ID NO: 7984251 - DNA, 22 bp, Homo sapiens
acagttaataagtagtaagtca

SEQ ID NO: 7984252 - DNA, 22 bp, Homo sapiens
acagttaaggaaatggaggttc

SEQ ID NO: 7984253 - DNA, 22 bp, Homo sapiens
acagttaagcagtatgatcaca

SEQ ID NO: 7984254 - DNA, 22 bp, Homo sapiens
agggcctggtgacctgggtcct

SEQ ID NO: 7984255 - DNA, 22 bp, Homo sapiens
agggcctggtgacctgggtcct

SEQ ID NO: 7984256 - DNA, 22 bp, Homo sapiens
agggcctggtgacctgggtcct

SEQ ID NO: 7984257 - DNA, 22 bp, Homo sapiens
agggcctggtgacctgggtcct

SEQ ID NO: 7984258 - DNA, 22 bp, Homo sapiens
agggcctggtgacctgggtcct

SEQ ID NO: 7984259 - DNA, 22 bp, Homo sapiens
agggcctggtgacctgggtcct

SEQ ID NO: 7984260 - DNA, 22 bp, Homo sapiens
agggcctgggtctgtactcctc

SEQ ID NO: 7984261 - DNA, 22 bp, Homo sapiens
agggcctggtgacctgggtcct

SEQ ID NO: 7984262 - DNA, 22 bp, Homo sapiens
agggcctgggtctgtactcctc

SEQ ID NO: 7984263 - DNA, 22 bp, Homo sapiens
agggcctggggtagcttactgc

SEQ ID NO: 7984264 - DNA, 22 bp, Homo sapiens
agggcctggttctgtgtaggga

SEQ ID NO: 7984265 - DNA, 22 bp, Homo sapiens
agggcctggttctgtgtaggga

SEQ ID NO: 7984266 - DNA, 22 bp, Homo sapiens
agggcctggttctgtgtaggga

SEQ ID NO: 7984267 - DNA, 22 bp, Homo sapiens
accccagctctgagccacacca

SEQ ID NO: 7984268 - DNA, 22 bp, Homo sapiens
accccagctctgagccacacca

SEQ ID NO: 7984269 - DNA, 22 bp, Homo sapiens
accccaggaagtggaggtcatg

SEQ ID NO: 7984270 - DNA, 22 bp, Homo sapiens
accccaggaagtggaggtcatg

SEQ ID NO: 7984271 - DNA, 22 bp, Homo sapiens
accccaggaagtggaggtcatg

SEQ ID NO: 7984272 - DNA, 22 bp, Homo sapiens
accccttttatagaagaacaga

SEQ ID NO: 7984273 - DNA, 22 bp, Homo sapiens
acccgatgttggtgctctagta

SEQ ID NO: 7984274 - DNA, 22 bp, Homo sapiens
accccttttatagaagaacaga

SEQ ID NO: 7984275 - DNA, 22 bp, Homo sapiens
acccgccgcacgtccaggctga

SEQ ID NO: 7984276 - DNA, 22 bp, Homo sapiens
acccggaggcgggggatgcagt

SEQ ID NO: 7984277 - DNA, 22 bp, Homo sapiens
acccgggaggcaggagtcatag

SEQ ID NO: 7984278 - DNA, 22 bp, Homo sapiens
acccggagtcggaggttgcagt

SEQ ID NO: 7984279 - DNA, 22 bp, Homo sapiens
acccggagtcggaggttgcagt

SEQ ID NO: 7984280 - DNA, 22 bp, Homo sapiens
accctaataatcacagactagt

SEQ ID NO: 7984281 - DNA, 22 bp, Homo sapiens
accctaataatcacagactagt

SEQ ID NO: 7984282 - DNA, 22 bp, Homo sapiens
acccgggaggcaggagtcatag

SEQ ID NO: 7984283 - DNA, 22 bp, Homo sapiens
accctaatcccttaaacctgtg

SEQ ID NO: 7984284 - DNA, 22 bp, Homo sapiens
accctactaaatgtggtatgtc

SEQ ID NO: 7984285 - DNA, 22 bp, Homo sapiens
acccgtggttttatactacttc

SEQ ID NO: 7984286 - DNA, 22 bp, Homo sapiens
acccgggaggcaggagtcatag

SEQ ID NO: 7984287 - DNA, 22 bp, Homo sapiens
accctcaacaaattcactctat

SEQ ID NO: 7984288 - DNA, 22 bp, Homo sapiens
accctcaacaaattcactctat

SEQ ID NO: 7984289 - DNA, 22 bp, Homo sapiens
accctcaacaaattcactctat

SEQ ID NO: 7984290 - DNA, 22 bp, Homo sapiens
accctcaacaaattcactctat

SEQ ID NO: 7984291 - DNA, 22 bp, Homo sapiens
accctcaacaaattcactctat

SEQ ID NO: 7984292 - DNA, 22 bp, Homo sapiens
accctcaacaaattcactctat

SEQ ID NO: 7984293 - DNA, 22 bp, Homo sapiens
accctcagacagctgtggccag

SEQ ID NO: 7984294 - DNA, 16 bp, Homo sapiens
accctcagaaactgct

SEQ ID NO: 7984295 - DNA, 22 bp, Homo sapiens
accctcagacagctgtggccag

SEQ ID NO: 7984296 - DNA, 22 bp, Homo sapiens
accctcagacatattccatcat

SEQ ID NO: 7984297 - DNA, 22 bp, Homo sapiens
agggcctgggccagcacccttt

SEQ ID NO: 7984298 - DNA, 22 bp, Homo sapiens
agggcctgggccagcacccttt

SEQ ID NO: 7984299 - DNA, 22 bp, Homo sapiens
agggcctgggccagcacccttt

SEQ ID NO: 7984300 - DNA, 22 bp, Homo sapiens
agggcctggggtagcttactgc

SEQ ID NO: 7984301 - DNA, 22 bp, Homo sapiens
agggcctgggatgtcctcctag

SEQ ID NO: 7984302 - DNA, 22 bp, Homo sapiens
agggcctgggatgtcctcctag

SEQ ID NO: 7984303 - DNA, 22 bp, Homo sapiens
agggcctgggatgtcctcctag

SEQ ID NO: 7984304 - DNA, 22 bp, Homo sapiens
agggcctgggatgtcctcctag

SEQ ID NO: 7984305 - DNA, 22 bp, Homo sapiens
agggcctgggatgtcctcctag

SEQ ID NO: 7984306 - DNA, 22 bp, Homo sapiens
agggcctgggccagcacccttt

SEQ ID NO: 7984307 - DNA, 17 bp, Homo sapiens
acccaggctctatcttg

SEQ ID NO: 7984308 - DNA, 22 bp, Homo sapiens
acccaggctgcttctcagtggc

SEQ ID NO: 7984309 - DNA, 22 bp, Homo sapiens
acccaggctggagtgcagtagc

SEQ ID NO: 7984310 - DNA, 22 bp, Homo sapiens
acccaggctgcttctcagtggc

SEQ ID NO: 7984311 - DNA, 22 bp, Homo sapiens
acccaggctggagtgcagtagc

SEQ ID NO: 7984312 - DNA, 22 bp, Homo sapiens
acccaggctggagtgcagtgac

SEQ ID NO: 7984313 - DNA, 22 bp, Homo sapiens
acccaggctggagtgcagtgac

SEQ ID NO: 7984314 - DNA, 22 bp, Homo sapiens
acccaggctggagtgcagtagc

SEQ ID NO: 7984315 - DNA, 22 bp, Homo sapiens
agggcctgggaagaggaaccct

SEQ ID NO: 7984316 - DNA, 22 bp, Homo sapiens
acccaggcctgagagacaggag

SEQ ID NO: 7984317 - DNA, 22 bp, Homo sapiens
acccaggcctgagagacaggag

SEQ ID NO: 7984318 - DNA, 22 bp, Homo sapiens
acccaggcctgagagacaggag

SEQ ID NO: 7984319 - DNA, 22 bp, Homo sapiens
acccaggcgggagtgcagtgtc

SEQ ID NO: 7984320 - DNA, 22 bp, Homo sapiens
acccaggcgggagtgcagtgtc

SEQ ID NO: 7984321 - DNA, 22 bp, Homo sapiens
acccaggcgggagtgcagtgtc

SEQ ID NO: 7984322 - DNA, 22 bp, Homo sapiens
acccaggcgggagtgcagtgtc

SEQ ID NO: 7984323 - DNA, 22 bp, Homo sapiens
acccaggcgggagtgcagtgtc

SEQ ID NO: 7984324 - DNA, 22 bp, Homo sapiens
acccaggctagaagtgaattat

SEQ ID NO: 7984325 - DNA, 22 bp, Homo sapiens
acccaggcgggagtgcagtgtc

SEQ ID NO: 7984326 - DNA, 22 bp, Homo sapiens
acccaggctagagtgcagtggt

SEQ ID NO: 7984327 - DNA, 22 bp, Homo sapiens
acccaggctagagtgcagtggt

SEQ ID NO: 7984328 - DNA, 22 bp, Homo sapiens
acccaggctagagtgcagtggt

SEQ ID NO: 7984329 - DNA, 22 bp, Homo sapiens
acccaggctagagtgcagtggt

SEQ ID NO: 7984330 - DNA, 18 bp, Homo sapiens
acccaggctcatggtcct

SEQ ID NO: 7984331 - DNA, 22 bp, Homo sapiens
acccaggctagggtgcagtggc

SEQ ID NO: 7984332 - DNA, 18 bp, Homo sapiens
acccaggctcatggtcct

SEQ ID NO: 7984333 - DNA, 18 bp, Homo sapiens
acccaggctcatggtcct

SEQ ID NO: 7984334 - DNA, 18 bp, Homo sapiens
acccaggctcatggtcct

SEQ ID NO: 7984335 - DNA, 17 bp, Homo sapiens
acccaggctctatcttg

SEQ ID NO: 7984336 - DNA, 22 bp, Homo sapiens
acccaggctagagtgcagtggt

SEQ ID NO: 7984337 - DNA, 22 bp, Homo sapiens
acccaggctagagtgcagtggt

SEQ ID NO: 7984338 - DNA, 22 bp, Homo sapiens
acccaggctagggtgcagtggc

SEQ ID NO: 7984339 - DNA, 22 bp, Homo sapiens
acccaggctagggtgcagtggc

SEQ ID NO: 7984340 - DNA, 22 bp, Homo sapiens
acccaggctagggtgcagtggc

SEQ ID NO: 7984341 - DNA, 22 bp, Homo sapiens
acccaggctagggtgcagtggc

SEQ ID NO: 7984342 - DNA, 22 bp, Homo sapiens
acccaggctagggtgcagtggc

SEQ ID NO: 7984343 - DNA, 22 bp, Homo sapiens
agggagctcagttggaagcggt

SEQ ID NO: 7984344 - DNA, 22 bp, Homo sapiens
agggagctcacagtccagtaga

SEQ ID NO: 7984345 - DNA, 22 bp, Homo sapiens
agggagctcacagtccagtaga

SEQ ID NO: 7984346 - DNA, 22 bp, Homo sapiens
agggagctcgatgcctgagtgt

SEQ ID NO: 7984347 - DNA, 22 bp, Homo sapiens
agggagctcgatgcctgagtgt

SEQ ID NO: 7984348 - DNA, 22 bp, Homo sapiens
agggagctcagttggaagcggt

SEQ ID NO: 7984349 - DNA, 22 bp, Homo sapiens
agggagctcgatgcctgagtgt

SEQ ID NO: 7984350 - DNA, 22 bp, Homo sapiens
agggagctctaagtagagggac

SEQ ID NO: 7984351 - DNA, 22 bp, Homo sapiens
agggagctctaagtagagggac

SEQ ID NO: 7984352 - DNA, 22 bp, Homo sapiens
agggagctctaagtagagggac

SEQ ID NO: 7984353 - DNA, 22 bp, Homo sapiens
agggagctctgggggcacacgg

SEQ ID NO: 7984354 - DNA, 22 bp, Homo sapiens
agggagctctgggggcacacgg

SEQ ID NO: 7984355 - DNA, 22 bp, Homo sapiens
agggagctctgggggcacacgg

SEQ ID NO: 7984356 - DNA, 22 bp, Homo sapiens
agggagctctgggggcacacgg

SEQ ID NO: 7984357 - DNA, 22 bp, Homo sapiens
agggagctctgggggcacacgg

SEQ ID NO: 7984358 - DNA, 22 bp, Homo sapiens
agggagctctttggtcttgccg

SEQ ID NO: 7984359 - DNA, 22 bp, Homo sapiens
agggagctctttggtcttgccg

SEQ ID NO: 7984360 - DNA, 22 bp, Homo sapiens
accatattagaaagcacagctc

SEQ ID NO: 7984361 - DNA, 22 bp, Homo sapiens
accatcaagaccttatctagtt

SEQ ID NO: 7984362 - DNA, 22 bp, Homo sapiens
accatcagagcacagtccgtgc

SEQ ID NO: 7984363 - DNA, 22 bp, Homo sapiens
accatcagtactggatgctgac

SEQ ID NO: 7984364 - DNA, 22 bp, Homo sapiens
accatgttggccaagctggtct

SEQ ID NO: 7984365 - DNA, 22 bp, Homo sapiens
accatcagtcattgtcagtggg

SEQ ID NO: 7984366 - DNA, 22 bp, Homo sapiens
accatcagtcacatgtagagaa

SEQ ID NO: 7984367 - DNA, 22 bp, Homo sapiens
accattctgtctctttacaaat

SEQ ID NO: 7984368 - DNA, 22 bp, Homo sapiens
accattctttacacttatttct

SEQ ID NO: 7984369 - DNA, 22 bp, Homo sapiens
accattgccccctagtgtctgt

SEQ ID NO: 7984370 - DNA, 22 bp, Homo sapiens
accattgccccctagtgtctgt

SEQ ID NO: 7984371 - DNA, 22 bp, Homo sapiens
accatttaaaattgatgccttc

SEQ ID NO: 7984372 - DNA, 22 bp, Homo sapiens
accatttaaaattgatgccttc

SEQ ID NO: 7984373 - DNA, 22 bp, Homo sapiens
accattgccccctagtgtctgt

SEQ ID NO: 7984374 - DNA, 22 bp, Homo sapiens
accatttaaggaaaatgtatca

SEQ ID NO: 7984375 - DNA, 22 bp, Homo sapiens
accatttaaggaaaatgtatca

SEQ ID NO: 7984376 - DNA, 22 bp, Homo sapiens
accattgcctagaaaaattcct

SEQ ID NO: 7984377 - DNA, 22 bp, Homo sapiens
accatttaataagtatttccat

SEQ ID NO: 7984378 - DNA, 22 bp, Homo sapiens
accattctgtctctttacaaat

SEQ ID NO: 7984379 - DNA, 22 bp, Homo sapiens
accattctggtccatactgttc

SEQ ID NO: 7984380 - DNA, 21 bp, Homo sapiens
accattctgcacatgctgtca

SEQ ID NO: 7984381 - DNA, 21 bp, Homo sapiens
accattctgcacatgctgtca

SEQ ID NO: 7984382 - DNA, 21 bp, Homo sapiens
accattctgcacatgctgtca

SEQ ID NO: 7984383 - DNA, 20 bp, Homo sapiens
accattaatgtaagctttgt

SEQ ID NO: 7984384 - DNA, 22 bp, Homo sapiens
accattacatgatccttaccca

SEQ ID NO: 7984385 - DNA, 22 bp, Homo sapiens
accattaagaatctggtttcct

SEQ ID NO: 7984386 - DNA, 22 bp, Homo sapiens
accatgttggccaagctggtct

SEQ ID NO: 7984387 - DNA, 22 bp, Homo sapiens
accatgttggccaagctggtct

SEQ ID NO: 7984388 - DNA, 22 bp, Homo sapiens
accattaacatgattttgggga

SEQ ID NO: 7984389 - DNA, 22 bp, Homo sapiens
accatgtttagtgcagtgttca

SEQ ID NO: 7984390 - DNA, 23 bp, Homo sapiens
agggcatgaagcagaggacgtgg

SEQ ID NO: 7984391 - DNA, 22 bp, Homo sapiens
agggcatgaagcagtggacagc

SEQ ID NO: 7984392 - DNA, 22 bp, Homo sapiens
agggcatgaagcagtggacagc

SEQ ID NO: 7984393 - DNA, 22 bp, Homo sapiens
agggcatgaagcagtggacagc

SEQ ID NO: 7984394 - DNA, 22 bp, Homo sapiens
agggcatgaagcagtggacagc

SEQ ID NO: 7984395 - DNA, 22 bp, Homo sapiens
acccaggagcaggctgggcagt

SEQ ID NO: 7984396 - DNA, 22 bp, Homo sapiens
acccaggagcaggctgggcagt

SEQ ID NO: 7984397 - DNA, 22 bp, Homo sapiens
acccaggcctgagagacaggag

SEQ ID NO: 7984398 - DNA, 22 bp, Homo sapiens
acccaggagcaggctgggcagt

SEQ ID NO: 7984399 - DNA, 22 bp, Homo sapiens
acccaggagcaggctgggcagt

SEQ ID NO: 7984400 - DNA, 22 bp, Homo sapiens
acccaggagcaggctgggcagt

SEQ ID NO: 7984401 - DNA, 22 bp, Homo sapiens
agggcagttcagccacaggctc

SEQ ID NO: 7984402 - DNA, 22 bp, Homo sapiens
agggcatctctaacagtctcct

SEQ ID NO: 7984403 - DNA, 22 bp, Homo sapiens
agggcatgaaatgggcagaagc

SEQ ID NO: 7984404 - DNA, 22 bp, Homo sapiens
agggcatgaaatgggcagaagc

SEQ ID NO: 7984405 - DNA, 22 bp, Homo sapiens
agggcatgaaatgggcagaagc

SEQ ID NO: 7984406 - DNA, 23 bp, Homo sapiens
agggcatgaagcagaggacgtgg

SEQ ID NO: 7984407 - DNA, 22 bp, Homo sapiens
acccacacctccgtatatcact

SEQ ID NO: 7984408 - DNA, 22 bp, Homo sapiens
acccacagaacctgtgacaaca

SEQ ID NO: 7984409 - DNA, 22 bp, Homo sapiens
agggcagcttccatagtctggc

SEQ ID NO: 7984410 - DNA, 22 bp, Homo sapiens
agggcagcttccatagtctggc

SEQ ID NO: 7984411 - DNA, 20 bp, Homo sapiens
agggcagcttgaggagccgg

SEQ ID NO: 7984412 - DNA, 20 bp, Homo sapiens
agggcagcttgaggagccgg

SEQ ID NO: 7984413 - DNA, 20 bp, Homo sapiens
agggcagcttgaggagccgg

SEQ ID NO: 7984414 - DNA, 20 bp, Homo sapiens
agggcagcttgaggagccgg

SEQ ID NO: 7984415 - DNA, 20 bp, Homo sapiens
agggcagcttgaggagccgg

SEQ ID NO: 7984416 - DNA, 20 bp, Homo sapiens
agggcagcttgaggagccgg

SEQ ID NO: 7984417 - DNA, 20 bp, Homo sapiens
agggcagcttgaggagccgg

SEQ ID NO: 7984418 - DNA, 20 bp, Homo sapiens
agggcagcttgaggagccgg

SEQ ID NO: 7984419 - DNA, 22 bp, Homo sapiens
acccacacatctctaattcagt

SEQ ID NO: 7984420 - DNA, 22 bp, Homo sapiens
acccacacatctctaattcagt

SEQ ID NO: 7984421 - DNA, 22 bp, Homo sapiens
acccacacctccgtatatcact

SEQ ID NO: 7984422 - DNA, 22 bp, Homo sapiens
acccacacctccgtatatcact

SEQ ID NO: 7984423 - DNA, 22 bp, Homo sapiens
acccaagttttccatgcctgtt

SEQ ID NO: 7984424 - DNA, 22 bp, Homo sapiens
acccaattctgcccaattttgt

SEQ ID NO: 7984425 - DNA, 22 bp, Homo sapiens
acccacaacagctctaggaagt

SEQ ID NO: 7984426 - DNA, 19 bp, Homo sapiens
acccaatccactccattcc

SEQ ID NO: 7984427 - DNA, 22 bp, Homo sapiens
accatttactcccattggaagt

SEQ ID NO: 7984428 - DNA, 22 bp, Homo sapiens
accatttagtaagtatacctgg

SEQ ID NO: 7984429 - DNA, 22 bp, Homo sapiens
accatttagtaagtatacctgg

SEQ ID NO: 7984430 - DNA, 22 bp, Homo sapiens
accatttatcaagcacctgtga

SEQ ID NO: 7984431 - DNA, 22 bp, Homo sapiens
acccaaagcaatattcatcagt

SEQ ID NO: 7984432 - DNA, 22 bp, Homo sapiens
accattttgggtattttcagag

SEQ ID NO: 7984433 - DNA, 21 bp, Homo sapiens
accaaaacctatactttctgt

SEQ ID NO: 7984434 - DNA, 21 bp, Homo sapiens
accaaaacctatactttctgt

SEQ ID NO: 7984435 - DNA, 21 bp, Homo sapiens
accaaaacctatactttctgt

SEQ ID NO: 7984436 - DNA, 22 bp, Homo sapiens
accaaaacctgctactaaagga

SEQ ID NO: 7984437 - DNA, 22 bp, Homo sapiens
accaaaacctgctactaaagga

SEQ ID NO: 7984438 - DNA, 22 bp, Homo sapiens
accaaaacctgctactaaagga

SEQ ID NO: 7984439 - DNA, 22 bp, Homo sapiens
accaaaacctgctactaaagga

SEQ ID NO: 7984440 - DNA, 22 bp, Homo sapiens
accaaacaaaattgtgcactgt

SEQ ID NO: 7984441 - DNA, 22 bp, Homo sapiens
aggctggagtgtgcagtggcgc

SEQ ID NO: 7984442 - DNA, 22 bp, Homo sapiens
aggctggagtgtgcagtggcgc

SEQ ID NO: 7984443 - DNA, 22 bp, Homo sapiens
aggctggagtgtgcagtggcgc

SEQ ID NO: 7984444 - DNA, 22 bp, Homo sapiens
accaaagcgagtgatatgtcat

SEQ ID NO: 7984445 - DNA, 22 bp, Homo sapiens
acatttttgggttgatgtctga

SEQ ID NO: 7984446 - DNA, 22 bp, Homo sapiens
acatttttgggttgatgtctga

SEQ ID NO: 7984447 - DNA, 22 bp, Homo sapiens
acatttttgggttgatgtctga

SEQ ID NO: 7984448 - DNA, 22 bp, Homo sapiens
acatttttgggttgatgtctga

SEQ ID NO: 7984449 - DNA, 22 bp, Homo sapiens
acattttttagagtcccacatt

SEQ ID NO: 7984450 - DNA, 22 bp, Homo sapiens
acattttttagagtcccacatt

SEQ ID NO: 7984451 - DNA, 22 bp, Homo sapiens
acattttttagagtcccacatt

SEQ ID NO: 7984452 - DNA, 22 bp, Homo sapiens
acattttttagagtcccacatt

SEQ ID NO: 7984453 - DNA, 22 bp, Homo sapiens
accaaaaattgtggggctgaat

SEQ ID NO: 7984454 - DNA, 22 bp, Homo sapiens
accaaaaattgtggggctgaat

SEQ ID NO: 7984455 - DNA, 22 bp, Homo sapiens
accaaaaattgtggggctgaat

SEQ ID NO: 7984456 - DNA, 22 bp, Homo sapiens
accaaaaagatatgttgaagcc

SEQ ID NO: 7984457 - DNA, 22 bp, Homo sapiens
accaaaaattgtggggctgaat

SEQ ID NO: 7984458 - DNA, 22 bp, Homo sapiens
acattttttagagtcccacatt

SEQ ID NO: 7984459 - DNA, 22 bp, Homo sapiens
accaaaaagatatgttgaagcc

SEQ ID NO: 7984460 - DNA, 22 bp, Homo sapiens
accaaaaagatatgttgaagcc

SEQ ID NO: 7984461 - DNA, 22 bp, Homo sapiens
acatttttattcatcaaagcag

SEQ ID NO: 7984462 - DNA, 22 bp, Homo sapiens
acatttttattcatcaaagcag

SEQ ID NO: 7984463 - DNA, 22 bp, Homo sapiens
acatttttattcatcaaagcag

SEQ ID NO: 7984464 - DNA, 22 bp, Homo sapiens
acatttttattcatcaaagcag

SEQ ID NO: 7984465 - DNA, 22 bp, Homo sapiens
acatttttcacatttgtagggt

SEQ ID NO: 7984466 - DNA, 22 bp, Homo sapiens
acatttttattcatcaaagcag

SEQ ID NO: 7984467 - DNA, 22 bp, Homo sapiens
acatttttattcatcaaagcag

SEQ ID NO: 7984468 - DNA, 22 bp, Homo sapiens
acatttttattcatcaaagcag

SEQ ID NO: 7984469 - DNA, 22 bp, Homo sapiens
acatttttattcatcaaagcag

SEQ ID NO: 7984470 - DNA, 22 bp, Homo sapiens
acatttttattcatcaaagcag

SEQ ID NO: 7984471 - DNA, 22 bp, Homo sapiens
acatttttcacatttgtagggt

SEQ ID NO: 7984472 - DNA, 22 bp, Homo sapiens
acatttttctaggaggcaaggt

SEQ ID NO: 7984473 - DNA, 22 bp, Homo sapiens
acatttttctaggaggcaaggt

SEQ ID NO: 7984474 - DNA, 22 bp, Homo sapiens
acatttttctaggaggcaaggt

SEQ ID NO: 7984475 - DNA, 22 bp, Homo sapiens
acatttttctaggaggcaaggt

SEQ ID NO: 7984476 - DNA, 22 bp, Homo sapiens
acatttttactgggcatctgca

SEQ ID NO: 7984477 - DNA, 22 bp, Homo sapiens
acatttttactgggcatctgca

SEQ ID NO: 7984478 - DNA, 22 bp, Homo sapiens
acatttttactgggcatctgca

SEQ ID NO: 7984479 - DNA, 22 bp, Homo sapiens
acatttttatcctgagtgccag

SEQ ID NO: 7984480 - DNA, 22 bp, Homo sapiens
acatttttactgggcatctgca

SEQ ID NO: 7984481 - DNA, 22 bp, Homo sapiens
acatttttactgggcatctgca

SEQ ID NO: 7984482 - DNA, 22 bp, Homo sapiens
acatttgtgattatctagggct

SEQ ID NO: 7984483 - DNA, 22 bp, Homo sapiens
acatttgtcttctttcagatta

SEQ ID NO: 7984484 - DNA, 22 bp, Homo sapiens
acatttgtcttctttcagatta

SEQ ID NO: 7984485 - DNA, 22 bp, Homo sapiens
acatttgtcttctttcagatta

SEQ ID NO: 7984486 - DNA, 22 bp, Homo sapiens
aggctgcagaacagtcaggtgc

SEQ ID NO: 7984487 - DNA, 22 bp, Homo sapiens
acatttgtcttcctcctcagtg

SEQ ID NO: 7984488 - DNA, 22 bp, Homo sapiens
aggctgcagaacagtcaggtgc

SEQ ID NO: 7984489 - DNA, 22 bp, Homo sapiens
aggctgcagaacagtcaggtgc

SEQ ID NO: 7984490 - DNA, 22 bp, Homo sapiens
aggctgcagaacagtcaggtgc

SEQ ID NO: 7984491 - DNA, 22 bp, Homo sapiens
aggctggatttatggggacttc

SEQ ID NO: 7984492 - DNA, 22 bp, Homo sapiens
aggctggatgtgcctcaccgag

SEQ ID NO: 7984493 - DNA, 22 bp, Homo sapiens
aggctggcaaggcagatgtgtg

SEQ ID NO: 7984494 - DNA, 22 bp, Homo sapiens
aggctggcaaggcagatgtgtg

SEQ ID NO: 7984495 - DNA, 22 bp, Homo sapiens
aggctggcaaggcagatgtgtg

SEQ ID NO: 7984496 - DNA, 22 bp, Homo sapiens
aggctggcaaggcagatgtgtg

SEQ ID NO: 7984497 - DNA, 20 bp, Homo sapiens
aggctggcactcctggccag

SEQ ID NO: 7984498 - DNA, 20 bp, Homo sapiens
aggctggcactcctggccag

SEQ ID NO: 7984499 - DNA, 20 bp, Homo sapiens
aggctggcactcctggccag

SEQ ID NO: 7984500 - DNA, 20 bp, Homo sapiens
aggctggcactcctggccag

SEQ ID NO: 7984501 - DNA, 20 bp, Homo sapiens
aggctggcactcctggccag

SEQ ID NO: 7984502 - DNA, 20 bp, Homo sapiens
aggctggcactcctggccag

SEQ ID NO: 7984503 - DNA, 22 bp, Homo sapiens
aggctggcagccacctcagcag

SEQ ID NO: 7984504 - DNA, 22 bp, Homo sapiens
aggctggcagccacctcagcag

SEQ ID NO: 7984505 - DNA, 22 bp, Homo sapiens
aggctggagtgtgcagtggcgc

SEQ ID NO: 7984506 - DNA, 22 bp, Homo sapiens
aggctggagtgtgcagtggcgc

SEQ ID NO: 7984507 - DNA, 22 bp, Homo sapiens
aggctggagtgtgcagtggcgc

SEQ ID NO: 7984508 - DNA, 22 bp, Homo sapiens
aggctggagtgtgcagtggcgc

SEQ ID NO: 7984509 - DNA, 22 bp, Homo sapiens
aggctggagtgtgcagtggcgc

SEQ ID NO: 7984510 - DNA, 22 bp, Homo sapiens
aggctggagtgtgcagtggcgc

SEQ ID NO: 7984511 - DNA, 22 bp, Homo sapiens
aggctggagtgtgcagtggcgc

SEQ ID NO: 7984512 - DNA, 22 bp, Homo sapiens
aggctggatgtgcctcaccgag

SEQ ID NO: 7984513 - DNA, 22 bp, Homo sapiens
aggctggatgtgcctcaccgag

SEQ ID NO: 7984514 - DNA, 22 bp, Homo sapiens
aggctggatttatggggacttc

SEQ ID NO: 7984515 - DNA, 22 bp, Homo sapiens
aggctggatttatggggacttc

SEQ ID NO: 7984516 - DNA, 19 bp, Homo sapiens
aggctggatgcccatctta

SEQ ID NO: 7984517 - DNA, 19 bp, Homo sapiens
aggctggatgcccatctta

SEQ ID NO: 7984518 - DNA, 19 bp, Homo sapiens
aggctggatgcccatctta

SEQ ID NO: 7984519 - DNA, 22 bp, Homo sapiens
aggctggatctctgttgccttc

SEQ ID NO: 7984520 - DNA, 22 bp, Homo sapiens
aggctggatctctgttgccttc

SEQ ID NO: 7984521 - DNA, 22 bp, Homo sapiens
aggctggatctctgttgccttc

SEQ ID NO: 7984522 - DNA, 22 bp, Homo sapiens
agggaagaatcactgggatgtt

SEQ ID NO: 7984523 - DNA, 22 bp, Homo sapiens
agggaagaatcactgggatgtt

SEQ ID NO: 7984524 - DNA, 22 bp, Homo sapiens
agggaagaatcactgggatgtt

SEQ ID NO: 7984525 - DNA, 22 bp, Homo sapiens
agggaagaatcactgggatgtt

SEQ ID NO: 7984526 - DNA, 23 bp, Homo sapiens
aggctttatggtagaaagtttgc

SEQ ID NO: 7984527 - DNA, 22 bp, Homo sapiens
aggctttatttgatctatatgc

SEQ ID NO: 7984528 - DNA, 22 bp, Homo sapiens
aggctttcctgtcactcatgct

SEQ ID NO: 7984529 - DNA, 22 bp, Homo sapiens
aggctggcatacatttgttctt

SEQ ID NO: 7984530 - DNA, 22 bp, Homo sapiens
aggctggcagccacctcagcag

SEQ ID NO: 7984531 - DNA, 22 bp, Homo sapiens
aggctttactggatttttcgct

SEQ ID NO: 7984532 - DNA, 22 bp, Homo sapiens
aggctggcagccacctcagcag

SEQ ID NO: 7984533 - DNA, 22 bp, Homo sapiens
aggctggcagccacctcagcag

SEQ ID NO: 7984534 - DNA, 22 bp, Homo sapiens
agggaagagcttgcaagaaacc

SEQ ID NO: 7984535 - DNA, 22 bp, Homo sapiens
agggaagagcttgcaagaaacc

SEQ ID NO: 7984536 - DNA, 22 bp, Homo sapiens
agggaagagcttgcaagaaacc

SEQ ID NO: 7984537 - DNA, 22 bp, Homo sapiens
agggaagagcttgcaagaaacc

SEQ ID NO: 7984538 - DNA, 22 bp, Homo sapiens
agggaagagcttgcaagaaacc

SEQ ID NO: 7984539 - DNA, 22 bp, Homo sapiens
agggaagaggaccagagtctct

SEQ ID NO: 7984540 - DNA, 22 bp, Homo sapiens
agggaagaggaccagagtctct

SEQ ID NO: 7984541 - DNA, 22 bp, Homo sapiens
agggaagaggaccagagtctct

SEQ ID NO: 7984542 - DNA, 22 bp, Homo sapiens
agggaagaggaccagagtctct

SEQ ID NO: 7984543 - DNA, 22 bp, Homo sapiens
agggaagaggaccagagtctct

SEQ ID NO: 7984544 - DNA, 22 bp, Homo sapiens
agggaagaggaccagagtctct

SEQ ID NO: 7984545 - DNA, 22 bp, Homo sapiens
agggaagagcttgcaagaaacc

SEQ ID NO: 7984546 - DNA, 22 bp, Homo sapiens
agggaagagcttgcaagaaacc

SEQ ID NO: 7984547 - DNA, 22 bp, Homo sapiens
agggaagagcttgcaagaaacc

SEQ ID NO: 7984548 - DNA, 22 bp, Homo sapiens
accaggcctagcaagtacatta

SEQ ID NO: 7984549 - DNA, 22 bp, Homo sapiens
accaggcctagcaagtacatta

SEQ ID NO: 7984550 - DNA, 22 bp, Homo sapiens
accaggcctagcaagtacatta

SEQ ID NO: 7984551 - DNA, 22 bp, Homo sapiens
accaggcctagcaagtacatta

SEQ ID NO: 7984552 - DNA, 19 bp, Homo sapiens
accaggcctcagaggccct

SEQ ID NO: 7984553 - DNA, 19 bp, Homo sapiens
accaggcctcagaggccct

SEQ ID NO: 7984554 - DNA, 19 bp, Homo sapiens
accaggcctcagaggccct

SEQ ID NO: 7984555 - DNA, 22 bp, Homo sapiens
accaggccctccagctgcgtgg

SEQ ID NO: 7984556 - DNA, 22 bp, Homo sapiens
accaggccctccagctgcgtgg

SEQ ID NO: 7984557 - DNA, 20 bp, Homo sapiens
accaggcccggtgtctcctc

SEQ ID NO: 7984558 - DNA, 20 bp, Homo sapiens
accaggcccggtgtctcctc

SEQ ID NO: 7984559 - DNA, 22 bp, Homo sapiens
accaggccctccagctgcgtgg

SEQ ID NO: 7984560 - DNA, 22 bp, Homo sapiens
accaggcctagcaagtacatta

SEQ ID NO: 7984561 - DNA, 22 bp, Homo sapiens
accaggccctccagctgcgtgg

SEQ ID NO: 7984562 - DNA, 23 bp, Homo sapiens
agggagctaaaaggctggagcag

SEQ ID NO: 7984563 - DNA, 23 bp, Homo sapiens
agggagctaaaaggctggagcag

SEQ ID NO: 7984564 - DNA, 23 bp, Homo sapiens
agggagctaaaaggctggagcag

SEQ ID NO: 7984565 - DNA, 19 bp, Homo sapiens
accaggcctcagaggccct

SEQ ID NO: 7984566 - DNA, 22 bp, Homo sapiens
agggagccttcctggctgtggt

SEQ ID NO: 7984567 - DNA, 22 bp, Homo sapiens
agggagccttcctggctgtggt

SEQ ID NO: 7984568 - DNA, 22 bp, Homo sapiens
agggagccttcctggctgtggt

SEQ ID NO: 7984569 - DNA, 22 bp, Homo sapiens
agggagctattgtgttactttg

SEQ ID NO: 7984570 - DNA, 20 bp, Homo sapiens
accaggccccgggccctgca

SEQ ID NO: 7984571 - DNA, 20 bp, Homo sapiens
accaggccccgggccctgca

SEQ ID NO: 7984572 - DNA, 20 bp, Homo sapiens
accaggccccgggccctgca

SEQ ID NO: 7984573 - DNA, 20 bp, Homo sapiens
accaggccccgggccctgca

SEQ ID NO: 7984574 - DNA, 22 bp, Homo sapiens
accaggcccatgtggattacta

SEQ ID NO: 7984575 - DNA, 20 bp, Homo sapiens
accaggccccgggccctgca

SEQ ID NO: 7984576 - DNA, 20 bp, Homo sapiens
accaggcccggtgtctcctc

SEQ ID NO: 7984577 - DNA, 22 bp, Homo sapiens
accaggcccgctgctatggtgg

SEQ ID NO: 7984578 - DNA, 22 bp, Homo sapiens
accaggcccgctgctatggtgg

SEQ ID NO: 7984579 - DNA, 22 bp, Homo sapiens
accaggagttgggggtgggacc

SEQ ID NO: 7984580 - DNA, 22 bp, Homo sapiens
accaggagttgggggtgggacc

SEQ ID NO: 7984581 - DNA, 22 bp, Homo sapiens
agggacagtatccatctcacag

SEQ ID NO: 7984582 - DNA, 22 bp, Homo sapiens
agggacagtatccatctcacag

SEQ ID NO: 7984583 - DNA, 22 bp, Homo sapiens
agggacagtatccatctcacag

SEQ ID NO: 7984584 - DNA, 22 bp, Homo sapiens
agggacagtatccatctcacag

SEQ ID NO: 7984585 - DNA, 22 bp, Homo sapiens
agggacagtatccatctcacag

SEQ ID NO: 7984586 - DNA, 22 bp, Homo sapiens
agggacagtatccatctcacag

SEQ ID NO: 7984587 - DNA, 22 bp, Homo sapiens
agggacagtatccatctcacag

SEQ ID NO: 7984588 - DNA, 22 bp, Homo sapiens
accaggagttttgaccaggggc

SEQ ID NO: 7984589 - DNA, 22 bp, Homo sapiens
accaggcccaccgcatgctcct

SEQ ID NO: 7984590 - DNA, 23 bp, Homo sapiens
accaggagttgtctcaggaaaca

SEQ ID NO: 7984591 - DNA, 23 bp, Homo sapiens
accaggagttgtctcaggaaaca

SEQ ID NO: 7984592 - DNA, 23 bp, Homo sapiens
accaggagttgtctcaggaaaca

SEQ ID NO: 7984593 - DNA, 22 bp, Homo sapiens
accaggcccaccgcatgctcct

SEQ ID NO: 7984594 - DNA, 22 bp, Homo sapiens
agggaagcaggaatagctctga

SEQ ID NO: 7984595 - DNA, 22 bp, Homo sapiens
agggaagcaggaatagctctga

SEQ ID NO: 7984596 - DNA, 22 bp, Homo sapiens
agggaagcagcagccgcctgtc

SEQ ID NO: 7984597 - DNA, 22 bp, Homo sapiens
agggaagcagcagccgcctgtc

SEQ ID NO: 7984598 - DNA, 22 bp, Homo sapiens
agggaagcaggaatagctctga

SEQ ID NO: 7984599 - DNA, 22 bp, Homo sapiens
agggaagcaggaatagctctga

SEQ ID NO: 7984600 - DNA, 22 bp, Homo sapiens
agggaagcagcagccgcctgtc

SEQ ID NO: 7984601 - DNA, 22 bp, Homo sapiens
agggaagcaatattagatatca

SEQ ID NO: 7984602 - DNA, 22 bp, Homo sapiens
agggaagcaatgattattattc

SEQ ID NO: 7984603 - DNA, 22 bp, Homo sapiens
agggaagcaatgattattattc

SEQ ID NO: 7984604 - DNA, 22 bp, Homo sapiens
agggaagcaatattagatatca

SEQ ID NO: 7984605 - DNA, 22 bp, Homo sapiens
agggaagatgtctcatcttagg

SEQ ID NO: 7984606 - DNA, 22 bp, Homo sapiens
agggaagaggaccagagtctct

SEQ ID NO: 7984607 - DNA, 22 bp, Homo sapiens
agggaagaggcaaggtttatgg

SEQ ID NO: 7984608 - DNA, 22 bp, Homo sapiens
agggaagaggcaaggtttatgg

SEQ ID NO: 7984609 - DNA, 22 bp, Homo sapiens
agggaagaggaccagagtctct

SEQ ID NO: 7984610 - DNA, 22 bp, Homo sapiens
agggaagaggaccagagtctct

SEQ ID NO: 7984611 - DNA, 22 bp, Homo sapiens
agggaagaggaccagagtctct

SEQ ID NO: 7984612 - DNA, 22 bp, Homo sapiens
agggaagccctggctgagaccc

SEQ ID NO: 7984613 - DNA, 22 bp, Homo sapiens
agggaagccccgaggaggcacc

SEQ ID NO: 7984614 - DNA, 22 bp, Homo sapiens
agggaagccccgaggaggcacc

SEQ ID NO: 7984615 - DNA, 22 bp, Homo sapiens
agggaagcaggaatagctctga

SEQ ID NO: 7984616 - DNA, 22 bp, Homo sapiens
agggaagccaagccttagagaa

SEQ ID NO: 7984617 - DNA, 22 bp, Homo sapiens
agggaagccccgaggaggcacc

SEQ ID NO: 7984618 - DNA, 22 bp, Homo sapiens
agggaagccaagccttagagaa

SEQ ID NO: 7984619 - DNA, 22 bp, Homo sapiens
agggaagccccgaggaggcacc

SEQ ID NO: 7984620 - DNA, 22 bp, Homo sapiens
agggaagccaagccttagagaa

SEQ ID NO: 7984621 - DNA, 22 bp, Homo sapiens
agggaagctgctgggtccacct

SEQ ID NO: 7984622 - DNA, 22 bp, Homo sapiens
agggaagctgctgggtccacct

SEQ ID NO: 7984623 - DNA, 22 bp, Homo sapiens
agggaagctgctgggtccacct

SEQ ID NO: 7984624 - DNA, 22 bp, Homo sapiens
agggaagctgctgggtccacct

SEQ ID NO: 7984625 - DNA, 22 bp, Homo sapiens
agggaagccctggctgagaccc

SEQ ID NO: 7984626 - DNA, 22 bp, Homo sapiens
agggaagccctggctgagaccc

SEQ ID NO: 7984627 - DNA, 22 bp, Homo sapiens
agggaagcttgttactgagaag

SEQ ID NO: 7984628 - DNA, 22 bp, Homo sapiens
agggaatgtagcaagatgccaa

SEQ ID NO: 7984629 - DNA, 22 bp, Homo sapiens
agggaagcttgttactgagaag

SEQ ID NO: 7984630 - DNA, 22 bp, Homo sapiens
agggaattcactggaacgccct

SEQ ID NO: 7984631 - DNA, 22 bp, Homo sapiens
agggaattcactggaacgccct

SEQ ID NO: 7984632 - DNA, 22 bp, Homo sapiens
agggaatgtagcaagatgccaa

SEQ ID NO: 7984633 - DNA, 22 bp, Homo sapiens
agggaatgtgaaaacacctctc

SEQ ID NO: 7984634 - DNA, 22 bp, Homo sapiens
agggaattcactggaacgccct

SEQ ID NO: 7984635 - DNA, 22 bp, Homo sapiens
agggaattcactggaacgccct

SEQ ID NO: 7984636 - DNA, 22 bp, Homo sapiens
agggaattcactggaacgccct

SEQ ID NO: 7984637 - DNA, 22 bp, Homo sapiens
agggacacactccagtgttatt

SEQ ID NO: 7984638 - DNA, 21 bp, Homo sapiens
agggacacacaggatggggct

SEQ ID NO: 7984639 - DNA, 22 bp, Homo sapiens
agggacacgaggtcctgctggg

SEQ ID NO: 7984640 - DNA, 22 bp, Homo sapiens
agggacacgaggtcctgctggg

SEQ ID NO: 7984641 - DNA, 22 bp, Homo sapiens
agggacagatgaatgactgagt

SEQ ID NO: 7984642 - DNA, 22 bp, Homo sapiens
agggacagatgaatgactgagt

SEQ ID NO: 7984643 - DNA, 22 bp, Homo sapiens
agggacagatgaatgactgagt

SEQ ID NO: 7984644 - DNA, 22 bp, Homo sapiens
agggacagatgaatgactgagt

SEQ ID NO: 7984645 - DNA, 22 bp, Homo sapiens
agggacagatgaatgactgagt

SEQ ID NO: 7984646 - DNA, 22 bp, Homo sapiens
agggacagatgaatgactgagt

SEQ ID NO: 7984647 - DNA, 22 bp, Homo sapiens
agggacacttgctttcaggccc

SEQ ID NO: 7984648 - DNA, 22 bp, Homo sapiens
agggacagatgaatgactgagt

SEQ ID NO: 7984649 - DNA, 22 bp, Homo sapiens
agggacagatgaatgactgagt

SEQ ID NO: 7984650 - DNA, 22 bp, Homo sapiens
agggacagatgaatgactgagt

SEQ ID NO: 7984651 - DNA, 22 bp, Homo sapiens
agggacagatgaatgactgagt

SEQ ID NO: 7984652 - DNA, 22 bp, Homo sapiens
agggacagatgaatgactgagt

SEQ ID NO: 7984653 - DNA, 17 bp, Homo sapiens
agggacagcagtttagg

SEQ ID NO: 7984654 - DNA, 17 bp, Homo sapiens
agggacagcagtttagg

SEQ ID NO: 7984655 - DNA, 17 bp, Homo sapiens
agggacagcagtttagg

SEQ ID NO: 7984656 - DNA, 17 bp, Homo sapiens
agggacagcagtttagg

SEQ ID NO: 7984657 - DNA, 17 bp, Homo sapiens
agggacagcagtttagg

SEQ ID NO: 7984658 - DNA, 22 bp, Homo sapiens
aggcaggctggtctgaagagtg

SEQ ID NO: 7984659 - DNA, 22 bp, Homo sapiens
aggcaggctggtctgaagagtg

SEQ ID NO: 7984660 - DNA, 23 bp, Homo sapiens
aggcaggcagttcagctgttgtt

SEQ ID NO: 7984661 - DNA, 23 bp, Homo sapiens
aggcaggcagttcagctgttgtt

SEQ ID NO: 7984662 - DNA, 23 bp, Homo sapiens
aggcaggcagttcagctgttgtt

SEQ ID NO: 7984663 - DNA, 22 bp, Homo sapiens
aggcaggctggtctgaagagtg

SEQ ID NO: 7984664 - DNA, 22 bp, Homo sapiens
aggcaggctggtctgaagagtg

SEQ ID NO: 7984665 - DNA, 22 bp, Homo sapiens
aggcagggaccagttgttttct

SEQ ID NO: 7984666 - DNA, 22 bp, Homo sapiens
aggcagggaccagttgttttct

SEQ ID NO: 7984667 - DNA, 22 bp, Homo sapiens
aggcagggctcatttcttaggc

SEQ ID NO: 7984668 - DNA, 22 bp, Homo sapiens
aggcaggcagctgtcaccactc

SEQ ID NO: 7984669 - DNA, 22 bp, Homo sapiens
aggcaggcagctgtcaccactc

SEQ ID NO: 7984670 - DNA, 17 bp, Homo sapiens
aggcaggcagagcggga

SEQ ID NO: 7984671 - DNA, 22 bp, Homo sapiens
aggcaggcagctgtcaccactc

SEQ ID NO: 7984672 - DNA, 22 bp, Homo sapiens
aggcaggcagggctcactgtct

SEQ ID NO: 7984673 - DNA, 17 bp, Homo sapiens
aggcaggcagagcggga

SEQ ID NO: 7984674 - DNA, 17 bp, Homo sapiens
aggcaggcagagcggga

SEQ ID NO: 7984675 - DNA, 17 bp, Homo sapiens
aggcaggcagagcggga

SEQ ID NO: 7984676 - DNA, 17 bp, Homo sapiens
aggcaggcagagcggga

SEQ ID NO: 7984677 - DNA, 17 bp, Homo sapiens
aggcaggcagagcggga

SEQ ID NO: 7984678 - DNA, 22 bp, Homo sapiens
acatgacttttctcttccagag

SEQ ID NO: 7984679 - DNA, 22 bp, Homo sapiens
acatgacttttctcttccagag

SEQ ID NO: 7984680 - DNA, 22 bp, Homo sapiens
aggcaggggagctggaagggta

SEQ ID NO: 7984681 - DNA, 22 bp, Homo sapiens
aggcaggggagctggaagggta

SEQ ID NO: 7984682 - DNA, 22 bp, Homo sapiens
acatgaaagttattctgagttg

SEQ ID NO: 7984683 - DNA, 22 bp, Homo sapiens
aggcagggctcatttcttaggc

SEQ ID NO: 7984684 - DNA, 22 bp, Homo sapiens
aggcagggctcatttcttaggc

SEQ ID NO: 7984685 - DNA, 22 bp, Homo sapiens
aggcagggctgggattagactc

SEQ ID NO: 7984686 - DNA, 22 bp, Homo sapiens
aggcagggctgggattagactc

SEQ ID NO: 7984687 - DNA, 22 bp, Homo sapiens
aggcagggctgggattagactc

SEQ ID NO: 7984688 - DNA, 22 bp, Homo sapiens
aggcagggctgggattagactc

SEQ ID NO: 7984689 - DNA, 22 bp, Homo sapiens
aggcaggggagctggaagggta

SEQ ID NO: 7984690 - DNA, 22 bp, Homo sapiens
aggcagggctgggattagactc

SEQ ID NO: 7984691 - DNA, 22 bp, Homo sapiens
aggcaggggagctggaagggta

SEQ ID NO: 7984692 - DNA, 22 bp, Homo sapiens
aggcaggggagctggaagggta

SEQ ID NO: 7984693 - DNA, 22 bp, Homo sapiens
acatgagatcacaaagataaat

SEQ ID NO: 7984694 - DNA, 16 bp, Homo sapiens
acatgagataatgcta

SEQ ID NO: 7984695 - DNA, 22 bp, Homo sapiens
acatgagaggctgtggagtaca

SEQ ID NO: 7984696 - DNA, 22 bp, Homo sapiens
acatgagattagctcacccact

SEQ ID NO: 7984697 - DNA, 22 bp, Homo sapiens
acatgagattagctcacccact

SEQ ID NO: 7984698 - DNA, 22 bp, Homo sapiens
acatgagaggctgtggagtaca

SEQ ID NO: 7984699 - DNA, 22 bp, Homo sapiens
acatgaggtaagggatgttaag

SEQ ID NO: 7984700 - DNA, 23 bp, Homo sapiens
acatgatacacaattagcaaacc

SEQ ID NO: 7984701 - DNA, 23 bp, Homo sapiens
acatgatacacaattagcaaacc

SEQ ID NO: 7984702 - DNA, 22 bp, Homo sapiens
acatgatatatgggaaatgctt

SEQ ID NO: 7984703 - DNA, 23 bp, Homo sapiens
acatgatacacaattagcaaacc

SEQ ID NO: 7984704 - DNA, 23 bp, Homo sapiens
acatgatacacaattagcaaacc

SEQ ID NO: 7984705 - DNA, 22 bp, Homo sapiens
acatgatttcagggaattctca

SEQ ID NO: 7984706 - DNA, 22 bp, Homo sapiens
acatgattcttgataggcattg

SEQ ID NO: 7984707 - DNA, 22 bp, Homo sapiens
acatgatttcagggaattctca

SEQ ID NO: 7984708 - DNA, 22 bp, Homo sapiens
acatgatttcagggaattctca

SEQ ID NO: 7984709 - DNA, 22 bp, Homo sapiens
acatgatttgcatgatttgtaa

SEQ ID NO: 7984710 - DNA, 22 bp, Homo sapiens
acatgattaaaagattttaaag

SEQ ID NO: 7984711 - DNA, 22 bp, Homo sapiens
acatgattaaaagattttaaag

SEQ ID NO: 7984712 - DNA, 22 bp, Homo sapiens
acatgattaaaagattttaaag

SEQ ID NO: 7984713 - DNA, 22 bp, Homo sapiens
acatgcaaatgtgcatgcatgt

SEQ ID NO: 7984714 - DNA, 22 bp, Homo sapiens
acatgcaaatgtgcatgcatgt

SEQ ID NO: 7984715 - DNA, 23 bp, Homo sapiens
acatgcaaaaatcacagtctcct

SEQ ID NO: 7984716 - DNA, 22 bp, Homo sapiens
acatgattttagtatcataata

SEQ ID NO: 7984717 - DNA, 22 bp, Homo sapiens
acatgattttagtatcataata

SEQ ID NO: 7984718 - DNA, 22 bp, Homo sapiens
acatgatttgcatgatttgtaa

SEQ ID NO: 7984719 - DNA, 22 bp, Homo sapiens
acatgatttttaaagagataat

SEQ ID NO: 7984720 - DNA, 22 bp, Homo sapiens
acatgatttttaaagagataat

SEQ ID NO: 7984721 - DNA, 19 bp, Homo sapiens
acatgcaaggcacctgcag

SEQ ID NO: 7984722 - DNA, 22 bp, Homo sapiens
acatgcacacctatatacatgt

SEQ ID NO: 7984723 - DNA, 22 bp, Homo sapiens
acatgcacacctatatacatgt

SEQ ID NO: 7984724 - DNA, 19 bp, Homo sapiens
acatgcaaggcacctgcag

SEQ ID NO: 7984725 - DNA, 22 bp, Homo sapiens
acatgcacacgattcagtctgg

SEQ ID NO: 7984726 - DNA, 22 bp, Homo sapiens
acatgcacacgattcagtctgg

SEQ ID NO: 7984727 - DNA, 22 bp, Homo sapiens
acatgcacacgattcagtctgg

SEQ ID NO: 7984728 - DNA, 22 bp, Homo sapiens
acatgcacccagggcattgctt

SEQ ID NO: 7984729 - DNA, 22 bp, Homo sapiens
acatgcacagcaagggtgagag

SEQ ID NO: 7984730 - DNA, 22 bp, Homo sapiens
acatgcacagcaagggtgagag

SEQ ID NO: 7984731 - DNA, 22 bp, Homo sapiens
acatgcacccagttacactctc

SEQ ID NO: 7984732 - DNA, 20 bp, Homo sapiens
acatggcattcccacgtggt

SEQ ID NO: 7984733 - DNA, 22 bp, Homo sapiens
aggcctgcctggagcctggctg

SEQ ID NO: 7984734 - DNA, 22 bp, Homo sapiens
aggcctgcctggagcctggctg

SEQ ID NO: 7984735 - DNA, 22 bp, Homo sapiens
aggcctgcctggatcacacaga

SEQ ID NO: 7984736 - DNA, 22 bp, Homo sapiens
acatggcattcactcccacagg

SEQ ID NO: 7984737 - DNA, 20 bp, Homo sapiens
acatggcattcccacgtggt

SEQ ID NO: 7984738 - DNA, 22 bp, Homo sapiens
acatggcattcactcccacagg

SEQ ID NO: 7984739 - DNA, 19 bp, Homo sapiens
acatggcatcccaggaggt

SEQ ID NO: 7984740 - DNA, 22 bp, Homo sapiens
acatggcacccagatctcaaaa

SEQ ID NO: 7984741 - DNA, 22 bp, Homo sapiens
acatggcagctgatgattggaa

SEQ ID NO: 7984742 - DNA, 22 bp, Homo sapiens
acatggcagctgatgattggaa

SEQ ID NO: 7984743 - DNA, 22 bp, Homo sapiens
acatggcaggaatcatgtgttt

SEQ ID NO: 7984744 - DNA, 22 bp, Homo sapiens
acatggcaggaatcatgtgttt

SEQ ID NO: 7984745 - DNA, 22 bp, Homo sapiens
acatggcaggaatcatgtgttt

SEQ ID NO: 7984746 - DNA, 17 bp, Homo sapiens
acatggcagttcacgct

SEQ ID NO: 7984747 - DNA, 17 bp, Homo sapiens
acatggcagttcacgct

SEQ ID NO: 7984748 - DNA, 19 bp, Homo sapiens
acatggcatcccaggaggt

SEQ ID NO: 7984749 - DNA, 21 bp, Homo sapiens
acatggactgtgaatggggac

SEQ ID NO: 7984750 - DNA, 21 bp, Homo sapiens
acatggactgtgaatggggac

SEQ ID NO: 7984751 - DNA, 22 bp, Homo sapiens
acatggagaccagatggaagta

SEQ ID NO: 7984752 - DNA, 22 bp, Homo sapiens
acatggagaccagatggaagta

SEQ ID NO: 7984753 - DNA, 22 bp, Homo sapiens
acatggagctcaaacatgagtg

SEQ ID NO: 7984754 - DNA, 22 bp, Homo sapiens
acatggagctcaaacatgagtg

SEQ ID NO: 7984755 - DNA, 22 bp, Homo sapiens
acatggatgaattgtctagtgg

SEQ ID NO: 7984756 - DNA, 21 bp, Homo sapiens
acatggatataggactgaatt

SEQ ID NO: 7984757 - DNA, 22 bp, Homo sapiens
acatggattgttttaaaagatg

SEQ ID NO: 7984758 - DNA, 22 bp, Homo sapiens
acatggcaaaaccccgtttcta

SEQ ID NO: 7984759 - DNA, 22 bp, Homo sapiens
acatggcacccagatctcaaaa

SEQ ID NO: 7984760 - DNA, 22 bp, Homo sapiens
acatggcaaaagggactttaca

SEQ ID NO: 7984761 - DNA, 22 bp, Homo sapiens
acatggaaagtactccacaatt

SEQ ID NO: 7984762 - DNA, 21 bp, Homo sapiens
acatggaagagaaattaacca

SEQ ID NO: 7984763 - DNA, 21 bp, Homo sapiens
acatggaagagaaattaacca

SEQ ID NO: 7984764 - DNA, 22 bp, Homo sapiens
acatggaagataaaaatactca

SEQ ID NO: 7984765 - DNA, 22 bp, Homo sapiens
acatggaagcaaagttctattt

SEQ ID NO: 7984766 - DNA, 20 bp, Homo sapiens
acatggaaggtcaaactatc

SEQ ID NO: 7984767 - DNA, 22 bp, Homo sapiens
aggcccttgggtcctctccaca

SEQ ID NO: 7984768 - DNA, 22 bp, Homo sapiens
aggcccttggactcatgctcga

SEQ ID NO: 7984769 - DNA, 22 bp, Homo sapiens
aggcccttggactcatgctcga

SEQ ID NO: 7984770 - DNA, 22 bp, Homo sapiens
aggccgaagtggatgggcatct

SEQ ID NO: 7984771 - DNA, 22 bp, Homo sapiens
acatggaaaactaactgctttt

SEQ ID NO: 7984772 - DNA, 22 bp, Homo sapiens
aggcccttaggacccctgcgtg

SEQ ID NO: 7984773 - DNA, 22 bp, Homo sapiens
aggcccttaggacccctgcgtg

SEQ ID NO: 7984774 - DNA, 22 bp, Homo sapiens
aggcccttggactcatgctcga

SEQ ID NO: 7984775 - DNA, 22 bp, Homo sapiens
aggcccttcttggtggctcagg

SEQ ID NO: 7984776 - DNA, 22 bp, Homo sapiens
aggccctgttgtagcattttgg

SEQ ID NO: 7984777 - DNA, 20 bp, Homo sapiens
aggccctgccagggacggag

SEQ ID NO: 7984778 - DNA, 22 bp, Homo sapiens
acatgcataaactacttcttat

SEQ ID NO: 7984779 - DNA, 20 bp, Homo sapiens
acatgcagtggtcatttcag

SEQ ID NO: 7984780 - DNA, 20 bp, Homo sapiens
acatgcagtggtcatttcag

SEQ ID NO: 7984781 - DNA, 20 bp, Homo sapiens
acatgcagtggtcatttcag

SEQ ID NO: 7984782 - DNA, 22 bp, Homo sapiens
acatgcaggaaaatgcacagat

SEQ ID NO: 7984783 - DNA, 22 bp, Homo sapiens
acatgcaggtgatctggtcaat

SEQ ID NO: 7984784 - DNA, 22 bp, Homo sapiens
acatgcaggtgatctggtcaat

SEQ ID NO: 7984785 - DNA, 22 bp, Homo sapiens
acatgcagggctttttgcctct

SEQ ID NO: 7984786 - DNA, 22 bp, Homo sapiens
acatgcagggctttttgcctct

SEQ ID NO: 7984787 - DNA, 22 bp, Homo sapiens
acatgcagtgaggatcttagaa

SEQ ID NO: 7984788 - DNA, 22 bp, Homo sapiens
acatgcagggctttttgcctct

SEQ ID NO: 7984789 - DNA, 22 bp, Homo sapiens
acatgcaggtgatctggtcaat

SEQ ID NO: 7984790 - DNA, 22 bp, Homo sapiens
acatgcaggtgatctggtcaat

SEQ ID NO: 7984791 - DNA, 22 bp, Homo sapiens
acatgcagtgaggatcttagaa

SEQ ID NO: 7984792 - DNA, 20 bp, Homo sapiens
acatgcagtggtcatttcag

SEQ ID NO: 7984793 - DNA, 22 bp, Homo sapiens
acatgcagtgagtagttctcca

SEQ ID NO: 7984794 - DNA, 22 bp, Homo sapiens
acatgcagtgagtagttctcca

SEQ ID NO: 7984795 - DNA, 20 bp, Homo sapiens
acatgcacgtgtgtatatat

SEQ ID NO: 7984796 - DNA, 20 bp, Homo sapiens
acatgcacgtgtgtatatat

SEQ ID NO: 7984797 - DNA, 22 bp, Homo sapiens
acatgcacggcaccatcttctg

SEQ ID NO: 7984798 - DNA, 22 bp, Homo sapiens
acatgcacggcaccatcttctg

SEQ ID NO: 7984799 - DNA, 22 bp, Homo sapiens
acatgcactggttgaggggttt

SEQ ID NO: 7984800 - DNA, 22 bp, Homo sapiens
acatgcactggttgaggggttt

SEQ ID NO: 7984801 - DNA, 22 bp, Homo sapiens
acatgcactgctcagggttccg

SEQ ID NO: 7984802 - DNA, 22 bp, Homo sapiens
acatgcactctcactgtgctct

SEQ ID NO: 7984803 - DNA, 22 bp, Homo sapiens
acatgcactctcactgtgctct

SEQ ID NO: 7984804 - DNA, 22 bp, Homo sapiens
acatgcagaattcttagagagc

SEQ ID NO: 7984805 - DNA, 22 bp, Homo sapiens
acatgcagacgggatcctggca

SEQ ID NO: 7984806 - DNA, 22 bp, Homo sapiens
acatgcagacgggatcctggca

SEQ ID NO: 7984807 - DNA, 22 bp, Homo sapiens
acatgcagaattcttagagagc

SEQ ID NO: 7984808 - DNA, 22 bp, Homo sapiens
acatgcaggaaaatgcacagat

SEQ ID NO: 7984809 - DNA, 22 bp, Homo sapiens
acatgcaggaaaatgcacagat

SEQ ID NO: 7984810 - DNA, 22 bp, Homo sapiens
acatgcaggaaaatgcacagat

SEQ ID NO: 7984811 - DNA, 22 bp, Homo sapiens
acatgcagagggagggccaggc

SEQ ID NO: 7984812 - DNA, 22 bp, Homo sapiens
acatgcagagggagggccaggc

SEQ ID NO: 7984813 - DNA, 22 bp, Homo sapiens
aggccctgtccatggtgctgaa

SEQ ID NO: 7984814 - DNA, 22 bp, Homo sapiens
aggccctgtccatggtgctgaa

SEQ ID NO: 7984815 - DNA, 22 bp, Homo sapiens
aggccctgtccatggtgctgaa

SEQ ID NO: 7984816 - DNA, 22 bp, Homo sapiens
aggccctgtccatggtgctgaa

SEQ ID NO: 7984817 - DNA, 22 bp, Homo sapiens
aggccctgtccatggtgctgaa

SEQ ID NO: 7984818 - DNA, 22 bp, Homo sapiens
aggccctgtccatggtgctgaa

SEQ ID NO: 7984819 - DNA, 22 bp, Homo sapiens
aggccctgttatgagccactgt

SEQ ID NO: 7984820 - DNA, 22 bp, Homo sapiens
aggccctgttatgagccactgt

SEQ ID NO: 7984821 - DNA, 22 bp, Homo sapiens
aggccctgtccatggtgctgaa

SEQ ID NO: 7984822 - DNA, 20 bp, Homo sapiens
aggccctgtgcatcttgttt

SEQ ID NO: 7984823 - DNA, 22 bp, Homo sapiens
aggccctgttatgagccactgt

SEQ ID NO: 7984824 - DNA, 22 bp, Homo sapiens
aggccctgcccagagctcctcg

SEQ ID NO: 7984825 - DNA, 22 bp, Homo sapiens
aggccctgcccagagctcctcg

SEQ ID NO: 7984826 - DNA, 22 bp, Homo sapiens
aggccctggtcaggtctggctg

SEQ ID NO: 7984827 - DNA, 22 bp, Homo sapiens
aggccctggtcaggtctggctg

SEQ ID NO: 7984828 - DNA, 22 bp, Homo sapiens
aggccctgcccagagctcctcg

SEQ ID NO: 7984829 - DNA, 22 bp, Homo sapiens
aggccctgtaaggtgtggagat

SEQ ID NO: 7984830 - DNA, 22 bp, Homo sapiens
aggccctgtaaggtgtggagat

SEQ ID NO: 7984831 - DNA, 22 bp, Homo sapiens
aggccctgtaaggtgtggagat

SEQ ID NO: 7984832 - DNA, 22 bp, Homo sapiens
aggccctgtaaggtgtggagat

SEQ ID NO: 7984833 - DNA, 22 bp, Homo sapiens
aggccctggtcaggtctggctg

SEQ ID NO: 7984834 - DNA, 22 bp, Homo sapiens
aggccctgtaaggtgtggagat

SEQ ID NO: 7984835 - DNA, 22 bp, Homo sapiens
aggccctggtcaggtctggctg

SEQ ID NO: 7984836 - DNA, 22 bp, Homo sapiens
acattgtatacagacttagtca

SEQ ID NO: 7984837 - DNA, 22 bp, Homo sapiens
aggctatttccactcttctcat

SEQ ID NO: 7984838 - DNA, 22 bp, Homo sapiens
aggctatttccactcttctcat

SEQ ID NO: 7984839 - DNA, 22 bp, Homo sapiens
aggctatggtggggccagtggc

SEQ ID NO: 7984840 - DNA, 22 bp, Homo sapiens
aggctatggtggggccagtggc

SEQ ID NO: 7984841 - DNA, 22 bp, Homo sapiens
aggctaggggcagtgccagcat

SEQ ID NO: 7984842 - DNA, 22 bp, Homo sapiens
aggctaggggcagtgccagcat

SEQ ID NO: 7984843 - DNA, 22 bp, Homo sapiens
aggctaggggcagtgccagcat

SEQ ID NO: 7984844 - DNA, 22 bp, Homo sapiens
aggctagggtaacagatgtggc

SEQ ID NO: 7984845 - DNA, 22 bp, Homo sapiens
aggctaggaatcaagcctttct

SEQ ID NO: 7984846 - DNA, 22 bp, Homo sapiens
aggctaggcatgtgctaccaca

SEQ ID NO: 7984847 - DNA, 22 bp, Homo sapiens
aggctaggctgatgcctcttcc

SEQ ID NO: 7984848 - DNA, 22 bp, Homo sapiens
aggctaggccttgccctggaac

SEQ ID NO: 7984849 - DNA, 22 bp, Homo sapiens
aggctaggcatgtgctaccaca

SEQ ID NO: 7984850 - DNA, 22 bp, Homo sapiens
aggctagggccatggctggtga

SEQ ID NO: 7984851 - DNA, 22 bp, Homo sapiens
aggctagggccatggctggtga

SEQ ID NO: 7984852 - DNA, 22 bp, Homo sapiens
aggctaggctgatgcctcttcc

SEQ ID NO: 7984853 - DNA, 22 bp, Homo sapiens
aggctaggctgatgcctcttcc

SEQ ID NO: 7984854 - DNA, 22 bp, Homo sapiens
aggctagggccatggctggtga

SEQ ID NO: 7984855 - DNA, 22 bp, Homo sapiens
aggctagggccatggctggtga

SEQ ID NO: 7984856 - DNA, 19 bp, Homo sapiens
acatttaaattcagatctc

SEQ ID NO: 7984857 - DNA, 22 bp, Homo sapiens
acattgtgatccgactgattaa

SEQ ID NO: 7984858 - DNA, 22 bp, Homo sapiens
acattgtgcctgtgatattaca

SEQ ID NO: 7984859 - DNA, 22 bp, Homo sapiens
acatttaaccaaactgtttaat

SEQ ID NO: 7984860 - DNA, 22 bp, Homo sapiens
acatttaaccctcaggtttctg

SEQ ID NO: 7984861 - DNA, 22 bp, Homo sapiens
acatttaaccctcaggtttctg

SEQ ID NO: 7984862 - DNA, 22 bp, Homo sapiens
acatttaaccaaactgtttaat

SEQ ID NO: 7984863 - DNA, 22 bp, Homo sapiens
acatttaaccaaactgtttaat

SEQ ID NO: 7984864 - DNA, 22 bp, Homo sapiens
acatttaagttaaaacctcagt

SEQ ID NO: 7984865 - DNA, 22 bp, Homo sapiens
acatttaacctttgaggaactg

SEQ ID NO: 7984866 - DNA, 22 bp, Homo sapiens
acatttaacctttgaggaactg

SEQ ID NO: 7984867 - DNA, 22 bp, Homo sapiens
acatttaacctttgaggaactg

SEQ ID NO: 7984868 - DNA, 22 bp, Homo sapiens
acatttaaccctcaggtttctg

SEQ ID NO: 7984869 - DNA, 22 bp, Homo sapiens
acatttaaccctcaggtttctg

SEQ ID NO: 7984870 - DNA, 22 bp, Homo sapiens
acatttaatgatcctactgtga

SEQ ID NO: 7984871 - DNA, 22 bp, Homo sapiens
acatttaatgatcctactgtga

SEQ ID NO: 7984872 - DNA, 22 bp, Homo sapiens
acatttaatgatcctactgtga

SEQ ID NO: 7984873 - DNA, 22 bp, Homo sapiens
acatttaagttaaaacctcagt

SEQ ID NO: 7984874 - DNA, 22 bp, Homo sapiens
acatttaagttaaaacctcagt

SEQ ID NO: 7984875 - DNA, 22 bp, Homo sapiens
acatttaagttaaaacctcagt

SEQ ID NO: 7984876 - DNA, 22 bp, Homo sapiens
aggcctttgtggagctcatggc

SEQ ID NO: 7984877 - DNA, 22 bp, Homo sapiens
aggcctttgtggagctcatggc

SEQ ID NO: 7984878 - DNA, 20 bp, Homo sapiens
aggccttgtttatagtgaga

SEQ ID NO: 7984879 - DNA, 20 bp, Homo sapiens
aggccttgtttatagtgaga

SEQ ID NO: 7984880 - DNA, 22 bp, Homo sapiens
aggcctttgtacaataatcata

SEQ ID NO: 7984881 - DNA, 16 bp, Homo sapiens
aggcgaaggttcattt

SEQ ID NO: 7984882 - DNA, 22 bp, Homo sapiens
aggcgaagggaccagacggtag

SEQ ID NO: 7984883 - DNA, 22 bp, Homo sapiens
aggcgcagaaggccaggggcct

SEQ ID NO: 7984884 - DNA, 22 bp, Homo sapiens
aggcgcagaaggccaggggcct

SEQ ID NO: 7984885 - DNA, 22 bp, Homo sapiens
aggcgcagacatacagggtctg

SEQ ID NO: 7984886 - DNA, 22 bp, Homo sapiens
aggcgcagacatacagggtctg

SEQ ID NO: 7984887 - DNA, 22 bp, Homo sapiens
aggcgcagacatacagggtctg

SEQ ID NO: 7984888 - DNA, 22 bp, Homo sapiens
aggctagctgattgccttagaa

SEQ ID NO: 7984889 - DNA, 22 bp, Homo sapiens
aggctagctaatgagtactgtg

SEQ ID NO: 7984890 - DNA, 22 bp, Homo sapiens
aggctagctgtttcagggctag

SEQ ID NO: 7984891 - DNA, 22 bp, Homo sapiens
aggctagctgtttcagggctag

SEQ ID NO: 7984892 - DNA, 22 bp, Homo sapiens
aggctagctgattgccttagaa

SEQ ID NO: 7984893 - DNA, 22 bp, Homo sapiens
aggcgctgagtaggcaaggagg

SEQ ID NO: 7984894 - DNA, 22 bp, Homo sapiens
aggcgcctgcgggatccttgcc

SEQ ID NO: 7984895 - DNA, 22 bp, Homo sapiens
aggcgcagcacgtgagagttgg

SEQ ID NO: 7984896 - DNA, 22 bp, Homo sapiens
aggcgcagggtttggacccagg

SEQ ID NO: 7984897 - DNA, 22 bp, Homo sapiens
aggcgcagggtttggacccagg

SEQ ID NO: 7984898 - DNA, 22 bp, Homo sapiens
aggcctgcctggatcacacaga

SEQ ID NO: 7984899 - DNA, 22 bp, Homo sapiens
aggcctgcctggatcacacaga

SEQ ID NO: 7984900 - DNA, 22 bp, Homo sapiens
aggcctgttccttcctgggcac

SEQ ID NO: 7984901 - DNA, 22 bp, Homo sapiens
aggcctgttccaggcccctttt

SEQ ID NO: 7984902 - DNA, 22 bp, Homo sapiens
aggcctgtttccttgggttgct

SEQ ID NO: 7984903 - DNA, 22 bp, Homo sapiens
aggcctgtttccttgggttgct

SEQ ID NO: 7984904 - DNA, 22 bp, Homo sapiens
aggcctgttggcgtgggctcta

SEQ ID NO: 7984905 - DNA, 22 bp, Homo sapiens
aggccttaccatagctgtagca

SEQ ID NO: 7984906 - DNA, 22 bp, Homo sapiens
aggccttaccatagctgtagca

SEQ ID NO: 7984907 - DNA, 22 bp, Homo sapiens
aggccttaccatagctgtagca

SEQ ID NO: 7984908 - DNA, 22 bp, Homo sapiens
aggccttaccatagctgtagca

SEQ ID NO: 7984909 - DNA, 22 bp, Homo sapiens
aggcctgtttcttgtccagctc

SEQ ID NO: 7984910 - DNA, 22 bp, Homo sapiens
aggccttaccatagctgtagca

SEQ ID NO: 7984911 - DNA, 22 bp, Homo sapiens
aggccttcctcggagacaggga

SEQ ID NO: 7984912 - DNA, 22 bp, Homo sapiens
aggccttcctcggagacaggga

SEQ ID NO: 7984913 - DNA, 22 bp, Homo sapiens
aggccttggaagccagggagcc

SEQ ID NO: 7984914 - DNA, 22 bp, Homo sapiens
aggccttggcagaggccaggct

SEQ ID NO: 7984915 - DNA, 22 bp, Homo sapiens
aggccttgtgagaagcagagaa

SEQ ID NO: 7984916 - DNA, 22 bp, Homo sapiens
aggccttgtgagaagcagagaa

SEQ ID NO: 7984917 - DNA, 22 bp, Homo sapiens
aggccttgtaatggaggggaaa

SEQ ID NO: 7984918 - DNA, 22 bp, Homo sapiens
aggccttgtaatggaggggaaa

SEQ ID NO: 7984919 - DNA, 22 bp, Homo sapiens
aggccttgccaatgagagaact

SEQ ID NO: 7984920 - DNA, 22 bp, Homo sapiens
aggccttgccaatgagagaact

SEQ ID NO: 7984921 - DNA, 22 bp, Homo sapiens
aggccttggaagccagggagcc

SEQ ID NO: 7984922 - DNA, 22 bp, Homo sapiens
aggccttgccaatgagagaact

SEQ ID NO: 7984923 - DNA, 22 bp, Homo sapiens
aggccttgccaatgagagaact

SEQ ID NO: 7984924 - DNA, 22 bp, Homo sapiens
aggccttgaaccttgctgggtg

SEQ ID NO: 7984925 - DNA, 22 bp, Homo sapiens
aggccttgatttaaattttgat

SEQ ID NO: 7984926 - DNA, 22 bp, Homo sapiens
aggccttgccaatgagagaact

SEQ ID NO: 7984927 - DNA, 22 bp, Homo sapiens
aggccttcctcggagacaggga

SEQ ID NO: 7984928 - DNA, 22 bp, Homo sapiens
acatttatataactcactagga

SEQ ID NO: 7984929 - DNA, 22 bp, Homo sapiens
acatttatataactcactagga

SEQ ID NO: 7984930 - DNA, 22 bp, Homo sapiens
acatttatataactcactagga

SEQ ID NO: 7984931 - DNA, 22 bp, Homo sapiens
acatttatataactcactagga

SEQ ID NO: 7984932 - DNA, 22 bp, Homo sapiens
acatttattactcaggttgttg

SEQ ID NO: 7984933 - DNA, 22 bp, Homo sapiens
acatttatatttagtggggaat

SEQ ID NO: 7984934 - DNA, 22 bp, Homo sapiens
acatttatatttagtggggaat

SEQ ID NO: 7984935 - DNA, 22 bp, Homo sapiens
acatttattttcagctgggaaa

SEQ ID NO: 7984936 - DNA, 22 bp, Homo sapiens
acatttattactcaggttgttg

SEQ ID NO: 7984937 - DNA, 22 bp, Homo sapiens
acatttattttcagctgggaaa

SEQ ID NO: 7984938 - DNA, 22 bp, Homo sapiens
acatttattttggcacggcaca

SEQ ID NO: 7984939 - DNA, 22 bp, Homo sapiens
acatttattttggcacggcaca

SEQ ID NO: 7984940 - DNA, 22 bp, Homo sapiens
acatttattttggcacggcaca

SEQ ID NO: 7984941 - DNA, 23 bp, Homo sapiens
acatttcaatactgagggtctga

SEQ ID NO: 7984942 - DNA, 22 bp, Homo sapiens
acatttcactgttcacagcagg

SEQ ID NO: 7984943 - DNA, 22 bp, Homo sapiens
acatttaatgatcctactgtga

SEQ ID NO: 7984944 - DNA, 22 bp, Homo sapiens
acatttaatgatcctactgtga

SEQ ID NO: 7984945 - DNA, 22 bp, Homo sapiens
acatttacagtgctagacaatc

SEQ ID NO: 7984946 - DNA, 22 bp, Homo sapiens
acatttacagtgctagacaatc

SEQ ID NO: 7984947 - DNA, 22 bp, Homo sapiens
acatttacagtgctagacaatc

SEQ ID NO: 7984948 - DNA, 22 bp, Homo sapiens
acatttacttatcaaaagtcag

SEQ ID NO: 7984949 - DNA, 22 bp, Homo sapiens
acatttacctagttaagtcaat

SEQ ID NO: 7984950 - DNA, 22 bp, Homo sapiens
acatttacctagttaagtcaat

SEQ ID NO: 7984951 - DNA, 22 bp, Homo sapiens
acatttacctagttaagtcaat

SEQ ID NO: 7984952 - DNA, 22 bp, Homo sapiens
acatttaccctggaacattgga

SEQ ID NO: 7984953 - DNA, 22 bp, Homo sapiens
acatttatataactcactagga

SEQ ID NO: 7984954 - DNA, 22 bp, Homo sapiens
acatttatataactcactagga

SEQ ID NO: 7984955 - DNA, 22 bp, Homo sapiens
acatttatataactcactagga

SEQ ID NO: 7984956 - DNA, 22 bp, Homo sapiens
acatttatataactcactagga

SEQ ID NO: 7984957 - DNA, 22 bp, Homo sapiens
acatttaggatgttttgagaga

SEQ ID NO: 7984958 - DNA, 18 bp, Homo sapiens
acatttaggagagtcaat

SEQ ID NO: 7984959 - DNA, 18 bp, Homo sapiens
acatttaggagagtcaat

SEQ ID NO: 7984960 - DNA, 22 bp, Homo sapiens
acatttagatggtgttatagta

SEQ ID NO: 7984961 - DNA, 22 bp, Homo sapiens
acatttagctgtacaatctatg

SEQ ID NO: 7984962 - DNA, 22 bp, Homo sapiens
acatttagagttctttactcca

SEQ ID NO: 7984963 - DNA, 19 bp, Homo sapiens
acatttagaatgtacttgc

SEQ ID NO: 7984964 - DNA, 22 bp, Homo sapiens
acatttacctagttaagtcaat

SEQ ID NO: 7984965 - DNA, 19 bp, Homo sapiens
acatttagaatgtacttgc

SEQ ID NO: 7984966 - DNA, 19 bp, Homo sapiens
acatttagaatgtacttgc

SEQ ID NO: 7984967 - DNA, 22 bp, Homo sapiens
aggctgaggctttccttggaga

SEQ ID NO: 7984968 - DNA, 22 bp, Homo sapiens
aggctgaggctttccttggaga

SEQ ID NO: 7984969 - DNA, 22 bp, Homo sapiens
aggctgaggctttccttggaga

SEQ ID NO: 7984970 - DNA, 22 bp, Homo sapiens
aggctgaggctttccttggaga

SEQ ID NO: 7984971 - DNA, 22 bp, Homo sapiens
aggctgagggctcctgagggca

SEQ ID NO: 7984972 - DNA, 22 bp, Homo sapiens
aggctgagggctcctgagggca

SEQ ID NO: 7984973 - DNA, 22 bp, Homo sapiens
aggctgaggctttccttggaga

SEQ ID NO: 7984974 - DNA, 22 bp, Homo sapiens
aggctgaggctttccttggaga

SEQ ID NO: 7984975 - DNA, 22 bp, Homo sapiens
aggctgagggctcctgagggca

SEQ ID NO: 7984976 - DNA, 22 bp, Homo sapiens
aggctgaggctttccttggaga

SEQ ID NO: 7984977 - DNA, 22 bp, Homo sapiens
aggctgagggctcctgagggca

SEQ ID NO: 7984978 - DNA, 22 bp, Homo sapiens
aggctgagggctcctgagggca

SEQ ID NO: 7984979 - DNA, 22 bp, Homo sapiens
acatttcactgttcacagcagg

SEQ ID NO: 7984980 - DNA, 22 bp, Homo sapiens
aggctgaggatccctgtgttct

SEQ ID NO: 7984981 - DNA, 22 bp, Homo sapiens
aggctgaggatccctgtgttct

SEQ ID NO: 7984982 - DNA, 22 bp, Homo sapiens
aggctgaggctggcagctccag

SEQ ID NO: 7984983 - DNA, 22 bp, Homo sapiens
aggctgaggatccctgtgttct

SEQ ID NO: 7984984 - DNA, 22 bp, Homo sapiens
aggctgaggatccctgtgttct

SEQ ID NO: 7984985 - DNA, 22 bp, Homo sapiens
aggctgaggatccctgtgttct

SEQ ID NO: 7984986 - DNA, 22 bp, Homo sapiens
aggctgaggctggcagctccag

SEQ ID NO: 7984987 - DNA, 22 bp, Homo sapiens
aggctgaggctggcagctccag

SEQ ID NO: 7984988 - DNA, 22 bp, Homo sapiens
aggctgaggctggcagctccag

SEQ ID NO: 7984989 - DNA, 22 bp, Homo sapiens
aggctgaggctggcagctccag

SEQ ID NO: 7984990 - DNA, 22 bp, Homo sapiens
aggctgaggctggcagctccag

SEQ ID NO: 7984991 - DNA, 22 bp, Homo sapiens
aggctgaggctggcagctccag

SEQ ID NO: 7984992 - DNA, 22 bp, Homo sapiens
aggctgagtttctcattctcgc

SEQ ID NO: 7984993 - DNA, 22 bp, Homo sapiens
aggctgagtttctcattctcgc

SEQ ID NO: 7984994 - DNA, 22 bp, Homo sapiens
aggctgatgctggctgaggctg

SEQ ID NO: 7984995 - DNA, 22 bp, Homo sapiens
aggctgagtttctcattctcgc

SEQ ID NO: 7984996 - DNA, 22 bp, Homo sapiens
aggctgagtttctcattctcgc

SEQ ID NO: 7984997 - DNA, 22 bp, Homo sapiens
aggctgagtttctcattctcgc

SEQ ID NO: 7984998 - DNA, 22 bp, Homo sapiens
aggctgagtttctcattctcgc

SEQ ID NO: 7984999 - DNA, 19 bp, Homo sapiens
aggctgcaaggtggtgggc

SEQ ID NO: 7985000 - DNA, 18 bp, Homo sapiens
aggctgcactgtcttaaa

SEQ ID NO: 7985001 - DNA, 18 bp, Homo sapiens
aggctgcactgtcttaaa

SEQ ID NO: 7985002 - DNA, 22 bp, Homo sapiens
aggctgattgaagtttttgtgg

SEQ ID NO: 7985003 - DNA, 22 bp, Homo sapiens
aggctgatgctggctgaggctg

SEQ ID NO: 7985004 - DNA, 22 bp, Homo sapiens
aggctgaggggcgagggaccct

SEQ ID NO: 7985005 - DNA, 22 bp, Homo sapiens
aggctgagtgctcccctagatg

SEQ ID NO: 7985006 - DNA, 22 bp, Homo sapiens
aggctgagtgctcccctagatg

SEQ ID NO: 7985007 - DNA, 22 bp, Homo sapiens
aggctgagtgctcccctagatg

SEQ ID NO: 7985008 - DNA, 22 bp, Homo sapiens
aggctgagggctcctgagggca

SEQ ID NO: 7985009 - DNA, 22 bp, Homo sapiens
aggctgagggctcctgagggca

SEQ ID NO: 7985010 - DNA, 22 bp, Homo sapiens
aggctgagggctcctgagggca

SEQ ID NO: 7985011 - DNA, 20 bp, Homo sapiens
aggctgagttctatgcactt

SEQ ID NO: 7985012 - DNA, 20 bp, Homo sapiens
aggctgagttctatgcactt

SEQ ID NO: 7985013 - DNA, 20 bp, Homo sapiens
aggctgagttctatgcactt

SEQ ID NO: 7985014 - DNA, 22 bp, Homo sapiens
aggctgagtgctcccctagatg

SEQ ID NO: 7985015 - DNA, 22 bp, Homo sapiens
aggctgagtttctcattctcgc

SEQ ID NO: 7985016 - DNA, 20 bp, Homo sapiens
aggctgagttctatgcactt

SEQ ID NO: 7985017 - DNA, 22 bp, Homo sapiens
aacctggccctaatcccagtag

SEQ ID NO: 7985018 - DNA, 22 bp, Homo sapiens
aacctggccccagattccccat

SEQ ID NO: 7985019 - DNA, 22 bp, Homo sapiens
aacctggccccagattccccat

SEQ ID NO: 7985020 - DNA, 22 bp, Homo sapiens
aacctggccccagattccccat

SEQ ID NO: 7985021 - DNA, 22 bp, Homo sapiens
aacctggccctaatcccagtag

SEQ ID NO: 7985022 - DNA, 22 bp, Homo sapiens
aacctggccctaatcccagtag

SEQ ID NO: 7985023 - DNA, 22 bp, Homo sapiens
aacctggctcatgcagaaccct

SEQ ID NO: 7985024 - DNA, 22 bp, Homo sapiens
aacctggctgcaaagaagggga

SEQ ID NO: 7985025 - DNA, 22 bp, Homo sapiens
aacctgctttctcagagaaggg

SEQ ID NO: 7985026 - DNA, 22 bp, Homo sapiens
aacctggaggctgtgtagtctt

SEQ ID NO: 7985027 - DNA, 22 bp, Homo sapiens
aacctgttccctggtccttgac

SEQ ID NO: 7985028 - DNA, 22 bp, Homo sapiens
aacctgggcttgaacagtgcct

SEQ ID NO: 7985029 - DNA, 22 bp, Homo sapiens
aacctggctgccagcaatgtgt

SEQ ID NO: 7985030 - DNA, 22 bp, Homo sapiens
aacctggctcatgcagaaccct

SEQ ID NO: 7985031 - DNA, 22 bp, Homo sapiens
aacctgttttggttgcatttca

SEQ ID NO: 7985032 - DNA, 22 bp, Homo sapiens
aaccttatcatgcataagtaga

SEQ ID NO: 7985033 - DNA, 19 bp, Homo sapiens
aaccttagcttctcaggcc

SEQ ID NO: 7985034 - DNA, 22 bp, Homo sapiens
aacctgagtcttttgatttgct

SEQ ID NO: 7985035 - DNA, 22 bp, Homo sapiens
aacctgctttctcagagaaggg

SEQ ID NO: 7985036 - DNA, 20 bp, Homo sapiens
aacctgaggcagtgttccag

SEQ ID NO: 7985037 - DNA, 22 bp, Homo sapiens
aacctgagggcaggaccccata

SEQ ID NO: 7985038 - DNA, 21 bp, Homo sapiens
aacctgagacccacgggacta

SEQ ID NO: 7985039 - DNA, 22 bp, Homo sapiens
aacctgagataataggagagta

SEQ ID NO: 7985040 - DNA, 22 bp, Homo sapiens
aacctgagatactggtctttat

SEQ ID NO: 7985041 - DNA, 22 bp, Homo sapiens
aacctgagcgcgttgctttcta

SEQ ID NO: 7985042 - DNA, 22 bp, Homo sapiens
aacctgaatttaattgaaatga

SEQ ID NO: 7985043 - DNA, 21 bp, Homo sapiens
aacctgagacccacgggacta

SEQ ID NO: 7985044 - DNA, 22 bp, Homo sapiens
aaccttttgcaagtgccttgac

SEQ ID NO: 7985045 - DNA, 22 bp, Homo sapiens
aaccttttgcaagtgccttgac

SEQ ID NO: 7985046 - DNA, 22 bp, Homo sapiens
aaccttttgcaagtgccttgac

SEQ ID NO: 7985047 - DNA, 22 bp, Homo sapiens
aacgaatagggatttttctaac

SEQ ID NO: 7985048 - DNA, 22 bp, Homo sapiens
aacctttgaggggagctctttc

SEQ ID NO: 7985049 - DNA, 19 bp, Homo sapiens
aacctttagatcattctcc

SEQ ID NO: 7985050 - DNA, 22 bp, Homo sapiens
aacctttgaggggagctctttc

SEQ ID NO: 7985051 - DNA, 22 bp, Homo sapiens
aacctttatttggtactattct

SEQ ID NO: 7985052 - DNA, 22 bp, Homo sapiens
aaccttcttgtgcagaactgta

SEQ ID NO: 7985053 - DNA, 22 bp, Homo sapiens
aaccttcacttgcttcatttga

SEQ ID NO: 7985054 - DNA, 22 bp, Homo sapiens
aaccttgaatacttaaatacat

SEQ ID NO: 7985055 - DNA, 22 bp, Homo sapiens
aatgaacaacactgaaggaaga

SEQ ID NO: 7985056 - DNA, 22 bp, Homo sapiens
aacgcccagccttgatcaaatg

SEQ ID NO: 7985057 - DNA, 22 bp, Homo sapiens
aacgcccgtggttgccaaggta

SEQ ID NO: 7985058 - DNA, 22 bp, Homo sapiens
aacgcccagccttgatcaaatg

SEQ ID NO: 7985059 - DNA, 22 bp, Homo sapiens
aacgcccagccttgatcaaatg

SEQ ID NO: 7985060 - DNA, 23 bp, Homo sapiens
aacgacagctacaggcatcccac

SEQ ID NO: 7985061 - DNA, 22 bp, Homo sapiens
aacgagctctccttctttcatt

SEQ ID NO: 7985062 - DNA, 22 bp, Homo sapiens
aatgaattctgaagtcttccaa

SEQ ID NO: 7985063 - DNA, 22 bp, Homo sapiens
aatgaattgcagtactgacttg

SEQ ID NO: 7985064 - DNA, 22 bp, Homo sapiens
aatgaacaacttgatttttgcc

SEQ ID NO: 7985065 - DNA, 22 bp, Homo sapiens
aatgaacaacttgatttttgcc

SEQ ID NO: 7985066 - DNA, 22 bp, Homo sapiens
aatgaattcgagtgaaggaaag

SEQ ID NO: 7985067 - DNA, 22 bp, Homo sapiens
aaccctttcttgcttgttctaa

SEQ ID NO: 7985068 - DNA, 22 bp, Homo sapiens
aacctcaaactcttgggcttaa

SEQ ID NO: 7985069 - DNA, 22 bp, Homo sapiens
aacctcaaactcttgggcttaa

SEQ ID NO: 7985070 - DNA, 22 bp, Homo sapiens
aacctcaaactcttgggcttaa

SEQ ID NO: 7985071 - DNA, 23 bp, Homo sapiens
aacctagactacttactatgtgg

SEQ ID NO: 7985072 - DNA, 22 bp, Homo sapiens
aacctagaagttagagtatcat

SEQ ID NO: 7985073 - DNA, 22 bp, Homo sapiens
aacctagactgacatatgtgta

SEQ ID NO: 7985074 - DNA, 22 bp, Homo sapiens
aacctcataggacttgaacata

SEQ ID NO: 7985075 - DNA, 22 bp, Homo sapiens
aacctcatttccttctttgtaa

SEQ ID NO: 7985076 - DNA, 22 bp, Homo sapiens
aacctcatttccttctttgtaa

SEQ ID NO: 7985077 - DNA, 22 bp, Homo sapiens
aacctctacatccaggaaagga

SEQ ID NO: 7985078 - DNA, 22 bp, Homo sapiens
aacctctagtatctgtcgtact

SEQ ID NO: 7985079 - DNA, 22 bp, Homo sapiens
aacctgaaactacattcttgat

SEQ ID NO: 7985080 - DNA, 22 bp, Homo sapiens
aaccctggggctgctctgcctg

SEQ ID NO: 7985081 - DNA, 22 bp, Homo sapiens
aaccctggggctgctctgcctg

SEQ ID NO: 7985082 - DNA, 22 bp, Homo sapiens
aaccctggggcagctgctaggg

SEQ ID NO: 7985083 - DNA, 22 bp, Homo sapiens
aaccctggggcagctgctaggg

SEQ ID NO: 7985084 - DNA, 22 bp, Homo sapiens
aaccctggggcagctgctaggg

SEQ ID NO: 7985085 - DNA, 22 bp, Homo sapiens
aaccctgggaggcagctcagtt

SEQ ID NO: 7985086 - DNA, 22 bp, Homo sapiens
aaccctgggctcccgacttacg

SEQ ID NO: 7985087 - DNA, 22 bp, Homo sapiens
aaccctttgttcggtgttctgg

SEQ ID NO: 7985088 - DNA, 22 bp, Homo sapiens
aaccctttcttgcttgttctaa

SEQ ID NO: 7985089 - DNA, 22 bp, Homo sapiens
aaccctttgttcggtgttctgg

SEQ ID NO: 7985090 - DNA, 22 bp, Homo sapiens
aaccctgggtcggcaccatttt

SEQ ID NO: 7985091 - DNA, 22 bp, Homo sapiens
aacccttaagcaaactcattta

SEQ ID NO: 7985092 - DNA, 22 bp, Homo sapiens
aaccctggagaaggctttggat

SEQ ID NO: 7985093 - DNA, 22 bp, Homo sapiens
aaccctggagaaggctttggat

SEQ ID NO: 7985094 - DNA, 22 bp, Homo sapiens
aaccctgattttacaaatgtct

SEQ ID NO: 7985095 - DNA, 22 bp, Homo sapiens
aacccgtgatcctgactcccct

SEQ ID NO: 7985096 - DNA, 22 bp, Homo sapiens
aaccctctcttattctttgcca

SEQ ID NO: 7985097 - DNA, 22 bp, Homo sapiens
aaccctgggaggcagctcagtt

SEQ ID NO: 7985098 - DNA, 22 bp, Homo sapiens
aaccctgggaggcagctcagtt

SEQ ID NO: 7985099 - DNA, 22 bp, Homo sapiens
aaccctgggaaacttaatgtca

SEQ ID NO: 7985100 - DNA, 22 bp, Homo sapiens
aaccctggctttccctaattct

SEQ ID NO: 7985101 - DNA, 22 bp, Homo sapiens
aaccctggccctggaataggca

SEQ ID NO: 7985102 - DNA, 22 bp, Homo sapiens
aaccctggccctggaataggca

SEQ ID NO: 7985103 - DNA, 22 bp, Homo sapiens
aacccgggaggcggaggttgtg

SEQ ID NO: 7985104 - DNA, 22 bp, Homo sapiens
aacccgggaggcggaggttgtg

SEQ ID NO: 7985105 - DNA, 22 bp, Homo sapiens
aacccgggaggcggaggttgtg

SEQ ID NO: 7985106 - DNA, 22 bp, Homo sapiens
aacccgggaggcggaggttgtg

SEQ ID NO: 7985107 - DNA, 22 bp, Homo sapiens
aacccgggaggcggaggttgtg

SEQ ID NO: 7985108 - DNA, 22 bp, Homo sapiens
aacccgggaggcggaggttgtg

SEQ ID NO: 7985109 - DNA, 22 bp, Homo sapiens
aacccgggaggcagaggttgtg

SEQ ID NO: 7985110 - DNA, 22 bp, Homo sapiens
aacccacaaaggatttcagctc

SEQ ID NO: 7985111 - DNA, 22 bp, Homo sapiens
aacccgggaggcggaggttgtg

SEQ ID NO: 7985112 - DNA, 22 bp, Homo sapiens
aacccgggaggcggaggttgtg

SEQ ID NO: 7985113 - DNA, 22 bp, Homo sapiens
aacccgggaggcggaggttgtg

SEQ ID NO: 7985114 - DNA, 22 bp, Homo sapiens
aacccgggaggcggaggttgtg

SEQ ID NO: 7985115 - DNA, 22 bp, Homo sapiens
aacccgggaggtggaggttatg

SEQ ID NO: 7985116 - DNA, 22 bp, Homo sapiens
aacccgggaggtggaggttatg

SEQ ID NO: 7985117 - DNA, 22 bp, Homo sapiens
aacccgggaggtggaggttatg

SEQ ID NO: 7985118 - DNA, 22 bp, Homo sapiens
aacatgttgctttaataatatt

SEQ ID NO: 7985119 - DNA, 22 bp, Homo sapiens
aacatgttgctttaataatatt

SEQ ID NO: 7985120 - DNA, 22 bp, Homo sapiens
aacatgttgctttaataatatt

SEQ ID NO: 7985121 - DNA, 22 bp, Homo sapiens
aaccattgatacatgcaacaat

SEQ ID NO: 7985122 - DNA, 22 bp, Homo sapiens
aaccatttgcagttactgagac

SEQ ID NO: 7985123 - DNA, 22 bp, Homo sapiens
aaccatttgccattatcttaag

SEQ ID NO: 7985124 - DNA, 22 bp, Homo sapiens
aaccatttgccattatcttaag

SEQ ID NO: 7985125 - DNA, 22 bp, Homo sapiens
aaccatttgcagttactgagac

SEQ ID NO: 7985126 - DNA, 22 bp, Homo sapiens
aacatgttgagttgaaagtagc

SEQ ID NO: 7985127 - DNA, 22 bp, Homo sapiens
aacatgttgagttgaaagtagc

SEQ ID NO: 7985128 - DNA, 22 bp, Homo sapiens
aacatgttgagttgaaagtagc

SEQ ID NO: 7985129 - DNA, 22 bp, Homo sapiens
aacatgttgagttgaaagtagc

SEQ ID NO: 7985130 - DNA, 22 bp, Homo sapiens
aacatgtgtcttgcatttcttg

SEQ ID NO: 7985131 - DNA, 22 bp, Homo sapiens
aacatgtgtcttgcatttcttg

SEQ ID NO: 7985132 - DNA, 22 bp, Homo sapiens
aatgctttcttataaccactgc

SEQ ID NO: 7985133 - DNA, 22 bp, Homo sapiens
aatgctttcttataaccactgc

SEQ ID NO: 7985134 - DNA, 22 bp, Homo sapiens
aatgctttcttataaccactgc

SEQ ID NO: 7985135 - DNA, 22 bp, Homo sapiens
aatgctttcttataaccactgc

SEQ ID NO: 7985136 - DNA, 22 bp, Homo sapiens
aactagtttagctttttaagac

SEQ ID NO: 7985137 - DNA, 22 bp, Homo sapiens
aactagttttagctctagcaac

SEQ ID NO: 7985138 - DNA, 22 bp, Homo sapiens
aactataatggggttaggaaat

SEQ ID NO: 7985139 - DNA, 22 bp, Homo sapiens
aactataatggggttaggaaat

SEQ ID NO: 7985140 - DNA, 22 bp, Homo sapiens
aatgctttctcagagtccttca

SEQ ID NO: 7985141 - DNA, 22 bp, Homo sapiens
aactagaacgtctagttgctgg

SEQ ID NO: 7985142 - DNA, 22 bp, Homo sapiens
aactagaacgtctagttgctgg

SEQ ID NO: 7985143 - DNA, 22 bp, Homo sapiens
aactagaacgtctagttgctgg

SEQ ID NO: 7985144 - DNA, 22 bp, Homo sapiens
aactagcagctaagacataatt

SEQ ID NO: 7985145 - DNA, 22 bp, Homo sapiens
aactagcagctaagacataatt

SEQ ID NO: 7985146 - DNA, 22 bp, Homo sapiens
aactagcagctaagacataatt

SEQ ID NO: 7985147 - DNA, 22 bp, Homo sapiens
aactagtaaaagcaacagtata

SEQ ID NO: 7985148 - DNA, 22 bp, Homo sapiens
aactagtttagctttttaagac

SEQ ID NO: 7985149 - DNA, 22 bp, Homo sapiens
aactagtcagtgattctcagaa

SEQ ID NO: 7985150 - DNA, 22 bp, Homo sapiens
aactagctggattagtgttttc

SEQ ID NO: 7985151 - DNA, 22 bp, Homo sapiens
aactagctggattagtgttttc

SEQ ID NO: 7985152 - DNA, 22 bp, Homo sapiens
aactagcagctaagacataatt

SEQ ID NO: 7985153 - DNA, 23 bp, Homo sapiens
aactagctaggcagcctgtcagc

SEQ ID NO: 7985154 - DNA, 22 bp, Homo sapiens
aactagctttagttttggaagg

SEQ ID NO: 7985155 - DNA, 22 bp, Homo sapiens
aactaggagtttttcttgagaa

SEQ ID NO: 7985156 - DNA, 22 bp, Homo sapiens
aactaggatatatttctgacca

SEQ ID NO: 7985157 - DNA, 22 bp, Homo sapiens
aactagtaaaagcaacagtata

SEQ ID NO: 7985158 - DNA, 22 bp, Homo sapiens
aatggctgttatttcagcagat

SEQ ID NO: 7985159 - DNA, 18 bp, Homo sapiens
aatggctgggttgttgcc

SEQ ID NO: 7985160 - DNA, 22 bp, Homo sapiens
aatggcttaatgataccttatc

SEQ ID NO: 7985161 - DNA, 22 bp, Homo sapiens
aatggcttaagtataagtgaga

SEQ ID NO: 7985162 - DNA, 22 bp, Homo sapiens
aatggcttagcagagttagaag

SEQ ID NO: 7985163 - DNA, 22 bp, Homo sapiens
aatggctctgatgttgttgtga

SEQ ID NO: 7985164 - DNA, 22 bp, Homo sapiens
aatggctctgatgttgttgtga

SEQ ID NO: 7985165 - DNA, 22 bp, Homo sapiens
aatggcctttgagatgaaaggg

SEQ ID NO: 7985166 - DNA, 22 bp, Homo sapiens
aatggctctgatgttgttgtga

SEQ ID NO: 7985167 - DNA, 22 bp, Homo sapiens
aatggctgaagaagtgtggcca

SEQ ID NO: 7985168 - DNA, 22 bp, Homo sapiens
aatggctgatgccaggtctagg

SEQ ID NO: 7985169 - DNA, 22 bp, Homo sapiens
aatggctgatgccaggtctagg

SEQ ID NO: 7985170 - DNA, 22 bp, Homo sapiens
aatggctgccagggcaggaggt

SEQ ID NO: 7985171 - DNA, 22 bp, Homo sapiens
aatggctgccagggcaggaggt

SEQ ID NO: 7985172 - DNA, 21 bp, Homo sapiens
aatggctgggcaaggtctctc

SEQ ID NO: 7985173 - DNA, 21 bp, Homo sapiens
aatggctgggcaaggtctctc

SEQ ID NO: 7985174 - DNA, 21 bp, Homo sapiens
aatggctgggcaaggtctctc

SEQ ID NO: 7985175 - DNA, 19 bp, Homo sapiens
aactagaaaggttttgaga

SEQ ID NO: 7985176 - DNA, 19 bp, Homo sapiens
aactagaaaggttttgaga

SEQ ID NO: 7985177 - DNA, 20 bp, Homo sapiens
aactagaaagcacccatgga

SEQ ID NO: 7985178 - DNA, 22 bp, Homo sapiens
aactagaaagaacatatttcca

SEQ ID NO: 7985179 - DNA, 22 bp, Homo sapiens
aactagaaaacaagatgctgat

SEQ ID NO: 7985180 - DNA, 22 bp, Homo sapiens
aactagaaaaagactttctgag

SEQ ID NO: 7985181 - DNA, 22 bp, Homo sapiens
aactacttgactgacagattca

SEQ ID NO: 7985182 - DNA, 22 bp, Homo sapiens
aactagaaaacaagatgctgat

SEQ ID NO: 7985183 - DNA, 22 bp, Homo sapiens
aactagaaagaacatatttcca

SEQ ID NO: 7985184 - DNA, 22 bp, Homo sapiens
aactagaaatcactacaggtat

SEQ ID NO: 7985185 - DNA, 22 bp, Homo sapiens
aactagaaatcactacaggtat

SEQ ID NO: 7985186 - DNA, 22 bp, Homo sapiens
aactagaaccacttgtatttcc

SEQ ID NO: 7985187 - DNA, 22 bp, Homo sapiens
aactagaacgagaaagctgaac

SEQ ID NO: 7985188 - DNA, 22 bp, Homo sapiens
aactagaacgagaaagctgaac

SEQ ID NO: 7985189 - DNA, 22 bp, Homo sapiens
aactagaacctgcattttaaca

SEQ ID NO: 7985190 - DNA, 22 bp, Homo sapiens
aactagaacctgcattttaaca

SEQ ID NO: 7985191 - DNA, 22 bp, Homo sapiens
aatgacagtgttgggccagatg

SEQ ID NO: 7985192 - DNA, 22 bp, Homo sapiens
aatgacataagtgcagatgcta

SEQ ID NO: 7985193 - DNA, 22 bp, Homo sapiens
aatgacagccctctagtctggg

SEQ ID NO: 7985194 - DNA, 22 bp, Homo sapiens
aactacttgaagagttcagcag

SEQ ID NO: 7985195 - DNA, 22 bp, Homo sapiens
aactagaaaaagactttctgag

SEQ ID NO: 7985196 - DNA, 22 bp, Homo sapiens
aactactaccacagtcaagaca

SEQ ID NO: 7985197 - DNA, 22 bp, Homo sapiens
aatgacatgctttttaattata

SEQ ID NO: 7985198 - DNA, 22 bp, Homo sapiens
aatgacatgctttttaattata

SEQ ID NO: 7985199 - DNA, 23 bp, Homo sapiens
aatgacaggcaatgtaattgtgt

SEQ ID NO: 7985200 - DNA, 22 bp, Homo sapiens
aatgacagccagattcttctct

SEQ ID NO: 7985201 - DNA, 22 bp, Homo sapiens
aatgacagagcactgaacttgg

SEQ ID NO: 7985202 - DNA, 22 bp, Homo sapiens
aatgacagagcactgaacttgg

SEQ ID NO: 7985203 - DNA, 23 bp, Homo sapiens
aatgacacctcataggtaacttc

SEQ ID NO: 7985204 - DNA, 22 bp, Homo sapiens
aatgacagagatagaagggatg

SEQ ID NO: 7985205 - DNA, 22 bp, Homo sapiens
aatgacaatggcagaggtagaa

SEQ ID NO: 7985206 - DNA, 22 bp, Homo sapiens
aatgacaatattaatttggagg

SEQ ID NO: 7985207 - DNA, 22 bp, Homo sapiens
aatgacaataatcattaacttt

SEQ ID NO: 7985208 - DNA, 22 bp, Homo sapiens
aatgacaataatcattaacttt

SEQ ID NO: 7985209 - DNA, 22 bp, Homo sapiens
aatgacaataatcattaacttt

SEQ ID NO: 7985210 - DNA, 22 bp, Homo sapiens
aatgacaataatcattaacttt

SEQ ID NO: 7985211 - DNA, 22 bp, Homo sapiens
aatgacaagacatagtctctga

SEQ ID NO: 7985212 - DNA, 22 bp, Homo sapiens
aatgacaataatcattaacttt

SEQ ID NO: 7985213 - DNA, 22 bp, Homo sapiens
aatgacaagacatagtctctga

SEQ ID NO: 7985214 - DNA, 22 bp, Homo sapiens
aatgacaagacatagtctctga

SEQ ID NO: 7985215 - DNA, 22 bp, Homo sapiens
aatgacaagacatagtctctga

SEQ ID NO: 7985216 - DNA, 22 bp, Homo sapiens
aatgacaagacatagtctctga

SEQ ID NO: 7985217 - DNA, 22 bp, Homo sapiens
aatgacaagacatagtctctga

SEQ ID NO: 7985218 - DNA, 22 bp, Homo sapiens
aatgacaaccacaatggtgctg

SEQ ID NO: 7985219 - DNA, 22 bp, Homo sapiens
aatgacaaatatggaagcctga

SEQ ID NO: 7985220 - DNA, 22 bp, Homo sapiens
aatgaattgcagtactgacttg

SEQ ID NO: 7985221 - DNA, 22 bp, Homo sapiens
aatagactttctttttagaaca

SEQ ID NO: 7985222 - DNA, 22 bp, Homo sapiens
aatagactttctttttagaaca

SEQ ID NO: 7985223 - DNA, 22 bp, Homo sapiens
aatagactttctttttagaaca

SEQ ID NO: 7985224 - DNA, 22 bp, Homo sapiens
aatagactccagggtctatttt

SEQ ID NO: 7985225 - DNA, 22 bp, Homo sapiens
aatagacaattctagccaacat

SEQ ID NO: 7985226 - DNA, 22 bp, Homo sapiens
aatagacaattctagccaacat

SEQ ID NO: 7985227 - DNA, 22 bp, Homo sapiens
aatagacattatttctctatga

SEQ ID NO: 7985228 - DNA, 22 bp, Homo sapiens
aatagacattatttctctatga

SEQ ID NO: 7985229 - DNA, 22 bp, Homo sapiens
aatagacattatttctctatga

SEQ ID NO: 7985230 - DNA, 22 bp, Homo sapiens
aatagaggagctttggactccc

SEQ ID NO: 7985231 - DNA, 22 bp, Homo sapiens
aatagagtattttagcatctta

SEQ ID NO: 7985232 - DNA, 22 bp, Homo sapiens
aatagaggtggcatgttataga

SEQ ID NO: 7985233 - DNA, 22 bp, Homo sapiens
aatagagacctagatgccatga

SEQ ID NO: 7985234 - DNA, 22 bp, Homo sapiens
aatagactttgtataatttccc

SEQ ID NO: 7985235 - DNA, 22 bp, Homo sapiens
aatagactttctttttagaaca

SEQ ID NO: 7985236 - DNA, 22 bp, Homo sapiens
aatagactttgtataatttccc

SEQ ID NO: 7985237 - DNA, 22 bp, Homo sapiens
aatagagtcagttctacattct

SEQ ID NO: 7985238 - DNA, 22 bp, Homo sapiens
aatagagtcagttctacattct

SEQ ID NO: 7985239 - DNA, 22 bp, Homo sapiens
aatagatactacttagatgtag

SEQ ID NO: 7985240 - DNA, 22 bp, Homo sapiens
aatagatactacttagatgtag

SEQ ID NO: 7985241 - DNA, 22 bp, Homo sapiens
aatagatactacttagatgtag

SEQ ID NO: 7985242 - DNA, 22 bp, Homo sapiens
aatagatactacttagatgtag

SEQ ID NO: 7985243 - DNA, 22 bp, Homo sapiens
aatagatactacttagatgtag

SEQ ID NO: 7985244 - DNA, 22 bp, Homo sapiens
aatagatactacttagatgtag

SEQ ID NO: 7985245 - DNA, 22 bp, Homo sapiens
aatagatactacttagatgtag

SEQ ID NO: 7985246 - DNA, 19 bp, Homo sapiens
aatagattaattatcctct

SEQ ID NO: 7985247 - DNA, 22 bp, Homo sapiens
aatagcaaacagacatgcacaa

SEQ ID NO: 7985248 - DNA, 22 bp, Homo sapiens
aatagcaaacactggtaaagtt

SEQ ID NO: 7985249 - DNA, 22 bp, Homo sapiens
aatagcaaacactggtaaagtt

SEQ ID NO: 7985250 - DNA, 22 bp, Homo sapiens
aatagattcatggttaagagca

SEQ ID NO: 7985251 - DNA, 22 bp, Homo sapiens
aatagcaaacactggtaaagtt

SEQ ID NO: 7985252 - DNA, 22 bp, Homo sapiens
aacatgtacctacaatcagaat

SEQ ID NO: 7985253 - DNA, 22 bp, Homo sapiens
aacatgtacctacaatcagaat

SEQ ID NO: 7985254 - DNA, 22 bp, Homo sapiens
aacatgtaaccagcattcatct

SEQ ID NO: 7985255 - DNA, 22 bp, Homo sapiens
aacatgtaaccagcattcatct

SEQ ID NO: 7985256 - DNA, 22 bp, Homo sapiens
aacatgtaaccagcattcatct

SEQ ID NO: 7985257 - DNA, 22 bp, Homo sapiens
aacatgtatcgctttttaatat

SEQ ID NO: 7985258 - DNA, 22 bp, Homo sapiens
aacatgtattttccttggcaac

SEQ ID NO: 7985259 - DNA, 22 bp, Homo sapiens
aacatgtcttactttgctttct

SEQ ID NO: 7985260 - DNA, 22 bp, Homo sapiens
aacatgtctttagagaaacatt

SEQ ID NO: 7985261 - DNA, 22 bp, Homo sapiens
aacatgtgagcaggttttttat

SEQ ID NO: 7985262 - DNA, 22 bp, Homo sapiens
aatagacaagcaccctggtaaa

SEQ ID NO: 7985263 - DNA, 22 bp, Homo sapiens
aatagacaagcaccctggtaaa

SEQ ID NO: 7985264 - DNA, 22 bp, Homo sapiens
aatacatgttttctactattct

SEQ ID NO: 7985265 - DNA, 20 bp, Homo sapiens
aatacatgagcacactttca

SEQ ID NO: 7985266 - DNA, 22 bp, Homo sapiens
aacatctttttgtttgctgaaa

SEQ ID NO: 7985267 - DNA, 22 bp, Homo sapiens
aacatgaaaactacctgtgatt

SEQ ID NO: 7985268 - DNA, 22 bp, Homo sapiens
aacatgaaaacctccacagcaa

SEQ ID NO: 7985269 - DNA, 22 bp, Homo sapiens
aacatctttacaacagacctag

SEQ ID NO: 7985270 - DNA, 22 bp, Homo sapiens
aacatctttgataaacttagtg

SEQ ID NO: 7985271 - DNA, 22 bp, Homo sapiens
aacatctttgccaaattgctat

SEQ ID NO: 7985272 - DNA, 22 bp, Homo sapiens
aacatctttgccaaattgctat

SEQ ID NO: 7985273 - DNA, 22 bp, Homo sapiens
aacatcttgtactgcacatttt

SEQ ID NO: 7985274 - DNA, 22 bp, Homo sapiens
aacatcttatctgcatgatccc

SEQ ID NO: 7985275 - DNA, 22 bp, Homo sapiens
aacatcttatctgcatgatccc

SEQ ID NO: 7985276 - DNA, 22 bp, Homo sapiens
aacatcttcagagaagctaagt

SEQ ID NO: 7985277 - DNA, 22 bp, Homo sapiens
aacatcttgtcaaatgtccaca

SEQ ID NO: 7985278 - DNA, 22 bp, Homo sapiens
aacatcttgtcaaatgtccaca

SEQ ID NO: 7985279 - DNA, 22 bp, Homo sapiens
aacatcttgtctaatgtcagct

SEQ ID NO: 7985280 - DNA, 22 bp, Homo sapiens
aacatcttgtctaatgtcagct

SEQ ID NO: 7985281 - DNA, 22 bp, Homo sapiens
aacatctagttcctatataata

SEQ ID NO: 7985282 - DNA, 22 bp, Homo sapiens
aacatctcagaagtgaccctga

SEQ ID NO: 7985283 - DNA, 22 bp, Homo sapiens
aacatctcatggactacattct

SEQ ID NO: 7985284 - DNA, 22 bp, Homo sapiens
aacatctcatggactacattct

SEQ ID NO: 7985285 - DNA, 22 bp, Homo sapiens
aacatctaggttctcatcgata

SEQ ID NO: 7985286 - DNA, 22 bp, Homo sapiens
aacatctaggttctcatcgata

SEQ ID NO: 7985287 - DNA, 22 bp, Homo sapiens
aacatctgatcgaacagtgcca

SEQ ID NO: 7985288 - DNA, 19 bp, Homo sapiens
aacatctgtaactattttc

SEQ ID NO: 7985289 - DNA, 22 bp, Homo sapiens
aacatctgggccctgattttgg

SEQ ID NO: 7985290 - DNA, 22 bp, Homo sapiens
aacatctccaacctacatccac

SEQ ID NO: 7985291 - DNA, 22 bp, Homo sapiens
aacatctgaaaaggcttcactc

SEQ ID NO: 7985292 - DNA, 22 bp, Homo sapiens
aacatatttggctgatattccc

SEQ ID NO: 7985293 - DNA, 22 bp, Homo sapiens
aacatcacaatttcatttatgc

SEQ ID NO: 7985294 - DNA, 22 bp, Homo sapiens
aacatcagaagtagaagactca

SEQ ID NO: 7985295 - DNA, 22 bp, Homo sapiens
aacatcagaagtagaagactca

SEQ ID NO: 7985296 - DNA, 22 bp, Homo sapiens
aacatcagaagtagaagactca

SEQ ID NO: 7985297 - DNA, 22 bp, Homo sapiens
aacatcagaagtagaagactca

SEQ ID NO: 7985298 - DNA, 22 bp, Homo sapiens
aacatcagaatatccatgttgg

SEQ ID NO: 7985299 - DNA, 22 bp, Homo sapiens
aacatcagtattctcatctgta

SEQ ID NO: 7985300 - DNA, 22 bp, Homo sapiens
aacatcagtattctcatctgta

SEQ ID NO: 7985301 - DNA, 22 bp, Homo sapiens
aacatcagcacacaatagcaag

SEQ ID NO: 7985302 - DNA, 22 bp, Homo sapiens
aacatcagcacacaatagcaag

SEQ ID NO: 7985303 - DNA, 22 bp, Homo sapiens
aacatcagaatatccatgttgg

SEQ ID NO: 7985304 - DNA, 22 bp, Homo sapiens
aacatcatcatgaacaactaat

SEQ ID NO: 7985305 - DNA, 22 bp, Homo sapiens
aacatcatcatgaacaactaat

SEQ ID NO: 7985306 - DNA, 22 bp, Homo sapiens
aacatcatcagatgggtgcttg

SEQ ID NO: 7985307 - DNA, 22 bp, Homo sapiens
aacatcatcatgaacaactaat

SEQ ID NO: 7985308 - DNA, 22 bp, Homo sapiens
aacatcatcatgaacaactaat

SEQ ID NO: 7985309 - DNA, 22 bp, Homo sapiens
aacatcatcatgaacaactaat

SEQ ID NO: 7985310 - DNA, 22 bp, Homo sapiens
aacatcatcctttgagtattta

SEQ ID NO: 7985311 - DNA, 22 bp, Homo sapiens
aacatcatcagatgggtgcttg

SEQ ID NO: 7985312 - DNA, 22 bp, Homo sapiens
aacatcatcctttgagtattta

SEQ ID NO: 7985313 - DNA, 22 bp, Homo sapiens
aacatcatcctttgagtattta

SEQ ID NO: 7985314 - DNA, 22 bp, Homo sapiens
aacatcatcctttgagtattta

SEQ ID NO: 7985315 - DNA, 22 bp, Homo sapiens
aacatccccagcgtctcctagg

SEQ ID NO: 7985316 - DNA, 22 bp, Homo sapiens
aacatctacagtgagatgttag

SEQ ID NO: 7985317 - DNA, 22 bp, Homo sapiens
aacatccccttcatgtcatgat

SEQ ID NO: 7985318 - DNA, 22 bp, Homo sapiens
aacatctacagtgagatgttag

SEQ ID NO: 7985319 - DNA, 22 bp, Homo sapiens
aacatccccagcgtctcctagg

SEQ ID NO: 7985320 - DNA, 22 bp, Homo sapiens
aacatcattatgtccattaatg

SEQ ID NO: 7985321 - DNA, 22 bp, Homo sapiens
aacatcattatgtccattaatg

SEQ ID NO: 7985322 - DNA, 22 bp, Homo sapiens
aacatcattatgtccattaatg

SEQ ID NO: 7985323 - DNA, 19 bp, Homo sapiens
aacatcatggctctttcca

SEQ ID NO: 7985324 - DNA, 19 bp, Homo sapiens
aacatcatggctctttcca

SEQ ID NO: 7985325 - DNA, 22 bp, Homo sapiens
aacatatctacggatacgatta

SEQ ID NO: 7985326 - DNA, 22 bp, Homo sapiens
aacatattcagatgccaagtcc

SEQ ID NO: 7985327 - DNA, 22 bp, Homo sapiens
aacatattcagatgccaagtcc

SEQ ID NO: 7985328 - DNA, 22 bp, Homo sapiens
aacatattcagatgccaagtcc

SEQ ID NO: 7985329 - DNA, 22 bp, Homo sapiens
aacatatttggctgatattccc

SEQ ID NO: 7985330 - DNA, 22 bp, Homo sapiens
aacatatttggctgatattccc

SEQ ID NO: 7985331 - DNA, 22 bp, Homo sapiens
aacataaatttgaagtggcaaa

SEQ ID NO: 7985332 - DNA, 22 bp, Homo sapiens
aacataaatttgaagtggcaaa

SEQ ID NO: 7985333 - DNA, 22 bp, Homo sapiens
aacataaatttgaagtggcaaa

SEQ ID NO: 7985334 - DNA, 22 bp, Homo sapiens
aacataaatttgaagtggcaaa

SEQ ID NO: 7985335 - DNA, 22 bp, Homo sapiens
aacataaatttgaagtggcaaa

SEQ ID NO: 7985336 - DNA, 22 bp, Homo sapiens
aacagcttactcaatggtgatt

SEQ ID NO: 7985337 - DNA, 22 bp, Homo sapiens
aacagcttactcaatggtgatt

SEQ ID NO: 7985338 - DNA, 22 bp, Homo sapiens
aacagctgtctgcctatctctg

SEQ ID NO: 7985339 - DNA, 22 bp, Homo sapiens
aacagctgttcgcagatgtagg

SEQ ID NO: 7985340 - DNA, 22 bp, Homo sapiens
aacagctgttcgcagatgtagg

SEQ ID NO: 7985341 - DNA, 22 bp, Homo sapiens
aacagctgtctgcctatctctg

SEQ ID NO: 7985342 - DNA, 22 bp, Homo sapiens
aacagcttagaaatgttgctaa

SEQ ID NO: 7985343 - DNA, 22 bp, Homo sapiens
aacagcttagaaatgttgctaa

SEQ ID NO: 7985344 - DNA, 22 bp, Homo sapiens
aacagcttcatcacatggcata

SEQ ID NO: 7985345 - DNA, 22 bp, Homo sapiens
aacagcttcatcacatggcata

SEQ ID NO: 7985346 - DNA, 22 bp, Homo sapiens
aacagcttcatcacatggcata

SEQ ID NO: 7985347 - DNA, 22 bp, Homo sapiens
aacagcttgagactggatatgc

SEQ ID NO: 7985348 - DNA, 22 bp, Homo sapiens
aacagcttcatcacatggcata

SEQ ID NO: 7985349 - DNA, 22 bp, Homo sapiens
aacagctgcttcagtacttgaa

SEQ ID NO: 7985350 - DNA, 22 bp, Homo sapiens
aacagctgtatactgtagctgt

SEQ ID NO: 7985351 - DNA, 22 bp, Homo sapiens
aacagctgcttctatcttttca

SEQ ID NO: 7985352 - DNA, 22 bp, Homo sapiens
aacagctgcttctatcttttca

SEQ ID NO: 7985353 - DNA, 22 bp, Homo sapiens
aacagctgcaaaaggttgcctg

SEQ ID NO: 7985354 - DNA, 22 bp, Homo sapiens
aacagctgcttcagtacttgaa

SEQ ID NO: 7985355 - DNA, 22 bp, Homo sapiens
aacagctgcaaaaggttgcctg

SEQ ID NO: 7985356 - DNA, 20 bp, Homo sapiens
aacagctctcgacttatctt

SEQ ID NO: 7985357 - DNA, 22 bp, Homo sapiens
aacagctattagaacttcatgg

SEQ ID NO: 7985358 - DNA, 22 bp, Homo sapiens
aacagctagtggtctagacttt

SEQ ID NO: 7985359 - DNA, 22 bp, Homo sapiens
aacagctagtaccaatccacta

SEQ ID NO: 7985360 - DNA, 22 bp, Homo sapiens
aagtgtcaatatttttgtaggt

SEQ ID NO: 7985361 - DNA, 22 bp, Homo sapiens
aagtgtatttttgtactaacat

SEQ ID NO: 7985362 - DNA, 22 bp, Homo sapiens
aagtgtcctcattcaacatgca

SEQ ID NO: 7985363 - DNA, 22 bp, Homo sapiens
aagtgtatatatgacttataaa

SEQ ID NO: 7985364 - DNA, 22 bp, Homo sapiens
aagtgtatatatgacttataaa

SEQ ID NO: 7985365 - DNA, 22 bp, Homo sapiens
aagtgtattaagcaacgttatt

SEQ ID NO: 7985366 - DNA, 22 bp, Homo sapiens
aagtgtctagcacctggatgca

SEQ ID NO: 7985367 - DNA, 22 bp, Homo sapiens
aagtgtctagcacctggatgca

SEQ ID NO: 7985368 - DNA, 22 bp, Homo sapiens
aagtgtctaactggttacttct

SEQ ID NO: 7985369 - DNA, 22 bp, Homo sapiens
aagtgtctacatttgctaacca

SEQ ID NO: 7985370 - DNA, 22 bp, Homo sapiens
aacagcgacgtcctccccaaca

SEQ ID NO: 7985371 - DNA, 22 bp, Homo sapiens
aacagcctgagagaacaatgat

SEQ ID NO: 7985372 - DNA, 22 bp, Homo sapiens
aacagcctcagtgagattagga

SEQ ID NO: 7985373 - DNA, 22 bp, Homo sapiens
aagtggtagacaaagataattg

SEQ ID NO: 7985374 - DNA, 22 bp, Homo sapiens
aagtggtagagagagcataagc

SEQ ID NO: 7985375 - DNA, 22 bp, Homo sapiens
aagtggtagagagagcataagc

SEQ ID NO: 7985376 - DNA, 22 bp, Homo sapiens
aagtggtaggaagagagcactg

SEQ ID NO: 7985377 - DNA, 22 bp, Homo sapiens
aagtggtgtgttggaagaaatc

SEQ ID NO: 7985378 - DNA, 22 bp, Homo sapiens
aagtggtagagagagcataagc

SEQ ID NO: 7985379 - DNA, 22 bp, Homo sapiens
aagtggttattttgatctagaa

SEQ ID NO: 7985380 - DNA, 22 bp, Homo sapiens
aagtggttgcttgtgagtcccc

SEQ ID NO: 7985381 - DNA, 22 bp, Homo sapiens
aagtgcttgatcatagttctca

SEQ ID NO: 7985382 - DNA, 22 bp, Homo sapiens
aagtgcttgatcatagttctca

SEQ ID NO: 7985383 - DNA, 22 bp, Homo sapiens
aagtgcttggagcatacctgtt

SEQ ID NO: 7985384 - DNA, 22 bp, Homo sapiens
aagtgcttctgggattaggagt

SEQ ID NO: 7985385 - DNA, 22 bp, Homo sapiens
aagtgcttggattgcaggtatg

SEQ ID NO: 7985386 - DNA, 22 bp, Homo sapiens
aagtgcttggattgcaggtatg

SEQ ID NO: 7985387 - DNA, 23 bp, Homo sapiens
aagtgggtttagacagtcatttt

SEQ ID NO: 7985388 - DNA, 20 bp, Homo sapiens
aagtgggtttattctttttc

SEQ ID NO: 7985389 - DNA, 22 bp, Homo sapiens
aagtgggtttgaaatgctttca

SEQ ID NO: 7985390 - DNA, 22 bp, Homo sapiens
aagtggttgcttgtgagtcccc

SEQ ID NO: 7985391 - DNA, 21 bp, Homo sapiens
aagtggtttacatccagctgt

SEQ ID NO: 7985392 - DNA, 21 bp, Homo sapiens
aagtggtttacatccagctgt

SEQ ID NO: 7985393 - DNA, 21 bp, Homo sapiens
aagtggtttaggttaccgggg

SEQ ID NO: 7985394 - DNA, 22 bp, Homo sapiens
aagtggtttgattcagtttatg

SEQ ID NO: 7985395 - DNA, 22 bp, Homo sapiens
aagtggttttaagaggttcctt

SEQ ID NO: 7985396 - DNA, 23 bp, Homo sapiens
aagtggttttgaacccggaccct

SEQ ID NO: 7985397 - DNA, 22 bp, Homo sapiens
aagtgtaaattcacagacttca

SEQ ID NO: 7985398 - DNA, 22 bp, Homo sapiens
aagtgtacagcaacttctcagc

SEQ ID NO: 7985399 - DNA, 22 bp, Homo sapiens
aagtgtataacgacctacagga

SEQ ID NO: 7985400 - DNA, 22 bp, Homo sapiens
aaggcagcaagaattccaggtt

SEQ ID NO: 7985401 - DNA, 22 bp, Homo sapiens
aaggcagcaagaattccaggtt

SEQ ID NO: 7985402 - DNA, 22 bp, Homo sapiens
aaggcagcaagaattccaggtt

SEQ ID NO: 7985403 - DNA, 22 bp, Homo sapiens
aaggcagcaagaattccaggtt

SEQ ID NO: 7985404 - DNA, 22 bp, Homo sapiens
aaggcagcacagcaactgctca

SEQ ID NO: 7985405 - DNA, 22 bp, Homo sapiens
aaggcagcacagcaactgctca

SEQ ID NO: 7985406 - DNA, 22 bp, Homo sapiens
aaggcagcacagcaactgctca

SEQ ID NO: 7985407 - DNA, 22 bp, Homo sapiens
aaggcagcaccgcctcctgaaa

SEQ ID NO: 7985408 - DNA, 22 bp, Homo sapiens
aaggcagcaccgcctcctgaaa

SEQ ID NO: 7985409 - DNA, 22 bp, Homo sapiens
aaggcagcagaggaaaggtgct

SEQ ID NO: 7985410 - DNA, 22 bp, Homo sapiens
aaggcagcaggatttggtgact

SEQ ID NO: 7985411 - DNA, 22 bp, Homo sapiens
aaggcagcagaggaaaggtgct

SEQ ID NO: 7985412 - DNA, 22 bp, Homo sapiens
aaggcagcaactaatggatctc

SEQ ID NO: 7985413 - DNA, 22 bp, Homo sapiens
aaggcagcaagaattccaggtt

SEQ ID NO: 7985414 - DNA, 22 bp, Homo sapiens
aaggcagcaactaatggatctc

SEQ ID NO: 7985415 - DNA, 22 bp, Homo sapiens
aaggcagcaactaatggatctc

SEQ ID NO: 7985416 - DNA, 22 bp, Homo sapiens
aaggcagcaactaatggatctc

SEQ ID NO: 7985417 - DNA, 22 bp, Homo sapiens
aaggcagatataaagactagag

SEQ ID NO: 7985418 - DNA, 22 bp, Homo sapiens
aaggcagatataaagactagag

SEQ ID NO: 7985419 - DNA, 22 bp, Homo sapiens
aaggcagatataaagactagag

SEQ ID NO: 7985420 - DNA, 22 bp, Homo sapiens
aaggcacttaacgtgggaggat

SEQ ID NO: 7985421 - DNA, 22 bp, Homo sapiens
aaggcactgtactagttagtta

SEQ ID NO: 7985422 - DNA, 22 bp, Homo sapiens
aaggcacttaacgtgggaggat

SEQ ID NO: 7985423 - DNA, 22 bp, Homo sapiens
aaatgtctacttcccatctgta

SEQ ID NO: 7985424 - DNA, 22 bp, Homo sapiens
aaggcactgtactagttagtta

SEQ ID NO: 7985425 - DNA, 22 bp, Homo sapiens
aaggcagccagatcctttgggt

SEQ ID NO: 7985426 - DNA, 22 bp, Homo sapiens
aaggcagccagatcctttgggt

SEQ ID NO: 7985427 - DNA, 22 bp, Homo sapiens
aaggcagcatgaatccctgtac

SEQ ID NO: 7985428 - DNA, 22 bp, Homo sapiens
aaggcagcagtgcacgactgat

SEQ ID NO: 7985429 - DNA, 22 bp, Homo sapiens
aaggcagcagtgcacgactgat

SEQ ID NO: 7985430 - DNA, 22 bp, Homo sapiens
aaggcagcagtgcacgactgat

SEQ ID NO: 7985431 - DNA, 19 bp, Homo sapiens
aaggcagcagtagcatcca

SEQ ID NO: 7985432 - DNA, 19 bp, Homo sapiens
aaggcagcagtagcatcca

SEQ ID NO: 7985433 - DNA, 22 bp, Homo sapiens
aaggcagcaggatttggtgact

SEQ ID NO: 7985434 - DNA, 22 bp, Homo sapiens
aaggcagcaggatttggtgact

SEQ ID NO: 7985435 - DNA, 22 bp, Homo sapiens
aaggcagcaggatttggtgact

SEQ ID NO: 7985436 - DNA, 22 bp, Homo sapiens
aaggcagccctggctcagcctg

SEQ ID NO: 7985437 - DNA, 22 bp, Homo sapiens
aaggcagccctggctcagcctg

SEQ ID NO: 7985438 - DNA, 22 bp, Homo sapiens
aaggcagccatgtgctttgggt

SEQ ID NO: 7985439 - DNA, 22 bp, Homo sapiens
aaggcagccatgtgctttgggt

SEQ ID NO: 7985440 - DNA, 22 bp, Homo sapiens
aaggcagccatagcaccatcca

SEQ ID NO: 7985441 - DNA, 22 bp, Homo sapiens
aaggcagccagatcctttgggt

SEQ ID NO: 7985442 - DNA, 22 bp, Homo sapiens
aaggcagccatagcaccatcca

SEQ ID NO: 7985443 - DNA, 22 bp, Homo sapiens
aaggcagccctggctcagcctg

SEQ ID NO: 7985444 - DNA, 22 bp, Homo sapiens
aaggcagccctggctcagcctg

SEQ ID NO: 7985445 - DNA, 22 bp, Homo sapiens
aaattattcaaaaagctgtgtt

SEQ ID NO: 7985446 - DNA, 22 bp, Homo sapiens
aaggctggggtgcagacggcct

SEQ ID NO: 7985447 - DNA, 22 bp, Homo sapiens
aaggctgagccagggcccctat

SEQ ID NO: 7985448 - DNA, 22 bp, Homo sapiens
aaggctgggtaacctgtccact

SEQ ID NO: 7985449 - DNA, 22 bp, Homo sapiens
aaggctgggtaacctgtccact

SEQ ID NO: 7985450 - DNA, 21 bp, Homo sapiens
aaattcacctagtaaaacttc

SEQ ID NO: 7985451 - DNA, 22 bp, Homo sapiens
aaattcacaagagcattgcctg

SEQ ID NO: 7985452 - DNA, 22 bp, Homo sapiens
aaggctgagccagggcccctat

SEQ ID NO: 7985453 - DNA, 22 bp, Homo sapiens
aaggctgagccagggcccctat

SEQ ID NO: 7985454 - DNA, 22 bp, Homo sapiens
aaggctgagagtcacagtccta

SEQ ID NO: 7985455 - DNA, 21 bp, Homo sapiens
aaattcacctagtaaaacttc

SEQ ID NO: 7985456 - DNA, 19 bp, Homo sapiens
aaggctggtaccataggtt

SEQ ID NO: 7985457 - DNA, 19 bp, Homo sapiens
aaggctggtaccataggtt

SEQ ID NO: 7985458 - DNA, 22 bp, Homo sapiens
aaggctgggtttgggatgtgat

SEQ ID NO: 7985459 - DNA, 22 bp, Homo sapiens
aaggctgggtttgggatgtgat

SEQ ID NO: 7985460 - DNA, 22 bp, Homo sapiens
aaggctgaggagggcctgcagg

SEQ ID NO: 7985461 - DNA, 22 bp, Homo sapiens
aaggctgggtttgggatgtgat

SEQ ID NO: 7985462 - DNA, 22 bp, Homo sapiens
aaggctgggtttgggatgtgat

SEQ ID NO: 7985463 - DNA, 23 bp, Homo sapiens
aaattattgctcttcaattgcct

SEQ ID NO: 7985464 - DNA, 23 bp, Homo sapiens
aaattattgctcttcaattgcct

SEQ ID NO: 7985465 - DNA, 23 bp, Homo sapiens
aaattattgctcttcaattgcct

SEQ ID NO: 7985466 - DNA, 18 bp, Homo sapiens
aaattattcttccttttc

SEQ ID NO: 7985467 - DNA, 22 bp, Homo sapiens
aaattattctcatgtgtttctt

SEQ ID NO: 7985468 - DNA, 22 bp, Homo sapiens
aaattattcaaaaagctgtgtt

SEQ ID NO: 7985469 - DNA, 22 bp, Homo sapiens
aaattattcaaaaagctgtgtt

SEQ ID NO: 7985470 - DNA, 22 bp, Homo sapiens
aaattattctcatgtgtttctt

SEQ ID NO: 7985471 - DNA, 22 bp, Homo sapiens
aaattattctcatgtgtttctt

SEQ ID NO: 7985472 - DNA, 22 bp, Homo sapiens
aaattattctcatgtgtttctt

SEQ ID NO: 7985473 - DNA, 22 bp, Homo sapiens
aaattattttcagaatggagaa

SEQ ID NO: 7985474 - DNA, 23 bp, Homo sapiens
aaattattgctcttcaattgcct

SEQ ID NO: 7985475 - DNA, 22 bp, Homo sapiens
aaattcaattaactttcatgct

SEQ ID NO: 7985476 - DNA, 22 bp, Homo sapiens
aaattcaattaactttcatgct

SEQ ID NO: 7985477 - DNA, 22 bp, Homo sapiens
aaattcaatgatcactggctca

SEQ ID NO: 7985478 - DNA, 22 bp, Homo sapiens
aaattattttcagaatggagaa

SEQ ID NO: 7985479 - DNA, 22 bp, Homo sapiens
aaattcaattaactttcatgct

SEQ ID NO: 7985480 - DNA, 22 bp, Homo sapiens
aaattcacaagagcattgcctg

SEQ ID NO: 7985481 - DNA, 22 bp, Homo sapiens
aaattcaattaactttcatgct

SEQ ID NO: 7985482 - DNA, 22 bp, Homo sapiens
aaatgcatttcactaatgtttc

SEQ ID NO: 7985483 - DNA, 22 bp, Homo sapiens
aaatgcattggtttctacttgt

SEQ ID NO: 7985484 - DNA, 22 bp, Homo sapiens
aaatgcattggtttctacttgt

SEQ ID NO: 7985485 - DNA, 22 bp, Homo sapiens
aaatgcatttcactaatgtttc

SEQ ID NO: 7985486 - DNA, 22 bp, Homo sapiens
aaggaaagacaggacggaattc

SEQ ID NO: 7985487 - DNA, 22 bp, Homo sapiens
aaggaaagacaggacggaattc

SEQ ID NO: 7985488 - DNA, 22 bp, Homo sapiens
aaggaaagacaggacggaattc

SEQ ID NO: 7985489 - DNA, 22 bp, Homo sapiens
aaatgcatgtgctatagatgtg

SEQ ID NO: 7985490 - DNA, 22 bp, Homo sapiens
aaatgcatgtgctatagatgtg

SEQ ID NO: 7985491 - DNA, 22 bp, Homo sapiens
aaatgcatgtgctatagatgtg

SEQ ID NO: 7985492 - DNA, 22 bp, Homo sapiens
aaatgcatgtatgtaatatgct

SEQ ID NO: 7985493 - DNA, 22 bp, Homo sapiens
aaatgcattctgttttcactag

SEQ ID NO: 7985494 - DNA, 22 bp, Homo sapiens
aaatgcattaagtcagaacaat

SEQ ID NO: 7985495 - DNA, 22 bp, Homo sapiens
aaggaaagacaggacggaattc

SEQ ID NO: 7985496 - DNA, 22 bp, Homo sapiens
aaggaagacacagatgaagtga

SEQ ID NO: 7985497 - DNA, 22 bp, Homo sapiens
aaggaagacacagatgaagtga

SEQ ID NO: 7985498 - DNA, 22 bp, Homo sapiens
aaggaagacacagatgaagtga

SEQ ID NO: 7985499 - DNA, 22 bp, Homo sapiens
aaggaagacacagatgaagtga

SEQ ID NO: 7985500 - DNA, 22 bp, Homo sapiens
aaggaagacacagatgaagtga

SEQ ID NO: 7985501 - DNA, 22 bp, Homo sapiens
aaggaagacacagatgaagtga

SEQ ID NO: 7985502 - DNA, 22 bp, Homo sapiens
aaggaagactcgcaggtctatg

SEQ ID NO: 7985503 - DNA, 22 bp, Homo sapiens
aaggaagactcgcaggtctatg

SEQ ID NO: 7985504 - DNA, 22 bp, Homo sapiens
aaggaagactcgcaggtctatg

SEQ ID NO: 7985505 - DNA, 22 bp, Homo sapiens
aaggaagacacagatgaagtga

SEQ ID NO: 7985506 - DNA, 22 bp, Homo sapiens
aaggaagacacagatgaagtga

SEQ ID NO: 7985507 - DNA, 22 bp, Homo sapiens
aaggaagacacagatgaagtga

SEQ ID NO: 7985508 - DNA, 22 bp, Homo sapiens
aaggaagactcgcaggtctatg

SEQ ID NO: 7985509 - DNA, 22 bp, Homo sapiens
aaggaagagcaaagaattatgt

SEQ ID NO: 7985510 - DNA, 22 bp, Homo sapiens
aaggaagagaatccttctcaga

SEQ ID NO: 7985511 - DNA, 22 bp, Homo sapiens
aaggaagagaatccttctcaga

SEQ ID NO: 7985512 - DNA, 22 bp, Homo sapiens
aaggaagacttgagaaggttcc

SEQ ID NO: 7985513 - DNA, 22 bp, Homo sapiens
aaggaagacttgagaaggttcc

SEQ ID NO: 7985514 - DNA, 22 bp, Homo sapiens
aaggaagacttgagaaggttcc

SEQ ID NO: 7985515 - DNA, 22 bp, Homo sapiens
aaggaagagaatccttctcaga

SEQ ID NO: 7985516 - DNA, 22 bp, Homo sapiens
aaatgtcaaggtgatagatgca

SEQ ID NO: 7985517 - DNA, 22 bp, Homo sapiens
aaatgtcagaaaacatggagtg

SEQ ID NO: 7985518 - DNA, 22 bp, Homo sapiens
aaatgtcagaaaacatggagtg

SEQ ID NO: 7985519 - DNA, 22 bp, Homo sapiens
aaatgtcagaggaacatattga

SEQ ID NO: 7985520 - DNA, 22 bp, Homo sapiens
aaatgtcagaagctttacttct

SEQ ID NO: 7985521 - DNA, 22 bp, Homo sapiens
aaatgtcatatttaagtaggaa

SEQ ID NO: 7985522 - DNA, 22 bp, Homo sapiens
aaatgtccattgaatggatgag

SEQ ID NO: 7985523 - DNA, 22 bp, Homo sapiens
aaatgtctactcctgtgtttat

SEQ ID NO: 7985524 - DNA, 22 bp, Homo sapiens
aaatgtccttagagaaaagtca

SEQ ID NO: 7985525 - DNA, 22 bp, Homo sapiens
aaatgtcctgagattcaactta

SEQ ID NO: 7985526 - DNA, 22 bp, Homo sapiens
aaatgtctactcctgtgtttat

SEQ ID NO: 7985527 - DNA, 22 bp, Homo sapiens
aaatgtctactcctgtgtttat

SEQ ID NO: 7985528 - DNA, 22 bp, Homo sapiens
aaatgtcagaggaacatattga

SEQ ID NO: 7985529 - DNA, 22 bp, Homo sapiens
aaatgtcagaggaacatattga

SEQ ID NO: 7985530 - DNA, 22 bp, Homo sapiens
aaatgtcatatttaagtaggaa

SEQ ID NO: 7985531 - DNA, 22 bp, Homo sapiens
aaatgtcaaggtgatagatgca

SEQ ID NO: 7985532 - DNA, 22 bp, Homo sapiens
aaatgtcaaggtgatagatgca

SEQ ID NO: 7985533 - DNA, 22 bp, Homo sapiens
aaatgtcaaggtgatagatgca

SEQ ID NO: 7985534 - DNA, 22 bp, Homo sapiens
aaggaagatgaaagtactgcta

SEQ ID NO: 7985535 - DNA, 22 bp, Homo sapiens
aaggaagatatatcaagcttaa

SEQ ID NO: 7985536 - DNA, 22 bp, Homo sapiens
aaggaagagtctagaacaggca

SEQ ID NO: 7985537 - DNA, 22 bp, Homo sapiens
aaggaagagtctagaacaggca

SEQ ID NO: 7985538 - DNA, 22 bp, Homo sapiens
aaggaagagtctagaacaggca

SEQ ID NO: 7985539 - DNA, 22 bp, Homo sapiens
aaggaagagcaaagaattatgt

SEQ ID NO: 7985540 - DNA, 22 bp, Homo sapiens
aaatttgtattccttttccgta

SEQ ID NO: 7985541 - DNA, 22 bp, Homo sapiens
aaatttgtcaacttcatatgtt

SEQ ID NO: 7985542 - DNA, 22 bp, Homo sapiens
aaatttgataagccattgttac

SEQ ID NO: 7985543 - DNA, 22 bp, Homo sapiens
aaatttctgttgttttgagcca

SEQ ID NO: 7985544 - DNA, 22 bp, Homo sapiens
aaatttctggaagtgtcagagt

SEQ ID NO: 7985545 - DNA, 22 bp, Homo sapiens
aaatttctgttgttttgagcca

SEQ ID NO: 7985546 - DNA, 22 bp, Homo sapiens
aaatttctggaagtgtcagagt

SEQ ID NO: 7985547 - DNA, 22 bp, Homo sapiens
aaatttctgttgttttgagcca

SEQ ID NO: 7985548 - DNA, 22 bp, Homo sapiens
aaatttctgttgttttgagcca

SEQ ID NO: 7985549 - DNA, 22 bp, Homo sapiens
aaatttcttgaggctctctagc

SEQ ID NO: 7985550 - DNA, 22 bp, Homo sapiens
aaatttcttgaggctctctagc

SEQ ID NO: 7985551 - DNA, 22 bp, Homo sapiens
aaatttcttgaggctctctagc

SEQ ID NO: 7985552 - DNA, 22 bp, Homo sapiens
aaatttcttgaggctctctagc

SEQ ID NO: 7985553 - DNA, 22 bp, Homo sapiens
aaattttaaggctggaacttaa

SEQ ID NO: 7985554 - DNA, 22 bp, Homo sapiens
aaattttaaggctggaacttaa

SEQ ID NO: 7985555 - DNA, 22 bp, Homo sapiens
aaattttaaggctggaacttaa

SEQ ID NO: 7985556 - DNA, 22 bp, Homo sapiens
aaattttaaggctggaacttaa

SEQ ID NO: 7985557 - DNA, 22 bp, Homo sapiens
aaatttgttcaatgtctatttg

SEQ ID NO: 7985558 - DNA, 23 bp, Homo sapiens
aacacaaagctgattccagtggc

SEQ ID NO: 7985559 - DNA, 23 bp, Homo sapiens
aacacaaagctgattccagtggc

SEQ ID NO: 7985560 - DNA, 22 bp, Homo sapiens
aacaatgtgaagtgctgttcag

SEQ ID NO: 7985561 - DNA, 22 bp, Homo sapiens
aacaatgtaatctactctgctc

SEQ ID NO: 7985562 - DNA, 22 bp, Homo sapiens
aacaatgcttgccaagtgtgat

SEQ ID NO: 7985563 - DNA, 22 bp, Homo sapiens
aacaatgtctcatcctatgtgg

SEQ ID NO: 7985564 - DNA, 22 bp, Homo sapiens
aacaatgtcctgtgagatgata

SEQ ID NO: 7985565 - DNA, 22 bp, Homo sapiens
aacaatgtcctgtgagatgata

SEQ ID NO: 7985566 - DNA, 22 bp, Homo sapiens
aaatttctaagtcaagaagaac

SEQ ID NO: 7985567 - DNA, 22 bp, Homo sapiens
aaggctggttccatccctggtg

SEQ ID NO: 7985568 - DNA, 22 bp, Homo sapiens
aaggctggttccatccctggtg

SEQ ID NO: 7985569 - DNA, 22 bp, Homo sapiens
aaatttctaagtcaagaagaac

SEQ ID NO: 7985570 - DNA, 22 bp, Homo sapiens
aaatttctaagtcaagaagaac

SEQ ID NO: 7985571 - DNA, 22 bp, Homo sapiens
aaatttctaagtcaagaagaac

SEQ ID NO: 7985572 - DNA, 22 bp, Homo sapiens
aaatttctaagtcaagaagaac

SEQ ID NO: 7985573 - DNA, 22 bp, Homo sapiens
aaatttctaagtcaagaagaac

SEQ ID NO: 7985574 - DNA, 21 bp, Homo sapiens
aaatttctgcaagcctcaact

SEQ ID NO: 7985575 - DNA, 22 bp, Homo sapiens
aaatttctggaagtgtcagagt

SEQ ID NO: 7985576 - DNA, 22 bp, Homo sapiens
aaatttctggaagtgtcagagt

SEQ ID NO: 7985577 - DNA, 21 bp, Homo sapiens
aaatttctgcaagcctcaact

SEQ ID NO: 7985578 - DNA, 22 bp, Homo sapiens
aaggctggtggattatgaggtc

SEQ ID NO: 7985579 - DNA, 22 bp, Homo sapiens
aaggctggttccatccctggtg

SEQ ID NO: 7985580 - DNA, 22 bp, Homo sapiens
aaggctggttccatccctggtg

SEQ ID NO: 7985581 - DNA, 22 bp, Homo sapiens
aaggctggtcagatgtggtgaa

SEQ ID NO: 7985582 - DNA, 22 bp, Homo sapiens
aaggctggtcagatgtggtgaa

SEQ ID NO: 7985583 - DNA, 22 bp, Homo sapiens
aaggctggtggattatgaggtc

SEQ ID NO: 7985584 - DNA, 22 bp, Homo sapiens
aaggctggtggattatgaggtc

SEQ ID NO: 7985585 - DNA, 22 bp, Homo sapiens
aacacaggccagcctgtgcagt

SEQ ID NO: 7985586 - DNA, 22 bp, Homo sapiens
aacacaggggcgtggctcttac

SEQ ID NO: 7985587 - DNA, 22 bp, Homo sapiens
aacacagggcagctgctgggaa

SEQ ID NO: 7985588 - DNA, 20 bp, Homo sapiens
aacacagataccaaaggttg

SEQ ID NO: 7985589 - DNA, 22 bp, Homo sapiens
aacacagatcaaaatatttcct

SEQ ID NO: 7985590 - DNA, 22 bp, Homo sapiens
aacacagatcaaaatatttcct

SEQ ID NO: 7985591 - DNA, 22 bp, Homo sapiens
aacacagatcaaaatatttcct

SEQ ID NO: 7985592 - DNA, 22 bp, Homo sapiens
aacacagatcaaaatatttcct

SEQ ID NO: 7985593 - DNA, 22 bp, Homo sapiens
aacacagatcaaaatatttcct

SEQ ID NO: 7985594 - DNA, 22 bp, Homo sapiens
aacacagctaatttctgtcaat

SEQ ID NO: 7985595 - DNA, 22 bp, Homo sapiens
aacacagctaatttctgtcaat

SEQ ID NO: 7985596 - DNA, 22 bp, Homo sapiens
aacacaggaaattggtaaatgg

SEQ ID NO: 7985597 - DNA, 22 bp, Homo sapiens
aacacaatcttccagtttgctg

SEQ ID NO: 7985598 - DNA, 20 bp, Homo sapiens
aacacactggtggcatcagg

SEQ ID NO: 7985599 - DNA, 22 bp, Homo sapiens
aacacagaagtgccaagagcca

SEQ ID NO: 7985600 - DNA, 22 bp, Homo sapiens
aacacagaagtgccaagagcca

SEQ ID NO: 7985601 - DNA, 22 bp, Homo sapiens
aacacagaagtgccaagagcca

SEQ ID NO: 7985602 - DNA, 22 bp, Homo sapiens
aacacagaagtgccaagagcca

SEQ ID NO: 7985603 - DNA, 22 bp, Homo sapiens
aacacagaagtgccaagagcca

SEQ ID NO: 7985604 - DNA, 22 bp, Homo sapiens
aacacagaagtgccaagagcca

SEQ ID NO: 7985605 - DNA, 22 bp, Homo sapiens
aacacagagtatttgaagcatt

SEQ ID NO: 7985606 - DNA, 22 bp, Homo sapiens
aacacagagtatttgaagcatt

SEQ ID NO: 7985607 - DNA, 22 bp, Homo sapiens
aacacagagtatttgaagcatt

SEQ ID NO: 7985608 - DNA, 22 bp, Homo sapiens
aacacagagtatttgaagcatt

SEQ ID NO: 7985609 - DNA, 22 bp, Homo sapiens
aacacagacatagtgattacag

SEQ ID NO: 7985610 - DNA, 22 bp, Homo sapiens
aacacagacatagtgattacag

SEQ ID NO: 7985611 - DNA, 22 bp, Homo sapiens
aacacagacatagtgattacag

SEQ ID NO: 7985612 - DNA, 20 bp, Homo sapiens
aacacagataccaaaggttg

SEQ ID NO: 7985613 - DNA, 20 bp, Homo sapiens
aacacagataccaaaggttg

SEQ ID NO: 7985614 - DNA, 20 bp, Homo sapiens
aacacagataccaaaggttg

SEQ ID NO: 7985615 - DNA, 20 bp, Homo sapiens
aacacagataccaaaggttg

SEQ ID NO: 7985616 - DNA, 22 bp, Homo sapiens
aacacagagtatttgaagcatt

SEQ ID NO: 7985617 - DNA, 22 bp, Homo sapiens
aacagagaggccacctcagcag

SEQ ID NO: 7985618 - DNA, 22 bp, Homo sapiens
aacagagaggccacctcagcag

SEQ ID NO: 7985619 - DNA, 22 bp, Homo sapiens
aacagacatatttttaatatgc

SEQ ID NO: 7985620 - DNA, 22 bp, Homo sapiens
aacagacaactcctgtggctca

SEQ ID NO: 7985621 - DNA, 22 bp, Homo sapiens
aacagacatatttttaatatgc

SEQ ID NO: 7985622 - DNA, 22 bp, Homo sapiens
aacagacatatttttaatatgc

SEQ ID NO: 7985623 - DNA, 22 bp, Homo sapiens
aacagacatatttttaatatgc

SEQ ID NO: 7985624 - DNA, 22 bp, Homo sapiens
aacagacatatttttaatatgc

SEQ ID NO: 7985625 - DNA, 22 bp, Homo sapiens
aacagacatatttttaatatgc

SEQ ID NO: 7985626 - DNA, 22 bp, Homo sapiens
aacagacagaaaaatgtgatct

SEQ ID NO: 7985627 - DNA, 22 bp, Homo sapiens
aacagacatatttttaatatgc

SEQ ID NO: 7985628 - DNA, 22 bp, Homo sapiens
aacagacagaaaaatgtgatct

SEQ ID NO: 7985629 - DNA, 22 bp, Homo sapiens
aacagacagaaaaatgtgatct

SEQ ID NO: 7985630 - DNA, 22 bp, Homo sapiens
aacagacagaaaaatgtgatct

SEQ ID NO: 7985631 - DNA, 22 bp, Homo sapiens
aacagacagaaaaatgtgatct

SEQ ID NO: 7985632 - DNA, 22 bp, Homo sapiens
aacagacagaaaaatgtgatct

SEQ ID NO: 7985633 - DNA, 22 bp, Homo sapiens
aacagacaactcctgtggctca

SEQ ID NO: 7985634 - DNA, 22 bp, Homo sapiens
aacagacaactcctgtggctca

SEQ ID NO: 7985635 - DNA, 22 bp, Homo sapiens
aacagaaatcatttagggctct

SEQ ID NO: 7985636 - DNA, 22 bp, Homo sapiens
aacagaaatcatttagggctct

SEQ ID NO: 7985637 - DNA, 22 bp, Homo sapiens
aacagaaatcatttagggctct

SEQ ID NO: 7985638 - DNA, 22 bp, Homo sapiens
aacagaaaaggtaggtggcttt

SEQ ID NO: 7985639 - DNA, 22 bp, Homo sapiens
aacagaaaaggtaggtggcttt

SEQ ID NO: 7985640 - DNA, 22 bp, Homo sapiens
aacagaacccgagtgtgaatct

SEQ ID NO: 7985641 - DNA, 22 bp, Homo sapiens
aacagaacccgagtgtgaatct

SEQ ID NO: 7985642 - DNA, 22 bp, Homo sapiens
aacagaactgttgttctggagg

SEQ ID NO: 7985643 - DNA, 22 bp, Homo sapiens
aacagaactgttgttctggagg

SEQ ID NO: 7985644 - DNA, 22 bp, Homo sapiens
aacagaagggggtatttacatt

SEQ ID NO: 7985645 - DNA, 22 bp, Homo sapiens
aacagaacccgagtgtgaatct

SEQ ID NO: 7985646 - DNA, 22 bp, Homo sapiens
aacagaatagttgatgtacagt

SEQ ID NO: 7985647 - DNA, 22 bp, Homo sapiens
aacagaatatcaaaagattatg

SEQ ID NO: 7985648 - DNA, 22 bp, Homo sapiens
aacagaatatcaaaagattatg

SEQ ID NO: 7985649 - DNA, 22 bp, Homo sapiens
aacagaatcttgggttcttttc

SEQ ID NO: 7985650 - DNA, 22 bp, Homo sapiens
aacagaatcttgggttcttttc

SEQ ID NO: 7985651 - DNA, 22 bp, Homo sapiens
aacactttttagtaaagattga

SEQ ID NO: 7985652 - DNA, 22 bp, Homo sapiens
aacactttttagtaaagattga

SEQ ID NO: 7985653 - DNA, 22 bp, Homo sapiens
aacactttttagtaaagattga

SEQ ID NO: 7985654 - DNA, 22 bp, Homo sapiens
aacactttgttgcctatgaacg

SEQ ID NO: 7985655 - DNA, 22 bp, Homo sapiens
aacactttgttgcctatgaacg

SEQ ID NO: 7985656 - DNA, 22 bp, Homo sapiens
aacactttgttgcctatgaacg

SEQ ID NO: 7985657 - DNA, 22 bp, Homo sapiens
aacactttttatatattgtatc

SEQ ID NO: 7985658 - DNA, 22 bp, Homo sapiens
aacactttttatatattgtatc

SEQ ID NO: 7985659 - DNA, 22 bp, Homo sapiens
aacactttttatatattgtatc

SEQ ID NO: 7985660 - DNA, 22 bp, Homo sapiens
aacactttttcctcctgtctgg

SEQ ID NO: 7985661 - DNA, 22 bp, Homo sapiens
aacactttctattattatggtt

SEQ ID NO: 7985662 - DNA, 22 bp, Homo sapiens
aacactttctattattatggtt

SEQ ID NO: 7985663 - DNA, 22 bp, Homo sapiens
aacactttcttccttgctcagg

SEQ ID NO: 7985664 - DNA, 22 bp, Homo sapiens
aacactttcttccttgctcagg

SEQ ID NO: 7985665 - DNA, 22 bp, Homo sapiens
aacactttggatgcagaaccaa

SEQ ID NO: 7985666 - DNA, 22 bp, Homo sapiens
aacactttggaatagagatagg

SEQ ID NO: 7985667 - DNA, 22 bp, Homo sapiens
aacactttcttccttgctcagg

SEQ ID NO: 7985668 - DNA, 22 bp, Homo sapiens
aacactttcttccttgctcagg

SEQ ID NO: 7985669 - DNA, 22 bp, Homo sapiens
aacactttggaatagagatagg

SEQ ID NO: 7985670 - DNA, 22 bp, Homo sapiens
aacacaggttcattctgtgagg

SEQ ID NO: 7985671 - DNA, 22 bp, Homo sapiens
aacacaggttgctgggcctcac

SEQ ID NO: 7985672 - DNA, 20 bp, Homo sapiens
aacacagggttaccatcaga

SEQ ID NO: 7985673 - DNA, 20 bp, Homo sapiens
aacacagggttaccatcaga

SEQ ID NO: 7985674 - DNA, 22 bp, Homo sapiens
aacacaggtttgtggtaaataa

SEQ ID NO: 7985675 - DNA, 22 bp, Homo sapiens
aacacagtcattagaggcagcc

SEQ ID NO: 7985676 - DNA, 22 bp, Homo sapiens
aacacagtcctgctcacttatt

SEQ ID NO: 7985677 - DNA, 22 bp, Homo sapiens
aacacagtcattagaggcagcc

SEQ ID NO: 7985678 - DNA, 22 bp, Homo sapiens
aacacagtcctgctcacttatt

SEQ ID NO: 7985679 - DNA, 22 bp, Homo sapiens
aacacagtcctgctcacttatt

SEQ ID NO: 7985680 - DNA, 22 bp, Homo sapiens
aacacagtttctctatgagagt

SEQ ID NO: 7985681 - DNA, 22 bp, Homo sapiens
aacacagttagtaagggaaata

SEQ ID NO: 7985682 - DNA, 22 bp, Homo sapiens
aacacagttagtaagggaaata

SEQ ID NO: 7985683 - DNA, 22 bp, Homo sapiens
aacacagtttctgcattggtag

SEQ ID NO: 7985684 - DNA, 22 bp, Homo sapiens
aacacagtttctgcattggtag

SEQ ID NO: 7985685 - DNA, 22 bp, Homo sapiens
aacacagttttccaaaatagag

SEQ ID NO: 7985686 - DNA, 22 bp, Homo sapiens
aacacagttttccaaaatagag

SEQ ID NO: 7985687 - DNA, 22 bp, Homo sapiens
aacacagttttccaaaatagag

SEQ ID NO: 7985688 - DNA, 22 bp, Homo sapiens
aacactgtatcagtcttcaata

SEQ ID NO: 7985689 - DNA, 22 bp, Homo sapiens
aacactgtatcagtcttcaata

SEQ ID NO: 7985690 - DNA, 22 bp, Homo sapiens
aacactgtatcagtcttcaata

SEQ ID NO: 7985691 - DNA, 22 bp, Homo sapiens
aacactgtatcagtcttcaata

SEQ ID NO: 7985692 - DNA, 22 bp, Homo sapiens
aatttcactgtggagcacattt

SEQ ID NO: 7985693 - DNA, 22 bp, Homo sapiens
aatttcactggaaaagataatt

SEQ ID NO: 7985694 - DNA, 22 bp, Homo sapiens
aatttacacttcatttggaggg

SEQ ID NO: 7985695 - DNA, 22 bp, Homo sapiens
aatttacacttcatttggaggg

SEQ ID NO: 7985696 - DNA, 22 bp, Homo sapiens
aagaacaactgctttaaaagca

SEQ ID NO: 7985697 - DNA, 22 bp, Homo sapiens
aagaacaactgctttaaaagca

SEQ ID NO: 7985698 - DNA, 22 bp, Homo sapiens
aagaacaactgctttaaaagca

SEQ ID NO: 7985699 - DNA, 22 bp, Homo sapiens
aagaacaactgctttaaaagca

SEQ ID NO: 7985700 - DNA, 17 bp, Homo sapiens
aagaacactcaatagca

SEQ ID NO: 7985701 - DNA, 17 bp, Homo sapiens
aagaacactcaatagca

SEQ ID NO: 7985702 - DNA, 17 bp, Homo sapiens
aagaacactcaatagca

SEQ ID NO: 7985703 - DNA, 17 bp, Homo sapiens
aagaacactcaatagca

SEQ ID NO: 7985704 - DNA, 22 bp, Homo sapiens
aatttaaggaggccttcactct

SEQ ID NO: 7985705 - DNA, 22 bp, Homo sapiens
aagaacagattcagcctgaact

SEQ ID NO: 7985706 - DNA, 22 bp, Homo sapiens
aagaaatgtgaatattgaatag

SEQ ID NO: 7985707 - DNA, 22 bp, Homo sapiens
aagaaatgtgaatattgaatag

SEQ ID NO: 7985708 - DNA, 22 bp, Homo sapiens
aagaaatgtgaatattgaatag

SEQ ID NO: 7985709 - DNA, 22 bp, Homo sapiens
aagaaatgtgaatattgaatag

SEQ ID NO: 7985710 - DNA, 22 bp, Homo sapiens
aagaaatgtgaatattgaatag

SEQ ID NO: 7985711 - DNA, 22 bp, Homo sapiens
aagaaatgtgaatattgaatag

SEQ ID NO: 7985712 - DNA, 22 bp, Homo sapiens
aagaaatgtgaatattgaatag

SEQ ID NO: 7985713 - DNA, 22 bp, Homo sapiens
aagaaatgtgaatattgaatag

SEQ ID NO: 7985714 - DNA, 22 bp, Homo sapiens
aagaaatggcttcatctgagta

SEQ ID NO: 7985715 - DNA, 22 bp, Homo sapiens
aagaaatggcttcatctgagta

SEQ ID NO: 7985716 - DNA, 22 bp, Homo sapiens
aagaaatggcttcatctgagta

SEQ ID NO: 7985717 - DNA, 22 bp, Homo sapiens
aattctgagaacaaaaggtact

SEQ ID NO: 7985718 - DNA, 22 bp, Homo sapiens
aagaaatggcttcatctgagta

SEQ ID NO: 7985719 - DNA, 22 bp, Homo sapiens
aagaaatgtagagcctagtaaa

SEQ ID NO: 7985720 - DNA, 22 bp, Homo sapiens
aagaaatgtagagcctagtaaa

SEQ ID NO: 7985721 - DNA, 22 bp, Homo sapiens
aagaaatgtagagcctagtaaa

SEQ ID NO: 7985722 - DNA, 22 bp, Homo sapiens
aagaaatgtagagcctagtaaa

SEQ ID NO: 7985723 - DNA, 22 bp, Homo sapiens
aagaacaactgctttaaaagca

SEQ ID NO: 7985724 - DNA, 22 bp, Homo sapiens
aagaacaactgctttaaaagca

SEQ ID NO: 7985725 - DNA, 22 bp, Homo sapiens
aagaacaactgctttaaaagca

SEQ ID NO: 7985726 - DNA, 22 bp, Homo sapiens
aagaacaactgctttaaaagca

SEQ ID NO: 7985727 - DNA, 22 bp, Homo sapiens
aagaaattaaggaatgcaacga

SEQ ID NO: 7985728 - DNA, 22 bp, Homo sapiens
aagaaattaaggaatgcaacga

SEQ ID NO: 7985729 - DNA, 22 bp, Homo sapiens
aagaaattaaggaatgcaacga

SEQ ID NO: 7985730 - DNA, 22 bp, Homo sapiens
aagaaattaatgtgccattact

SEQ ID NO: 7985731 - DNA, 22 bp, Homo sapiens
aattcctctatctttcttcaag

SEQ ID NO: 7985732 - DNA, 22 bp, Homo sapiens
aattcctagttgtacttagtga

SEQ ID NO: 7985733 - DNA, 23 bp, Homo sapiens
aattcctgtcttgctttatcgga

SEQ ID NO: 7985734 - DNA, 22 bp, Homo sapiens
aattctataggcaagctatttt

SEQ ID NO: 7985735 - DNA, 22 bp, Homo sapiens
aattctataggcaagctatttt

SEQ ID NO: 7985736 - DNA, 22 bp, Homo sapiens
aattctagcattgtgaaaatat

SEQ ID NO: 7985737 - DNA, 22 bp, Homo sapiens
aattctagcccaggcaaaacta

SEQ ID NO: 7985738 - DNA, 22 bp, Homo sapiens
aattctacattggttcacattt

SEQ ID NO: 7985739 - DNA, 22 bp, Homo sapiens
aattctaaatgtaatttagaat

SEQ ID NO: 7985740 - DNA, 22 bp, Homo sapiens
aattctaaatgtaatttagaat

SEQ ID NO: 7985741 - DNA, 22 bp, Homo sapiens
aattctcaggaatttcatctgt

SEQ ID NO: 7985742 - DNA, 22 bp, Homo sapiens
aattctcaggaatttcatctgt

SEQ ID NO: 7985743 - DNA, 22 bp, Homo sapiens
aattctataggcaagctatttt

SEQ ID NO: 7985744 - DNA, 22 bp, Homo sapiens
aattctatgttcttgagtaaga

SEQ ID NO: 7985745 - DNA, 22 bp, Homo sapiens
aattctatgttcttgagtaaga

SEQ ID NO: 7985746 - DNA, 22 bp, Homo sapiens
aattctctactgtttggtgctc

SEQ ID NO: 7985747 - DNA, 22 bp, Homo sapiens
aattctctccagggtaacatca

SEQ ID NO: 7985748 - DNA, 22 bp, Homo sapiens
aattctctccagggtaacatca

SEQ ID NO: 7985749 - DNA, 22 bp, Homo sapiens
aattctgaaagattccttattc

SEQ ID NO: 7985750 - DNA, 22 bp, Homo sapiens
aattctctccagggtaacatca

SEQ ID NO: 7985751 - DNA, 22 bp, Homo sapiens
aattcccactatatgccaagca

SEQ ID NO: 7985752 - DNA, 21 bp, Homo sapiens
aattcccagaaacagcacaag

SEQ ID NO: 7985753 - DNA, 22 bp, Homo sapiens
aattcccaccttctctcttttg

SEQ ID NO: 7985754 - DNA, 22 bp, Homo sapiens
aattcccaccttctctcttttg

SEQ ID NO: 7985755 - DNA, 22 bp, Homo sapiens
aattcccatttgcagaaaatca

SEQ ID NO: 7985756 - DNA, 22 bp, Homo sapiens
aattcccatttgcagaaaatca

SEQ ID NO: 7985757 - DNA, 22 bp, Homo sapiens
aattcccactatatgccaagca

SEQ ID NO: 7985758 - DNA, 22 bp, Homo sapiens
aattccctcaggggactccttt

SEQ ID NO: 7985759 - DNA, 22 bp, Homo sapiens
aattcacaatgtgtagtcatgc

SEQ ID NO: 7985760 - DNA, 22 bp, Homo sapiens
aattcacaatgtgtagtcatgc

SEQ ID NO: 7985761 - DNA, 22 bp, Homo sapiens
aattcacaatgtgtagtcatgc

SEQ ID NO: 7985762 - DNA, 21 bp, Homo sapiens
aagaaagataattaaggaccc

SEQ ID NO: 7985763 - DNA, 22 bp, Homo sapiens
aattcacaattatgttgggaga

SEQ ID NO: 7985764 - DNA, 22 bp, Homo sapiens
aagaaagataaggtttgcttgg

SEQ ID NO: 7985765 - DNA, 22 bp, Homo sapiens
aagaaagagatcactcctccat

SEQ ID NO: 7985766 - DNA, 22 bp, Homo sapiens
aagaaagagatcactcctccat

SEQ ID NO: 7985767 - DNA, 22 bp, Homo sapiens
aagaaagataaggtttgcttgg

SEQ ID NO: 7985768 - DNA, 22 bp, Homo sapiens
aagaaagataaggtttgcttgg

SEQ ID NO: 7985769 - DNA, 22 bp, Homo sapiens
aagaaagataaggtttgcttgg

SEQ ID NO: 7985770 - DNA, 20 bp, Homo sapiens
aagaaacttgaaagtacaag

SEQ ID NO: 7985771 - DNA, 20 bp, Homo sapiens
aagaaacttgaaagtacaag

SEQ ID NO: 7985772 - DNA, 22 bp, Homo sapiens
aagaaagagatcactcctccat

SEQ ID NO: 7985773 - DNA, 22 bp, Homo sapiens
aactttctgtctgagctgcaga

SEQ ID NO: 7985774 - DNA, 22 bp, Homo sapiens
aactggtgagataaattattta

SEQ ID NO: 7985775 - DNA, 22 bp, Homo sapiens
aactttctgttacgtccccaga

SEQ ID NO: 7985776 - DNA, 22 bp, Homo sapiens
aagaaaacaatgacttgccagc

SEQ ID NO: 7985777 - DNA, 22 bp, Homo sapiens
aactttcttgtgacatttgggg

SEQ ID NO: 7985778 - DNA, 22 bp, Homo sapiens
aactttcttggatgtctcaaca

SEQ ID NO: 7985779 - DNA, 22 bp, Homo sapiens
aactttctgtctgagctgcaga

SEQ ID NO: 7985780 - DNA, 22 bp, Homo sapiens
aactggtatggtgagaagagag

SEQ ID NO: 7985781 - DNA, 22 bp, Homo sapiens
aactggtagctgattaagtata

SEQ ID NO: 7985782 - DNA, 22 bp, Homo sapiens
aactggtagaaagcagtaagtg

SEQ ID NO: 7985783 - DNA, 22 bp, Homo sapiens
aactggtatctcttcagtgtaa

SEQ ID NO: 7985784 - DNA, 19 bp, Homo sapiens
aactggataatggccacat

SEQ ID NO: 7985785 - DNA, 22 bp, Homo sapiens
aactggagggcaaatggcttgt

SEQ ID NO: 7985786 - DNA, 19 bp, Homo sapiens
aactggataatggccacat

SEQ ID NO: 7985787 - DNA, 22 bp, Homo sapiens
aactggatcagttgagggaggc

SEQ ID NO: 7985788 - DNA, 22 bp, Homo sapiens
aactggatcagttgagggaggc

SEQ ID NO: 7985789 - DNA, 22 bp, Homo sapiens
aactggattattcagttgctgc

SEQ ID NO: 7985790 - DNA, 22 bp, Homo sapiens
aactggattaactggctcaaat

SEQ ID NO: 7985791 - DNA, 22 bp, Homo sapiens
aactggaatgaaatttacgatg

SEQ ID NO: 7985792 - DNA, 22 bp, Homo sapiens
aactggagggcaaatggcttgt

SEQ ID NO: 7985793 - DNA, 22 bp, Homo sapiens
aactggctgggaacacctagag

SEQ ID NO: 7985794 - DNA, 22 bp, Homo sapiens
aactggcatatgaacttgttct

SEQ ID NO: 7985795 - DNA, 22 bp, Homo sapiens
aactgggcccagtctgagttgg

SEQ ID NO: 7985796 - DNA, 22 bp, Homo sapiens
aactggcatatgaacttgttct

SEQ ID NO: 7985797 - DNA, 22 bp, Homo sapiens
aactggatttaggaacagagaa

SEQ ID NO: 7985798 - DNA, 22 bp, Homo sapiens
aactggattcttactgggctga

SEQ ID NO: 7985799 - DNA, 22 bp, Homo sapiens
aactggattgacctagtttaag

SEQ ID NO: 7985800 - DNA, 22 bp, Homo sapiens
aactggatttaggaacagagaa

SEQ ID NO: 7985801 - DNA, 22 bp, Homo sapiens
aactggattttgatgagcagtt

SEQ ID NO: 7985802 - DNA, 21 bp, Homo sapiens
aactggcagaccaactatggc

SEQ ID NO: 7985803 - DNA, 22 bp, Homo sapiens
aactggattttgatgagcagtt

SEQ ID NO: 7985804 - DNA, 22 bp, Homo sapiens
aatggctttgacattttcaaat

SEQ ID NO: 7985805 - DNA, 22 bp, Homo sapiens
aatgggaagccagaagacaagg

SEQ ID NO: 7985806 - DNA, 22 bp, Homo sapiens
aactgcttcttactgctgggca

SEQ ID NO: 7985807 - DNA, 22 bp, Homo sapiens
aatggcttttgcacttaaatcg

SEQ ID NO: 7985808 - DNA, 22 bp, Homo sapiens
aatggcttttaaaaatagcatt

SEQ ID NO: 7985809 - DNA, 22 bp, Homo sapiens
aatggctttgagtattttctgg

SEQ ID NO: 7985810 - DNA, 22 bp, Homo sapiens
aatggctttgacattttcaaat

SEQ ID NO: 7985811 - DNA, 22 bp, Homo sapiens
aactggaaagatcagtaggaag

SEQ ID NO: 7985812 - DNA, 22 bp, Homo sapiens
aactggaaagatcagtaggaag

SEQ ID NO: 7985813 - DNA, 17 bp, Homo sapiens
aactgctttttttagcc

SEQ ID NO: 7985814 - DNA, 22 bp, Homo sapiens
aactgcttgtaaataatgttga

SEQ ID NO: 7985815 - DNA, 22 bp, Homo sapiens
aactggaaccttttattcagtc

SEQ ID NO: 7985816 - DNA, 22 bp, Homo sapiens
aactggaaagatcagtaggaag

SEQ ID NO: 7985817 - DNA, 22 bp, Homo sapiens
aactggaaccttttattcagtc

SEQ ID NO: 7985818 - DNA, 22 bp, Homo sapiens
aactggaaccttttattcagtc

SEQ ID NO: 7985819 - DNA, 22 bp, Homo sapiens
aactggaactggtagtgttggt

SEQ ID NO: 7985820 - DNA, 22 bp, Homo sapiens
aactggaaggattgcagatgtc

SEQ ID NO: 7985821 - DNA, 22 bp, Homo sapiens
aagaaaacaatgacttgccagc

SEQ ID NO: 7985822 - DNA, 22 bp, Homo sapiens
aagaaaacaatgacttgccagc

SEQ ID NO: 7985823 - DNA, 22 bp, Homo sapiens
aagaaaacaatgacttgccagc

SEQ ID NO: 7985824 - DNA, 22 bp, Homo sapiens
aagaaaacatgatctaatttaa

SEQ ID NO: 7985825 - DNA, 22 bp, Homo sapiens
aagaaaacgttttgaggagttt

SEQ ID NO: 7985826 - DNA, 20 bp, Homo sapiens
aagaaaacgtcttcagggga

SEQ ID NO: 7985827 - DNA, 22 bp, Homo sapiens
aagaaaacgttttgaggagttt

SEQ ID NO: 7985828 - DNA, 20 bp, Homo sapiens
aagaaaacgtcttcagggga

SEQ ID NO: 7985829 - DNA, 22 bp, Homo sapiens
aagaaaacatgatctaatttaa

SEQ ID NO: 7985830 - DNA, 22 bp, Homo sapiens
aagaaaatcagttctggtcagt

SEQ ID NO: 7985831 - DNA, 22 bp, Homo sapiens
aagaaaatcagttctggtcagt

SEQ ID NO: 7985832 - DNA, 22 bp, Homo sapiens
aagaaaatcagttctggtcagt

SEQ ID NO: 7985833 - DNA, 22 bp, Homo sapiens
aagaaaagatgtttggttttca

SEQ ID NO: 7985834 - DNA, 22 bp, Homo sapiens
aagaaaagatgtttggttttca

SEQ ID NO: 7985835 - DNA, 22 bp, Homo sapiens
aagaaaaggtaaccgcttatct

SEQ ID NO: 7985836 - DNA, 22 bp, Homo sapiens
aagaaaagaaacctgaggcttt

SEQ ID NO: 7985837 - DNA, 22 bp, Homo sapiens
aagaaaagaaacctgaggcttt

SEQ ID NO: 7985838 - DNA, 22 bp, Homo sapiens
aagaaaagatgtttggttttca

SEQ ID NO: 7985839 - DNA, 22 bp, Homo sapiens
aagaaaagaaacctgaggcttt

SEQ ID NO: 7985840 - DNA, 22 bp, Homo sapiens
aagaaaagaaacctgaggcttt

SEQ ID NO: 7985841 - DNA, 22 bp, Homo sapiens
aagaaaagaaacctgaggcttt

SEQ ID NO: 7985842 - DNA, 22 bp, Homo sapiens
aagaaaagaaacctgaggcttt

SEQ ID NO: 7985843 - DNA, 22 bp, Homo sapiens
aagaaacaaccactgctctcct

SEQ ID NO: 7985844 - DNA, 22 bp, Homo sapiens
aagaaaccaaccctgccagcac

SEQ ID NO: 7985845 - DNA, 22 bp, Homo sapiens
aagaaacaaccactgctctcct

SEQ ID NO: 7985846 - DNA, 22 bp, Homo sapiens
aagaaacaaccactgctctcct

SEQ ID NO: 7985847 - DNA, 22 bp, Homo sapiens
aagaaacaaccactgctctcct

SEQ ID NO: 7985848 - DNA, 22 bp, Homo sapiens
aagaaacaaccactgctctcct

SEQ ID NO: 7985849 - DNA, 22 bp, Homo sapiens
aagaaacaaccactgctctcct

SEQ ID NO: 7985850 - DNA, 22 bp, Homo sapiens
aagaaacaaccactgctctcct

SEQ ID NO: 7985851 - DNA, 22 bp, Homo sapiens
aagaaaatcagttctggtcagt

SEQ ID NO: 7985852 - DNA, 22 bp, Homo sapiens
aagaaacaaccactgctctcct

SEQ ID NO: 7985853 - DNA, 22 bp, Homo sapiens
aagaaaatcagttctggtcagt

SEQ ID NO: 7985854 - DNA, 22 bp, Homo sapiens
aagaaaatcagttctggtcagt

SEQ ID NO: 7985855 - DNA, 22 bp, Homo sapiens
aagaaacctagtctggagcagc

SEQ ID NO: 7985856 - DNA, 22 bp, Homo sapiens
aagaaactgaaagtggcttcat

SEQ ID NO: 7985857 - DNA, 22 bp, Homo sapiens
aagaaactggaatatagagagc

SEQ ID NO: 7985858 - DNA, 22 bp, Homo sapiens
aagaaactggaatatagagagc

SEQ ID NO: 7985859 - DNA, 22 bp, Homo sapiens
aagaaactggaatatagagagc

SEQ ID NO: 7985860 - DNA, 22 bp, Homo sapiens
aagaaactgttgcgtgacagcg

SEQ ID NO: 7985861 - DNA, 20 bp, Homo sapiens
aagaaacttgaaagtacaag

SEQ ID NO: 7985862 - DNA, 22 bp, Homo sapiens
aatttgttacacagcaatataa

SEQ ID NO: 7985863 - DNA, 22 bp, Homo sapiens
aatttgttacacagcaatataa

SEQ ID NO: 7985864 - DNA, 22 bp, Homo sapiens
aatttccagaccccatccacag

SEQ ID NO: 7985865 - DNA, 22 bp, Homo sapiens
aattttaagcatatgactggtt

SEQ ID NO: 7985866 - DNA, 22 bp, Homo sapiens
aattttaagcatatgactggtt

SEQ ID NO: 7985867 - DNA, 22 bp, Homo sapiens
aatttgttttcaagtcactgga

SEQ ID NO: 7985868 - DNA, 22 bp, Homo sapiens
aatttgttagcatactctagtt

SEQ ID NO: 7985869 - DNA, 22 bp, Homo sapiens
aatttgttttcaagtcactgga

SEQ ID NO: 7985870 - DNA, 22 bp, Homo sapiens
aatttgttagcatactctagtt

SEQ ID NO: 7985871 - DNA, 22 bp, Homo sapiens
aatttgttataacttgggctga

SEQ ID NO: 7985872 - DNA, 22 bp, Homo sapiens
aattttaagcatatgactggtt

SEQ ID NO: 7985873 - DNA, 22 bp, Homo sapiens
aattttaatcagtggtgctgag

SEQ ID NO: 7985874 - DNA, 22 bp, Homo sapiens
aattttaagcatatgactggtt

SEQ ID NO: 7985875 - DNA, 22 bp, Homo sapiens
aattttaagcatatgactggtt

SEQ ID NO: 7985876 - DNA, 22 bp, Homo sapiens
aattttaatcagtggtgctgag

SEQ ID NO: 7985877 - DNA, 22 bp, Homo sapiens
aattttaatcagtggtgctgag

SEQ ID NO: 7985878 - DNA, 22 bp, Homo sapiens
aattttaatcagtggtgctgag

SEQ ID NO: 7985879 - DNA, 22 bp, Homo sapiens
aattttaatcagtggtgctgag

SEQ ID NO: 7985880 - DNA, 22 bp, Homo sapiens
aattttacaaaatacctccgat

SEQ ID NO: 7985881 - DNA, 22 bp, Homo sapiens
aattttacaagaaggcctcgta

SEQ ID NO: 7985882 - DNA, 22 bp, Homo sapiens
aattttactaatctgagtgtga

SEQ ID NO: 7985883 - DNA, 22 bp, Homo sapiens
aattttacataggggatatggg

SEQ ID NO: 7985884 - DNA, 20 bp, Homo sapiens
aattttactgtcctatagag

SEQ ID NO: 7985885 - DNA, 22 bp, Homo sapiens
aatttcagatgtcataaatata

SEQ ID NO: 7985886 - DNA, 22 bp, Homo sapiens
aatttcagatgtcataaatata

SEQ ID NO: 7985887 - DNA, 22 bp, Homo sapiens
aatttcagatgtcataaatata

SEQ ID NO: 7985888 - DNA, 22 bp, Homo sapiens
aatttcagcaacgggagcctag

SEQ ID NO: 7985889 - DNA, 22 bp, Homo sapiens
aatttcagggtgaatggactga

SEQ ID NO: 7985890 - DNA, 22 bp, Homo sapiens
aatttcagttgctaataagttc

SEQ ID NO: 7985891 - DNA, 22 bp, Homo sapiens
aatttcagttgctaataagttc

SEQ ID NO: 7985892 - DNA, 22 bp, Homo sapiens
aatttcagtatgaagtttcaca

SEQ ID NO: 7985893 - DNA, 22 bp, Homo sapiens
aatttcagtatgaagtttcaca

SEQ ID NO: 7985894 - DNA, 22 bp, Homo sapiens
aatttcagttgctaataagttc

SEQ ID NO: 7985895 - DNA, 22 bp, Homo sapiens
aatttcagatattaaagaatga

SEQ ID NO: 7985896 - DNA, 22 bp, Homo sapiens
aatttcagatattaaagaatga

SEQ ID NO: 7985897 - DNA, 22 bp, Homo sapiens
aatttcagatgtcataaatata

SEQ ID NO: 7985898 - DNA, 22 bp, Homo sapiens
aatttcagatattaaagaatga

SEQ ID NO: 7985899 - DNA, 21 bp, Homo sapiens
aatttcagacccattttgcct

SEQ ID NO: 7985900 - DNA, 22 bp, Homo sapiens
aatttcagaggtagagattcta

SEQ ID NO: 7985901 - DNA, 22 bp, Homo sapiens
aatttcagatattaaagaatga

SEQ ID NO: 7985902 - DNA, 21 bp, Homo sapiens
aatttcagacccattttgcct

SEQ ID NO: 7985903 - DNA, 21 bp, Homo sapiens
aatttcagacccattttgcct

SEQ ID NO: 7985904 - DNA, 22 bp, Homo sapiens
aatttcagaacccaaattagcg

SEQ ID NO: 7985905 - DNA, 22 bp, Homo sapiens
aatttcagaacccaaattagcg

SEQ ID NO: 7985906 - DNA, 22 bp, Homo sapiens
aatttcagaacccaaattagcg

SEQ ID NO: 7985907 - DNA, 22 bp, Homo sapiens
aagacttgaccaggttgaaggc

SEQ ID NO: 7985908 - DNA, 22 bp, Homo sapiens
aagacttgaccaggttgaaggc

SEQ ID NO: 7985909 - DNA, 22 bp, Homo sapiens
aagacttgaccaggttgaaggc

SEQ ID NO: 7985910 - DNA, 22 bp, Homo sapiens
aagaccattgctgtatttgtag

SEQ ID NO: 7985911 - DNA, 22 bp, Homo sapiens
aagaccatcacagagacacttg

SEQ ID NO: 7985912 - DNA, 22 bp, Homo sapiens
aagaccatcacagagacacttg

SEQ ID NO: 7985913 - DNA, 22 bp, Homo sapiens
aagacttgaccaggttgaaggc

SEQ ID NO: 7985914 - DNA, 22 bp, Homo sapiens
aagacttatagtcagtaattct

SEQ ID NO: 7985915 - DNA, 22 bp, Homo sapiens
aagactttcaaacctatgtttg

SEQ ID NO: 7985916 - DNA, 22 bp, Homo sapiens
aagactttcaagtatgcatgca

SEQ ID NO: 7985917 - DNA, 22 bp, Homo sapiens
aattttatctctaagcaggctt

SEQ ID NO: 7985918 - DNA, 22 bp, Homo sapiens
aattttatctctaagcaggctt

SEQ ID NO: 7985919 - DNA, 22 bp, Homo sapiens
aagaccataatgtaagatgaat

SEQ ID NO: 7985920 - DNA, 22 bp, Homo sapiens
aattttatctctaagcaggctt

SEQ ID NO: 7985921 - DNA, 20 bp, Homo sapiens
aattttatctccatcctttg

SEQ ID NO: 7985922 - DNA, 20 bp, Homo sapiens
aattttatctccatcctttg

SEQ ID NO: 7985923 - DNA, 20 bp, Homo sapiens
aattttatctccatcctttg

SEQ ID NO: 7985924 - DNA, 20 bp, Homo sapiens
aattttatctccatcctttg

SEQ ID NO: 7985925 - DNA, 20 bp, Homo sapiens
aattttatctccatcctttg

SEQ ID NO: 7985926 - DNA, 22 bp, Homo sapiens
aattttacttccctcagtgtag

SEQ ID NO: 7985927 - DNA, 22 bp, Homo sapiens
aattttacttccctcagtgtag

SEQ ID NO: 7985928 - DNA, 22 bp, Homo sapiens
aagactttctgtaaagctacag

SEQ ID NO: 7985929 - DNA, 22 bp, Homo sapiens
aagactttctgtaaagctacag

SEQ ID NO: 7985930 - DNA, 22 bp, Homo sapiens
aagactttctgtaaagctacag

SEQ ID NO: 7985931 - DNA, 22 bp, Homo sapiens
aagagaaagcagactttgtcat

SEQ ID NO: 7985932 - DNA, 22 bp, Homo sapiens
aagagaaagcagactttgtcat

SEQ ID NO: 7985933 - DNA, 22 bp, Homo sapiens
aagactttctggggtgtaaagg

SEQ ID NO: 7985934 - DNA, 22 bp, Homo sapiens
aagactttctggggtgtaaagg

SEQ ID NO: 7985935 - DNA, 22 bp, Homo sapiens
aagagaaagcagactttgtcat

SEQ ID NO: 7985936 - DNA, 22 bp, Homo sapiens
aagagaaagcagactttgtcat

SEQ ID NO: 7985937 - DNA, 22 bp, Homo sapiens
aagagaaagcagactttgtcat

SEQ ID NO: 7985938 - DNA, 22 bp, Homo sapiens
aagagaaagcagactttgtcat

SEQ ID NO: 7985939 - DNA, 22 bp, Homo sapiens
aagagaacagtcaccatgcaca

SEQ ID NO: 7985940 - DNA, 22 bp, Homo sapiens
aagagaagaaagtgtctacaca

SEQ ID NO: 7985941 - DNA, 22 bp, Homo sapiens
aagagaagaaagtgtctacaca

SEQ ID NO: 7985942 - DNA, 22 bp, Homo sapiens
aagagaacagtcaccatgcaca

SEQ ID NO: 7985943 - DNA, 22 bp, Homo sapiens
aagagaacagtcaccatgcaca

SEQ ID NO: 7985944 - DNA, 22 bp, Homo sapiens
aagagaacagtcaccatgcaca

SEQ ID NO: 7985945 - DNA, 22 bp, Homo sapiens
aagagaaggattctgagcctgg

SEQ ID NO: 7985946 - DNA, 22 bp, Homo sapiens
aagagaaggattctgagcctgg

SEQ ID NO: 7985947 - DNA, 22 bp, Homo sapiens
aagagaaggattctgagcctgg

SEQ ID NO: 7985948 - DNA, 22 bp, Homo sapiens
aagagaaggattctgagcctgg

SEQ ID NO: 7985949 - DNA, 20 bp, Homo sapiens
aagagaagaagtctttgaaa

SEQ ID NO: 7985950 - DNA, 20 bp, Homo sapiens
aagagaagaagtctttgaaa

SEQ ID NO: 7985951 - DNA, 20 bp, Homo sapiens
aagagaagaagtctttgaaa

SEQ ID NO: 7985952 - DNA, 20 bp, Homo sapiens
aagagaagaagtctttgaaa

SEQ ID NO: 7985953 - DNA, 22 bp, Homo sapiens
aagagaagaaagtgtctacaca

SEQ ID NO: 7985954 - DNA, 22 bp, Homo sapiens
aagagaagaaagtgtctacaca

SEQ ID NO: 7985955 - DNA, 22 bp, Homo sapiens
aagagaagaaagtgtctacaca

SEQ ID NO: 7985956 - DNA, 22 bp, Homo sapiens
aagagaagaaagtgtctacaca

SEQ ID NO: 7985957 - DNA, 22 bp, Homo sapiens
aagagaagaaagtgtctacaca

SEQ ID NO: 7985958 - DNA, 22 bp, Homo sapiens
aagagaagaaagtgtctacaca

SEQ ID NO: 7985959 - DNA, 22 bp, Homo sapiens
aagagaagaaagtgtctacaca

SEQ ID NO: 7985960 - DNA, 22 bp, Homo sapiens
aagagaagaaagtgtctacaca

SEQ ID NO: 7985961 - DNA, 22 bp, Homo sapiens
aagagaagaaagtgtctacaca

SEQ ID NO: 7985962 - DNA, 20 bp, Homo sapiens
aagagaagaagtctttgaaa

SEQ ID NO: 7985963 - DNA, 22 bp, Homo sapiens
aagagaatatcgatagcactct

SEQ ID NO: 7985964 - DNA, 22 bp, Homo sapiens
aagagaatgacaaggagaacct

SEQ ID NO: 7985965 - DNA, 22 bp, Homo sapiens
aagagaatacaagcaggcagga

SEQ ID NO: 7985966 - DNA, 22 bp, Homo sapiens
aagagaatacaagcaggcagga

SEQ ID NO: 7985967 - DNA, 22 bp, Homo sapiens
aagagaatacaagcaggcagga

SEQ ID NO: 7985968 - DNA, 22 bp, Homo sapiens
aagagaatatcgatagcactct

SEQ ID NO: 7985969 - DNA, 22 bp, Homo sapiens
aagagaatacaagcaggcagga

SEQ ID NO: 7985970 - DNA, 22 bp, Homo sapiens
aagagaatacaagcaggcagga

SEQ ID NO: 7985971 - DNA, 22 bp, Homo sapiens
aagagaaggtgaggaagccggt

SEQ ID NO: 7985972 - DNA, 22 bp, Homo sapiens
aagagaaggattctgagcctgg

SEQ ID NO: 7985973 - DNA, 22 bp, Homo sapiens
aagagaaggtgaggaagccggt

SEQ ID NO: 7985974 - DNA, 22 bp, Homo sapiens
aagagaaggccctgacccaccc

SEQ ID NO: 7985975 - DNA, 22 bp, Homo sapiens
aagagaaggtgaggaagccggt

SEQ ID NO: 7985976 - DNA, 22 bp, Homo sapiens
aagagaaggccctgacccaccc

SEQ ID NO: 7985977 - DNA, 22 bp, Homo sapiens
aagagaaggccctgacccaccc

SEQ ID NO: 7985978 - DNA, 22 bp, Homo sapiens
aagagaaggccctgacccaccc

SEQ ID NO: 7985979 - DNA, 22 bp, Homo sapiens
aagagaaggccctgacccaccc

SEQ ID NO: 7985980 - DNA, 22 bp, Homo sapiens
aagagaaggccctgacccaccc

SEQ ID NO: 7985981 - DNA, 22 bp, Homo sapiens
aagagaaggccctgacccaccc

SEQ ID NO: 7985982 - DNA, 22 bp, Homo sapiens
aagagacaatgtcttttggata

SEQ ID NO: 7985983 - DNA, 22 bp, Homo sapiens
aagagacagagccatgtttcta

SEQ ID NO: 7985984 - DNA, 22 bp, Homo sapiens
aagagacatgaatactcgaagg

SEQ ID NO: 7985985 - DNA, 22 bp, Homo sapiens
aagagaattctggttttcctat

SEQ ID NO: 7985986 - DNA, 22 bp, Homo sapiens
aagagaatgacaaggagaacct

SEQ ID NO: 7985987 - DNA, 22 bp, Homo sapiens
aagagaatgacaaggagaacct

SEQ ID NO: 7985988 - DNA, 22 bp, Homo sapiens
aagagaatgacaaggagaacct

SEQ ID NO: 7985989 - DNA, 22 bp, Homo sapiens
aagagaatatcgatagcactct

SEQ ID NO: 7985990 - DNA, 22 bp, Homo sapiens
aagagaattctggttttcctat

SEQ ID NO: 7985991 - DNA, 22 bp, Homo sapiens
aagagacaagaattccaacgct

SEQ ID NO: 7985992 - DNA, 22 bp, Homo sapiens
acaatgttctgtctgacttgtc

SEQ ID NO: 7985993 - DNA, 22 bp, Homo sapiens
aagagactttgcagtgtcccta

SEQ ID NO: 7985994 - DNA, 22 bp, Homo sapiens
aagagacttctagatttgttga

SEQ ID NO: 7985995 - DNA, 22 bp, Homo sapiens
aagagacttgtccgaagttgta

SEQ ID NO: 7985996 - DNA, 22 bp, Homo sapiens
acaatgtttctctttagtcatt

SEQ ID NO: 7985997 - DNA, 22 bp, Homo sapiens
acaatgttttgaaacatctagg

SEQ ID NO: 7985998 - DNA, 22 bp, Homo sapiens
acacaaaatcaaagtcctaggc

SEQ ID NO: 7985999 - DNA, 22 bp, Homo sapiens
acacaaaatcaaagtcctaggc

SEQ ID NO: 7986000 - DNA, 22 bp, Homo sapiens
acaatgtttctctttagtcatt

SEQ ID NO: 7986001 - DNA, 22 bp, Homo sapiens
acacaaaatcaaagtcctaggc

SEQ ID NO: 7986002 - DNA, 22 bp, Homo sapiens
acaatgttttgaaacatctagg

SEQ ID NO: 7986003 - DNA, 22 bp, Homo sapiens
acacaaaatcaaagtcctaggc

SEQ ID NO: 7986004 - DNA, 22 bp, Homo sapiens
acacaaaatcaaagtcctaggc

SEQ ID NO: 7986005 - DNA, 22 bp, Homo sapiens
aagagactggaaactagggtca

SEQ ID NO: 7986006 - DNA, 22 bp, Homo sapiens
aagagactatggtgtctatgaa

SEQ ID NO: 7986007 - DNA, 22 bp, Homo sapiens
aagagactaagaaagggcaata

SEQ ID NO: 7986008 - DNA, 22 bp, Homo sapiens
aagagacatgaatactcgaagg

SEQ ID NO: 7986009 - DNA, 21 bp, Homo sapiens
aagagacatttctcatcagca

SEQ ID NO: 7986010 - DNA, 21 bp, Homo sapiens
aagagacatttctcatcagca

SEQ ID NO: 7986011 - DNA, 21 bp, Homo sapiens
aagagacatttctcatcagca

SEQ ID NO: 7986012 - DNA, 21 bp, Homo sapiens
aagagacatttctcatcagca

SEQ ID NO: 7986013 - DNA, 22 bp, Homo sapiens
acacaaagttggatgacaaaat

SEQ ID NO: 7986014 - DNA, 22 bp, Homo sapiens
acacaaagttggatgacaaaat

SEQ ID NO: 7986015 - DNA, 22 bp, Homo sapiens
acacaaagttggatgacaaaat

SEQ ID NO: 7986016 - DNA, 22 bp, Homo sapiens
acacaaagttggatgacaaaat

SEQ ID NO: 7986017 - DNA, 22 bp, Homo sapiens
acacaaagttggatgacaaaat

SEQ ID NO: 7986018 - DNA, 22 bp, Homo sapiens
acacaaagttggatgacaaaat

SEQ ID NO: 7986019 - DNA, 20 bp, Homo sapiens
acacaaagcaatggagtaca

SEQ ID NO: 7986020 - DNA, 22 bp, Homo sapiens
acacaaactgctagaaaattgg

SEQ ID NO: 7986021 - DNA, 22 bp, Homo sapiens
acacaaactgctagaaaattgg

SEQ ID NO: 7986022 - DNA, 22 bp, Homo sapiens
acacaaactgctagaaaattgg

SEQ ID NO: 7986023 - DNA, 22 bp, Homo sapiens
acacaaactgctagaaaattgg

SEQ ID NO: 7986024 - DNA, 22 bp, Homo sapiens
acacaaacagtctatagcacca

SEQ ID NO: 7986025 - DNA, 22 bp, Homo sapiens
acacaaacagtctatagcacca

SEQ ID NO: 7986026 - DNA, 22 bp, Homo sapiens
acacaaacagtctatagcacca

SEQ ID NO: 7986027 - DNA, 22 bp, Homo sapiens
acacaaacagtctatagcacca

SEQ ID NO: 7986028 - DNA, 22 bp, Homo sapiens
acacaaaatcaaagtcctaggc

SEQ ID NO: 7986029 - DNA, 21 bp, Homo sapiens
acacaaacctcctcagcctgg

SEQ ID NO: 7986030 - DNA, 22 bp, Homo sapiens
acacaaactgctagaaaattgg

SEQ ID NO: 7986031 - DNA, 21 bp, Homo sapiens
acacaaacctcctcagcctgg

SEQ ID NO: 7986032 - DNA, 22 bp, Homo sapiens
acacaaacagtctatagcacca

SEQ ID NO: 7986033 - DNA, 22 bp, Homo sapiens
acacaaacagtctatagcacca

SEQ ID NO: 7986034 - DNA, 22 bp, Homo sapiens
aagagcacttttcttatctgca

SEQ ID NO: 7986035 - DNA, 22 bp, Homo sapiens
aagagcacttttcttatctgca

SEQ ID NO: 7986036 - DNA, 22 bp, Homo sapiens
aagagcactaacagagctgata

SEQ ID NO: 7986037 - DNA, 22 bp, Homo sapiens
aagagcactaacagagctgata

SEQ ID NO: 7986038 - DNA, 22 bp, Homo sapiens
aagagcaccgcagcagcccaac

SEQ ID NO: 7986039 - DNA, 22 bp, Homo sapiens
aagagcaccttaattatgcaga

SEQ ID NO: 7986040 - DNA, 22 bp, Homo sapiens
aagagcaccttaattatgcaga

SEQ ID NO: 7986041 - DNA, 22 bp, Homo sapiens
aagagcagattcctagtggagc

SEQ ID NO: 7986042 - DNA, 22 bp, Homo sapiens
aagagcagcctccaggggtgga

SEQ ID NO: 7986043 - DNA, 22 bp, Homo sapiens
aagagcagcctccaggggtgga

SEQ ID NO: 7986044 - DNA, 22 bp, Homo sapiens
aagagcagcctccaggggtgga

SEQ ID NO: 7986045 - DNA, 22 bp, Homo sapiens
acacaaattgtaggataattgc

SEQ ID NO: 7986046 - DNA, 22 bp, Homo sapiens
aagagatttctgtaaaatgtaa

SEQ ID NO: 7986047 - DNA, 22 bp, Homo sapiens
aagagcaacttggaaacactca

SEQ ID NO: 7986048 - DNA, 22 bp, Homo sapiens
aagagcaacttggaaacactca

SEQ ID NO: 7986049 - DNA, 22 bp, Homo sapiens
aagagcaacttggaaacactca

SEQ ID NO: 7986050 - DNA, 22 bp, Homo sapiens
aagagcaacttggaaacactca

SEQ ID NO: 7986051 - DNA, 22 bp, Homo sapiens
aagagcaagtgggtagtgaagc

SEQ ID NO: 7986052 - DNA, 22 bp, Homo sapiens
aagagcaagtgggtagtgaagc

SEQ ID NO: 7986053 - DNA, 22 bp, Homo sapiens
aagagcaagtgggtagtgaagc

SEQ ID NO: 7986054 - DNA, 22 bp, Homo sapiens
aagagcaagtgggtagtgaagc

SEQ ID NO: 7986055 - DNA, 22 bp, Homo sapiens
aagagcaacttggaaacactca

SEQ ID NO: 7986056 - DNA, 22 bp, Homo sapiens
aagagcaacttggaaacactca

SEQ ID NO: 7986057 - DNA, 23 bp, Homo sapiens
aagatgtatttttaccaaatgtc

SEQ ID NO: 7986058 - DNA, 22 bp, Homo sapiens
aagatgtgaaattgtctctggg

SEQ ID NO: 7986059 - DNA, 22 bp, Homo sapiens
aagatgtgcagttcatggcagg

SEQ ID NO: 7986060 - DNA, 22 bp, Homo sapiens
aagatgtgaacagaaccacagg

SEQ ID NO: 7986061 - DNA, 22 bp, Homo sapiens
aagatgtgatgggttaagggcc

SEQ ID NO: 7986062 - DNA, 22 bp, Homo sapiens
aagatgtaaaggcaatataaag

SEQ ID NO: 7986063 - DNA, 22 bp, Homo sapiens
aagatgtatcagttaagtcttc

SEQ ID NO: 7986064 - DNA, 21 bp, Homo sapiens
aagatggttatgtgctaaaga

SEQ ID NO: 7986065 - DNA, 22 bp, Homo sapiens
aagatggtgtggtcaaggacca

SEQ ID NO: 7986066 - DNA, 22 bp, Homo sapiens
aagatggtcttgagatattata

SEQ ID NO: 7986067 - DNA, 22 bp, Homo sapiens
aagatggctgcagcaattccaa

SEQ ID NO: 7986068 - DNA, 22 bp, Homo sapiens
aagatggctgcagcaattccaa

SEQ ID NO: 7986069 - DNA, 22 bp, Homo sapiens
aagatggtaaggcagctggcag

SEQ ID NO: 7986070 - DNA, 22 bp, Homo sapiens
aagatggcttagagtcctggtg

SEQ ID NO: 7986071 - DNA, 22 bp, Homo sapiens
aagatgcttgagaactgtttga

SEQ ID NO: 7986072 - DNA, 22 bp, Homo sapiens
aagatggagcacgagcagaagc

SEQ ID NO: 7986073 - DNA, 22 bp, Homo sapiens
aagatgctggcaggaatagcta

SEQ ID NO: 7986074 - DNA, 22 bp, Homo sapiens
aagatgctggcaggaatagcta

SEQ ID NO: 7986075 - DNA, 21 bp, Homo sapiens
aagatgatattttatctgtag

SEQ ID NO: 7986076 - DNA, 22 bp, Homo sapiens
aagatgataggacttgcttaag

SEQ ID NO: 7986077 - DNA, 21 bp, Homo sapiens
aagatgatattttatctgtag

SEQ ID NO: 7986078 - DNA, 22 bp, Homo sapiens
aagatgataggacttgcttaag

SEQ ID NO: 7986079 - DNA, 22 bp, Homo sapiens
aagatgataggacttgcttaag

SEQ ID NO: 7986080 - DNA, 22 bp, Homo sapiens
aagatgatgcagactttgatgt

SEQ ID NO: 7986081 - DNA, 22 bp, Homo sapiens
aagatgatgttgtgttttcact

SEQ ID NO: 7986082 - DNA, 22 bp, Homo sapiens
aagatgatgttgtgttttcact

SEQ ID NO: 7986083 - DNA, 22 bp, Homo sapiens
aagatgatgttgtgttttcact

SEQ ID NO: 7986084 - DNA, 22 bp, Homo sapiens
aagatgatggtatatagggtat

SEQ ID NO: 7986085 - DNA, 22 bp, Homo sapiens
aagatgatagatctgtcaatgt

SEQ ID NO: 7986086 - DNA, 22 bp, Homo sapiens
aagatgactatttatctgtaag

SEQ ID NO: 7986087 - DNA, 22 bp, Homo sapiens
aagatgactatttatctgtaag

SEQ ID NO: 7986088 - DNA, 22 bp, Homo sapiens
aagatgaatcagtatgtgtcct

SEQ ID NO: 7986089 - DNA, 22 bp, Homo sapiens
aagatgacagatgcttagagtc

SEQ ID NO: 7986090 - DNA, 22 bp, Homo sapiens
aagatgaccctgagggcaattg

SEQ ID NO: 7986091 - DNA, 22 bp, Homo sapiens
aagatgaccctgagggcaattg

SEQ ID NO: 7986092 - DNA, 22 bp, Homo sapiens
aagatgcatgctgaagctggct

SEQ ID NO: 7986093 - DNA, 22 bp, Homo sapiens
aagatgcatgctgaagctggct

SEQ ID NO: 7986094 - DNA, 22 bp, Homo sapiens
aagatgcggttgaccatggtgt

SEQ ID NO: 7986095 - DNA, 22 bp, Homo sapiens
aagatgcatgctgaagctggct

SEQ ID NO: 7986096 - DNA, 22 bp, Homo sapiens
aagatgcagcaaactacttttt

SEQ ID NO: 7986097 - DNA, 22 bp, Homo sapiens
aagatgcagcttccacttttgc

SEQ ID NO: 7986098 - DNA, 22 bp, Homo sapiens
aagatgcacaatgtggcaatta

SEQ ID NO: 7986099 - DNA, 22 bp, Homo sapiens
aagatgcacaatgtggcaatta

SEQ ID NO: 7986100 - DNA, 22 bp, Homo sapiens
aagatgcacaatgtggcaatta

SEQ ID NO: 7986101 - DNA, 22 bp, Homo sapiens
aagatgcagcaaactacttttt

SEQ ID NO: 7986102 - DNA, 22 bp, Homo sapiens
aagcaataatcccaaagtgctg

SEQ ID NO: 7986103 - DNA, 22 bp, Homo sapiens
aagcaatagcaacaactttaca

SEQ ID NO: 7986104 - DNA, 22 bp, Homo sapiens
aagcaatacaagtggtcattga

SEQ ID NO: 7986105 - DNA, 22 bp, Homo sapiens
aagcaataagccagatttggat

SEQ ID NO: 7986106 - DNA, 22 bp, Homo sapiens
aagcaataaataatttttagta

SEQ ID NO: 7986107 - DNA, 22 bp, Homo sapiens
aagcaagttctcatcatttata

SEQ ID NO: 7986108 - DNA, 22 bp, Homo sapiens
aagcaagtaggtatttgacaaa

SEQ ID NO: 7986109 - DNA, 22 bp, Homo sapiens
aagcaagtacaatagcaagtac

SEQ ID NO: 7986110 - DNA, 22 bp, Homo sapiens
aagcaagtacaatagcaagtac

SEQ ID NO: 7986111 - DNA, 22 bp, Homo sapiens
aagcaagagttggagtgatgtt

SEQ ID NO: 7986112 - DNA, 22 bp, Homo sapiens
aagcaagcagtgtggaatttta

SEQ ID NO: 7986113 - DNA, 22 bp, Homo sapiens
aagcaagcaaggtgttacatat

SEQ ID NO: 7986114 - DNA, 22 bp, Homo sapiens
aagcaagcccaggctcagtcaa

SEQ ID NO: 7986115 - DNA, 22 bp, Homo sapiens
aagcaagctgttggcaataggg

SEQ ID NO: 7986116 - DNA, 22 bp, Homo sapiens
aagcaagccaatctgttttgtt

SEQ ID NO: 7986117 - DNA, 19 bp, Homo sapiens
aagcaagctttgagtgggt

SEQ ID NO: 7986118 - DNA, 22 bp, Homo sapiens
aagcaaggcaacctatgtccag

SEQ ID NO: 7986119 - DNA, 22 bp, Homo sapiens
aagcaaggcaacctatgtccag

SEQ ID NO: 7986120 - DNA, 22 bp, Homo sapiens
aagcaaggcccagagcatcagc

SEQ ID NO: 7986121 - DNA, 22 bp, Homo sapiens
aagcaaggcccagagcatcagc

SEQ ID NO: 7986122 - DNA, 22 bp, Homo sapiens
aagcaaggcccagagcatcagc

SEQ ID NO: 7986123 - DNA, 22 bp, Homo sapiens
aagcaaggccggaaggaaactc

SEQ ID NO: 7986124 - DNA, 22 bp, Homo sapiens
aagcaaagagataaccttttgg

SEQ ID NO: 7986125 - DNA, 22 bp, Homo sapiens
aagcaaagagataaccttttgg

SEQ ID NO: 7986126 - DNA, 22 bp, Homo sapiens
aagcaagacagaagttactgcc

SEQ ID NO: 7986127 - DNA, 22 bp, Homo sapiens
aagatgttaggaaagttagggt

SEQ ID NO: 7986128 - DNA, 22 bp, Homo sapiens
aagatgttagggtggaagggat

SEQ ID NO: 7986129 - DNA, 22 bp, Homo sapiens
aagcaaagacagtttgagtgga

SEQ ID NO: 7986130 - DNA, 22 bp, Homo sapiens
aagcaagagttggagtgatgtt

SEQ ID NO: 7986131 - DNA, 22 bp, Homo sapiens
aagcaagagttggagtgatgtt

SEQ ID NO: 7986132 - DNA, 22 bp, Homo sapiens
aagcaagagttggagtgatgtt

SEQ ID NO: 7986133 - DNA, 22 bp, Homo sapiens
aagcaagaggaaatgtggacct

SEQ ID NO: 7986134 - DNA, 22 bp, Homo sapiens
aagcaagacagaagttactgcc

SEQ ID NO: 7986135 - DNA, 22 bp, Homo sapiens
aagcaagaggaaatgtggacct

SEQ ID NO: 7986136 - DNA, 22 bp, Homo sapiens
aagatgtgctgtcttgccactc

SEQ ID NO: 7986137 - DNA, 22 bp, Homo sapiens
aagatgtgtcaccccatgactg

SEQ ID NO: 7986138 - DNA, 22 bp, Homo sapiens
aagatgtgctatcaactggaga

SEQ ID NO: 7986139 - DNA, 22 bp, Homo sapiens
aagatgttaaatctgtagaatt

SEQ ID NO: 7986140 - DNA, 22 bp, Homo sapiens
aagatgttaaattgggggcatt

SEQ ID NO: 7986141 - DNA, 22 bp, Homo sapiens
aagatgttaaatctgtagaatt

SEQ ID NO: 7986142 - DNA, 22 bp, Homo sapiens
aagatgttactcaaccaggata

SEQ ID NO: 7986143 - DNA, 22 bp, Homo sapiens
aagatgttagaggtcatgcaga

SEQ ID NO: 7986144 - DNA, 22 bp, Homo sapiens
aagatgttagattatggggaca

SEQ ID NO: 7986145 - DNA, 22 bp, Homo sapiens
aagatgttagaggtcatgcaga

SEQ ID NO: 7986146 - DNA, 22 bp, Homo sapiens
aagatgaatcagtatgtgtcct

SEQ ID NO: 7986147 - DNA, 22 bp, Homo sapiens
aagatgaatcagtatgtgtcct

SEQ ID NO: 7986148 - DNA, 22 bp, Homo sapiens
aagatgaaaatttactgtgatg

SEQ ID NO: 7986149 - DNA, 22 bp, Homo sapiens
aagatgaaaatttactgtgatg

SEQ ID NO: 7986150 - DNA, 22 bp, Homo sapiens
aagatatagatggtggtataaa

SEQ ID NO: 7986151 - DNA, 22 bp, Homo sapiens
aagatatagatggtggtataaa

SEQ ID NO: 7986152 - DNA, 22 bp, Homo sapiens
aagatatagataaaactatgca

SEQ ID NO: 7986153 - DNA, 22 bp, Homo sapiens
aagatatagataaaactatgca

SEQ ID NO: 7986154 - DNA, 22 bp, Homo sapiens
acacatttatggatcgcagaaa

SEQ ID NO: 7986155 - DNA, 22 bp, Homo sapiens
acacatttattacatgcatgtg

SEQ ID NO: 7986156 - DNA, 22 bp, Homo sapiens
acacatttattacatgcatgtg

SEQ ID NO: 7986157 - DNA, 22 bp, Homo sapiens
acacatttagcaccaggtttat

SEQ ID NO: 7986158 - DNA, 22 bp, Homo sapiens
acacatttctaaatttttaccg

SEQ ID NO: 7986159 - DNA, 22 bp, Homo sapiens
acacatttctaaatttttaccg

SEQ ID NO: 7986160 - DNA, 22 bp, Homo sapiens
acacatttctaaatttttaccg

SEQ ID NO: 7986161 - DNA, 22 bp, Homo sapiens
acacatttattacatgcatgtg

SEQ ID NO: 7986162 - DNA, 22 bp, Homo sapiens
acacatttaaaaaggaacatat

SEQ ID NO: 7986163 - DNA, 22 bp, Homo sapiens
acacatttacatgtttacgtat

SEQ ID NO: 7986164 - DNA, 22 bp, Homo sapiens
acacatttacatgtttacgtat

SEQ ID NO: 7986165 - DNA, 22 bp, Homo sapiens
acacatttacatgtttacgtat

SEQ ID NO: 7986166 - DNA, 22 bp, Homo sapiens
acacatttagcaccaggtttat

SEQ ID NO: 7986167 - DNA, 22 bp, Homo sapiens
acacattctttaaatgtctgtt

SEQ ID NO: 7986168 - DNA, 22 bp, Homo sapiens
acacattctttaaatgtctgtt

SEQ ID NO: 7986169 - DNA, 19 bp, Homo sapiens
acacatgctcctggagcct

SEQ ID NO: 7986170 - DNA, 22 bp, Homo sapiens
acacattatctcattaaatact

SEQ ID NO: 7986171 - DNA, 21 bp, Homo sapiens
acacattatgagcatagactc

SEQ ID NO: 7986172 - DNA, 21 bp, Homo sapiens
acacattatgagcatagactc

SEQ ID NO: 7986173 - DNA, 22 bp, Homo sapiens
acacattcctgcagacatgatg

SEQ ID NO: 7986174 - DNA, 22 bp, Homo sapiens
acacatgagaaacatcagttgt

SEQ ID NO: 7986175 - DNA, 22 bp, Homo sapiens
acacatgacctccgcagcagca

SEQ ID NO: 7986176 - DNA, 22 bp, Homo sapiens
acacatgagaaacatcagttgt

SEQ ID NO: 7986177 - DNA, 19 bp, Homo sapiens
acacatgaggagggacccc

SEQ ID NO: 7986178 - DNA, 22 bp, Homo sapiens
acacatgaggatgaggggatca

SEQ ID NO: 7986179 - DNA, 22 bp, Homo sapiens
acacatgagttctcatcttgtg

SEQ ID NO: 7986180 - DNA, 19 bp, Homo sapiens
acacatgaggagggacccc

SEQ ID NO: 7986181 - DNA, 22 bp, Homo sapiens
acacatgaggaaggcctcaccc

SEQ ID NO: 7986182 - DNA, 22 bp, Homo sapiens
acacatgagttctcatcttgtg

SEQ ID NO: 7986183 - DNA, 22 bp, Homo sapiens
acacatgataagaaagtttaaa

SEQ ID NO: 7986184 - DNA, 22 bp, Homo sapiens
acacatgataagaaagtttaaa

SEQ ID NO: 7986185 - DNA, 22 bp, Homo sapiens
acacatgattaatgccaagcat

SEQ ID NO: 7986186 - DNA, 22 bp, Homo sapiens
acacatgcaggtatacatgttc

SEQ ID NO: 7986187 - DNA, 22 bp, Homo sapiens
acacatgcaggtatacatgttc

SEQ ID NO: 7986188 - DNA, 22 bp, Homo sapiens
acacatgctccagtctccagga

SEQ ID NO: 7986189 - DNA, 20 bp, Homo sapiens
acacatgcattcatgtgggc

SEQ ID NO: 7986190 - DNA, 22 bp, Homo sapiens
acacatatatacatatttgtgc

SEQ ID NO: 7986191 - DNA, 22 bp, Homo sapiens
acacatatatacatatttgtgc

SEQ ID NO: 7986192 - DNA, 22 bp, Homo sapiens
acacatatatacatatttgtgc

SEQ ID NO: 7986193 - DNA, 22 bp, Homo sapiens
acacatatatgtcgaagtcctc

SEQ ID NO: 7986194 - DNA, 22 bp, Homo sapiens
acacatcttagactgaaatatg

SEQ ID NO: 7986195 - DNA, 22 bp, Homo sapiens
acacatcttagactgaaatatg

SEQ ID NO: 7986196 - DNA, 17 bp, Homo sapiens
acacatcttggctttgc

SEQ ID NO: 7986197 - DNA, 17 bp, Homo sapiens
acacatcttggctttgc

SEQ ID NO: 7986198 - DNA, 22 bp, Homo sapiens
acacatgaaagacattaaggtg

SEQ ID NO: 7986199 - DNA, 17 bp, Homo sapiens
acacatcttggctttgc

SEQ ID NO: 7986200 - DNA, 17 bp, Homo sapiens
acacatcttggctttgc

SEQ ID NO: 7986201 - DNA, 22 bp, Homo sapiens
acacatgaaataatattatgca

SEQ ID NO: 7986202 - DNA, 22 bp, Homo sapiens
acacatgaaataatattatgca

SEQ ID NO: 7986203 - DNA, 22 bp, Homo sapiens
acacatgaatcactggtggaag

SEQ ID NO: 7986204 - DNA, 22 bp, Homo sapiens
aagagcaggctgctgtggagta

SEQ ID NO: 7986205 - DNA, 22 bp, Homo sapiens
aagagcaggctgctgtggagta

SEQ ID NO: 7986206 - DNA, 22 bp, Homo sapiens
aagagcaggctgctgtggagta

SEQ ID NO: 7986207 - DNA, 22 bp, Homo sapiens
aagagcaggacagaatcagaac

SEQ ID NO: 7986208 - DNA, 22 bp, Homo sapiens
aagagcaggacagaatcagaac

SEQ ID NO: 7986209 - DNA, 22 bp, Homo sapiens
aagagcaggctgtcaatggggc

SEQ ID NO: 7986210 - DNA, 19 bp, Homo sapiens
aagagcagggaaagaattg

SEQ ID NO: 7986211 - DNA, 19 bp, Homo sapiens
aagagcagggaaagaattg

SEQ ID NO: 7986212 - DNA, 22 bp, Homo sapiens
aagagcaggctgctgtggagta

SEQ ID NO: 7986213 - DNA, 22 bp, Homo sapiens
aagagcaggctgctgtggagta

SEQ ID NO: 7986214 - DNA, 22 bp, Homo sapiens
aagagcaggctgtcaatggggc

SEQ ID NO: 7986215 - DNA, 19 bp, Homo sapiens
aagcaatgttgtgaatcta

SEQ ID NO: 7986216 - DNA, 21 bp, Homo sapiens
aagcaattaccttcccatgtg

SEQ ID NO: 7986217 - DNA, 21 bp, Homo sapiens
aagcaattaccttcccatgtg

SEQ ID NO: 7986218 - DNA, 19 bp, Homo sapiens
aagcaatgttgtgaatcta

SEQ ID NO: 7986219 - DNA, 22 bp, Homo sapiens
aagcaatgttagaggccttagg

SEQ ID NO: 7986220 - DNA, 22 bp, Homo sapiens
aagcaatgttagaggccttagg

SEQ ID NO: 7986221 - DNA, 22 bp, Homo sapiens
aagcaatgtgtttgaaaggcca

SEQ ID NO: 7986222 - DNA, 22 bp, Homo sapiens
aagcaatgtgtttgaaaggcca

SEQ ID NO: 7986223 - DNA, 22 bp, Homo sapiens
aagcaatgtgtttgaaaggcca

SEQ ID NO: 7986224 - DNA, 22 bp, Homo sapiens
aagcaatgtgttaatgaatgag

SEQ ID NO: 7986225 - DNA, 22 bp, Homo sapiens
aagcaatgtgttaatgaatgag

SEQ ID NO: 7986226 - DNA, 22 bp, Homo sapiens
aagcaatgtgttaatgaatgag

SEQ ID NO: 7986227 - DNA, 23 bp, Homo sapiens
aagcaatgctgagccagttctga

SEQ ID NO: 7986228 - DNA, 23 bp, Homo sapiens
aagcaatgctgagccagttctga

SEQ ID NO: 7986229 - DNA, 22 bp, Homo sapiens
aagcaatgtgttaatgaatgag

SEQ ID NO: 7986230 - DNA, 22 bp, Homo sapiens
aagcaatatactgatatgatta

SEQ ID NO: 7986231 - DNA, 22 bp, Homo sapiens
aagcaatatactgatatgatta

SEQ ID NO: 7986232 - DNA, 20 bp, Homo sapiens
aagcaatatagtgcaaatgt

SEQ ID NO: 7986233 - DNA, 20 bp, Homo sapiens
aagcaatatagtgcaaatgt

SEQ ID NO: 7986234 - DNA, 20 bp, Homo sapiens
aagcaatatagtgcaaatgt

SEQ ID NO: 7986235 - DNA, 22 bp, Homo sapiens
aagcaatatactgatatgatta

SEQ ID NO: 7986236 - DNA, 22 bp, Homo sapiens
aagcaatagggtaatctactca

SEQ ID NO: 7986237 - DNA, 22 bp, Homo sapiens
aagcacatttggaaaacatgga

SEQ ID NO: 7986238 - DNA, 22 bp, Homo sapiens
aagcacattttccagcagctct

SEQ ID NO: 7986239 - DNA, 22 bp, Homo sapiens
aagcacacttggctctgtgtac

SEQ ID NO: 7986240 - DNA, 22 bp, Homo sapiens
aagcacattttccagcagctct

SEQ ID NO: 7986241 - DNA, 22 bp, Homo sapiens
aagcacctctatgattgctttt

SEQ ID NO: 7986242 - DNA, 22 bp, Homo sapiens
aagcaccctttgtctggacatg

SEQ ID NO: 7986243 - DNA, 22 bp, Homo sapiens
aagcaccaccctcccaacctgt

SEQ ID NO: 7986244 - DNA, 22 bp, Homo sapiens
aagcacccaatttacagcagtt

SEQ ID NO: 7986245 - DNA, 22 bp, Homo sapiens
aagcacaatttaggactgaaat

SEQ ID NO: 7986246 - DNA, 22 bp, Homo sapiens
aagcacaatttcaccttcttgt

SEQ ID NO: 7986247 - DNA, 22 bp, Homo sapiens
aagcacaatttaggactgaaat

SEQ ID NO: 7986248 - DNA, 22 bp, Homo sapiens
aagcaattggttttagtaaaat

SEQ ID NO: 7986249 - DNA, 22 bp, Homo sapiens
aagcaattgtcctgtctctaca

SEQ ID NO: 7986250 - DNA, 22 bp, Homo sapiens
aagcaattgtcctgtctctaca

SEQ ID NO: 7986251 - DNA, 22 bp, Homo sapiens
aagcaattgtcctgtctctaca

SEQ ID NO: 7986252 - DNA, 22 bp, Homo sapiens
aagcaattgagtgaaacctctt

SEQ ID NO: 7986253 - DNA, 22 bp, Homo sapiens
aagcaattcacagttcacttaa

SEQ ID NO: 7986254 - DNA, 22 bp, Homo sapiens
aagcaattcacagttcacttaa

SEQ ID NO: 7986255 - DNA, 19 bp, Homo sapiens
aagcaatgttgtgaatcta

SEQ ID NO: 7986256 - DNA, 22 bp, Homo sapiens
aagcaattcacagttcacttaa

SEQ ID NO: 7986257 - DNA, 22 bp, Homo sapiens
aagcaattcacagttcacttaa

SEQ ID NO: 7986258 - DNA, 22 bp, Homo sapiens
aagcaattcagcaaacctagaa

SEQ ID NO: 7986259 - DNA, 22 bp, Homo sapiens
aagcaattcagcaaacctagaa

SEQ ID NO: 7986260 - DNA, 22 bp, Homo sapiens
aagcacaatgaacatcttagat

SEQ ID NO: 7986261 - DNA, 22 bp, Homo sapiens
aagcacaatgaacatcttagat

SEQ ID NO: 7986262 - DNA, 22 bp, Homo sapiens
aagcacaatgaacatcttagat

SEQ ID NO: 7986263 - DNA, 22 bp, Homo sapiens
aagcacaatttaggactgaaat

SEQ ID NO: 7986264 - DNA, 22 bp, Homo sapiens
aagcaatttgacagtacatatc

SEQ ID NO: 7986265 - DNA, 22 bp, Homo sapiens
aagcaattcagcaaacctagaa

SEQ ID NO: 7986266 - DNA, 22 bp, Homo sapiens
aagcaatttgacagtacatatc

SEQ ID NO: 7986267 - DNA, 22 bp, Homo sapiens
aagcacaatgaacatcttagat

SEQ ID NO: 7986268 - DNA, 22 bp, Homo sapiens
aagcaatttgacagtacatatc

SEQ ID NO: 7986269 - DNA, 22 bp, Homo sapiens
aagcagagccaccagctttgga

SEQ ID NO: 7986270 - DNA, 22 bp, Homo sapiens
aagcagagcaagcgtatttatt

SEQ ID NO: 7986271 - DNA, 22 bp, Homo sapiens
aagcagagcaagcgtatttatt

SEQ ID NO: 7986272 - DNA, 22 bp, Homo sapiens
aagcagagcctgagacagggat

SEQ ID NO: 7986273 - DNA, 22 bp, Homo sapiens
aagcagagcctgagacagggat

SEQ ID NO: 7986274 - DNA, 22 bp, Homo sapiens
aagcagaggaccgacggaggga

SEQ ID NO: 7986275 - DNA, 22 bp, Homo sapiens
aagcagagcctgagacagggat

SEQ ID NO: 7986276 - DNA, 22 bp, Homo sapiens
aagcagagaatctgggagcgag

SEQ ID NO: 7986277 - DNA, 22 bp, Homo sapiens
aagcagagaatctgggagcgag

SEQ ID NO: 7986278 - DNA, 22 bp, Homo sapiens
aagcagagaatctgggagcgag

SEQ ID NO: 7986279 - DNA, 22 bp, Homo sapiens
aagcagagaaaagcttaggttc

SEQ ID NO: 7986280 - DNA, 22 bp, Homo sapiens
aagcagagaaaagcttaggttc

SEQ ID NO: 7986281 - DNA, 22 bp, Homo sapiens
aagcagactgggccataaggaa

SEQ ID NO: 7986282 - DNA, 22 bp, Homo sapiens
aagcagactgggccataaggaa

SEQ ID NO: 7986283 - DNA, 19 bp, Homo sapiens
aagcagactctgagccagg

SEQ ID NO: 7986284 - DNA, 19 bp, Homo sapiens
aagcagactctgagccagg

SEQ ID NO: 7986285 - DNA, 19 bp, Homo sapiens
aagcagactctgagccagg

SEQ ID NO: 7986286 - DNA, 19 bp, Homo sapiens
aagcagactctgagccagg

SEQ ID NO: 7986287 - DNA, 22 bp, Homo sapiens
aagcagagaatctgggagcgag

SEQ ID NO: 7986288 - DNA, 22 bp, Homo sapiens
aagcagagaccggctaatggag

SEQ ID NO: 7986289 - DNA, 22 bp, Homo sapiens
aagcagagagcagaattaagtt

SEQ ID NO: 7986290 - DNA, 22 bp, Homo sapiens
aagcagagaccggctaatggag

SEQ ID NO: 7986291 - DNA, 21 bp, Homo sapiens
aagcagacctgagcacagaac

SEQ ID NO: 7986292 - DNA, 22 bp, Homo sapiens
aagcagacatcccatacttttg

SEQ ID NO: 7986293 - DNA, 18 bp, Homo sapiens
aagcagacagcagacagt

SEQ ID NO: 7986294 - DNA, 22 bp, Homo sapiens
aagcagaatttcccactagttg

SEQ ID NO: 7986295 - DNA, 22 bp, Homo sapiens
aagcagaatttcccactagttg

SEQ ID NO: 7986296 - DNA, 22 bp, Homo sapiens
aagcagaatttaatagaaaggt

SEQ ID NO: 7986297 - DNA, 22 bp, Homo sapiens
aagcagaatttaatagaaaggt

SEQ ID NO: 7986298 - DNA, 22 bp, Homo sapiens
aagcagaatttaatagaaaggt

SEQ ID NO: 7986299 - DNA, 22 bp, Homo sapiens
aagcagaatttaatagaaaggt

SEQ ID NO: 7986300 - DNA, 22 bp, Homo sapiens
aagcagaatttaatagaaaggt

SEQ ID NO: 7986301 - DNA, 22 bp, Homo sapiens
aagcagaatttaatagaaaggt

SEQ ID NO: 7986302 - DNA, 22 bp, Homo sapiens
aagcagaatttcccactagttg

SEQ ID NO: 7986303 - DNA, 22 bp, Homo sapiens
aagcagaatttcccactagttg

SEQ ID NO: 7986304 - DNA, 22 bp, Homo sapiens
aagcagaatttcccactagttg

SEQ ID NO: 7986305 - DNA, 22 bp, Homo sapiens
aagcagaatttcccactagttg

SEQ ID NO: 7986306 - DNA, 22 bp, Homo sapiens
aagcagaagttgatctaccata

SEQ ID NO: 7986307 - DNA, 22 bp, Homo sapiens
aagcagaatagaggcccttccc

SEQ ID NO: 7986308 - DNA, 22 bp, Homo sapiens
aagcagaatagaggcccttccc

SEQ ID NO: 7986309 - DNA, 22 bp, Homo sapiens
aagcagaatttaatagaaaggt

SEQ ID NO: 7986310 - DNA, 22 bp, Homo sapiens
aagcagaagttgatctaccata

SEQ ID NO: 7986311 - DNA, 22 bp, Homo sapiens
aagcagaagttgatctaccata

SEQ ID NO: 7986312 - DNA, 22 bp, Homo sapiens
aagcagaagttgatctaccata

SEQ ID NO: 7986313 - DNA, 22 bp, Homo sapiens
aagcagaagttgatctaccata

SEQ ID NO: 7986314 - DNA, 20 bp, Homo sapiens
aagcagaagctgctctcagc

SEQ ID NO: 7986315 - DNA, 20 bp, Homo sapiens
aagcagaagctgctctcagc

SEQ ID NO: 7986316 - DNA, 22 bp, Homo sapiens
aagcagaaggggaataatattt

SEQ ID NO: 7986317 - DNA, 22 bp, Homo sapiens
aagcagaactgggaagtagtgg

SEQ ID NO: 7986318 - DNA, 22 bp, Homo sapiens
aagcagaaggggaataatattt

SEQ ID NO: 7986319 - DNA, 22 bp, Homo sapiens
aagcagaaggggaataatattt

SEQ ID NO: 7986320 - DNA, 22 bp, Homo sapiens
aagcagaaggggaataatattt

SEQ ID NO: 7986321 - DNA, 20 bp, Homo sapiens
aagcagaagctgctctcagc

SEQ ID NO: 7986322 - DNA, 20 bp, Homo sapiens
aagcagaagctgctctcagc

SEQ ID NO: 7986323 - DNA, 22 bp, Homo sapiens
aagcagaggtagggtgtgcagt

SEQ ID NO: 7986324 - DNA, 22 bp, Homo sapiens
aagcagagggtatggccaggtt

SEQ ID NO: 7986325 - DNA, 22 bp, Homo sapiens
aagcagagggtatggccaggtt

SEQ ID NO: 7986326 - DNA, 22 bp, Homo sapiens
aagcagaggtagggtgtgcagt

SEQ ID NO: 7986327 - DNA, 22 bp, Homo sapiens
aagcagagggtatggccaggtt

SEQ ID NO: 7986328 - DNA, 22 bp, Homo sapiens
acagcagaccccagtgccatgg

SEQ ID NO: 7986329 - DNA, 22 bp, Homo sapiens
acagcagaccccagtgccatgg

SEQ ID NO: 7986330 - DNA, 22 bp, Homo sapiens
acagcagaccccagtgccatgg

SEQ ID NO: 7986331 - DNA, 22 bp, Homo sapiens
acagcaaaagacaagaacttaa

SEQ ID NO: 7986332 - DNA, 22 bp, Homo sapiens
acagcaaaagacaagaacttaa

SEQ ID NO: 7986333 - DNA, 22 bp, Homo sapiens
acagcaaaagacaagaacttaa

SEQ ID NO: 7986334 - DNA, 22 bp, Homo sapiens
acagcaaaagacaagaacttaa

SEQ ID NO: 7986335 - DNA, 22 bp, Homo sapiens
acagcaaaagacaagaacttaa

SEQ ID NO: 7986336 - DNA, 22 bp, Homo sapiens
acagcaaaagacaagaacttaa

SEQ ID NO: 7986337 - DNA, 22 bp, Homo sapiens
aagcagaggccacagagtgggc

SEQ ID NO: 7986338 - DNA, 22 bp, Homo sapiens
aagcagagggtatggccaggtt

SEQ ID NO: 7986339 - DNA, 22 bp, Homo sapiens
aagcagagggtatggccaggtt

SEQ ID NO: 7986340 - DNA, 22 bp, Homo sapiens
aagcagaggccacagagtgggc

SEQ ID NO: 7986341 - DNA, 22 bp, Homo sapiens
aagcagaggccacagagtgggc

SEQ ID NO: 7986342 - DNA, 22 bp, Homo sapiens
aagcagaggccacagagtgggc

SEQ ID NO: 7986343 - DNA, 22 bp, Homo sapiens
aagcagaggccacagagtgggc

SEQ ID NO: 7986344 - DNA, 22 bp, Homo sapiens
aagcagaggccacagagtgggc

SEQ ID NO: 7986345 - DNA, 22 bp, Homo sapiens
aagcagaggccacagagtgggc

SEQ ID NO: 7986346 - DNA, 22 bp, Homo sapiens
aagcagaggccacagagtgggc

SEQ ID NO: 7986347 - DNA, 22 bp, Homo sapiens
aagcagaggaccgacggaggga

SEQ ID NO: 7986348 - DNA, 22 bp, Homo sapiens
aagcagaggaccgacggaggga

SEQ ID NO: 7986349 - DNA, 22 bp, Homo sapiens
aagcagaggaccgacggaggga

SEQ ID NO: 7986350 - DNA, 22 bp, Homo sapiens
aagcagaggaccgacggaggga

SEQ ID NO: 7986351 - DNA, 22 bp, Homo sapiens
aagcagaggaccgacggaggga

SEQ ID NO: 7986352 - DNA, 22 bp, Homo sapiens
acagcagagacactcaggaggc

SEQ ID NO: 7986353 - DNA, 22 bp, Homo sapiens
acagcagagacactcaggaggc

SEQ ID NO: 7986354 - DNA, 22 bp, Homo sapiens
acagcagagacactcaggaggc

SEQ ID NO: 7986355 - DNA, 22 bp, Homo sapiens
acagcagagacactcaggaggc

SEQ ID NO: 7986356 - DNA, 22 bp, Homo sapiens
acagcagagacactcaggaggc

SEQ ID NO: 7986357 - DNA, 22 bp, Homo sapiens
acagcagagacactcaggaggc

SEQ ID NO: 7986358 - DNA, 22 bp, Homo sapiens
acagcagagacactcaggaggc

SEQ ID NO: 7986359 - DNA, 22 bp, Homo sapiens
acagcagaccccagtgccatgg

SEQ ID NO: 7986360 - DNA, 22 bp, Homo sapiens
acagcagagaactttagagggt

SEQ ID NO: 7986361 - DNA, 22 bp, Homo sapiens
acagcagagaactttagagggt

SEQ ID NO: 7986362 - DNA, 22 bp, Homo sapiens
acagcagactttctacagctca

SEQ ID NO: 7986363 - DNA, 22 bp, Homo sapiens
acagcagagaactttagagggt

SEQ ID NO: 7986364 - DNA, 22 bp, Homo sapiens
acagcagagaactttagagggt

SEQ ID NO: 7986365 - DNA, 22 bp, Homo sapiens
acagcagagacactcaggaggc

SEQ ID NO: 7986366 - DNA, 22 bp, Homo sapiens
acagcagagccagtggctctag

SEQ ID NO: 7986367 - DNA, 22 bp, Homo sapiens
acagcagagccagtggctctag

SEQ ID NO: 7986368 - DNA, 22 bp, Homo sapiens
acagcagagccagtggctctag

SEQ ID NO: 7986369 - DNA, 22 bp, Homo sapiens
acagcagagccagtggctctag

SEQ ID NO: 7986370 - DNA, 22 bp, Homo sapiens
acagcagagcaccagggccact

SEQ ID NO: 7986371 - DNA, 21 bp, Homo sapiens
acagcagagatcaagactaag

SEQ ID NO: 7986372 - DNA, 21 bp, Homo sapiens
acagcagagatcaagactaag

SEQ ID NO: 7986373 - DNA, 21 bp, Homo sapiens
acagcagagatcaagactaag

SEQ ID NO: 7986374 - DNA, 22 bp, Homo sapiens
acagcagagcaccagggccact

SEQ ID NO: 7986375 - DNA, 22 bp, Homo sapiens
acagcagagcaccagggccact

SEQ ID NO: 7986376 - DNA, 22 bp, Homo sapiens
acagcagagcaccagggccact

SEQ ID NO: 7986377 - DNA, 22 bp, Homo sapiens
acagcagagcaccagggccact

SEQ ID NO: 7986378 - DNA, 22 bp, Homo sapiens
aagcagctgtgtgacataatct

SEQ ID NO: 7986379 - DNA, 22 bp, Homo sapiens
aagcagctgtgtgacataatct

SEQ ID NO: 7986380 - DNA, 22 bp, Homo sapiens
aagcagcttaaattagagcctg

SEQ ID NO: 7986381 - DNA, 21 bp, Homo sapiens
aagcagcttaataaagtatgt

SEQ ID NO: 7986382 - DNA, 21 bp, Homo sapiens
aagcagcttaataaagtatgt

SEQ ID NO: 7986383 - DNA, 22 bp, Homo sapiens
aagcagctgcaggttcaaagga

SEQ ID NO: 7986384 - DNA, 22 bp, Homo sapiens
aagcagctgcaggttcaaagga

SEQ ID NO: 7986385 - DNA, 22 bp, Homo sapiens
aagcagctgcaggttcaaagga

SEQ ID NO: 7986386 - DNA, 22 bp, Homo sapiens
aagcagctgcaggttcaaagga

SEQ ID NO: 7986387 - DNA, 22 bp, Homo sapiens
aagcagctggaagagtaagatg

SEQ ID NO: 7986388 - DNA, 22 bp, Homo sapiens
aagcagctgtgtgacataatct

SEQ ID NO: 7986389 - DNA, 22 bp, Homo sapiens
aagcagctggaagagtaagatg

SEQ ID NO: 7986390 - DNA, 22 bp, Homo sapiens
aagcagctggaagagtaagatg

SEQ ID NO: 7986391 - DNA, 22 bp, Homo sapiens
acagcagagcctggtacttact

SEQ ID NO: 7986392 - DNA, 22 bp, Homo sapiens
acagcagagcctggtacttact

SEQ ID NO: 7986393 - DNA, 22 bp, Homo sapiens
acagcagaggaaaagtctgata

SEQ ID NO: 7986394 - DNA, 22 bp, Homo sapiens
acagcagaggaaaagtctgata

SEQ ID NO: 7986395 - DNA, 22 bp, Homo sapiens
acagcagaggaaaagtctgata

SEQ ID NO: 7986396 - DNA, 22 bp, Homo sapiens
acagcagaggaaaagtctgata

SEQ ID NO: 7986397 - DNA, 22 bp, Homo sapiens
acagcagagcctagcttaatct

SEQ ID NO: 7986398 - DNA, 22 bp, Homo sapiens
acagcagagcctagcttaatct

SEQ ID NO: 7986399 - DNA, 22 bp, Homo sapiens
acagcagagtagttttccaact

SEQ ID NO: 7986400 - DNA, 22 bp, Homo sapiens
acagcagaggaaaagtctgata

SEQ ID NO: 7986401 - DNA, 22 bp, Homo sapiens
aagcagctgatttcacagctca

SEQ ID NO: 7986402 - DNA, 22 bp, Homo sapiens
acagcagagtggagatgagcac

SEQ ID NO: 7986403 - DNA, 22 bp, Homo sapiens
acagcagagtggagatgagcac

SEQ ID NO: 7986404 - DNA, 22 bp, Homo sapiens
acagcagagtggagatgagcac

SEQ ID NO: 7986405 - DNA, 22 bp, Homo sapiens
acagcagagtggagatgagcac

SEQ ID NO: 7986406 - DNA, 22 bp, Homo sapiens
acagcagagtggagatgagcac

SEQ ID NO: 7986407 - DNA, 22 bp, Homo sapiens
acagcagagtggagatgagcac

SEQ ID NO: 7986408 - DNA, 22 bp, Homo sapiens
acagcctggactggctctctgc

SEQ ID NO: 7986409 - DNA, 22 bp, Homo sapiens
acagcctggactggctctctgc

SEQ ID NO: 7986410 - DNA, 22 bp, Homo sapiens
acagcctggactggctctctgc

SEQ ID NO: 7986411 - DNA, 22 bp, Homo sapiens
acagcctggactggctctctgc

SEQ ID NO: 7986412 - DNA, 22 bp, Homo sapiens
acagccagggcattgtcgccga

SEQ ID NO: 7986413 - DNA, 22 bp, Homo sapiens
acagccagggtctcaggaggcg

SEQ ID NO: 7986414 - DNA, 22 bp, Homo sapiens
acagcctgctgcctgcttcttg

SEQ ID NO: 7986415 - DNA, 22 bp, Homo sapiens
acagccagggtctcaggaggcg

SEQ ID NO: 7986416 - DNA, 22 bp, Homo sapiens
aagcaggaagctcaggtccttg

SEQ ID NO: 7986417 - DNA, 22 bp, Homo sapiens
aagcaggaaggagcccagggca

SEQ ID NO: 7986418 - DNA, 22 bp, Homo sapiens
aagcaggaagctcaggtccttg

SEQ ID NO: 7986419 - DNA, 22 bp, Homo sapiens
aagcaggaaggagcccagggca

SEQ ID NO: 7986420 - DNA, 22 bp, Homo sapiens
acagccagggcattgtcgccga

SEQ ID NO: 7986421 - DNA, 22 bp, Homo sapiens
acagccagggcattgtcgccga

SEQ ID NO: 7986422 - DNA, 22 bp, Homo sapiens
aagcaggaagctcaggtccttg

SEQ ID NO: 7986423 - DNA, 22 bp, Homo sapiens
aagcaggaagctcaggtccttg

SEQ ID NO: 7986424 - DNA, 21 bp, Homo sapiens
aagcaggaacttcaaagggac

SEQ ID NO: 7986425 - DNA, 21 bp, Homo sapiens
aagcaggaacttcaaagggac

SEQ ID NO: 7986426 - DNA, 22 bp, Homo sapiens
aagcaggaagctcaggtccttg

SEQ ID NO: 7986427 - DNA, 22 bp, Homo sapiens
aagcaggaagctcaggtccttg

SEQ ID NO: 7986428 - DNA, 22 bp, Homo sapiens
aagcagctttctttcctgtgaa

SEQ ID NO: 7986429 - DNA, 22 bp, Homo sapiens
aagcagctttctttcctgtgaa

SEQ ID NO: 7986430 - DNA, 22 bp, Homo sapiens
aagcagctttctttcctgtgaa

SEQ ID NO: 7986431 - DNA, 22 bp, Homo sapiens
aagcagctttctttcctgtgaa

SEQ ID NO: 7986432 - DNA, 22 bp, Homo sapiens
aagcagcttttgaagagtgagg

SEQ ID NO: 7986433 - DNA, 22 bp, Homo sapiens
aagcagcttttgaagagtgagg

SEQ ID NO: 7986434 - DNA, 22 bp, Homo sapiens
aagcagcttttgaagagtgagg

SEQ ID NO: 7986435 - DNA, 21 bp, Homo sapiens
aagcaggaacttcaaagggac

SEQ ID NO: 7986436 - DNA, 22 bp, Homo sapiens
aagcagcttccccaaagtgcct

SEQ ID NO: 7986437 - DNA, 22 bp, Homo sapiens
aagcagcttccccaaagtgcct

SEQ ID NO: 7986438 - DNA, 22 bp, Homo sapiens
aagcagcttccccaaagtgcct

SEQ ID NO: 7986439 - DNA, 22 bp, Homo sapiens
aagcagcttccccaaagtgcct

SEQ ID NO: 7986440 - DNA, 22 bp, Homo sapiens
aagcagcttccctggctcctgg

SEQ ID NO: 7986441 - DNA, 22 bp, Homo sapiens
aagcagcttccctggctcctgg

SEQ ID NO: 7986442 - DNA, 22 bp, Homo sapiens
aagcagcttccctggctcctgg

SEQ ID NO: 7986443 - DNA, 22 bp, Homo sapiens
aagcagcttccctggctcctgg

SEQ ID NO: 7986444 - DNA, 23 bp, Homo sapiens
aaaggcaggcctaggacatattg

SEQ ID NO: 7986445 - DNA, 23 bp, Homo sapiens
aaaggcaggcctaggacatattg

SEQ ID NO: 7986446 - DNA, 22 bp, Homo sapiens
aaaggcaggctttcacatctca

SEQ ID NO: 7986447 - DNA, 22 bp, Homo sapiens
aaaggcaggctttcacatctca

SEQ ID NO: 7986448 - DNA, 22 bp, Homo sapiens
aaaggcaggctttcacatctca

SEQ ID NO: 7986449 - DNA, 22 bp, Homo sapiens
aaaggcagtgggtatgtggatc

SEQ ID NO: 7986450 - DNA, 22 bp, Homo sapiens
aaaggcagtgggtatgtggatc

SEQ ID NO: 7986451 - DNA, 22 bp, Homo sapiens
aaaggcagtgggtatgtggatc

SEQ ID NO: 7986452 - DNA, 22 bp, Homo sapiens
aaaggcagtgggtatgtggatc

SEQ ID NO: 7986453 - DNA, 22 bp, Homo sapiens
aaaggcagtgggtatgtggatc

SEQ ID NO: 7986454 - DNA, 22 bp, Homo sapiens
aaaggcagtgggtatgtggatc

SEQ ID NO: 7986455 - DNA, 22 bp, Homo sapiens
aaaggcagtgggtatgtggatc

SEQ ID NO: 7986456 - DNA, 19 bp, Homo sapiens
aaaggcagtgggtggcgtg

SEQ ID NO: 7986457 - DNA, 19 bp, Homo sapiens
aaaggcagtgggtggcgtg

SEQ ID NO: 7986458 - DNA, 19 bp, Homo sapiens
aaaggcagtgggtggcgtg

SEQ ID NO: 7986459 - DNA, 22 bp, Homo sapiens
aaaggcagtgtgatactgtggt

SEQ ID NO: 7986460 - DNA, 22 bp, Homo sapiens
aaaggcagtgtgatactgtggt

SEQ ID NO: 7986461 - DNA, 22 bp, Homo sapiens
aaaggcagtgtgatactgtggt

SEQ ID NO: 7986462 - DNA, 22 bp, Homo sapiens
aaaggcagtgtgatactgtggt

SEQ ID NO: 7986463 - DNA, 22 bp, Homo sapiens
aaaggcatgattaattctgtgt

SEQ ID NO: 7986464 - DNA, 21 bp, Homo sapiens
aactgcaaatgatgctggaga

SEQ ID NO: 7986465 - DNA, 22 bp, Homo sapiens
aaaggcagagttgttggaggca

SEQ ID NO: 7986466 - DNA, 22 bp, Homo sapiens
aaaggcagagttgttggaggca

SEQ ID NO: 7986467 - DNA, 22 bp, Homo sapiens
aaaggcagagttgttggaggca

SEQ ID NO: 7986468 - DNA, 22 bp, Homo sapiens
aacccgggaggcagaggttgtg

SEQ ID NO: 7986469 - DNA, 22 bp, Homo sapiens
aacccgggaggcagaggttgtg

SEQ ID NO: 7986470 - DNA, 22 bp, Homo sapiens
aacccgggaggcagaggttgtg

SEQ ID NO: 7986471 - DNA, 22 bp, Homo sapiens
aacccgggaggcagaggttgtg

SEQ ID NO: 7986472 - DNA, 18 bp, Homo sapiens
aaaggcagattactggga

SEQ ID NO: 7986473 - DNA, 22 bp, Homo sapiens
aaaggcagagttgttggaggca

SEQ ID NO: 7986474 - DNA, 22 bp, Homo sapiens
aaaggcaggactgcagcatagg

SEQ ID NO: 7986475 - DNA, 18 bp, Homo sapiens
aaaggcagattactggga

SEQ ID NO: 7986476 - DNA, 22 bp, Homo sapiens
aaaggcaggactgcagcatagg

SEQ ID NO: 7986477 - DNA, 18 bp, Homo sapiens
aaaggcagattactggga

SEQ ID NO: 7986478 - DNA, 22 bp, Homo sapiens
aaccccgctcaggctgggtgag

SEQ ID NO: 7986479 - DNA, 22 bp, Homo sapiens
aaccccagtaccccaggatatg

SEQ ID NO: 7986480 - DNA, 22 bp, Homo sapiens
aaccccagtaccccaggatatg

SEQ ID NO: 7986481 - DNA, 22 bp, Homo sapiens
aaccccagtaccccaggatatg

SEQ ID NO: 7986482 - DNA, 22 bp, Homo sapiens
aaccccaggctggaggagtctc

SEQ ID NO: 7986483 - DNA, 22 bp, Homo sapiens
aaccccaggctggaggagtctc

SEQ ID NO: 7986484 - DNA, 22 bp, Homo sapiens
aacccattaatccttgcaagca

SEQ ID NO: 7986485 - DNA, 22 bp, Homo sapiens
aacccgggaggcagaggttgtg

SEQ ID NO: 7986486 - DNA, 22 bp, Homo sapiens
aacccgggaggcagaggttgtg

SEQ ID NO: 7986487 - DNA, 22 bp, Homo sapiens
aacccgggaggcagaggttgtg

SEQ ID NO: 7986488 - DNA, 22 bp, Homo sapiens
aacccgggaggcagaggttgtg

SEQ ID NO: 7986489 - DNA, 22 bp, Homo sapiens
aacccgggaggcagaggttgtg

SEQ ID NO: 7986490 - DNA, 22 bp, Homo sapiens
aacccgagggccccaggctcgg

SEQ ID NO: 7986491 - DNA, 22 bp, Homo sapiens
aacccgagggccccaggctcgg

SEQ ID NO: 7986492 - DNA, 22 bp, Homo sapiens
aacccgagggccccaggctcgg

SEQ ID NO: 7986493 - DNA, 22 bp, Homo sapiens
aacatttgtttggcttcaatta

SEQ ID NO: 7986494 - DNA, 22 bp, Homo sapiens
aacatttgtttcgttatgtgaa

SEQ ID NO: 7986495 - DNA, 22 bp, Homo sapiens
aacatttgtgtttgctaaaaat

SEQ ID NO: 7986496 - DNA, 22 bp, Homo sapiens
aacatttgtttcgttatgtgaa

SEQ ID NO: 7986497 - DNA, 22 bp, Homo sapiens
aacatttgtttggcttcaatta

SEQ ID NO: 7986498 - DNA, 22 bp, Homo sapiens
aacccacaagcagctgtagccc

SEQ ID NO: 7986499 - DNA, 22 bp, Homo sapiens
aaagccttttctgtttaacaca

SEQ ID NO: 7986500 - DNA, 22 bp, Homo sapiens
aaagccttttatgatcagttaa

SEQ ID NO: 7986501 - DNA, 22 bp, Homo sapiens
aaagccttttatgatcagttaa

SEQ ID NO: 7986502 - DNA, 22 bp, Homo sapiens
aaagccttttatgatcagttaa

SEQ ID NO: 7986503 - DNA, 22 bp, Homo sapiens
aaagcctttgtctcaggctctg

SEQ ID NO: 7986504 - DNA, 22 bp, Homo sapiens
aaagccttgggatttgtgatca

SEQ ID NO: 7986505 - DNA, 22 bp, Homo sapiens
aaagcctcccaggttatgagta

SEQ ID NO: 7986506 - DNA, 22 bp, Homo sapiens
aaagcctcccaggttatgagta

SEQ ID NO: 7986507 - DNA, 22 bp, Homo sapiens
aaagcctcccaggttatgagta

SEQ ID NO: 7986508 - DNA, 22 bp, Homo sapiens
aaagcctcccaggttatgagta

SEQ ID NO: 7986509 - DNA, 22 bp, Homo sapiens
aaagcctgtctggtcatagcta

SEQ ID NO: 7986510 - DNA, 22 bp, Homo sapiens
aaagcctgggttcctcactatc

SEQ ID NO: 7986511 - DNA, 22 bp, Homo sapiens
aaagcctcccaggttatgagta

SEQ ID NO: 7986512 - DNA, 22 bp, Homo sapiens
aaagccttgagatcctatagtt

SEQ ID NO: 7986513 - DNA, 22 bp, Homo sapiens
aaagccttcttcggtctgtgat

SEQ ID NO: 7986514 - DNA, 22 bp, Homo sapiens
aaagccttcttcggtctgtgat

SEQ ID NO: 7986515 - DNA, 22 bp, Homo sapiens
aaagccttcttgtatcgagcca

SEQ ID NO: 7986516 - DNA, 22 bp, Homo sapiens
aaagccttcaagtagatgtaag

SEQ ID NO: 7986517 - DNA, 22 bp, Homo sapiens
aacccagggtgaggggagtcta

SEQ ID NO: 7986518 - DNA, 22 bp, Homo sapiens
aacccagggtggaggttgcagt

SEQ ID NO: 7986519 - DNA, 22 bp, Homo sapiens
aacccagggtgaggggagtcta

SEQ ID NO: 7986520 - DNA, 22 bp, Homo sapiens
aacccagggtgaggggagtcta

SEQ ID NO: 7986521 - DNA, 22 bp, Homo sapiens
aacccagggtggaggttgcagt

SEQ ID NO: 7986522 - DNA, 22 bp, Homo sapiens
aacccaggtctttggcttccag

SEQ ID NO: 7986523 - DNA, 22 bp, Homo sapiens
aacccaggtctttggcttccag

SEQ ID NO: 7986524 - DNA, 22 bp, Homo sapiens
aacccatgttggaagcttatca

SEQ ID NO: 7986525 - DNA, 22 bp, Homo sapiens
aacccaggagttggaggctgtg

SEQ ID NO: 7986526 - DNA, 22 bp, Homo sapiens
aacccaggagacaggttgcagt

SEQ ID NO: 7986527 - DNA, 22 bp, Homo sapiens
aacccagagctggaggagagta

SEQ ID NO: 7986528 - DNA, 22 bp, Homo sapiens
aacccagccgtgtagctgccgc

SEQ ID NO: 7986529 - DNA, 22 bp, Homo sapiens
aacccactctacctggctccat

SEQ ID NO: 7986530 - DNA, 16 bp, Homo sapiens
aacccacagctcccga

SEQ ID NO: 7986531 - DNA, 22 bp, Homo sapiens
aacccaccgtggtagggcacac

SEQ ID NO: 7986532 - DNA, 22 bp, Homo sapiens
aacccaggaggcagaggctgca

SEQ ID NO: 7986533 - DNA, 22 bp, Homo sapiens
aacccaggagacaggttgcagt

SEQ ID NO: 7986534 - DNA, 22 bp, Homo sapiens
aaaggttttgccctgggtattc

SEQ ID NO: 7986535 - DNA, 22 bp, Homo sapiens
aaaggttttggtaaggctttaa

SEQ ID NO: 7986536 - DNA, 22 bp, Homo sapiens
aaaggttttggtaaggctttaa

SEQ ID NO: 7986537 - DNA, 22 bp, Homo sapiens
aactgtggacttgagactgatg

SEQ ID NO: 7986538 - DNA, 22 bp, Homo sapiens
aactgtgtccttagctctcact

SEQ ID NO: 7986539 - DNA, 22 bp, Homo sapiens
aactgtcttatttatatttctg

SEQ ID NO: 7986540 - DNA, 22 bp, Homo sapiens
aactgtcttaataacaaaagct

SEQ ID NO: 7986541 - DNA, 22 bp, Homo sapiens
aactgtcttaataacaaaagct

SEQ ID NO: 7986542 - DNA, 23 bp, Homo sapiens
aactgtcttgcaagtgtgatacc

SEQ ID NO: 7986543 - DNA, 22 bp, Homo sapiens
aactgtgaggatgtgcaaattc

SEQ ID NO: 7986544 - DNA, 22 bp, Homo sapiens
aactgtcttgcctactcagcat

SEQ ID NO: 7986545 - DNA, 22 bp, Homo sapiens
aactgtcttgcctactcagcat

SEQ ID NO: 7986546 - DNA, 22 bp, Homo sapiens
aactgtctaaggagaatatgaa

SEQ ID NO: 7986547 - DNA, 22 bp, Homo sapiens
aactgtctaaggagaatatgaa

SEQ ID NO: 7986548 - DNA, 22 bp, Homo sapiens
aactgtctgaaactggggtttc

SEQ ID NO: 7986549 - DNA, 22 bp, Homo sapiens
aactgtatacaattgtcagaca

SEQ ID NO: 7986550 - DNA, 22 bp, Homo sapiens
aactgtagggatctgtcttagt

SEQ ID NO: 7986551 - DNA, 22 bp, Homo sapiens
aactgtagtgcttatagactct

SEQ ID NO: 7986552 - DNA, 22 bp, Homo sapiens
aactgtagcaaagaacagctct

SEQ ID NO: 7986553 - DNA, 22 bp, Homo sapiens
aactgtagaagggacacaaaag

SEQ ID NO: 7986554 - DNA, 22 bp, Homo sapiens
aactgtaagagaataaatgtgt

SEQ ID NO: 7986555 - DNA, 22 bp, Homo sapiens
aactgtaaggcttagaacagca

SEQ ID NO: 7986556 - DNA, 22 bp, Homo sapiens
aactgtaaggcttagaacagca

SEQ ID NO: 7986557 - DNA, 22 bp, Homo sapiens
aactgtaagagaataaatgtgt

SEQ ID NO: 7986558 - DNA, 22 bp, Homo sapiens
aactgtaagacaaatgacttct

SEQ ID NO: 7986559 - DNA, 22 bp, Homo sapiens
aactgtaagaaataaaattctg

SEQ ID NO: 7986560 - DNA, 22 bp, Homo sapiens
aactgtacgataataaatttgt

SEQ ID NO: 7986561 - DNA, 22 bp, Homo sapiens
aactgtaatttttacatagtaa

SEQ ID NO: 7986562 - DNA, 22 bp, Homo sapiens
aactgtaatttttacatagtaa

SEQ ID NO: 7986563 - DNA, 22 bp, Homo sapiens
aactgtaatttttacatagtaa

SEQ ID NO: 7986564 - DNA, 22 bp, Homo sapiens
aactgtaatgaattgttcatga

SEQ ID NO: 7986565 - DNA, 22 bp, Homo sapiens
aactgtaatgaattgttcatga

SEQ ID NO: 7986566 - DNA, 22 bp, Homo sapiens
aactgtaagtggttggaagaag

SEQ ID NO: 7986567 - DNA, 22 bp, Homo sapiens
aactgtaatgaattgttcatga

SEQ ID NO: 7986568 - DNA, 19 bp, Homo sapiens
aactgtaattaatacccta

SEQ ID NO: 7986569 - DNA, 22 bp, Homo sapiens
aactgtaatttttacatagtaa

SEQ ID NO: 7986570 - DNA, 22 bp, Homo sapiens
aaaggtttttatttatcctgga

SEQ ID NO: 7986571 - DNA, 22 bp, Homo sapiens
aaaggtttttatttatcctgga

SEQ ID NO: 7986572 - DNA, 22 bp, Homo sapiens
aaaggttttgttcatcgatttt

SEQ ID NO: 7986573 - DNA, 22 bp, Homo sapiens
aaagtaacaataaggttctatt

SEQ ID NO: 7986574 - DNA, 22 bp, Homo sapiens
aaagtaagaccaagtgatcatt

SEQ ID NO: 7986575 - DNA, 22 bp, Homo sapiens
aaagtaacctagtaatagtgtc

SEQ ID NO: 7986576 - DNA, 22 bp, Homo sapiens
aaagtaaagattgggaatgtgt

SEQ ID NO: 7986577 - DNA, 22 bp, Homo sapiens
aaagtaaagattgggaatgtgt

SEQ ID NO: 7986578 - DNA, 22 bp, Homo sapiens
aagaaataagacttctctgtcc

SEQ ID NO: 7986579 - DNA, 22 bp, Homo sapiens
aagaaataagacttctctgtcc

SEQ ID NO: 7986580 - DNA, 22 bp, Homo sapiens
aaagtaattgcagtttctgcca

SEQ ID NO: 7986581 - DNA, 22 bp, Homo sapiens
aagaaataagacttctctgtcc

SEQ ID NO: 7986582 - DNA, 22 bp, Homo sapiens
aagaaataagacttctctgtcc

SEQ ID NO: 7986583 - DNA, 22 bp, Homo sapiens
aagaaataagacttctctgtcc

SEQ ID NO: 7986584 - DNA, 22 bp, Homo sapiens
aaagtaagatttgcatttcaga

SEQ ID NO: 7986585 - DNA, 22 bp, Homo sapiens
aaagtaagggttaatctacttt

SEQ ID NO: 7986586 - DNA, 22 bp, Homo sapiens
aaagtaagggttaatctacttt

SEQ ID NO: 7986587 - DNA, 22 bp, Homo sapiens
aaagtaagatttgcatttcaga

SEQ ID NO: 7986588 - DNA, 22 bp, Homo sapiens
aaagtaagatttgcatttcaga

SEQ ID NO: 7986589 - DNA, 22 bp, Homo sapiens
aaagtaattaagaagctggaca

SEQ ID NO: 7986590 - DNA, 22 bp, Homo sapiens
aaagtaattaagaagctggaca

SEQ ID NO: 7986591 - DNA, 22 bp, Homo sapiens
aaagtaattgcagtttctgcca

SEQ ID NO: 7986592 - DNA, 22 bp, Homo sapiens
aaagtaattgcagtttctgcca

SEQ ID NO: 7986593 - DNA, 22 bp, Homo sapiens
aagaacatgaacacaatgttta

SEQ ID NO: 7986594 - DNA, 22 bp, Homo sapiens
aagaacatgaacctcttctaac

SEQ ID NO: 7986595 - DNA, 22 bp, Homo sapiens
aagaacatgagttatgatgatt

SEQ ID NO: 7986596 - DNA, 22 bp, Homo sapiens
aagaacatgaacacaatgttta

SEQ ID NO: 7986597 - DNA, 22 bp, Homo sapiens
aagaacataacagaagctgtgt

SEQ ID NO: 7986598 - DNA, 22 bp, Homo sapiens
aagaacataacagaagctgtgt

SEQ ID NO: 7986599 - DNA, 22 bp, Homo sapiens
aagaacataacagaagctgtgt

SEQ ID NO: 7986600 - DNA, 22 bp, Homo sapiens
aagaacataacagaagctgtgt

SEQ ID NO: 7986601 - DNA, 22 bp, Homo sapiens
aagaacataacagaagctgtgt

SEQ ID NO: 7986602 - DNA, 22 bp, Homo sapiens
aagaacagttgggaggtgagcc

SEQ ID NO: 7986603 - DNA, 22 bp, Homo sapiens
aagaacagttgggaggtgagcc

SEQ ID NO: 7986604 - DNA, 22 bp, Homo sapiens
aagaacagttgggaggtgagcc

SEQ ID NO: 7986605 - DNA, 22 bp, Homo sapiens
aagaacagttgggaggtgagcc

SEQ ID NO: 7986606 - DNA, 22 bp, Homo sapiens
aagaacagttgggaggtgagcc

SEQ ID NO: 7986607 - DNA, 22 bp, Homo sapiens
aaagattatggcattgaaatac

SEQ ID NO: 7986608 - DNA, 22 bp, Homo sapiens
aaagattatggcattgaaatac

SEQ ID NO: 7986609 - DNA, 22 bp, Homo sapiens
aaagattatggcattgaaatac

SEQ ID NO: 7986610 - DNA, 22 bp, Homo sapiens
aaagattatggcattgaaatac

SEQ ID NO: 7986611 - DNA, 22 bp, Homo sapiens
aaagattagataagatagattt

SEQ ID NO: 7986612 - DNA, 22 bp, Homo sapiens
aaagattatggaacacacatga

SEQ ID NO: 7986613 - DNA, 22 bp, Homo sapiens
aaagattatggaacacacatga

SEQ ID NO: 7986614 - DNA, 22 bp, Homo sapiens
aaagattatggaacacacatga

SEQ ID NO: 7986615 - DNA, 22 bp, Homo sapiens
aaagattaaggtattgttagct

SEQ ID NO: 7986616 - DNA, 22 bp, Homo sapiens
aaagattaaggtattgttagct

SEQ ID NO: 7986617 - DNA, 22 bp, Homo sapiens
aaagattagataagatagattt

SEQ ID NO: 7986618 - DNA, 22 bp, Homo sapiens
aaagattaggcggcaactgggc

SEQ ID NO: 7986619 - DNA, 22 bp, Homo sapiens
aaagattagataagatagattt

SEQ ID NO: 7986620 - DNA, 22 bp, Homo sapiens
aaagatgttttataagttatgg

SEQ ID NO: 7986621 - DNA, 22 bp, Homo sapiens
aaagatgttttataagttatgg

SEQ ID NO: 7986622 - DNA, 22 bp, Homo sapiens
aaagattaaatcaaattggtca

SEQ ID NO: 7986623 - DNA, 22 bp, Homo sapiens
aaagattaaatcaaattggtca

SEQ ID NO: 7986624 - DNA, 22 bp, Homo sapiens
aaagattaaatcaaattggtca

SEQ ID NO: 7986625 - DNA, 22 bp, Homo sapiens
aaagattaaatcaaattggtca

SEQ ID NO: 7986626 - DNA, 22 bp, Homo sapiens
aaagatgttttacatagcacct

SEQ ID NO: 7986627 - DNA, 22 bp, Homo sapiens
aaagatgttttacatagcacct

SEQ ID NO: 7986628 - DNA, 22 bp, Homo sapiens
aaagatgttttacatagcacct

SEQ ID NO: 7986629 - DNA, 22 bp, Homo sapiens
aaagatgtttgttccaaaattc

SEQ ID NO: 7986630 - DNA, 22 bp, Homo sapiens
aaagatgttttataagttatgg

SEQ ID NO: 7986631 - DNA, 22 bp, Homo sapiens
aaagatgttttataagttatgg

SEQ ID NO: 7986632 - DNA, 21 bp, Homo sapiens
aaagatgtttcatctgagaaa

SEQ ID NO: 7986633 - DNA, 21 bp, Homo sapiens
aaagatgtttcttttcctcac

SEQ ID NO: 7986634 - DNA, 22 bp, Homo sapiens
aaagatgtttgttccaaaattc

SEQ ID NO: 7986635 - DNA, 22 bp, Homo sapiens
aaagatgtttgttccaaaattc

SEQ ID NO: 7986636 - DNA, 22 bp, Homo sapiens
aaagatttgagttctgcttata

SEQ ID NO: 7986637 - DNA, 22 bp, Homo sapiens
aaagatttgagttctgcttata

SEQ ID NO: 7986638 - DNA, 22 bp, Homo sapiens
aaagatttgagttctgcttata

SEQ ID NO: 7986639 - DNA, 22 bp, Homo sapiens
aaagatttcagaagcctgtgcc

SEQ ID NO: 7986640 - DNA, 22 bp, Homo sapiens
aaagatttgaaattaggcatca

SEQ ID NO: 7986641 - DNA, 22 bp, Homo sapiens
aaagatttcagaagcctgtgcc

SEQ ID NO: 7986642 - DNA, 22 bp, Homo sapiens
aaagatttatgaagttcaatta

SEQ ID NO: 7986643 - DNA, 22 bp, Homo sapiens
aaagattatggcattgaaatac

SEQ ID NO: 7986644 - DNA, 22 bp, Homo sapiens
aaagattatggcattgaaatac

SEQ ID NO: 7986645 - DNA, 22 bp, Homo sapiens
aaagattcctttattctccaag

SEQ ID NO: 7986646 - DNA, 22 bp, Homo sapiens
aaagatttaagaataatttgtg

SEQ ID NO: 7986647 - DNA, 22 bp, Homo sapiens
aaagattgatcatgaattgaca

SEQ ID NO: 7986648 - DNA, 22 bp, Homo sapiens
aaagattcgagcgatgtataaa

SEQ ID NO: 7986649 - DNA, 22 bp, Homo sapiens
aaagattcgagcgatgtataaa

SEQ ID NO: 7986650 - DNA, 22 bp, Homo sapiens
aaagatttaagaataatttgtg

SEQ ID NO: 7986651 - DNA, 22 bp, Homo sapiens
aaagatttaagaataatttgtg

SEQ ID NO: 7986652 - DNA, 22 bp, Homo sapiens
aaagatttaagaataatttgtg

SEQ ID NO: 7986653 - DNA, 22 bp, Homo sapiens
aaagatttatgaagttcaatta

SEQ ID NO: 7986654 - DNA, 22 bp, Homo sapiens
aaagatttatgaagttcaatta

SEQ ID NO: 7986655 - DNA, 22 bp, Homo sapiens
aaagatttatgaagttcaatta

SEQ ID NO: 7986656 - DNA, 22 bp, Homo sapiens
aacacattttgcctaggcaata

SEQ ID NO: 7986657 - DNA, 22 bp, Homo sapiens
aacacattttgcctaggcaata

SEQ ID NO: 7986658 - DNA, 22 bp, Homo sapiens
aacacattttgcctaggcaata

SEQ ID NO: 7986659 - DNA, 23 bp, Homo sapiens
aacaccaaggctcagagagataa

SEQ ID NO: 7986660 - DNA, 23 bp, Homo sapiens
aacaccaaggctcagagagataa

SEQ ID NO: 7986661 - DNA, 22 bp, Homo sapiens
aaagcaagtctctacaaagtac

SEQ ID NO: 7986662 - DNA, 22 bp, Homo sapiens
aaagcaagtctctacaaagtac

SEQ ID NO: 7986663 - DNA, 22 bp, Homo sapiens
aaagcaagtctctacaaagtac

SEQ ID NO: 7986664 - DNA, 22 bp, Homo sapiens
aacacattttgcctaggcaata

SEQ ID NO: 7986665 - DNA, 22 bp, Homo sapiens
aacactgtcagcctttgatgga

SEQ ID NO: 7986666 - DNA, 22 bp, Homo sapiens
aacactgtcagcctttgatgga

SEQ ID NO: 7986667 - DNA, 22 bp, Homo sapiens
aacactgtcttatacttcaatg

SEQ ID NO: 7986668 - DNA, 22 bp, Homo sapiens
aacactgtcttatacttcaatg

SEQ ID NO: 7986669 - DNA, 22 bp, Homo sapiens
aacactgtcttatacttcaatg

SEQ ID NO: 7986670 - DNA, 22 bp, Homo sapiens
aaagcaaacagaaccccaagct

SEQ ID NO: 7986671 - DNA, 22 bp, Homo sapiens
aaagcaaacagaaccccaagct

SEQ ID NO: 7986672 - DNA, 22 bp, Homo sapiens
aaagcaagatgcatccgtcaag

SEQ ID NO: 7986673 - DNA, 22 bp, Homo sapiens
aaagcaagatgcatccgtcaag

SEQ ID NO: 7986674 - DNA, 23 bp, Homo sapiens
aaagcaaggaattggcaacagag

SEQ ID NO: 7986675 - DNA, 23 bp, Homo sapiens
aaagcaaggaattggcaacagag

SEQ ID NO: 7986676 - DNA, 22 bp, Homo sapiens
aaagcaaacagaaccccaagct

SEQ ID NO: 7986677 - DNA, 23 bp, Homo sapiens
aaagcaaggaattggcaacagag

SEQ ID NO: 7986678 - DNA, 23 bp, Homo sapiens
aaagcaaggaattggcaacagag

SEQ ID NO: 7986679 - DNA, 23 bp, Homo sapiens
aaagcaaggaattggcaacagag

SEQ ID NO: 7986680 - DNA, 23 bp, Homo sapiens
aaagcaaggaattggcaacagag

SEQ ID NO: 7986681 - DNA, 23 bp, Homo sapiens
aaagcaaggaattggcaacagag

SEQ ID NO: 7986682 - DNA, 22 bp, Homo sapiens
aaagcaagtctctacaaagtac

SEQ ID NO: 7986683 - DNA, 22 bp, Homo sapiens
aaagcaagtctctacaaagtac

SEQ ID NO: 7986684 - DNA, 22 bp, Homo sapiens
aaagcaagtctctacaaagtac

SEQ ID NO: 7986685 - DNA, 22 bp, Homo sapiens
aaagcaagtctctacaaagtac

SEQ ID NO: 7986686 - DNA, 22 bp, Homo sapiens
aaagcaagtctctacaaagtac

SEQ ID NO: 7986687 - DNA, 22 bp, Homo sapiens
aacacttatccacatttgaaag

SEQ ID NO: 7986688 - DNA, 22 bp, Homo sapiens
aacactgtggtcttttcagtaa

SEQ ID NO: 7986689 - DNA, 22 bp, Homo sapiens
aacacttgaatgtgtagcagct

SEQ ID NO: 7986690 - DNA, 22 bp, Homo sapiens
aacacttctgttgataataagc

SEQ ID NO: 7986691 - DNA, 22 bp, Homo sapiens
aacacttcccgaccatatggct

SEQ ID NO: 7986692 - DNA, 22 bp, Homo sapiens
aacacttcccgaccatatggct

SEQ ID NO: 7986693 - DNA, 22 bp, Homo sapiens
aacacttaaggagagatcaaat

SEQ ID NO: 7986694 - DNA, 22 bp, Homo sapiens
aacactgtgcagtgtaatgctg

SEQ ID NO: 7986695 - DNA, 22 bp, Homo sapiens
aacactgtgaggtaatgaccta

SEQ ID NO: 7986696 - DNA, 22 bp, Homo sapiens
aacactgtgcccaccctagtcc

SEQ ID NO: 7986697 - DNA, 22 bp, Homo sapiens
aacactgtgcccaccctagtcc

SEQ ID NO: 7986698 - DNA, 22 bp, Homo sapiens
aacactgtgcccaccctagtcc

SEQ ID NO: 7986699 - DNA, 22 bp, Homo sapiens
aacactgtgaggtaatgaccta

SEQ ID NO: 7986700 - DNA, 22 bp, Homo sapiens
aacactgtgcagtgtaatgctg

SEQ ID NO: 7986701 - DNA, 22 bp, Homo sapiens
aacactgtgaggtaatgaccta

SEQ ID NO: 7986702 - DNA, 22 bp, Homo sapiens
aacactgtgaggtaatgaccta

SEQ ID NO: 7986703 - DNA, 20 bp, Homo sapiens
aacactgtgcgtggtaggtg

SEQ ID NO: 7986704 - DNA, 20 bp, Homo sapiens
aacactgtgcgtggtaggtg

SEQ ID NO: 7986705 - DNA, 22 bp, Homo sapiens
aacactgtgctccccaggctgt

SEQ ID NO: 7986706 - DNA, 22 bp, Homo sapiens
aacactgtggtcttttcagtaa

SEQ ID NO: 7986707 - DNA, 22 bp, Homo sapiens
aacactgtgctccccaggctgt

SEQ ID NO: 7986708 - DNA, 22 bp, Homo sapiens
aacactgtggtcttttcagtaa

SEQ ID NO: 7986709 - DNA, 22 bp, Homo sapiens
aacatacatatttcagtgtcca

SEQ ID NO: 7986710 - DNA, 22 bp, Homo sapiens
aacatacatatttcagtgtcca

SEQ ID NO: 7986711 - DNA, 22 bp, Homo sapiens
aacatacagtgagcagtggact

SEQ ID NO: 7986712 - DNA, 22 bp, Homo sapiens
aacatacagtgagcagtggact

SEQ ID NO: 7986713 - DNA, 22 bp, Homo sapiens
aacatacagtgagcagtggact

SEQ ID NO: 7986714 - DNA, 22 bp, Homo sapiens
aacatacagtgagcagtggact

SEQ ID NO: 7986715 - DNA, 22 bp, Homo sapiens
aacatacatatttcagtgtcca

SEQ ID NO: 7986716 - DNA, 22 bp, Homo sapiens
aacatacagtgagcagtggact

SEQ ID NO: 7986717 - DNA, 22 bp, Homo sapiens
aacatacagtgagcagtggact

SEQ ID NO: 7986718 - DNA, 22 bp, Homo sapiens
aacatacagtgagcagtggact

SEQ ID NO: 7986719 - DNA, 22 bp, Homo sapiens
aacataatgtggccaaagtcac

SEQ ID NO: 7986720 - DNA, 22 bp, Homo sapiens
aacataatgtggccaaagtcac

SEQ ID NO: 7986721 - DNA, 22 bp, Homo sapiens
aacataatgtggccaaagtcac

SEQ ID NO: 7986722 - DNA, 22 bp, Homo sapiens
aacataatgtggccaaagtcac

SEQ ID NO: 7986723 - DNA, 22 bp, Homo sapiens
aacatagaagatggttaattgt

SEQ ID NO: 7986724 - DNA, 22 bp, Homo sapiens
aacatagaatggctccagagct

SEQ ID NO: 7986725 - DNA, 22 bp, Homo sapiens
aacatagaataaatgagttagg

SEQ ID NO: 7986726 - DNA, 22 bp, Homo sapiens
aacatagaataaatgagttagg

SEQ ID NO: 7986727 - DNA, 22 bp, Homo sapiens
aacatagaatggctccagagct

SEQ ID NO: 7986728 - DNA, 22 bp, Homo sapiens
aacatagaatggctccagagct

SEQ ID NO: 7986729 - DNA, 22 bp, Homo sapiens
aacatagaattgttatattttc

SEQ ID NO: 7986730 - DNA, 22 bp, Homo sapiens
aacatagaattgttatattttc

SEQ ID NO: 7986731 - DNA, 22 bp, Homo sapiens
aacatagaattgttatattttc

SEQ ID NO: 7986732 - DNA, 22 bp, Homo sapiens
aacatagaattgttatattttc

SEQ ID NO: 7986733 - DNA, 22 bp, Homo sapiens
aacatagaattgttatattttc

SEQ ID NO: 7986734 - DNA, 22 bp, Homo sapiens
aacatacttatactaaataatg

SEQ ID NO: 7986735 - DNA, 22 bp, Homo sapiens
aacatacttgtactatgcatat

SEQ ID NO: 7986736 - DNA, 22 bp, Homo sapiens
aacatataaactcttaagttca

SEQ ID NO: 7986737 - DNA, 22 bp, Homo sapiens
aacatataaactcttaagttca

SEQ ID NO: 7986738 - DNA, 22 bp, Homo sapiens
aacatagctttactcaaatgac

SEQ ID NO: 7986739 - DNA, 22 bp, Homo sapiens
aacatagctttactcaaatgac

SEQ ID NO: 7986740 - DNA, 22 bp, Homo sapiens
aacatagcgagacactgtgtct

SEQ ID NO: 7986741 - DNA, 22 bp, Homo sapiens
aacatagccagaatgtctcctg

SEQ ID NO: 7986742 - DNA, 22 bp, Homo sapiens
aacatagagacaggaagtgctt

SEQ ID NO: 7986743 - DNA, 22 bp, Homo sapiens
aacatagagacaggaagtgctt

SEQ ID NO: 7986744 - DNA, 22 bp, Homo sapiens
aacatagagacaggaagtgctt

SEQ ID NO: 7986745 - DNA, 22 bp, Homo sapiens
aacatagagacaggaagtgctt

SEQ ID NO: 7986746 - DNA, 22 bp, Homo sapiens
aacatagaattgttatattttc

SEQ ID NO: 7986747 - DNA, 22 bp, Homo sapiens
aacatagacccagttcaacaaa

SEQ ID NO: 7986748 - DNA, 22 bp, Homo sapiens
aacatagacccagttcaacaaa

SEQ ID NO: 7986749 - DNA, 22 bp, Homo sapiens
aacatagacccagttcaacaaa

SEQ ID NO: 7986750 - DNA, 22 bp, Homo sapiens
aaagcccatgtggaagtacagg

SEQ ID NO: 7986751 - DNA, 22 bp, Homo sapiens
aaagcccatgtggaagtacagg

SEQ ID NO: 7986752 - DNA, 22 bp, Homo sapiens
aaagccattgcagagcaggatt

SEQ ID NO: 7986753 - DNA, 22 bp, Homo sapiens
aaagccattgcagagcaggatt

SEQ ID NO: 7986754 - DNA, 22 bp, Homo sapiens
aaagccattacaaaatttcata

SEQ ID NO: 7986755 - DNA, 19 bp, Homo sapiens
aaagcagaggagcatctga

SEQ ID NO: 7986756 - DNA, 22 bp, Homo sapiens
aaagcagagcagggcacttatg

SEQ ID NO: 7986757 - DNA, 22 bp, Homo sapiens
aaagcagagcagggcacttatg

SEQ ID NO: 7986758 - DNA, 22 bp, Homo sapiens
aaagcagactgatttgcatcac

SEQ ID NO: 7986759 - DNA, 22 bp, Homo sapiens
aaagcagagatcatggcttgta

SEQ ID NO: 7986760 - DNA, 22 bp, Homo sapiens
aaagcagagatcatggcttgta

SEQ ID NO: 7986761 - DNA, 22 bp, Homo sapiens
aaagcagagatcatggcttgta

SEQ ID NO: 7986762 - DNA, 22 bp, Homo sapiens
aaagcagactgatttgcatcac

SEQ ID NO: 7986763 - DNA, 22 bp, Homo sapiens
aaagcagaactgagagagctgg

SEQ ID NO: 7986764 - DNA, 22 bp, Homo sapiens
aaagcagaactgagagagctgg

SEQ ID NO: 7986765 - DNA, 22 bp, Homo sapiens
aaagcacttgaaatctggcagt

SEQ ID NO: 7986766 - DNA, 22 bp, Homo sapiens
aaagcactttgagactgacagg

SEQ ID NO: 7986767 - DNA, 22 bp, Homo sapiens
aaagcactgcacatatatttgc

SEQ ID NO: 7986768 - DNA, 22 bp, Homo sapiens
aaagcactggagtcatcatcta

SEQ ID NO: 7986769 - DNA, 22 bp, Homo sapiens
aaagcactcgttagtatttctg

SEQ ID NO: 7986770 - DNA, 22 bp, Homo sapiens
aacactttcctgcctttctgat

SEQ ID NO: 7986771 - DNA, 22 bp, Homo sapiens
aaagcactcggcttcatccagg

SEQ ID NO: 7986772 - DNA, 23 bp, Homo sapiens
aacacttgcatgaacagctacac

SEQ ID NO: 7986773 - DNA, 23 bp, Homo sapiens
aacacttgcatgaacagctacac

SEQ ID NO: 7986774 - DNA, 22 bp, Homo sapiens
aaagcagaggtgatatgactta

SEQ ID NO: 7986775 - DNA, 22 bp, Homo sapiens
aaagcagaggtgatatgactta

SEQ ID NO: 7986776 - DNA, 22 bp, Homo sapiens
aaagcagaggtgatatgactta

SEQ ID NO: 7986777 - DNA, 19 bp, Homo sapiens
aaagcagaggagcatctga

SEQ ID NO: 7986778 - DNA, 19 bp, Homo sapiens
aaagcagaggagcatctga

SEQ ID NO: 7986779 - DNA, 19 bp, Homo sapiens
aaagcagaggagcatctga

SEQ ID NO: 7986780 - DNA, 22 bp, Homo sapiens
aaagcagaggtgatatgactta

SEQ ID NO: 7986781 - DNA, 22 bp, Homo sapiens
aaagcagattctgatgcagtag

SEQ ID NO: 7986782 - DNA, 22 bp, Homo sapiens
aaagcagattctgatgcagtag

SEQ ID NO: 7986783 - DNA, 22 bp, Homo sapiens
aaagcagaggttgcagtgagct

SEQ ID NO: 7986784 - DNA, 22 bp, Homo sapiens
aaagcagaggttgcagtgagct

SEQ ID NO: 7986785 - DNA, 22 bp, Homo sapiens
aaagcagaggttgcagtgagct

SEQ ID NO: 7986786 - DNA, 22 bp, Homo sapiens
aaagcagaggttgcagtgagct

SEQ ID NO: 7986787 - DNA, 22 bp, Homo sapiens
aaagcagaggttgcagtgagct

SEQ ID NO: 7986788 - DNA, 22 bp, Homo sapiens
aaagcagattctgatgcagtag

SEQ ID NO: 7986789 - DNA, 22 bp, Homo sapiens
aaagcagattctgatgcagtag

SEQ ID NO: 7986790 - DNA, 22 bp, Homo sapiens
aaagcagcaaatacttttgcac

SEQ ID NO: 7986791 - DNA, 22 bp, Homo sapiens
aaagcagcaacagctgttagaa

SEQ ID NO: 7986792 - DNA, 22 bp, Homo sapiens
aacagtgagaaggtggacagga

SEQ ID NO: 7986793 - DNA, 19 bp, Homo sapiens
aacagtgaggcccagcctg

SEQ ID NO: 7986794 - DNA, 19 bp, Homo sapiens
aacagtgaggcccagcctg

SEQ ID NO: 7986795 - DNA, 22 bp, Homo sapiens
aacataagggagcttcaaaact

SEQ ID NO: 7986796 - DNA, 22 bp, Homo sapiens
aacataagggagcttcaaaact

SEQ ID NO: 7986797 - DNA, 22 bp, Homo sapiens
aacagtgatatcaagacagaca

SEQ ID NO: 7986798 - DNA, 22 bp, Homo sapiens
aacagtgagttgatgactgaat

SEQ ID NO: 7986799 - DNA, 22 bp, Homo sapiens
aacagtgaggtgaatatgctcc

SEQ ID NO: 7986800 - DNA, 22 bp, Homo sapiens
aagactgaatttgcatagttgg

SEQ ID NO: 7986801 - DNA, 22 bp, Homo sapiens
aagactgagtggcttaagaaaa

SEQ ID NO: 7986802 - DNA, 22 bp, Homo sapiens
aagactgagttcaaatcacagc

SEQ ID NO: 7986803 - DNA, 22 bp, Homo sapiens
aagactgagtggcttaagaaaa

SEQ ID NO: 7986804 - DNA, 22 bp, Homo sapiens
aagactctgtatcatgagggag

SEQ ID NO: 7986805 - DNA, 22 bp, Homo sapiens
aagactctatctttagagatca

SEQ ID NO: 7986806 - DNA, 22 bp, Homo sapiens
aagactctatctttagagatca

SEQ ID NO: 7986807 - DNA, 22 bp, Homo sapiens
aagactctatctttagagatca

SEQ ID NO: 7986808 - DNA, 22 bp, Homo sapiens
aagactgatgtccagtcccatg

SEQ ID NO: 7986809 - DNA, 22 bp, Homo sapiens
aagactgtacattttccagtct

SEQ ID NO: 7986810 - DNA, 22 bp, Homo sapiens
aagactgatgtccagtcccatg

SEQ ID NO: 7986811 - DNA, 22 bp, Homo sapiens
aagactgtacattttccagtct

SEQ ID NO: 7986812 - DNA, 22 bp, Homo sapiens
aagactgtatattgagaaaaga

SEQ ID NO: 7986813 - DNA, 22 bp, Homo sapiens
aagactgtatattgagaaaaga

SEQ ID NO: 7986814 - DNA, 22 bp, Homo sapiens
aagactgtatgagacaatataa

SEQ ID NO: 7986815 - DNA, 22 bp, Homo sapiens
aaagtttagtgtcctctaccac

SEQ ID NO: 7986816 - DNA, 22 bp, Homo sapiens
aaagtttagtgtcctctaccac

SEQ ID NO: 7986817 - DNA, 22 bp, Homo sapiens
aaagtttaggctttgaaaccag

SEQ ID NO: 7986818 - DNA, 22 bp, Homo sapiens
aaagtttaggctttgaaaccag

SEQ ID NO: 7986819 - DNA, 22 bp, Homo sapiens
aaagtttacagtgcacatgggt

SEQ ID NO: 7986820 - DNA, 22 bp, Homo sapiens
aaagtttaggctttgaaaccag

SEQ ID NO: 7986821 - DNA, 22 bp, Homo sapiens
aaagtttacagtgcacatgggt

SEQ ID NO: 7986822 - DNA, 22 bp, Homo sapiens
aagactgatgtccagtcccatg

SEQ ID NO: 7986823 - DNA, 22 bp, Homo sapiens
aagactgtcttttctgagtgac

SEQ ID NO: 7986824 - DNA, 22 bp, Homo sapiens
aaagttgtttcctaaggtctaa

SEQ ID NO: 7986825 - DNA, 22 bp, Homo sapiens
aagactgtgtctatggctactc

SEQ ID NO: 7986826 - DNA, 22 bp, Homo sapiens
aagacccttctctgaggaggaa

SEQ ID NO: 7986827 - DNA, 22 bp, Homo sapiens
aagacctctgaggtagaagttc

SEQ ID NO: 7986828 - DNA, 22 bp, Homo sapiens
aagacctgcagtttctctacct

SEQ ID NO: 7986829 - DNA, 22 bp, Homo sapiens
aagacctgcatgcggactaaca

SEQ ID NO: 7986830 - DNA, 22 bp, Homo sapiens
aagaccctacccctggagagga

SEQ ID NO: 7986831 - DNA, 22 bp, Homo sapiens
aagaccctacccctggagagga

SEQ ID NO: 7986832 - DNA, 22 bp, Homo sapiens
aagacagatgcaacctgctagc

SEQ ID NO: 7986833 - DNA, 22 bp, Homo sapiens
aagacagatgcaacctgctagc

SEQ ID NO: 7986834 - DNA, 22 bp, Homo sapiens
aagacagatgcaacctgctagc

SEQ ID NO: 7986835 - DNA, 17 bp, Homo sapiens
aagaccctagtctaccc

SEQ ID NO: 7986836 - DNA, 22 bp, Homo sapiens
aagaccctatactcagtgaccc

SEQ ID NO: 7986837 - DNA, 22 bp, Homo sapiens
aagactcaaggaacaacacagt

SEQ ID NO: 7986838 - DNA, 22 bp, Homo sapiens
aagactcaaggaacaacacagt

SEQ ID NO: 7986839 - DNA, 22 bp, Homo sapiens
aagactcaaggaacaacacagt

SEQ ID NO: 7986840 - DNA, 22 bp, Homo sapiens
aagactagtgaaacatcaaact

SEQ ID NO: 7986841 - DNA, 22 bp, Homo sapiens
aagactagggtgtgtttaatct

SEQ ID NO: 7986842 - DNA, 22 bp, Homo sapiens
aagactaaatgtgttctaaagt

SEQ ID NO: 7986843 - DNA, 22 bp, Homo sapiens
aagactaaatgtgttctaaagt

SEQ ID NO: 7986844 - DNA, 22 bp, Homo sapiens
aagactaaatgtgttctaaagt

SEQ ID NO: 7986845 - DNA, 22 bp, Homo sapiens
aagactaaatgtgttctaaagt

SEQ ID NO: 7986846 - DNA, 22 bp, Homo sapiens
aagactagaccagtgaatagga

SEQ ID NO: 7986847 - DNA, 22 bp, Homo sapiens
aagactagaccagtgaatagga

SEQ ID NO: 7986848 - DNA, 23 bp, Homo sapiens
aagactaattcttaattgcttag

SEQ ID NO: 7986849 - DNA, 22 bp, Homo sapiens
aagacgcaccctttgagggcac

SEQ ID NO: 7986850 - DNA, 22 bp, Homo sapiens
aagacctgcgttatcctgcctg

SEQ ID NO: 7986851 - DNA, 22 bp, Homo sapiens
aagacctgccagcctcatcctg

SEQ ID NO: 7986852 - DNA, 22 bp, Homo sapiens
aagacctgggagagattgggtt

SEQ ID NO: 7986853 - DNA, 22 bp, Homo sapiens
aaagtgattatgctgtcaaaga

SEQ ID NO: 7986854 - DNA, 22 bp, Homo sapiens
aaagtgatgccaggagtctggt

SEQ ID NO: 7986855 - DNA, 22 bp, Homo sapiens
aaagtgaggacttgagtactgt

SEQ ID NO: 7986856 - DNA, 22 bp, Homo sapiens
aaagtgaggacttgagtactgt

SEQ ID NO: 7986857 - DNA, 22 bp, Homo sapiens
aaagtgaatgtatcccgtaagt

SEQ ID NO: 7986858 - DNA, 22 bp, Homo sapiens
aaagtgaatgtatcccgtaagt

SEQ ID NO: 7986859 - DNA, 19 bp, Homo sapiens
aaagtgaatgctgttttct

SEQ ID NO: 7986860 - DNA, 19 bp, Homo sapiens
aaagtgaatgctgttttct

SEQ ID NO: 7986861 - DNA, 22 bp, Homo sapiens
aaagtgacaaccagcaggactt

SEQ ID NO: 7986862 - DNA, 22 bp, Homo sapiens
aaagtgaattgatttaagggga

SEQ ID NO: 7986863 - DNA, 22 bp, Homo sapiens
aagaacatgctataattatctt

SEQ ID NO: 7986864 - DNA, 22 bp, Homo sapiens
aagaacatgatggccatgtgca

SEQ ID NO: 7986865 - DNA, 22 bp, Homo sapiens
aagaacatgatggccatgtgca

SEQ ID NO: 7986866 - DNA, 22 bp, Homo sapiens
aagaacatgagttatgatgatt

SEQ ID NO: 7986867 - DNA, 22 bp, Homo sapiens
aagaacatggtaggataacaaa

SEQ ID NO: 7986868 - DNA, 22 bp, Homo sapiens
aagaacatgggtgtgggcattc

SEQ ID NO: 7986869 - DNA, 22 bp, Homo sapiens
aagaacatggtaggataacaaa

SEQ ID NO: 7986870 - DNA, 22 bp, Homo sapiens
aaagtgatttaagtacctcagg

SEQ ID NO: 7986871 - DNA, 22 bp, Homo sapiens
aaagtgatttaagtacctcagg

SEQ ID NO: 7986872 - DNA, 22 bp, Homo sapiens
aaagtgatttaagtacctcagg

SEQ ID NO: 7986873 - DNA, 22 bp, Homo sapiens
aaagtgcaatcagttagaccat

SEQ ID NO: 7986874 - DNA, 22 bp, Homo sapiens
aaagtgcactagaatccagatt

SEQ ID NO: 7986875 - DNA, 20 bp, Homo sapiens
aaagtgcacagatacagctc

SEQ ID NO: 7986876 - DNA, 22 bp, Homo sapiens
aaagtgcagaactgttctcact

SEQ ID NO: 7986877 - DNA, 22 bp, Homo sapiens
aaagtgcactctcagtgctgct

SEQ ID NO: 7986878 - DNA, 22 bp, Homo sapiens
aaagtgcagaactgttctcact

SEQ ID NO: 7986879 - DNA, 22 bp, Homo sapiens
aaagtgcagaactgttctcact

SEQ ID NO: 7986880 - DNA, 22 bp, Homo sapiens
aaagtgcactagaatccagatt

SEQ ID NO: 7986881 - DNA, 22 bp, Homo sapiens
aaagtgcactctcagtgctgct

SEQ ID NO: 7986882 - DNA, 22 bp, Homo sapiens
aaagtgcactctcagtgctgct

SEQ ID NO: 7986883 - DNA, 22 bp, Homo sapiens
aaagtgcagctgaaaacatcct

SEQ ID NO: 7986884 - DNA, 22 bp, Homo sapiens
aaagtgcagctgaaaacatcct

SEQ ID NO: 7986885 - DNA, 22 bp, Homo sapiens
aaagtgcagctgaaaacatcct

SEQ ID NO: 7986886 - DNA, 22 bp, Homo sapiens
aagacagagggaagcaatgatg

SEQ ID NO: 7986887 - DNA, 22 bp, Homo sapiens
aagacagatgcaacctgctagc

SEQ ID NO: 7986888 - DNA, 22 bp, Homo sapiens
aaagttttagaactaggaagca

SEQ ID NO: 7986889 - DNA, 22 bp, Homo sapiens
aaagttttagctgtccagttcc

SEQ ID NO: 7986890 - DNA, 22 bp, Homo sapiens
aaagttttatatgctgcagcga

SEQ ID NO: 7986891 - DNA, 22 bp, Homo sapiens
aaagtttgtcacttggctagaa

SEQ ID NO: 7986892 - DNA, 22 bp, Homo sapiens
aaagtttgttatatgataagga

SEQ ID NO: 7986893 - DNA, 22 bp, Homo sapiens
aaagtttgttgcttacaaagaa

SEQ ID NO: 7986894 - DNA, 22 bp, Homo sapiens
aaagttttagaactaggaagca

SEQ ID NO: 7986895 - DNA, 22 bp, Homo sapiens
aaagtttattttccctggttag

SEQ ID NO: 7986896 - DNA, 22 bp, Homo sapiens
aaagtttcaatagaggaagtgg

SEQ ID NO: 7986897 - DNA, 22 bp, Homo sapiens
aaagtttatcatagccggggac

SEQ ID NO: 7986898 - DNA, 22 bp, Homo sapiens
aaagtttatcatagccggggac

SEQ ID NO: 7986899 - DNA, 22 bp, Homo sapiens
aaagtttattttccctggttag

SEQ ID NO: 7986900 - DNA, 22 bp, Homo sapiens
aaagtttcctgctaagtgctat

SEQ ID NO: 7986901 - DNA, 22 bp, Homo sapiens
aaagtttcccaaagtaatgtga

SEQ ID NO: 7986902 - DNA, 22 bp, Homo sapiens
aaagtttattttccctggttag

SEQ ID NO: 7986903 - DNA, 22 bp, Homo sapiens
aaagtttgcaatttatgttaat

SEQ ID NO: 7986904 - DNA, 22 bp, Homo sapiens
aaagtttgagtgatttgacaca

SEQ ID NO: 7986905 - DNA, 22 bp, Homo sapiens
aaagtttgaatgatatattagt

SEQ ID NO: 7986906 - DNA, 22 bp, Homo sapiens
aaagtttcctgctaagtgctat

SEQ ID NO: 7986907 - DNA, 23 bp, Homo sapiens
aaagtttgaagcaacagtagttg

SEQ ID NO: 7986908 - DNA, 23 bp, Homo sapiens
aaagtttgaagcaacagtagttg

SEQ ID NO: 7986909 - DNA, 22 bp, Homo sapiens
aagagggaaattgttggctgct

SEQ ID NO: 7986910 - DNA, 22 bp, Homo sapiens
aagaggaggatgctttacagct

SEQ ID NO: 7986911 - DNA, 22 bp, Homo sapiens
aagagggaagtcacctggaggt

SEQ ID NO: 7986912 - DNA, 22 bp, Homo sapiens
aagagggaagtcacctggaggt

SEQ ID NO: 7986913 - DNA, 22 bp, Homo sapiens
aagagggaagtcacctggaggt

SEQ ID NO: 7986914 - DNA, 22 bp, Homo sapiens
aagagggagggcaaaggcactg

SEQ ID NO: 7986915 - DNA, 22 bp, Homo sapiens
aagagggctgcaatcttattgc

SEQ ID NO: 7986916 - DNA, 22 bp, Homo sapiens
aagagggctgcaatcttattgc

SEQ ID NO: 7986917 - DNA, 22 bp, Homo sapiens
aagagggctgcaatcttattgc

SEQ ID NO: 7986918 - DNA, 22 bp, Homo sapiens
aagagggctgcaatcttattgc

SEQ ID NO: 7986919 - DNA, 22 bp, Homo sapiens
aagagggcagcacaggtgggtc

SEQ ID NO: 7986920 - DNA, 22 bp, Homo sapiens
aagagggaggtgcgggtgcaga

SEQ ID NO: 7986921 - DNA, 22 bp, Homo sapiens
aagagggaggtgcgggtgcaga

SEQ ID NO: 7986922 - DNA, 22 bp, Homo sapiens
aagagggaggtgcgggtgcaga

SEQ ID NO: 7986923 - DNA, 22 bp, Homo sapiens
aagataaactcttgatttctga

SEQ ID NO: 7986924 - DNA, 22 bp, Homo sapiens
aagatatattcgacgtgaatga

SEQ ID NO: 7986925 - DNA, 22 bp, Homo sapiens
aagataacaggaggagtttgta

SEQ ID NO: 7986926 - DNA, 22 bp, Homo sapiens
aagatatagatggtggtataaa

SEQ ID NO: 7986927 - DNA, 22 bp, Homo sapiens
aagataaactcttgatttctga

SEQ ID NO: 7986928 - DNA, 22 bp, Homo sapiens
aagataaactcttgatttctga

SEQ ID NO: 7986929 - DNA, 22 bp, Homo sapiens
aaatactggttttggagatgct

SEQ ID NO: 7986930 - DNA, 22 bp, Homo sapiens
aaatactgggctcaaaagggtt

SEQ ID NO: 7986931 - DNA, 22 bp, Homo sapiens
aaatactggttttggagatgct

SEQ ID NO: 7986932 - DNA, 21 bp, Homo sapiens
aaatactgggcagtgacttga

SEQ ID NO: 7986933 - DNA, 22 bp, Homo sapiens
aaatactggcaagtgctaattc

SEQ ID NO: 7986934 - DNA, 21 bp, Homo sapiens
aaatactgggcagtgacttga

SEQ ID NO: 7986935 - DNA, 22 bp, Homo sapiens
aaatactattgaccaggtctct

SEQ ID NO: 7986936 - DNA, 22 bp, Homo sapiens
aaatactcatcccaggaactgg

SEQ ID NO: 7986937 - DNA, 22 bp, Homo sapiens
aaatactgctgctattcctttt

SEQ ID NO: 7986938 - DNA, 22 bp, Homo sapiens
aaatactgctgctattcctttt

SEQ ID NO: 7986939 - DNA, 19 bp, Homo sapiens
aaatactgaagttgttcat

SEQ ID NO: 7986940 - DNA, 22 bp, Homo sapiens
aaatactgctgctattcctttt

SEQ ID NO: 7986941 - DNA, 22 bp, Homo sapiens
aaatactggcaagtgctaattc

SEQ ID NO: 7986942 - DNA, 22 bp, Homo sapiens
aaatactggcaagtgctaattc

SEQ ID NO: 7986943 - DNA, 22 bp, Homo sapiens
aaatacatttacagtcgtggct

SEQ ID NO: 7986944 - DNA, 22 bp, Homo sapiens
aaatacatttacagtcgtggct

SEQ ID NO: 7986945 - DNA, 23 bp, Homo sapiens
aaatacctgaattagatattatc

SEQ ID NO: 7986946 - DNA, 22 bp, Homo sapiens
aaatacatttacagtcgtggct

SEQ ID NO: 7986947 - DNA, 22 bp, Homo sapiens
aaatactagaattcagagttga

SEQ ID NO: 7986948 - DNA, 22 bp, Homo sapiens
aaatactagaattcagagttga

SEQ ID NO: 7986949 - DNA, 23 bp, Homo sapiens
aaatacctgaattagatattatc

SEQ ID NO: 7986950 - DNA, 23 bp, Homo sapiens
aaatacctgaattagatattatc

SEQ ID NO: 7986951 - DNA, 22 bp, Homo sapiens
aagaggggtggtctgtgaggat

SEQ ID NO: 7986952 - DNA, 22 bp, Homo sapiens
aagaggggtggtctgtgaggat

SEQ ID NO: 7986953 - DNA, 22 bp, Homo sapiens
aagaggggtggtctgtgaggat

SEQ ID NO: 7986954 - DNA, 22 bp, Homo sapiens
aagaggggtggtctgtgaggat

SEQ ID NO: 7986955 - DNA, 22 bp, Homo sapiens
aagaggtagcagtcacaaaaga

SEQ ID NO: 7986956 - DNA, 22 bp, Homo sapiens
aagaggtaatgactgcttgagt

SEQ ID NO: 7986957 - DNA, 22 bp, Homo sapiens
aagaggtaaccatagcaaccac

SEQ ID NO: 7986958 - DNA, 22 bp, Homo sapiens
aagcagcatcctgggcagacct

SEQ ID NO: 7986959 - DNA, 22 bp, Homo sapiens
aagcaggagagcctgggcgagc

SEQ ID NO: 7986960 - DNA, 22 bp, Homo sapiens
aagcagcatatgacagcatcca

SEQ ID NO: 7986961 - DNA, 22 bp, Homo sapiens
aagcagcatatgacagcatcca

SEQ ID NO: 7986962 - DNA, 22 bp, Homo sapiens
aagattctcactgctcaacttt

SEQ ID NO: 7986963 - DNA, 22 bp, Homo sapiens
aagattctcagaaaaaggctat

SEQ ID NO: 7986964 - DNA, 22 bp, Homo sapiens
aagcagcatagctcccttagtt

SEQ ID NO: 7986965 - DNA, 20 bp, Homo sapiens
aagattcattgtaattaggg

SEQ ID NO: 7986966 - DNA, 22 bp, Homo sapiens
aagattcccagagaagttccac

SEQ ID NO: 7986967 - DNA, 22 bp, Homo sapiens
aagattctacaaactctggtaa

SEQ ID NO: 7986968 - DNA, 22 bp, Homo sapiens
aagattccctgaatggttcacc

SEQ ID NO: 7986969 - DNA, 22 bp, Homo sapiens
aagattctacagtaggtacatt

SEQ ID NO: 7986970 - DNA, 22 bp, Homo sapiens
aagattctacagtaggtacatt

SEQ ID NO: 7986971 - DNA, 22 bp, Homo sapiens
aagattctacagtaggtacatt

SEQ ID NO: 7986972 - DNA, 22 bp, Homo sapiens
aagattctagaggaacttctta

SEQ ID NO: 7986973 - DNA, 22 bp, Homo sapiens
aagattctacagtaggtacatt

SEQ ID NO: 7986974 - DNA, 22 bp, Homo sapiens
aagattctacagtaggtacatt

SEQ ID NO: 7986975 - DNA, 22 bp, Homo sapiens
aagattcccagagaagttccac

SEQ ID NO: 7986976 - DNA, 22 bp, Homo sapiens
aagattctagaggaacttctta

SEQ ID NO: 7986977 - DNA, 20 bp, Homo sapiens
aagattcattgtaattaggg

SEQ ID NO: 7986978 - DNA, 22 bp, Homo sapiens
aagattcacagagtgaatgaaa

SEQ ID NO: 7986979 - DNA, 22 bp, Homo sapiens
aagattcacagagtgaatgaaa

SEQ ID NO: 7986980 - DNA, 22 bp, Homo sapiens
aagattcacagagtgaatgaaa

SEQ ID NO: 7986981 - DNA, 22 bp, Homo sapiens
aagattatttaagacaggaacc

SEQ ID NO: 7986982 - DNA, 22 bp, Homo sapiens
aagattatttaagacaggaacc

SEQ ID NO: 7986983 - DNA, 22 bp, Homo sapiens
aagattatggcagataacaatt

SEQ ID NO: 7986984 - DNA, 22 bp, Homo sapiens
aagattatggcagataacaatt

SEQ ID NO: 7986985 - DNA, 22 bp, Homo sapiens
aagattatggcagataacaatt

SEQ ID NO: 7986986 - DNA, 22 bp, Homo sapiens
aagattatttaagacaggaacc

SEQ ID NO: 7986987 - DNA, 22 bp, Homo sapiens
aagattatggcagataacaatt

SEQ ID NO: 7986988 - DNA, 22 bp, Homo sapiens
aagcaggagatgcaggaatgta

SEQ ID NO: 7986989 - DNA, 22 bp, Homo sapiens
aagcaggagatgcaggaatgta

SEQ ID NO: 7986990 - DNA, 22 bp, Homo sapiens
aagcaggagatgcaggaatgta

SEQ ID NO: 7986991 - DNA, 22 bp, Homo sapiens
aagcaggagatgcaggaatgta

SEQ ID NO: 7986992 - DNA, 22 bp, Homo sapiens
aagcaggagatgcaggaatgta

SEQ ID NO: 7986993 - DNA, 22 bp, Homo sapiens
aagcaggagatgcaggaatgta

SEQ ID NO: 7986994 - DNA, 22 bp, Homo sapiens
aagcaggagatgggtgcttttc

SEQ ID NO: 7986995 - DNA, 22 bp, Homo sapiens
aagcaggatggaggttgagtta

SEQ ID NO: 7986996 - DNA, 22 bp, Homo sapiens
aagcaggatggaggttgagtta

SEQ ID NO: 7986997 - DNA, 22 bp, Homo sapiens
aagcaggagatgggtgcttttc

SEQ ID NO: 7986998 - DNA, 22 bp, Homo sapiens
aagcaggagatgggtgcttttc

SEQ ID NO: 7986999 - DNA, 22 bp, Homo sapiens
aagcaggagagcctgggtgagc

SEQ ID NO: 7987000 - DNA, 22 bp, Homo sapiens
aagcaggagatgcaggaatgta

SEQ ID NO: 7987001 - DNA, 22 bp, Homo sapiens
aagcaggagatgcaggaatgta

SEQ ID NO: 7987002 - DNA, 22 bp, Homo sapiens
aagcaggagatgcaggaatgta

SEQ ID NO: 7987003 - DNA, 22 bp, Homo sapiens
aagcaggagagcctgggcgagc

SEQ ID NO: 7987004 - DNA, 22 bp, Homo sapiens
aagcaggagagcctgggcgagc

SEQ ID NO: 7987005 - DNA, 22 bp, Homo sapiens
aagcaggagagcctgggtgagc

SEQ ID NO: 7987006 - DNA, 22 bp, Homo sapiens
aagcaggagagcctgggtgagc

SEQ ID NO: 7987007 - DNA, 22 bp, Homo sapiens
aagcaggagagcctgggtgagc

SEQ ID NO: 7987008 - DNA, 22 bp, Homo sapiens
aagcaggagagcctgggtgagc

SEQ ID NO: 7987009 - DNA, 22 bp, Homo sapiens
aagcaggcaaggttgtggggca

SEQ ID NO: 7987010 - DNA, 22 bp, Homo sapiens
aagcaggatggatctagtgttc

SEQ ID NO: 7987011 - DNA, 22 bp, Homo sapiens
aagcaggatggatctagtgttc

SEQ ID NO: 7987012 - DNA, 22 bp, Homo sapiens
aagcaggatggaggttgagtta

SEQ ID NO: 7987013 - DNA, 22 bp, Homo sapiens
aagcaggatggatctagtgttc

SEQ ID NO: 7987014 - DNA, 22 bp, Homo sapiens
aagcaggcagggtggagagttt

SEQ ID NO: 7987015 - DNA, 22 bp, Homo sapiens
aagcaggcaaggttgtggggca

SEQ ID NO: 7987016 - DNA, 22 bp, Homo sapiens
aagcaggcagggtggagagttt

SEQ ID NO: 7987017 - DNA, 22 bp, Homo sapiens
aagcaggcatgggaggccatcc

SEQ ID NO: 7987018 - DNA, 22 bp, Homo sapiens
aagcaggcatcttggaggtcaa

SEQ ID NO: 7987019 - DNA, 22 bp, Homo sapiens
aagcaggcatcttggaggtcaa

SEQ ID NO: 7987020 - DNA, 22 bp, Homo sapiens
aagcaggcatcttggaggtcaa

SEQ ID NO: 7987021 - DNA, 22 bp, Homo sapiens
aagatgttgtcgttagtgatga

SEQ ID NO: 7987022 - DNA, 22 bp, Homo sapiens
aagatgttgcattagaatacct

SEQ ID NO: 7987023 - DNA, 22 bp, Homo sapiens
aagatgttgggtgcctccggaa

SEQ ID NO: 7987024 - DNA, 22 bp, Homo sapiens
aagatgttgtcgttagtgatga

SEQ ID NO: 7987025 - DNA, 18 bp, Homo sapiens
aagatgtttaatgggaag

SEQ ID NO: 7987026 - DNA, 18 bp, Homo sapiens
aagatgtttaatgggaag

SEQ ID NO: 7987027 - DNA, 22 bp, Homo sapiens
aagatgtttagatttatacaat

SEQ ID NO: 7987028 - DNA, 22 bp, Homo sapiens
aagatgtttagatttatacaat

SEQ ID NO: 7987029 - DNA, 22 bp, Homo sapiens
aagatgttttaatatttcgagg

SEQ ID NO: 7987030 - DNA, 22 bp, Homo sapiens
aagattaaaggggagacaagct

SEQ ID NO: 7987031 - DNA, 22 bp, Homo sapiens
aagattaaaggggagacaagct

SEQ ID NO: 7987032 - DNA, 22 bp, Homo sapiens
aagattactacggaacatgacc

SEQ ID NO: 7987033 - DNA, 22 bp, Homo sapiens
aagatgtttaggtaaaaagttt

SEQ ID NO: 7987034 - DNA, 22 bp, Homo sapiens
aagatgtttaggtaaaaagttt

SEQ ID NO: 7987035 - DNA, 22 bp, Homo sapiens
aagatccaggcaaaagttggaa

SEQ ID NO: 7987036 - DNA, 22 bp, Homo sapiens
aagatccatgagggcagagatt

SEQ ID NO: 7987037 - DNA, 21 bp, Homo sapiens
aagatccaagcaggcacttgt

SEQ ID NO: 7987038 - DNA, 22 bp, Homo sapiens
aagatccaggcaaaagttggaa

SEQ ID NO: 7987039 - DNA, 22 bp, Homo sapiens
aagatcataatatttatctcat

SEQ ID NO: 7987040 - DNA, 22 bp, Homo sapiens
aagatccatgggaatgtttggc

SEQ ID NO: 7987041 - DNA, 23 bp, Homo sapiens
aagatccattcaaattatgtatc

SEQ ID NO: 7987042 - DNA, 22 bp, Homo sapiens
aagatccatgggaatgtttggc

SEQ ID NO: 7987043 - DNA, 22 bp, Homo sapiens
aagatgttgcaagggactcttc

SEQ ID NO: 7987044 - DNA, 22 bp, Homo sapiens
aagatgttgcaagggactcttc

SEQ ID NO: 7987045 - DNA, 22 bp, Homo sapiens
aagatgttgcattagaatacct

SEQ ID NO: 7987046 - DNA, 22 bp, Homo sapiens
aagatcctgtactttcctcact

SEQ ID NO: 7987047 - DNA, 23 bp, Homo sapiens
aagatccattcaaattatgtatc

SEQ ID NO: 7987048 - DNA, 22 bp, Homo sapiens
aagatcctgcttttgcttctgt

SEQ ID NO: 7987049 - DNA, 21 bp, Homo sapiens
aagatcccagagtgctcagta

SEQ ID NO: 7987050 - DNA, 22 bp, Homo sapiens
aagatattcaaagatttattag

SEQ ID NO: 7987051 - DNA, 22 bp, Homo sapiens
aagatattcaaagatttattag

SEQ ID NO: 7987052 - DNA, 22 bp, Homo sapiens
aagatatattttggtgatttca

SEQ ID NO: 7987053 - DNA, 22 bp, Homo sapiens
aagatatattttggtgatttca

SEQ ID NO: 7987054 - DNA, 22 bp, Homo sapiens
aagatattcaaagatttattag

SEQ ID NO: 7987055 - DNA, 22 bp, Homo sapiens
aagatattttagaacattcact

SEQ ID NO: 7987056 - DNA, 22 bp, Homo sapiens
aagatcaagatcagagaacagc

SEQ ID NO: 7987057 - DNA, 22 bp, Homo sapiens
aagatcaagatcagagaacagc

SEQ ID NO: 7987058 - DNA, 22 bp, Homo sapiens
aagatattttagaacattcact

SEQ ID NO: 7987059 - DNA, 22 bp, Homo sapiens
aagatattttagaacattcact

SEQ ID NO: 7987060 - DNA, 14 bp, Homo sapiens
aagatcaccttcct

SEQ ID NO: 7987061 - DNA, 14 bp, Homo sapiens
aagatcaccttcct

SEQ ID NO: 7987062 - DNA, 18 bp, Homo sapiens
aagatcacaaaatagctg

SEQ ID NO: 7987063 - DNA, 22 bp, Homo sapiens
aagatcaagtgctggcagtgtt

SEQ ID NO: 7987064 - DNA, 22 bp, Homo sapiens
aagatcaagtgtactttatgta

SEQ ID NO: 7987065 - DNA, 22 bp, Homo sapiens
aagatcaagatcagagaacagc

SEQ ID NO: 7987066 - DNA, 22 bp, Homo sapiens
aagatcagaactttatacagga

SEQ ID NO: 7987067 - DNA, 22 bp, Homo sapiens
aagatcaccttgacatgaaaag

SEQ ID NO: 7987068 - DNA, 14 bp, Homo sapiens
aagatcaccttcct

SEQ ID NO: 7987069 - DNA, 22 bp, Homo sapiens
aagatcagctcccgagtctgag

SEQ ID NO: 7987070 - DNA, 22 bp, Homo sapiens
aagatcagaactttatacagga

SEQ ID NO: 7987071 - DNA, 22 bp, Homo sapiens
aagatcaggcgtggaaaacact

SEQ ID NO: 7987072 - DNA, 22 bp, Homo sapiens
aagatcagctcccgagtctgag

SEQ ID NO: 7987073 - DNA, 22 bp, Homo sapiens
aagatcaggcgtggaaaacact

SEQ ID NO: 7987074 - DNA, 22 bp, Homo sapiens
aagatcaggcgtggaaaacact

SEQ ID NO: 7987075 - DNA, 22 bp, Homo sapiens
aagatcaggcgtggaaaacact

SEQ ID NO: 7987076 - DNA, 22 bp, Homo sapiens
aaatgcatggtaaatgattgcc

SEQ ID NO: 7987077 - DNA, 22 bp, Homo sapiens
aagccttcagtccgttgcagag

SEQ ID NO: 7987078 - DNA, 22 bp, Homo sapiens
aaatgcatggctgttttaaagc

SEQ ID NO: 7987079 - DNA, 22 bp, Homo sapiens
aaatgcatggctgttttaaagc

SEQ ID NO: 7987080 - DNA, 22 bp, Homo sapiens
aaatgcatggctgttttaaagc

SEQ ID NO: 7987081 - DNA, 22 bp, Homo sapiens
aaatgcatgtagaataatagag

SEQ ID NO: 7987082 - DNA, 22 bp, Homo sapiens
aaatgcatgtagaataatagag

SEQ ID NO: 7987083 - DNA, 22 bp, Homo sapiens
aaatgcatgtagaataatagag

SEQ ID NO: 7987084 - DNA, 22 bp, Homo sapiens
aaatgcatgtatgtaatatgct

SEQ ID NO: 7987085 - DNA, 22 bp, Homo sapiens
aagccttcagtccgttgcagag

SEQ ID NO: 7987086 - DNA, 22 bp, Homo sapiens
aagccttcagagttggctggtc

SEQ ID NO: 7987087 - DNA, 22 bp, Homo sapiens
aagccttcagagttggctggtc

SEQ ID NO: 7987088 - DNA, 22 bp, Homo sapiens
aagcctgtgtttctgctagtct

SEQ ID NO: 7987089 - DNA, 22 bp, Homo sapiens
aagcctggcacattggagtctg

SEQ ID NO: 7987090 - DNA, 22 bp, Homo sapiens
aagccttaaatgtttctaatat

SEQ ID NO: 7987091 - DNA, 22 bp, Homo sapiens
aagcctgctttgttccacagca

SEQ ID NO: 7987092 - DNA, 22 bp, Homo sapiens
aagcctggcacattggagtctg

SEQ ID NO: 7987093 - DNA, 22 bp, Homo sapiens
aagcctgagggtgttgctagat

SEQ ID NO: 7987094 - DNA, 22 bp, Homo sapiens
aagcctctggggcctcatctgt

SEQ ID NO: 7987095 - DNA, 22 bp, Homo sapiens
aagcctctggggcctcatctgt

SEQ ID NO: 7987096 - DNA, 22 bp, Homo sapiens
aagcctcaccttttagaagcta

SEQ ID NO: 7987097 - DNA, 22 bp, Homo sapiens
aagcctccttattaaaggatat

SEQ ID NO: 7987098 - DNA, 22 bp, Homo sapiens
aagccctgtcaccctgacttca

SEQ ID NO: 7987099 - DNA, 22 bp, Homo sapiens
aagccctgtaaattgcccttaa

SEQ ID NO: 7987100 - DNA, 22 bp, Homo sapiens
aagccctgtcaccctgacttca

SEQ ID NO: 7987101 - DNA, 22 bp, Homo sapiens
aagcccagatgggagcatttca

SEQ ID NO: 7987102 - DNA, 22 bp, Homo sapiens
aagccctgtcaccctgacttca

SEQ ID NO: 7987103 - DNA, 22 bp, Homo sapiens
aagccctgtccggggggaagaa

SEQ ID NO: 7987104 - DNA, 22 bp, Homo sapiens
aagccctgttctttctctcacc

SEQ ID NO: 7987105 - DNA, 22 bp, Homo sapiens
aagccctgttaggcactgggga

SEQ ID NO: 7987106 - DNA, 22 bp, Homo sapiens
aagccctgttctttctctcacc

SEQ ID NO: 7987107 - DNA, 22 bp, Homo sapiens
aagccctgttaggcactgggga

SEQ ID NO: 7987108 - DNA, 22 bp, Homo sapiens
aagcccttggcagagttcccca

SEQ ID NO: 7987109 - DNA, 22 bp, Homo sapiens
aagccctgttctttctctcacc

SEQ ID NO: 7987110 - DNA, 21 bp, Homo sapiens
aagcccttgaaatagatatat

SEQ ID NO: 7987111 - DNA, 22 bp, Homo sapiens
aagcccttggcagagttcccca

SEQ ID NO: 7987112 - DNA, 22 bp, Homo sapiens
aagcccttggcgcacaccgggc

SEQ ID NO: 7987113 - DNA, 22 bp, Homo sapiens
aagccgggcctgagaaatgaca

SEQ ID NO: 7987114 - DNA, 22 bp, Homo sapiens
aagccgggcctgagaaatgaca

SEQ ID NO: 7987115 - DNA, 22 bp, Homo sapiens
aagccgggcctgagaaatgaca

SEQ ID NO: 7987116 - DNA, 22 bp, Homo sapiens
aagcctaggcctactctggttt

SEQ ID NO: 7987117 - DNA, 21 bp, Homo sapiens
aagcctcaagcagaagacaga

SEQ ID NO: 7987118 - DNA, 21 bp, Homo sapiens
aagcctcaagcagaagacaga

SEQ ID NO: 7987119 - DNA, 22 bp, Homo sapiens
aagccgaggccacacagcagga

SEQ ID NO: 7987120 - DNA, 22 bp, Homo sapiens
aaatctttccctttactatcca

SEQ ID NO: 7987121 - DNA, 22 bp, Homo sapiens
aagcccagatgagatccctgga

SEQ ID NO: 7987122 - DNA, 22 bp, Homo sapiens
aagcccagatgggagcatttca

SEQ ID NO: 7987123 - DNA, 22 bp, Homo sapiens
aagcccagatgggagcatttca

SEQ ID NO: 7987124 - DNA, 22 bp, Homo sapiens
aagcccagatgggagcatttca

SEQ ID NO: 7987125 - DNA, 22 bp, Homo sapiens
aagcccagatgtgagaactgag

SEQ ID NO: 7987126 - DNA, 22 bp, Homo sapiens
aagcccagatgtgagaactgag

SEQ ID NO: 7987127 - DNA, 22 bp, Homo sapiens
aagcccagatgggagcatttca

SEQ ID NO: 7987128 - DNA, 22 bp, Homo sapiens
aaatctttccctttactatcca

SEQ ID NO: 7987129 - DNA, 22 bp, Homo sapiens
aaatctttccctttactatcca

SEQ ID NO: 7987130 - DNA, 22 bp, Homo sapiens
aaatctggttcagtaagtcctc

SEQ ID NO: 7987131 - DNA, 22 bp, Homo sapiens
aaatctgttgtaatgtttttta

SEQ ID NO: 7987132 - DNA, 22 bp, Homo sapiens
aaatctgtttcaggtatatttg

SEQ ID NO: 7987133 - DNA, 22 bp, Homo sapiens
aaatctgtttcaggtatatttg

SEQ ID NO: 7987134 - DNA, 22 bp, Homo sapiens
aaatctgggtcaaggtggagtg

SEQ ID NO: 7987135 - DNA, 22 bp, Homo sapiens
aaatctgagaaatattgtccag

SEQ ID NO: 7987136 - DNA, 22 bp, Homo sapiens
aaatctctgaacttaataatgc

SEQ ID NO: 7987137 - DNA, 22 bp, Homo sapiens
aaatctctgcaggcaaatgtga

SEQ ID NO: 7987138 - DNA, 22 bp, Homo sapiens
aaatctctggcagaaataaact

SEQ ID NO: 7987139 - DNA, 22 bp, Homo sapiens
aaatctcactgtagtcaaagtg

SEQ ID NO: 7987140 - DNA, 22 bp, Homo sapiens
aaatctcaatttgaattgtagc

SEQ ID NO: 7987141 - DNA, 22 bp, Homo sapiens
aaatctcaatttgaattgtagc

SEQ ID NO: 7987142 - DNA, 22 bp, Homo sapiens
aaatctcactgtagtcaaagtg

SEQ ID NO: 7987143 - DNA, 22 bp, Homo sapiens
aaatctcactgtagtcaaagtg

SEQ ID NO: 7987144 - DNA, 22 bp, Homo sapiens
aaatctcactggcaggcaggca

SEQ ID NO: 7987145 - DNA, 22 bp, Homo sapiens
aaatctcagcccttattttaga

SEQ ID NO: 7987146 - DNA, 22 bp, Homo sapiens
aaatctcagcccttattttaga

SEQ ID NO: 7987147 - DNA, 21 bp, Homo sapiens
aaatctcagctggcctctgtg

SEQ ID NO: 7987148 - DNA, 21 bp, Homo sapiens
aaatctcagctggcctctgtg

SEQ ID NO: 7987149 - DNA, 22 bp, Homo sapiens
aaatctcagtgttctaagcatt

SEQ ID NO: 7987150 - DNA, 22 bp, Homo sapiens
aaatctcagtgttctaagcatt

SEQ ID NO: 7987151 - DNA, 22 bp, Homo sapiens
aaatctcagtgttctaagcatt

SEQ ID NO: 7987152 - DNA, 22 bp, Homo sapiens
aaatctcagtgttctaagcatt

SEQ ID NO: 7987153 - DNA, 22 bp, Homo sapiens
aaatctcaggcctctatttact

SEQ ID NO: 7987154 - DNA, 22 bp, Homo sapiens
aaatctctgaacttaataatgc

SEQ ID NO: 7987155 - DNA, 22 bp, Homo sapiens
aaatctcattatttataccata

SEQ ID NO: 7987156 - DNA, 22 bp, Homo sapiens
aagcaggccctgggccagggga

SEQ ID NO: 7987157 - DNA, 22 bp, Homo sapiens
aagcaggcattccagagacaat

SEQ ID NO: 7987158 - DNA, 22 bp, Homo sapiens
aagcaggcatgggaggccatcc

SEQ ID NO: 7987159 - DNA, 22 bp, Homo sapiens
aagcaggcgagggcctggagca

SEQ ID NO: 7987160 - DNA, 22 bp, Homo sapiens
aaatctcaatttgaattgtagc

SEQ ID NO: 7987161 - DNA, 22 bp, Homo sapiens
aagcaggcgagggcctggagca

SEQ ID NO: 7987162 - DNA, 22 bp, Homo sapiens
aagcaggcgagggcctggagca

SEQ ID NO: 7987163 - DNA, 22 bp, Homo sapiens
aagcaggccctgggccagggga

SEQ ID NO: 7987164 - DNA, 22 bp, Homo sapiens
aagcaggccctgggccagggga

SEQ ID NO: 7987165 - DNA, 21 bp, Homo sapiens
aaagaaatctcccattggtag

SEQ ID NO: 7987166 - DNA, 21 bp, Homo sapiens
aaagaaatctcccattggtag

SEQ ID NO: 7987167 - DNA, 21 bp, Homo sapiens
aaagaaatctcccattggtag

SEQ ID NO: 7987168 - DNA, 21 bp, Homo sapiens
aaagaaatctcccattggtag

SEQ ID NO: 7987169 - DNA, 21 bp, Homo sapiens
aaagaaatctcccattggtag

SEQ ID NO: 7987170 - DNA, 22 bp, Homo sapiens
aaagaaatagatggcatttaaa

SEQ ID NO: 7987171 - DNA, 22 bp, Homo sapiens
aaagaaatagatggcatttaaa

SEQ ID NO: 7987172 - DNA, 22 bp, Homo sapiens
aaagaaatagatggcatttaaa

SEQ ID NO: 7987173 - DNA, 22 bp, Homo sapiens
aaagaaatagatggcatttaaa

SEQ ID NO: 7987174 - DNA, 22 bp, Homo sapiens
aaagaacaaatgatatatggtt

SEQ ID NO: 7987175 - DNA, 22 bp, Homo sapiens
aaagaacaaatgatatatggtt

SEQ ID NO: 7987176 - DNA, 22 bp, Homo sapiens
aaagaacaaatgatatatggtt

SEQ ID NO: 7987177 - DNA, 21 bp, Homo sapiens
aaagaaatctcccattggtag

SEQ ID NO: 7987178 - DNA, 22 bp, Homo sapiens
aaagaacaaatgatatatggtt

SEQ ID NO: 7987179 - DNA, 22 bp, Homo sapiens
aaagaacaaattagctgtttta

SEQ ID NO: 7987180 - DNA, 22 bp, Homo sapiens
aaagaacaaattagctgtttta

SEQ ID NO: 7987181 - DNA, 22 bp, Homo sapiens
aaagaaatagatggcatttaaa

SEQ ID NO: 7987182 - DNA, 22 bp, Homo sapiens
aaagaaatagatggcatttaaa

SEQ ID NO: 7987183 - DNA, 22 bp, Homo sapiens
aaagaaatagatggcatttaaa

SEQ ID NO: 7987184 - DNA, 22 bp, Homo sapiens
aaagaaatagatggcatttaaa

SEQ ID NO: 7987185 - DNA, 22 bp, Homo sapiens
aaagaaatagatggcatttaaa

SEQ ID NO: 7987186 - DNA, 22 bp, Homo sapiens
aaagaaatagatggcatttaaa

SEQ ID NO: 7987187 - DNA, 22 bp, Homo sapiens
aaagaaatacctttctcagctt

SEQ ID NO: 7987188 - DNA, 22 bp, Homo sapiens
aaagaaatagatggcatttaaa

SEQ ID NO: 7987189 - DNA, 22 bp, Homo sapiens
aaactttttattctaatgtcta

SEQ ID NO: 7987190 - DNA, 22 bp, Homo sapiens
aaacttttttaggttcataggc

SEQ ID NO: 7987191 - DNA, 22 bp, Homo sapiens
aaacttttttaggttcataggc

SEQ ID NO: 7987192 - DNA, 22 bp, Homo sapiens
aaactttttattctaatgtcta

SEQ ID NO: 7987193 - DNA, 22 bp, Homo sapiens
aaacttttttaggttcataggc

SEQ ID NO: 7987194 - DNA, 22 bp, Homo sapiens
aaagaaacctatcagccacatg

SEQ ID NO: 7987195 - DNA, 22 bp, Homo sapiens
aaagaaatacctttctcagctt

SEQ ID NO: 7987196 - DNA, 22 bp, Homo sapiens
aaagaaatacctttctcagctt

SEQ ID NO: 7987197 - DNA, 22 bp, Homo sapiens
aaagaaatacctttctcagctt

SEQ ID NO: 7987198 - DNA, 22 bp, Homo sapiens
aaagaaatacctttctcagctt

SEQ ID NO: 7987199 - DNA, 22 bp, Homo sapiens
aaagaaacctatcagccacatg

SEQ ID NO: 7987200 - DNA, 16 bp, Homo sapiens
aaagaaacaggtgtcc

SEQ ID NO: 7987201 - DNA, 22 bp, Homo sapiens
aaagaaacctatcagccacatg

SEQ ID NO: 7987202 - DNA, 22 bp, Homo sapiens
aaagaaacctatcagccacatg

SEQ ID NO: 7987203 - DNA, 22 bp, Homo sapiens
aaagaaacctatcagccacatg

SEQ ID NO: 7987204 - DNA, 22 bp, Homo sapiens
aaatagtcctgggaatagtact

SEQ ID NO: 7987205 - DNA, 22 bp, Homo sapiens
aaatagttacttctgctgtctt

SEQ ID NO: 7987206 - DNA, 22 bp, Homo sapiens
aaatagttacttctgctgtctt

SEQ ID NO: 7987207 - DNA, 22 bp, Homo sapiens
aaatagttacttctgctgtctt

SEQ ID NO: 7987208 - DNA, 22 bp, Homo sapiens
aaatagttagccctgcatatat

SEQ ID NO: 7987209 - DNA, 22 bp, Homo sapiens
aaatagttagccctgcatatat

SEQ ID NO: 7987210 - DNA, 22 bp, Homo sapiens
aaatagttagccctgcatatat

SEQ ID NO: 7987211 - DNA, 22 bp, Homo sapiens
aaatagttagccctgcatatat

SEQ ID NO: 7987212 - DNA, 22 bp, Homo sapiens
aaactgtcctcccgaggtttcc

SEQ ID NO: 7987213 - DNA, 20 bp, Homo sapiens
aaactgtctgtcagtatcta

SEQ ID NO: 7987214 - DNA, 22 bp, Homo sapiens
aaactgtgaagcaagtacaagg

SEQ ID NO: 7987215 - DNA, 22 bp, Homo sapiens
aaatagtcctgggaatagtact

SEQ ID NO: 7987216 - DNA, 22 bp, Homo sapiens
aaactgtgaagcaagtacaagg

SEQ ID NO: 7987217 - DNA, 22 bp, Homo sapiens
aaatagttcagcttgtaaaccc

SEQ ID NO: 7987218 - DNA, 22 bp, Homo sapiens
aaatagttcagcttgtaaaccc

SEQ ID NO: 7987219 - DNA, 22 bp, Homo sapiens
aaatagttcagcttgtaaaccc

SEQ ID NO: 7987220 - DNA, 22 bp, Homo sapiens
aaatagttgtttggatcaataa

SEQ ID NO: 7987221 - DNA, 22 bp, Homo sapiens
aaatagttcagcttgtaaaccc

SEQ ID NO: 7987222 - DNA, 22 bp, Homo sapiens
aaatagttcagcttgtaaaccc

SEQ ID NO: 7987223 - DNA, 22 bp, Homo sapiens
aaatagttcagccacggtgact

SEQ ID NO: 7987224 - DNA, 22 bp, Homo sapiens
aaatagttcagccacggtgact

SEQ ID NO: 7987225 - DNA, 22 bp, Homo sapiens
aaatagttagccctgcatatat

SEQ ID NO: 7987226 - DNA, 22 bp, Homo sapiens
aaatagttagccctgcatatat

SEQ ID NO: 7987227 - DNA, 22 bp, Homo sapiens
aaacttccagtttaacatttac

SEQ ID NO: 7987228 - DNA, 22 bp, Homo sapiens
aaatagtttagctctcatttca

SEQ ID NO: 7987229 - DNA, 22 bp, Homo sapiens
aaatagttgtttggatcaataa

SEQ ID NO: 7987230 - DNA, 22 bp, Homo sapiens
aaatagttgtttggatcaataa

SEQ ID NO: 7987231 - DNA, 22 bp, Homo sapiens
aaatagttgtttggatcaataa

SEQ ID NO: 7987232 - DNA, 22 bp, Homo sapiens
aaatagttgtttggatcaataa

SEQ ID NO: 7987233 - DNA, 22 bp, Homo sapiens
aaatagtttagctctcatttca

SEQ ID NO: 7987234 - DNA, 22 bp, Homo sapiens
aaatagtttagctctcatttca

SEQ ID NO: 7987235 - DNA, 22 bp, Homo sapiens
aaatagttgtttggatcaataa

SEQ ID NO: 7987236 - DNA, 22 bp, Homo sapiens
aaatagtttagctctcatttca

SEQ ID NO: 7987237 - DNA, 22 bp, Homo sapiens
aaatagtttagctctcatttca

SEQ ID NO: 7987238 - DNA, 22 bp, Homo sapiens
aaacttttcctgctcttgtcct

SEQ ID NO: 7987239 - DNA, 22 bp, Homo sapiens
aaacttttcctgctcttgtcct

SEQ ID NO: 7987240 - DNA, 22 bp, Homo sapiens
aaacttttcctgctcttgtcct

SEQ ID NO: 7987241 - DNA, 22 bp, Homo sapiens
aaacttttcctgctcttgtcct

SEQ ID NO: 7987242 - DNA, 22 bp, Homo sapiens
aaactttgttcgtccagactca

SEQ ID NO: 7987243 - DNA, 22 bp, Homo sapiens
aaactttgttcgtccagactca

SEQ ID NO: 7987244 - DNA, 22 bp, Homo sapiens
aaactttcatgtatctctttca

SEQ ID NO: 7987245 - DNA, 22 bp, Homo sapiens
aaactttaggaaggaatttaca

SEQ ID NO: 7987246 - DNA, 22 bp, Homo sapiens
aaacttctggctacaagcaata

SEQ ID NO: 7987247 - DNA, 22 bp, Homo sapiens
aaactttggtatgtagcaaaac

SEQ ID NO: 7987248 - DNA, 22 bp, Homo sapiens
aaactttggtatgtagcaaaac

SEQ ID NO: 7987249 - DNA, 22 bp, Homo sapiens
aaagacttgggtgaagtaattt

SEQ ID NO: 7987250 - DNA, 22 bp, Homo sapiens
aaagacttgggtgaagtaattt

SEQ ID NO: 7987251 - DNA, 22 bp, Homo sapiens
aaagacttggcttatgatttgc

SEQ ID NO: 7987252 - DNA, 22 bp, Homo sapiens
aaagacttgggtgaagtaattt

SEQ ID NO: 7987253 - DNA, 22 bp, Homo sapiens
aaagacttgggagcagtatgct

SEQ ID NO: 7987254 - DNA, 22 bp, Homo sapiens
aaagactttcacctagcaaaga

SEQ ID NO: 7987255 - DNA, 22 bp, Homo sapiens
aaagactttcacctagcaaaga

SEQ ID NO: 7987256 - DNA, 22 bp, Homo sapiens
aaagactttcacctagcaaaga

SEQ ID NO: 7987257 - DNA, 22 bp, Homo sapiens
aaagactttcacctagcaaaga

SEQ ID NO: 7987258 - DNA, 22 bp, Homo sapiens
aaagactttaggttagaggcat

SEQ ID NO: 7987259 - DNA, 22 bp, Homo sapiens
aaagactgcaaaaacgcacaga

SEQ ID NO: 7987260 - DNA, 22 bp, Homo sapiens
aaagactgaggggaaagtgatg

SEQ ID NO: 7987261 - DNA, 22 bp, Homo sapiens
aaagactgcaaaaacgcacaga

SEQ ID NO: 7987262 - DNA, 22 bp, Homo sapiens
aaagactgaggggaaagtgatg

SEQ ID NO: 7987263 - DNA, 22 bp, Homo sapiens
aaagactgaggggaaagtgatg

SEQ ID NO: 7987264 - DNA, 22 bp, Homo sapiens
aaagactggaaggtgaggctgt

SEQ ID NO: 7987265 - DNA, 23 bp, Homo sapiens
aaagactgctgagaattttagga

SEQ ID NO: 7987266 - DNA, 21 bp, Homo sapiens
aaagacttgcctgaaagtgag

SEQ ID NO: 7987267 - DNA, 21 bp, Homo sapiens
aaagacttgcctgaaagtgag

SEQ ID NO: 7987268 - DNA, 22 bp, Homo sapiens
aaagactggtgtgttacatata

SEQ ID NO: 7987269 - DNA, 22 bp, Homo sapiens
aaagactggtgtgttacatata

SEQ ID NO: 7987270 - DNA, 22 bp, Homo sapiens
aaagactaagaagagtattatt

SEQ ID NO: 7987271 - DNA, 22 bp, Homo sapiens
aaagactacacgggaaagagct

SEQ ID NO: 7987272 - DNA, 22 bp, Homo sapiens
aaagactcttaactccctagcg

SEQ ID NO: 7987273 - DNA, 23 bp, Homo sapiens
aaagactgaggaaagtctctgtc

SEQ ID NO: 7987274 - DNA, 22 bp, Homo sapiens
aaagactagcatttatatgtac

SEQ ID NO: 7987275 - DNA, 22 bp, Homo sapiens
aaagactagcatttatatgtac

SEQ ID NO: 7987276 - DNA, 21 bp, Homo sapiens
aaagaacaggcagatgttctt

SEQ ID NO: 7987277 - DNA, 22 bp, Homo sapiens
aaagacatgacacattggagag

SEQ ID NO: 7987278 - DNA, 22 bp, Homo sapiens
aaagacatgacacattggagag

SEQ ID NO: 7987279 - DNA, 22 bp, Homo sapiens
aaagaacagatgtgtggtgcat

SEQ ID NO: 7987280 - DNA, 22 bp, Homo sapiens
aaagaacaaattagctgtttta

SEQ ID NO: 7987281 - DNA, 22 bp, Homo sapiens
aaagaacaatgtggaatctcct

SEQ ID NO: 7987282 - DNA, 22 bp, Homo sapiens
aaagaacaatgtggaatctcct

SEQ ID NO: 7987283 - DNA, 22 bp, Homo sapiens
aaagaacaatgtggaatctcct

SEQ ID NO: 7987284 - DNA, 22 bp, Homo sapiens
aaagaacaatgtggaatctcct

SEQ ID NO: 7987285 - DNA, 22 bp, Homo sapiens
aaagagaacttttacccaagaa

SEQ ID NO: 7987286 - DNA, 20 bp, Homo sapiens
aaagagaagcctcaccttgt

SEQ ID NO: 7987287 - DNA, 22 bp, Homo sapiens
aaagagaacttttacccaagaa

SEQ ID NO: 7987288 - DNA, 22 bp, Homo sapiens
aaagagaacttttacccaagaa

SEQ ID NO: 7987289 - DNA, 22 bp, Homo sapiens
aaagagaacttttacccaagaa

SEQ ID NO: 7987290 - DNA, 22 bp, Homo sapiens
aaagagaacttttacccaagaa

SEQ ID NO: 7987291 - DNA, 22 bp, Homo sapiens
aaagagaaacttagaagcctga

SEQ ID NO: 7987292 - DNA, 22 bp, Homo sapiens
aaagagaacttttacccaagaa

SEQ ID NO: 7987293 - DNA, 20 bp, Homo sapiens
aaagagaagcctcaccttgt

SEQ ID NO: 7987294 - DNA, 20 bp, Homo sapiens
aaagagaagcctcaccttgt

SEQ ID NO: 7987295 - DNA, 20 bp, Homo sapiens
aaagagaagcctcaccttgt

SEQ ID NO: 7987296 - DNA, 20 bp, Homo sapiens
aaagagaagcctcaccttgt

SEQ ID NO: 7987297 - DNA, 22 bp, Homo sapiens
aaagagacaccaaagactctag

SEQ ID NO: 7987298 - DNA, 21 bp, Homo sapiens
aaagagacaaatggcatatac

SEQ ID NO: 7987299 - DNA, 22 bp, Homo sapiens
aaagagaaaatgatctgtacat

SEQ ID NO: 7987300 - DNA, 22 bp, Homo sapiens
aaagagaaaatgatctgtacat

SEQ ID NO: 7987301 - DNA, 22 bp, Homo sapiens
aaagagaaaatgatctgtacat

SEQ ID NO: 7987302 - DNA, 22 bp, Homo sapiens
aaagagaaaaagatcccggctc

SEQ ID NO: 7987303 - DNA, 22 bp, Homo sapiens
aaagagaaaaagatcccggctc

SEQ ID NO: 7987304 - DNA, 22 bp, Homo sapiens
aaagagaaaatgatctgtacat

SEQ ID NO: 7987305 - DNA, 22 bp, Homo sapiens
aaagactttcacctagcaaaga

SEQ ID NO: 7987306 - DNA, 22 bp, Homo sapiens
aaagagaaacttagaagcctga

SEQ ID NO: 7987307 - DNA, 22 bp, Homo sapiens
aaagagaaacttagaagcctga

SEQ ID NO: 7987308 - DNA, 22 bp, Homo sapiens
aaagagaaacttagaagcctga

SEQ ID NO: 7987309 - DNA, 22 bp, Homo sapiens
aaagagaaacttagaagcctga

SEQ ID NO: 7987310 - DNA, 22 bp, Homo sapiens
aaagagaaacttagaagcctga

SEQ ID NO: 7987311 - DNA, 22 bp, Homo sapiens
aaagagaaacttagaagcctga

SEQ ID NO: 7987312 - DNA, 22 bp, Homo sapiens
aaagagaaacttagaagcctga

SEQ ID NO: 7987313 - DNA, 22 bp, Homo sapiens
aaagagaaacttagaagcctga

SEQ ID NO: 7987314 - DNA, 22 bp, Homo sapiens
aaagagaaacttagaagcctga

SEQ ID NO: 7987315 - DNA, 22 bp, Homo sapiens
aaagagaaacttagaagcctga

SEQ ID NO: 7987316 - DNA, 22 bp, Homo sapiens
aaagagaaacttagaagcctga

SEQ ID NO: 7987317 - DNA, 22 bp, Homo sapiens
aaagatgttatgaaataactat

SEQ ID NO: 7987318 - DNA, 22 bp, Homo sapiens
aaagatgttgctgctccgccct

SEQ ID NO: 7987319 - DNA, 23 bp, Homo sapiens
aaagatgttcccaaagttcacgt

SEQ ID NO: 7987320 - DNA, 23 bp, Homo sapiens
aaagatgttcccaaagttcacgt

SEQ ID NO: 7987321 - DNA, 23 bp, Homo sapiens
aaagatgttcccaaagttcacgt

SEQ ID NO: 7987322 - DNA, 21 bp, Homo sapiens
aaagatgtttcatctgagaaa

SEQ ID NO: 7987323 - DNA, 21 bp, Homo sapiens
aaagatgtttcatctgagaaa

SEQ ID NO: 7987324 - DNA, 21 bp, Homo sapiens
aaagatgtttcatctgagaaa

SEQ ID NO: 7987325 - DNA, 22 bp, Homo sapiens
aaagatgttatgaaataactat

SEQ ID NO: 7987326 - DNA, 22 bp, Homo sapiens
aaagatgttatgaaataactat

SEQ ID NO: 7987327 - DNA, 22 bp, Homo sapiens
aaagatgttatgaaataactat

SEQ ID NO: 7987328 - DNA, 22 bp, Homo sapiens
aaagatgttaatagcaccattt

SEQ ID NO: 7987329 - DNA, 22 bp, Homo sapiens
aaagatgttaatagcaccattt

SEQ ID NO: 7987330 - DNA, 22 bp, Homo sapiens
aaagatgttaatagcaccattt

SEQ ID NO: 7987331 - DNA, 22 bp, Homo sapiens
aaagatcagtctgaagcaacat

SEQ ID NO: 7987332 - DNA, 22 bp, Homo sapiens
aaagagcaagctgagatttgaa

SEQ ID NO: 7987333 - DNA, 22 bp, Homo sapiens
aaagagatgtgccaaatagcct

SEQ ID NO: 7987334 - DNA, 22 bp, Homo sapiens
aaagagatgtgccaaatagcct

SEQ ID NO: 7987335 - DNA, 22 bp, Homo sapiens
aaagagatgtgccaaatagcct

SEQ ID NO: 7987336 - DNA, 20 bp, Homo sapiens
aaagagaagcctcaccttgt

SEQ ID NO: 7987337 - DNA, 22 bp, Homo sapiens
aaagagacaccaaagactctag

SEQ ID NO: 7987338 - DNA, 22 bp, Homo sapiens
aaagagcaagggctttgaggct

SEQ ID NO: 7987339 - DNA, 22 bp, Homo sapiens
aaagatcagtctgaagcaacat

SEQ ID NO: 7987340 - DNA, 22 bp, Homo sapiens
aaagagcaccctcaatgtctga

SEQ ID NO: 7987341 - DNA, 22 bp, Homo sapiens
aaactgtaaatactagtaagtg

SEQ ID NO: 7987342 - DNA, 22 bp, Homo sapiens
aaactgtaaacacagcagtaca

SEQ ID NO: 7987343 - DNA, 22 bp, Homo sapiens
aaactgtaaacacagcagtaca

SEQ ID NO: 7987344 - DNA, 22 bp, Homo sapiens
aaactgcaattacttttgcacc

SEQ ID NO: 7987345 - DNA, 22 bp, Homo sapiens
aaactgcaattacttttgcagc

SEQ ID NO: 7987346 - DNA, 22 bp, Homo sapiens
aaactgcaatgacaggtaggag

SEQ ID NO: 7987347 - DNA, 22 bp, Homo sapiens
aaacattgtaattttagcatgg

SEQ ID NO: 7987348 - DNA, 22 bp, Homo sapiens
aaacattgctaaataatgctgc

SEQ ID NO: 7987349 - DNA, 22 bp, Homo sapiens
aaacattgctaaataatgctgc

SEQ ID NO: 7987350 - DNA, 22 bp, Homo sapiens
aaacattgagcacttgctattt

SEQ ID NO: 7987351 - DNA, 22 bp, Homo sapiens
aaacattgacctcatcctggca

SEQ ID NO: 7987352 - DNA, 22 bp, Homo sapiens
aaacattgacctcatcctggca

SEQ ID NO: 7987353 - DNA, 22 bp, Homo sapiens
aaacattctcagccctgcttgc

SEQ ID NO: 7987354 - DNA, 22 bp, Homo sapiens
aaacattccctaatgtgtccgt

SEQ ID NO: 7987355 - DNA, 22 bp, Homo sapiens
aaactgtaagagaataaactac

SEQ ID NO: 7987356 - DNA, 22 bp, Homo sapiens
aaactgtaagagaataaactac

SEQ ID NO: 7987357 - DNA, 22 bp, Homo sapiens
aaactgtaatgcaggatcaaga

SEQ ID NO: 7987358 - DNA, 22 bp, Homo sapiens
aaactgtatagggaaaagtaga

SEQ ID NO: 7987359 - DNA, 22 bp, Homo sapiens
aaactgtatagggaaaagtaga

SEQ ID NO: 7987360 - DNA, 22 bp, Homo sapiens
aaactgtatagggaaaagtaga

SEQ ID NO: 7987361 - DNA, 22 bp, Homo sapiens
aaactgtatatttatggcatgt

SEQ ID NO: 7987362 - DNA, 22 bp, Homo sapiens
aaactgtattccatcctcatca

SEQ ID NO: 7987363 - DNA, 22 bp, Homo sapiens
aaactgtcacctaatgtatttt

SEQ ID NO: 7987364 - DNA, 22 bp, Homo sapiens
aaactgtcattttatatagtta

SEQ ID NO: 7987365 - DNA, 22 bp, Homo sapiens
aaacatgtaattctgcttaaga

SEQ ID NO: 7987366 - DNA, 22 bp, Homo sapiens
aaacatgtagtgcatgaggatc

SEQ ID NO: 7987367 - DNA, 22 bp, Homo sapiens
aaacatgtaattctgcttaaga

SEQ ID NO: 7987368 - DNA, 22 bp, Homo sapiens
aaacatgtttagaaagcagctg

SEQ ID NO: 7987369 - DNA, 22 bp, Homo sapiens
aaacatgtttagaaagcagctg

SEQ ID NO: 7987370 - DNA, 22 bp, Homo sapiens
aaacatgtttagaaagcagctg

SEQ ID NO: 7987371 - DNA, 22 bp, Homo sapiens
aaacatgtttagaaagcagctg

SEQ ID NO: 7987372 - DNA, 22 bp, Homo sapiens
aaacatgtagtgcatgaggatc

SEQ ID NO: 7987373 - DNA, 22 bp, Homo sapiens
aaacatgtaagttcagatcacc

SEQ ID NO: 7987374 - DNA, 22 bp, Homo sapiens
aaacatgtaattctgcttaaga

SEQ ID NO: 7987375 - DNA, 22 bp, Homo sapiens
aaacatgtaattctgcttaaga

SEQ ID NO: 7987376 - DNA, 22 bp, Homo sapiens
aaacatgtaagttcagatcacc

SEQ ID NO: 7987377 - DNA, 22 bp, Homo sapiens
aaacatgtaagttcagatcacc

SEQ ID NO: 7987378 - DNA, 22 bp, Homo sapiens
aaacatgtaagttcagatcacc

SEQ ID NO: 7987379 - DNA, 22 bp, Homo sapiens
aaacatgtaagttcagatcacc

SEQ ID NO: 7987380 - DNA, 22 bp, Homo sapiens
aaacatgtaagttcagatcacc

SEQ ID NO: 7987381 - DNA, 22 bp, Homo sapiens
aaacatgggcttcctgatgcga

SEQ ID NO: 7987382 - DNA, 22 bp, Homo sapiens
aaacatgctggatttagaatat

SEQ ID NO: 7987383 - DNA, 22 bp, Homo sapiens
aaacatgctggatttagaatat

SEQ ID NO: 7987384 - DNA, 22 bp, Homo sapiens
aaacatgctggatttagaatat

SEQ ID NO: 7987385 - DNA, 18 bp, Homo sapiens
aaacatggcttaaaggct

SEQ ID NO: 7987386 - DNA, 22 bp, Homo sapiens
aaacatgggcttcctgatgcga

SEQ ID NO: 7987387 - DNA, 23 bp, Homo sapiens
aaacatgcagcacatgaatgcta

SEQ ID NO: 7987388 - DNA, 23 bp, Homo sapiens
aaacatgcagcacatgaatgcta

SEQ ID NO: 7987389 - DNA, 22 bp, Homo sapiens
aaacatgatgtcatatatgcca

SEQ ID NO: 7987390 - DNA, 22 bp, Homo sapiens
aaacatgatgtcatatatgcca

SEQ ID NO: 7987391 - DNA, 22 bp, Homo sapiens
aaacatgatgtcatatatgcca

SEQ ID NO: 7987392 - DNA, 22 bp, Homo sapiens
aaacatgcattcaagaaaatct

SEQ ID NO: 7987393 - DNA, 22 bp, Homo sapiens
aaacatgcattcaagaaaatct

SEQ ID NO: 7987394 - DNA, 22 bp, Homo sapiens
aaacatgcattcaagaaaatct

SEQ ID NO: 7987395 - DNA, 22 bp, Homo sapiens
aaacatgttttctgaatatttt

SEQ ID NO: 7987396 - DNA, 22 bp, Homo sapiens
aaacatgttttctgaatatttt

SEQ ID NO: 7987397 - DNA, 22 bp, Homo sapiens
aaacattagacaccatatgctc

SEQ ID NO: 7987398 - DNA, 22 bp, Homo sapiens
aaacattagacaccatatgctc

SEQ ID NO: 7987399 - DNA, 22 bp, Homo sapiens
aaacattcacatttgctagtaa

SEQ ID NO: 7987400 - DNA, 22 bp, Homo sapiens
aaacattcaaagcaggatgtgt

SEQ ID NO: 7987401 - DNA, 22 bp, Homo sapiens
aaacattagacaccatatgctc

SEQ ID NO: 7987402 - DNA, 22 bp, Homo sapiens
aaacattagacaccatatgctc

SEQ ID NO: 7987403 - DNA, 20 bp, Homo sapiens
aaacattcatgtacaagtga

SEQ ID NO: 7987404 - DNA, 20 bp, Homo sapiens
aaacattcatgtacaagtga

SEQ ID NO: 7987405 - DNA, 22 bp, Homo sapiens
aaacattcactctcaattttag

SEQ ID NO: 7987406 - DNA, 22 bp, Homo sapiens
aaacattcactctcaattttag

SEQ ID NO: 7987407 - DNA, 22 bp, Homo sapiens
aaacattccatttctatgtaag

SEQ ID NO: 7987408 - DNA, 22 bp, Homo sapiens
aaacattccatatataccttgt

SEQ ID NO: 7987409 - DNA, 22 bp, Homo sapiens
aaacattccatttctatgtaag

SEQ ID NO: 7987410 - DNA, 22 bp, Homo sapiens
aaacattccatttctatgtaag

SEQ ID NO: 7987411 - DNA, 22 bp, Homo sapiens
aaacattccatttctatgtaag

SEQ ID NO: 7987412 - DNA, 22 bp, Homo sapiens
aaacagatgagttataatagcc

SEQ ID NO: 7987413 - DNA, 22 bp, Homo sapiens
aaacagatgagttataatagcc

SEQ ID NO: 7987414 - DNA, 22 bp, Homo sapiens
aaacagataatgctataaatgg

SEQ ID NO: 7987415 - DNA, 22 bp, Homo sapiens
aaacagatgagttataatagcc

SEQ ID NO: 7987416 - DNA, 22 bp, Homo sapiens
aaacagcaatggagaagccagg

SEQ ID NO: 7987417 - DNA, 22 bp, Homo sapiens
aaacagcaatggagaagccagg

SEQ ID NO: 7987418 - DNA, 22 bp, Homo sapiens
aaacagcaatggagaagccagg

SEQ ID NO: 7987419 - DNA, 22 bp, Homo sapiens
aaacagcaattacttttgcacc

SEQ ID NO: 7987420 - DNA, 22 bp, Homo sapiens
aaacagctaatggccaggaata

SEQ ID NO: 7987421 - DNA, 22 bp, Homo sapiens
aaacagctacttctgtataatg

SEQ ID NO: 7987422 - DNA, 20 bp, Homo sapiens
aaacagctaaaccagctctc

SEQ ID NO: 7987423 - DNA, 22 bp, Homo sapiens
aaacagctaagtacattcaagg

SEQ ID NO: 7987424 - DNA, 22 bp, Homo sapiens
aaacagctaagtacattcaagg

SEQ ID NO: 7987425 - DNA, 22 bp, Homo sapiens
aaacagctaagtacattcaagg

SEQ ID NO: 7987426 - DNA, 20 bp, Homo sapiens
aaacagctaaaccagctctc

SEQ ID NO: 7987427 - DNA, 22 bp, Homo sapiens
aaacagccatgtcagctttgca

SEQ ID NO: 7987428 - DNA, 22 bp, Homo sapiens
aaacagccatgtcagctttgca

SEQ ID NO: 7987429 - DNA, 22 bp, Homo sapiens
aaacagcagctgtttaatttgc

SEQ ID NO: 7987430 - DNA, 22 bp, Homo sapiens
aaacagcaggaacatcttgcca

SEQ ID NO: 7987431 - DNA, 22 bp, Homo sapiens
aaacagcagctgtttaatttgc

SEQ ID NO: 7987432 - DNA, 22 bp, Homo sapiens
aaacagcaggaacatcttgcca

SEQ ID NO: 7987433 - DNA, 22 bp, Homo sapiens
aaacagcaggaacatcttgcca

SEQ ID NO: 7987434 - DNA, 22 bp, Homo sapiens
aaacatctcaaagaggtatttg

SEQ ID NO: 7987435 - DNA, 22 bp, Homo sapiens
aaacatctcaaagaggtatttg

SEQ ID NO: 7987436 - DNA, 22 bp, Homo sapiens
aaacatctcaaagaggtatttg

SEQ ID NO: 7987437 - DNA, 22 bp, Homo sapiens
aaacagctgtcattgttttaaa

SEQ ID NO: 7987438 - DNA, 22 bp, Homo sapiens
aaacagctggtctcaaatgttc

SEQ ID NO: 7987439 - DNA, 22 bp, Homo sapiens
aaacagctgcagtacacggcct

SEQ ID NO: 7987440 - DNA, 22 bp, Homo sapiens
aaacagctgggaggtagaggcg

SEQ ID NO: 7987441 - DNA, 22 bp, Homo sapiens
aaacagctggtctcaaatgttc

SEQ ID NO: 7987442 - DNA, 22 bp, Homo sapiens
aaacagctggtctcaaatgttc

SEQ ID NO: 7987443 - DNA, 22 bp, Homo sapiens
aaacatgatgcctgtactaaga

SEQ ID NO: 7987444 - DNA, 22 bp, Homo sapiens
aaacatgatgcctgtactaaga

SEQ ID NO: 7987445 - DNA, 21 bp, Homo sapiens
aaacatctctgcttttgtgtc

SEQ ID NO: 7987446 - DNA, 22 bp, Homo sapiens
aaacatgatgcctgtactaaga

SEQ ID NO: 7987447 - DNA, 22 bp, Homo sapiens
aaacagctacttctgtataatg

SEQ ID NO: 7987448 - DNA, 22 bp, Homo sapiens
aaacagctcaagaagttactct

SEQ ID NO: 7987449 - DNA, 22 bp, Homo sapiens
aaacagctcaagaagttactct

SEQ ID NO: 7987450 - DNA, 22 bp, Homo sapiens
aaacagctccttagtttccatc

SEQ ID NO: 7987451 - DNA, 22 bp, Homo sapiens
aaacagctgggaggtagaggcg

SEQ ID NO: 7987452 - DNA, 22 bp, Homo sapiens
aaacagctgggaggtagaggcg

SEQ ID NO: 7987453 - DNA, 22 bp, Homo sapiens
aaacagctacttctgtataatg

SEQ ID NO: 7987454 - DNA, 22 bp, Homo sapiens
aaacagctgcactgctgatgtc

SEQ ID NO: 7987455 - DNA, 22 bp, Homo sapiens
aaacagctgcactgctgatgtc

SEQ ID NO: 7987456 - DNA, 22 bp, Homo sapiens
aaacagctgcagtacacggcct

SEQ ID NO: 7987457 - DNA, 22 bp, Homo sapiens
aaacactgaaaattttggtcat

SEQ ID NO: 7987458 - DNA, 22 bp, Homo sapiens
aaacactgaagacctatctggt

SEQ ID NO: 7987459 - DNA, 22 bp, Homo sapiens
aaacactgaagacctatctggt

SEQ ID NO: 7987460 - DNA, 22 bp, Homo sapiens
aaagccactgcatgtgtagtat

SEQ ID NO: 7987461 - DNA, 20 bp, Homo sapiens
aaagccactggcaagagact

SEQ ID NO: 7987462 - DNA, 20 bp, Homo sapiens
aaagccactggcaagagact

SEQ ID NO: 7987463 - DNA, 22 bp, Homo sapiens
aaacactgatggatatttttcc

SEQ ID NO: 7987464 - DNA, 22 bp, Homo sapiens
aaagccagaattcgtccagcct

SEQ ID NO: 7987465 - DNA, 22 bp, Homo sapiens
aaagccagaattcgtccagcct

SEQ ID NO: 7987466 - DNA, 22 bp, Homo sapiens
aaagccagagcaagctgtcaca

SEQ ID NO: 7987467 - DNA, 22 bp, Homo sapiens
aaagccagagtgtgttagagac

SEQ ID NO: 7987468 - DNA, 22 bp, Homo sapiens
aaagccagagtgtgttagagac

SEQ ID NO: 7987469 - DNA, 22 bp, Homo sapiens
aaagccagcaaggtgagtttca

SEQ ID NO: 7987470 - DNA, 22 bp, Homo sapiens
aaagccagctctgagctgcacc

SEQ ID NO: 7987471 - DNA, 22 bp, Homo sapiens
aaacagataagggacaatttca

SEQ ID NO: 7987472 - DNA, 22 bp, Homo sapiens
aaacagataagggacaatttca

SEQ ID NO: 7987473 - DNA, 22 bp, Homo sapiens
aaacagataatgctataaatgg

SEQ ID NO: 7987474 - DNA, 22 bp, Homo sapiens
aaacagataatgctataaatgg

SEQ ID NO: 7987475 - DNA, 22 bp, Homo sapiens
aaacagataatgctataaatgg

SEQ ID NO: 7987476 - DNA, 22 bp, Homo sapiens
aaacagataatgctataaatgg

SEQ ID NO: 7987477 - DNA, 22 bp, Homo sapiens
aaacagagtttggtaaatagcc

SEQ ID NO: 7987478 - DNA, 22 bp, Homo sapiens
aaacagagtttggtaaatagcc

SEQ ID NO: 7987479 - DNA, 22 bp, Homo sapiens
aaacagagtttggtaaatagcc

SEQ ID NO: 7987480 - DNA, 22 bp, Homo sapiens
aaacactgtgggacatcttact

SEQ ID NO: 7987481 - DNA, 22 bp, Homo sapiens
aaacactgtgggacatcttact

SEQ ID NO: 7987482 - DNA, 22 bp, Homo sapiens
aaagccaggcagccaagccagt

SEQ ID NO: 7987483 - DNA, 22 bp, Homo sapiens
aaagccaggcagccaagccagt

SEQ ID NO: 7987484 - DNA, 22 bp, Homo sapiens
aaacacaagaggcagggtacag

SEQ ID NO: 7987485 - DNA, 22 bp, Homo sapiens
aaagagcttgcttgctttatat

SEQ ID NO: 7987486 - DNA, 22 bp, Homo sapiens
aaagagcttgcttgctttatat

SEQ ID NO: 7987487 - DNA, 22 bp, Homo sapiens
aaagagcttgcttgctttatat

SEQ ID NO: 7987488 - DNA, 22 bp, Homo sapiens
aaagagcttcatttccatttat

SEQ ID NO: 7987489 - DNA, 22 bp, Homo sapiens
aaagagctgggacttaaagtgc

SEQ ID NO: 7987490 - DNA, 22 bp, Homo sapiens
aaagagctgggacttaaagtgc

SEQ ID NO: 7987491 - DNA, 22 bp, Homo sapiens
aaacacaagatggcctcttctg

SEQ ID NO: 7987492 - DNA, 22 bp, Homo sapiens
aaacacaagaggcagggtacag

SEQ ID NO: 7987493 - DNA, 17 bp, Homo sapiens
aaagagcttggagtgtt

SEQ ID NO: 7987494 - DNA, 22 bp, Homo sapiens
aaagagctatacaaccatgtcc

SEQ ID NO: 7987495 - DNA, 22 bp, Homo sapiens
aaagagctatacaaccatgtcc

SEQ ID NO: 7987496 - DNA, 22 bp, Homo sapiens
aaagagctcacagtccactgga

SEQ ID NO: 7987497 - DNA, 22 bp, Homo sapiens
aaagagctcacagtccactgga

SEQ ID NO: 7987498 - DNA, 22 bp, Homo sapiens
aaagagctcacagtccactgga

SEQ ID NO: 7987499 - DNA, 22 bp, Homo sapiens
aaagagctcggaaagtgttgaa

SEQ ID NO: 7987500 - DNA, 22 bp, Homo sapiens
aaagagctcttactctagtgta

SEQ ID NO: 7987501 - DNA, 22 bp, Homo sapiens
aaagagctcttactctagtgta

SEQ ID NO: 7987502 - DNA, 22 bp, Homo sapiens
aaagagctgatagcatctgttt

SEQ ID NO: 7987503 - DNA, 22 bp, Homo sapiens
aaagagctcttactctagtgta

SEQ ID NO: 7987504 - DNA, 22 bp, Homo sapiens
aaagagctgatagcatctgttt

SEQ ID NO: 7987505 - DNA, 22 bp, Homo sapiens
aaagagctgagacctggtggag

SEQ ID NO: 7987506 - DNA, 22 bp, Homo sapiens
aaagagctggcatttatagtct

SEQ ID NO: 7987507 - DNA, 22 bp, Homo sapiens
aaagagctgggacttaaagtgc

SEQ ID NO: 7987508 - DNA, 22 bp, Homo sapiens
aaagagctggcatttatagtct

SEQ ID NO: 7987509 - DNA, 22 bp, Homo sapiens
aaacacattttaggaaaatcta

SEQ ID NO: 7987510 - DNA, 22 bp, Homo sapiens
aaacacattttaggaaaatcta

SEQ ID NO: 7987511 - DNA, 22 bp, Homo sapiens
aaacacattttaggaaaatcta

SEQ ID NO: 7987512 - DNA, 22 bp, Homo sapiens
aaacacattttaggaaaatcta

SEQ ID NO: 7987513 - DNA, 22 bp, Homo sapiens
aaacaccaagagctagctatta

SEQ ID NO: 7987514 - DNA, 22 bp, Homo sapiens
aaacaccaagagctagctatta

SEQ ID NO: 7987515 - DNA, 22 bp, Homo sapiens
aaacaccaagagctagctatta

SEQ ID NO: 7987516 - DNA, 22 bp, Homo sapiens
aaacacattagccctgtggaaa

SEQ ID NO: 7987517 - DNA, 22 bp, Homo sapiens
aaacacattagccctgtggaaa

SEQ ID NO: 7987518 - DNA, 22 bp, Homo sapiens
aaacacattagccctgtggaaa

SEQ ID NO: 7987519 - DNA, 22 bp, Homo sapiens
aaacacatcattcatgtcgtca

SEQ ID NO: 7987520 - DNA, 22 bp, Homo sapiens
aaacacattttaggaaaatcta

SEQ ID NO: 7987521 - DNA, 22 bp, Homo sapiens
aaacacattagccctgtggaaa

SEQ ID NO: 7987522 - DNA, 22 bp, Homo sapiens
aaacactagcaggaagcactga

SEQ ID NO: 7987523 - DNA, 22 bp, Homo sapiens
aaacactaataacagtggctgg

SEQ ID NO: 7987524 - DNA, 22 bp, Homo sapiens
aaacactaataacagtggctgg

SEQ ID NO: 7987525 - DNA, 22 bp, Homo sapiens
aaacactagcaggaagcactga

SEQ ID NO: 7987526 - DNA, 22 bp, Homo sapiens
aaacactcatgtgttactctcc

SEQ ID NO: 7987527 - DNA, 22 bp, Homo sapiens
aaacactcatgtgttactctcc

SEQ ID NO: 7987528 - DNA, 22 bp, Homo sapiens
aaacaccaagagctagctatta

SEQ ID NO: 7987529 - DNA, 22 bp, Homo sapiens
aaacaccaagagctagctatta

SEQ ID NO: 7987530 - DNA, 22 bp, Homo sapiens
aaacaccagtcccagtatacac

SEQ ID NO: 7987531 - DNA, 22 bp, Homo sapiens
aaacaccagtcccagtatacac

SEQ ID NO: 7987532 - DNA, 22 bp, Homo sapiens
aaacaccagtcccagtatacac

SEQ ID NO: 7987533 - DNA, 22 bp, Homo sapiens
aaaatgtgatctacaaatgcaa

SEQ ID NO: 7987534 - DNA, 22 bp, Homo sapiens
aaaattcattcctcagactgcc

SEQ ID NO: 7987535 - DNA, 22 bp, Homo sapiens
aaaattcattcctcagactgcc

SEQ ID NO: 7987536 - DNA, 22 bp, Homo sapiens
aaaattcattcctcagactgcc

SEQ ID NO: 7987537 - DNA, 22 bp, Homo sapiens
aaaattcattcctcagactgcc

SEQ ID NO: 7987538 - DNA, 22 bp, Homo sapiens
aaaattcattcctcagactgcc

SEQ ID NO: 7987539 - DNA, 22 bp, Homo sapiens
aaaattctcttgatcttgacag

SEQ ID NO: 7987540 - DNA, 22 bp, Homo sapiens
aaaattctcttgatcttgacag

SEQ ID NO: 7987541 - DNA, 22 bp, Homo sapiens
aaaattctaacatgcagccaag

SEQ ID NO: 7987542 - DNA, 22 bp, Homo sapiens
aaaattctcttgatcttgacag

SEQ ID NO: 7987543 - DNA, 22 bp, Homo sapiens
aaaattctcttgatcttgacag

SEQ ID NO: 7987544 - DNA, 22 bp, Homo sapiens
aaaattgaagtgatcaggaact

SEQ ID NO: 7987545 - DNA, 22 bp, Homo sapiens
aaaattgaagtgatcaggaact

SEQ ID NO: 7987546 - DNA, 22 bp, Homo sapiens
aaaattgaagtgatcaggaact

SEQ ID NO: 7987547 - DNA, 22 bp, Homo sapiens
aaaattctgtcattaaattgtg

SEQ ID NO: 7987548 - DNA, 17 bp, Homo sapiens
aaaattctgtaaagagg

SEQ ID NO: 7987549 - DNA, 17 bp, Homo sapiens
aaaattctgtaaagagg

SEQ ID NO: 7987550 - DNA, 17 bp, Homo sapiens
aaaattctgtaaagagg

SEQ ID NO: 7987551 - DNA, 22 bp, Homo sapiens
aaaattctgtcattaaattgtg

SEQ ID NO: 7987552 - DNA, 22 bp, Homo sapiens
aaaattctgtcattaaattgtg

SEQ ID NO: 7987553 - DNA, 22 bp, Homo sapiens
aaaattctgtcattaaattgtg

SEQ ID NO: 7987554 - DNA, 18 bp, Homo sapiens
aaagagccacccagggcc

SEQ ID NO: 7987555 - DNA, 22 bp, Homo sapiens
aaagagccagctacctcagttt

SEQ ID NO: 7987556 - DNA, 22 bp, Homo sapiens
aaagagcccttccatgactctt

SEQ ID NO: 7987557 - DNA, 22 bp, Homo sapiens
aaagagccagctacctcagttt

SEQ ID NO: 7987558 - DNA, 21 bp, Homo sapiens
aaagagcccgctgagaggttc

SEQ ID NO: 7987559 - DNA, 22 bp, Homo sapiens
aaagagccagggcattaggtga

SEQ ID NO: 7987560 - DNA, 20 bp, Homo sapiens
aaagagcccttggagcaggc

SEQ ID NO: 7987561 - DNA, 20 bp, Homo sapiens
aaagagcccttggagcaggc

SEQ ID NO: 7987562 - DNA, 22 bp, Homo sapiens
aaagagcctatattcagctgca

SEQ ID NO: 7987563 - DNA, 22 bp, Homo sapiens
aaagagctaacattgccgagat

SEQ ID NO: 7987564 - DNA, 22 bp, Homo sapiens
aaagagctatacaaccatgtcc

SEQ ID NO: 7987565 - DNA, 19 bp, Homo sapiens
aaaattgcgtattttgagg

SEQ ID NO: 7987566 - DNA, 22 bp, Homo sapiens
aaaattgaggctcatgttaaat

SEQ ID NO: 7987567 - DNA, 22 bp, Homo sapiens
aaaattggacgtagctactcca

SEQ ID NO: 7987568 - DNA, 22 bp, Homo sapiens
aaaattgaggctcatgttaaat

SEQ ID NO: 7987569 - DNA, 22 bp, Homo sapiens
aaaattgaggctcatgttaaat

SEQ ID NO: 7987570 - DNA, 22 bp, Homo sapiens
aaaattgagagttatagatggt

SEQ ID NO: 7987571 - DNA, 22 bp, Homo sapiens
aaaattgagagttatagatggt

SEQ ID NO: 7987572 - DNA, 22 bp, Homo sapiens
aaaattgagagtcttgtgcaag

SEQ ID NO: 7987573 - DNA, 22 bp, Homo sapiens
aaaatatgtataactcttctgc

SEQ ID NO: 7987574 - DNA, 22 bp, Homo sapiens
aaaatattttagggccaggaga

SEQ ID NO: 7987575 - DNA, 22 bp, Homo sapiens
aaaatatgtataactcttctgc

SEQ ID NO: 7987576 - DNA, 22 bp, Homo sapiens
aaaatattttagggccaggaga

SEQ ID NO: 7987577 - DNA, 22 bp, Homo sapiens
aaaatattttagggccaggaga

SEQ ID NO: 7987578 - DNA, 22 bp, Homo sapiens
aaaatattttagggccaggaga

SEQ ID NO: 7987579 - DNA, 22 bp, Homo sapiens
aaaatatgtataactcttctgc

SEQ ID NO: 7987580 - DNA, 22 bp, Homo sapiens
aaaatatgtataactcttctgc

SEQ ID NO: 7987581 - DNA, 22 bp, Homo sapiens
aaaatattttagggccaggaga

SEQ ID NO: 7987582 - DNA, 22 bp, Homo sapiens
aaaatattttagggccaggaga

SEQ ID NO: 7987583 - DNA, 22 bp, Homo sapiens
aaaatattttagggccaggaga

SEQ ID NO: 7987584 - DNA, 22 bp, Homo sapiens
aaactgcaattatttttgcaat

SEQ ID NO: 7987585 - DNA, 22 bp, Homo sapiens
aaaatattttagggccaggaga

SEQ ID NO: 7987586 - DNA, 22 bp, Homo sapiens
aaaatattttagggccaggaga

SEQ ID NO: 7987587 - DNA, 22 bp, Homo sapiens
aaactgcacacgatgtgcctga

SEQ ID NO: 7987588 - DNA, 22 bp, Homo sapiens
aaactgcacatgaggctggtgc

SEQ ID NO: 7987589 - DNA, 21 bp, Homo sapiens
aaaatgtgagcgtgatgctta

SEQ ID NO: 7987590 - DNA, 22 bp, Homo sapiens
aaactggtagcaatttaagggt

SEQ ID NO: 7987591 - DNA, 22 bp, Homo sapiens
aaactggtattcaaatgtttgg

SEQ ID NO: 7987592 - DNA, 22 bp, Homo sapiens
aaactggtaataaaatggatta

SEQ ID NO: 7987593 - DNA, 22 bp, Homo sapiens
aaactggtaatcggcaagtgag

SEQ ID NO: 7987594 - DNA, 22 bp, Homo sapiens
aaactggtaatcggcaagtgag

SEQ ID NO: 7987595 - DNA, 22 bp, Homo sapiens
aaactgctttccacagtggcta

SEQ ID NO: 7987596 - DNA, 22 bp, Homo sapiens
aaactggattaccaggctggtg

SEQ ID NO: 7987597 - DNA, 18 bp, Homo sapiens
aaactggcttggcctgtg

SEQ ID NO: 7987598 - DNA, 22 bp, Homo sapiens
aaactgggattcttcacaaggt

SEQ ID NO: 7987599 - DNA, 17 bp, Homo sapiens
aaactggggtcaggagc

SEQ ID NO: 7987600 - DNA, 17 bp, Homo sapiens
aaactggggtcaggagc

SEQ ID NO: 7987601 - DNA, 17 bp, Homo sapiens
aaactggggtcaggagc

SEQ ID NO: 7987602 - DNA, 22 bp, Homo sapiens
aaactgccaaaagaccttggat

SEQ ID NO: 7987603 - DNA, 22 bp, Homo sapiens
aaactgcagagccatggttcaa

SEQ ID NO: 7987604 - DNA, 22 bp, Homo sapiens
aaactgctgggcatatatttct

SEQ ID NO: 7987605 - DNA, 22 bp, Homo sapiens
aaactgcctcctgggcaactaa

SEQ ID NO: 7987606 - DNA, 22 bp, Homo sapiens
aaactgccacaagagggacatc

SEQ ID NO: 7987607 - DNA, 22 bp, Homo sapiens
aaactgctggttgctggccagc

SEQ ID NO: 7987608 - DNA, 22 bp, Homo sapiens
aaactgcaggtcatgacccatt

SEQ ID NO: 7987609 - DNA, 23 bp, Homo sapiens
aaactgcttccaattcctgccat

SEQ ID NO: 7987610 - DNA, 22 bp, Homo sapiens
aaaatatgaagttgtcagtatg

SEQ ID NO: 7987611 - DNA, 22 bp, Homo sapiens
aaaatatgaagttgtcagtatg

SEQ ID NO: 7987612 - DNA, 22 bp, Homo sapiens
aaaatatgaagttgtcagtatg

SEQ ID NO: 7987613 - DNA, 22 bp, Homo sapiens
aaaatatgaagttgtcagtatg

SEQ ID NO: 7987614 - DNA, 22 bp, Homo sapiens
aaaatatgaagttgtcagtatg

SEQ ID NO: 7987615 - DNA, 22 bp, Homo sapiens
aaaatatgactgtgctccttaa

SEQ ID NO: 7987616 - DNA, 22 bp, Homo sapiens
aaaatatggggtgagcccagag

SEQ ID NO: 7987617 - DNA, 22 bp, Homo sapiens
aaaatatggggtgagcccagag

SEQ ID NO: 7987618 - DNA, 22 bp, Homo sapiens
aaaatatgactgtgctccttaa

SEQ ID NO: 7987619 - DNA, 20 bp, Homo sapiens
aaaatatgtataactcttct

SEQ ID NO: 7987620 - DNA, 20 bp, Homo sapiens
aaaatatgtataactcttct

SEQ ID NO: 7987621 - DNA, 22 bp, Homo sapiens
aaaatatggggtgagcccagag

SEQ ID NO: 7987622 - DNA, 22 bp, Homo sapiens
aaaatatggggtgagcccagag

SEQ ID NO: 7987623 - DNA, 22 bp, Homo sapiens
aaaatatggggtgagcccagag

SEQ ID NO: 7987624 - DNA, 20 bp, Homo sapiens
aaaatatgtataactcttct

SEQ ID NO: 7987625 - DNA, 22 bp, Homo sapiens
aaaatactgtggagtgttgaaa

SEQ ID NO: 7987626 - DNA, 22 bp, Homo sapiens
aaacagtattatcaatatattt

SEQ ID NO: 7987627 - DNA, 22 bp, Homo sapiens
aaacagtcaaaggcctaagcta

SEQ ID NO: 7987628 - DNA, 22 bp, Homo sapiens
aaacagtcatggttgctgttca

SEQ ID NO: 7987629 - DNA, 22 bp, Homo sapiens
aaacagtattatcaatatattt

SEQ ID NO: 7987630 - DNA, 22 bp, Homo sapiens
aaaatagttaacgttcagagta

SEQ ID NO: 7987631 - DNA, 22 bp, Homo sapiens
aaaatactgtggagtgttgaaa

SEQ ID NO: 7987632 - DNA, 22 bp, Homo sapiens
aaaatactgtggagtgttgaaa

SEQ ID NO: 7987633 - DNA, 22 bp, Homo sapiens
aaaatatgaagttgtcagtatg

SEQ ID NO: 7987634 - DNA, 22 bp, Homo sapiens
aaaatatgaagttgtcagtatg

SEQ ID NO: 7987635 - DNA, 22 bp, Homo sapiens
aaacagtattatcaatatattt

SEQ ID NO: 7987636 - DNA, 22 bp, Homo sapiens
aaacagtattatcaatatattt

SEQ ID NO: 7987637 - DNA, 22 bp, Homo sapiens
aaacagtattatcaatatattt

SEQ ID NO: 7987638 - DNA, 22 bp, Homo sapiens
aaacagtagaagtgtattttat

SEQ ID NO: 7987639 - DNA, 22 bp, Homo sapiens
aaacagtattatcaatatattt

SEQ ID NO: 7987640 - DNA, 22 bp, Homo sapiens
aaacagtagaagtgtattttat

SEQ ID NO: 7987641 - DNA, 22 bp, Homo sapiens
aaacagtactcgatttttgtag

SEQ ID NO: 7987642 - DNA, 22 bp, Homo sapiens
aaacagtactcgatttttgtag

SEQ ID NO: 7987643 - DNA, 22 bp, Homo sapiens
aaacagtactcgatttttgtag

SEQ ID NO: 7987644 - DNA, 22 bp, Homo sapiens
aaacagtaagttctagtattat

SEQ ID NO: 7987645 - DNA, 22 bp, Homo sapiens
aaacagtaagttctagtattat

SEQ ID NO: 7987646 - DNA, 22 bp, Homo sapiens
aaacagtaagttctagtattat

SEQ ID NO: 7987647 - DNA, 22 bp, Homo sapiens
aaacagtaagttctagtattat

SEQ ID NO: 7987648 - DNA, 22 bp, Homo sapiens
aaacagtaagttctagtattat

SEQ ID NO: 7987649 - DNA, 22 bp, Homo sapiens
aaacaggagttgaccaagtaca

SEQ ID NO: 7987650 - DNA, 22 bp, Homo sapiens
aaacaggagttgaccaagtaca

SEQ ID NO: 7987651 - DNA, 22 bp, Homo sapiens
aaacagctttcagaatctctca

SEQ ID NO: 7987652 - DNA, 22 bp, Homo sapiens
aaacaggcacatagtaacattt

SEQ ID NO: 7987653 - DNA, 22 bp, Homo sapiens
aaacaggagttgaccaagtaca

SEQ ID NO: 7987654 - DNA, 22 bp, Homo sapiens
aaacaggagttgaccaagtaca

SEQ ID NO: 7987655 - DNA, 22 bp, Homo sapiens
aaacaggcatcactcagcaaag

SEQ ID NO: 7987656 - DNA, 22 bp, Homo sapiens
aaacaggcatcactcagcaaag

SEQ ID NO: 7987657 - DNA, 22 bp, Homo sapiens
aaacaggcgcttactaagaaaa

SEQ ID NO: 7987658 - DNA, 19 bp, Homo sapiens
aaacaggccgagtgcctaa

SEQ ID NO: 7987659 - DNA, 22 bp, Homo sapiens
aaacaggcttccattagagcaa

SEQ ID NO: 7987660 - DNA, 22 bp, Homo sapiens
aaacaggcttgcaacatgtttt

SEQ ID NO: 7987661 - DNA, 22 bp, Homo sapiens
aaacaggcttgcaacatgtttt

SEQ ID NO: 7987662 - DNA, 22 bp, Homo sapiens
aaacaggcttttaagtcaatag

SEQ ID NO: 7987663 - DNA, 22 bp, Homo sapiens
aaaagtaattgcaattttgtag

SEQ ID NO: 7987664 - DNA, 22 bp, Homo sapiens
aaaagtaattgatgcaatcgta

SEQ ID NO: 7987665 - DNA, 22 bp, Homo sapiens
aaaagtaattgcaattttgtag

SEQ ID NO: 7987666 - DNA, 22 bp, Homo sapiens
aaaagtaattgcaattttgtag

SEQ ID NO: 7987667 - DNA, 22 bp, Homo sapiens
aaaagtaattgcaattttgtag

SEQ ID NO: 7987668 - DNA, 22 bp, Homo sapiens
aaaaggttttgagtacaaatat

SEQ ID NO: 7987669 - DNA, 22 bp, Homo sapiens
aaaagtaatcgcagtttttgcc

SEQ ID NO: 7987670 - DNA, 22 bp, Homo sapiens
aaaagtaatcgcagtttttgcc

SEQ ID NO: 7987671 - DNA, 22 bp, Homo sapiens
aaaagtaattgatgcaatcgta

SEQ ID NO: 7987672 - DNA, 22 bp, Homo sapiens
aaaagtaatcgcagtttttgcc

SEQ ID NO: 7987673 - DNA, 22 bp, Homo sapiens
aaaagtaatcgcagtttttgcc

SEQ ID NO: 7987674 - DNA, 22 bp, Homo sapiens
aaaaggtagattctccttctat

SEQ ID NO: 7987675 - DNA, 22 bp, Homo sapiens
aaaaggtagttgccaaataagg

SEQ ID NO: 7987676 - DNA, 22 bp, Homo sapiens
aaaaggtagttgccaaataagg

SEQ ID NO: 7987677 - DNA, 22 bp, Homo sapiens
aaaaggtagttgccaaataagg

SEQ ID NO: 7987678 - DNA, 22 bp, Homo sapiens
aaaaggtagttgccaaataagg

SEQ ID NO: 7987679 - DNA, 22 bp, Homo sapiens
aaaattcatggcttgggaaaag

SEQ ID NO: 7987680 - DNA, 22 bp, Homo sapiens
aaaaggacaagctttggagtta

SEQ ID NO: 7987681 - DNA, 19 bp, Homo sapiens
aaaaggagagatcagagtt

SEQ ID NO: 7987682 - DNA, 22 bp, Homo sapiens
aaaagggcaaaaccatcatgga

SEQ ID NO: 7987683 - DNA, 19 bp, Homo sapiens
aaaaggagagatcagagtt

SEQ ID NO: 7987684 - DNA, 22 bp, Homo sapiens
aaacagcttgtttcaggaaagt

SEQ ID NO: 7987685 - DNA, 22 bp, Homo sapiens
aaacagctttcagaatctctca

SEQ ID NO: 7987686 - DNA, 22 bp, Homo sapiens
aaacagctttcagaatctctca

SEQ ID NO: 7987687 - DNA, 22 bp, Homo sapiens
aaacagcttgtttcaggaaagt

SEQ ID NO: 7987688 - DNA, 22 bp, Homo sapiens
aaaagtaattgtggtttttgcc

SEQ ID NO: 7987689 - DNA, 22 bp, Homo sapiens
aaaagtaattgtggtttttgcc

SEQ ID NO: 7987690 - DNA, 22 bp, Homo sapiens
aaaagtaattgtggtttttgcc

SEQ ID NO: 7987691 - DNA, 22 bp, Homo sapiens
aaaagtaattgcagtttttgcc

SEQ ID NO: 7987692 - DNA, 22 bp, Homo sapiens
aaaagtaattgcggtttttgcc

SEQ ID NO: 7987693 - DNA, 22 bp, Homo sapiens
aaaagtaattgcggtttttgcc

SEQ ID NO: 7987694 - DNA, 22 bp, Homo sapiens
aaaagtaattgcggtttttgcc

SEQ ID NO: 7987695 - DNA, 22 bp, Homo sapiens
aaaagtaattgcggtttttgcc

SEQ ID NO: 7987696 - DNA, 22 bp, Homo sapiens
aaaagtaattgcggtttttgct

SEQ ID NO: 7987697 - DNA, 22 bp, Homo sapiens
aaaagtaattgcggtttttgct

SEQ ID NO: 7987698 - DNA, 22 bp, Homo sapiens
aaaagtaattgcggtttttgct

SEQ ID NO: 7987699 - DNA, 22 bp, Homo sapiens
aaaagtaattgcggtttttgct

SEQ ID NO: 7987700 - DNA, 22 bp, Homo sapiens
aaaagtaattgtggttttggcc

SEQ ID NO: 7987701 - DNA, 22 bp, Homo sapiens
aaaagtaattgcagttttgtca

SEQ ID NO: 7987702 - DNA, 22 bp, Homo sapiens
aaaagtaattgcagttttgcca

SEQ ID NO: 7987703 - DNA, 22 bp, Homo sapiens
aaaagtaattgcagttttgtca

SEQ ID NO: 7987704 - DNA, 22 bp, Homo sapiens
aaaagtaattgcagttttgtca

SEQ ID NO: 7987705 - DNA, 22 bp, Homo sapiens
aaaagtaattgcagttttgtca

SEQ ID NO: 7987706 - DNA, 22 bp, Homo sapiens
aaaagtaattgcagtttttgcc

SEQ ID NO: 7987707 - DNA, 22 bp, Homo sapiens
aaaagtaattgcagtttttgcc

SEQ ID NO: 7987708 - DNA, 22 bp, Homo sapiens
aaaagtaattgcagtttttgcc

SEQ ID NO: 7987709 - DNA, 22 bp, Homo sapiens
aaaagtaattgcagttttgcca

SEQ ID NO: 7987710 - DNA, 22 bp, Homo sapiens
aaaagtaattgcagttttcgcc

SEQ ID NO: 7987711 - DNA, 22 bp, Homo sapiens
aaaagtaattgcagttttcgcc

SEQ ID NO: 7987712 - DNA, 22 bp, Homo sapiens
aaaattatggagtatcccaaag

SEQ ID NO: 7987713 - DNA, 22 bp, Homo sapiens
aaaattatggagtatcccaaag

SEQ ID NO: 7987714 - DNA, 22 bp, Homo sapiens
aaaattcatagaactgtacgct

SEQ ID NO: 7987715 - DNA, 22 bp, Homo sapiens
aaaattcatggcttgggaaaag

SEQ ID NO: 7987716 - DNA, 22 bp, Homo sapiens
aaaattcatggcttgggaaaag

SEQ ID NO: 7987717 - DNA, 22 bp, Homo sapiens
aaaattcatggcttgggaaaag

SEQ ID NO: 7987718 - DNA, 22 bp, Homo sapiens
aaaattcatagaactgtacgct

SEQ ID NO: 7987719 - DNA, 22 bp, Homo sapiens
aaaattcatagaactgtacgct

SEQ ID NO: 7987720 - DNA, 22 bp, Homo sapiens
aaaattcatagaactgtacgct

SEQ ID NO: 7987721 - DNA, 22 bp, Homo sapiens
aaaattcatggcttgggaaaag

SEQ ID NO: 7987722 - DNA, 22 bp, Homo sapiens
aaaattaagtgtctgggaagcc

SEQ ID NO: 7987723 - DNA, 22 bp, Homo sapiens
aaaattactattgttcctgggc

SEQ ID NO: 7987724 - DNA, 22 bp, Homo sapiens
aaaattactattgttcctgggc

SEQ ID NO: 7987725 - DNA, 22 bp, Homo sapiens
aaaattaagtgtctgggaagcc

SEQ ID NO: 7987726 - DNA, 22 bp, Homo sapiens
aaaattaagtgtctgggaagcc

SEQ ID NO: 7987727 - DNA, 22 bp, Homo sapiens
aaaattatggagtatcccaaag

SEQ ID NO: 7987728 - DNA, 22 bp, Homo sapiens
aaaattatggagtatcccaaag

SEQ ID NO: 7987729 - DNA, 22 bp, Homo sapiens
aaaattatagatctagtgcctg

SEQ ID NO: 7987730 - DNA, 22 bp, Homo sapiens
aaaattatggagtatcccaaag

SEQ ID NO: 7987731 - DNA, 21 bp, Homo sapiens
aaaatgtttccttgttggtta

SEQ ID NO: 7987732 - DNA, 21 bp, Homo sapiens
aaaatgtttccttgttggtta

SEQ ID NO: 7987733 - DNA, 22 bp, Homo sapiens
aaaatgtgtttatgcatttcgt

SEQ ID NO: 7987734 - DNA, 22 bp, Homo sapiens
aaaagaacctagctcctcagtc

SEQ ID NO: 7987735 - DNA, 22 bp, Homo sapiens
aaaagaacctagctcctcagtc

SEQ ID NO: 7987736 - DNA, 22 bp, Homo sapiens
aaaactttcagggatacagaaa

SEQ ID NO: 7987737 - DNA, 22 bp, Homo sapiens
aaaactgaaccttgagatcttt

SEQ ID NO: 7987738 - DNA, 22 bp, Homo sapiens
aaaactgaaccttgagatcttt

SEQ ID NO: 7987739 - DNA, 22 bp, Homo sapiens
aaaactgaaccttgagatcttt

SEQ ID NO: 7987740 - DNA, 22 bp, Homo sapiens
aaaactgcccagtcagtaagca

SEQ ID NO: 7987741 - DNA, 22 bp, Homo sapiens
aaaactgaggtttcctgaagaa

SEQ ID NO: 7987742 - DNA, 22 bp, Homo sapiens
aaaactgtatcttcttgggact

SEQ ID NO: 7987743 - DNA, 22 bp, Homo sapiens
aaaacttagctaggcaagtttt

SEQ ID NO: 7987744 - DNA, 22 bp, Homo sapiens
aaaacttagctaggcaagtttt

SEQ ID NO: 7987745 - DNA, 22 bp, Homo sapiens
aaaactttcagggatacagaaa

SEQ ID NO: 7987746 - DNA, 22 bp, Homo sapiens
aaaactttcagggatacagaaa

SEQ ID NO: 7987747 - DNA, 22 bp, Homo sapiens
aaaaagtcatattcttgttcct

SEQ ID NO: 7987748 - DNA, 22 bp, Homo sapiens
aaaaagtctgcaaaggaggttg

SEQ ID NO: 7987749 - DNA, 18 bp, Homo sapiens
aaaaagtgctcaggccta

SEQ ID NO: 7987750 - DNA, 22 bp, Homo sapiens
aaaaagtcatattcttgttcct

SEQ ID NO: 7987751 - DNA, 22 bp, Homo sapiens
aaaaagtattggccatggttga

SEQ ID NO: 7987752 - DNA, 22 bp, Homo sapiens
aaaaatacttcacttctgggtg

SEQ ID NO: 7987753 - DNA, 22 bp, Homo sapiens
aaaaatacttcacttctgggtg

SEQ ID NO: 7987754 - DNA, 22 bp, Homo sapiens
aaaaatacttcacttctgggtg

SEQ ID NO: 7987755 - DNA, 22 bp, Homo sapiens
aaaaagtttcaactgccaactc

SEQ ID NO: 7987756 - DNA, 22 bp, Homo sapiens
aaaaagtttcaactgccaactc

SEQ ID NO: 7987757 - DNA, 22 bp, Homo sapiens
aaaaagtttcaactgccaactc

SEQ ID NO: 7987758 - DNA, 22 bp, Homo sapiens
aaaaatacttcacttctgggtg

SEQ ID NO: 7987759 - DNA, 22 bp, Homo sapiens
aaaaatacttcacttctgggtg

SEQ ID NO: 7987760 - DNA, 22 bp, Homo sapiens
aaaaatacttcacttctgggtg

SEQ ID NO: 7987761 - DNA, 22 bp, Homo sapiens
aaaaatacttcacttctgggtg

SEQ ID NO: 7987762 - DNA, 22 bp, Homo sapiens
aaaaggaggcaaacagcctaga

SEQ ID NO: 7987763 - DNA, 22 bp, Homo sapiens
aaaaatacttcacttctgggtg

SEQ ID NO: 7987764 - DNA, 22 bp, Homo sapiens
aaaaatacttcacttctgggtg

SEQ ID NO: 7987765 - DNA, 22 bp, Homo sapiens
aaaaatacttcacttctgggtg

SEQ ID NO: 7987766 - DNA, 22 bp, Homo sapiens
aaaaggatcagattttgagcag

SEQ ID NO: 7987767 - DNA, 21 bp, Homo sapiens
aaaaggaggcaggtgaacagc

SEQ ID NO: 7987768 - DNA, 22 bp, Homo sapiens
aaaaggaggtcactttattcct

SEQ ID NO: 7987769 - DNA, 22 bp, Homo sapiens
aaaaagcttaaatgagcagttc

SEQ ID NO: 7987770 - DNA, 22 bp, Homo sapiens
aaaaagcttaaatgagcagttc

SEQ ID NO: 7987771 - DNA, 22 bp, Homo sapiens
aaaaaggctaagcatcttgtgc

SEQ ID NO: 7987772 - DNA, 22 bp, Homo sapiens
aaaaaggctaagcatcttgtgc

SEQ ID NO: 7987773 - DNA, 22 bp, Homo sapiens
aaaaaggctaagcatcttgtgc

SEQ ID NO: 7987774 - DNA, 22 bp, Homo sapiens
aaaaagtattggccatggttga

SEQ ID NO: 7987775 - DNA, 22 bp, Homo sapiens
aaaaagtattggccatggttga

SEQ ID NO: 7987776 - DNA, 22 bp, Homo sapiens
aaaaagtattggccatggttga

SEQ ID NO: 7987777 - DNA, 22 bp, Homo sapiens
aaaaagtattggccatggttga

SEQ ID NO: 7987778 - DNA, 22 bp, Homo sapiens
aaaaaggttgatccagattagg

SEQ ID NO: 7987779 - DNA, 22 bp, Homo sapiens
aaaaaggttgatccagattagg

SEQ ID NO: 7987780 - DNA, 22 bp, Homo sapiens
aaaaagatgtcctgaagtttag

SEQ ID NO: 7987781 - DNA, 22 bp, Homo sapiens
aaaaactggtaactattcccca

SEQ ID NO: 7987782 - DNA, 22 bp, Homo sapiens
aaaaagatgtcctgaagtttag

SEQ ID NO: 7987783 - DNA, 22 bp, Homo sapiens
aaaaactgcaattacttttgtc

SEQ ID NO: 7987784 - DNA, 22 bp, Homo sapiens
aaaaactgcaattacttttgtc

SEQ ID NO: 7987785 - DNA, 21 bp, Homo sapiens
aaaaagctggggcatgcatgc

SEQ ID NO: 7987786 - DNA, 21 bp, Homo sapiens
aaaaagctggggcatgcatgc

SEQ ID NO: 7987787 - DNA, 22 bp, Homo sapiens
aaaaagcttaaatgagcagttc

SEQ ID NO: 7987788 - DNA, 22 bp, Homo sapiens
aaaaccaggcttgctgtgctcg

SEQ ID NO: 7987789 - DNA, 22 bp, Homo sapiens
aaaaggctagctagtaacagaa

SEQ ID NO: 7987790 - DNA, 22 bp, Homo sapiens
aaaacataaactgacagcccat

SEQ ID NO: 7987791 - DNA, 22 bp, Homo sapiens
aaaacctgtgaatagttaactc

SEQ ID NO: 7987792 - DNA, 22 bp, Homo sapiens
aaaacctgattgaattctattt

SEQ ID NO: 7987793 - DNA, 22 bp, Homo sapiens
aaaacctgattgaattctattt

SEQ ID NO: 7987794 - DNA, 22 bp, Homo sapiens
aaaacctgattgaattctattt

SEQ ID NO: 7987795 - DNA, 22 bp, Homo sapiens
aaaacccttctgcagactctga

SEQ ID NO: 7987796 - DNA, 22 bp, Homo sapiens
aaaactctgcagttagtttcta

SEQ ID NO: 7987797 - DNA, 22 bp, Homo sapiens
aaaactctgcagttagtttcta

SEQ ID NO: 7987798 - DNA, 22 bp, Homo sapiens
aaaactcaaacattttggcata

SEQ ID NO: 7987799 - DNA, 22 bp, Homo sapiens
aaaactctgcagttagtttcta

SEQ ID NO: 7987800 - DNA, 22 bp, Homo sapiens
aaaactctgcagttagtttcta

SEQ ID NO: 7987801 - DNA, 22 bp, Homo sapiens
aaaaccttctagactttatatt

SEQ ID NO: 7987802 - DNA, 22 bp, Homo sapiens
aaaaccttctagactttatatt

SEQ ID NO: 7987803 - DNA, 22 bp, Homo sapiens
aaaacgatgtttaaaagctctg

SEQ ID NO: 7987804 - DNA, 22 bp, Homo sapiens
aaaactacatttgacattttgt

SEQ ID NO: 7987805 - DNA, 22 bp, Homo sapiens
aaaactaaatacgctttgcctc

SEQ ID NO: 7987806 - DNA, 22 bp, Homo sapiens
aaaacagtttttgctaactgct

SEQ ID NO: 7987807 - DNA, 22 bp, Homo sapiens
aaaaggctcttcaaaatggaag

SEQ ID NO: 7987808 - DNA, 22 bp, Homo sapiens
aaaaggctaattaagttttgga

SEQ ID NO: 7987809 - DNA, 22 bp, Homo sapiens
aaaaggctagctagtaacagaa

SEQ ID NO: 7987810 - DNA, 22 bp, Homo sapiens
aaaaggctaattaagttttgga

SEQ ID NO: 7987811 - DNA, 22 bp, Homo sapiens
aaaaggctaatccagagcaact

SEQ ID NO: 7987812 - DNA, 22 bp, Homo sapiens
aaaaggcattttgtcaaccata

SEQ ID NO: 7987813 - DNA, 22 bp, Homo sapiens
aaaaggcattttgtcaaccata

SEQ ID NO: 7987814 - DNA, 22 bp, Homo sapiens
aaaaggcatggaggttgatagt

SEQ ID NO: 7987815 - DNA, 22 bp, Homo sapiens
aaaaggctaatccagagcaact

SEQ ID NO: 7987816 - DNA, 22 bp, Homo sapiens
aaaaggcattttgtcaaccata

SEQ ID NO: 7987817 - DNA, 22 bp, Homo sapiens
aaaaggatgttttcatgaaaca

SEQ ID NO: 7987818 - DNA, 22 bp, Homo sapiens
aaaaggatgttttcatgaaaca

SEQ ID NO: 7987819 - DNA, 22 bp, Homo sapiens
aaaaggatgttttcatgaaaca

SEQ ID NO: 7987820 - DNA, 22 bp, Homo sapiens
aaaaggcagtgcaagagagggt

SEQ ID NO: 7987821 - DNA, 22 bp, Homo sapiens
aaaaggcagtgcaagagagggt

SEQ ID NO: 7987822 - DNA, 22 bp, Homo sapiens
aaaaggcagtgcaagagagggt

SEQ ID NO: 7987823 - DNA, 22 bp, Homo sapiens
aaaaggcagtgcaagagagggt

SEQ ID NO: 7987824 - DNA, 22 bp, Homo sapiens
aaaaggcagtgcaagagagggt

SEQ ID NO: 7987825 - DNA, 22 bp, Homo sapiens
aaaaggcatggaggttgatagt

SEQ ID NO: 7987826 - DNA, 22 bp, Homo sapiens
aaaaggcatggaggttgatagt

SEQ ID NO: 7987827 - DNA, 22 bp, Homo sapiens
aaaaggcagtgcaagagagggt

SEQ ID NO: 7987828 - DNA, 22 bp, Homo sapiens
aaaaggcatggaggttgatagt

SEQ ID NO: 7987829 - DNA, 22 bp, Homo sapiens
aaaaggcatggaggttgatagt

SEQ ID NO: 7987830 - DNA, 22 bp, Homo sapiens
aaaaggcatggaggttgatagt

SEQ ID NO: 7987831 - DNA, 18 bp, Homo sapiens
acacaggctgacagcacc

SEQ ID NO: 7987832 - DNA, 18 bp, Homo sapiens
acacaggctgacagcacc

SEQ ID NO: 7987833 - DNA, 22 bp, Homo sapiens
acacaggcatagccatacatgt

SEQ ID NO: 7987834 - DNA, 18 bp, Homo sapiens
acacaggctgacagcacc

SEQ ID NO: 7987835 - DNA, 18 bp, Homo sapiens
acacaggctgacagcacc

SEQ ID NO: 7987836 - DNA, 18 bp, Homo sapiens
acacaggctgacagcacc

SEQ ID NO: 7987837 - DNA, 18 bp, Homo sapiens
acacaggctgacagcacc

SEQ ID NO: 7987838 - DNA, 22 bp, Homo sapiens
agcagctggttcccgagggcgt

SEQ ID NO: 7987839 - DNA, 22 bp, Homo sapiens
agcagctggttcccgagggcgt

SEQ ID NO: 7987840 - DNA, 22 bp, Homo sapiens
agcagctggttcccgagggcgt

SEQ ID NO: 7987841 - DNA, 22 bp, Homo sapiens
agcagctggtgcaactctaaga

SEQ ID NO: 7987842 - DNA, 22 bp, Homo sapiens
agcagctggttcccgagggcgt

SEQ ID NO: 7987843 - DNA, 22 bp, Homo sapiens
agcagctggttcccgagggcgt

SEQ ID NO: 7987844 - DNA, 22 bp, Homo sapiens
agcagctgtactttcatctgtt

SEQ ID NO: 7987845 - DNA, 22 bp, Homo sapiens
agcagctggttcccgagggcgt

SEQ ID NO: 7987846 - DNA, 22 bp, Homo sapiens
agcagctggttcccgagggcgt

SEQ ID NO: 7987847 - DNA, 17 bp, Homo sapiens
acacagggagagggagc

SEQ ID NO: 7987848 - DNA, 17 bp, Homo sapiens
acacagggagagggagc

SEQ ID NO: 7987849 - DNA, 17 bp, Homo sapiens
acacagggagagggagc

SEQ ID NO: 7987850 - DNA, 17 bp, Homo sapiens
acacagggagagggagc

SEQ ID NO: 7987851 - DNA, 17 bp, Homo sapiens
acacagggagagggagc

SEQ ID NO: 7987852 - DNA, 17 bp, Homo sapiens
acacagggagagggagc

SEQ ID NO: 7987853 - DNA, 22 bp, Homo sapiens
acacagggatatttcaggtggt

SEQ ID NO: 7987854 - DNA, 22 bp, Homo sapiens
acacagggatatttcaggtggt

SEQ ID NO: 7987855 - DNA, 22 bp, Homo sapiens
acacagggatatttcaggtggt

SEQ ID NO: 7987856 - DNA, 22 bp, Homo sapiens
acacagggatatttcaggtggt

SEQ ID NO: 7987857 - DNA, 22 bp, Homo sapiens
acacagggatatttcaggtggt

SEQ ID NO: 7987858 - DNA, 22 bp, Homo sapiens
acacagggaggaggtgctgtgc

SEQ ID NO: 7987859 - DNA, 22 bp, Homo sapiens
acacagggaggaggtgctgtgc

SEQ ID NO: 7987860 - DNA, 22 bp, Homo sapiens
acacagggaggaggtgctgtgc

SEQ ID NO: 7987861 - DNA, 22 bp, Homo sapiens
acacagggaggaggtgctgtgc

SEQ ID NO: 7987862 - DNA, 22 bp, Homo sapiens
acacagggaggaggtgctgtgc

SEQ ID NO: 7987863 - DNA, 22 bp, Homo sapiens
acacagggaggaggtgctgtgc

SEQ ID NO: 7987864 - DNA, 22 bp, Homo sapiens
acacatcttagactgaaatatg

SEQ ID NO: 7987865 - DNA, 22 bp, Homo sapiens
acacatctgcaagagccagacc

SEQ ID NO: 7987866 - DNA, 22 bp, Homo sapiens
acacagggcggaaagcatgaga

SEQ ID NO: 7987867 - DNA, 22 bp, Homo sapiens
acacagggcggaaagcatgaga

SEQ ID NO: 7987868 - DNA, 22 bp, Homo sapiens
acacagggcggaaagcatgaga

SEQ ID NO: 7987869 - DNA, 22 bp, Homo sapiens
acacatgggtggggagctaagt

SEQ ID NO: 7987870 - DNA, 22 bp, Homo sapiens
acacatgctgataagaatataa

SEQ ID NO: 7987871 - DNA, 22 bp, Homo sapiens
acacatggtggctggactatag

SEQ ID NO: 7987872 - DNA, 19 bp, Homo sapiens
acacatgtaacagtttttc

SEQ ID NO: 7987873 - DNA, 22 bp, Homo sapiens
acacatgtaaaacacttagcaa

SEQ ID NO: 7987874 - DNA, 22 bp, Homo sapiens
acacagggcagagagctggctc

SEQ ID NO: 7987875 - DNA, 22 bp, Homo sapiens
acacagggcagagagctggctc

SEQ ID NO: 7987876 - DNA, 22 bp, Homo sapiens
acacagggcggaaagcatgaga

SEQ ID NO: 7987877 - DNA, 22 bp, Homo sapiens
acacagggcggaaagcatgaga

SEQ ID NO: 7987878 - DNA, 22 bp, Homo sapiens
acacagggcagagagctggctc

SEQ ID NO: 7987879 - DNA, 22 bp, Homo sapiens
acacagggcagagagctggctc

SEQ ID NO: 7987880 - DNA, 22 bp, Homo sapiens
acacagggcagagagctggctc

SEQ ID NO: 7987881 - DNA, 22 bp, Homo sapiens
acacagggcagagagctggctc

SEQ ID NO: 7987882 - DNA, 19 bp, Homo sapiens
acacagggatcagagggtt

SEQ ID NO: 7987883 - DNA, 19 bp, Homo sapiens
acacagggatcagagggtt

SEQ ID NO: 7987884 - DNA, 19 bp, Homo sapiens
acacagggatcagagggtt

SEQ ID NO: 7987885 - DNA, 19 bp, Homo sapiens
acacagggatcagagggtt

SEQ ID NO: 7987886 - DNA, 19 bp, Homo sapiens
acacagggatcagagggtt

SEQ ID NO: 7987887 - DNA, 19 bp, Homo sapiens
acacagggatcagagggtt

SEQ ID NO: 7987888 - DNA, 19 bp, Homo sapiens
acacagggatcagagggtt

SEQ ID NO: 7987889 - DNA, 22 bp, Homo sapiens
acacagggcaatgctttgacct

SEQ ID NO: 7987890 - DNA, 22 bp, Homo sapiens
acacagggcaatgctttgacct

SEQ ID NO: 7987891 - DNA, 22 bp, Homo sapiens
acacatgtacagattagtattt

SEQ ID NO: 7987892 - DNA, 22 bp, Homo sapiens
acacatggattgcttagctgga

SEQ ID NO: 7987893 - DNA, 19 bp, Homo sapiens
acacatgtaacagtttttc

SEQ ID NO: 7987894 - DNA, 22 bp, Homo sapiens
acacatgtacagattagtattt

SEQ ID NO: 7987895 - DNA, 22 bp, Homo sapiens
acacatgtacagattagtattt

SEQ ID NO: 7987896 - DNA, 22 bp, Homo sapiens
acacatgtatatgcttgtgtgt

SEQ ID NO: 7987897 - DNA, 22 bp, Homo sapiens
acacatgtatatgcttgtgtgt

SEQ ID NO: 7987898 - DNA, 20 bp, Homo sapiens
acacatgtcaagctaaaggc

SEQ ID NO: 7987899 - DNA, 20 bp, Homo sapiens
acacatgtcaagctaaaggc

SEQ ID NO: 7987900 - DNA, 20 bp, Homo sapiens
acacatgtcaagctaaaggc

SEQ ID NO: 7987901 - DNA, 22 bp, Homo sapiens
acacatgtatgttttgtatttg

SEQ ID NO: 7987902 - DNA, 22 bp, Homo sapiens
acacatgtgattctaagacagc

SEQ ID NO: 7987903 - DNA, 22 bp, Homo sapiens
acacatgtgattctaagacagc

SEQ ID NO: 7987904 - DNA, 22 bp, Homo sapiens
acacatgtgattctaagacagc

SEQ ID NO: 7987905 - DNA, 22 bp, Homo sapiens
acacatgtgattctaagacagc

SEQ ID NO: 7987906 - DNA, 22 bp, Homo sapiens
acacatgtttacagtcttcagt

SEQ ID NO: 7987907 - DNA, 22 bp, Homo sapiens
acacatgtttacagtcttcagt

SEQ ID NO: 7987908 - DNA, 22 bp, Homo sapiens
acacatgtttacagtcttcagt

SEQ ID NO: 7987909 - DNA, 22 bp, Homo sapiens
acacatgtttacagtcttcagt

SEQ ID NO: 7987910 - DNA, 22 bp, Homo sapiens
acacatgtgtctgcatgcagtg

SEQ ID NO: 7987911 - DNA, 20 bp, Homo sapiens
acacatgtgcgtgttcagta

SEQ ID NO: 7987912 - DNA, 20 bp, Homo sapiens
acacatgtgcgtgttcagta

SEQ ID NO: 7987913 - DNA, 20 bp, Homo sapiens
acacatgtgcgtgttcagta

SEQ ID NO: 7987914 - DNA, 20 bp, Homo sapiens
acacatgtgcgtgttcagta

SEQ ID NO: 7987915 - DNA, 20 bp, Homo sapiens
acacatgtgcgtgttcagta

SEQ ID NO: 7987916 - DNA, 22 bp, Homo sapiens
acacattaacctttgaaattct

SEQ ID NO: 7987917 - DNA, 22 bp, Homo sapiens
acacattaaaacgtctacaatg

SEQ ID NO: 7987918 - DNA, 22 bp, Homo sapiens
acacattaacctttgaaattct

SEQ ID NO: 7987919 - DNA, 22 bp, Homo sapiens
acacattaacctttgaaattct

SEQ ID NO: 7987920 - DNA, 22 bp, Homo sapiens
acacattaaaacgtctacaatg

SEQ ID NO: 7987921 - DNA, 22 bp, Homo sapiens
acacattaaaacgtctacaatg

SEQ ID NO: 7987922 - DNA, 22 bp, Homo sapiens
acacattaaaacgtctacaatg

SEQ ID NO: 7987923 - DNA, 22 bp, Homo sapiens
acacattaaaacgtctacaatg

SEQ ID NO: 7987924 - DNA, 22 bp, Homo sapiens
acacatgtttccaaaagcaccc

SEQ ID NO: 7987925 - DNA, 22 bp, Homo sapiens
acacatgtttccaaaagcaccc

SEQ ID NO: 7987926 - DNA, 22 bp, Homo sapiens
acacatgtttacagtcttcagt

SEQ ID NO: 7987927 - DNA, 22 bp, Homo sapiens
acacatgtttgtgtagtcagtt

SEQ ID NO: 7987928 - DNA, 22 bp, Homo sapiens
acacatgtttgtgtagtcagtt

SEQ ID NO: 7987929 - DNA, 22 bp, Homo sapiens
acacatgtttgtgtagtcagtt

SEQ ID NO: 7987930 - DNA, 22 bp, Homo sapiens
acactataagacagatacagca

SEQ ID NO: 7987931 - DNA, 22 bp, Homo sapiens
acactataagacagatacagca

SEQ ID NO: 7987932 - DNA, 22 bp, Homo sapiens
acactagtggaaattgatttgt

SEQ ID NO: 7987933 - DNA, 22 bp, Homo sapiens
acactagtatttctataagtga

SEQ ID NO: 7987934 - DNA, 22 bp, Homo sapiens
acactagctattaacttcacat

SEQ ID NO: 7987935 - DNA, 22 bp, Homo sapiens
acactagtagaatagtgtttgc

SEQ ID NO: 7987936 - DNA, 22 bp, Homo sapiens
acacccaggaataaggactggg

SEQ ID NO: 7987937 - DNA, 22 bp, Homo sapiens
acacccaggaataaggactggg

SEQ ID NO: 7987938 - DNA, 22 bp, Homo sapiens
acacccaggaataaggactggg

SEQ ID NO: 7987939 - DNA, 22 bp, Homo sapiens
acactagctaaatgctgattaa

SEQ ID NO: 7987940 - DNA, 22 bp, Homo sapiens
acacccaggctggcgtgcagtg

SEQ ID NO: 7987941 - DNA, 22 bp, Homo sapiens
acacattatagagagtataata

SEQ ID NO: 7987942 - DNA, 22 bp, Homo sapiens
acacattataggcaatcaaaag

SEQ ID NO: 7987943 - DNA, 22 bp, Homo sapiens
acacattataggcaatcaaaag

SEQ ID NO: 7987944 - DNA, 22 bp, Homo sapiens
acacattataggcaatcaaaag

SEQ ID NO: 7987945 - DNA, 22 bp, Homo sapiens
acacattatagagagtataata

SEQ ID NO: 7987946 - DNA, 22 bp, Homo sapiens
acacattatagagagtataata

SEQ ID NO: 7987947 - DNA, 22 bp, Homo sapiens
acacattagtgctctgtctcat

SEQ ID NO: 7987948 - DNA, 22 bp, Homo sapiens
acacattatagagagtataata

SEQ ID NO: 7987949 - DNA, 22 bp, Homo sapiens
acacattaggcagtgcttaaat

SEQ ID NO: 7987950 - DNA, 22 bp, Homo sapiens
acacattagtgctctgtctcat

SEQ ID NO: 7987951 - DNA, 22 bp, Homo sapiens
acacattaggcagtgcttaaat

SEQ ID NO: 7987952 - DNA, 22 bp, Homo sapiens
acacattaggcagtgcttaaat

SEQ ID NO: 7987953 - DNA, 22 bp, Homo sapiens
acactctgtaatgtcacactcc

SEQ ID NO: 7987954 - DNA, 22 bp, Homo sapiens
acactctgtgaggcatgtaatg

SEQ ID NO: 7987955 - DNA, 22 bp, Homo sapiens
acactctgtgaggcatgtaatg

SEQ ID NO: 7987956 - DNA, 22 bp, Homo sapiens
acactctacagagcaatctacc

SEQ ID NO: 7987957 - DNA, 22 bp, Homo sapiens
acactccagggagggagggaat

SEQ ID NO: 7987958 - DNA, 22 bp, Homo sapiens
acactctagagggaagcgcttt

SEQ ID NO: 7987959 - DNA, 22 bp, Homo sapiens
acactctgtaatgtcacactcc

SEQ ID NO: 7987960 - DNA, 22 bp, Homo sapiens
acactcaccctcccactgcctg

SEQ ID NO: 7987961 - DNA, 22 bp, Homo sapiens
acactatttaaatctaacctgt

SEQ ID NO: 7987962 - DNA, 22 bp, Homo sapiens
acactatttaaatctaacctgt

SEQ ID NO: 7987963 - DNA, 22 bp, Homo sapiens
acactatacttccattgctggt

SEQ ID NO: 7987964 - DNA, 22 bp, Homo sapiens
acactatacttccattgctggt

SEQ ID NO: 7987965 - DNA, 22 bp, Homo sapiens
acactgaatcagaaattgttgg

SEQ ID NO: 7987966 - DNA, 22 bp, Homo sapiens
acactgaatatacaatgaatat

SEQ ID NO: 7987967 - DNA, 22 bp, Homo sapiens
acactgaatatacaatgaatat

SEQ ID NO: 7987968 - DNA, 22 bp, Homo sapiens
acactgaataattgagagttga

SEQ ID NO: 7987969 - DNA, 22 bp, Homo sapiens
acactgaataattgagagttga

SEQ ID NO: 7987970 - DNA, 22 bp, Homo sapiens
acactgaagagcactttcaaag

SEQ ID NO: 7987971 - DNA, 22 bp, Homo sapiens
acactctttttgtggttgtcta

SEQ ID NO: 7987972 - DNA, 22 bp, Homo sapiens
acactgattgtagtctgtggtg

SEQ ID NO: 7987973 - DNA, 19 bp, Homo sapiens
acactgatcagatcagcag

SEQ ID NO: 7987974 - DNA, 22 bp, Homo sapiens
acactgatgttggccctggtca

SEQ ID NO: 7987975 - DNA, 19 bp, Homo sapiens
acactgatcagatcagcag

SEQ ID NO: 7987976 - DNA, 19 bp, Homo sapiens
acactgatcagatcagcag

SEQ ID NO: 7987977 - DNA, 22 bp, Homo sapiens
acactgagttttaccaggcaca

SEQ ID NO: 7987978 - DNA, 22 bp, Homo sapiens
acactgcagatgaaagcataag

SEQ ID NO: 7987979 - DNA, 22 bp, Homo sapiens
acactgagtgtagaaatagcca

SEQ ID NO: 7987980 - DNA, 22 bp, Homo sapiens
acactgagttttaccaggcaca

SEQ ID NO: 7987981 - DNA, 22 bp, Homo sapiens
acactgagtattgagtagggta

SEQ ID NO: 7987982 - DNA, 22 bp, Homo sapiens
acacttcagcagtatgcttggg

SEQ ID NO: 7987983 - DNA, 22 bp, Homo sapiens
acacttcagcagtatgcttggg

SEQ ID NO: 7987984 - DNA, 22 bp, Homo sapiens
acactttacagaatgttttgat

SEQ ID NO: 7987985 - DNA, 22 bp, Homo sapiens
acactttactcttacaccattg

SEQ ID NO: 7987986 - DNA, 22 bp, Homo sapiens
acactttactcttacaccattg

SEQ ID NO: 7987987 - DNA, 22 bp, Homo sapiens
acactttacagcttcctttgca

SEQ ID NO: 7987988 - DNA, 22 bp, Homo sapiens
acactttagaaaaaagaatggt

SEQ ID NO: 7987989 - DNA, 22 bp, Homo sapiens
acactttactcttacaccattg

SEQ ID NO: 7987990 - DNA, 22 bp, Homo sapiens
acactttagaaaaaagaatggt

SEQ ID NO: 7987991 - DNA, 22 bp, Homo sapiens
acactttagaaaaaagaatggt

SEQ ID NO: 7987992 - DNA, 22 bp, Homo sapiens
acactgaatgctgtttagaaat

SEQ ID NO: 7987993 - DNA, 22 bp, Homo sapiens
acactgaatgtttaagaacttg

SEQ ID NO: 7987994 - DNA, 22 bp, Homo sapiens
acactgaatgtttaagaacttg

SEQ ID NO: 7987995 - DNA, 19 bp, Homo sapiens
acactgaatgtagaattgg

SEQ ID NO: 7987996 - DNA, 17 bp, Homo sapiens
acactgacatgccacac

SEQ ID NO: 7987997 - DNA, 17 bp, Homo sapiens
acactgacatgccacac

SEQ ID NO: 7987998 - DNA, 21 bp, Homo sapiens
acactgacaaccatccacgag

SEQ ID NO: 7987999 - DNA, 22 bp, Homo sapiens
acactgaatgtttaagaacttg

SEQ ID NO: 7988000 - DNA, 22 bp, Homo sapiens
acactgagcttccaagatgggg

SEQ ID NO: 7988001 - DNA, 22 bp, Homo sapiens
acactgagaggtgacagcgtgc

SEQ ID NO: 7988002 - DNA, 22 bp, Homo sapiens
acactgagattttcctgacacc

SEQ ID NO: 7988003 - DNA, 22 bp, Homo sapiens
acactgagcatctctagaggca

SEQ ID NO: 7988004 - DNA, 22 bp, Homo sapiens
acactgacgcttgacagtcacc

SEQ ID NO: 7988005 - DNA, 22 bp, Homo sapiens
acactgactgggacagaagacc

SEQ ID NO: 7988006 - DNA, 22 bp, Homo sapiens
acactgactgggacagaagacc

SEQ ID NO: 7988007 - DNA, 22 bp, Homo sapiens
acactgacgcttgacagtcacc

SEQ ID NO: 7988008 - DNA, 22 bp, Homo sapiens
agcagatgaatcccagataaag

SEQ ID NO: 7988009 - DNA, 22 bp, Homo sapiens
agcagatatttgttgagcactt

SEQ ID NO: 7988010 - DNA, 22 bp, Homo sapiens
agcagatgagcctcatgactgg

SEQ ID NO: 7988011 - DNA, 22 bp, Homo sapiens
agcagatgaatcccagataaag

SEQ ID NO: 7988012 - DNA, 22 bp, Homo sapiens
agcagagcctgggctaggggtg

SEQ ID NO: 7988013 - DNA, 22 bp, Homo sapiens
agcagagtttctcaacatcagc

SEQ ID NO: 7988014 - DNA, 22 bp, Homo sapiens
agcagagtttctcaacatcagc

SEQ ID NO: 7988015 - DNA, 20 bp, Homo sapiens
agcagatagcgggagagttt

SEQ ID NO: 7988016 - DNA, 19 bp, Homo sapiens
agcagagccctgaagatcc

SEQ ID NO: 7988017 - DNA, 18 bp, Homo sapiens
agcagagcccatgcattc

SEQ ID NO: 7988018 - DNA, 19 bp, Homo sapiens
agcagagccctgaagatcc

SEQ ID NO: 7988019 - DNA, 18 bp, Homo sapiens
agcagagcccatgcattc

SEQ ID NO: 7988020 - DNA, 18 bp, Homo sapiens
agcagagcccatgcattc

SEQ ID NO: 7988021 - DNA, 18 bp, Homo sapiens
agcagagcccatgcattc

SEQ ID NO: 7988022 - DNA, 22 bp, Homo sapiens
agcagagcctgggctaggggtg

SEQ ID NO: 7988023 - DNA, 22 bp, Homo sapiens
agcagagcctgggctaggggtg

SEQ ID NO: 7988024 - DNA, 22 bp, Homo sapiens
agcagagcccttccatggcctt

SEQ ID NO: 7988025 - DNA, 22 bp, Homo sapiens
agcagagcccttccatggcctt

SEQ ID NO: 7988026 - DNA, 22 bp, Homo sapiens
agcagagcccttccatggcctt

SEQ ID NO: 7988027 - DNA, 22 bp, Homo sapiens
agcagatgttccctggtccctt

SEQ ID NO: 7988028 - DNA, 22 bp, Homo sapiens
agcagatgttccctggtccctt

SEQ ID NO: 7988029 - DNA, 22 bp, Homo sapiens
agcagatgtgtctctgcactgt

SEQ ID NO: 7988030 - DNA, 22 bp, Homo sapiens
agcagatgtgtctctgcactgt

SEQ ID NO: 7988031 - DNA, 22 bp, Homo sapiens
agcagatggtgtcatgggatgg

SEQ ID NO: 7988032 - DNA, 22 bp, Homo sapiens
agcagatggtgtcatgggatgg

SEQ ID NO: 7988033 - DNA, 22 bp, Homo sapiens
agcagatgcgtctgagtgggag

SEQ ID NO: 7988034 - DNA, 22 bp, Homo sapiens
agcagatgggagatggagctgc

SEQ ID NO: 7988035 - DNA, 22 bp, Homo sapiens
agcagatgggagatggagctgc

SEQ ID NO: 7988036 - DNA, 22 bp, Homo sapiens
agcagatggagaatggagtcag

SEQ ID NO: 7988037 - DNA, 22 bp, Homo sapiens
agcagatgagcctcatgactgg

SEQ ID NO: 7988038 - DNA, 22 bp, Homo sapiens
agcagatgcattatgattgaaa

SEQ ID NO: 7988039 - DNA, 22 bp, Homo sapiens
agcagatgcaaacttaccttga

SEQ ID NO: 7988040 - DNA, 22 bp, Homo sapiens
agcagatgcattatgattgaaa

SEQ ID NO: 7988041 - DNA, 22 bp, Homo sapiens
agcagatgttccctggtccctt

SEQ ID NO: 7988042 - DNA, 22 bp, Homo sapiens
agcagatgtttcagagcaggct

SEQ ID NO: 7988043 - DNA, 23 bp, Homo sapiens
agcagcaaaaatttatctttctg

SEQ ID NO: 7988044 - DNA, 22 bp, Homo sapiens
agcagcaaaagagaatagtttg

SEQ ID NO: 7988045 - DNA, 22 bp, Homo sapiens
agcagcaaaagagaatagtttg

SEQ ID NO: 7988046 - DNA, 22 bp, Homo sapiens
acacagaagatctcttaatgct

SEQ ID NO: 7988047 - DNA, 22 bp, Homo sapiens
acacagaagatctcttaatgct

SEQ ID NO: 7988048 - DNA, 22 bp, Homo sapiens
acacagaagatctcttaatgct

SEQ ID NO: 7988049 - DNA, 22 bp, Homo sapiens
acacagaagatctcttaatgct

SEQ ID NO: 7988050 - DNA, 22 bp, Homo sapiens
agcagcaaagaataggccctct

SEQ ID NO: 7988051 - DNA, 22 bp, Homo sapiens
agcagcaaagaataggccctct

SEQ ID NO: 7988052 - DNA, 22 bp, Homo sapiens
agcagcaaagccaggggatggg

SEQ ID NO: 7988053 - DNA, 22 bp, Homo sapiens
agcagcaaagaataggccctct

SEQ ID NO: 7988054 - DNA, 22 bp, Homo sapiens
agcagagccaggtctctctgta

SEQ ID NO: 7988055 - DNA, 22 bp, Homo sapiens
agcagagccagaattggaccag

SEQ ID NO: 7988056 - DNA, 22 bp, Homo sapiens
agcagagccagaattggaccag

SEQ ID NO: 7988057 - DNA, 22 bp, Homo sapiens
agcagagccagaattggaccag

SEQ ID NO: 7988058 - DNA, 22 bp, Homo sapiens
agcagagccaggtctctctgta

SEQ ID NO: 7988059 - DNA, 22 bp, Homo sapiens
agcagagccaggtctctctgta

SEQ ID NO: 7988060 - DNA, 22 bp, Homo sapiens
agcagagcatggtgggaagggc

SEQ ID NO: 7988061 - DNA, 21 bp, Homo sapiens
agcagagccaccattacctgc

SEQ ID NO: 7988062 - DNA, 22 bp, Homo sapiens
agcagagccagaattggaccag

SEQ ID NO: 7988063 - DNA, 22 bp, Homo sapiens
agcagagcatggtgggaagggc

SEQ ID NO: 7988064 - DNA, 22 bp, Homo sapiens
agcagagcatgctaagtgactc

SEQ ID NO: 7988065 - DNA, 22 bp, Homo sapiens
agcagagcatgctaagtgactc

SEQ ID NO: 7988066 - DNA, 19 bp, Homo sapiens
agcagagcagggccgtggg

SEQ ID NO: 7988067 - DNA, 22 bp, Homo sapiens
agcagagcagatagtattatct

SEQ ID NO: 7988068 - DNA, 22 bp, Homo sapiens
agcagagcatgctaagtgactc

SEQ ID NO: 7988069 - DNA, 19 bp, Homo sapiens
agcagagcagggccgtggg

SEQ ID NO: 7988070 - DNA, 19 bp, Homo sapiens
agcagagcaaagtggctga

SEQ ID NO: 7988071 - DNA, 22 bp, Homo sapiens
agcagagcaaagctcagaaatg

SEQ ID NO: 7988072 - DNA, 18 bp, Homo sapiens
agcagagagtgaatggga

SEQ ID NO: 7988073 - DNA, 18 bp, Homo sapiens
agcagagagtgaatggga

SEQ ID NO: 7988074 - DNA, 18 bp, Homo sapiens
agcagagagtgaatggga

SEQ ID NO: 7988075 - DNA, 18 bp, Homo sapiens
agcagagagtgaatggga

SEQ ID NO: 7988076 - DNA, 22 bp, Homo sapiens
agcagagaggaggtggccctgt

SEQ ID NO: 7988077 - DNA, 22 bp, Homo sapiens
agcagagcagaatgtgaaggtg

SEQ ID NO: 7988078 - DNA, 22 bp, Homo sapiens
agcagagcagaatgtgaaggtg

SEQ ID NO: 7988079 - DNA, 22 bp, Homo sapiens
agcagagcagaatgtgaaggtg

SEQ ID NO: 7988080 - DNA, 22 bp, Homo sapiens
agcagagcagatagtattatct

SEQ ID NO: 7988081 - DNA, 22 bp, Homo sapiens
agcagagcagaatgtgaaggtg

SEQ ID NO: 7988082 - DNA, 19 bp, Homo sapiens
agcagagcaaagtggctga

SEQ ID NO: 7988083 - DNA, 19 bp, Homo sapiens
agcagagcaaagtggctga

SEQ ID NO: 7988084 - DNA, 19 bp, Homo sapiens
agcagagcaaagtggctga

SEQ ID NO: 7988085 - DNA, 22 bp, Homo sapiens
acaatgcacctattttaaaact

SEQ ID NO: 7988086 - DNA, 22 bp, Homo sapiens
acaatgcacctattttaaaact

SEQ ID NO: 7988087 - DNA, 22 bp, Homo sapiens
acaatgcaccagcatcttcacc

SEQ ID NO: 7988088 - DNA, 22 bp, Homo sapiens
acaatgcacctattttaaaact

SEQ ID NO: 7988089 - DNA, 22 bp, Homo sapiens
acaatgcacctattttaaaact

SEQ ID NO: 7988090 - DNA, 22 bp, Homo sapiens
acaatgcaccagcatcttcacc

SEQ ID NO: 7988091 - DNA, 22 bp, Homo sapiens
acaatgcacctattttaaaact

SEQ ID NO: 7988092 - DNA, 22 bp, Homo sapiens
agcagagaggaggtggccctgt

SEQ ID NO: 7988093 - DNA, 22 bp, Homo sapiens
agcagagaggaggtggccctgt

SEQ ID NO: 7988094 - DNA, 22 bp, Homo sapiens
agcagaagaaagccacatgact

SEQ ID NO: 7988095 - DNA, 22 bp, Homo sapiens
agcagagaggaggtggccctgt

SEQ ID NO: 7988096 - DNA, 22 bp, Homo sapiens
agcagaacctgcagacctgtct

SEQ ID NO: 7988097 - DNA, 22 bp, Homo sapiens
agcagaactgatgagacttgag

SEQ ID NO: 7988098 - DNA, 22 bp, Homo sapiens
acacagatgatgttccaggaac

SEQ ID NO: 7988099 - DNA, 22 bp, Homo sapiens
acacagatgatgttccaggaac

SEQ ID NO: 7988100 - DNA, 22 bp, Homo sapiens
acacagatgatgttccaggaac

SEQ ID NO: 7988101 - DNA, 22 bp, Homo sapiens
acacagatgcattacacatcta

SEQ ID NO: 7988102 - DNA, 22 bp, Homo sapiens
acacagatgcaacctgaccgag

SEQ ID NO: 7988103 - DNA, 22 bp, Homo sapiens
acacagatgcattacacatcta

SEQ ID NO: 7988104 - DNA, 22 bp, Homo sapiens
acacagatattgtacttgatcc

SEQ ID NO: 7988105 - DNA, 22 bp, Homo sapiens
acacagatattttgaatacata

SEQ ID NO: 7988106 - DNA, 22 bp, Homo sapiens
acacagataatgctcatatagg

SEQ ID NO: 7988107 - DNA, 22 bp, Homo sapiens
acacagagtttgacacatggga

SEQ ID NO: 7988108 - DNA, 22 bp, Homo sapiens
acacagataatgctcatatagg

SEQ ID NO: 7988109 - DNA, 22 bp, Homo sapiens
agcagctggggcctgtgacgat

SEQ ID NO: 7988110 - DNA, 22 bp, Homo sapiens
agcagctggggcctgtgacgat

SEQ ID NO: 7988111 - DNA, 22 bp, Homo sapiens
agcagctggggcctgtgacgat

SEQ ID NO: 7988112 - DNA, 22 bp, Homo sapiens
agcagctgggctcagagctggg

SEQ ID NO: 7988113 - DNA, 22 bp, Homo sapiens
agcagctggggcctgtgacgat

SEQ ID NO: 7988114 - DNA, 22 bp, Homo sapiens
agcagctgggctcagagctggg

SEQ ID NO: 7988115 - DNA, 22 bp, Homo sapiens
agcagctgggctcagagctggg

SEQ ID NO: 7988116 - DNA, 22 bp, Homo sapiens
agcagctgggctcagagctggg

SEQ ID NO: 7988117 - DNA, 22 bp, Homo sapiens
agcagctgagccccagctgtga

SEQ ID NO: 7988118 - DNA, 22 bp, Homo sapiens
acacagatgcattacacatcta

SEQ ID NO: 7988119 - DNA, 22 bp, Homo sapiens
acacagatgctatttagtctct

SEQ ID NO: 7988120 - DNA, 22 bp, Homo sapiens
agcagctgagccccagctgtga

SEQ ID NO: 7988121 - DNA, 22 bp, Homo sapiens
agcagctgagccccagctgtga

SEQ ID NO: 7988122 - DNA, 22 bp, Homo sapiens
agcagctgagccccagctgtga

SEQ ID NO: 7988123 - DNA, 22 bp, Homo sapiens
agcagctgagccccagctgtga

SEQ ID NO: 7988124 - DNA, 22 bp, Homo sapiens
agcagctgggtccggcggagca

SEQ ID NO: 7988125 - DNA, 23 bp, Homo sapiens
agcagctggggtgctcttttgtc

SEQ ID NO: 7988126 - DNA, 23 bp, Homo sapiens
agcagctggggtgctcttttgtc

SEQ ID NO: 7988127 - DNA, 22 bp, Homo sapiens
agcagctgggtccggcggagca

SEQ ID NO: 7988128 - DNA, 22 bp, Homo sapiens
agcagctgggtccggcggagca

SEQ ID NO: 7988129 - DNA, 22 bp, Homo sapiens
agcagctgggtccggcggagca

SEQ ID NO: 7988130 - DNA, 22 bp, Homo sapiens
agcagctgggtccggcggagca

SEQ ID NO: 7988131 - DNA, 22 bp, Homo sapiens
agcagctggggcctgtgacgat

SEQ ID NO: 7988132 - DNA, 22 bp, Homo sapiens
agcagctggggcctgtgacgat

SEQ ID NO: 7988133 - DNA, 22 bp, Homo sapiens
agcagctggggcctgtgacgat

SEQ ID NO: 7988134 - DNA, 22 bp, Homo sapiens
agcagctggggcctgtgacgat

SEQ ID NO: 7988135 - DNA, 23 bp, Homo sapiens
agcagctggggtgctcttttgtc

SEQ ID NO: 7988136 - DNA, 23 bp, Homo sapiens
agcagctggggtgctcttttgtc

SEQ ID NO: 7988137 - DNA, 22 bp, Homo sapiens
agcagctgggtccggcggagca

SEQ ID NO: 7988138 - DNA, 17 bp, Homo sapiens
agcagctgggttgatct

SEQ ID NO: 7988139 - DNA, 22 bp, Homo sapiens
agcagctgggtccggcggagca

SEQ ID NO: 7988140 - DNA, 22 bp, Homo sapiens
agcagctgggtccggcggagca

SEQ ID NO: 7988141 - DNA, 22 bp, Homo sapiens
agcagctggtaggagtggccac

SEQ ID NO: 7988142 - DNA, 17 bp, Homo sapiens
agcagctgggttgatct

SEQ ID NO: 7988143 - DNA, 17 bp, Homo sapiens
agcagctgggttgatct

SEQ ID NO: 7988144 - DNA, 17 bp, Homo sapiens
agcagctgggttgatct

SEQ ID NO: 7988145 - DNA, 17 bp, Homo sapiens
agcagctgggttgatct

SEQ ID NO: 7988146 - DNA, 17 bp, Homo sapiens
agcagctgggttgatct

SEQ ID NO: 7988147 - DNA, 17 bp, Homo sapiens
agcagctgggttgatct

SEQ ID NO: 7988148 - DNA, 22 bp, Homo sapiens
agcagctggtaggagtggccac

SEQ ID NO: 7988149 - DNA, 22 bp, Homo sapiens
agcagctggtaggagtggccac

SEQ ID NO: 7988150 - DNA, 22 bp, Homo sapiens
agcagctggtaggagtggccac

SEQ ID NO: 7988151 - DNA, 22 bp, Homo sapiens
agcagctggtaggagtggccac

SEQ ID NO: 7988152 - DNA, 22 bp, Homo sapiens
agcagctggtaggagtggccac

SEQ ID NO: 7988153 - DNA, 22 bp, Homo sapiens
agcagctggtaggagtggccac

SEQ ID NO: 7988154 - DNA, 22 bp, Homo sapiens
agcagctggggcctgtgacgat

SEQ ID NO: 7988155 - DNA, 22 bp, Homo sapiens
agcagctggtaggagtggccac

SEQ ID NO: 7988156 - DNA, 22 bp, Homo sapiens
agcagctggtaggagtggccac

SEQ ID NO: 7988157 - DNA, 22 bp, Homo sapiens
agcagctggtaggagtggccac

SEQ ID NO: 7988158 - DNA, 22 bp, Homo sapiens
agcagctggtgagcaagctcag

SEQ ID NO: 7988159 - DNA, 22 bp, Homo sapiens
agcagctggtgcaactctaaga

SEQ ID NO: 7988160 - DNA, 22 bp, Homo sapiens
agcagctggtgcaactctaaga

SEQ ID NO: 7988161 - DNA, 22 bp, Homo sapiens
agcagctggtaggagtggccac

SEQ ID NO: 7988162 - DNA, 22 bp, Homo sapiens
agcagctggtgagcaagctcag

SEQ ID NO: 7988163 - DNA, 22 bp, Homo sapiens
agcagctggtgagcaagctcag

SEQ ID NO: 7988164 - DNA, 22 bp, Homo sapiens
agcagctggtgagcaagctcag

SEQ ID NO: 7988165 - DNA, 22 bp, Homo sapiens
agcagctggtgagcaagctcag

SEQ ID NO: 7988166 - DNA, 22 bp, Homo sapiens
agcagctggtgagcaagctcag

SEQ ID NO: 7988167 - DNA, 22 bp, Homo sapiens
acacagagtttgacacatggga

SEQ ID NO: 7988168 - DNA, 22 bp, Homo sapiens
acacagagtttgacacatggga

SEQ ID NO: 7988169 - DNA, 22 bp, Homo sapiens
acacagagtttgacacatggga

SEQ ID NO: 7988170 - DNA, 22 bp, Homo sapiens
acacagagtttgacacatggga

SEQ ID NO: 7988171 - DNA, 22 bp, Homo sapiens
acacagagtggtttgtagaata

SEQ ID NO: 7988172 - DNA, 22 bp, Homo sapiens
acacagagtggtttgtagaata

SEQ ID NO: 7988173 - DNA, 22 bp, Homo sapiens
acacagagttattatgtgaact

SEQ ID NO: 7988174 - DNA, 22 bp, Homo sapiens
acacagagttattatgtgaact

SEQ ID NO: 7988175 - DNA, 22 bp, Homo sapiens
acacagagttattatgtgaact

SEQ ID NO: 7988176 - DNA, 22 bp, Homo sapiens
acacagagttattatgtgaact

SEQ ID NO: 7988177 - DNA, 22 bp, Homo sapiens
acacagagtatttagaaggggt

SEQ ID NO: 7988178 - DNA, 22 bp, Homo sapiens
acacagagtatttagaaggggt

SEQ ID NO: 7988179 - DNA, 22 bp, Homo sapiens
acacagagtatttagaaggggt

SEQ ID NO: 7988180 - DNA, 22 bp, Homo sapiens
acacagagtatttagaaggggt

SEQ ID NO: 7988181 - DNA, 22 bp, Homo sapiens
acacagagtccttactgaggta

SEQ ID NO: 7988182 - DNA, 22 bp, Homo sapiens
acacagagtccttactgaggta

SEQ ID NO: 7988183 - DNA, 22 bp, Homo sapiens
acacagagtccttactgaggta

SEQ ID NO: 7988184 - DNA, 22 bp, Homo sapiens
acacagagtccttactgaggta

SEQ ID NO: 7988185 - DNA, 22 bp, Homo sapiens
acacagagtccttactgaggta

SEQ ID NO: 7988186 - DNA, 20 bp, Homo sapiens
acacagagtgagtctgcttg

SEQ ID NO: 7988187 - DNA, 20 bp, Homo sapiens
acacagagtgagtctgcttg

SEQ ID NO: 7988188 - DNA, 22 bp, Homo sapiens
acacagagggcagaagatacat

SEQ ID NO: 7988189 - DNA, 22 bp, Homo sapiens
acacagaggtggccactctttt

SEQ ID NO: 7988190 - DNA, 22 bp, Homo sapiens
acacagaggtggccactctttt

SEQ ID NO: 7988191 - DNA, 22 bp, Homo sapiens
acacagagtatcttttgcctag

SEQ ID NO: 7988192 - DNA, 22 bp, Homo sapiens
acacagagtatcttttgcctag

SEQ ID NO: 7988193 - DNA, 22 bp, Homo sapiens
acacagagtatcttttgcctag

SEQ ID NO: 7988194 - DNA, 22 bp, Homo sapiens
acacagagggcagaagatacat

SEQ ID NO: 7988195 - DNA, 22 bp, Homo sapiens
acacagagcttctcaactggga

SEQ ID NO: 7988196 - DNA, 22 bp, Homo sapiens
acacagaagatctcttaatgct

SEQ ID NO: 7988197 - DNA, 22 bp, Homo sapiens
acacagaagatctcttaatgct

SEQ ID NO: 7988198 - DNA, 22 bp, Homo sapiens
acacagaggaaagtgtgaaggg

SEQ ID NO: 7988199 - DNA, 22 bp, Homo sapiens
acacagaggaaagtgtgaaggg

SEQ ID NO: 7988200 - DNA, 22 bp, Homo sapiens
acacagaggaaagtgtgaaggg

SEQ ID NO: 7988201 - DNA, 22 bp, Homo sapiens
acacagaggaaagtgtgaaggg

SEQ ID NO: 7988202 - DNA, 22 bp, Homo sapiens
acacagaggaaagtgtgaaggg

SEQ ID NO: 7988203 - DNA, 21 bp, Homo sapiens
acacagaggcatcatcacttt

SEQ ID NO: 7988204 - DNA, 22 bp, Homo sapiens
acacagaggcatgacagtggct

SEQ ID NO: 7988205 - DNA, 22 bp, Homo sapiens
acacagaggcatgacagtggct

SEQ ID NO: 7988206 - DNA, 22 bp, Homo sapiens
acacagaggcatgacagtggct

SEQ ID NO: 7988207 - DNA, 21 bp, Homo sapiens
acacagaggcatcatcacttt

SEQ ID NO: 7988208 - DNA, 21 bp, Homo sapiens
acacagaggcatcatcacttt

SEQ ID NO: 7988209 - DNA, 22 bp, Homo sapiens
agcctctgactgtcagcaaggt

SEQ ID NO: 7988210 - DNA, 22 bp, Homo sapiens
agcctctctttattcccagcta

SEQ ID NO: 7988211 - DNA, 22 bp, Homo sapiens
agcctctctttattcccagcta

SEQ ID NO: 7988212 - DNA, 22 bp, Homo sapiens
agcctctgatggctcccaagga

SEQ ID NO: 7988213 - DNA, 22 bp, Homo sapiens
agcctctgatgatcacaggggg

SEQ ID NO: 7988214 - DNA, 22 bp, Homo sapiens
agcctctgatgatcacaggggg

SEQ ID NO: 7988215 - DNA, 22 bp, Homo sapiens
agcctctgatgatcacaggggg

SEQ ID NO: 7988216 - DNA, 22 bp, Homo sapiens
agcctctgatgatcacaggggg

SEQ ID NO: 7988217 - DNA, 22 bp, Homo sapiens
acagagccactttggtgcctac

SEQ ID NO: 7988218 - DNA, 22 bp, Homo sapiens
acagagcctccaggagtgctgg

SEQ ID NO: 7988219 - DNA, 21 bp, Homo sapiens
acagagccgggcacaaagctg

SEQ ID NO: 7988220 - DNA, 22 bp, Homo sapiens
acagagcatttgggacagagag

SEQ ID NO: 7988221 - DNA, 22 bp, Homo sapiens
agcctctgatggctcccaagga

SEQ ID NO: 7988222 - DNA, 22 bp, Homo sapiens
agcctctgatggctcccaagga

SEQ ID NO: 7988223 - DNA, 22 bp, Homo sapiens
acagagccaaaaggacatagta

SEQ ID NO: 7988224 - DNA, 22 bp, Homo sapiens
acagagccactttggtgcctac

SEQ ID NO: 7988225 - DNA, 22 bp, Homo sapiens
agcctctcatgttctcccccag

SEQ ID NO: 7988226 - DNA, 22 bp, Homo sapiens
agcctctcatgttctcccccag

SEQ ID NO: 7988227 - DNA, 22 bp, Homo sapiens
agcctctccagagcctggcaga

SEQ ID NO: 7988228 - DNA, 22 bp, Homo sapiens
agcctctctgttagtcactggg

SEQ ID NO: 7988229 - DNA, 22 bp, Homo sapiens
agcctctcttatcccttcaaag

SEQ ID NO: 7988230 - DNA, 22 bp, Homo sapiens
agcctctcttatcccttcaaag

SEQ ID NO: 7988231 - DNA, 20 bp, Homo sapiens
agccctgtttcctggagaga

SEQ ID NO: 7988232 - DNA, 22 bp, Homo sapiens
agcctcctgtagccctcaccca

SEQ ID NO: 7988233 - DNA, 22 bp, Homo sapiens
agccctgttgtctgatgatggg

SEQ ID NO: 7988234 - DNA, 22 bp, Homo sapiens
acagagagctgtgattgagtta

SEQ ID NO: 7988235 - DNA, 22 bp, Homo sapiens
agccctgtttatgccacatcat

SEQ ID NO: 7988236 - DNA, 22 bp, Homo sapiens
agcctctcactgtcaccctccc

SEQ ID NO: 7988237 - DNA, 22 bp, Homo sapiens
agcctcctgtagccctcaccca

SEQ ID NO: 7988238 - DNA, 22 bp, Homo sapiens
acagatgagttaaagcagagtg

SEQ ID NO: 7988239 - DNA, 22 bp, Homo sapiens
acagatgagttaaagcagagtg

SEQ ID NO: 7988240 - DNA, 22 bp, Homo sapiens
acagatgagttagaataggcag

SEQ ID NO: 7988241 - DNA, 22 bp, Homo sapiens
acagatgatgtgcacagataga

SEQ ID NO: 7988242 - DNA, 22 bp, Homo sapiens
acagatgaggcccatcagtctg

SEQ ID NO: 7988243 - DNA, 22 bp, Homo sapiens
acagatgaggctggcgagggca

SEQ ID NO: 7988244 - DNA, 22 bp, Homo sapiens
acagatatttggggaaagacgt

SEQ ID NO: 7988245 - DNA, 22 bp, Homo sapiens
acagatgaggctggcgagggca

SEQ ID NO: 7988246 - DNA, 22 bp, Homo sapiens
acagatgagttaaagcagagtg

SEQ ID NO: 7988247 - DNA, 22 bp, Homo sapiens
acagatgaggtgtttggagagc

SEQ ID NO: 7988248 - DNA, 22 bp, Homo sapiens
acagatgaggtgtttggagagc

SEQ ID NO: 7988249 - DNA, 22 bp, Homo sapiens
acagatggaatgtgttatggga

SEQ ID NO: 7988250 - DNA, 19 bp, Homo sapiens
acagatgcttttgctgccc

SEQ ID NO: 7988251 - DNA, 17 bp, Homo sapiens
acagatgctgataagaa

SEQ ID NO: 7988252 - DNA, 22 bp, Homo sapiens
acagatgctctgatgtctgggt

SEQ ID NO: 7988253 - DNA, 22 bp, Homo sapiens
acagatgcaaggaaatgattgc

SEQ ID NO: 7988254 - DNA, 22 bp, Homo sapiens
acagatgatgtgcacagataga

SEQ ID NO: 7988255 - DNA, 22 bp, Homo sapiens
acagatgatgtgcacagataga

SEQ ID NO: 7988256 - DNA, 22 bp, Homo sapiens
acagatgatttttatgaaaaca

SEQ ID NO: 7988257 - DNA, 22 bp, Homo sapiens
acagatgatttttatgaaaaca

SEQ ID NO: 7988258 - DNA, 22 bp, Homo sapiens
acagatgatttttatgaaaaca

SEQ ID NO: 7988259 - DNA, 17 bp, Homo sapiens
acagagctacatattct

SEQ ID NO: 7988260 - DNA, 22 bp, Homo sapiens
acagagctaatgttgcataggc

SEQ ID NO: 7988261 - DNA, 22 bp, Homo sapiens
acagagctcccagccatctcct

SEQ ID NO: 7988262 - DNA, 22 bp, Homo sapiens
acagagctcccagccatctcct

SEQ ID NO: 7988263 - DNA, 22 bp, Homo sapiens
acagagctaatgttgcataggc

SEQ ID NO: 7988264 - DNA, 22 bp, Homo sapiens
acagagctaatgttgcataggc

SEQ ID NO: 7988265 - DNA, 22 bp, Homo sapiens
acagagcctccaggagtgctgg

SEQ ID NO: 7988266 - DNA, 22 bp, Homo sapiens
acagagctaatgttgcataggc

SEQ ID NO: 7988267 - DNA, 22 bp, Homo sapiens
acagagctaatgttgcataggc

SEQ ID NO: 7988268 - DNA, 22 bp, Homo sapiens
acagagctaatgttgcataggc

SEQ ID NO: 7988269 - DNA, 19 bp, Homo sapiens
acagagctctctgcttctg

SEQ ID NO: 7988270 - DNA, 19 bp, Homo sapiens
acagagctctctgcttctg

SEQ ID NO: 7988271 - DNA, 22 bp, Homo sapiens
acagagctgggatctgaaccca

SEQ ID NO: 7988272 - DNA, 22 bp, Homo sapiens
acagagctgggatctgaaccca

SEQ ID NO: 7988273 - DNA, 22 bp, Homo sapiens
acagagctgtacatgtgccatg

SEQ ID NO: 7988274 - DNA, 20 bp, Homo sapiens
acagatatttgattttcagt

SEQ ID NO: 7988275 - DNA, 20 bp, Homo sapiens
acagatatttgattttcagt

SEQ ID NO: 7988276 - DNA, 22 bp, Homo sapiens
acagatatttggggaaagacgt

SEQ ID NO: 7988277 - DNA, 22 bp, Homo sapiens
acagatgaggaatttatttggt

SEQ ID NO: 7988278 - DNA, 22 bp, Homo sapiens
acagatgaggcccatcagtctg

SEQ ID NO: 7988279 - DNA, 22 bp, Homo sapiens
acagatatttggggaaagacgt

SEQ ID NO: 7988280 - DNA, 22 bp, Homo sapiens
acagatggaggttattatgaac

SEQ ID NO: 7988281 - DNA, 22 bp, Homo sapiens
acagatggcacctttttgctgt

SEQ ID NO: 7988282 - DNA, 19 bp, Homo sapiens
acagatggaggaatctggg

SEQ ID NO: 7988283 - DNA, 19 bp, Homo sapiens
acagatggaggaatctggg

SEQ ID NO: 7988284 - DNA, 22 bp, Homo sapiens
acagatggagctactaggtaaa

SEQ ID NO: 7988285 - DNA, 22 bp, Homo sapiens
acagatggagctactaggtaaa

SEQ ID NO: 7988286 - DNA, 20 bp, Homo sapiens
acagatggcagttattacat

SEQ ID NO: 7988287 - DNA, 22 bp, Homo sapiens
acagatggcacctttttgctgt

SEQ ID NO: 7988288 - DNA, 22 bp, Homo sapiens
acagatggcactttttaggact

SEQ ID NO: 7988289 - DNA, 21 bp, Homo sapiens
acagatgggatgagcacactg

SEQ ID NO: 7988290 - DNA, 22 bp, Homo sapiens
acagatggccatattactatat

SEQ ID NO: 7988291 - DNA, 22 bp, Homo sapiens
acagatggtactaaacccatat

SEQ ID NO: 7988292 - DNA, 22 bp, Homo sapiens
acagatggtagcattatgttgg

SEQ ID NO: 7988293 - DNA, 22 bp, Homo sapiens
acagatggtactaaacccatat

SEQ ID NO: 7988294 - DNA, 22 bp, Homo sapiens
acagatggtactaaacccatat

SEQ ID NO: 7988295 - DNA, 22 bp, Homo sapiens
acagatggggcacaaagccaca

SEQ ID NO: 7988296 - DNA, 22 bp, Homo sapiens
acagatggggcacaaagccaca

SEQ ID NO: 7988297 - DNA, 21 bp, Homo sapiens
acagatgggatgagcacactg

SEQ ID NO: 7988298 - DNA, 22 bp, Homo sapiens
acagatggttattgtcatttct

SEQ ID NO: 7988299 - DNA, 22 bp, Homo sapiens
acagatgtaatctattcacatt

SEQ ID NO: 7988300 - DNA, 22 bp, Homo sapiens
acagatgtaatctattcacatt

SEQ ID NO: 7988301 - DNA, 22 bp, Homo sapiens
acagatgtaatctattcacatt

SEQ ID NO: 7988302 - DNA, 22 bp, Homo sapiens
acagatggtagcattatgttgg

SEQ ID NO: 7988303 - DNA, 22 bp, Homo sapiens
acagatggtgagccgctgatgt

SEQ ID NO: 7988304 - DNA, 22 bp, Homo sapiens
acagatggttattgtcatttct

SEQ ID NO: 7988305 - DNA, 22 bp, Homo sapiens
acagattcactgcactggccat

SEQ ID NO: 7988306 - DNA, 22 bp, Homo sapiens
acagattcactgcactggccat

SEQ ID NO: 7988307 - DNA, 22 bp, Homo sapiens
acagattatggatatatgtgga

SEQ ID NO: 7988308 - DNA, 22 bp, Homo sapiens
acagattatggatatatgtgga

SEQ ID NO: 7988309 - DNA, 22 bp, Homo sapiens
acagattcactgcactggccat

SEQ ID NO: 7988310 - DNA, 19 bp, Homo sapiens
agctcctgattgtgcctcg

SEQ ID NO: 7988311 - DNA, 19 bp, Homo sapiens
agctcctgattgtgcctcg

SEQ ID NO: 7988312 - DNA, 22 bp, Homo sapiens
agctcccagagctcgagagtaa

SEQ ID NO: 7988313 - DNA, 22 bp, Homo sapiens
agctcccagagctcgagagtaa

SEQ ID NO: 7988314 - DNA, 22 bp, Homo sapiens
acagatgtaatctattcacatt

SEQ ID NO: 7988315 - DNA, 22 bp, Homo sapiens
acagatgtaccttagtgatggg

SEQ ID NO: 7988316 - DNA, 22 bp, Homo sapiens
acagatgtaccttagtgatggg

SEQ ID NO: 7988317 - DNA, 21 bp, Homo sapiens
acagatgtgatatgcagtctt

SEQ ID NO: 7988318 - DNA, 21 bp, Homo sapiens
acagatgtgatatgcagtctt

SEQ ID NO: 7988319 - DNA, 21 bp, Homo sapiens
acagatgtgatatgcagtctt

SEQ ID NO: 7988320 - DNA, 22 bp, Homo sapiens
acagatgtggagtttgcatgat

SEQ ID NO: 7988321 - DNA, 22 bp, Homo sapiens
acagatgttagcaatgatgatg

SEQ ID NO: 7988322 - DNA, 21 bp, Homo sapiens
acagattagcacaatgcaggc

SEQ ID NO: 7988323 - DNA, 22 bp, Homo sapiens
acagatgttagcaatgatgatg

SEQ ID NO: 7988324 - DNA, 22 bp, Homo sapiens
acagatgttacagtatgatctc

SEQ ID NO: 7988325 - DNA, 22 bp, Homo sapiens
acagatgtggagtttgcatgat

SEQ ID NO: 7988326 - DNA, 22 bp, Homo sapiens
acagatgtggagtttgcatgat

SEQ ID NO: 7988327 - DNA, 22 bp, Homo sapiens
agctcctgcagactcctgctca

SEQ ID NO: 7988328 - DNA, 22 bp, Homo sapiens
agctcctgcagactcctgctca

SEQ ID NO: 7988329 - DNA, 22 bp, Homo sapiens
agctcctgcagactcctgctca

SEQ ID NO: 7988330 - DNA, 22 bp, Homo sapiens
agctcctgcagactcctgctca

SEQ ID NO: 7988331 - DNA, 22 bp, Homo sapiens
agctcctgccaacactgatggg

SEQ ID NO: 7988332 - DNA, 22 bp, Homo sapiens
agctcctgcagactcctgctca

SEQ ID NO: 7988333 - DNA, 22 bp, Homo sapiens
agctcctgccaacactgatggg

SEQ ID NO: 7988334 - DNA, 22 bp, Homo sapiens
agctcctgcaccaggggcccct

SEQ ID NO: 7988335 - DNA, 22 bp, Homo sapiens
agctcctgcaccaggggcccct

SEQ ID NO: 7988336 - DNA, 19 bp, Homo sapiens
agctcctgattgtgcctcg

SEQ ID NO: 7988337 - DNA, 19 bp, Homo sapiens
agctcctgattgtgcctcg

SEQ ID NO: 7988338 - DNA, 22 bp, Homo sapiens
agctcccagagtcctctgccca

SEQ ID NO: 7988339 - DNA, 22 bp, Homo sapiens
agctcctgcaccaggggcccct

SEQ ID NO: 7988340 - DNA, 22 bp, Homo sapiens
agctcctgcacccagccttgag

SEQ ID NO: 7988341 - DNA, 22 bp, Homo sapiens
agctcctgcaccaggggcccct

SEQ ID NO: 7988342 - DNA, 22 bp, Homo sapiens
agctcctgcaccaggggcccct

SEQ ID NO: 7988343 - DNA, 22 bp, Homo sapiens
agctcctgcacccagccttgag

SEQ ID NO: 7988344 - DNA, 22 bp, Homo sapiens
agctcctgcacccagccttgag

SEQ ID NO: 7988345 - DNA, 22 bp, Homo sapiens
agctcctgcacccagccttgag

SEQ ID NO: 7988346 - DNA, 22 bp, Homo sapiens
agctcctgcccaggaaggctct

SEQ ID NO: 7988347 - DNA, 22 bp, Homo sapiens
agctcctgcccaggaaggctct

SEQ ID NO: 7988348 - DNA, 22 bp, Homo sapiens
agctcctgccaacactgatggg

SEQ ID NO: 7988349 - DNA, 22 bp, Homo sapiens
agctcctgccaacactgatggg

SEQ ID NO: 7988350 - DNA, 22 bp, Homo sapiens
agctcctgccaacactgatggg

SEQ ID NO: 7988351 - DNA, 22 bp, Homo sapiens
agctcctgcccaggaaggctct

SEQ ID NO: 7988352 - DNA, 22 bp, Homo sapiens
agctcctgcccaggaaggctct

SEQ ID NO: 7988353 - DNA, 22 bp, Homo sapiens
agctcctgcccaggaaggctct

SEQ ID NO: 7988354 - DNA, 17 bp, Homo sapiens
agctcctgcccatggct

SEQ ID NO: 7988355 - DNA, 17 bp, Homo sapiens
agctcctgcccatggct

SEQ ID NO: 7988356 - DNA, 17 bp, Homo sapiens
agctcctgcccatggct

SEQ ID NO: 7988357 - DNA, 17 bp, Homo sapiens
agctcctgcccatggct

SEQ ID NO: 7988358 - DNA, 17 bp, Homo sapiens
agctcctgcccatggct

SEQ ID NO: 7988359 - DNA, 17 bp, Homo sapiens
agctcctgcccatggct

SEQ ID NO: 7988360 - DNA, 17 bp, Homo sapiens
agctcctgcccatggct

SEQ ID NO: 7988361 - DNA, 17 bp, Homo sapiens
agctcctgcccatggct

SEQ ID NO: 7988362 - DNA, 22 bp, Homo sapiens
agctcctgcgcacggtgcacac

SEQ ID NO: 7988363 - DNA, 22 bp, Homo sapiens
agctcctgcgcacggtgcacac

SEQ ID NO: 7988364 - DNA, 22 bp, Homo sapiens
agctcctgcgcacggtgcacac

SEQ ID NO: 7988365 - DNA, 22 bp, Homo sapiens
agctcctgcgcacggtgcacac

SEQ ID NO: 7988366 - DNA, 22 bp, Homo sapiens
agctcctgcgcacggtgcacac

SEQ ID NO: 7988367 - DNA, 22 bp, Homo sapiens
agctcctgctctttgtccctaa

SEQ ID NO: 7988368 - DNA, 22 bp, Homo sapiens
agctcctgctctttgtccctaa

SEQ ID NO: 7988369 - DNA, 22 bp, Homo sapiens
agctcctgctctttgtccctaa

SEQ ID NO: 7988370 - DNA, 22 bp, Homo sapiens
agctcctgctctttgtccctaa

SEQ ID NO: 7988371 - DNA, 22 bp, Homo sapiens
agctcctgcgcacggtgcacac

SEQ ID NO: 7988372 - DNA, 22 bp, Homo sapiens
agctcctgcgcacggtgcacac

SEQ ID NO: 7988373 - DNA, 22 bp, Homo sapiens
agctcctgcgcacggtgcacac

SEQ ID NO: 7988374 - DNA, 22 bp, Homo sapiens
agctcctgctctttgtccctaa

SEQ ID NO: 7988375 - DNA, 22 bp, Homo sapiens
agctcctgctctttgtccctaa

SEQ ID NO: 7988376 - DNA, 22 bp, Homo sapiens
agctcctgcttgacagaagagg

SEQ ID NO: 7988377 - DNA, 22 bp, Homo sapiens
agctcctgcttgacagaagagg

SEQ ID NO: 7988378 - DNA, 22 bp, Homo sapiens
agctcctgcttgacagaagagg

SEQ ID NO: 7988379 - DNA, 22 bp, Homo sapiens
agctcctgcttgacagaagagg

SEQ ID NO: 7988380 - DNA, 22 bp, Homo sapiens
acagcaattttgtgcacaagtg

SEQ ID NO: 7988381 - DNA, 22 bp, Homo sapiens
acagcacaatctgagtcccaga

SEQ ID NO: 7988382 - DNA, 22 bp, Homo sapiens
acagcacaatctgagtcccaga

SEQ ID NO: 7988383 - DNA, 22 bp, Homo sapiens
acagcaattttgtgcacaagtg

SEQ ID NO: 7988384 - DNA, 22 bp, Homo sapiens
acagcacaatctgagtcccaga

SEQ ID NO: 7988385 - DNA, 22 bp, Homo sapiens
acagcacaatctgagtcccaga

SEQ ID NO: 7988386 - DNA, 22 bp, Homo sapiens
acagcacaatctgagtcccaga

SEQ ID NO: 7988387 - DNA, 19 bp, Homo sapiens
acagcacagaaatatttca

SEQ ID NO: 7988388 - DNA, 22 bp, Homo sapiens
acagcacagagtggtatggctg

SEQ ID NO: 7988389 - DNA, 22 bp, Homo sapiens
acagcacagagtggtatggctg

SEQ ID NO: 7988390 - DNA, 19 bp, Homo sapiens
agccagggtgagaaggagc

SEQ ID NO: 7988391 - DNA, 22 bp, Homo sapiens
agccagggtgagagggctttgt

SEQ ID NO: 7988392 - DNA, 22 bp, Homo sapiens
agccagggtgagagggctttgt

SEQ ID NO: 7988393 - DNA, 19 bp, Homo sapiens
agccagggtgagaaggagc

SEQ ID NO: 7988394 - DNA, 19 bp, Homo sapiens
agccagggtgagaaggagc

SEQ ID NO: 7988395 - DNA, 19 bp, Homo sapiens
agccagggtgagaaggagc

SEQ ID NO: 7988396 - DNA, 22 bp, Homo sapiens
agccagggtctctcgctctgtt

SEQ ID NO: 7988397 - DNA, 22 bp, Homo sapiens
agccagggtctctcgctctgtt

SEQ ID NO: 7988398 - DNA, 19 bp, Homo sapiens
agccagggtgagaaggagc

SEQ ID NO: 7988399 - DNA, 22 bp, Homo sapiens
agccagggtctctcgctctgtt

SEQ ID NO: 7988400 - DNA, 19 bp, Homo sapiens
agccagggtgagaaggagc

SEQ ID NO: 7988401 - DNA, 22 bp, Homo sapiens
agccagggtaaggtacttagta

SEQ ID NO: 7988402 - DNA, 22 bp, Homo sapiens
agccagggtaaggtacttagta

SEQ ID NO: 7988403 - DNA, 22 bp, Homo sapiens
agccagggggacgctttctggc

SEQ ID NO: 7988404 - DNA, 22 bp, Homo sapiens
agccagggggacgctttctggc

SEQ ID NO: 7988405 - DNA, 22 bp, Homo sapiens
agccagggggacgctttctggc

SEQ ID NO: 7988406 - DNA, 19 bp, Homo sapiens
agccagggtccagacatgt

SEQ ID NO: 7988407 - DNA, 19 bp, Homo sapiens
agccagggtccagacatgt

SEQ ID NO: 7988408 - DNA, 22 bp, Homo sapiens
agccagggtaaggtacttagta

SEQ ID NO: 7988409 - DNA, 22 bp, Homo sapiens
agccagggggacgctttctggc

SEQ ID NO: 7988410 - DNA, 22 bp, Homo sapiens
agccagggtaaggtacttagta

SEQ ID NO: 7988411 - DNA, 22 bp, Homo sapiens
agccagggtaaggtacttagta

SEQ ID NO: 7988412 - DNA, 19 bp, Homo sapiens
agccagggtccagacatgt

SEQ ID NO: 7988413 - DNA, 19 bp, Homo sapiens
agccagggtccagacatgt

SEQ ID NO: 7988414 - DNA, 19 bp, Homo sapiens
agccagggtccagacatgt

SEQ ID NO: 7988415 - DNA, 19 bp, Homo sapiens
agccagggtccagacatgt

SEQ ID NO: 7988416 - DNA, 19 bp, Homo sapiens
agccagggtccagacatgt

SEQ ID NO: 7988417 - DNA, 19 bp, Homo sapiens
agccagggtccagacatgt

SEQ ID NO: 7988418 - DNA, 22 bp, Homo sapiens
agccagggtctctcgctctgtt

SEQ ID NO: 7988419 - DNA, 22 bp, Homo sapiens
agccagggtctctcgctctgtt

SEQ ID NO: 7988420 - DNA, 22 bp, Homo sapiens
agccagggtctctcgctctgtt

SEQ ID NO: 7988421 - DNA, 22 bp, Homo sapiens
agccagggtctctcgctctgtt

SEQ ID NO: 7988422 - DNA, 22 bp, Homo sapiens
agccagggtctctcgctctgtt

SEQ ID NO: 7988423 - DNA, 21 bp, Homo sapiens
acagagaaagagcagcctcct

SEQ ID NO: 7988424 - DNA, 21 bp, Homo sapiens
acagagaaagagcagcctcct

SEQ ID NO: 7988425 - DNA, 21 bp, Homo sapiens
acagagaaagagcagcctcct

SEQ ID NO: 7988426 - DNA, 21 bp, Homo sapiens
acagagaaagagcagcctcct

SEQ ID NO: 7988427 - DNA, 21 bp, Homo sapiens
acagagaaagagcagcctcct

SEQ ID NO: 7988428 - DNA, 22 bp, Homo sapiens
acagagaaagtgggctgaagat

SEQ ID NO: 7988429 - DNA, 21 bp, Homo sapiens
acagagaaagagcagcctcct

SEQ ID NO: 7988430 - DNA, 22 bp, Homo sapiens
acagagaaagtgggctgaagat

SEQ ID NO: 7988431 - DNA, 22 bp, Homo sapiens
acagagaaagtgggctgaagat

SEQ ID NO: 7988432 - DNA, 22 bp, Homo sapiens
acagagaaagtgggctgaagat

SEQ ID NO: 7988433 - DNA, 22 bp, Homo sapiens
acagactgttggcctactgagc

SEQ ID NO: 7988434 - DNA, 22 bp, Homo sapiens
acagactgtgagtatgcatagt

SEQ ID NO: 7988435 - DNA, 22 bp, Homo sapiens
acagactgtgagtctcattttc

SEQ ID NO: 7988436 - DNA, 21 bp, Homo sapiens
acagagaaagagcagcctcct

SEQ ID NO: 7988437 - DNA, 22 bp, Homo sapiens
acagagaaactaaggagtttgg

SEQ ID NO: 7988438 - DNA, 22 bp, Homo sapiens
acagagaaactaaggagtttgg

SEQ ID NO: 7988439 - DNA, 22 bp, Homo sapiens
acagactgtgagtatgcatagt

SEQ ID NO: 7988440 - DNA, 22 bp, Homo sapiens
acagactgtgagtatgcatagt

SEQ ID NO: 7988441 - DNA, 22 bp, Homo sapiens
acagactgtcccaccacatgga

SEQ ID NO: 7988442 - DNA, 22 bp, Homo sapiens
acagactgtcatgacactatat

SEQ ID NO: 7988443 - DNA, 23 bp, Homo sapiens
acagactgtattcaaagtaggac

SEQ ID NO: 7988444 - DNA, 21 bp, Homo sapiens
agccagggtggacactgtatg

SEQ ID NO: 7988445 - DNA, 22 bp, Homo sapiens
acagacattcagctaagtctat

SEQ ID NO: 7988446 - DNA, 22 bp, Homo sapiens
acagacattcagctaagtctat

SEQ ID NO: 7988447 - DNA, 23 bp, Homo sapiens
acagacattccataatgtacacc

SEQ ID NO: 7988448 - DNA, 23 bp, Homo sapiens
acagacattccataatgtacacc

SEQ ID NO: 7988449 - DNA, 22 bp, Homo sapiens
acagagagaattgggtttacag

SEQ ID NO: 7988450 - DNA, 22 bp, Homo sapiens
acagagagaaacaatcagcagc

SEQ ID NO: 7988451 - DNA, 22 bp, Homo sapiens
acagagagaaacaatcagcagc

SEQ ID NO: 7988452 - DNA, 22 bp, Homo sapiens
acagagagctgtgattgagtta

SEQ ID NO: 7988453 - DNA, 22 bp, Homo sapiens
acagagagaggcccgaggctgc

SEQ ID NO: 7988454 - DNA, 22 bp, Homo sapiens
acagagagctgtgattgagtta

SEQ ID NO: 7988455 - DNA, 22 bp, Homo sapiens
acagagagaggcccgaggctgc

SEQ ID NO: 7988456 - DNA, 22 bp, Homo sapiens
acagagagaggcccgaggctgc

SEQ ID NO: 7988457 - DNA, 22 bp, Homo sapiens
acagagagaggcccgaggctgc

SEQ ID NO: 7988458 - DNA, 22 bp, Homo sapiens
acagagagaggcccgaggctgc

SEQ ID NO: 7988459 - DNA, 22 bp, Homo sapiens
acagagagaggcccgaggctgc

SEQ ID NO: 7988460 - DNA, 22 bp, Homo sapiens
acagagagaattgggtttacag

SEQ ID NO: 7988461 - DNA, 22 bp, Homo sapiens
acagagactgggatgcctgcct

SEQ ID NO: 7988462 - DNA, 22 bp, Homo sapiens
acagagacttggagcaggctga

SEQ ID NO: 7988463 - DNA, 22 bp, Homo sapiens
acagagacttggagcaggctga

SEQ ID NO: 7988464 - DNA, 22 bp, Homo sapiens
acagagactgggagcaagaggc

SEQ ID NO: 7988465 - DNA, 20 bp, Homo sapiens
acagagactgagacacttgc

SEQ ID NO: 7988466 - DNA, 20 bp, Homo sapiens
acagagactgagacacttgc

SEQ ID NO: 7988467 - DNA, 20 bp, Homo sapiens
acagagactgagacacttgc

SEQ ID NO: 7988468 - DNA, 22 bp, Homo sapiens
acagagactcatgaaagatgac

SEQ ID NO: 7988469 - DNA, 23 bp, Homo sapiens
acagagactgccaagatattctc

SEQ ID NO: 7988470 - DNA, 23 bp, Homo sapiens
acagagactgccaagatattctc

SEQ ID NO: 7988471 - DNA, 23 bp, Homo sapiens
acagagactgccaagatattctc

SEQ ID NO: 7988472 - DNA, 22 bp, Homo sapiens
acagagactgggagcaagaggc

SEQ ID NO: 7988473 - DNA, 22 bp, Homo sapiens
acagagactgggagcaagaggc

SEQ ID NO: 7988474 - DNA, 22 bp, Homo sapiens
acagagactgggagcaagaggc

SEQ ID NO: 7988475 - DNA, 22 bp, Homo sapiens
acagagactcatgaaagatgac

SEQ ID NO: 7988476 - DNA, 22 bp, Homo sapiens
acagagactcatgaaagatgac

SEQ ID NO: 7988477 - DNA, 22 bp, Homo sapiens
acagagactaagcttttcatca

SEQ ID NO: 7988478 - DNA, 22 bp, Homo sapiens
acagagactaagcttttcatca

SEQ ID NO: 7988479 - DNA, 22 bp, Homo sapiens
acagagactaagcttttcatca

SEQ ID NO: 7988480 - DNA, 22 bp, Homo sapiens
acagagaccagttacagcgtcc

SEQ ID NO: 7988481 - DNA, 22 bp, Homo sapiens
acagagaccagttacagcgtcc

SEQ ID NO: 7988482 - DNA, 22 bp, Homo sapiens
acagagacctggccttgctttg

SEQ ID NO: 7988483 - DNA, 22 bp, Homo sapiens
acagagacaggcagacagtctt

SEQ ID NO: 7988484 - DNA, 22 bp, Homo sapiens
acagagacaggcagacagtctt

SEQ ID NO: 7988485 - DNA, 22 bp, Homo sapiens
acagagacaggcagacagtctt

SEQ ID NO: 7988486 - DNA, 22 bp, Homo sapiens
acagagaccagcatcttctgcc

SEQ ID NO: 7988487 - DNA, 22 bp, Homo sapiens
acagagaccagttacagcgtcc

SEQ ID NO: 7988488 - DNA, 22 bp, Homo sapiens
acagagaaagtgggctgaagat

SEQ ID NO: 7988489 - DNA, 22 bp, Homo sapiens
acagagaaagtgggctgaagat

SEQ ID NO: 7988490 - DNA, 22 bp, Homo sapiens
acagagaaagttcctctcaggc

SEQ ID NO: 7988491 - DNA, 22 bp, Homo sapiens
acagagaaagttcctctcaggc

SEQ ID NO: 7988492 - DNA, 22 bp, Homo sapiens
acagagaaagtgggctgaagat

SEQ ID NO: 7988493 - DNA, 22 bp, Homo sapiens
acagagaaagttcctctcaggc

SEQ ID NO: 7988494 - DNA, 22 bp, Homo sapiens
acagagaaagttcctctcaggc

SEQ ID NO: 7988495 - DNA, 23 bp, Homo sapiens
acagagacaatggtttcatcttg

SEQ ID NO: 7988496 - DNA, 23 bp, Homo sapiens
acagagacaatggtttcatcttg

SEQ ID NO: 7988497 - DNA, 22 bp, Homo sapiens
acagagacacggaagctaaaga

SEQ ID NO: 7988498 - DNA, 22 bp, Homo sapiens
acagagacaatatttgtaaagt

SEQ ID NO: 7988499 - DNA, 22 bp, Homo sapiens
acagagaaagttcctctcaggc

SEQ ID NO: 7988500 - DNA, 22 bp, Homo sapiens
acagagacaatatttgtaaagt

SEQ ID NO: 7988501 - DNA, 23 bp, Homo sapiens
acagagacaatggtttcatcttg

SEQ ID NO: 7988502 - DNA, 22 bp, Homo sapiens
acagagacaatatttgtaaagt

SEQ ID NO: 7988503 - DNA, 22 bp, Homo sapiens
acagagacaaatgttagtagtt

SEQ ID NO: 7988504 - DNA, 22 bp, Homo sapiens
acagagacaaatgttagtagtt

SEQ ID NO: 7988505 - DNA, 22 bp, Homo sapiens
acacttttgtttgaagtctcca

SEQ ID NO: 7988506 - DNA, 22 bp, Homo sapiens
acagaaaaatgagggagctgga

SEQ ID NO: 7988507 - DNA, 22 bp, Homo sapiens
acagaaaaatgagggagctgga

SEQ ID NO: 7988508 - DNA, 22 bp, Homo sapiens
acacttttgtttgaagtctcca

SEQ ID NO: 7988509 - DNA, 22 bp, Homo sapiens
acacttttgtgtatatccagtt

SEQ ID NO: 7988510 - DNA, 22 bp, Homo sapiens
acacttttgtgtatatccagtt

SEQ ID NO: 7988511 - DNA, 22 bp, Homo sapiens
acagaaaaatgagggagctgga

SEQ ID NO: 7988512 - DNA, 22 bp, Homo sapiens
acagaaaaatgagggagctgga

SEQ ID NO: 7988513 - DNA, 22 bp, Homo sapiens
acagaaaaatgagggagctgga

SEQ ID NO: 7988514 - DNA, 22 bp, Homo sapiens
acagaaaaatgagggagctgga

SEQ ID NO: 7988515 - DNA, 22 bp, Homo sapiens
acagaaaagtttacttttgctc

SEQ ID NO: 7988516 - DNA, 22 bp, Homo sapiens
acagaaaagtttacttttgctc

SEQ ID NO: 7988517 - DNA, 22 bp, Homo sapiens
acagaaaagtttacttttgctc

SEQ ID NO: 7988518 - DNA, 22 bp, Homo sapiens
acagaaaagtttacttttgctc

SEQ ID NO: 7988519 - DNA, 22 bp, Homo sapiens
acagaaacccagaaaacctctc

SEQ ID NO: 7988520 - DNA, 22 bp, Homo sapiens
acagaaaatgccagaagggtgg

SEQ ID NO: 7988521 - DNA, 22 bp, Homo sapiens
acagaaaatgccagaagggtgg

SEQ ID NO: 7988522 - DNA, 22 bp, Homo sapiens
acagaaaatgccagaagggtgg

SEQ ID NO: 7988523 - DNA, 22 bp, Homo sapiens
acagaaaatgccagaagggtgg

SEQ ID NO: 7988524 - DNA, 22 bp, Homo sapiens
acagaaaatgccagaagggtgg

SEQ ID NO: 7988525 - DNA, 22 bp, Homo sapiens
acagaaaatgccagaagggtgg

SEQ ID NO: 7988526 - DNA, 22 bp, Homo sapiens
acagaaacccagaaaacctctc

SEQ ID NO: 7988527 - DNA, 22 bp, Homo sapiens
acagaaagaaggtgtatttgag

SEQ ID NO: 7988528 - DNA, 22 bp, Homo sapiens
acagaaagaaggtgtatttgag

SEQ ID NO: 7988529 - DNA, 22 bp, Homo sapiens
acagaaagaccttgtaacactt

SEQ ID NO: 7988530 - DNA, 22 bp, Homo sapiens
acagaaagaccttgtaacactt

SEQ ID NO: 7988531 - DNA, 22 bp, Homo sapiens
acagaaagaaggtgtatttgag

SEQ ID NO: 7988532 - DNA, 22 bp, Homo sapiens
acacttttatctctggaggctt

SEQ ID NO: 7988533 - DNA, 22 bp, Homo sapiens
acacttttatctctggaggctt

SEQ ID NO: 7988534 - DNA, 22 bp, Homo sapiens
acacttttagctatgagttaat

SEQ ID NO: 7988535 - DNA, 22 bp, Homo sapiens
acacttttagctatgagttaat

SEQ ID NO: 7988536 - DNA, 22 bp, Homo sapiens
acacttttaagactttaatgaa

SEQ ID NO: 7988537 - DNA, 22 bp, Homo sapiens
acacttttaagactttaatgaa

SEQ ID NO: 7988538 - DNA, 22 bp, Homo sapiens
acactttgttgtggcatatacg

SEQ ID NO: 7988539 - DNA, 22 bp, Homo sapiens
acactttgtcctttttcattgt

SEQ ID NO: 7988540 - DNA, 22 bp, Homo sapiens
acactttctggagctgcacata

SEQ ID NO: 7988541 - DNA, 22 bp, Homo sapiens
acactttgatagataatgcagg

SEQ ID NO: 7988542 - DNA, 22 bp, Homo sapiens
acactttatgtctagatctggg

SEQ ID NO: 7988543 - DNA, 22 bp, Homo sapiens
acactttatgtctagatctggg

SEQ ID NO: 7988544 - DNA, 22 bp, Homo sapiens
acactttctggagctgcacata

SEQ ID NO: 7988545 - DNA, 23 bp, Homo sapiens
acactttcaaatatgcacagagc

SEQ ID NO: 7988546 - DNA, 22 bp, Homo sapiens
acactttatctcatctcagaca

SEQ ID NO: 7988547 - DNA, 22 bp, Homo sapiens
acactttatctcatctcagaca

SEQ ID NO: 7988548 - DNA, 22 bp, Homo sapiens
acactttatgtctagatctggg

SEQ ID NO: 7988549 - DNA, 22 bp, Homo sapiens
acactttatcaatattcaaaaa

SEQ ID NO: 7988550 - DNA, 22 bp, Homo sapiens
acactttatcaatattcaaaaa

SEQ ID NO: 7988551 - DNA, 22 bp, Homo sapiens
acactttatcaatattcaaaaa

SEQ ID NO: 7988552 - DNA, 22 bp, Homo sapiens
acagacacaggcgtggagtcgc

SEQ ID NO: 7988553 - DNA, 22 bp, Homo sapiens
acagacacaggcgtggagtcgc

SEQ ID NO: 7988554 - DNA, 22 bp, Homo sapiens
acagacacaggcgtggagtcgc

SEQ ID NO: 7988555 - DNA, 22 bp, Homo sapiens
acagacacaggcgtggagtcgc

SEQ ID NO: 7988556 - DNA, 22 bp, Homo sapiens
acagacacaggcgtggagtcgc

SEQ ID NO: 7988557 - DNA, 22 bp, Homo sapiens
acagacacaggcctgggctcct

SEQ ID NO: 7988558 - DNA, 22 bp, Homo sapiens
acagacacaggcctgggctcct

SEQ ID NO: 7988559 - DNA, 22 bp, Homo sapiens
acagacacaggcgtggagtcgc

SEQ ID NO: 7988560 - DNA, 22 bp, Homo sapiens
acagacacaggcctgggctcct

SEQ ID NO: 7988561 - DNA, 22 bp, Homo sapiens
acagacaagtagttcagacaag

SEQ ID NO: 7988562 - DNA, 22 bp, Homo sapiens
acagacaagtagttcagacaag

SEQ ID NO: 7988563 - DNA, 22 bp, Homo sapiens
acagaattaatgaaaattacaa

SEQ ID NO: 7988564 - DNA, 22 bp, Homo sapiens
acagacaagtagttcagacaag

SEQ ID NO: 7988565 - DNA, 22 bp, Homo sapiens
acagacaagtagttcagacaag

SEQ ID NO: 7988566 - DNA, 22 bp, Homo sapiens
acagacaagtagttcagacaag

SEQ ID NO: 7988567 - DNA, 22 bp, Homo sapiens
acagacaagtagttcagacaag

SEQ ID NO: 7988568 - DNA, 22 bp, Homo sapiens
acagaaagataggcacaaggtc

SEQ ID NO: 7988569 - DNA, 22 bp, Homo sapiens
acagaaagataggcacaaggtc

SEQ ID NO: 7988570 - DNA, 22 bp, Homo sapiens
acagaaagataggcacaaggtc

SEQ ID NO: 7988571 - DNA, 22 bp, Homo sapiens
acagaaagataggcacaaggtc

SEQ ID NO: 7988572 - DNA, 22 bp, Homo sapiens
acagaaagataggcacaaggtc

SEQ ID NO: 7988573 - DNA, 22 bp, Homo sapiens
acagaaagataggcacaaggtc

SEQ ID NO: 7988574 - DNA, 22 bp, Homo sapiens
acagaattaatgaaaattacaa

SEQ ID NO: 7988575 - DNA, 22 bp, Homo sapiens
acagaattaatgaaaattacaa

SEQ ID NO: 7988576 - DNA, 22 bp, Homo sapiens
acagaattaatgaaaattacaa

SEQ ID NO: 7988577 - DNA, 22 bp, Homo sapiens
acagaaagaccttgtaacactt

SEQ ID NO: 7988578 - DNA, 22 bp, Homo sapiens
acagaaagaccttgtaacactt

SEQ ID NO: 7988579 - DNA, 20 bp, Homo sapiens
acagaaagagagaatgtcag

SEQ ID NO: 7988580 - DNA, 20 bp, Homo sapiens
acagaaagagagaatgtcag

SEQ ID NO: 7988581 - DNA, 20 bp, Homo sapiens
acagaaagagagaatgtcag

SEQ ID NO: 7988582 - DNA, 22 bp, Homo sapiens
agccagggggacgctttctggc

SEQ ID NO: 7988583 - DNA, 22 bp, Homo sapiens
agccagggggacgctttctggc

SEQ ID NO: 7988584 - DNA, 22 bp, Homo sapiens
agccaggggattcatcagggac

SEQ ID NO: 7988585 - DNA, 22 bp, Homo sapiens
agccaggggattcatcagggac

SEQ ID NO: 7988586 - DNA, 22 bp, Homo sapiens
agccaggggattcatcagggac

SEQ ID NO: 7988587 - DNA, 22 bp, Homo sapiens
agccaggggattcatcagggac

SEQ ID NO: 7988588 - DNA, 22 bp, Homo sapiens
agccaggggattcatcagggac

SEQ ID NO: 7988589 - DNA, 22 bp, Homo sapiens
agccaggggattcatcagggac

SEQ ID NO: 7988590 - DNA, 22 bp, Homo sapiens
acagacagggcacctgcctcct

SEQ ID NO: 7988591 - DNA, 22 bp, Homo sapiens
acagacagattttgtctgatgt

SEQ ID NO: 7988592 - DNA, 22 bp, Homo sapiens
acagacagattttgtctgatgt

SEQ ID NO: 7988593 - DNA, 22 bp, Homo sapiens
acagacagaggctccatgagga

SEQ ID NO: 7988594 - DNA, 22 bp, Homo sapiens
acagacagaggctccatgagga

SEQ ID NO: 7988595 - DNA, 22 bp, Homo sapiens
acagacagacagagaactattc

SEQ ID NO: 7988596 - DNA, 22 bp, Homo sapiens
acagacagacagagaactattc

SEQ ID NO: 7988597 - DNA, 18 bp, Homo sapiens
acagacacttagtatgag

SEQ ID NO: 7988598 - DNA, 18 bp, Homo sapiens
acagacacttagtatgag

SEQ ID NO: 7988599 - DNA, 22 bp, Homo sapiens
acagacactgcactcccacctt

SEQ ID NO: 7988600 - DNA, 22 bp, Homo sapiens
acagacacaggcgtggagtcgc

SEQ ID NO: 7988601 - DNA, 22 bp, Homo sapiens
acagacactgcactcccacctt

SEQ ID NO: 7988602 - DNA, 22 bp, Homo sapiens
acagacactgcactcccacctt

SEQ ID NO: 7988603 - DNA, 22 bp, Homo sapiens
acagacagacagattgcatatg

SEQ ID NO: 7988604 - DNA, 22 bp, Homo sapiens
acagacagacagagaactattc

SEQ ID NO: 7988605 - DNA, 22 bp, Homo sapiens
acagacagacagattgcatatg

SEQ ID NO: 7988606 - DNA, 22 bp, Homo sapiens
acagacagacagattgcatatg

SEQ ID NO: 7988607 - DNA, 22 bp, Homo sapiens
acagacagaggctccatgagga

SEQ ID NO: 7988608 - DNA, 22 bp, Homo sapiens
acagacagaggctccatgagga

SEQ ID NO: 7988609 - DNA, 22 bp, Homo sapiens
aattaacagagggcttattact

SEQ ID NO: 7988610 - DNA, 22 bp, Homo sapiens
aattaacagagggcttattact

SEQ ID NO: 7988611 - DNA, 22 bp, Homo sapiens
aattaacagagggcttattact

SEQ ID NO: 7988612 - DNA, 22 bp, Homo sapiens
agagacagatctgagggacctc

SEQ ID NO: 7988613 - DNA, 22 bp, Homo sapiens
aattaacaaatgtagctgtgat

SEQ ID NO: 7988614 - DNA, 22 bp, Homo sapiens
aattaacaaatgtagctgtgat

SEQ ID NO: 7988615 - DNA, 22 bp, Homo sapiens
agagacagatctgagggacctc

SEQ ID NO: 7988616 - DNA, 22 bp, Homo sapiens
agagacagatctgagggacctc

SEQ ID NO: 7988617 - DNA, 18 bp, Homo sapiens
agagacagcagcaaaaga

SEQ ID NO: 7988618 - DNA, 18 bp, Homo sapiens
agagacagcagcaaaaga

SEQ ID NO: 7988619 - DNA, 18 bp, Homo sapiens
agagacagcagcaaaaga

SEQ ID NO: 7988620 - DNA, 22 bp, Homo sapiens
agagacagatctgagggacctc

SEQ ID NO: 7988621 - DNA, 22 bp, Homo sapiens
agagacagatctgagggacctc

SEQ ID NO: 7988622 - DNA, 22 bp, Homo sapiens
agagacagatctgagggacctc

SEQ ID NO: 7988623 - DNA, 22 bp, Homo sapiens
agagacagatctgagggacctc

SEQ ID NO: 7988624 - DNA, 22 bp, Homo sapiens
agagacaggatatctgctcatg

SEQ ID NO: 7988625 - DNA, 22 bp, Homo sapiens
agagacaggatatctgctcatg

SEQ ID NO: 7988626 - DNA, 22 bp, Homo sapiens
agagacaggagttctgtttcca

SEQ ID NO: 7988627 - DNA, 22 bp, Homo sapiens
agagacaggagttctgtttcca

SEQ ID NO: 7988628 - DNA, 22 bp, Homo sapiens
agagacaggagttctgtttcca

SEQ ID NO: 7988629 - DNA, 18 bp, Homo sapiens
agagacagcagcaaaaga

SEQ ID NO: 7988630 - DNA, 18 bp, Homo sapiens
agagacagcagcaaaaga

SEQ ID NO: 7988631 - DNA, 22 bp, Homo sapiens
agagacaggaatggcattaaga

SEQ ID NO: 7988632 - DNA, 22 bp, Homo sapiens
agagacaggaatggcattaaga

SEQ ID NO: 7988633 - DNA, 22 bp, Homo sapiens
agagacaggaatggcattaaga

SEQ ID NO: 7988634 - DNA, 22 bp, Homo sapiens
aattaaatgacaggggaagatg

SEQ ID NO: 7988635 - DNA, 22 bp, Homo sapiens
aattaaatgacaggggaagatg

SEQ ID NO: 7988636 - DNA, 23 bp, Homo sapiens
aattaaattgctagatccagggc

SEQ ID NO: 7988637 - DNA, 23 bp, Homo sapiens
aattaaattgctagatccagggc

SEQ ID NO: 7988638 - DNA, 23 bp, Homo sapiens
aattaaattgctagatccagggc

SEQ ID NO: 7988639 - DNA, 22 bp, Homo sapiens
aattaaattggtttagagagga

SEQ ID NO: 7988640 - DNA, 22 bp, Homo sapiens
aattaaattggtttagagagga

SEQ ID NO: 7988641 - DNA, 22 bp, Homo sapiens
aattaaattggtttagagagga

SEQ ID NO: 7988642 - DNA, 22 bp, Homo sapiens
aattaaaagataacccatgagt

SEQ ID NO: 7988643 - DNA, 22 bp, Homo sapiens
aattaaaagataacccatgagt

SEQ ID NO: 7988644 - DNA, 22 bp, Homo sapiens
aattaaaagataacccatgagt

SEQ ID NO: 7988645 - DNA, 22 bp, Homo sapiens
aattaaaggtcatgttaaaggg

SEQ ID NO: 7988646 - DNA, 22 bp, Homo sapiens
aattaaaggtcatgttaaaggg

SEQ ID NO: 7988647 - DNA, 22 bp, Homo sapiens
aattaaaagataacccatgagt

SEQ ID NO: 7988648 - DNA, 22 bp, Homo sapiens
aattaaaagataacccatgagt

SEQ ID NO: 7988649 - DNA, 22 bp, Homo sapiens
aattaaaagataacccatgagt

SEQ ID NO: 7988650 - DNA, 22 bp, Homo sapiens
aattaaaagataacccatgagt

SEQ ID NO: 7988651 - DNA, 22 bp, Homo sapiens
aattaaaaaaggagagcttgct

SEQ ID NO: 7988652 - DNA, 22 bp, Homo sapiens
aattaaaagataacccatgagt

SEQ ID NO: 7988653 - DNA, 22 bp, Homo sapiens
aattaaaagataacccatgagt

SEQ ID NO: 7988654 - DNA, 22 bp, Homo sapiens
aattaaaaaaggagagcttgct

SEQ ID NO: 7988655 - DNA, 22 bp, Homo sapiens
aattaaaaaaggagagcttgct

SEQ ID NO: 7988656 - DNA, 22 bp, Homo sapiens
aattaaaaaaggagagcttgct

SEQ ID NO: 7988657 - DNA, 22 bp, Homo sapiens
aatgtgtaaaaggttttcttca

SEQ ID NO: 7988658 - DNA, 22 bp, Homo sapiens
aatgtgtaaatgaggagtcttg

SEQ ID NO: 7988659 - DNA, 22 bp, Homo sapiens
aatgtggttaaaatttggttgt

SEQ ID NO: 7988660 - DNA, 22 bp, Homo sapiens
aatgtggggaagccatggctga

SEQ ID NO: 7988661 - DNA, 18 bp, Homo sapiens
agaccctctaagggcagt

SEQ ID NO: 7988662 - DNA, 18 bp, Homo sapiens
agaccctctaagggcagt

SEQ ID NO: 7988663 - DNA, 22 bp, Homo sapiens
agaccctctcctcatggacatg

SEQ ID NO: 7988664 - DNA, 22 bp, Homo sapiens
aatgtgtacatgacagatagaa

SEQ ID NO: 7988665 - DNA, 22 bp, Homo sapiens
agaccccctttaatggaagtgc

SEQ ID NO: 7988666 - DNA, 22 bp, Homo sapiens
agaccccctttaatggaagtgc

SEQ ID NO: 7988667 - DNA, 22 bp, Homo sapiens
agaccctgcacctctcgtgggc

SEQ ID NO: 7988668 - DNA, 22 bp, Homo sapiens
agaccctgaagttttctatgat

SEQ ID NO: 7988669 - DNA, 22 bp, Homo sapiens
agaccctgcattttccagggtt

SEQ ID NO: 7988670 - DNA, 21 bp, Homo sapiens
agaccctgcatatgttcagta

SEQ ID NO: 7988671 - DNA, 22 bp, Homo sapiens
agaccctgcacctctcgtgggc

SEQ ID NO: 7988672 - DNA, 22 bp, Homo sapiens
agaccctggggaaagtcacttc

SEQ ID NO: 7988673 - DNA, 22 bp, Homo sapiens
agaccctggtaaacactccagg

SEQ ID NO: 7988674 - DNA, 22 bp, Homo sapiens
agaccctggggaaagtcacttc

SEQ ID NO: 7988675 - DNA, 22 bp, Homo sapiens
agaccctgcattttccagggtt

SEQ ID NO: 7988676 - DNA, 22 bp, Homo sapiens
aattaaaaaaggagagcttgct

SEQ ID NO: 7988677 - DNA, 22 bp, Homo sapiens
aattaaaaaaggagagcttgct

SEQ ID NO: 7988678 - DNA, 22 bp, Homo sapiens
aattaaaaaaggagagcttgct

SEQ ID NO: 7988679 - DNA, 22 bp, Homo sapiens
aattaaaaaaggagagcttgct

SEQ ID NO: 7988680 - DNA, 22 bp, Homo sapiens
aattaaaaaaggagagcttgct

SEQ ID NO: 7988681 - DNA, 22 bp, Homo sapiens
aattaaaaaaggagagcttgct

SEQ ID NO: 7988682 - DNA, 22 bp, Homo sapiens
aattaaaaaaggagagcttgct

SEQ ID NO: 7988683 - DNA, 22 bp, Homo sapiens
aatgttttaaaagagattgaga

SEQ ID NO: 7988684 - DNA, 22 bp, Homo sapiens
aatgttttaaaagagattgaga

SEQ ID NO: 7988685 - DNA, 22 bp, Homo sapiens
aatgttttaaaagagattgaga

SEQ ID NO: 7988686 - DNA, 22 bp, Homo sapiens
aatgttttaaaagagattgaga

SEQ ID NO: 7988687 - DNA, 22 bp, Homo sapiens
aatgtttgtgcataaatatgtt

SEQ ID NO: 7988688 - DNA, 22 bp, Homo sapiens
agaccctgtatgtgtttagttt

SEQ ID NO: 7988689 - DNA, 20 bp, Homo sapiens
agaccctgtgtcctgtggcc

SEQ ID NO: 7988690 - DNA, 22 bp, Homo sapiens
agaccctgtcagtgttaggaaa

SEQ ID NO: 7988691 - DNA, 20 bp, Homo sapiens
agaccctgtgtcctgtggcc

SEQ ID NO: 7988692 - DNA, 22 bp, Homo sapiens
agacccttcatgtagttcccca

SEQ ID NO: 7988693 - DNA, 22 bp, Homo sapiens
agacccttgcagtctggttgtc

SEQ ID NO: 7988694 - DNA, 22 bp, Homo sapiens
agacccttcagacggctagagc

SEQ ID NO: 7988695 - DNA, 22 bp, Homo sapiens
agaccctttgggtctgtgcagg

SEQ ID NO: 7988696 - DNA, 22 bp, Homo sapiens
agaccctttgggtctgtgcagg

SEQ ID NO: 7988697 - DNA, 22 bp, Homo sapiens
agacccttgtaatgactgtgag

SEQ ID NO: 7988698 - DNA, 22 bp, Homo sapiens
agagccaggtgctgctgtttga

SEQ ID NO: 7988699 - DNA, 22 bp, Homo sapiens
agagccaggtgctgctgtttga

SEQ ID NO: 7988700 - DNA, 22 bp, Homo sapiens
agagccaggtgctgctgtttga

SEQ ID NO: 7988701 - DNA, 22 bp, Homo sapiens
agagccaggctctacctgggtt

SEQ ID NO: 7988702 - DNA, 22 bp, Homo sapiens
agagccaggctctacctgggtt

SEQ ID NO: 7988703 - DNA, 22 bp, Homo sapiens
agagccaggctctacctgggtt

SEQ ID NO: 7988704 - DNA, 22 bp, Homo sapiens
agagccaggctctacctgggtt

SEQ ID NO: 7988705 - DNA, 22 bp, Homo sapiens
agagccaggctctacctgggtt

SEQ ID NO: 7988706 - DNA, 22 bp, Homo sapiens
agagccaggctctacctgggtt

SEQ ID NO: 7988707 - DNA, 22 bp, Homo sapiens
agagccaggctcccatggggca

SEQ ID NO: 7988708 - DNA, 22 bp, Homo sapiens
agagccaggctcccatggggca

SEQ ID NO: 7988709 - DNA, 22 bp, Homo sapiens
agagccaggctcccatggggca

SEQ ID NO: 7988710 - DNA, 22 bp, Homo sapiens
agagccaggctcccatggggca

SEQ ID NO: 7988711 - DNA, 22 bp, Homo sapiens
agagccagttacaactgtggag

SEQ ID NO: 7988712 - DNA, 22 bp, Homo sapiens
agagccagttacaactgtggag

SEQ ID NO: 7988713 - DNA, 22 bp, Homo sapiens
agagccagttacaactgtggag

SEQ ID NO: 7988714 - DNA, 22 bp, Homo sapiens
agagccagttacaactgtggag

SEQ ID NO: 7988715 - DNA, 22 bp, Homo sapiens
agagccagttaagcacttacag

SEQ ID NO: 7988716 - DNA, 22 bp, Homo sapiens
agagccagttacaactgtggag

SEQ ID NO: 7988717 - DNA, 22 bp, Homo sapiens
agagccagttacaactgtggag

SEQ ID NO: 7988718 - DNA, 22 bp, Homo sapiens
agagccaggtgtagtctcggag

SEQ ID NO: 7988719 - DNA, 22 bp, Homo sapiens
agagccaggtgtagtctcggag

SEQ ID NO: 7988720 - DNA, 22 bp, Homo sapiens
agagccaggtgtagtctcggag

SEQ ID NO: 7988721 - DNA, 22 bp, Homo sapiens
agagccaggtgctgctgtttga

SEQ ID NO: 7988722 - DNA, 22 bp, Homo sapiens
agagccaggtgtagtctcggag

SEQ ID NO: 7988723 - DNA, 22 bp, Homo sapiens
agagccaggcggctgggcacct

SEQ ID NO: 7988724 - DNA, 22 bp, Homo sapiens
agagccaggcggctgggcacct

SEQ ID NO: 7988725 - DNA, 22 bp, Homo sapiens
agagccaggcggctgggcacct

SEQ ID NO: 7988726 - DNA, 22 bp, Homo sapiens
agagccaggctcccatggggca

SEQ ID NO: 7988727 - DNA, 22 bp, Homo sapiens
agagccaggctcccatggggca

SEQ ID NO: 7988728 - DNA, 22 bp, Homo sapiens
agagccaggcggctgggcacct

SEQ ID NO: 7988729 - DNA, 22 bp, Homo sapiens
agagccaggcggctgggcacct

SEQ ID NO: 7988730 - DNA, 22 bp, Homo sapiens
agagccaggcggctgggcacct

SEQ ID NO: 7988731 - DNA, 22 bp, Homo sapiens
agagccaggcggctgggcacct

SEQ ID NO: 7988732 - DNA, 22 bp, Homo sapiens
agagcagtcaggctaggacact

SEQ ID NO: 7988733 - DNA, 22 bp, Homo sapiens
agagcagtcaggaacatgctta

SEQ ID NO: 7988734 - DNA, 22 bp, Homo sapiens
agagcaggtggcaactctggga

SEQ ID NO: 7988735 - DNA, 22 bp, Homo sapiens
agagcaggtggcaactctggga

SEQ ID NO: 7988736 - DNA, 22 bp, Homo sapiens
agagacaggatatctgctcatg

SEQ ID NO: 7988737 - DNA, 22 bp, Homo sapiens
agagacagggttttgccatgtt

SEQ ID NO: 7988738 - DNA, 22 bp, Homo sapiens
agagacaggatatctgctcatg

SEQ ID NO: 7988739 - DNA, 22 bp, Homo sapiens
agagacaggatatctgctcatg

SEQ ID NO: 7988740 - DNA, 22 bp, Homo sapiens
agagacaggatatctgctcatg

SEQ ID NO: 7988741 - DNA, 22 bp, Homo sapiens
agagacaggatatctgctcatg

SEQ ID NO: 7988742 - DNA, 22 bp, Homo sapiens
agagacaggatatctgctcatg

SEQ ID NO: 7988743 - DNA, 22 bp, Homo sapiens
agagacagggttttgccatgtt

SEQ ID NO: 7988744 - DNA, 22 bp, Homo sapiens
agagacagggttttgccatgtt

SEQ ID NO: 7988745 - DNA, 22 bp, Homo sapiens
agagacagggttttgccatgtt

SEQ ID NO: 7988746 - DNA, 22 bp, Homo sapiens
agagacagggttttgccatgtt

SEQ ID NO: 7988747 - DNA, 22 bp, Homo sapiens
agagcaggtggcaactctggga

SEQ ID NO: 7988748 - DNA, 22 bp, Homo sapiens
agagacagggttttgccatgtt

SEQ ID NO: 7988749 - DNA, 22 bp, Homo sapiens
agagacagggttttgccatgtt

SEQ ID NO: 7988750 - DNA, 22 bp, Homo sapiens
agagacagggttttgccatgtt

SEQ ID NO: 7988751 - DNA, 22 bp, Homo sapiens
agagacagggttttgccatgtt

SEQ ID NO: 7988752 - DNA, 22 bp, Homo sapiens
agagcaggtggcaactctggga

SEQ ID NO: 7988753 - DNA, 22 bp, Homo sapiens
agagcaggtggcaactctggga

SEQ ID NO: 7988754 - DNA, 22 bp, Homo sapiens
agagccagttgttaagcactta

SEQ ID NO: 7988755 - DNA, 22 bp, Homo sapiens
agagccagttgttaagcactta

SEQ ID NO: 7988756 - DNA, 22 bp, Homo sapiens
agagccagttgttaagcactta

SEQ ID NO: 7988757 - DNA, 22 bp, Homo sapiens
agagccagttgttaagcactta

SEQ ID NO: 7988758 - DNA, 22 bp, Homo sapiens
agagccagttacaactgtggag

SEQ ID NO: 7988759 - DNA, 22 bp, Homo sapiens
agagccagttacaactgtggag

SEQ ID NO: 7988760 - DNA, 22 bp, Homo sapiens
agagccagttacaactgtggag

SEQ ID NO: 7988761 - DNA, 22 bp, Homo sapiens
agagccagttacaactgtggag

SEQ ID NO: 7988762 - DNA, 22 bp, Homo sapiens
agagcctgcatctagcctcaga

SEQ ID NO: 7988763 - DNA, 22 bp, Homo sapiens
agagcctgcatctagcctcaga

SEQ ID NO: 7988764 - DNA, 22 bp, Homo sapiens
agagcctgcatctagcctcaga

SEQ ID NO: 7988765 - DNA, 22 bp, Homo sapiens
agagcctgcatctagcctcaga

SEQ ID NO: 7988766 - DNA, 22 bp, Homo sapiens
agagcctgcatctagcctcaga

SEQ ID NO: 7988767 - DNA, 22 bp, Homo sapiens
agagcctgcatcaggcttgggg

SEQ ID NO: 7988768 - DNA, 22 bp, Homo sapiens
agagcctgcatcaggcttgggg

SEQ ID NO: 7988769 - DNA, 22 bp, Homo sapiens
agagccagttgttaagcactta

SEQ ID NO: 7988770 - DNA, 22 bp, Homo sapiens
agagcctgcatcaggcttgggg

SEQ ID NO: 7988771 - DNA, 22 bp, Homo sapiens
agagcctggacctgagctacaa

SEQ ID NO: 7988772 - DNA, 22 bp, Homo sapiens
agagcctggacctgagctacaa

SEQ ID NO: 7988773 - DNA, 22 bp, Homo sapiens
agagcctggacctgagctacaa

SEQ ID NO: 7988774 - DNA, 22 bp, Homo sapiens
agagcctggacctgagctacaa

SEQ ID NO: 7988775 - DNA, 22 bp, Homo sapiens
agagcctggacctgagctacaa

SEQ ID NO: 7988776 - DNA, 22 bp, Homo sapiens
agagcctggacctgggctctga

SEQ ID NO: 7988777 - DNA, 22 bp, Homo sapiens
agagcctggacctgggctctga

SEQ ID NO: 7988778 - DNA, 22 bp, Homo sapiens
agagcctggacctgggctctga

SEQ ID NO: 7988779 - DNA, 22 bp, Homo sapiens
agagcctggacctgggctctga

SEQ ID NO: 7988780 - DNA, 22 bp, Homo sapiens
agagcctggacctgagctacaa

SEQ ID NO: 7988781 - DNA, 22 bp, Homo sapiens
agagcctgctgtgtaagtcaca

SEQ ID NO: 7988782 - DNA, 22 bp, Homo sapiens
agagcctgctgtgtaagtcaca

SEQ ID NO: 7988783 - DNA, 22 bp, Homo sapiens
agagcctgctgtgtaagtcaca

SEQ ID NO: 7988784 - DNA, 22 bp, Homo sapiens
agagcctgctacctcattccag

SEQ ID NO: 7988785 - DNA, 20 bp, Homo sapiens
agagcctggaaaaagacatc

SEQ ID NO: 7988786 - DNA, 20 bp, Homo sapiens
agagcctggaaaaagacatc

SEQ ID NO: 7988787 - DNA, 20 bp, Homo sapiens
agagcctggaaaaagacatc

SEQ ID NO: 7988788 - DNA, 20 bp, Homo sapiens
agagcctggaaaaagacatc

SEQ ID NO: 7988789 - DNA, 22 bp, Homo sapiens
agagcctggaggttctgctgaa

SEQ ID NO: 7988790 - DNA, 22 bp, Homo sapiens
agagcctggaggttctgctgaa

SEQ ID NO: 7988791 - DNA, 22 bp, Homo sapiens
agagcctggaggttctgctgaa

SEQ ID NO: 7988792 - DNA, 22 bp, Homo sapiens
agagcctggacttttctgagcc

SEQ ID NO: 7988793 - DNA, 22 bp, Homo sapiens
agagcctggaggttctgctgaa

SEQ ID NO: 7988794 - DNA, 22 bp, Homo sapiens
agagcctggacttttctgagcc

SEQ ID NO: 7988795 - DNA, 22 bp, Homo sapiens
agagcctggacttttctgagcc

SEQ ID NO: 7988796 - DNA, 22 bp, Homo sapiens
agagcctggacttttctgagcc

SEQ ID NO: 7988797 - DNA, 22 bp, Homo sapiens
agagcctggacctgggctctga

SEQ ID NO: 7988798 - DNA, 22 bp, Homo sapiens
agagcctggacctgggctctga

SEQ ID NO: 7988799 - DNA, 22 bp, Homo sapiens
agagcctggcaaaaggtcctgc

SEQ ID NO: 7988800 - DNA, 22 bp, Homo sapiens
agagcctggcaaaaggtcctgc

SEQ ID NO: 7988801 - DNA, 22 bp, Homo sapiens
agagcctggcaaaaggtcctgc

SEQ ID NO: 7988802 - DNA, 22 bp, Homo sapiens
agagcctggaggttctgctgaa

SEQ ID NO: 7988803 - DNA, 22 bp, Homo sapiens
agagcctggaggttctgctgaa

SEQ ID NO: 7988804 - DNA, 22 bp, Homo sapiens
agagcctggaggttctgctgaa

SEQ ID NO: 7988805 - DNA, 22 bp, Homo sapiens
aattccagggggtaccattcat

SEQ ID NO: 7988806 - DNA, 22 bp, Homo sapiens
aattccaggcagaaatgtgagt

SEQ ID NO: 7988807 - DNA, 22 bp, Homo sapiens
agagcctggcaaaaggtcctgc

SEQ ID NO: 7988808 - DNA, 22 bp, Homo sapiens
agagcctggcaaaaggtcctgc

SEQ ID NO: 7988809 - DNA, 22 bp, Homo sapiens
aattccatatctgtgattatta

SEQ ID NO: 7988810 - DNA, 22 bp, Homo sapiens
aattccagtctctgctctattt

SEQ ID NO: 7988811 - DNA, 22 bp, Homo sapiens
aattccagggttagctcatttg

SEQ ID NO: 7988812 - DNA, 22 bp, Homo sapiens
aattccagggtacctctgattt

SEQ ID NO: 7988813 - DNA, 22 bp, Homo sapiens
aattccagtaggcaccactcat

SEQ ID NO: 7988814 - DNA, 22 bp, Homo sapiens
aattccatccatttgtttcaac

SEQ ID NO: 7988815 - DNA, 22 bp, Homo sapiens
aattctgcttcatcagctcttt

SEQ ID NO: 7988816 - DNA, 22 bp, Homo sapiens
aattctgatgatactgcattgt

SEQ ID NO: 7988817 - DNA, 22 bp, Homo sapiens
aattctgatgagtcagagaaag

SEQ ID NO: 7988818 - DNA, 22 bp, Homo sapiens
agacaatgtcaaggtgatcatc

SEQ ID NO: 7988819 - DNA, 22 bp, Homo sapiens
agacaatgtcaaggtgatcatc

SEQ ID NO: 7988820 - DNA, 22 bp, Homo sapiens
agacaatgtcaaggtgatcatc

SEQ ID NO: 7988821 - DNA, 22 bp, Homo sapiens
agacaatgtttggtctacactt

SEQ ID NO: 7988822 - DNA, 19 bp, Homo sapiens
agacaatggggttggcagt

SEQ ID NO: 7988823 - DNA, 22 bp, Homo sapiens
agacaatggctaagtaacctgt

SEQ ID NO: 7988824 - DNA, 22 bp, Homo sapiens
agacaatgtcaaggtgatcatc

SEQ ID NO: 7988825 - DNA, 22 bp, Homo sapiens
agacaatggagggaaatacttc

SEQ ID NO: 7988826 - DNA, 22 bp, Homo sapiens
agacaatggctaagtaacctgt

SEQ ID NO: 7988827 - DNA, 22 bp, Homo sapiens
agacaatggagggaaatacttc

SEQ ID NO: 7988828 - DNA, 22 bp, Homo sapiens
agacaatggagagcagagtact

SEQ ID NO: 7988829 - DNA, 20 bp, Homo sapiens
agacaatgagtgacagagtt

SEQ ID NO: 7988830 - DNA, 22 bp, Homo sapiens
agacaatgcaagcagggagtgg

SEQ ID NO: 7988831 - DNA, 22 bp, Homo sapiens
agacaatggaccaagcaccttc

SEQ ID NO: 7988832 - DNA, 22 bp, Homo sapiens
agacaatggaccaagcaccttc

SEQ ID NO: 7988833 - DNA, 21 bp, Homo sapiens
agacaatgctgtaaaattcag

SEQ ID NO: 7988834 - DNA, 22 bp, Homo sapiens
agacaatatgtatattaagaat

SEQ ID NO: 7988835 - DNA, 22 bp, Homo sapiens
agacaatatgtatattaagaat

SEQ ID NO: 7988836 - DNA, 22 bp, Homo sapiens
agacaatatgtatattaagaat

SEQ ID NO: 7988837 - DNA, 22 bp, Homo sapiens
agacaatatgtatattaagaat

SEQ ID NO: 7988838 - DNA, 22 bp, Homo sapiens
agacaatgaatagatttgagaa

SEQ ID NO: 7988839 - DNA, 22 bp, Homo sapiens
agacaatatttcttgcctggtt

SEQ ID NO: 7988840 - DNA, 22 bp, Homo sapiens
agacaatatgtatattaagaat

SEQ ID NO: 7988841 - DNA, 23 bp, Homo sapiens
agaagcagcttctggagtatcgg

SEQ ID NO: 7988842 - DNA, 23 bp, Homo sapiens
agaagcagcttctggagtatcgg

SEQ ID NO: 7988843 - DNA, 23 bp, Homo sapiens
agaagcagcttctggagtatcgg

SEQ ID NO: 7988844 - DNA, 22 bp, Homo sapiens
agaagcagcaagcccttcaaag

SEQ ID NO: 7988845 - DNA, 20 bp, Homo sapiens
agacaaaatgacttcatgca

SEQ ID NO: 7988846 - DNA, 22 bp, Homo sapiens
agaagcagctttcaaggtgatt

SEQ ID NO: 7988847 - DNA, 22 bp, Homo sapiens
agacaaacccagtggctgtttt

SEQ ID NO: 7988848 - DNA, 20 bp, Homo sapiens
agacaaaatgacttcatgca

SEQ ID NO: 7988849 - DNA, 20 bp, Homo sapiens
agacaaaatgacttcatgca

SEQ ID NO: 7988850 - DNA, 20 bp, Homo sapiens
agacaaaatgacttcatgca

SEQ ID NO: 7988851 - DNA, 22 bp, Homo sapiens
agaagcagactctgaggcaagg

SEQ ID NO: 7988852 - DNA, 22 bp, Homo sapiens
agaagcagactctgaggcaagg

SEQ ID NO: 7988853 - DNA, 22 bp, Homo sapiens
agaagcagactctgaggcaagg

SEQ ID NO: 7988854 - DNA, 22 bp, Homo sapiens
agaagcagcaagcccttcaaag

SEQ ID NO: 7988855 - DNA, 22 bp, Homo sapiens
agaagcagactctgaggcaagg

SEQ ID NO: 7988856 - DNA, 22 bp, Homo sapiens
agaagcagactctgaggcaagg

SEQ ID NO: 7988857 - DNA, 22 bp, Homo sapiens
agaagcagaaggaagcagggcc

SEQ ID NO: 7988858 - DNA, 22 bp, Homo sapiens
agaagcagaaggaagcagggcc

SEQ ID NO: 7988859 - DNA, 22 bp, Homo sapiens
aatggcactttataaatgttaa

SEQ ID NO: 7988860 - DNA, 22 bp, Homo sapiens
aatggcagaatgggccagaagc

SEQ ID NO: 7988861 - DNA, 22 bp, Homo sapiens
aatggcagaatgggccagaagc

SEQ ID NO: 7988862 - DNA, 22 bp, Homo sapiens
aatggcagaatgggccagaagc

SEQ ID NO: 7988863 - DNA, 22 bp, Homo sapiens
aatggcactttataaatgttaa

SEQ ID NO: 7988864 - DNA, 22 bp, Homo sapiens
aatggcagagactgttgaaata

SEQ ID NO: 7988865 - DNA, 22 bp, Homo sapiens
aatggcagaatgggccagaagc

SEQ ID NO: 7988866 - DNA, 22 bp, Homo sapiens
aatggcagaggcaaagatggta

SEQ ID NO: 7988867 - DNA, 22 bp, Homo sapiens
aatggcagagactgttgaaata

SEQ ID NO: 7988868 - DNA, 22 bp, Homo sapiens
aatggcagaggcaaagatggta

SEQ ID NO: 7988869 - DNA, 22 bp, Homo sapiens
aatggcagaggcaaagatggta

SEQ ID NO: 7988870 - DNA, 19 bp, Homo sapiens
aatggcagatgccatatct

SEQ ID NO: 7988871 - DNA, 22 bp, Homo sapiens
aatggcagaggcaaagatggta

SEQ ID NO: 7988872 - DNA, 22 bp, Homo sapiens
aatggcagaggcaaagatggta

SEQ ID NO: 7988873 - DNA, 22 bp, Homo sapiens
aatggcagtagttgcatgagag

SEQ ID NO: 7988874 - DNA, 22 bp, Homo sapiens
aatggcagtagttgcatgagag

SEQ ID NO: 7988875 - DNA, 22 bp, Homo sapiens
aatggcagtagttgcatgagag

SEQ ID NO: 7988876 - DNA, 22 bp, Homo sapiens
aatggcagtagttgcatgagag

SEQ ID NO: 7988877 - DNA, 22 bp, Homo sapiens
aatgggaagtcactactgttac

SEQ ID NO: 7988878 - DNA, 22 bp, Homo sapiens
aatgggaagtcactactgttac

SEQ ID NO: 7988879 - DNA, 22 bp, Homo sapiens
aatgggagagaacacaaagtcc

SEQ ID NO: 7988880 - DNA, 22 bp, Homo sapiens
aatgggaagccagaagacaagg

SEQ ID NO: 7988881 - DNA, 22 bp, Homo sapiens
aatgggaggtagtatgggaggt

SEQ ID NO: 7988882 - DNA, 22 bp, Homo sapiens
aatgggataatagaagtagaat

SEQ ID NO: 7988883 - DNA, 22 bp, Homo sapiens
aatgggagtggcttggaaatca

SEQ ID NO: 7988884 - DNA, 22 bp, Homo sapiens
aatgggcacacttagagagtaa

SEQ ID NO: 7988885 - DNA, 22 bp, Homo sapiens
aatgggattaagaaagatcttg

SEQ ID NO: 7988886 - DNA, 22 bp, Homo sapiens
aatgggcacacttagagagtaa

SEQ ID NO: 7988887 - DNA, 22 bp, Homo sapiens
aatggcactttataaatgttaa

SEQ ID NO: 7988888 - DNA, 22 bp, Homo sapiens
aatggcactttataaatgttaa

SEQ ID NO: 7988889 - DNA, 22 bp, Homo sapiens
aatggcaaagtgttttcatacc

SEQ ID NO: 7988890 - DNA, 22 bp, Homo sapiens
aatggcaagctgaactcagaag

SEQ ID NO: 7988891 - DNA, 22 bp, Homo sapiens
aatggaggtgtctggcctggta

SEQ ID NO: 7988892 - DNA, 22 bp, Homo sapiens
agacaattaaaaaattatgctt

SEQ ID NO: 7988893 - DNA, 22 bp, Homo sapiens
agacaattgttctaagtaaaaa

SEQ ID NO: 7988894 - DNA, 22 bp, Homo sapiens
agacaattagcacatcacgggg

SEQ ID NO: 7988895 - DNA, 22 bp, Homo sapiens
aatggagacttcaaaatggatt

SEQ ID NO: 7988896 - DNA, 22 bp, Homo sapiens
aatggagaggctgtgagtgaga

SEQ ID NO: 7988897 - DNA, 22 bp, Homo sapiens
aatggagaggctgtgagtgaga

SEQ ID NO: 7988898 - DNA, 22 bp, Homo sapiens
aatgtaaaatatcttgtacttg

SEQ ID NO: 7988899 - DNA, 22 bp, Homo sapiens
aatgtaaaatatcttgtacttg

SEQ ID NO: 7988900 - DNA, 22 bp, Homo sapiens
aatgtaaaatatcttgtacttg

SEQ ID NO: 7988901 - DNA, 22 bp, Homo sapiens
aatggttttgtctcatcaatgt

SEQ ID NO: 7988902 - DNA, 22 bp, Homo sapiens
aatggttttgtctcatcaatgt

SEQ ID NO: 7988903 - DNA, 22 bp, Homo sapiens
aatggttttgctttagtattct

SEQ ID NO: 7988904 - DNA, 22 bp, Homo sapiens
aatggttttgctttagtattct

SEQ ID NO: 7988905 - DNA, 22 bp, Homo sapiens
aatggtttttgcatattcaggt

SEQ ID NO: 7988906 - DNA, 22 bp, Homo sapiens
aatggtttttagtgagatcgat

SEQ ID NO: 7988907 - DNA, 18 bp, Homo sapiens
aatgtgaatatttacttc

SEQ ID NO: 7988908 - DNA, 22 bp, Homo sapiens
aatgtgactggagtctcttggc

SEQ ID NO: 7988909 - DNA, 22 bp, Homo sapiens
aatgtgactggagtctcttggc

SEQ ID NO: 7988910 - DNA, 22 bp, Homo sapiens
aatgtcttctcttgttgaattt

SEQ ID NO: 7988911 - DNA, 22 bp, Homo sapiens
aatgtcttccctggcaggccaa

SEQ ID NO: 7988912 - DNA, 22 bp, Homo sapiens
aatgtcttcagttctgtattgt

SEQ ID NO: 7988913 - DNA, 22 bp, Homo sapiens
aatgtgaactttgtcatgtaac

SEQ ID NO: 7988914 - DNA, 22 bp, Homo sapiens
aatgtcttcagttctgtattgt

SEQ ID NO: 7988915 - DNA, 22 bp, Homo sapiens
aatgtcttcagttctgtattgt

SEQ ID NO: 7988916 - DNA, 22 bp, Homo sapiens
aatgtcttccctggcaggccaa

SEQ ID NO: 7988917 - DNA, 22 bp, Homo sapiens
aatgtgaggccttggtagttat

SEQ ID NO: 7988918 - DNA, 22 bp, Homo sapiens
aatgtgaggccttggtagttat

SEQ ID NO: 7988919 - DNA, 22 bp, Homo sapiens
aatgtgagccaatgcccgtggg

SEQ ID NO: 7988920 - DNA, 22 bp, Homo sapiens
aatgtgaggccttggtagttat

SEQ ID NO: 7988921 - DNA, 22 bp, Homo sapiens
aatgtgagccaatgcccgtggg

SEQ ID NO: 7988922 - DNA, 22 bp, Homo sapiens
aatgtgatctgtcatgatggca

SEQ ID NO: 7988923 - DNA, 22 bp, Homo sapiens
aatgtgcaggctcaaaccttgt

SEQ ID NO: 7988924 - DNA, 22 bp, Homo sapiens
aatgtgcagtgcctgaagcatg

SEQ ID NO: 7988925 - DNA, 22 bp, Homo sapiens
aatgtgcagatgaataaacaaa

SEQ ID NO: 7988926 - DNA, 23 bp, Homo sapiens
aatgtgctgtattcatttctgga

SEQ ID NO: 7988927 - DNA, 22 bp, Homo sapiens
aatgtgctggtaactgctttgc

SEQ ID NO: 7988928 - DNA, 22 bp, Homo sapiens
aatgtgcttctggctgtggtca

SEQ ID NO: 7988929 - DNA, 22 bp, Homo sapiens
aatgtgctgtcaacatttcgaa

SEQ ID NO: 7988930 - DNA, 22 bp, Homo sapiens
aatgtgctttgttcagccattt

SEQ ID NO: 7988931 - DNA, 22 bp, Homo sapiens
aatgtggatgatactagtactt

SEQ ID NO: 7988932 - DNA, 22 bp, Homo sapiens
aatgtggatccttacagatacc

SEQ ID NO: 7988933 - DNA, 22 bp, Homo sapiens
aatgtggccacttttttctggg

SEQ ID NO: 7988934 - DNA, 22 bp, Homo sapiens
aatgtggccacttttttctggg

SEQ ID NO: 7988935 - DNA, 22 bp, Homo sapiens
aatgtggatccttacagatacc

SEQ ID NO: 7988936 - DNA, 22 bp, Homo sapiens
aatgtggaatcatggactttat

SEQ ID NO: 7988937 - DNA, 22 bp, Homo sapiens
aatgtggactcttgtatttttc

SEQ ID NO: 7988938 - DNA, 17 bp, Homo sapiens
aatgtggaagtacatgc

SEQ ID NO: 7988939 - DNA, 17 bp, Homo sapiens
aatgtggaagtacatgc

SEQ ID NO: 7988940 - DNA, 17 bp, Homo sapiens
aatgtggaagtacatgc

SEQ ID NO: 7988941 - DNA, 23 bp, Homo sapiens
aatgggtgcaactatccatgaca

SEQ ID NO: 7988942 - DNA, 23 bp, Homo sapiens
aatgggtgcaactatccatgaca

SEQ ID NO: 7988943 - DNA, 23 bp, Homo sapiens
aatgggtgcaactatccatgaca

SEQ ID NO: 7988944 - DNA, 22 bp, Homo sapiens
aatgggttgctttccacagcct

SEQ ID NO: 7988945 - DNA, 22 bp, Homo sapiens
aatgggtttctgtcccagctct

SEQ ID NO: 7988946 - DNA, 23 bp, Homo sapiens
aatgggtgcaactatccatgaca

SEQ ID NO: 7988947 - DNA, 23 bp, Homo sapiens
aatgggtgcaactatccatgaca

SEQ ID NO: 7988948 - DNA, 20 bp, Homo sapiens
aatgggctttgatgagtgtg

SEQ ID NO: 7988949 - DNA, 20 bp, Homo sapiens
aatgggctttgatgagtgtg

SEQ ID NO: 7988950 - DNA, 23 bp, Homo sapiens
aatgggtgcaactatccatgaca

SEQ ID NO: 7988951 - DNA, 22 bp, Homo sapiens
aatgggctttcttggacaggag

SEQ ID NO: 7988952 - DNA, 22 bp, Homo sapiens
aatgggctttcttggacaggag

SEQ ID NO: 7988953 - DNA, 22 bp, Homo sapiens
aatgggcatttgtttgtggtac

SEQ ID NO: 7988954 - DNA, 22 bp, Homo sapiens
aatgggcatttggggttgagaa

SEQ ID NO: 7988955 - DNA, 22 bp, Homo sapiens
aatggtaatatttcatagttgt

SEQ ID NO: 7988956 - DNA, 22 bp, Homo sapiens
aatggtaatggagagaactact

SEQ ID NO: 7988957 - DNA, 22 bp, Homo sapiens
aatggtaatattggcacagaaa

SEQ ID NO: 7988958 - DNA, 19 bp, Homo sapiens
aatggtaattagagaaatg

SEQ ID NO: 7988959 - DNA, 19 bp, Homo sapiens
aatggtaattagagaaatg

SEQ ID NO: 7988960 - DNA, 22 bp, Homo sapiens
aatggtaccctggtgacttaga

SEQ ID NO: 7988961 - DNA, 22 bp, Homo sapiens
aatggtaatttgcagaaagtcc

SEQ ID NO: 7988962 - DNA, 22 bp, Homo sapiens
aatggtaatttgcagaaagtcc

SEQ ID NO: 7988963 - DNA, 22 bp, Homo sapiens
aatggtaatttgcagaaagtcc

SEQ ID NO: 7988964 - DNA, 22 bp, Homo sapiens
aatggtttcaaacacactaagt

SEQ ID NO: 7988965 - DNA, 22 bp, Homo sapiens
aatggtttcaaacacactaagt

SEQ ID NO: 7988966 - DNA, 22 bp, Homo sapiens
aatggtttctgaagttaggcag

SEQ ID NO: 7988967 - DNA, 22 bp, Homo sapiens
aatggtttatggggaccgcaaa

SEQ ID NO: 7988968 - DNA, 22 bp, Homo sapiens
aatggtgaggctcctaaatttt

SEQ ID NO: 7988969 - DNA, 22 bp, Homo sapiens
aatggtggatgtctgttctgac

SEQ ID NO: 7988970 - DNA, 23 bp, Homo sapiens
aatggtcttcctccacccctctg

SEQ ID NO: 7988971 - DNA, 22 bp, Homo sapiens
aatggtttaacatatgcttgag

SEQ ID NO: 7988972 - DNA, 22 bp, Homo sapiens
aatggttacagaaatgaaagta

SEQ ID NO: 7988973 - DNA, 22 bp, Homo sapiens
aatggtttagttaagactgagt

SEQ ID NO: 7988974 - DNA, 22 bp, Homo sapiens
aatggtttgatggacaaaatga

SEQ ID NO: 7988975 - DNA, 19 bp, Homo sapiens
aatggtttgatgaagtata

SEQ ID NO: 7988976 - DNA, 22 bp, Homo sapiens
aatggtttaacatatgcttgag

SEQ ID NO: 7988977 - DNA, 22 bp, Homo sapiens
aatggtttctgaagttaggcag

SEQ ID NO: 7988978 - DNA, 19 bp, Homo sapiens
aatggtttgatgaagtata

SEQ ID NO: 7988979 - DNA, 22 bp, Homo sapiens
aatggtttggactattcaatag

SEQ ID NO: 7988980 - DNA, 22 bp, Homo sapiens
aatggtttggactattcaatag

SEQ ID NO: 7988981 - DNA, 22 bp, Homo sapiens
aatggtttgatggacaaaatga

SEQ ID NO: 7988982 - DNA, 22 bp, Homo sapiens
aatggttttctagaacatgaaa

SEQ ID NO: 7988983 - DNA, 22 bp, Homo sapiens
aatggttttctagaacatgaaa

SEQ ID NO: 7988984 - DNA, 22 bp, Homo sapiens
aatggttttgcaggtttgtgga

SEQ ID NO: 7988985 - DNA, 22 bp, Homo sapiens
aatggtttgtacctgtccttgg

SEQ ID NO: 7988986 - DNA, 22 bp, Homo sapiens
aatggtttgtacctgtccttgg

SEQ ID NO: 7988987 - DNA, 22 bp, Homo sapiens
agataagtcttccatatttcta

SEQ ID NO: 7988988 - DNA, 22 bp, Homo sapiens
agataagtactgttattattgc

SEQ ID NO: 7988989 - DNA, 22 bp, Homo sapiens
agataataagtctggtaataat

SEQ ID NO: 7988990 - DNA, 22 bp, Homo sapiens
agataataagtctggtaataat

SEQ ID NO: 7988991 - DNA, 22 bp, Homo sapiens
agataataagtctggtaataat

SEQ ID NO: 7988992 - DNA, 22 bp, Homo sapiens
agataataaatgttttaggttt

SEQ ID NO: 7988993 - DNA, 22 bp, Homo sapiens
agataataaatgttttaggttt

SEQ ID NO: 7988994 - DNA, 22 bp, Homo sapiens
agataactaaagaaagggatta

SEQ ID NO: 7988995 - DNA, 22 bp, Homo sapiens
agataacttttgggtattcatg

SEQ ID NO: 7988996 - DNA, 22 bp, Homo sapiens
agataagatagtccagcacaat

SEQ ID NO: 7988997 - DNA, 22 bp, Homo sapiens
agataagctgtttttcaagaat

SEQ ID NO: 7988998 - DNA, 22 bp, Homo sapiens
agataatggagggatttgcatt

SEQ ID NO: 7988999 - DNA, 22 bp, Homo sapiens
acaactagcaggtattaatttt

SEQ ID NO: 7989000 - DNA, 22 bp, Homo sapiens
acaagaatgtagattagttaag

SEQ ID NO: 7989001 - DNA, 22 bp, Homo sapiens
acaaccttctggagatatctgt

SEQ ID NO: 7989002 - DNA, 22 bp, Homo sapiens
acaaccatcgtctttgcagcca

SEQ ID NO: 7989003 - DNA, 22 bp, Homo sapiens
acaacctgttcgtttccacaga

SEQ ID NO: 7989004 - DNA, 22 bp, Homo sapiens
acaaccatgtcagttcaaacca

SEQ ID NO: 7989005 - DNA, 22 bp, Homo sapiens
acaagagcattgcaggtgtgtt

SEQ ID NO: 7989006 - DNA, 22 bp, Homo sapiens
acaagagccctttcagattgac

SEQ ID NO: 7989007 - DNA, 20 bp, Homo sapiens
acaagagctcagattcagag

SEQ ID NO: 7989008 - DNA, 22 bp, Homo sapiens
acaagagccctttcagattgac

SEQ ID NO: 7989009 - DNA, 22 bp, Homo sapiens
acaagagtatctttgactttag

SEQ ID NO: 7989010 - DNA, 22 bp, Homo sapiens
acaagagtaatttcaacagagt

SEQ ID NO: 7989011 - DNA, 22 bp, Homo sapiens
acaagagtaatttcaacagagt

SEQ ID NO: 7989012 - DNA, 22 bp, Homo sapiens
acaagagtagacagccttcttt

SEQ ID NO: 7989013 - DNA, 22 bp, Homo sapiens
acaagagtaatttcaacagagt

SEQ ID NO: 7989014 - DNA, 22 bp, Homo sapiens
acaagatagcttagaagattca

SEQ ID NO: 7989015 - DNA, 22 bp, Homo sapiens
acaagatactcagctacaagac

SEQ ID NO: 7989016 - DNA, 22 bp, Homo sapiens
acaagagtgagattatcatgta

SEQ ID NO: 7989017 - DNA, 22 bp, Homo sapiens
acaagagtctgcatttctaaca

SEQ ID NO: 7989018 - DNA, 22 bp, Homo sapiens
acaagatactcagctacaagac

SEQ ID NO: 7989019 - DNA, 22 bp, Homo sapiens
acaagagagacactaggaatgt

SEQ ID NO: 7989020 - DNA, 22 bp, Homo sapiens
acaagagacaagaggttcttct

SEQ ID NO: 7989021 - DNA, 22 bp, Homo sapiens
acaagaattatttctagttaac

SEQ ID NO: 7989022 - DNA, 22 bp, Homo sapiens
acaagaattatttctagttaac

SEQ ID NO: 7989023 - DNA, 22 bp, Homo sapiens
acaagactgtgctctaagagtg

SEQ ID NO: 7989024 - DNA, 22 bp, Homo sapiens
acaagagattatctacagatga

SEQ ID NO: 7989025 - DNA, 22 bp, Homo sapiens
acaagagattatctacagatga

SEQ ID NO: 7989026 - DNA, 22 bp, Homo sapiens
acaagagattatctacagatga

SEQ ID NO: 7989027 - DNA, 22 bp, Homo sapiens
acaagagattatctacagatga

SEQ ID NO: 7989028 - DNA, 22 bp, Homo sapiens
acaagagattatctacagatga

SEQ ID NO: 7989029 - DNA, 22 bp, Homo sapiens
acaagagcattgcaggtgtgtt

SEQ ID NO: 7989030 - DNA, 22 bp, Homo sapiens
acaacaaagacacttgaaatga

SEQ ID NO: 7989031 - DNA, 22 bp, Homo sapiens
acaacaaagacacttgaaatga

SEQ ID NO: 7989032 - DNA, 22 bp, Homo sapiens
acaacaatctaccctagcttct

SEQ ID NO: 7989033 - DNA, 22 bp, Homo sapiens
acaacaaagacacttgaaatga

SEQ ID NO: 7989034 - DNA, 22 bp, Homo sapiens
acaacaaagacacttgaaatga

SEQ ID NO: 7989035 - DNA, 22 bp, Homo sapiens
acaacaatctaccctagcttct

SEQ ID NO: 7989036 - DNA, 22 bp, Homo sapiens
acaacaatctaccctagcttct

SEQ ID NO: 7989037 - DNA, 22 bp, Homo sapiens
acaacaatctaccctagcttct

SEQ ID NO: 7989038 - DNA, 22 bp, Homo sapiens
acaacacagcaaaaccccatct

SEQ ID NO: 7989039 - DNA, 22 bp, Homo sapiens
acaacacagctttcctcaagtt

SEQ ID NO: 7989040 - DNA, 22 bp, Homo sapiens
acaacacagcaaaaccccatct

SEQ ID NO: 7989041 - DNA, 22 bp, Homo sapiens
acaacaaagacacttgaaatga

SEQ ID NO: 7989042 - DNA, 22 bp, Homo sapiens
acaacaaagacacttgaaatga

SEQ ID NO: 7989043 - DNA, 20 bp, Homo sapiens
acaaattggcagaatgacaa

SEQ ID NO: 7989044 - DNA, 20 bp, Homo sapiens
acaacaaacttgcttaagga

SEQ ID NO: 7989045 - DNA, 20 bp, Homo sapiens
acaacaaacttgcttaagga

SEQ ID NO: 7989046 - DNA, 22 bp, Homo sapiens
agaggggttaagtgctagtccg

SEQ ID NO: 7989047 - DNA, 22 bp, Homo sapiens
agaggggttaagtgctagtccg

SEQ ID NO: 7989048 - DNA, 22 bp, Homo sapiens
agaggggttaagtgctagtccg

SEQ ID NO: 7989049 - DNA, 22 bp, Homo sapiens
agaggggtggtgctctcctgga

SEQ ID NO: 7989050 - DNA, 19 bp, Homo sapiens
acaaattggcaaaatgcaa

SEQ ID NO: 7989051 - DNA, 22 bp, Homo sapiens
acaaattgccccattttgaact

SEQ ID NO: 7989052 - DNA, 22 bp, Homo sapiens
acaaattgcctagtctagcatc

SEQ ID NO: 7989053 - DNA, 22 bp, Homo sapiens
acaaattgccccattttgaact

SEQ ID NO: 7989054 - DNA, 22 bp, Homo sapiens
agataactcattttgtatatcc

SEQ ID NO: 7989055 - DNA, 22 bp, Homo sapiens
agataacatttattgaatgtaa

SEQ ID NO: 7989056 - DNA, 22 bp, Homo sapiens
agataacatgttgcagattctg

SEQ ID NO: 7989057 - DNA, 22 bp, Homo sapiens
agataacatttattgaatgtaa

SEQ ID NO: 7989058 - DNA, 22 bp, Homo sapiens
acaacagagctggactgagagg

SEQ ID NO: 7989059 - DNA, 22 bp, Homo sapiens
agataaattcctaagatttcag

SEQ ID NO: 7989060 - DNA, 22 bp, Homo sapiens
agataaattcctaagatttcag

SEQ ID NO: 7989061 - DNA, 22 bp, Homo sapiens
acaacagagctggactgagagg

SEQ ID NO: 7989062 - DNA, 22 bp, Homo sapiens
acaacagagctggactgagagg

SEQ ID NO: 7989063 - DNA, 22 bp, Homo sapiens
acaacagagctggactgagagg

SEQ ID NO: 7989064 - DNA, 22 bp, Homo sapiens
acaacagagctggactgagagg

SEQ ID NO: 7989065 - DNA, 22 bp, Homo sapiens
acaacagagctggactgagagg

SEQ ID NO: 7989066 - DNA, 22 bp, Homo sapiens
acaacagagctggactgagagg

SEQ ID NO: 7989067 - DNA, 22 bp, Homo sapiens
acaacacagctttcctcaagtt

SEQ ID NO: 7989068 - DNA, 22 bp, Homo sapiens
acaacacagctttcctcaagtt

SEQ ID NO: 7989069 - DNA, 22 bp, Homo sapiens
acaacacagctttcctcaagtt

SEQ ID NO: 7989070 - DNA, 22 bp, Homo sapiens
acaacacatgtgtatatgtgtg

SEQ ID NO: 7989071 - DNA, 22 bp, Homo sapiens
acaacaaagacacttgaaatga

SEQ ID NO: 7989072 - DNA, 22 bp, Homo sapiens
acaacacatgtgtatatgtgtg

SEQ ID NO: 7989073 - DNA, 22 bp, Homo sapiens
acaacacatgtgtatatgtgtg

SEQ ID NO: 7989074 - DNA, 17 bp, Homo sapiens
acaacagaaatgtattc

SEQ ID NO: 7989075 - DNA, 22 bp, Homo sapiens
acaacagagctggactgagagg

SEQ ID NO: 7989076 - DNA, 22 bp, Homo sapiens
acaacagagctggactgagagg

SEQ ID NO: 7989077 - DNA, 22 bp, Homo sapiens
acaagcatgtggtaaaaagacc

SEQ ID NO: 7989078 - DNA, 22 bp, Homo sapiens
acaagcatcaggttcagcaata

SEQ ID NO: 7989079 - DNA, 22 bp, Homo sapiens
acaagcatgtggtaaaaagacc

SEQ ID NO: 7989080 - DNA, 22 bp, Homo sapiens
acaagcatgggctttgacatca

SEQ ID NO: 7989081 - DNA, 22 bp, Homo sapiens
acaagcatgtggtaaaaagacc

SEQ ID NO: 7989082 - DNA, 22 bp, Homo sapiens
acaagcatcaggttcagcaata

SEQ ID NO: 7989083 - DNA, 22 bp, Homo sapiens
acaagcatcaggttcagcaata

SEQ ID NO: 7989084 - DNA, 22 bp, Homo sapiens
acaagcagtaaaggccacagtc

SEQ ID NO: 7989085 - DNA, 22 bp, Homo sapiens
acaagcagtaaaggccacagtc

SEQ ID NO: 7989086 - DNA, 17 bp, Homo sapiens
acaagcagtggccatgg

SEQ ID NO: 7989087 - DNA, 17 bp, Homo sapiens
acaagcagtggccatgg

SEQ ID NO: 7989088 - DNA, 22 bp, Homo sapiens
acaagcagtaaaggccacagtc

SEQ ID NO: 7989089 - DNA, 22 bp, Homo sapiens
acaagcataagtgagatgaata

SEQ ID NO: 7989090 - DNA, 22 bp, Homo sapiens
acaagcataagtgagatgaata

SEQ ID NO: 7989091 - DNA, 22 bp, Homo sapiens
acaagcataagtgagatgaata

SEQ ID NO: 7989092 - DNA, 17 bp, Homo sapiens
acaagcagtggccatgg

SEQ ID NO: 7989093 - DNA, 22 bp, Homo sapiens
acaagcttccaggtgatgctga

SEQ ID NO: 7989094 - DNA, 22 bp, Homo sapiens
acaatagacaaagtgaatggct

SEQ ID NO: 7989095 - DNA, 22 bp, Homo sapiens
acaatcacacatgcaattatac

SEQ ID NO: 7989096 - DNA, 22 bp, Homo sapiens
acaagcttattaagttatctgt

SEQ ID NO: 7989097 - DNA, 22 bp, Homo sapiens
acaagctgtggtgggacaagag

SEQ ID NO: 7989098 - DNA, 22 bp, Homo sapiens
acaagctgtggtgggacaagag

SEQ ID NO: 7989099 - DNA, 22 bp, Homo sapiens
acaagcgggccacagtgctggt

SEQ ID NO: 7989100 - DNA, 22 bp, Homo sapiens
acaagcgggccacagtgctggt

SEQ ID NO: 7989101 - DNA, 23 bp, Homo sapiens
acaagatagggataaaaagataa

SEQ ID NO: 7989102 - DNA, 23 bp, Homo sapiens
acaagatagggataaaaagataa

SEQ ID NO: 7989103 - DNA, 23 bp, Homo sapiens
acaagatagggataaaaagataa

SEQ ID NO: 7989104 - DNA, 22 bp, Homo sapiens
acaagatagcttagaagattca

SEQ ID NO: 7989105 - DNA, 22 bp, Homo sapiens
acaagatagcttagaagattca

SEQ ID NO: 7989106 - DNA, 23 bp, Homo sapiens
acaagatagggataaaaagataa

SEQ ID NO: 7989107 - DNA, 23 bp, Homo sapiens
acaagatagggataaaaagataa

SEQ ID NO: 7989108 - DNA, 23 bp, Homo sapiens
acaagatagggataaaaagataa

SEQ ID NO: 7989109 - DNA, 23 bp, Homo sapiens
acaagatagggataaaaagataa

SEQ ID NO: 7989110 - DNA, 22 bp, Homo sapiens
acaagataggttgagtctagcc

SEQ ID NO: 7989111 - DNA, 22 bp, Homo sapiens
acaagataggttgagtctagcc

SEQ ID NO: 7989112 - DNA, 22 bp, Homo sapiens
acaagataggttgagtctagcc

SEQ ID NO: 7989113 - DNA, 22 bp, Homo sapiens
acaagatggaatattgagaaaa

SEQ ID NO: 7989114 - DNA, 22 bp, Homo sapiens
acaagatggaatattgagaaaa

SEQ ID NO: 7989115 - DNA, 22 bp, Homo sapiens
acaagatggaatattgagaaaa

SEQ ID NO: 7989116 - DNA, 22 bp, Homo sapiens
acaagatgtgtttatacaagct

SEQ ID NO: 7989117 - DNA, 22 bp, Homo sapiens
acaagatgtgtttatacaagct

SEQ ID NO: 7989118 - DNA, 22 bp, Homo sapiens
acaagattcaatgaattgattg

SEQ ID NO: 7989119 - DNA, 22 bp, Homo sapiens
acaagattcaatgaattgattg

SEQ ID NO: 7989120 - DNA, 22 bp, Homo sapiens
acaagcagaaggtggggtctta

SEQ ID NO: 7989121 - DNA, 22 bp, Homo sapiens
acaagcagaaggtggggtctta

SEQ ID NO: 7989122 - DNA, 22 bp, Homo sapiens
acaagcacttcactgtcctctg

SEQ ID NO: 7989123 - DNA, 22 bp, Homo sapiens
acaagattttgtctggtagggt

SEQ ID NO: 7989124 - DNA, 22 bp, Homo sapiens
acaagattttatgactcttttt

SEQ ID NO: 7989125 - DNA, 22 bp, Homo sapiens
acaagattttatgactcttttt

SEQ ID NO: 7989126 - DNA, 22 bp, Homo sapiens
acaagcagagattaaatgtttt

SEQ ID NO: 7989127 - DNA, 23 bp, Homo sapiens
acaagcagcccagtgctctgcct

SEQ ID NO: 7989128 - DNA, 22 bp, Homo sapiens
acaagcagaaggtggggtctta

SEQ ID NO: 7989129 - DNA, 23 bp, Homo sapiens
acaagcagcccagtgctctgcct

SEQ ID NO: 7989130 - DNA, 18 bp, Homo sapiens
acaagcaggggcaaacac

SEQ ID NO: 7989131 - DNA, 22 bp, Homo sapiens
acaagattttatgactcttttt

SEQ ID NO: 7989132 - DNA, 22 bp, Homo sapiens
acaagatttggctgaaactcca

SEQ ID NO: 7989133 - DNA, 22 bp, Homo sapiens
acaagatttggctgaaactcca

SEQ ID NO: 7989134 - DNA, 22 bp, Homo sapiens
acaagattttatgactcttttt

SEQ ID NO: 7989135 - DNA, 22 bp, Homo sapiens
acaagatttaatgcaacccaag

SEQ ID NO: 7989136 - DNA, 22 bp, Homo sapiens
acaagatttaatgcaacccaag

SEQ ID NO: 7989137 - DNA, 22 bp, Homo sapiens
acaagattgataagtctgccct

SEQ ID NO: 7989138 - DNA, 22 bp, Homo sapiens
acaagatttggctgaaactcca

SEQ ID NO: 7989139 - DNA, 22 bp, Homo sapiens
acaagatttagcttaaagggct

SEQ ID NO: 7989140 - DNA, 22 bp, Homo sapiens
acaatcttattagtagtataga

SEQ ID NO: 7989141 - DNA, 22 bp, Homo sapiens
acaatcttattagtagtataga

SEQ ID NO: 7989142 - DNA, 22 bp, Homo sapiens
acaatctggaaaagttaactat

SEQ ID NO: 7989143 - DNA, 20 bp, Homo sapiens
acaatctgtttgttgtctgt

SEQ ID NO: 7989144 - DNA, 22 bp, Homo sapiens
acaatcagcactgagtttatct

SEQ ID NO: 7989145 - DNA, 22 bp, Homo sapiens
acaatcagcactgagtttatct

SEQ ID NO: 7989146 - DNA, 22 bp, Homo sapiens
acaatcattggcttcattacaa

SEQ ID NO: 7989147 - DNA, 22 bp, Homo sapiens
acaatcattccgttcacaacag

SEQ ID NO: 7989148 - DNA, 22 bp, Homo sapiens
acaatgaaaaaatttactgtgg

SEQ ID NO: 7989149 - DNA, 22 bp, Homo sapiens
acaatgaaaaaatttactgtgg

SEQ ID NO: 7989150 - DNA, 22 bp, Homo sapiens
acaatgaaaaaatttactgtgg

SEQ ID NO: 7989151 - DNA, 22 bp, Homo sapiens
acaatgaaaaaatttactgtgg

SEQ ID NO: 7989152 - DNA, 22 bp, Homo sapiens
acaatgaaagcaagaagacggc

SEQ ID NO: 7989153 - DNA, 22 bp, Homo sapiens
acaatgaaagcaagaagacggc

SEQ ID NO: 7989154 - DNA, 22 bp, Homo sapiens
acaatgaaccaaatttaccaat

SEQ ID NO: 7989155 - DNA, 22 bp, Homo sapiens
acaatgaacgctttttaactgt

SEQ ID NO: 7989156 - DNA, 22 bp, Homo sapiens
acaatgaacgctttttaactgt

SEQ ID NO: 7989157 - DNA, 22 bp, Homo sapiens
acaatgaaaggtattctgaact

SEQ ID NO: 7989158 - DNA, 22 bp, Homo sapiens
acaatgaacacacaaggaattc

SEQ ID NO: 7989159 - DNA, 22 bp, Homo sapiens
acaatgaacacacaaggaattc

SEQ ID NO: 7989160 - DNA, 22 bp, Homo sapiens
acaatgaacacacaaggaattc

SEQ ID NO: 7989161 - DNA, 22 bp, Homo sapiens
acaatgaacacacaaggaattc

SEQ ID NO: 7989162 - DNA, 22 bp, Homo sapiens
acaatgaagggagacacttgct

SEQ ID NO: 7989163 - DNA, 22 bp, Homo sapiens
acaatgaagggagacacttgct

SEQ ID NO: 7989164 - DNA, 22 bp, Homo sapiens
acaatgaagctccactgagctt

SEQ ID NO: 7989165 - DNA, 22 bp, Homo sapiens
acaatgaagataatgttgcagt

SEQ ID NO: 7989166 - DNA, 22 bp, Homo sapiens
acaatgaagataatgttgcagt

SEQ ID NO: 7989167 - DNA, 22 bp, Homo sapiens
acaatgaagataatgttgcagt

SEQ ID NO: 7989168 - DNA, 22 bp, Homo sapiens
acaatgaatactaagcaccagg

SEQ ID NO: 7989169 - DNA, 22 bp, Homo sapiens
acaatgaatactaagcaccagg

SEQ ID NO: 7989170 - DNA, 22 bp, Homo sapiens
acaatgaatactaagcaccagg

SEQ ID NO: 7989171 - DNA, 22 bp, Homo sapiens
acaatgaatatcatgaagtact

SEQ ID NO: 7989172 - DNA, 22 bp, Homo sapiens
acaatgaatatcatgaagtact

SEQ ID NO: 7989173 - DNA, 19 bp, Homo sapiens
acaatgaatgtgttctctt

SEQ ID NO: 7989174 - DNA, 22 bp, Homo sapiens
acaatgaatatcatgaagtact

SEQ ID NO: 7989175 - DNA, 22 bp, Homo sapiens
acaatgatgcagatgagtaaga

SEQ ID NO: 7989176 - DNA, 22 bp, Homo sapiens
acaatgatgcagatgagtaaga

SEQ ID NO: 7989177 - DNA, 22 bp, Homo sapiens
acaatgatgcagatgagtaaga

SEQ ID NO: 7989178 - DNA, 19 bp, Homo sapiens
acaatgaatgtgttctctt

SEQ ID NO: 7989179 - DNA, 22 bp, Homo sapiens
acaatgattttttagagtagtt

SEQ ID NO: 7989180 - DNA, 22 bp, Homo sapiens
acaatgattttttagagtagtt

SEQ ID NO: 7989181 - DNA, 22 bp, Homo sapiens
acaatgattttttagagtagtt

SEQ ID NO: 7989182 - DNA, 22 bp, Homo sapiens
acaatgcaattgtaaggtgtgt

SEQ ID NO: 7989183 - DNA, 22 bp, Homo sapiens
acaaagtaagggctaatgagca

SEQ ID NO: 7989184 - DNA, 22 bp, Homo sapiens
acaaagtaagggctaatgagca

SEQ ID NO: 7989185 - DNA, 22 bp, Homo sapiens
acaaagtaagggctaatgagca

SEQ ID NO: 7989186 - DNA, 22 bp, Homo sapiens
acaaagtaagggctaatgagca

SEQ ID NO: 7989187 - DNA, 22 bp, Homo sapiens
acaaaggtgagcagaagacaca

SEQ ID NO: 7989188 - DNA, 22 bp, Homo sapiens
acaaaggtgagcagaagacaca

SEQ ID NO: 7989189 - DNA, 22 bp, Homo sapiens
acaaaggtggaccatgtggctt

SEQ ID NO: 7989190 - DNA, 22 bp, Homo sapiens
acaaaggcaggattgacttagt

SEQ ID NO: 7989191 - DNA, 18 bp, Homo sapiens
acaaaggtctgcaagacc

SEQ ID NO: 7989192 - DNA, 22 bp, Homo sapiens
acaaagggggactgcagagggt

SEQ ID NO: 7989193 - DNA, 22 bp, Homo sapiens
acaaagggggactgcagagggt

SEQ ID NO: 7989194 - DNA, 22 bp, Homo sapiens
acaaagtaggaagattagctga

SEQ ID NO: 7989195 - DNA, 23 bp, Homo sapiens
acaaagtaattcctgcttccaaa

SEQ ID NO: 7989196 - DNA, 23 bp, Homo sapiens
acaaagtaattcctgcttccaaa

SEQ ID NO: 7989197 - DNA, 22 bp, Homo sapiens
acaaagtaggcagtgggctgga

SEQ ID NO: 7989198 - DNA, 22 bp, Homo sapiens
acaaagtagtcaaagtagatga

SEQ ID NO: 7989199 - DNA, 20 bp, Homo sapiens
acaaagtattgaggacaagt

SEQ ID NO: 7989200 - DNA, 20 bp, Homo sapiens
acaaagtattgaggacaagt

SEQ ID NO: 7989201 - DNA, 22 bp, Homo sapiens
acaaagtagtcaaagtagatga

SEQ ID NO: 7989202 - DNA, 22 bp, Homo sapiens
acaaagtagtcaaagtagatga

SEQ ID NO: 7989203 - DNA, 22 bp, Homo sapiens
acaaagtaggtcatcaaagctc

SEQ ID NO: 7989204 - DNA, 22 bp, Homo sapiens
acaaagtaggtcatcaaagctc

SEQ ID NO: 7989205 - DNA, 22 bp, Homo sapiens
agagggggtgtcagcactgcag

SEQ ID NO: 7989206 - DNA, 22 bp, Homo sapiens
agagggggtgtcagcactgcag

SEQ ID NO: 7989207 - DNA, 22 bp, Homo sapiens
agagggggtgtcagcactgcag

SEQ ID NO: 7989208 - DNA, 22 bp, Homo sapiens
agagggggtgtcagcactgcag

SEQ ID NO: 7989209 - DNA, 22 bp, Homo sapiens
agagggggtgtcagcactgcag

SEQ ID NO: 7989210 - DNA, 22 bp, Homo sapiens
agagggggtgttccagaagcat

SEQ ID NO: 7989211 - DNA, 22 bp, Homo sapiens
agagggggtgttccagaagcat

SEQ ID NO: 7989212 - DNA, 22 bp, Homo sapiens
agaggggtgggcacagcgccca

SEQ ID NO: 7989213 - DNA, 22 bp, Homo sapiens
agagggggaaaatagaggtgtt

SEQ ID NO: 7989214 - DNA, 22 bp, Homo sapiens
agagggggaaaatagaggtgtt

SEQ ID NO: 7989215 - DNA, 22 bp, Homo sapiens
agagggggaaaatagaggtgtt

SEQ ID NO: 7989216 - DNA, 22 bp, Homo sapiens
agagggggaaaatagaggtgtt

SEQ ID NO: 7989217 - DNA, 22 bp, Homo sapiens
agagggggcagcggaccagtga

SEQ ID NO: 7989218 - DNA, 22 bp, Homo sapiens
agagggggcagcggaccagtga

SEQ ID NO: 7989219 - DNA, 22 bp, Homo sapiens
agagggggcagcggaccagtga

SEQ ID NO: 7989220 - DNA, 22 bp, Homo sapiens
agagggggcagcggaccagtga

SEQ ID NO: 7989221 - DNA, 22 bp, Homo sapiens
agaggctgtgcagagggagtgc

SEQ ID NO: 7989222 - DNA, 22 bp, Homo sapiens
agaggctgatggagtagtgtct

SEQ ID NO: 7989223 - DNA, 22 bp, Homo sapiens
agaggctgatggagtagtgtct

SEQ ID NO: 7989224 - DNA, 22 bp, Homo sapiens
agaggctgagaaaccctcttct

SEQ ID NO: 7989225 - DNA, 22 bp, Homo sapiens
agaggctgtgcccaccaggcaa

SEQ ID NO: 7989226 - DNA, 22 bp, Homo sapiens
agaggctgtgcccaccaggcaa

SEQ ID NO: 7989227 - DNA, 22 bp, Homo sapiens
agaggctgtgcccaccaggcaa

SEQ ID NO: 7989228 - DNA, 22 bp, Homo sapiens
agaggctgtgcccaccaggcaa

SEQ ID NO: 7989229 - DNA, 22 bp, Homo sapiens
agaggctgtgcccaccaggcaa

SEQ ID NO: 7989230 - DNA, 22 bp, Homo sapiens
agaggctgtgcccaccaggcaa

SEQ ID NO: 7989231 - DNA, 22 bp, Homo sapiens
agaggctgtgcccaccaggcaa

SEQ ID NO: 7989232 - DNA, 22 bp, Homo sapiens
agaggctgttacactcccagat

SEQ ID NO: 7989233 - DNA, 22 bp, Homo sapiens
agaggctgttacactcccagat

SEQ ID NO: 7989234 - DNA, 22 bp, Homo sapiens
agaggctgttacactcccagat

SEQ ID NO: 7989235 - DNA, 22 bp, Homo sapiens
agaggctgttacactcccagat

SEQ ID NO: 7989236 - DNA, 22 bp, Homo sapiens
agaggctgtgcccaccaggcaa

SEQ ID NO: 7989237 - DNA, 22 bp, Homo sapiens
agaggctgttacactcccagat

SEQ ID NO: 7989238 - DNA, 22 bp, Homo sapiens
agaggctgttacactcccagat

SEQ ID NO: 7989239 - DNA, 22 bp, Homo sapiens
agaggctgttacactcccagat

SEQ ID NO: 7989240 - DNA, 22 bp, Homo sapiens
agaggctgttacactcccagat

SEQ ID NO: 7989241 - DNA, 18 bp, Homo sapiens
agaggcttaatgaatggc

SEQ ID NO: 7989242 - DNA, 22 bp, Homo sapiens
agaggcttacaaagattgatga

SEQ ID NO: 7989243 - DNA, 22 bp, Homo sapiens
agaggcttctcggatggggcag

SEQ ID NO: 7989244 - DNA, 22 bp, Homo sapiens
agaggcttctttctgatttgcg

SEQ ID NO: 7989245 - DNA, 20 bp, Homo sapiens
agaggcttccttgggaggag

SEQ ID NO: 7989246 - DNA, 22 bp, Homo sapiens
agaggcttcctgccacctgaga

SEQ ID NO: 7989247 - DNA, 20 bp, Homo sapiens
agaggcttccttgggaggag

SEQ ID NO: 7989248 - DNA, 22 bp, Homo sapiens
agaggcttcctgccacctgaga

SEQ ID NO: 7989249 - DNA, 23 bp, Homo sapiens
agaggcttatgtttatttcttcc

SEQ ID NO: 7989250 - DNA, 22 bp, Homo sapiens
agaggcttcctgccacctgaga

SEQ ID NO: 7989251 - DNA, 22 bp, Homo sapiens
acaaagaaggaattggtcttta

SEQ ID NO: 7989252 - DNA, 22 bp, Homo sapiens
acaaagaaggaattggtcttta

SEQ ID NO: 7989253 - DNA, 22 bp, Homo sapiens
agaggcttggaggtgcaaggtt

SEQ ID NO: 7989254 - DNA, 22 bp, Homo sapiens
acaaagaaggaattggtcttta

SEQ ID NO: 7989255 - DNA, 22 bp, Homo sapiens
agaggcttgacaatatgattgg

SEQ ID NO: 7989256 - DNA, 22 bp, Homo sapiens
agaggcttctcggatggggcag

SEQ ID NO: 7989257 - DNA, 22 bp, Homo sapiens
acaaagaaggaattggtcttta

SEQ ID NO: 7989258 - DNA, 22 bp, Homo sapiens
acaaagaaggaattggtcttta

SEQ ID NO: 7989259 - DNA, 22 bp, Homo sapiens
acaaagaaggaattggtcttta

SEQ ID NO: 7989260 - DNA, 22 bp, Homo sapiens
acaaagaaggaattggtcttta

SEQ ID NO: 7989261 - DNA, 22 bp, Homo sapiens
acaaagcttagacctaagagat

SEQ ID NO: 7989262 - DNA, 19 bp, Homo sapiens
acaaagctgtgagcagctt

SEQ ID NO: 7989263 - DNA, 22 bp, Homo sapiens
acaaagcttagacctaagagat

SEQ ID NO: 7989264 - DNA, 22 bp, Homo sapiens
acaaagcttagacctaagagat

SEQ ID NO: 7989265 - DNA, 22 bp, Homo sapiens
acaaagcttagacctaagagat

SEQ ID NO: 7989266 - DNA, 21 bp, Homo sapiens
acaaaggaagtctcttttaag

SEQ ID NO: 7989267 - DNA, 18 bp, Homo sapiens
acaaaggatcatgaggga

SEQ ID NO: 7989268 - DNA, 18 bp, Homo sapiens
acaaaggatcatgaggga

SEQ ID NO: 7989269 - DNA, 18 bp, Homo sapiens
acaaaggatcatgaggga

SEQ ID NO: 7989270 - DNA, 22 bp, Homo sapiens
aattgcatgttaatgactaagt

SEQ ID NO: 7989271 - DNA, 22 bp, Homo sapiens
aattgcatgttaatgactaagt

SEQ ID NO: 7989272 - DNA, 22 bp, Homo sapiens
aattgcccatatttgagaatga

SEQ ID NO: 7989273 - DNA, 22 bp, Homo sapiens
aattgcataaaattcaactctg

SEQ ID NO: 7989274 - DNA, 22 bp, Homo sapiens
aattgcagcagcttcagcagtt

SEQ ID NO: 7989275 - DNA, 22 bp, Homo sapiens
aattgcaattttcttaaggtct

SEQ ID NO: 7989276 - DNA, 22 bp, Homo sapiens
aattgcaacaggtagacttttc

SEQ ID NO: 7989277 - DNA, 22 bp, Homo sapiens
aattgcatatatatgaggccat

SEQ ID NO: 7989278 - DNA, 22 bp, Homo sapiens
aattgcataaatttcatagcat

SEQ ID NO: 7989279 - DNA, 22 bp, Homo sapiens
aattgcaggcaccagcaggagc

SEQ ID NO: 7989280 - DNA, 22 bp, Homo sapiens
aattgagtgactgctgcatgtc

SEQ ID NO: 7989281 - DNA, 22 bp, Homo sapiens
aattgacagaaagtttacgagg

SEQ ID NO: 7989282 - DNA, 22 bp, Homo sapiens
aattgacagaaagtttacgagg

SEQ ID NO: 7989283 - DNA, 22 bp, Homo sapiens
aattgatggacagagatgaaga

SEQ ID NO: 7989284 - DNA, 22 bp, Homo sapiens
aattgatgatacccacacttat

SEQ ID NO: 7989285 - DNA, 22 bp, Homo sapiens
aattgatgattcttatgtgaaa

SEQ ID NO: 7989286 - DNA, 22 bp, Homo sapiens
aattgagtgctagacatcatga

SEQ ID NO: 7989287 - DNA, 22 bp, Homo sapiens
aattgatgatacccacacttat

SEQ ID NO: 7989288 - DNA, 22 bp, Homo sapiens
aattgatgtctaccacatgcct

SEQ ID NO: 7989289 - DNA, 22 bp, Homo sapiens
aattgatgtaaggaagacttag

SEQ ID NO: 7989290 - DNA, 22 bp, Homo sapiens
aattgatgtctaccacatgcct

SEQ ID NO: 7989291 - DNA, 22 bp, Homo sapiens
aattgatggacagagatgaaga

SEQ ID NO: 7989292 - DNA, 22 bp, Homo sapiens
aattgatggacagagatgaaga

SEQ ID NO: 7989293 - DNA, 22 bp, Homo sapiens
aattgatggacagagatgaaga

SEQ ID NO: 7989294 - DNA, 22 bp, Homo sapiens
aattgatgtaaggaagacttag

SEQ ID NO: 7989295 - DNA, 22 bp, Homo sapiens
aattgatgggcactgaaatatt

SEQ ID NO: 7989296 - DNA, 22 bp, Homo sapiens
aattgatgggcactgaaatatt

SEQ ID NO: 7989297 - DNA, 22 bp, Homo sapiens
aattcttggtcctagtgtataa

SEQ ID NO: 7989298 - DNA, 22 bp, Homo sapiens
aattcttgttgttagtatattt

SEQ ID NO: 7989299 - DNA, 22 bp, Homo sapiens
aattcttgttgttagtatattt

SEQ ID NO: 7989300 - DNA, 22 bp, Homo sapiens
aattgaaaatattgtagaccat

SEQ ID NO: 7989301 - DNA, 22 bp, Homo sapiens
aattgaaaatattgtagaccat

SEQ ID NO: 7989302 - DNA, 22 bp, Homo sapiens
aattgaaaatattgtagaccat

SEQ ID NO: 7989303 - DNA, 22 bp, Homo sapiens
aattcttgttgttagtatattt

SEQ ID NO: 7989304 - DNA, 22 bp, Homo sapiens
aattgaaaatattgtagaccat

SEQ ID NO: 7989305 - DNA, 22 bp, Homo sapiens
aattgaaagaagtgggattgcc

SEQ ID NO: 7989306 - DNA, 22 bp, Homo sapiens
aattgaaattctttgtggtcca

SEQ ID NO: 7989307 - DNA, 22 bp, Homo sapiens
aattgaaattctttgtggtcca

SEQ ID NO: 7989308 - DNA, 22 bp, Homo sapiens
aattgacaaatcatacttgtat

SEQ ID NO: 7989309 - DNA, 22 bp, Homo sapiens
aattgacaaatcatacttgtat

SEQ ID NO: 7989310 - DNA, 22 bp, Homo sapiens
aattgacaaatcatacttgtat

SEQ ID NO: 7989311 - DNA, 22 bp, Homo sapiens
aattgacaaatcatacttgtat

SEQ ID NO: 7989312 - DNA, 22 bp, Homo sapiens
aattctgtaactttactgaatt

SEQ ID NO: 7989313 - DNA, 22 bp, Homo sapiens
aattctgtaactttactgaatt

SEQ ID NO: 7989314 - DNA, 22 bp, Homo sapiens
aattctgtaactttactgaatt

SEQ ID NO: 7989315 - DNA, 22 bp, Homo sapiens
aattctgtaaagcttgtcatgc

SEQ ID NO: 7989316 - DNA, 22 bp, Homo sapiens
aattctgtaaagcttgtcatgc

SEQ ID NO: 7989317 - DNA, 22 bp, Homo sapiens
aattctgtaaagcttgtcatgc

SEQ ID NO: 7989318 - DNA, 20 bp, Homo sapiens
aattctgtcttttctgctgc

SEQ ID NO: 7989319 - DNA, 20 bp, Homo sapiens
aattctgtcttttctgctgc

SEQ ID NO: 7989320 - DNA, 22 bp, Homo sapiens
aattctgtaactttactgaatt

SEQ ID NO: 7989321 - DNA, 22 bp, Homo sapiens
aattctgtgcaggcagagctat

SEQ ID NO: 7989322 - DNA, 20 bp, Homo sapiens
aattctgtcttttctgctgc

SEQ ID NO: 7989323 - DNA, 22 bp, Homo sapiens
aattctgttactaatgtgatgt

SEQ ID NO: 7989324 - DNA, 19 bp, Homo sapiens
aattctgtttcagcagatc

SEQ ID NO: 7989325 - DNA, 22 bp, Homo sapiens
aattctgttactaatgtgatgt

SEQ ID NO: 7989326 - DNA, 22 bp, Homo sapiens
aattctgttactaatgtgatgt

SEQ ID NO: 7989327 - DNA, 22 bp, Homo sapiens
aattcttaatcccataaagtga

SEQ ID NO: 7989328 - DNA, 22 bp, Homo sapiens
aattcttcaagtgctttggaga

SEQ ID NO: 7989329 - DNA, 22 bp, Homo sapiens
aattcttaatcccataaagtga

SEQ ID NO: 7989330 - DNA, 22 bp, Homo sapiens
aattcttcaagtgctttggaga

SEQ ID NO: 7989331 - DNA, 22 bp, Homo sapiens
agaggctctgccgcctcaggta

SEQ ID NO: 7989332 - DNA, 22 bp, Homo sapiens
agaggctctgccgcctcaggta

SEQ ID NO: 7989333 - DNA, 22 bp, Homo sapiens
agaggctctgccgcctcaggta

SEQ ID NO: 7989334 - DNA, 22 bp, Homo sapiens
agaggctctggtgcagcatgca

SEQ ID NO: 7989335 - DNA, 22 bp, Homo sapiens
agaggctctaatcccctccaca

SEQ ID NO: 7989336 - DNA, 22 bp, Homo sapiens
agaggctctaatcccctccaca

SEQ ID NO: 7989337 - DNA, 22 bp, Homo sapiens
agaggctctaataccagcatgg

SEQ ID NO: 7989338 - DNA, 22 bp, Homo sapiens
agaggctctaataccagcatgg

SEQ ID NO: 7989339 - DNA, 22 bp, Homo sapiens
agaggctctttgagctgggaga

SEQ ID NO: 7989340 - DNA, 22 bp, Homo sapiens
agaggctcttgcccttcccaca

SEQ ID NO: 7989341 - DNA, 22 bp, Homo sapiens
agaggctctggtgcagcatgca

SEQ ID NO: 7989342 - DNA, 22 bp, Homo sapiens
agaggctctggtgcagcatgca

SEQ ID NO: 7989343 - DNA, 22 bp, Homo sapiens
agaggctctttgagctgggaga

SEQ ID NO: 7989344 - DNA, 22 bp, Homo sapiens
agaggctcttgcccttcccaca

SEQ ID NO: 7989345 - DNA, 22 bp, Homo sapiens
agaggctgaatgatgtcatcat

SEQ ID NO: 7989346 - DNA, 22 bp, Homo sapiens
agaggctgaatgatgtcatcat

SEQ ID NO: 7989347 - DNA, 22 bp, Homo sapiens
agaggctgaatgatgtcatcat

SEQ ID NO: 7989348 - DNA, 22 bp, Homo sapiens
agaggctgaatgatgtcatcat

SEQ ID NO: 7989349 - DNA, 22 bp, Homo sapiens
agaggctgagaaaccctcttct

SEQ ID NO: 7989350 - DNA, 22 bp, Homo sapiens
agaggctgaatgatgtcatcat

SEQ ID NO: 7989351 - DNA, 22 bp, Homo sapiens
agaggccctctctgctcagtct

SEQ ID NO: 7989352 - DNA, 18 bp, Homo sapiens
agaggctcgatactagaa

SEQ ID NO: 7989353 - DNA, 22 bp, Homo sapiens
agaggctctaaggttggatcaa

SEQ ID NO: 7989354 - DNA, 18 bp, Homo sapiens
agaggctcgatactagaa

SEQ ID NO: 7989355 - DNA, 21 bp, Homo sapiens
agaggccctcggactgggcgt

SEQ ID NO: 7989356 - DNA, 22 bp, Homo sapiens
agaggccctctctctcctgatg

SEQ ID NO: 7989357 - DNA, 22 bp, Homo sapiens
agaggccctctctctcctgatg

SEQ ID NO: 7989358 - DNA, 22 bp, Homo sapiens
agaggccctctctctcctgatg

SEQ ID NO: 7989359 - DNA, 22 bp, Homo sapiens
aattgcttgtttctttaactga

SEQ ID NO: 7989360 - DNA, 22 bp, Homo sapiens
aattgcttgtttctttaactga

SEQ ID NO: 7989361 - DNA, 22 bp, Homo sapiens
aattgcttgtcttcttccctac

SEQ ID NO: 7989362 - DNA, 17 bp, Homo sapiens
aattgcttgtactccca

SEQ ID NO: 7989363 - DNA, 22 bp, Homo sapiens
aattgcttgttttcggtcataa

SEQ ID NO: 7989364 - DNA, 22 bp, Homo sapiens
aattgctttacaagccgtttaa

SEQ ID NO: 7989365 - DNA, 22 bp, Homo sapiens
aattgctttagttaccatagtg

SEQ ID NO: 7989366 - DNA, 22 bp, Homo sapiens
aattgctttgaagaagggagcg

SEQ ID NO: 7989367 - DNA, 22 bp, Homo sapiens
aattgcttttatttagggccag

SEQ ID NO: 7989368 - DNA, 22 bp, Homo sapiens
aattgcttgatgactagtaatt

SEQ ID NO: 7989369 - DNA, 22 bp, Homo sapiens
aattgcttgatgactagtaatt

SEQ ID NO: 7989370 - DNA, 22 bp, Homo sapiens
aattgcttgatgactagtaatt

SEQ ID NO: 7989371 - DNA, 16 bp, Homo sapiens
aattgcttcttgctgc

SEQ ID NO: 7989372 - DNA, 22 bp, Homo sapiens
aattgcttcccaagggaggtct

SEQ ID NO: 7989373 - DNA, 22 bp, Homo sapiens
aattgcttcattaacatttagg

SEQ ID NO: 7989374 - DNA, 22 bp, Homo sapiens
aattgcttcattaacatttagg

SEQ ID NO: 7989375 - DNA, 22 bp, Homo sapiens
aattgcttatgccaggtgagag

SEQ ID NO: 7989376 - DNA, 22 bp, Homo sapiens
aattgcttactgtttttcacct

SEQ ID NO: 7989377 - DNA, 22 bp, Homo sapiens
aattgcttatcttgttgaatag

SEQ ID NO: 7989378 - DNA, 22 bp, Homo sapiens
aattgcttatcttgttgaatag

SEQ ID NO: 7989379 - DNA, 22 bp, Homo sapiens
aattgcttagagaatccaggta

SEQ ID NO: 7989380 - DNA, 22 bp, Homo sapiens
aattgcttagttgcaactatgc

SEQ ID NO: 7989381 - DNA, 22 bp, Homo sapiens
aattgcttagttgcaactatgc

SEQ ID NO: 7989382 - DNA, 22 bp, Homo sapiens
aagctaagggtgtttaagcagg

SEQ ID NO: 7989383 - DNA, 22 bp, Homo sapiens
aagctaagattacagatttggg

SEQ ID NO: 7989384 - DNA, 22 bp, Homo sapiens
aagctaagggtgtttaagcagg

SEQ ID NO: 7989385 - DNA, 21 bp, Homo sapiens
aagctacagaaaataatttga

SEQ ID NO: 7989386 - DNA, 22 bp, Homo sapiens
aagctacacatctgttgggtat

SEQ ID NO: 7989387 - DNA, 22 bp, Homo sapiens
aagcgccatggttcctgcgcag

SEQ ID NO: 7989388 - DNA, 22 bp, Homo sapiens
aagcgccatggttcctgcgcag

SEQ ID NO: 7989389 - DNA, 22 bp, Homo sapiens
aagcggcatgaggagtaagtag

SEQ ID NO: 7989390 - DNA, 22 bp, Homo sapiens
aagcgttggcctcccctgatga

SEQ ID NO: 7989391 - DNA, 22 bp, Homo sapiens
aagctatgagctaggcatctct

SEQ ID NO: 7989392 - DNA, 22 bp, Homo sapiens
aagctatcagctactatcagct

SEQ ID NO: 7989393 - DNA, 22 bp, Homo sapiens
aagctaggcctcagtttcctga

SEQ ID NO: 7989394 - DNA, 20 bp, Homo sapiens
aagctagcaaaagccacaaa

SEQ ID NO: 7989395 - DNA, 22 bp, Homo sapiens
aagctagattggcattcatttc

SEQ ID NO: 7989396 - DNA, 22 bp, Homo sapiens
aagctagattggcattcatttc

SEQ ID NO: 7989397 - DNA, 22 bp, Homo sapiens
aagctagataacttttatattt

SEQ ID NO: 7989398 - DNA, 22 bp, Homo sapiens
aagctacattaagcagatttac

SEQ ID NO: 7989399 - DNA, 22 bp, Homo sapiens
aagctacagtttacccatggtt

SEQ ID NO: 7989400 - DNA, 22 bp, Homo sapiens
aagctacattaagcagatttac

SEQ ID NO: 7989401 - DNA, 22 bp, Homo sapiens
aagctagataacttttatattt

SEQ ID NO: 7989402 - DNA, 22 bp, Homo sapiens
aagctagataacttttatattt

SEQ ID NO: 7989403 - DNA, 22 bp, Homo sapiens
aagctacttttatatgcagtag

SEQ ID NO: 7989404 - DNA, 22 bp, Homo sapiens
aagctagatgacgttatttttt

SEQ ID NO: 7989405 - DNA, 22 bp, Homo sapiens
aagctagatgacgttatttttt

SEQ ID NO: 7989406 - DNA, 22 bp, Homo sapiens
aagccaaggagaatggcctcag

SEQ ID NO: 7989407 - DNA, 22 bp, Homo sapiens
aagccaaaggctccagtgacct

SEQ ID NO: 7989408 - DNA, 22 bp, Homo sapiens
aagcatttttgaaatggtagga

SEQ ID NO: 7989409 - DNA, 22 bp, Homo sapiens
aagcatttttgaaatggtagga

SEQ ID NO: 7989410 - DNA, 22 bp, Homo sapiens
aagcatttttcacagcaacagc

SEQ ID NO: 7989411 - DNA, 22 bp, Homo sapiens
aagccctgggatgttcagcagt

SEQ ID NO: 7989412 - DNA, 22 bp, Homo sapiens
aagccaagtgctggccatgggc

SEQ ID NO: 7989413 - DNA, 22 bp, Homo sapiens
aagccaaggttttggtcacagc

SEQ ID NO: 7989414 - DNA, 22 bp, Homo sapiens
aagccaaggttttggtcacagc

SEQ ID NO: 7989415 - DNA, 22 bp, Homo sapiens
aagccaagtgctggccatgggc

SEQ ID NO: 7989416 - DNA, 22 bp, Homo sapiens
aagccttgattcactctgtgga

SEQ ID NO: 7989417 - DNA, 22 bp, Homo sapiens
aagccttccctttttgagctca

SEQ ID NO: 7989418 - DNA, 22 bp, Homo sapiens
aagccttcctgagtgcaaggcc

SEQ ID NO: 7989419 - DNA, 22 bp, Homo sapiens
aagccttccctttttgagctca

SEQ ID NO: 7989420 - DNA, 22 bp, Homo sapiens
aagccctggggttgcacaaggc

SEQ ID NO: 7989421 - DNA, 22 bp, Homo sapiens
aagcgcagacacagagagtgga

SEQ ID NO: 7989422 - DNA, 22 bp, Homo sapiens
aagcgcagacacagagagtgga

SEQ ID NO: 7989423 - DNA, 22 bp, Homo sapiens
aagcgccatggttcctgcgcag

SEQ ID NO: 7989424 - DNA, 22 bp, Homo sapiens
aagcatttttcacagcaacagc

SEQ ID NO: 7989425 - DNA, 22 bp, Homo sapiens
aagcatttttcacagcaacagc

SEQ ID NO: 7989426 - DNA, 22 bp, Homo sapiens
aagcatttttcacagcaacagc

SEQ ID NO: 7989427 - DNA, 22 bp, Homo sapiens
aagcattttgttttaagaatga

SEQ ID NO: 7989428 - DNA, 22 bp, Homo sapiens
aagcattttgttttaagaatga

SEQ ID NO: 7989429 - DNA, 22 bp, Homo sapiens
aagcattttgttttaagaatga

SEQ ID NO: 7989430 - DNA, 22 bp, Homo sapiens
aagcattttgccacttgaagtt

SEQ ID NO: 7989431 - DNA, 22 bp, Homo sapiens
aagcattttagataaagcatca

SEQ ID NO: 7989432 - DNA, 22 bp, Homo sapiens
aagcattttagataaagcatca

SEQ ID NO: 7989433 - DNA, 22 bp, Homo sapiens
aagcattttagataaagcatca

SEQ ID NO: 7989434 - DNA, 22 bp, Homo sapiens
aagcattttagtaatgaacttg

SEQ ID NO: 7989435 - DNA, 22 bp, Homo sapiens
aagcattttagataaagcatca

SEQ ID NO: 7989436 - DNA, 22 bp, Homo sapiens
acagccttattctttagtttac

SEQ ID NO: 7989437 - DNA, 22 bp, Homo sapiens
aagcattttagataaagcatca

SEQ ID NO: 7989438 - DNA, 19 bp, Homo sapiens
acagcctgttggtggggct

SEQ ID NO: 7989439 - DNA, 22 bp, Homo sapiens
acagcctgtgtaccagctggga

SEQ ID NO: 7989440 - DNA, 19 bp, Homo sapiens
acagcctgttggtggggct

SEQ ID NO: 7989441 - DNA, 22 bp, Homo sapiens
acagcctgtgtaccagctggga

SEQ ID NO: 7989442 - DNA, 22 bp, Homo sapiens
acagcctgtgtaccagctggga

SEQ ID NO: 7989443 - DNA, 22 bp, Homo sapiens
acagcctgtgtaccagctggga

SEQ ID NO: 7989444 - DNA, 22 bp, Homo sapiens
acagcctgtgtaccagctggga

SEQ ID NO: 7989445 - DNA, 22 bp, Homo sapiens
acagcctgtgtaccagctggga

SEQ ID NO: 7989446 - DNA, 22 bp, Homo sapiens
acagcctgtttgatctggtgct

SEQ ID NO: 7989447 - DNA, 22 bp, Homo sapiens
acagcctgtttgatctggtgct

SEQ ID NO: 7989448 - DNA, 22 bp, Homo sapiens
acagcctgtttgatctggtgct

SEQ ID NO: 7989449 - DNA, 19 bp, Homo sapiens
acagcctgttggtggggct

SEQ ID NO: 7989450 - DNA, 19 bp, Homo sapiens
acagcctgttggtggggct

SEQ ID NO: 7989451 - DNA, 22 bp, Homo sapiens
acagcctgtttgatctggtgct

SEQ ID NO: 7989452 - DNA, 22 bp, Homo sapiens
acagcctgtttgatctggtgct

SEQ ID NO: 7989453 - DNA, 22 bp, Homo sapiens
acagcctgtttgatctggtgct

SEQ ID NO: 7989454 - DNA, 21 bp, Homo sapiens
acagcctgtcatctcatggtc

SEQ ID NO: 7989455 - DNA, 21 bp, Homo sapiens
acagcctgtcatctcatggtc

SEQ ID NO: 7989456 - DNA, 21 bp, Homo sapiens
acagcctgtcatctcatggtc

SEQ ID NO: 7989457 - DNA, 21 bp, Homo sapiens
acagcctgtcatctcatggtc

SEQ ID NO: 7989458 - DNA, 22 bp, Homo sapiens
acagcctgtgtaccagctggga

SEQ ID NO: 7989459 - DNA, 21 bp, Homo sapiens
acagcctgtcatctcatggtc

SEQ ID NO: 7989460 - DNA, 21 bp, Homo sapiens
acagcctgtcatctcatggtc

SEQ ID NO: 7989461 - DNA, 21 bp, Homo sapiens
acagcctgtcatctcatggtc

SEQ ID NO: 7989462 - DNA, 21 bp, Homo sapiens
acagcctgtcatctcatggtc

SEQ ID NO: 7989463 - DNA, 21 bp, Homo sapiens
acagcctgtcatctcatggtc

SEQ ID NO: 7989464 - DNA, 22 bp, Homo sapiens
acagcctggactggctctctgc

SEQ ID NO: 7989465 - DNA, 22 bp, Homo sapiens
acagcctggcctgagttaaggc

SEQ ID NO: 7989466 - DNA, 22 bp, Homo sapiens
acagcctggcctgagttaaggc

SEQ ID NO: 7989467 - DNA, 21 bp, Homo sapiens
acagcctgtcatctcatggtc

SEQ ID NO: 7989468 - DNA, 21 bp, Homo sapiens
acagcctgtcatctcatggtc

SEQ ID NO: 7989469 - DNA, 21 bp, Homo sapiens
acagcctgtcatctcatggtc

SEQ ID NO: 7989470 - DNA, 22 bp, Homo sapiens
acagcctggcctgagttaaggc

SEQ ID NO: 7989471 - DNA, 22 bp, Homo sapiens
acagcctggcctgagttaaggc

SEQ ID NO: 7989472 - DNA, 22 bp, Homo sapiens
aagctatgttcctgcactgctc

SEQ ID NO: 7989473 - DNA, 22 bp, Homo sapiens
aagctattgaatttatagcata

SEQ ID NO: 7989474 - DNA, 22 bp, Homo sapiens
aagctatgttcctgcactgctc

SEQ ID NO: 7989475 - DNA, 22 bp, Homo sapiens
aagctattgaatttatagcata

SEQ ID NO: 7989476 - DNA, 22 bp, Homo sapiens
aagctattgaatttatagcata

SEQ ID NO: 7989477 - DNA, 22 bp, Homo sapiens
aagctcaaaccttggggctcag

SEQ ID NO: 7989478 - DNA, 22 bp, Homo sapiens
aagctcagcagccaggccctgt

SEQ ID NO: 7989479 - DNA, 22 bp, Homo sapiens
aagctcattaattagaagctaa

SEQ ID NO: 7989480 - DNA, 22 bp, Homo sapiens
aagctcatgggtgctgtacttt

SEQ ID NO: 7989481 - DNA, 22 bp, Homo sapiens
aagctcaggctggacctggctt

SEQ ID NO: 7989482 - DNA, 22 bp, Homo sapiens
aagctcagtgatgcctccaggg

SEQ ID NO: 7989483 - DNA, 22 bp, Homo sapiens
aagctcagtgatgcctccaggg

SEQ ID NO: 7989484 - DNA, 18 bp, Homo sapiens
aagctcattctcttccta

SEQ ID NO: 7989485 - DNA, 22 bp, Homo sapiens
aagctccccgaaacccacctct

SEQ ID NO: 7989486 - DNA, 22 bp, Homo sapiens
aagctctgaggtgagcaatcgg

SEQ ID NO: 7989487 - DNA, 22 bp, Homo sapiens
aagctctctgtcccctggactg

SEQ ID NO: 7989488 - DNA, 22 bp, Homo sapiens
aagctctgaggtgagcaatcgg

SEQ ID NO: 7989489 - DNA, 22 bp, Homo sapiens
aagctccccgaaacccacctct

SEQ ID NO: 7989490 - DNA, 22 bp, Homo sapiens
aagctccccgaaacccacctct

SEQ ID NO: 7989491 - DNA, 18 bp, Homo sapiens
aagctctggctaggaaaa

SEQ ID NO: 7989492 - DNA, 22 bp, Homo sapiens
aagctctgtagctcatgtgata

SEQ ID NO: 7989493 - DNA, 22 bp, Homo sapiens
aagctctgtctcttgggagtta

SEQ ID NO: 7989494 - DNA, 22 bp, Homo sapiens
aagctctgctcagcagactagg

SEQ ID NO: 7989495 - DNA, 22 bp, Homo sapiens
aagctctgctcagcagactagg

SEQ ID NO: 7989496 - DNA, 22 bp, Homo sapiens
aagctctgctcatgatgacgtt

SEQ ID NO: 7989497 - DNA, 20 bp, Homo sapiens
aagctctgcttcatgtggtc

SEQ ID NO: 7989498 - DNA, 20 bp, Homo sapiens
aagctctgcttcatgtggtc

SEQ ID NO: 7989499 - DNA, 17 bp, Homo sapiens
acagggcagaaacagct

SEQ ID NO: 7989500 - DNA, 17 bp, Homo sapiens
acagggcagaaacagct

SEQ ID NO: 7989501 - DNA, 17 bp, Homo sapiens
acagggcagaaacagct

SEQ ID NO: 7989502 - DNA, 17 bp, Homo sapiens
acagggcagaaacagct

SEQ ID NO: 7989503 - DNA, 22 bp, Homo sapiens
acagggaacaggaatatacaaa

SEQ ID NO: 7989504 - DNA, 22 bp, Homo sapiens
acagggaacaggaatatacaaa

SEQ ID NO: 7989505 - DNA, 22 bp, Homo sapiens
acagggaacaggaatatacaaa

SEQ ID NO: 7989506 - DNA, 22 bp, Homo sapiens
acagggaacaggaatatacaaa

SEQ ID NO: 7989507 - DNA, 22 bp, Homo sapiens
acagggaacaggaatatacaaa

SEQ ID NO: 7989508 - DNA, 22 bp, Homo sapiens
aagctctgtctcttgggagtta

SEQ ID NO: 7989509 - DNA, 22 bp, Homo sapiens
aagctctgtctcttgggagtta

SEQ ID NO: 7989510 - DNA, 18 bp, Homo sapiens
aagctcttaaatggttca

SEQ ID NO: 7989511 - DNA, 22 bp, Homo sapiens
acagggaaagggacagcagcag

SEQ ID NO: 7989512 - DNA, 22 bp, Homo sapiens
acagggaaagggacagcagcag

SEQ ID NO: 7989513 - DNA, 22 bp, Homo sapiens
acagggaaagggacagcagcag

SEQ ID NO: 7989514 - DNA, 22 bp, Homo sapiens
acagggaaagggacagcagcag

SEQ ID NO: 7989515 - DNA, 22 bp, Homo sapiens
acagggcagaaatgttgcatct

SEQ ID NO: 7989516 - DNA, 22 bp, Homo sapiens
acagggcagaaatgttgcatct

SEQ ID NO: 7989517 - DNA, 22 bp, Homo sapiens
acagggcagagaggcaggcttg

SEQ ID NO: 7989518 - DNA, 22 bp, Homo sapiens
acagggcagagaggcaggcttg

SEQ ID NO: 7989519 - DNA, 22 bp, Homo sapiens
acagggcagaaatgttgcatct

SEQ ID NO: 7989520 - DNA, 22 bp, Homo sapiens
acagggcagagaggcaggcttg

SEQ ID NO: 7989521 - DNA, 22 bp, Homo sapiens
acagggcagagaggcaggcttg

SEQ ID NO: 7989522 - DNA, 22 bp, Homo sapiens
acagggcagagaggcaggcttg

SEQ ID NO: 7989523 - DNA, 19 bp, Homo sapiens
acagggcagcaataggata

SEQ ID NO: 7989524 - DNA, 22 bp, Homo sapiens
acagggcagagggcagttggta

SEQ ID NO: 7989525 - DNA, 22 bp, Homo sapiens
acagggcagagggcagttggta

SEQ ID NO: 7989526 - DNA, 22 bp, Homo sapiens
acagggcagagaggcaggcttg

SEQ ID NO: 7989527 - DNA, 22 bp, Homo sapiens
acagggcagagggcagttggta

SEQ ID NO: 7989528 - DNA, 22 bp, Homo sapiens
acagggcagagggcagttggta

SEQ ID NO: 7989529 - DNA, 22 bp, Homo sapiens
acagggcagagtgaaatgctat

SEQ ID NO: 7989530 - DNA, 22 bp, Homo sapiens
aagctgcctagagttgaatgtc

SEQ ID NO: 7989531 - DNA, 22 bp, Homo sapiens
aagctgcctagagttgaatgtc

SEQ ID NO: 7989532 - DNA, 22 bp, Homo sapiens
aagctgccctgtgttagagttc

SEQ ID NO: 7989533 - DNA, 22 bp, Homo sapiens
aagctgccctgtgttagagttc

SEQ ID NO: 7989534 - DNA, 22 bp, Homo sapiens
aagctgcctgccacgctagata

SEQ ID NO: 7989535 - DNA, 19 bp, Homo sapiens
acagggcagcaataggata

SEQ ID NO: 7989536 - DNA, 19 bp, Homo sapiens
acagggcagcaataggata

SEQ ID NO: 7989537 - DNA, 18 bp, Homo sapiens
aagctgccctcaggcagg

SEQ ID NO: 7989538 - DNA, 22 bp, Homo sapiens
aagctgccctcattcccagtgc

SEQ ID NO: 7989539 - DNA, 22 bp, Homo sapiens
aagctgccttccatgtgaggaa

SEQ ID NO: 7989540 - DNA, 22 bp, Homo sapiens
aagctgcctgggaggaagggct

SEQ ID NO: 7989541 - DNA, 22 bp, Homo sapiens
aagctgcctgggaggaagggct

SEQ ID NO: 7989542 - DNA, 22 bp, Homo sapiens
aagctgccttccatgtgaggaa

SEQ ID NO: 7989543 - DNA, 22 bp, Homo sapiens
aagctgccttgctgaggagaaa

SEQ ID NO: 7989544 - DNA, 23 bp, Homo sapiens
aagctgccttcgcagttggtctg

SEQ ID NO: 7989545 - DNA, 22 bp, Homo sapiens
aagctgccttgctgaggagaaa

SEQ ID NO: 7989546 - DNA, 22 bp, Homo sapiens
aagctgcttggggctcctgcag

SEQ ID NO: 7989547 - DNA, 22 bp, Homo sapiens
acatatgagtactatacagtgc

SEQ ID NO: 7989548 - DNA, 22 bp, Homo sapiens
acatatgagtactatacagtgc

SEQ ID NO: 7989549 - DNA, 22 bp, Homo sapiens
acatatgagtactatacagtgc

SEQ ID NO: 7989550 - DNA, 22 bp, Homo sapiens
acatatgatattgaggatctca

SEQ ID NO: 7989551 - DNA, 22 bp, Homo sapiens
acatatgatattgaggatctca

SEQ ID NO: 7989552 - DNA, 22 bp, Homo sapiens
acatatgtatatgtacacagtc

SEQ ID NO: 7989553 - DNA, 22 bp, Homo sapiens
acatatgtatatgtacacagtc

SEQ ID NO: 7989554 - DNA, 22 bp, Homo sapiens
acatatgtatatgtacacagtc

SEQ ID NO: 7989555 - DNA, 22 bp, Homo sapiens
acatatgcgatcataggatgca

SEQ ID NO: 7989556 - DNA, 22 bp, Homo sapiens
acatatgcgatcataggatgca

SEQ ID NO: 7989557 - DNA, 22 bp, Homo sapiens
acatatgcgatcataggatgca

SEQ ID NO: 7989558 - DNA, 22 bp, Homo sapiens
acatatgtgcttatatccatga

SEQ ID NO: 7989559 - DNA, 19 bp, Homo sapiens
acatatgtggatatacatg

SEQ ID NO: 7989560 - DNA, 19 bp, Homo sapiens
acatatgtggatatacatg

SEQ ID NO: 7989561 - DNA, 22 bp, Homo sapiens
acatatgtctatttcatgtaaa

SEQ ID NO: 7989562 - DNA, 22 bp, Homo sapiens
acatatgtctatttcatgtaaa

SEQ ID NO: 7989563 - DNA, 22 bp, Homo sapiens
acatatgtgcttatatccatga

SEQ ID NO: 7989564 - DNA, 22 bp, Homo sapiens
acatatgtctatttcatgtaaa

SEQ ID NO: 7989565 - DNA, 22 bp, Homo sapiens
acatatgtgtctgcacatgccc

SEQ ID NO: 7989566 - DNA, 19 bp, Homo sapiens
acatatgtggatatacatg

SEQ ID NO: 7989567 - DNA, 19 bp, Homo sapiens
acatatgtggatatacatg

SEQ ID NO: 7989568 - DNA, 19 bp, Homo sapiens
acatatgtggatatacatg

SEQ ID NO: 7989569 - DNA, 19 bp, Homo sapiens
acatatgtggatatacatg

SEQ ID NO: 7989570 - DNA, 22 bp, Homo sapiens
acatatgtgttgtacatgcatg

SEQ ID NO: 7989571 - DNA, 22 bp, Homo sapiens
acatatgtgttgtacatgcatg

SEQ ID NO: 7989572 - DNA, 20 bp, Homo sapiens
acatatgtgtgcatatcttt

SEQ ID NO: 7989573 - DNA, 20 bp, Homo sapiens
acatatgtgtgcatatcttt

SEQ ID NO: 7989574 - DNA, 22 bp, Homo sapiens
aaggcagaggaaggtctagttt

SEQ ID NO: 7989575 - DNA, 22 bp, Homo sapiens
aaggcagaggaaggtctagttt

SEQ ID NO: 7989576 - DNA, 22 bp, Homo sapiens
aaggcagagggctggatcagag

SEQ ID NO: 7989577 - DNA, 22 bp, Homo sapiens
aaggcagagggctggatcagag

SEQ ID NO: 7989578 - DNA, 22 bp, Homo sapiens
aaggcagagggctggatcagag

SEQ ID NO: 7989579 - DNA, 22 bp, Homo sapiens
aaggcagagggctggatcagag

SEQ ID NO: 7989580 - DNA, 22 bp, Homo sapiens
aaggcagagggctggatcagag

SEQ ID NO: 7989581 - DNA, 22 bp, Homo sapiens
aaggcagagtctatcttggaag

SEQ ID NO: 7989582 - DNA, 22 bp, Homo sapiens
aaggcagagtctatcttggaag

SEQ ID NO: 7989583 - DNA, 22 bp, Homo sapiens
aaggcagagtctatcttggaag

SEQ ID NO: 7989584 - DNA, 22 bp, Homo sapiens
aaggcagagtctatcttggaag

SEQ ID NO: 7989585 - DNA, 22 bp, Homo sapiens
aaggcagagggctggatcagag

SEQ ID NO: 7989586 - DNA, 22 bp, Homo sapiens
aaggcagagggctggatcagag

SEQ ID NO: 7989587 - DNA, 22 bp, Homo sapiens
aaggcagagattagcagaatga

SEQ ID NO: 7989588 - DNA, 22 bp, Homo sapiens
aaggcagagattagcagaatga

SEQ ID NO: 7989589 - DNA, 22 bp, Homo sapiens
aaggcagagattagcagaatga

SEQ ID NO: 7989590 - DNA, 22 bp, Homo sapiens
aaggcagaggaaggtctagttt

SEQ ID NO: 7989591 - DNA, 22 bp, Homo sapiens
aaggcagagattagcagaatga

SEQ ID NO: 7989592 - DNA, 22 bp, Homo sapiens
aaggcagaggaaggtctagttt

SEQ ID NO: 7989593 - DNA, 22 bp, Homo sapiens
acatatgttgtaaacattccaa

SEQ ID NO: 7989594 - DNA, 22 bp, Homo sapiens
acatatgtgttgtacatgcatg

SEQ ID NO: 7989595 - DNA, 22 bp, Homo sapiens
aaggcagagattagcagaatga

SEQ ID NO: 7989596 - DNA, 22 bp, Homo sapiens
aaggcagagattagcagaatga

SEQ ID NO: 7989597 - DNA, 22 bp, Homo sapiens
acatatgtgttgtacatgcatg

SEQ ID NO: 7989598 - DNA, 22 bp, Homo sapiens
acatatgtgttgtacatgcatg

SEQ ID NO: 7989599 - DNA, 22 bp, Homo sapiens
acatatgtgttgtacatgcatg

SEQ ID NO: 7989600 - DNA, 22 bp, Homo sapiens
acatatgaggtgttattctatg

SEQ ID NO: 7989601 - DNA, 22 bp, Homo sapiens
acatatctgttagacacagcag

SEQ ID NO: 7989602 - DNA, 22 bp, Homo sapiens
acatagaacttcccagtgagca

SEQ ID NO: 7989603 - DNA, 22 bp, Homo sapiens
acatagaacctggcacatagta

SEQ ID NO: 7989604 - DNA, 22 bp, Homo sapiens
acatagaacctggcacatagta

SEQ ID NO: 7989605 - DNA, 22 bp, Homo sapiens
aaggaggcagaactcacatgga

SEQ ID NO: 7989606 - DNA, 22 bp, Homo sapiens
aaggaggcactcgctctcaggg

SEQ ID NO: 7989607 - DNA, 22 bp, Homo sapiens
aaggaggagtggggtcctggaa

SEQ ID NO: 7989608 - DNA, 22 bp, Homo sapiens
aaggaggagtggggtcctggaa

SEQ ID NO: 7989609 - DNA, 22 bp, Homo sapiens
aaggaggagcggaggcttgttg

SEQ ID NO: 7989610 - DNA, 22 bp, Homo sapiens
aaggaggagattagtgtttagg

SEQ ID NO: 7989611 - DNA, 22 bp, Homo sapiens
aaggaggacacccaggactggg

SEQ ID NO: 7989612 - DNA, 22 bp, Homo sapiens
aaggaggacacccaggactggg

SEQ ID NO: 7989613 - DNA, 22 bp, Homo sapiens
aaggaggacacccaggactggg

SEQ ID NO: 7989614 - DNA, 22 bp, Homo sapiens
aaggaggaatttcagggtgaat

SEQ ID NO: 7989615 - DNA, 22 bp, Homo sapiens
aaggaggaatttcagggtgaat

SEQ ID NO: 7989616 - DNA, 22 bp, Homo sapiens
aaggaggacacccaggactggg

SEQ ID NO: 7989617 - DNA, 22 bp, Homo sapiens
aaggaggaattctgagttcatg

SEQ ID NO: 7989618 - DNA, 22 bp, Homo sapiens
aaggaggaattctgagttcatg

SEQ ID NO: 7989619 - DNA, 22 bp, Homo sapiens
aaggaggaatttcagggtgaat

SEQ ID NO: 7989620 - DNA, 22 bp, Homo sapiens
aaggaggaatttcagggtgaat

SEQ ID NO: 7989621 - DNA, 22 bp, Homo sapiens
aaggaggaatttcagggtgaat

SEQ ID NO: 7989622 - DNA, 22 bp, Homo sapiens
aaggaggaatttcagggtgaat

SEQ ID NO: 7989623 - DNA, 22 bp, Homo sapiens
aaggaggaatgtagccagctcc

SEQ ID NO: 7989624 - DNA, 22 bp, Homo sapiens
aaggaggaatgtagccagctcc

SEQ ID NO: 7989625 - DNA, 22 bp, Homo sapiens
aaggaggaatgtagccagctcc

SEQ ID NO: 7989626 - DNA, 22 bp, Homo sapiens
acagtgtttatgtacagattgt

SEQ ID NO: 7989627 - DNA, 22 bp, Homo sapiens
acagtgtttatgtacagattgt

SEQ ID NO: 7989628 - DNA, 22 bp, Homo sapiens
acagtgtttatgtacagattgt

SEQ ID NO: 7989629 - DNA, 22 bp, Homo sapiens
acagtgtttatgtacagattgt

SEQ ID NO: 7989630 - DNA, 22 bp, Homo sapiens
aaggagagtacaggagttggta

SEQ ID NO: 7989631 - DNA, 22 bp, Homo sapiens
aaggagagtacaggagttggta

SEQ ID NO: 7989632 - DNA, 22 bp, Homo sapiens
aaggagagtacaggagttggta

SEQ ID NO: 7989633 - DNA, 22 bp, Homo sapiens
aaggagcacacaatctagaacc

SEQ ID NO: 7989634 - DNA, 22 bp, Homo sapiens
aaggagattgttaaagctatat

SEQ ID NO: 7989635 - DNA, 22 bp, Homo sapiens
aaggagattgttaaagctatat

SEQ ID NO: 7989636 - DNA, 22 bp, Homo sapiens
aaggagagtacaggagttggta

SEQ ID NO: 7989637 - DNA, 22 bp, Homo sapiens
aaggagagtacaggagttggta

SEQ ID NO: 7989638 - DNA, 22 bp, Homo sapiens
aaggagagtacaggagttggta

SEQ ID NO: 7989639 - DNA, 22 bp, Homo sapiens
aaggagctgggagggacacatg

SEQ ID NO: 7989640 - DNA, 22 bp, Homo sapiens
aaggagctgggagggacacatg

SEQ ID NO: 7989641 - DNA, 22 bp, Homo sapiens
aaggagctgggagggacacatg

SEQ ID NO: 7989642 - DNA, 17 bp, Homo sapiens
aaggagctgagagatgg

SEQ ID NO: 7989643 - DNA, 22 bp, Homo sapiens
aaggagctgggagggacacatg

SEQ ID NO: 7989644 - DNA, 22 bp, Homo sapiens
aaggagcttgttcgccttcctc

SEQ ID NO: 7989645 - DNA, 22 bp, Homo sapiens
aaggagctttcattacagcctt

SEQ ID NO: 7989646 - DNA, 22 bp, Homo sapiens
aaggagctttcattacagcctt

SEQ ID NO: 7989647 - DNA, 22 bp, Homo sapiens
aaggaggaaaatattgttgctg

SEQ ID NO: 7989648 - DNA, 22 bp, Homo sapiens
aaggagctcccggcagaccagg

SEQ ID NO: 7989649 - DNA, 22 bp, Homo sapiens
aaggagctcccggcagaccagg

SEQ ID NO: 7989650 - DNA, 22 bp, Homo sapiens
aaggagctcttaaaatcagaga

SEQ ID NO: 7989651 - DNA, 22 bp, Homo sapiens
aaggagctatgcataactgatc

SEQ ID NO: 7989652 - DNA, 22 bp, Homo sapiens
aaggagcgcttagggggcagaa

SEQ ID NO: 7989653 - DNA, 22 bp, Homo sapiens
aaggagacatttgcagagcacc

SEQ ID NO: 7989654 - DNA, 22 bp, Homo sapiens
aaggagagagctttgctggaac

SEQ ID NO: 7989655 - DNA, 22 bp, Homo sapiens
aaggagacatttgcagagcacc

SEQ ID NO: 7989656 - DNA, 22 bp, Homo sapiens
aaggagaatttggcttgtgatg

SEQ ID NO: 7989657 - DNA, 22 bp, Homo sapiens
aaggacaggctaacctgacatt

SEQ ID NO: 7989658 - DNA, 20 bp, Homo sapiens
aaggagaatgacacggctgc

SEQ ID NO: 7989659 - DNA, 22 bp, Homo sapiens
aaggacaggcacagtggtggag

SEQ ID NO: 7989660 - DNA, 22 bp, Homo sapiens
aaggacaggctaacctgacatt

SEQ ID NO: 7989661 - DNA, 22 bp, Homo sapiens
aaggacaggctaacctgacatt

SEQ ID NO: 7989662 - DNA, 22 bp, Homo sapiens
aaggacaggctaacctgacatt

SEQ ID NO: 7989663 - DNA, 22 bp, Homo sapiens
aaggacaggctaacctgacatt

SEQ ID NO: 7989664 - DNA, 22 bp, Homo sapiens
aagctggagagttaggtgaata

SEQ ID NO: 7989665 - DNA, 22 bp, Homo sapiens
aagctggactctgccatttact

SEQ ID NO: 7989666 - DNA, 22 bp, Homo sapiens
aagctggacattgtagggggga

SEQ ID NO: 7989667 - DNA, 22 bp, Homo sapiens
aagctggacactgacccactgt

SEQ ID NO: 7989668 - DNA, 22 bp, Homo sapiens
aagctggacattgtagggggga

SEQ ID NO: 7989669 - DNA, 20 bp, Homo sapiens
aagctggaagaccagcattg

SEQ ID NO: 7989670 - DNA, 20 bp, Homo sapiens
aagctggaagaccagcattg

SEQ ID NO: 7989671 - DNA, 22 bp, Homo sapiens
aagctggaacatcttgaggaag

SEQ ID NO: 7989672 - DNA, 22 bp, Homo sapiens
aagctggaacatcttgaggaag

SEQ ID NO: 7989673 - DNA, 22 bp, Homo sapiens
acagtcttgcacttctatcagc

SEQ ID NO: 7989674 - DNA, 22 bp, Homo sapiens
acagtcttgctgtatggtcagg

SEQ ID NO: 7989675 - DNA, 22 bp, Homo sapiens
acagtcttgcacttctatcagc

SEQ ID NO: 7989676 - DNA, 22 bp, Homo sapiens
acagtctttaatttctttgtgg

SEQ ID NO: 7989677 - DNA, 22 bp, Homo sapiens
acagtctttaatttctttgtgg

SEQ ID NO: 7989678 - DNA, 22 bp, Homo sapiens
acagtcttgctgtatggtcagg

SEQ ID NO: 7989679 - DNA, 22 bp, Homo sapiens
acagtcttgagcatcagccaga

SEQ ID NO: 7989680 - DNA, 22 bp, Homo sapiens
acagtcttgagcatcagccaga

SEQ ID NO: 7989681 - DNA, 22 bp, Homo sapiens
acagtcttcccttattccactc

SEQ ID NO: 7989682 - DNA, 22 bp, Homo sapiens
acagtcttcccttattccactc

SEQ ID NO: 7989683 - DNA, 22 bp, Homo sapiens
acagtcttcatgctagaatggc

SEQ ID NO: 7989684 - DNA, 22 bp, Homo sapiens
acagtcttcatgctagaatggc

SEQ ID NO: 7989685 - DNA, 22 bp, Homo sapiens
acagtcttatgcatacactatt

SEQ ID NO: 7989686 - DNA, 22 bp, Homo sapiens
acagtcttatgcatacactatt

SEQ ID NO: 7989687 - DNA, 22 bp, Homo sapiens
acagtcttatgcatacactatt

SEQ ID NO: 7989688 - DNA, 19 bp, Homo sapiens
acagtcttacaaatgtcca

SEQ ID NO: 7989689 - DNA, 19 bp, Homo sapiens
acagtcttacaaatgtcca

SEQ ID NO: 7989690 - DNA, 22 bp, Homo sapiens
acagtcttaatggataggagct

SEQ ID NO: 7989691 - DNA, 22 bp, Homo sapiens
aaggaggaataaagaggtggtg

SEQ ID NO: 7989692 - DNA, 22 bp, Homo sapiens
aaggaggaataaagaggtggtg

SEQ ID NO: 7989693 - DNA, 22 bp, Homo sapiens
aaggaggaataaagaggtggtg

SEQ ID NO: 7989694 - DNA, 22 bp, Homo sapiens
acagtctgtcccccaggtgcta

SEQ ID NO: 7989695 - DNA, 16 bp, Homo sapiens
acagtgtctcaagcac

SEQ ID NO: 7989696 - DNA, 22 bp, Homo sapiens
acagtgtctcactgctgaaatc

SEQ ID NO: 7989697 - DNA, 17 bp, Homo sapiens
acagtgtctatgaaatg

SEQ ID NO: 7989698 - DNA, 22 bp, Homo sapiens
acagtgttcttgatattacagt

SEQ ID NO: 7989699 - DNA, 22 bp, Homo sapiens
acagtctttcagtaataatact

SEQ ID NO: 7989700 - DNA, 22 bp, Homo sapiens
acagtctttaatttctttgtgg

SEQ ID NO: 7989701 - DNA, 22 bp, Homo sapiens
acagtctttagagtattgtcct

SEQ ID NO: 7989702 - DNA, 22 bp, Homo sapiens
acagtctttagagtattgtcct

SEQ ID NO: 7989703 - DNA, 22 bp, Homo sapiens
acagtgtttaaaataatatgct

SEQ ID NO: 7989704 - DNA, 22 bp, Homo sapiens
acagtgttgaggtgcttgtttc

SEQ ID NO: 7989705 - DNA, 22 bp, Homo sapiens
acagtgttgtggctcttaatag

SEQ ID NO: 7989706 - DNA, 22 bp, Homo sapiens
acagtgttgtggctcttaatag

SEQ ID NO: 7989707 - DNA, 22 bp, Homo sapiens
acagtgttgtatttagtttgat

SEQ ID NO: 7989708 - DNA, 22 bp, Homo sapiens
acatttaaatatgccttatatt

SEQ ID NO: 7989709 - DNA, 19 bp, Homo sapiens
acatttaaattcagatctc

SEQ ID NO: 7989710 - DNA, 19 bp, Homo sapiens
acatttaaattcagatctc

SEQ ID NO: 7989711 - DNA, 19 bp, Homo sapiens
acatttaaattcagatctc

SEQ ID NO: 7989712 - DNA, 19 bp, Homo sapiens
acatttaaattcagatctc

SEQ ID NO: 7989713 - DNA, 19 bp, Homo sapiens
aaggctggagaaggcctct

SEQ ID NO: 7989714 - DNA, 19 bp, Homo sapiens
aaggctggagaaggcctct

SEQ ID NO: 7989715 - DNA, 19 bp, Homo sapiens
aaggctggagaaggcctct

SEQ ID NO: 7989716 - DNA, 22 bp, Homo sapiens
aaggctggacctggatgaatct

SEQ ID NO: 7989717 - DNA, 19 bp, Homo sapiens
aaggctggagaaggcctct

SEQ ID NO: 7989718 - DNA, 19 bp, Homo sapiens
aaggctggagaaggcctct

SEQ ID NO: 7989719 - DNA, 19 bp, Homo sapiens
aaggctggagaaggcctct

SEQ ID NO: 7989720 - DNA, 21 bp, Homo sapiens
aaggctggagatgcaggtctg

SEQ ID NO: 7989721 - DNA, 19 bp, Homo sapiens
aaggctggagaaggcctct

SEQ ID NO: 7989722 - DNA, 21 bp, Homo sapiens
aaggctggagatgcaggtctg

SEQ ID NO: 7989723 - DNA, 21 bp, Homo sapiens
aaggctggagatgcaggtctg

SEQ ID NO: 7989724 - DNA, 22 bp, Homo sapiens
aaggctggagatggttggaatg

SEQ ID NO: 7989725 - DNA, 22 bp, Homo sapiens
aaggctggagatggttggaatg

SEQ ID NO: 7989726 - DNA, 22 bp, Homo sapiens
acatttaaatacctatgtttct

SEQ ID NO: 7989727 - DNA, 22 bp, Homo sapiens
acatttaaatacctatgtttct

SEQ ID NO: 7989728 - DNA, 22 bp, Homo sapiens
acatttaaatatgccttatatt

SEQ ID NO: 7989729 - DNA, 22 bp, Homo sapiens
acatttaaatatgccttatatt

SEQ ID NO: 7989730 - DNA, 22 bp, Homo sapiens
acatttaaatacctatgtttct

SEQ ID NO: 7989731 - DNA, 22 bp, Homo sapiens
acatttaaatacctatgtttct

SEQ ID NO: 7989732 - DNA, 22 bp, Homo sapiens
acatttaaatacctatgtttct

SEQ ID NO: 7989733 - DNA, 22 bp, Homo sapiens
acatttaaatacctatgtttct

SEQ ID NO: 7989734 - DNA, 22 bp, Homo sapiens
acattgttgtgcaattatagtt

SEQ ID NO: 7989735 - DNA, 22 bp, Homo sapiens
acattgttgtgcaattatagtt

SEQ ID NO: 7989736 - DNA, 22 bp, Homo sapiens
acattgttgagcctcttgttca

SEQ ID NO: 7989737 - DNA, 22 bp, Homo sapiens
acattgttgagcctcttgttca

SEQ ID NO: 7989738 - DNA, 22 bp, Homo sapiens
acattgttgagcctcttgttca

SEQ ID NO: 7989739 - DNA, 22 bp, Homo sapiens
acattgttctacttctagttag

SEQ ID NO: 7989740 - DNA, 22 bp, Homo sapiens
acattgttcctgagaacttggg

SEQ ID NO: 7989741 - DNA, 22 bp, Homo sapiens
acattgttctacttctagttag

SEQ ID NO: 7989742 - DNA, 22 bp, Homo sapiens
acattgttgtttgcagcacagg

SEQ ID NO: 7989743 - DNA, 22 bp, Homo sapiens
acattgttgtgcaattatagtt

SEQ ID NO: 7989744 - DNA, 22 bp, Homo sapiens
acattgtttctgaccatgatga

SEQ ID NO: 7989745 - DNA, 22 bp, Homo sapiens
acattgtttgagaatacagatg

SEQ ID NO: 7989746 - DNA, 22 bp, Homo sapiens
acattgtttgagaatacagatg

SEQ ID NO: 7989747 - DNA, 22 bp, Homo sapiens
acattgtttgagaatacagatg

SEQ ID NO: 7989748 - DNA, 22 bp, Homo sapiens
acattgtttgagaatacagatg

SEQ ID NO: 7989749 - DNA, 22 bp, Homo sapiens
acatttcttccctttagcagaa

SEQ ID NO: 7989750 - DNA, 22 bp, Homo sapiens
acatttcttccctttagcagaa

SEQ ID NO: 7989751 - DNA, 22 bp, Homo sapiens
acatttcttccacatgctgctg

SEQ ID NO: 7989752 - DNA, 22 bp, Homo sapiens
acatttcttagcctagttccag

SEQ ID NO: 7989753 - DNA, 22 bp, Homo sapiens
acatttcttcctaattatccct

SEQ ID NO: 7989754 - DNA, 22 bp, Homo sapiens
acatttgtgcaacgtatccaca

SEQ ID NO: 7989755 - DNA, 22 bp, Homo sapiens
acatttcttcctaattatccct

SEQ ID NO: 7989756 - DNA, 22 bp, Homo sapiens
acatttcttcctaattatccct

SEQ ID NO: 7989757 - DNA, 22 bp, Homo sapiens
acatttctggagtttctcaaca

SEQ ID NO: 7989758 - DNA, 22 bp, Homo sapiens
acatttctggagtttctcaaca

SEQ ID NO: 7989759 - DNA, 22 bp, Homo sapiens
acatttctggagtttctcaaca

SEQ ID NO: 7989760 - DNA, 22 bp, Homo sapiens
acatttctggagtttctcaaca

SEQ ID NO: 7989761 - DNA, 22 bp, Homo sapiens
acatttctggagtttctcaaca

SEQ ID NO: 7989762 - DNA, 22 bp, Homo sapiens
acatttctgctagaataggtga

SEQ ID NO: 7989763 - DNA, 22 bp, Homo sapiens
acatttctgctagaataggtga

SEQ ID NO: 7989764 - DNA, 22 bp, Homo sapiens
acatttctgctagaataggtga

SEQ ID NO: 7989765 - DNA, 22 bp, Homo sapiens
acatttctggagtttctcaaca

SEQ ID NO: 7989766 - DNA, 22 bp, Homo sapiens
acatttctggagtttctcaaca

SEQ ID NO: 7989767 - DNA, 22 bp, Homo sapiens
acatttcttagcctagttccag

SEQ ID NO: 7989768 - DNA, 22 bp, Homo sapiens
acatttcatttgcagtatggat

SEQ ID NO: 7989769 - DNA, 22 bp, Homo sapiens
aaggctgggaaacatgcaggcc

SEQ ID NO: 7989770 - DNA, 22 bp, Homo sapiens
acatttcatgttttccagagca

SEQ ID NO: 7989771 - DNA, 22 bp, Homo sapiens
aaggctggcaatatatttgtta

SEQ ID NO: 7989772 - DNA, 22 bp, Homo sapiens
aaggctggagatggttggaatg

SEQ ID NO: 7989773 - DNA, 22 bp, Homo sapiens
aaggctgggaaacatgcaggcc

SEQ ID NO: 7989774 - DNA, 22 bp, Homo sapiens
aaggctgggaaacatgcaggcc

SEQ ID NO: 7989775 - DNA, 22 bp, Homo sapiens
aaggctgggaaacatgcaggcc

SEQ ID NO: 7989776 - DNA, 22 bp, Homo sapiens
aaggctggcaatatatttgtta

SEQ ID NO: 7989777 - DNA, 22 bp, Homo sapiens
acatttctgcatctcagagcta

SEQ ID NO: 7989778 - DNA, 22 bp, Homo sapiens
acatttctgcatctcagagcta

SEQ ID NO: 7989779 - DNA, 22 bp, Homo sapiens
acatttctgcatctcagagcta

SEQ ID NO: 7989780 - DNA, 22 bp, Homo sapiens
acatttctgcatctcagagcta

SEQ ID NO: 7989781 - DNA, 22 bp, Homo sapiens
acatttctgcatgtagggtaat

SEQ ID NO: 7989782 - DNA, 22 bp, Homo sapiens
acatttctcttgatgtctctat

SEQ ID NO: 7989783 - DNA, 22 bp, Homo sapiens
acatttctcttgatgtctctat

SEQ ID NO: 7989784 - DNA, 22 bp, Homo sapiens
acatttcatttgcagtatggat

SEQ ID NO: 7989785 - DNA, 22 bp, Homo sapiens
acatttctcttgatgtctctat

SEQ ID NO: 7989786 - DNA, 22 bp, Homo sapiens
aaggcctttgggggcctggtcc

SEQ ID NO: 7989787 - DNA, 22 bp, Homo sapiens
aaggcctttgggggcctggtcc

SEQ ID NO: 7989788 - DNA, 22 bp, Homo sapiens
aaggcctttgccccgatacagg

SEQ ID NO: 7989789 - DNA, 22 bp, Homo sapiens
aaggcctttcttatcagtagat

SEQ ID NO: 7989790 - DNA, 22 bp, Homo sapiens
aaggcggggggatcacgaggtc

SEQ ID NO: 7989791 - DNA, 22 bp, Homo sapiens
aaggcgacacaggcagcaggcc

SEQ ID NO: 7989792 - DNA, 22 bp, Homo sapiens
aaggccttttcagttcctcctt

SEQ ID NO: 7989793 - DNA, 22 bp, Homo sapiens
aaggctagagaggtattcaagt

SEQ ID NO: 7989794 - DNA, 22 bp, Homo sapiens
aaggctaaattctgtactgcat

SEQ ID NO: 7989795 - DNA, 22 bp, Homo sapiens
aaggctccctcttctcgagtgt

SEQ ID NO: 7989796 - DNA, 22 bp, Homo sapiens
aaggctccagtgaatgctggca

SEQ ID NO: 7989797 - DNA, 22 bp, Homo sapiens
aaggctccaccctcatggatgc

SEQ ID NO: 7989798 - DNA, 22 bp, Homo sapiens
aaggctcagtaataagttggaa

SEQ ID NO: 7989799 - DNA, 22 bp, Homo sapiens
aaggctcaggagtcccttaagc

SEQ ID NO: 7989800 - DNA, 22 bp, Homo sapiens
aaggctcagggtttaagtttct

SEQ ID NO: 7989801 - DNA, 22 bp, Homo sapiens
aaggctcaaagaagctaagtga

SEQ ID NO: 7989802 - DNA, 22 bp, Homo sapiens
aaggctcagctactcagcctgc

SEQ ID NO: 7989803 - DNA, 22 bp, Homo sapiens
aaggctcagagcctggagctgc

SEQ ID NO: 7989804 - DNA, 22 bp, Homo sapiens
aaggctcagagcctggagctgc

SEQ ID NO: 7989805 - DNA, 22 bp, Homo sapiens
aaggctcactgtagagtaattg

SEQ ID NO: 7989806 - DNA, 22 bp, Homo sapiens
aaggctcactgaaatgtaggca

SEQ ID NO: 7989807 - DNA, 22 bp, Homo sapiens
aaggctcactgaaatgtaggca

SEQ ID NO: 7989808 - DNA, 22 bp, Homo sapiens
acattcttgaagtgaagtttat

SEQ ID NO: 7989809 - DNA, 23 bp, Homo sapiens
acattgttcaatgaaagttagga

SEQ ID NO: 7989810 - DNA, 22 bp, Homo sapiens
acattgttagtagaccagtggc

SEQ ID NO: 7989811 - DNA, 22 bp, Homo sapiens
acattgttagtagaccagtggc

SEQ ID NO: 7989812 - DNA, 21 bp, Homo sapiens
acattgtgtatgcgagagttt

SEQ ID NO: 7989813 - DNA, 22 bp, Homo sapiens
acattgttcctgagaacttggg

SEQ ID NO: 7989814 - DNA, 22 bp, Homo sapiens
acattgttccagcgatagagaa

SEQ ID NO: 7989815 - DNA, 22 bp, Homo sapiens
acattcttcttgtgaatttact

SEQ ID NO: 7989816 - DNA, 22 bp, Homo sapiens
acattcttccagctggctgttg

SEQ ID NO: 7989817 - DNA, 22 bp, Homo sapiens
aaggctcttgagtggtgatagt

SEQ ID NO: 7989818 - DNA, 22 bp, Homo sapiens
aaggctctccaaatgatataat

SEQ ID NO: 7989819 - DNA, 22 bp, Homo sapiens
aaggctcctttgtagttctttt

SEQ ID NO: 7989820 - DNA, 22 bp, Homo sapiens
aaggctcggcaatgtgcggctc

SEQ ID NO: 7989821 - DNA, 22 bp, Homo sapiens
aaggctccgtgactggggctga

SEQ ID NO: 7989822 - DNA, 21 bp, Homo sapiens
aaggctcctcctctaggcctc

SEQ ID NO: 7989823 - DNA, 22 bp, Homo sapiens
aaggctctgcaaaacctccaag

SEQ ID NO: 7989824 - DNA, 22 bp, Homo sapiens
aaggctctgcaaaacctccaag

SEQ ID NO: 7989825 - DNA, 22 bp, Homo sapiens
aaggctctgcaaaacctccaag

SEQ ID NO: 7989826 - DNA, 22 bp, Homo sapiens
aaggctctctgatggcagcagt

SEQ ID NO: 7989827 - DNA, 22 bp, Homo sapiens
aaggctctctgatggcagcagt

SEQ ID NO: 7989828 - DNA, 22 bp, Homo sapiens
aaggcagataagaattcagcaa

SEQ ID NO: 7989829 - DNA, 22 bp, Homo sapiens
aaggcagataagaattcagcaa

SEQ ID NO: 7989830 - DNA, 22 bp, Homo sapiens
aaggcagataagaattcagcaa

SEQ ID NO: 7989831 - DNA, 22 bp, Homo sapiens
aaggcagataagaattcagcaa

SEQ ID NO: 7989832 - DNA, 22 bp, Homo sapiens
aaggccaggggctggcgcctcc

SEQ ID NO: 7989833 - DNA, 22 bp, Homo sapiens
aaggccaggggctggcgcctcc

SEQ ID NO: 7989834 - DNA, 20 bp, Homo sapiens
aaggcagagtgggttggagc

SEQ ID NO: 7989835 - DNA, 22 bp, Homo sapiens
aaggcagataagaattcagcaa

SEQ ID NO: 7989836 - DNA, 20 bp, Homo sapiens
aaggcagagtgggttggagc

SEQ ID NO: 7989837 - DNA, 20 bp, Homo sapiens
aaggcagagtgggttggagc

SEQ ID NO: 7989838 - DNA, 20 bp, Homo sapiens
aaggcagagtgggttggagc

SEQ ID NO: 7989839 - DNA, 20 bp, Homo sapiens
aaggcagagtgggttggagc

SEQ ID NO: 7989840 - DNA, 22 bp, Homo sapiens
aaggcctcttctctctggagat

SEQ ID NO: 7989841 - DNA, 22 bp, Homo sapiens
aaggcctcttctctctggagat

SEQ ID NO: 7989842 - DNA, 22 bp, Homo sapiens
aaggcctccgccaatggcagag

SEQ ID NO: 7989843 - DNA, 22 bp, Homo sapiens
aaggcctccgccaatggcagag

SEQ ID NO: 7989844 - DNA, 22 bp, Homo sapiens
aaggcctcttctctctggagat

SEQ ID NO: 7989845 - DNA, 22 bp, Homo sapiens
aaggcctccctgtgtgcaggtg

SEQ ID NO: 7989846 - DNA, 22 bp, Homo sapiens
aaggcctccctctttcatggga

SEQ ID NO: 7989847 - DNA, 22 bp, Homo sapiens
aaggcccttggaaaatgcagta

SEQ ID NO: 7989848 - DNA, 22 bp, Homo sapiens
aaggcccttggaaaatgcagta

SEQ ID NO: 7989849 - DNA, 22 bp, Homo sapiens
aaggccctttagcagaggaggg

SEQ ID NO: 7989850 - DNA, 22 bp, Homo sapiens
aaggccctttagcagaggaggg

SEQ ID NO: 7989851 - DNA, 22 bp, Homo sapiens
aaggccctttagcagaggaggg

SEQ ID NO: 7989852 - DNA, 22 bp, Homo sapiens
aaggcctcaggtgaggctgccc

SEQ ID NO: 7989853 - DNA, 22 bp, Homo sapiens
aaggcctttaggctttcattgt

SEQ ID NO: 7989854 - DNA, 22 bp, Homo sapiens
aaggcctttcaggattttgctc

SEQ ID NO: 7989855 - DNA, 22 bp, Homo sapiens
aaggccttggctctctgtgtgc

SEQ ID NO: 7989856 - DNA, 22 bp, Homo sapiens
aaggccttggttctgagcaata

SEQ ID NO: 7989857 - DNA, 22 bp, Homo sapiens
aaggcctttctagctttgtgct

SEQ ID NO: 7989858 - DNA, 22 bp, Homo sapiens
aaggcctttctagctttgtgct

SEQ ID NO: 7989859 - DNA, 22 bp, Homo sapiens
aaggcctttcctgctttgaatg

SEQ ID NO: 7989860 - DNA, 22 bp, Homo sapiens
aaggcctttcttatcagtagat

SEQ ID NO: 7989861 - DNA, 22 bp, Homo sapiens
aaggcctttcttatcagtagat

SEQ ID NO: 7989862 - DNA, 22 bp, Homo sapiens
aaggccttgccgaaggatgcca

SEQ ID NO: 7989863 - DNA, 22 bp, Homo sapiens
aaggccttctcttgtgtctgtg

SEQ ID NO: 7989864 - DNA, 22 bp, Homo sapiens
aaggccttctcttgtgtctgtg

SEQ ID NO: 7989865 - DNA, 22 bp, Homo sapiens
aaggccttctcttgtgtctgtg

SEQ ID NO: 7989866 - DNA, 22 bp, Homo sapiens
aaggccttgcctgacagcacca

SEQ ID NO: 7989867 - DNA, 22 bp, Homo sapiens
aaggccttgcctgacagcacca

SEQ ID NO: 7989868 - DNA, 22 bp, Homo sapiens
aaggccttgccgaaggatgcca

SEQ ID NO: 7989869 - DNA, 22 bp, Homo sapiens
aaggccttgccgaaggatgcca

SEQ ID NO: 7989870 - DNA, 22 bp, Homo sapiens
aaggcctggatttaggttgtga

SEQ ID NO: 7989871 - DNA, 22 bp, Homo sapiens
aaggccttctaccaaggctggg

SEQ ID NO: 7989872 - DNA, 22 bp, Homo sapiens
aaggccttctaccaaggctggg

SEQ ID NO: 7989873 - DNA, 22 bp, Homo sapiens
aaggccttccctttgagccgca

SEQ ID NO: 7989874 - DNA, 22 bp, Homo sapiens
aaggccttaaagctctctccag

SEQ ID NO: 7989875 - DNA, 22 bp, Homo sapiens
aaggcctgctcagctgtctgtg

SEQ ID NO: 7989876 - DNA, 22 bp, Homo sapiens
aaggcctgctcagctgtctgtg

SEQ ID NO: 7989877 - DNA, 22 bp, Homo sapiens
aaggcctgaacatgaggagatg

SEQ ID NO: 7989878 - DNA, 22 bp, Homo sapiens
aaggcctgaacatgaggagatg

SEQ ID NO: 7989879 - DNA, 22 bp, Homo sapiens
aaggcctgaacatgaggagatg

SEQ ID NO: 7989880 - DNA, 21 bp, Homo sapiens
aaggcctgcttactgctagtt

SEQ ID NO: 7989881 - DNA, 21 bp, Homo sapiens
aaggcctgcttactgctagtt

SEQ ID NO: 7989882 - DNA, 22 bp, Homo sapiens
acattttacaccaagacttctt

SEQ ID NO: 7989883 - DNA, 22 bp, Homo sapiens
acattttacaccaagacttctt

SEQ ID NO: 7989884 - DNA, 22 bp, Homo sapiens
acattttaatatgcttagtgtg

SEQ ID NO: 7989885 - DNA, 22 bp, Homo sapiens
acattttacaccaagacttctt

SEQ ID NO: 7989886 - DNA, 22 bp, Homo sapiens
acattttacaccaagacttctt

SEQ ID NO: 7989887 - DNA, 22 bp, Homo sapiens
acattttacagttgtctggcta

SEQ ID NO: 7989888 - DNA, 22 bp, Homo sapiens
acattttacagttgtctggcta

SEQ ID NO: 7989889 - DNA, 22 bp, Homo sapiens
acattttacagttgtctggcta

SEQ ID NO: 7989890 - DNA, 21 bp, Homo sapiens
acattttctgttttaggaagt

SEQ ID NO: 7989891 - DNA, 21 bp, Homo sapiens
acattttctgttttaggaagt

SEQ ID NO: 7989892 - DNA, 21 bp, Homo sapiens
acattttctgttttaggaagt

SEQ ID NO: 7989893 - DNA, 22 bp, Homo sapiens
acatttgtttctctagagtagg

SEQ ID NO: 7989894 - DNA, 22 bp, Homo sapiens
acatttgtttctctagagtagg

SEQ ID NO: 7989895 - DNA, 22 bp, Homo sapiens
acattttaatatgcttagtgtg

SEQ ID NO: 7989896 - DNA, 22 bp, Homo sapiens
acattttaatatgcttagtgtg

SEQ ID NO: 7989897 - DNA, 22 bp, Homo sapiens
acattttaatatgcttagtgtg

SEQ ID NO: 7989898 - DNA, 22 bp, Homo sapiens
acatttgtgcacatgtgcatgg

SEQ ID NO: 7989899 - DNA, 22 bp, Homo sapiens
acatttgttcagggctgaggaa

SEQ ID NO: 7989900 - DNA, 22 bp, Homo sapiens
acatttgtgggggaacaggata

SEQ ID NO: 7989901 - DNA, 22 bp, Homo sapiens
acatttgttgccattcatggag

SEQ ID NO: 7989902 - DNA, 20 bp, Homo sapiens
acatttgtggatctgagaga

SEQ ID NO: 7989903 - DNA, 20 bp, Homo sapiens
acatttgtggatctgagaga

SEQ ID NO: 7989904 - DNA, 20 bp, Homo sapiens
acatttgtggatctgagaga

SEQ ID NO: 7989905 - DNA, 19 bp, Homo sapiens
accaggcttatggtcagtg

SEQ ID NO: 7989906 - DNA, 22 bp, Homo sapiens
accaggcttgataccaagaaat

SEQ ID NO: 7989907 - DNA, 22 bp, Homo sapiens
accaggcttgataccaagaaat

SEQ ID NO: 7989908 - DNA, 19 bp, Homo sapiens
accaggcttatggtcagtg

SEQ ID NO: 7989909 - DNA, 19 bp, Homo sapiens
accaggcttatggtcagtg

SEQ ID NO: 7989910 - DNA, 22 bp, Homo sapiens
accaggcccaccgcatgctcct

SEQ ID NO: 7989911 - DNA, 22 bp, Homo sapiens
accaggcttaatcctttgctat

SEQ ID NO: 7989912 - DNA, 22 bp, Homo sapiens
accaggcttaatcctttgctat

SEQ ID NO: 7989913 - DNA, 19 bp, Homo sapiens
accaggcttatggtcagtg

SEQ ID NO: 7989914 - DNA, 19 bp, Homo sapiens
accaggcttatggtcagtg

SEQ ID NO: 7989915 - DNA, 19 bp, Homo sapiens
accaggcttatggtcagtg

SEQ ID NO: 7989916 - DNA, 22 bp, Homo sapiens
acattttgaaagggaaattgtt

SEQ ID NO: 7989917 - DNA, 21 bp, Homo sapiens
acattttctgttttaggaagt

SEQ ID NO: 7989918 - DNA, 21 bp, Homo sapiens
accaggccaggaggctggcac

SEQ ID NO: 7989919 - DNA, 22 bp, Homo sapiens
acattttgagaaatgacaagct

SEQ ID NO: 7989920 - DNA, 22 bp, Homo sapiens
accaggcccaccgcatgctcct

SEQ ID NO: 7989921 - DNA, 22 bp, Homo sapiens
accaggcccaccgcatgctcct

SEQ ID NO: 7989922 - DNA, 22 bp, Homo sapiens
accaggctgttgggcccagtgt

SEQ ID NO: 7989923 - DNA, 21 bp, Homo sapiens
accaggcttgtgggagggagc

SEQ ID NO: 7989924 - DNA, 22 bp, Homo sapiens
accagggcaaatgtttgtactc

SEQ ID NO: 7989925 - DNA, 22 bp, Homo sapiens
accagggcacaggagtctgaag

SEQ ID NO: 7989926 - DNA, 22 bp, Homo sapiens
accagggcaaatgtttgtactc

SEQ ID NO: 7989927 - DNA, 22 bp, Homo sapiens
accagggaccgccacactgcaa

SEQ ID NO: 7989928 - DNA, 21 bp, Homo sapiens
accaggcttgtgggagggagc

SEQ ID NO: 7989929 - DNA, 21 bp, Homo sapiens
accaggcttgtgggagggagc

SEQ ID NO: 7989930 - DNA, 21 bp, Homo sapiens
accaggcttgtgggagggagc

SEQ ID NO: 7989931 - DNA, 22 bp, Homo sapiens
accaggcttgatgatttgctta

SEQ ID NO: 7989932 - DNA, 22 bp, Homo sapiens
accaggcttgatgatttgctta

SEQ ID NO: 7989933 - DNA, 22 bp, Homo sapiens
accaggcttgatgatttgctta

SEQ ID NO: 7989934 - DNA, 22 bp, Homo sapiens
aagggctgggtctggttaaccc

SEQ ID NO: 7989935 - DNA, 22 bp, Homo sapiens
aagggctggtctagaaagggag

SEQ ID NO: 7989936 - DNA, 22 bp, Homo sapiens
aagggctggtctagaaagggag

SEQ ID NO: 7989937 - DNA, 22 bp, Homo sapiens
aagggctggtctagaaagggag

SEQ ID NO: 7989938 - DNA, 22 bp, Homo sapiens
accagggcacaggagtctgaag

SEQ ID NO: 7989939 - DNA, 22 bp, Homo sapiens
aagggctgggtctggttaaccc

SEQ ID NO: 7989940 - DNA, 22 bp, Homo sapiens
aagggctgggtctggttaaccc

SEQ ID NO: 7989941 - DNA, 22 bp, Homo sapiens
aagggctgggtctggttaaccc

SEQ ID NO: 7989942 - DNA, 22 bp, Homo sapiens
aagggctgtaagccaagtaaag

SEQ ID NO: 7989943 - DNA, 22 bp, Homo sapiens
aagggctgtaagccaagtaaag

SEQ ID NO: 7989944 - DNA, 22 bp, Homo sapiens
aagggctgtaagccaagtaaag

SEQ ID NO: 7989945 - DNA, 22 bp, Homo sapiens
aagggctgtaagccaagtaaag

SEQ ID NO: 7989946 - DNA, 22 bp, Homo sapiens
aagggctggtctagaaagggag

SEQ ID NO: 7989947 - DNA, 22 bp, Homo sapiens
aagggctggtctagaaagggag

SEQ ID NO: 7989948 - DNA, 22 bp, Homo sapiens
aagggctgtaagccaagtaaag

SEQ ID NO: 7989949 - DNA, 22 bp, Homo sapiens
aagggcttaggattttgctgtg

SEQ ID NO: 7989950 - DNA, 22 bp, Homo sapiens
aagggctggtctagaaagggag

SEQ ID NO: 7989951 - DNA, 22 bp, Homo sapiens
aaggggaaaaagtgttaggagt

SEQ ID NO: 7989952 - DNA, 22 bp, Homo sapiens
aaggggaaaaagtgttaggagt

SEQ ID NO: 7989953 - DNA, 22 bp, Homo sapiens
aagggctgttatgtttttatac

SEQ ID NO: 7989954 - DNA, 22 bp, Homo sapiens
aagggctgttatgtttttatac

SEQ ID NO: 7989955 - DNA, 22 bp, Homo sapiens
aagggctgttatgtttttatac

SEQ ID NO: 7989956 - DNA, 22 bp, Homo sapiens
aagggcttacatctgtttctaa

SEQ ID NO: 7989957 - DNA, 22 bp, Homo sapiens
aagggctgtagtttgttgatca

SEQ ID NO: 7989958 - DNA, 22 bp, Homo sapiens
aagggctgtagtttgttgatca

SEQ ID NO: 7989959 - DNA, 22 bp, Homo sapiens
aagggctgtagtttgttgatca

SEQ ID NO: 7989960 - DNA, 22 bp, Homo sapiens
aagggctgtagacaagattgct

SEQ ID NO: 7989961 - DNA, 22 bp, Homo sapiens
aagggctgtagacaagattgct

SEQ ID NO: 7989962 - DNA, 22 bp, Homo sapiens
aagggctgtagacaagattgct

SEQ ID NO: 7989963 - DNA, 22 bp, Homo sapiens
acccagagcccttagcacagac

SEQ ID NO: 7989964 - DNA, 22 bp, Homo sapiens
accatgttggccaagctggtct

SEQ ID NO: 7989965 - DNA, 22 bp, Homo sapiens
accatgttggccaagctggtct

SEQ ID NO: 7989966 - DNA, 22 bp, Homo sapiens
accatgttggccaagctggtct

SEQ ID NO: 7989967 - DNA, 22 bp, Homo sapiens
accatgttggccaagctggtct

SEQ ID NO: 7989968 - DNA, 22 bp, Homo sapiens
accatgttggccaagctggtct

SEQ ID NO: 7989969 - DNA, 22 bp, Homo sapiens
aaggggaaaaagtgttaggagt

SEQ ID NO: 7989970 - DNA, 22 bp, Homo sapiens
acccagagctgggcttggcaaa

SEQ ID NO: 7989971 - DNA, 22 bp, Homo sapiens
acccagagctgggcttggcaaa

SEQ ID NO: 7989972 - DNA, 19 bp, Homo sapiens
acccagagccctttgcagg

SEQ ID NO: 7989973 - DNA, 19 bp, Homo sapiens
acccagagccctttgcagg

SEQ ID NO: 7989974 - DNA, 22 bp, Homo sapiens
acccagagctgggcttggcaaa

SEQ ID NO: 7989975 - DNA, 19 bp, Homo sapiens
acccagagccctttgcagg

SEQ ID NO: 7989976 - DNA, 22 bp, Homo sapiens
acccagagcccttagcacagac

SEQ ID NO: 7989977 - DNA, 22 bp, Homo sapiens
acccagagtcagacagccatgg

SEQ ID NO: 7989978 - DNA, 22 bp, Homo sapiens
acccagagtaacagatggattc

SEQ ID NO: 7989979 - DNA, 22 bp, Homo sapiens
acccagagtcatggcacttagc

SEQ ID NO: 7989980 - DNA, 22 bp, Homo sapiens
acccagagtcagacagccatgg

SEQ ID NO: 7989981 - DNA, 22 bp, Homo sapiens
acccagagtgtctgtctcagtc

SEQ ID NO: 7989982 - DNA, 22 bp, Homo sapiens
acccaggagccgtgagaggtta

SEQ ID NO: 7989983 - DNA, 22 bp, Homo sapiens
acccaggagccgtgagaggtta

SEQ ID NO: 7989984 - DNA, 22 bp, Homo sapiens
acccaggagccgtgagaggtta

SEQ ID NO: 7989985 - DNA, 22 bp, Homo sapiens
acccagagtcatgtttattccc

SEQ ID NO: 7989986 - DNA, 22 bp, Homo sapiens
acccagagtcatggcacttagc

SEQ ID NO: 7989987 - DNA, 22 bp, Homo sapiens
acccagaggcggaggttgcagt

SEQ ID NO: 7989988 - DNA, 22 bp, Homo sapiens
acccagagctgggcttggcaaa

SEQ ID NO: 7989989 - DNA, 22 bp, Homo sapiens
acccagagctgggcttggcaaa

SEQ ID NO: 7989990 - DNA, 22 bp, Homo sapiens
acccagagtaacagatggattc

SEQ ID NO: 7989991 - DNA, 22 bp, Homo sapiens
acccagagtaacagatggattc

SEQ ID NO: 7989992 - DNA, 22 bp, Homo sapiens
acccagaggtgtctagcaagct

SEQ ID NO: 7989993 - DNA, 22 bp, Homo sapiens
acccagaggtgtctagcaagct

SEQ ID NO: 7989994 - DNA, 22 bp, Homo sapiens
acccagaggtgtctagcaagct

SEQ ID NO: 7989995 - DNA, 22 bp, Homo sapiens
acccagaggtgtctagcaagct

SEQ ID NO: 7989996 - DNA, 22 bp, Homo sapiens
acccagaggcggaggttgcagt

SEQ ID NO: 7989997 - DNA, 22 bp, Homo sapiens
acccaggaggcagaggttgcag

SEQ ID NO: 7989998 - DNA, 22 bp, Homo sapiens
acccaggaggcagaggttgcag

SEQ ID NO: 7989999 - DNA, 22 bp, Homo sapiens
acccaggaggcagaggttgcag

SEQ ID NO: 7990000 - DNA, 22 bp, Homo sapiens
acccaggaggcagaggttgcag

SEQ ID NO: 7990001 - DNA, 22 bp, Homo sapiens
acccaggaggcaaggttgcagt

SEQ ID NO: 7990002 - DNA, 22 bp, Homo sapiens
acccaggaggcaaggttgcagt

SEQ ID NO: 7990003 - DNA, 22 bp, Homo sapiens
acccaggaggcaaggttgcagt

SEQ ID NO: 7990004 - DNA, 22 bp, Homo sapiens
acccaggagccgtgagaggtta

SEQ ID NO: 7990005 - DNA, 22 bp, Homo sapiens
acccaggagccgtgagaggtta

SEQ ID NO: 7990006 - DNA, 22 bp, Homo sapiens
acccaggagctctggggtcctc

SEQ ID NO: 7990007 - DNA, 22 bp, Homo sapiens
acccaggagctctggggtcctc

SEQ ID NO: 7990008 - DNA, 22 bp, Homo sapiens
acccaggaggcaaggttgcagt

SEQ ID NO: 7990009 - DNA, 22 bp, Homo sapiens
acccaggaggcaaggttgcagt

SEQ ID NO: 7990010 - DNA, 22 bp, Homo sapiens
acccaggataatctgtgtatct

SEQ ID NO: 7990011 - DNA, 22 bp, Homo sapiens
acccaggataatctgtgtatct

SEQ ID NO: 7990012 - DNA, 22 bp, Homo sapiens
acccaggataatctgtgtatct

SEQ ID NO: 7990013 - DNA, 22 bp, Homo sapiens
acccaggaggtggaggctgcag

SEQ ID NO: 7990014 - DNA, 22 bp, Homo sapiens
acccaggatagagtgctgcagt

SEQ ID NO: 7990015 - DNA, 22 bp, Homo sapiens
acccaggatagagtgctgcagt

SEQ ID NO: 7990016 - DNA, 22 bp, Homo sapiens
acccaggataatctgtgtatct

SEQ ID NO: 7990017 - DNA, 22 bp, Homo sapiens
acccaggaggtggaggctgcag

SEQ ID NO: 7990018 - DNA, 22 bp, Homo sapiens
acccaggaggtggaggctgcag

SEQ ID NO: 7990019 - DNA, 22 bp, Homo sapiens
acccaggaggtggaggctgcag

SEQ ID NO: 7990020 - DNA, 22 bp, Homo sapiens
acccaggaggtggaggctgcag

SEQ ID NO: 7990021 - DNA, 22 bp, Homo sapiens
acccaggaggtgacacagggct

SEQ ID NO: 7990022 - DNA, 22 bp, Homo sapiens
acccaggaggtgacacagggct

SEQ ID NO: 7990023 - DNA, 22 bp, Homo sapiens
acccaggaggtgacacagggct

SEQ ID NO: 7990024 - DNA, 22 bp, Homo sapiens
accccttctcctggctgttcca

SEQ ID NO: 7990025 - DNA, 22 bp, Homo sapiens
accccttctcctggctgttcca

SEQ ID NO: 7990026 - DNA, 22 bp, Homo sapiens
accctgagaaagtcacatgcat

SEQ ID NO: 7990027 - DNA, 22 bp, Homo sapiens
acccccttcgcacactctttca

SEQ ID NO: 7990028 - DNA, 22 bp, Homo sapiens
acccaggatgataatgttcaca

SEQ ID NO: 7990029 - DNA, 22 bp, Homo sapiens
acccaggatagagtgctgcagt

SEQ ID NO: 7990030 - DNA, 22 bp, Homo sapiens
acccaggatagagtgctgcagt

SEQ ID NO: 7990031 - DNA, 22 bp, Homo sapiens
acccaggatagagtgctgcagt

SEQ ID NO: 7990032 - DNA, 22 bp, Homo sapiens
acccaggatgataatgttcaca

SEQ ID NO: 7990033 - DNA, 22 bp, Homo sapiens
accctgagggatgagagttgca

SEQ ID NO: 7990034 - DNA, 22 bp, Homo sapiens
accctgagccgccaggaaggcc

SEQ ID NO: 7990035 - DNA, 20 bp, Homo sapiens
accctgaggctccccagcct

SEQ ID NO: 7990036 - DNA, 22 bp, Homo sapiens
accctgagccaaaccagttaga

SEQ ID NO: 7990037 - DNA, 22 bp, Homo sapiens
accctgagccgccaggaaggcc

SEQ ID NO: 7990038 - DNA, 22 bp, Homo sapiens
accctgagccgccaggaaggcc

SEQ ID NO: 7990039 - DNA, 22 bp, Homo sapiens
accctgagaaagtcacatgcat

SEQ ID NO: 7990040 - DNA, 22 bp, Homo sapiens
accctgagaaagtcacatgcat

SEQ ID NO: 7990041 - DNA, 22 bp, Homo sapiens
accctgagaatgagtgtctcct

SEQ ID NO: 7990042 - DNA, 19 bp, Homo sapiens
accctgagaggtggtccgg

SEQ ID NO: 7990043 - DNA, 22 bp, Homo sapiens
accctgagatgccacagcatga

SEQ ID NO: 7990044 - DNA, 22 bp, Homo sapiens
accctgagatgccacagcatga

SEQ ID NO: 7990045 - DNA, 22 bp, Homo sapiens
accctgagatgccacagcatga

SEQ ID NO: 7990046 - DNA, 22 bp, Homo sapiens
accctgccgtgggctgcttgtg

SEQ ID NO: 7990047 - DNA, 22 bp, Homo sapiens
accctgcctctgcttcctgtag

SEQ ID NO: 7990048 - DNA, 22 bp, Homo sapiens
accctgccgtgggctgcttgtg

SEQ ID NO: 7990049 - DNA, 22 bp, Homo sapiens
accctgccctctccagctcagg

SEQ ID NO: 7990050 - DNA, 22 bp, Homo sapiens
accctgccctctccagctcagg

SEQ ID NO: 7990051 - DNA, 20 bp, Homo sapiens
accctgccaggcatgtgaat

SEQ ID NO: 7990052 - DNA, 22 bp, Homo sapiens
accgggaagtcctgcactgggc

SEQ ID NO: 7990053 - DNA, 22 bp, Homo sapiens
accgggaagtcctgcactgggc

SEQ ID NO: 7990054 - DNA, 22 bp, Homo sapiens
accgggaagtcctgcactgggc

SEQ ID NO: 7990055 - DNA, 22 bp, Homo sapiens
acccttttgcctttaattcatg

SEQ ID NO: 7990056 - DNA, 21 bp, Homo sapiens
accctttgtttatgaatcagc

SEQ ID NO: 7990057 - DNA, 22 bp, Homo sapiens
accgactgagaatacttggctt

SEQ ID NO: 7990058 - DNA, 22 bp, Homo sapiens
accgagttagccaggatggtct

SEQ ID NO: 7990059 - DNA, 22 bp, Homo sapiens
accctgcagggcagaggctggt

SEQ ID NO: 7990060 - DNA, 22 bp, Homo sapiens
accctgatataggtccaagagc

SEQ ID NO: 7990061 - DNA, 22 bp, Homo sapiens
accctgagtgcaacggtgagga

SEQ ID NO: 7990062 - DNA, 22 bp, Homo sapiens
accctgagtgcaacggtgagga

SEQ ID NO: 7990063 - DNA, 22 bp, Homo sapiens
accctgaggggtatagcagaag

SEQ ID NO: 7990064 - DNA, 22 bp, Homo sapiens
accctgaggggtatagcagaag

SEQ ID NO: 7990065 - DNA, 22 bp, Homo sapiens
accctgaggggtatagcagaag

SEQ ID NO: 7990066 - DNA, 22 bp, Homo sapiens
accctgagggtgctgggtttct

SEQ ID NO: 7990067 - DNA, 22 bp, Homo sapiens
accctgagggtgctgggtttct

SEQ ID NO: 7990068 - DNA, 22 bp, Homo sapiens
accctgagtcactgtctgtctg

SEQ ID NO: 7990069 - DNA, 22 bp, Homo sapiens
accctgagtcagacagcctgac

SEQ ID NO: 7990070 - DNA, 22 bp, Homo sapiens
aagtcgtggcaggcttgcacga

SEQ ID NO: 7990071 - DNA, 22 bp, Homo sapiens
aagtcctttccagtcctgtgat

SEQ ID NO: 7990072 - DNA, 22 bp, Homo sapiens
aagtcctttctcatggaggaat

SEQ ID NO: 7990073 - DNA, 22 bp, Homo sapiens
aagtctaaacacatatttaaaa

SEQ ID NO: 7990074 - DNA, 22 bp, Homo sapiens
aagtctaaacacatatttaaaa

SEQ ID NO: 7990075 - DNA, 22 bp, Homo sapiens
aagtctaggacaggaagtctat

SEQ ID NO: 7990076 - DNA, 22 bp, Homo sapiens
aagtctagtatccttcttgact

SEQ ID NO: 7990077 - DNA, 22 bp, Homo sapiens
aagtctaggacaggaagtctat

SEQ ID NO: 7990078 - DNA, 22 bp, Homo sapiens
aagtctcagaaaactagtgtgg

SEQ ID NO: 7990079 - DNA, 22 bp, Homo sapiens
aagtctcatccgtgtagctcca

SEQ ID NO: 7990080 - DNA, 22 bp, Homo sapiens
aagtctcatccgtgtagctcca

SEQ ID NO: 7990081 - DNA, 22 bp, Homo sapiens
aagtctcagaaaactagtgtgg

SEQ ID NO: 7990082 - DNA, 22 bp, Homo sapiens
aagtctcagaaaactagtgtgg

SEQ ID NO: 7990083 - DNA, 22 bp, Homo sapiens
acgtggagccacagatggagca

SEQ ID NO: 7990084 - DNA, 22 bp, Homo sapiens
acgtggagagaatagggcacca

SEQ ID NO: 7990085 - DNA, 18 bp, Homo sapiens
acgtgctgtgccttttgc

SEQ ID NO: 7990086 - DNA, 18 bp, Homo sapiens
acgtgctgtgccttttgc

SEQ ID NO: 7990087 - DNA, 22 bp, Homo sapiens
acgtgctgaagttatccctgtt

SEQ ID NO: 7990088 - DNA, 22 bp, Homo sapiens
acgtgctggagaagagctcgcc

SEQ ID NO: 7990089 - DNA, 18 bp, Homo sapiens
acgtgctgtgccttttgc

SEQ ID NO: 7990090 - DNA, 22 bp, Homo sapiens
acgtgcgtgtgcgcacacatac

SEQ ID NO: 7990091 - DNA, 22 bp, Homo sapiens
acgtgcatctttccatatgtgg

SEQ ID NO: 7990092 - DNA, 20 bp, Homo sapiens
acgtggccaccagtggctta

SEQ ID NO: 7990093 - DNA, 20 bp, Homo sapiens
acgtggccaccagtggctta

SEQ ID NO: 7990094 - DNA, 20 bp, Homo sapiens
acgtggccaccagtggctta

SEQ ID NO: 7990095 - DNA, 20 bp, Homo sapiens
acgtggccaccagtggctta

SEQ ID NO: 7990096 - DNA, 22 bp, Homo sapiens
acgtggagccacagatggagca

SEQ ID NO: 7990097 - DNA, 20 bp, Homo sapiens
acgtggccaccagtggctta

SEQ ID NO: 7990098 - DNA, 22 bp, Homo sapiens
actacacagggatgtgactacc

SEQ ID NO: 7990099 - DNA, 22 bp, Homo sapiens
aagtctctttgggtactttatt

SEQ ID NO: 7990100 - DNA, 22 bp, Homo sapiens
actacactgccctggggatcaa

SEQ ID NO: 7990101 - DNA, 22 bp, Homo sapiens
aagtctctttacctctccaggc

SEQ ID NO: 7990102 - DNA, 22 bp, Homo sapiens
aagtctctttacctctccaggc

SEQ ID NO: 7990103 - DNA, 22 bp, Homo sapiens
aagtctctttacctctccaggc

SEQ ID NO: 7990104 - DNA, 22 bp, Homo sapiens
aagtctctttacctctccaggc

SEQ ID NO: 7990105 - DNA, 22 bp, Homo sapiens
aagtctctggtgatgcaggaaa

SEQ ID NO: 7990106 - DNA, 22 bp, Homo sapiens
aagtctctggtgatgcaggaaa

SEQ ID NO: 7990107 - DNA, 22 bp, Homo sapiens
aagtctctggcaaatgatcttg

SEQ ID NO: 7990108 - DNA, 22 bp, Homo sapiens
aagtctctggttgcttgcatgg

SEQ ID NO: 7990109 - DNA, 22 bp, Homo sapiens
aagtctaaacacatatttaaaa

SEQ ID NO: 7990110 - DNA, 22 bp, Homo sapiens
aagtctcttagtaatatccaac

SEQ ID NO: 7990111 - DNA, 22 bp, Homo sapiens
aagtctcttcctctgccaaaga

SEQ ID NO: 7990112 - DNA, 22 bp, Homo sapiens
aagtctcttcctctgccaaaga

SEQ ID NO: 7990113 - DNA, 22 bp, Homo sapiens
aagtctctaagactgtgccatc

SEQ ID NO: 7990114 - DNA, 22 bp, Homo sapiens
aagtctcatccgtgtagctcca

SEQ ID NO: 7990115 - DNA, 22 bp, Homo sapiens
aagtctcatccgtgtagctcca

SEQ ID NO: 7990116 - DNA, 22 bp, Homo sapiens
aagtctctcacatatctggtcc

SEQ ID NO: 7990117 - DNA, 22 bp, Homo sapiens
aagtctctcacatatctggtcc

SEQ ID NO: 7990118 - DNA, 22 bp, Homo sapiens
aagtctctcatggctgacagca

SEQ ID NO: 7990119 - DNA, 22 bp, Homo sapiens
aagtctctcatggctgacagca

SEQ ID NO: 7990120 - DNA, 22 bp, Homo sapiens
aagtctctcatggctgacagca

SEQ ID NO: 7990121 - DNA, 22 bp, Homo sapiens
aagtctctcatggctgacagca

SEQ ID NO: 7990122 - DNA, 22 bp, Homo sapiens
aagtctctctgtgtgggataag

SEQ ID NO: 7990123 - DNA, 22 bp, Homo sapiens
aagtctctggcaaatgatcttg

SEQ ID NO: 7990124 - DNA, 22 bp, Homo sapiens
aagtctctgatgtgtgttaggt

SEQ ID NO: 7990125 - DNA, 22 bp, Homo sapiens
aagtctctgactcacacaatgt

SEQ ID NO: 7990126 - DNA, 18 bp, Homo sapiens
aagtctctgaaagctttt

SEQ ID NO: 7990127 - DNA, 22 bp, Homo sapiens
acctagaaactgacagaatatt

SEQ ID NO: 7990128 - DNA, 22 bp, Homo sapiens
acctactgctccacagtgacta

SEQ ID NO: 7990129 - DNA, 22 bp, Homo sapiens
acctagaaactgacagaatatt

SEQ ID NO: 7990130 - DNA, 22 bp, Homo sapiens
acctacatggctttaagtaagt

SEQ ID NO: 7990131 - DNA, 22 bp, Homo sapiens
acctacatgttccacatagttg

SEQ ID NO: 7990132 - DNA, 20 bp, Homo sapiens
acctacatgtatagtgaggg

SEQ ID NO: 7990133 - DNA, 22 bp, Homo sapiens
acctagaactgcaggctatttt

SEQ ID NO: 7990134 - DNA, 22 bp, Homo sapiens
acctagaatgaagcaatgctgt

SEQ ID NO: 7990135 - DNA, 22 bp, Homo sapiens
acctagaactgcaggctatttt

SEQ ID NO: 7990136 - DNA, 22 bp, Homo sapiens
acctagaatccatctgcttatt

SEQ ID NO: 7990137 - DNA, 23 bp, Homo sapiens
acctagaaatacgttttacatgg

SEQ ID NO: 7990138 - DNA, 23 bp, Homo sapiens
acctagaaatacgttttacatgg

SEQ ID NO: 7990139 - DNA, 22 bp, Homo sapiens
acctagaatttaaaacattgct

SEQ ID NO: 7990140 - DNA, 22 bp, Homo sapiens
acctagagtagtcaaattcata

SEQ ID NO: 7990141 - DNA, 22 bp, Homo sapiens
acctagaatttaaaacattgct

SEQ ID NO: 7990142 - DNA, 22 bp, Homo sapiens
acctagaatttaaaacattgct

SEQ ID NO: 7990143 - DNA, 22 bp, Homo sapiens
acctacatcaagggagtggtag

SEQ ID NO: 7990144 - DNA, 22 bp, Homo sapiens
acctacatagttaagtaacaaa

SEQ ID NO: 7990145 - DNA, 23 bp, Homo sapiens
acctaattgaaaatgatgtcata

SEQ ID NO: 7990146 - DNA, 22 bp, Homo sapiens
acctaagaaatccagagatttc

SEQ ID NO: 7990147 - DNA, 22 bp, Homo sapiens
acctaagaaatccagagatttc

SEQ ID NO: 7990148 - DNA, 22 bp, Homo sapiens
acctaagagatcttctggtcca

SEQ ID NO: 7990149 - DNA, 22 bp, Homo sapiens
acctaagagatcttctggtcca

SEQ ID NO: 7990150 - DNA, 22 bp, Homo sapiens
accgggctaatttttgtatctt

SEQ ID NO: 7990151 - DNA, 22 bp, Homo sapiens
accgggctaatttttgtatctt

SEQ ID NO: 7990152 - DNA, 22 bp, Homo sapiens
accgtgtctgacactttgggcg

SEQ ID NO: 7990153 - DNA, 22 bp, Homo sapiens
accgggaagtcctgcactgggc

SEQ ID NO: 7990154 - DNA, 22 bp, Homo sapiens
accgggctaatttttgtatctt

SEQ ID NO: 7990155 - DNA, 22 bp, Homo sapiens
acggggctagagaaggtttctt

SEQ ID NO: 7990156 - DNA, 22 bp, Homo sapiens
acgggtggctgaggaggcctct

SEQ ID NO: 7990157 - DNA, 22 bp, Homo sapiens
acgggtggctgaggaggcctct

SEQ ID NO: 7990158 - DNA, 22 bp, Homo sapiens
acggtgaccaagcatcaccgag

SEQ ID NO: 7990159 - DNA, 22 bp, Homo sapiens
acggtaacagataccacagact

SEQ ID NO: 7990160 - DNA, 22 bp, Homo sapiens
acgggtggtaatgagaaaagga

SEQ ID NO: 7990161 - DNA, 22 bp, Homo sapiens
acggggctagagaaggtttctt

SEQ ID NO: 7990162 - DNA, 22 bp, Homo sapiens
acctttatgtttgattacaatt

SEQ ID NO: 7990163 - DNA, 22 bp, Homo sapiens
acctttatggagaacttgggat

SEQ ID NO: 7990164 - DNA, 22 bp, Homo sapiens
acctttatgattcacaatgtat

SEQ ID NO: 7990165 - DNA, 22 bp, Homo sapiens
acctttatggagaacttgggat

SEQ ID NO: 7990166 - DNA, 22 bp, Homo sapiens
acctttatgattcacaatgtat

SEQ ID NO: 7990167 - DNA, 22 bp, Homo sapiens
acctttatgattcacaatgtat

SEQ ID NO: 7990168 - DNA, 22 bp, Homo sapiens
acctttatgattcacaatgtat

SEQ ID NO: 7990169 - DNA, 22 bp, Homo sapiens
acctttatgattcacaatgtat

SEQ ID NO: 7990170 - DNA, 22 bp, Homo sapiens
acctttatgaaacagctgtcgt

SEQ ID NO: 7990171 - DNA, 22 bp, Homo sapiens
acggtgccggtggtgatgagcc

SEQ ID NO: 7990172 - DNA, 22 bp, Homo sapiens
acggtgctgggtattggggttc

SEQ ID NO: 7990173 - DNA, 22 bp, Homo sapiens
acggtgctgggtattggggttc

SEQ ID NO: 7990174 - DNA, 22 bp, Homo sapiens
acgtagtgtgttgtggaaagag

SEQ ID NO: 7990175 - DNA, 22 bp, Homo sapiens
acgtgcaggatctggttggcga

SEQ ID NO: 7990176 - DNA, 22 bp, Homo sapiens
acgtgcaggatctggttggcga

SEQ ID NO: 7990177 - DNA, 22 bp, Homo sapiens
acgtgcaggatctggttggcga

SEQ ID NO: 7990178 - DNA, 22 bp, Homo sapiens
acgtcttcgttggcagagattt

SEQ ID NO: 7990179 - DNA, 22 bp, Homo sapiens
acgtcatcgttgtcatcgtcat

SEQ ID NO: 7990180 - DNA, 22 bp, Homo sapiens
actacagaagtcttattagaga

SEQ ID NO: 7990181 - DNA, 22 bp, Homo sapiens
actagtttgaaaatatctgatt

SEQ ID NO: 7990182 - DNA, 22 bp, Homo sapiens
actagtttgaaaatatctgatt

SEQ ID NO: 7990183 - DNA, 22 bp, Homo sapiens
actacagaagtcttattagaga

SEQ ID NO: 7990184 - DNA, 22 bp, Homo sapiens
actacagaagtcttattagaga

SEQ ID NO: 7990185 - DNA, 22 bp, Homo sapiens
actagttttcaggcatgtctgg

SEQ ID NO: 7990186 - DNA, 22 bp, Homo sapiens
actagtttgagtaattgtaatg

SEQ ID NO: 7990187 - DNA, 22 bp, Homo sapiens
actagtttgagtaattgtaatg

SEQ ID NO: 7990188 - DNA, 22 bp, Homo sapiens
actagtttgaaaatatctgatt

SEQ ID NO: 7990189 - DNA, 22 bp, Homo sapiens
actagttttcaggcatgtctgg

SEQ ID NO: 7990190 - DNA, 22 bp, Homo sapiens
actagttttccataatatagga

SEQ ID NO: 7990191 - DNA, 22 bp, Homo sapiens
actagttttccataatatagga

SEQ ID NO: 7990192 - DNA, 22 bp, Homo sapiens
actagttttccataatatagga

SEQ ID NO: 7990193 - DNA, 22 bp, Homo sapiens
actataaaaggataaaccagaa

SEQ ID NO: 7990194 - DNA, 22 bp, Homo sapiens
actagtttttcctctgtcctgt

SEQ ID NO: 7990195 - DNA, 22 bp, Homo sapiens
actagtttttcctctgtcctgt

SEQ ID NO: 7990196 - DNA, 22 bp, Homo sapiens
actataaaaggataaaccagaa

SEQ ID NO: 7990197 - DNA, 22 bp, Homo sapiens
actataaaaggataaaccagaa

SEQ ID NO: 7990198 - DNA, 22 bp, Homo sapiens
actatacaccaaaatattaagg

SEQ ID NO: 7990199 - DNA, 22 bp, Homo sapiens
actatacaccaaaatattaagg

SEQ ID NO: 7990200 - DNA, 22 bp, Homo sapiens
actataaggttcatgtgagaat

SEQ ID NO: 7990201 - DNA, 23 bp, Homo sapiens
actataaagttgttctgatttac

SEQ ID NO: 7990202 - DNA, 23 bp, Homo sapiens
actataaagttgttctgatttac

SEQ ID NO: 7990203 - DNA, 23 bp, Homo sapiens
actataaagttgttctgatttac

SEQ ID NO: 7990204 - DNA, 22 bp, Homo sapiens
actcaccacagagcagggaacc

SEQ ID NO: 7990205 - DNA, 22 bp, Homo sapiens
actcactgcactttgaaatgtg

SEQ ID NO: 7990206 - DNA, 22 bp, Homo sapiens
actatacattgaatgttaaggt

SEQ ID NO: 7990207 - DNA, 22 bp, Homo sapiens
actatacataaaacatttgggt

SEQ ID NO: 7990208 - DNA, 22 bp, Homo sapiens
actatacattgaatgttaaggt

SEQ ID NO: 7990209 - DNA, 22 bp, Homo sapiens
actatacagtatgtacgtgcac

SEQ ID NO: 7990210 - DNA, 22 bp, Homo sapiens
actatacagtatgtacgtgcac

SEQ ID NO: 7990211 - DNA, 22 bp, Homo sapiens
actatacagtatgtacgtgcac

SEQ ID NO: 7990212 - DNA, 22 bp, Homo sapiens
actcagaagatgtgggtagata

SEQ ID NO: 7990213 - DNA, 22 bp, Homo sapiens
actcagaagatataatgactca

SEQ ID NO: 7990214 - DNA, 22 bp, Homo sapiens
actcagaagatataatgactca

SEQ ID NO: 7990215 - DNA, 22 bp, Homo sapiens
actcagaatgactgatgctgtg

SEQ ID NO: 7990216 - DNA, 22 bp, Homo sapiens
actcagaatgactgatgctgtg

SEQ ID NO: 7990217 - DNA, 22 bp, Homo sapiens
actcagaatgactgatgctgtg

SEQ ID NO: 7990218 - DNA, 22 bp, Homo sapiens
actcagaatgtcactgagggac

SEQ ID NO: 7990219 - DNA, 22 bp, Homo sapiens
actcagacagaccaaagttctg

SEQ ID NO: 7990220 - DNA, 22 bp, Homo sapiens
actcagaagatataatgactca

SEQ ID NO: 7990221 - DNA, 22 bp, Homo sapiens
actcagaagatataatgactca

SEQ ID NO: 7990222 - DNA, 22 bp, Homo sapiens
actcagaaccatttactctgag

SEQ ID NO: 7990223 - DNA, 22 bp, Homo sapiens
actcagaaccatttactctgag

SEQ ID NO: 7990224 - DNA, 22 bp, Homo sapiens
actcacttcttttactataaaa

SEQ ID NO: 7990225 - DNA, 23 bp, Homo sapiens
actccccagtctcttcttgccaa

SEQ ID NO: 7990226 - DNA, 22 bp, Homo sapiens
actccctcaagtcactttagtt

SEQ ID NO: 7990227 - DNA, 22 bp, Homo sapiens
actccctccaaatctgcacagt

SEQ ID NO: 7990228 - DNA, 22 bp, Homo sapiens
actccctccaaatctgcacagt

SEQ ID NO: 7990229 - DNA, 22 bp, Homo sapiens
actccctccaaatctgcacagt

SEQ ID NO: 7990230 - DNA, 22 bp, Homo sapiens
actctaaattgtgccaatatgc

SEQ ID NO: 7990231 - DNA, 20 bp, Homo sapiens
actctaccagggcagcagca

SEQ ID NO: 7990232 - DNA, 22 bp, Homo sapiens
actctaatctttgtcttttgtg

SEQ ID NO: 7990233 - DNA, 23 bp, Homo sapiens
actctaatgacaagtgtcttcat

SEQ ID NO: 7990234 - DNA, 22 bp, Homo sapiens
actctaatgctaatagtatttt

SEQ ID NO: 7990235 - DNA, 19 bp, Homo sapiens
actctacagtgtgtacaac

SEQ ID NO: 7990236 - DNA, 22 bp, Homo sapiens
actcagagaatatctagaagga

SEQ ID NO: 7990237 - DNA, 22 bp, Homo sapiens
actcagagaatatctagaagga

SEQ ID NO: 7990238 - DNA, 22 bp, Homo sapiens
actcagagaatatctagaagga

SEQ ID NO: 7990239 - DNA, 23 bp, Homo sapiens
actcagagaccccgggaagtgac

SEQ ID NO: 7990240 - DNA, 23 bp, Homo sapiens
actccccagtctcttcttgccaa

SEQ ID NO: 7990241 - DNA, 23 bp, Homo sapiens
actcagagaccccgggaagtgac

SEQ ID NO: 7990242 - DNA, 22 bp, Homo sapiens
actcagagaaacagcagggtgt

SEQ ID NO: 7990243 - DNA, 22 bp, Homo sapiens
actcagacttgcttcctggtgc

SEQ ID NO: 7990244 - DNA, 22 bp, Homo sapiens
actcagagaaacagcagggtgt

SEQ ID NO: 7990245 - DNA, 22 bp, Homo sapiens
actcagagaaacagcagggtgt

SEQ ID NO: 7990246 - DNA, 22 bp, Homo sapiens
actcagacatgccttttacttc

SEQ ID NO: 7990247 - DNA, 22 bp, Homo sapiens
actcagacagaccaaagttctg

SEQ ID NO: 7990248 - DNA, 22 bp, Homo sapiens
actcagactataagcttatttt

SEQ ID NO: 7990249 - DNA, 22 bp, Homo sapiens
actcagacgaaaacatgaacat

SEQ ID NO: 7990250 - DNA, 22 bp, Homo sapiens
actctcagggctccagggaaag

SEQ ID NO: 7990251 - DNA, 23 bp, Homo sapiens
actctcaggttctttccagcagg

SEQ ID NO: 7990252 - DNA, 22 bp, Homo sapiens
actctcagggacagggtctggg

SEQ ID NO: 7990253 - DNA, 22 bp, Homo sapiens
actctcagggacagggtctggg

SEQ ID NO: 7990254 - DNA, 22 bp, Homo sapiens
actctcaaatattaatctttgg

SEQ ID NO: 7990255 - DNA, 22 bp, Homo sapiens
actctattgctgcttgatgtga

SEQ ID NO: 7990256 - DNA, 22 bp, Homo sapiens
actctccctgagagggaggcat

SEQ ID NO: 7990257 - DNA, 22 bp, Homo sapiens
actctcccagctatatgtggtg

SEQ ID NO: 7990258 - DNA, 22 bp, Homo sapiens
actctcccagctatatgtggtg

SEQ ID NO: 7990259 - DNA, 22 bp, Homo sapiens
actctcccacgttcgactctaa

SEQ ID NO: 7990260 - DNA, 22 bp, Homo sapiens
actctcccacgttcgactctaa

SEQ ID NO: 7990261 - DNA, 22 bp, Homo sapiens
actctcccacgttcgactctaa

SEQ ID NO: 7990262 - DNA, 22 bp, Homo sapiens
actctccctgctatccacttcc

SEQ ID NO: 7990263 - DNA, 22 bp, Homo sapiens
actctccctgagagggaggcat

SEQ ID NO: 7990264 - DNA, 22 bp, Homo sapiens
actctccctgagagggaggcat

SEQ ID NO: 7990265 - DNA, 22 bp, Homo sapiens
actctccctgctatccacttcc

SEQ ID NO: 7990266 - DNA, 22 bp, Homo sapiens
actctccctgctatccacttcc

SEQ ID NO: 7990267 - DNA, 22 bp, Homo sapiens
actctccctgctatccacttcc

SEQ ID NO: 7990268 - DNA, 22 bp, Homo sapiens
actctccctgctatccacttcc

SEQ ID NO: 7990269 - DNA, 22 bp, Homo sapiens
actgagttatgggtatgccttg

SEQ ID NO: 7990270 - DNA, 22 bp, Homo sapiens
actgagtgggaggtttgtgtga

SEQ ID NO: 7990271 - DNA, 22 bp, Homo sapiens
actgatacggttttagagtcca

SEQ ID NO: 7990272 - DNA, 22 bp, Homo sapiens
actgatattaaacacaatttaa

SEQ ID NO: 7990273 - DNA, 22 bp, Homo sapiens
actgatcaagggtttaatttta

SEQ ID NO: 7990274 - DNA, 22 bp, Homo sapiens
actgatattaaacacaatttaa

SEQ ID NO: 7990275 - DNA, 22 bp, Homo sapiens
actgatcacagatatgtatatt

SEQ ID NO: 7990276 - DNA, 22 bp, Homo sapiens
actgcactccaacctgggtgac

SEQ ID NO: 7990277 - DNA, 22 bp, Homo sapiens
actgcactccaacctgggtgac

SEQ ID NO: 7990278 - DNA, 22 bp, Homo sapiens
actgaggttgtagtaggaattc

SEQ ID NO: 7990279 - DNA, 22 bp, Homo sapiens
actgaggttgaaatagtgatgt

SEQ ID NO: 7990280 - DNA, 22 bp, Homo sapiens
actgaggttgaaatagtgatgt

SEQ ID NO: 7990281 - DNA, 21 bp, Homo sapiens
actgaggttagatgccttgcc

SEQ ID NO: 7990282 - DNA, 20 bp, Homo sapiens
actgaggttagataacaggt

SEQ ID NO: 7990283 - DNA, 22 bp, Homo sapiens
actgaggttattgcaataaaat

SEQ ID NO: 7990284 - DNA, 22 bp, Homo sapiens
actgaggtttcattttatcgct

SEQ ID NO: 7990285 - DNA, 22 bp, Homo sapiens
actgaggtttacttgaaggaga

SEQ ID NO: 7990286 - DNA, 22 bp, Homo sapiens
actgaggtttttagtgttaaat

SEQ ID NO: 7990287 - DNA, 22 bp, Homo sapiens
actgagtgggaggtttgtgtga

SEQ ID NO: 7990288 - DNA, 22 bp, Homo sapiens
actgagtatcacttcttatttt

SEQ ID NO: 7990289 - DNA, 22 bp, Homo sapiens
actgagtggctggggagtggca

SEQ ID NO: 7990290 - DNA, 22 bp, Homo sapiens
actgcactccagcctgggtaac

SEQ ID NO: 7990291 - DNA, 22 bp, Homo sapiens
actgcactccagcctgggtaac

SEQ ID NO: 7990292 - DNA, 22 bp, Homo sapiens
actgcactccagcctgggtaac

SEQ ID NO: 7990293 - DNA, 22 bp, Homo sapiens
actgcactccagcctgggtaac

SEQ ID NO: 7990294 - DNA, 22 bp, Homo sapiens
actgcactccagcctcggggtc

SEQ ID NO: 7990295 - DNA, 19 bp, Homo sapiens
actgcactccagcctgggt

SEQ ID NO: 7990296 - DNA, 22 bp, Homo sapiens
actgcactccagcctgggtaac

SEQ ID NO: 7990297 - DNA, 22 bp, Homo sapiens
actgcactccagcctgggtaac

SEQ ID NO: 7990298 - DNA, 22 bp, Homo sapiens
actgcactccagcctgggtgac

SEQ ID NO: 7990299 - DNA, 22 bp, Homo sapiens
actgcactccagcctgggtaac

SEQ ID NO: 7990300 - DNA, 22 bp, Homo sapiens
actgcactccagcctgggtaac

SEQ ID NO: 7990301 - DNA, 22 bp, Homo sapiens
actgcactccagcctgggtaac

SEQ ID NO: 7990302 - DNA, 22 bp, Homo sapiens
actgcactccagcctgggtaac

SEQ ID NO: 7990303 - DNA, 22 bp, Homo sapiens
actgcactccagcctgggtaac

SEQ ID NO: 7990304 - DNA, 22 bp, Homo sapiens
actgcactccagcctcggggtc

SEQ ID NO: 7990305 - DNA, 22 bp, Homo sapiens
actgcactccagcccgagcaac

SEQ ID NO: 7990306 - DNA, 22 bp, Homo sapiens
actgcactccagcccgagcaac

SEQ ID NO: 7990307 - DNA, 22 bp, Homo sapiens
actgcactccagcctcggggtc

SEQ ID NO: 7990308 - DNA, 22 bp, Homo sapiens
actgcactccagcctcggggtc

SEQ ID NO: 7990309 - DNA, 22 bp, Homo sapiens
actgcactccaacctgggtgac

SEQ ID NO: 7990310 - DNA, 22 bp, Homo sapiens
actgcactccaacctgggtgac

SEQ ID NO: 7990311 - DNA, 22 bp, Homo sapiens
actgcactccaacctgggtgac

SEQ ID NO: 7990312 - DNA, 22 bp, Homo sapiens
actgcactccaacctgggtgac

SEQ ID NO: 7990313 - DNA, 22 bp, Homo sapiens
actgcactccaacctgggtgac

SEQ ID NO: 7990314 - DNA, 22 bp, Homo sapiens
actgcactccaacctgggtgac

SEQ ID NO: 7990315 - DNA, 22 bp, Homo sapiens
actgcactccaacctgggtgac

SEQ ID NO: 7990316 - DNA, 22 bp, Homo sapiens
actgcactccaacctgggtgac

SEQ ID NO: 7990317 - DNA, 22 bp, Homo sapiens
actgcactccaacctgggtgac

SEQ ID NO: 7990318 - DNA, 22 bp, Homo sapiens
actgcactccaacctgggtgac

SEQ ID NO: 7990319 - DNA, 22 bp, Homo sapiens
actctggagatggatgtcagga

SEQ ID NO: 7990320 - DNA, 22 bp, Homo sapiens
actctggcaagcttccacttcc

SEQ ID NO: 7990321 - DNA, 22 bp, Homo sapiens
actctggcaagcttccacttcc

SEQ ID NO: 7990322 - DNA, 22 bp, Homo sapiens
actctggccaggtgcggtatgt

SEQ ID NO: 7990323 - DNA, 22 bp, Homo sapiens
actctggcagcagaaccagtgt

SEQ ID NO: 7990324 - DNA, 22 bp, Homo sapiens
actctggcagcagaaccagtgt

SEQ ID NO: 7990325 - DNA, 22 bp, Homo sapiens
actctggcagcagaaccagtgt

SEQ ID NO: 7990326 - DNA, 22 bp, Homo sapiens
actctggcactgggtacctcag

SEQ ID NO: 7990327 - DNA, 22 bp, Homo sapiens
actctggcactgggtacctcag

SEQ ID NO: 7990328 - DNA, 22 bp, Homo sapiens
actctggcaagcttccacttcc

SEQ ID NO: 7990329 - DNA, 22 bp, Homo sapiens
actctggcactgggtacctcag

SEQ ID NO: 7990330 - DNA, 22 bp, Homo sapiens
actctgcttaattaaaaccagg

SEQ ID NO: 7990331 - DNA, 22 bp, Homo sapiens
actctgcttattgctgcaggca

SEQ ID NO: 7990332 - DNA, 22 bp, Homo sapiens
actctgcttgcccaatggaaac

SEQ ID NO: 7990333 - DNA, 22 bp, Homo sapiens
actctgcttgggccatatctgg

SEQ ID NO: 7990334 - DNA, 22 bp, Homo sapiens
actctgctgtttactctctata

SEQ ID NO: 7990335 - DNA, 22 bp, Homo sapiens
actctgctgtttactctctata

SEQ ID NO: 7990336 - DNA, 22 bp, Homo sapiens
actctgctgataggtcctcaga

SEQ ID NO: 7990337 - DNA, 22 bp, Homo sapiens
actctcccttatctaactttac

SEQ ID NO: 7990338 - DNA, 17 bp, Homo sapiens
actctgctgaagtagaa

SEQ ID NO: 7990339 - DNA, 22 bp, Homo sapiens
actctgctctgtatttcactgt

SEQ ID NO: 7990340 - DNA, 22 bp, Homo sapiens
actctggccatcttggaccttg

SEQ ID NO: 7990341 - DNA, 22 bp, Homo sapiens
actctggccatcttggaccttg

SEQ ID NO: 7990342 - DNA, 22 bp, Homo sapiens
actctggccaggtgcggtatgt

SEQ ID NO: 7990343 - DNA, 22 bp, Homo sapiens
actctggccaggtgcggtatgt

SEQ ID NO: 7990344 - DNA, 22 bp, Homo sapiens
actctggccatcttggaccttg

SEQ ID NO: 7990345 - DNA, 22 bp, Homo sapiens
actctggccccaggatctgtgt

SEQ ID NO: 7990346 - DNA, 22 bp, Homo sapiens
actctggccatcttggaccttg

SEQ ID NO: 7990347 - DNA, 22 bp, Homo sapiens
actctggccccaggatctgtgt

SEQ ID NO: 7990348 - DNA, 22 bp, Homo sapiens
actctggccctcctgctgccag

SEQ ID NO: 7990349 - DNA, 22 bp, Homo sapiens
actctggccccaggatctgtgt

SEQ ID NO: 7990350 - DNA, 22 bp, Homo sapiens
actctggccctcctgctgccag

SEQ ID NO: 7990351 - DNA, 22 bp, Homo sapiens
actctggcgggcgggcgagcca

SEQ ID NO: 7990352 - DNA, 22 bp, Homo sapiens
actctggccctcctgctgccag

SEQ ID NO: 7990353 - DNA, 22 bp, Homo sapiens
actctggctattcactataata

SEQ ID NO: 7990354 - DNA, 22 bp, Homo sapiens
actctggctgccttgtgagcat

SEQ ID NO: 7990355 - DNA, 22 bp, Homo sapiens
actctggctattcactataata

SEQ ID NO: 7990356 - DNA, 22 bp, Homo sapiens
actctggctattcactataata

SEQ ID NO: 7990357 - DNA, 22 bp, Homo sapiens
actctggcgggcgggcgagcca

SEQ ID NO: 7990358 - DNA, 22 bp, Homo sapiens
actctggcgggcgggcgagcca

SEQ ID NO: 7990359 - DNA, 22 bp, Homo sapiens
actctggcgggcgggcgagcca

SEQ ID NO: 7990360 - DNA, 22 bp, Homo sapiens
actgagagaacgggctgctccc

SEQ ID NO: 7990361 - DNA, 22 bp, Homo sapiens
actgagagaacgggctgctccc

SEQ ID NO: 7990362 - DNA, 22 bp, Homo sapiens
actctggctgccttgtgagcat

SEQ ID NO: 7990363 - DNA, 22 bp, Homo sapiens
actgaggtggggtctgcttgga

SEQ ID NO: 7990364 - DNA, 22 bp, Homo sapiens
actgaggtctcaggtggggaag

SEQ ID NO: 7990365 - DNA, 22 bp, Homo sapiens
actgaggtcatgcatagtttct

SEQ ID NO: 7990366 - DNA, 22 bp, Homo sapiens
actgaggtcaggggtatgtgat

SEQ ID NO: 7990367 - DNA, 22 bp, Homo sapiens
actgaggtctatcatgagccag

SEQ ID NO: 7990368 - DNA, 22 bp, Homo sapiens
actgaggtctatcatgagccag

SEQ ID NO: 7990369 - DNA, 22 bp, Homo sapiens
actgagagaagggattttaagt

SEQ ID NO: 7990370 - DNA, 22 bp, Homo sapiens
actgagagagctgggtatctcc

SEQ ID NO: 7990371 - DNA, 23 bp, Homo sapiens
actgaggtactgaggttgtgaca

SEQ ID NO: 7990372 - DNA, 22 bp, Homo sapiens
actgaggtataattgacataac

SEQ ID NO: 7990373 - DNA, 22 bp, Homo sapiens
actgaggtagggcacacctagg

SEQ ID NO: 7990374 - DNA, 22 bp, Homo sapiens
actgcactccagcctgggtgac

SEQ ID NO: 7990375 - DNA, 22 bp, Homo sapiens
actgcactccagcctgggtgac

SEQ ID NO: 7990376 - DNA, 22 bp, Homo sapiens
actgcactccagcctgggtgac

SEQ ID NO: 7990377 - DNA, 22 bp, Homo sapiens
actgcactccagcctgggtgac

SEQ ID NO: 7990378 - DNA, 22 bp, Homo sapiens
actgcactccagcctgggtaac

SEQ ID NO: 7990379 - DNA, 22 bp, Homo sapiens
actgcactccagcctgggtgac

SEQ ID NO: 7990380 - DNA, 22 bp, Homo sapiens
actgcactccagcctgggtgac

SEQ ID NO: 7990381 - DNA, 22 bp, Homo sapiens
actgcactccagcctgggtgac

SEQ ID NO: 7990382 - DNA, 22 bp, Homo sapiens
actgcgtggggagctgtgacta

SEQ ID NO: 7990383 - DNA, 22 bp, Homo sapiens
actgcgtggggagctgtgacta

SEQ ID NO: 7990384 - DNA, 22 bp, Homo sapiens
actgcgtggggagctgtgacta

SEQ ID NO: 7990385 - DNA, 22 bp, Homo sapiens
actgcactccagcctgggtgac

SEQ ID NO: 7990386 - DNA, 22 bp, Homo sapiens
actgcgggaacccgcggccggc

SEQ ID NO: 7990387 - DNA, 22 bp, Homo sapiens
actgcgggaacccgcggccggc

SEQ ID NO: 7990388 - DNA, 22 bp, Homo sapiens
actgctagtgagaaaataacca

SEQ ID NO: 7990389 - DNA, 22 bp, Homo sapiens
actggacagaggaaatatggag

SEQ ID NO: 7990390 - DNA, 22 bp, Homo sapiens
actggacagaggaaatatggag

SEQ ID NO: 7990391 - DNA, 23 bp, Homo sapiens
actggacagagtggacgaggctg

SEQ ID NO: 7990392 - DNA, 22 bp, Homo sapiens
actggacagaggaaatatggag

SEQ ID NO: 7990393 - DNA, 22 bp, Homo sapiens
actggacatttctagaaagcag

SEQ ID NO: 7990394 - DNA, 22 bp, Homo sapiens
actggactcacgtattcctgag

SEQ ID NO: 7990395 - DNA, 22 bp, Homo sapiens
actggactcacgtattcctgag

SEQ ID NO: 7990396 - DNA, 18 bp, Homo sapiens
actggagcattagcagct

SEQ ID NO: 7990397 - DNA, 18 bp, Homo sapiens
actggagcattagcagct

SEQ ID NO: 7990398 - DNA, 22 bp, Homo sapiens
actggagactgtgtcttttgat

SEQ ID NO: 7990399 - DNA, 22 bp, Homo sapiens
actggagactgtgtcttttgat

SEQ ID NO: 7990400 - DNA, 19 bp, Homo sapiens
actggagcctgatggagga

SEQ ID NO: 7990401 - DNA, 22 bp, Homo sapiens
actggagcccgtggaggcgcag

SEQ ID NO: 7990402 - DNA, 20 bp, Homo sapiens
actggagccatctcagccta

SEQ ID NO: 7990403 - DNA, 22 bp, Homo sapiens
actggagtccagacccaagagg

SEQ ID NO: 7990404 - DNA, 22 bp, Homo sapiens
actggagtagatctgactgagt

SEQ ID NO: 7990405 - DNA, 20 bp, Homo sapiens
actggagtaccctagagaag

SEQ ID NO: 7990406 - DNA, 20 bp, Homo sapiens
actggagtaccctagagaag

SEQ ID NO: 7990407 - DNA, 20 bp, Homo sapiens
actggagtaccctagagaag

SEQ ID NO: 7990408 - DNA, 22 bp, Homo sapiens
actggagtgtttggaggatgca

SEQ ID NO: 7990409 - DNA, 22 bp, Homo sapiens
actggagtgagtatcgatgaac

SEQ ID NO: 7990410 - DNA, 22 bp, Homo sapiens
actggagtgtttggaggatgca

SEQ ID NO: 7990411 - DNA, 22 bp, Homo sapiens
actggagtaaaggtcacttgtg

SEQ ID NO: 7990412 - DNA, 22 bp, Homo sapiens
actggagtaaaggtcacttgtg

SEQ ID NO: 7990413 - DNA, 22 bp, Homo sapiens
actggaggggaaaatggtagta

SEQ ID NO: 7990414 - DNA, 22 bp, Homo sapiens
actggaggggaaaatggtagta

SEQ ID NO: 7990415 - DNA, 22 bp, Homo sapiens
actggaggggaaaatggtagta

SEQ ID NO: 7990416 - DNA, 22 bp, Homo sapiens
actggaggattcctggaaggcg

SEQ ID NO: 7990417 - DNA, 22 bp, Homo sapiens
actggaggattcctggaaggcg

SEQ ID NO: 7990418 - DNA, 22 bp, Homo sapiens
actggaggattcctggaaggcg

SEQ ID NO: 7990419 - DNA, 22 bp, Homo sapiens
actggaggcccctcccagtgaa

SEQ ID NO: 7990420 - DNA, 22 bp, Homo sapiens
actggagcttctaaggaggagt

SEQ ID NO: 7990421 - DNA, 22 bp, Homo sapiens
actggctgaggaagttgccact

SEQ ID NO: 7990422 - DNA, 22 bp, Homo sapiens
actggctgaggaagttgccact

SEQ ID NO: 7990423 - DNA, 22 bp, Homo sapiens
actggctgaggaagttgccact

SEQ ID NO: 7990424 - DNA, 22 bp, Homo sapiens
aatacagagaatgttatttgga

SEQ ID NO: 7990425 - DNA, 22 bp, Homo sapiens
actggctgagttgcttcagcaa

SEQ ID NO: 7990426 - DNA, 22 bp, Homo sapiens
aatacagaggaaacatttaata

SEQ ID NO: 7990427 - DNA, 22 bp, Homo sapiens
aataccacctcattctggaggc

SEQ ID NO: 7990428 - DNA, 22 bp, Homo sapiens
aatacagaggcttccagtaaaa

SEQ ID NO: 7990429 - DNA, 22 bp, Homo sapiens
aataccttgctgtagccacgca

SEQ ID NO: 7990430 - DNA, 22 bp, Homo sapiens
aatacctttcctgccattcact

SEQ ID NO: 7990431 - DNA, 22 bp, Homo sapiens
aataccttgctgtagccacgca

SEQ ID NO: 7990432 - DNA, 22 bp, Homo sapiens
aataccttgctcatagggctga

SEQ ID NO: 7990433 - DNA, 22 bp, Homo sapiens
aataccttgctcatagggctga

SEQ ID NO: 7990434 - DNA, 22 bp, Homo sapiens
aatacctttcctgccattcact

SEQ ID NO: 7990435 - DNA, 22 bp, Homo sapiens
aataccttttcagtgcacaaaa

SEQ ID NO: 7990436 - DNA, 20 bp, Homo sapiens
aatactaaacacaaagcagt

SEQ ID NO: 7990437 - DNA, 20 bp, Homo sapiens
aatactaaacacaaagcagt

SEQ ID NO: 7990438 - DNA, 22 bp, Homo sapiens
aataccttccaacatcaagaca

SEQ ID NO: 7990439 - DNA, 22 bp, Homo sapiens
aataccttccacagtgaccttg

SEQ ID NO: 7990440 - DNA, 22 bp, Homo sapiens
aataccttccaacatcaagaca

SEQ ID NO: 7990441 - DNA, 22 bp, Homo sapiens
aataccttccaacatcaagaca

SEQ ID NO: 7990442 - DNA, 22 bp, Homo sapiens
aataccatgcagaaataacata

SEQ ID NO: 7990443 - DNA, 22 bp, Homo sapiens
aataccagagacagtgtttacc

SEQ ID NO: 7990444 - DNA, 22 bp, Homo sapiens
actggctgaaagtaaagaacac

SEQ ID NO: 7990445 - DNA, 22 bp, Homo sapiens
actggctctctacatttgccag

SEQ ID NO: 7990446 - DNA, 22 bp, Homo sapiens
actggcctatcagcatgagtct

SEQ ID NO: 7990447 - DNA, 22 bp, Homo sapiens
actggcctatcagcatgagtct

SEQ ID NO: 7990448 - DNA, 22 bp, Homo sapiens
actggcccttgattgcatcagc

SEQ ID NO: 7990449 - DNA, 22 bp, Homo sapiens
actggcctatcagcatgagtct

SEQ ID NO: 7990450 - DNA, 22 bp, Homo sapiens
actggccttgggtaaagcccct

SEQ ID NO: 7990451 - DNA, 22 bp, Homo sapiens
actggcccgggagcagaggcct

SEQ ID NO: 7990452 - DNA, 21 bp, Homo sapiens
actggccctgccttacaaata

SEQ ID NO: 7990453 - DNA, 21 bp, Homo sapiens
actggccctgccttacaaata

SEQ ID NO: 7990454 - DNA, 22 bp, Homo sapiens
actggccctggctgctaggctg

SEQ ID NO: 7990455 - DNA, 22 bp, Homo sapiens
actggcccttgattgcatcagc

SEQ ID NO: 7990456 - DNA, 22 bp, Homo sapiens
actggccctggctgctaggctg

SEQ ID NO: 7990457 - DNA, 22 bp, Homo sapiens
actggccaggttcaaaatacag

SEQ ID NO: 7990458 - DNA, 22 bp, Homo sapiens
actggcccgggagcagaggcct

SEQ ID NO: 7990459 - DNA, 22 bp, Homo sapiens
actggcccgggagcagaggcct

SEQ ID NO: 7990460 - DNA, 22 bp, Homo sapiens
actggcccgggagcagaggcct

SEQ ID NO: 7990461 - DNA, 22 bp, Homo sapiens
actggccaggcagcagtagctt

SEQ ID NO: 7990462 - DNA, 22 bp, Homo sapiens
actggccaggcgaaccacactg

SEQ ID NO: 7990463 - DNA, 22 bp, Homo sapiens
actggccaggagctggaaatac

SEQ ID NO: 7990464 - DNA, 22 bp, Homo sapiens
actggccaggcacagctgtggg

SEQ ID NO: 7990465 - DNA, 22 bp, Homo sapiens
aatcagagccctctgagcttca

SEQ ID NO: 7990466 - DNA, 22 bp, Homo sapiens
aatcagagaagtttcctatgcc

SEQ ID NO: 7990467 - DNA, 22 bp, Homo sapiens
aatcagagcaagacatggaaca

SEQ ID NO: 7990468 - DNA, 22 bp, Homo sapiens
aatcagactattaaagtctctt

SEQ ID NO: 7990469 - DNA, 22 bp, Homo sapiens
aatcagagtcccaagatctgta

SEQ ID NO: 7990470 - DNA, 22 bp, Homo sapiens
aatcagatgaatcaatatatcc

SEQ ID NO: 7990471 - DNA, 22 bp, Homo sapiens
aatcagaggaagtcaacggatc

SEQ ID NO: 7990472 - DNA, 21 bp, Homo sapiens
aatcagaggcttcctagttgg

SEQ ID NO: 7990473 - DNA, 22 bp, Homo sapiens
aatcagcaaaggtcagctctaa

SEQ ID NO: 7990474 - DNA, 22 bp, Homo sapiens
aatcagaacttctcagggtggg

SEQ ID NO: 7990475 - DNA, 22 bp, Homo sapiens
aatcagaacttctcagggtggg

SEQ ID NO: 7990476 - DNA, 22 bp, Homo sapiens
aatcagaacttctcagggtggg

SEQ ID NO: 7990477 - DNA, 22 bp, Homo sapiens
aatcagaaattgagggtctggt

SEQ ID NO: 7990478 - DNA, 22 bp, Homo sapiens
aatcagaaccttgggtcataac

SEQ ID NO: 7990479 - DNA, 22 bp, Homo sapiens
aatcagaacgctcgatcttcgg

SEQ ID NO: 7990480 - DNA, 22 bp, Homo sapiens
aatcagaatttattgaatcttt

SEQ ID NO: 7990481 - DNA, 22 bp, Homo sapiens
aatcagaatttattgaatcttt

SEQ ID NO: 7990482 - DNA, 22 bp, Homo sapiens
aatcagaatttattgaatcttt

SEQ ID NO: 7990483 - DNA, 22 bp, Homo sapiens
aatcagcaaatgcttactcagg

SEQ ID NO: 7990484 - DNA, 22 bp, Homo sapiens
aatcagcaaatgcttactcagg

SEQ ID NO: 7990485 - DNA, 22 bp, Homo sapiens
aatcagcaaatgcttactcagg

SEQ ID NO: 7990486 - DNA, 22 bp, Homo sapiens
aatcagcaaatgcttactcagg

SEQ ID NO: 7990487 - DNA, 22 bp, Homo sapiens
aatcagcagaagagaggtctta

SEQ ID NO: 7990488 - DNA, 22 bp, Homo sapiens
aatcagcaggcttctaaatttt

SEQ ID NO: 7990489 - DNA, 22 bp, Homo sapiens
aatcagcaaatgcttactcagg

SEQ ID NO: 7990490 - DNA, 22 bp, Homo sapiens
aatcagcaggcttctaaatttt

SEQ ID NO: 7990491 - DNA, 22 bp, Homo sapiens
aatcagcagttggaattagata

SEQ ID NO: 7990492 - DNA, 22 bp, Homo sapiens
aatcagcagttggaattagata

SEQ ID NO: 7990493 - DNA, 22 bp, Homo sapiens
aatcaggaaactatcaacacat

SEQ ID NO: 7990494 - DNA, 22 bp, Homo sapiens
aatcagctttgaaagagggtct

SEQ ID NO: 7990495 - DNA, 22 bp, Homo sapiens
aatcaggaactcaagtgcattg

SEQ ID NO: 7990496 - DNA, 22 bp, Homo sapiens
aatcaggaactcaagtgcattg

SEQ ID NO: 7990497 - DNA, 22 bp, Homo sapiens
aatcagcctgagcacaaggcca

SEQ ID NO: 7990498 - DNA, 23 bp, Homo sapiens
aatcagcatgctctgtggctggc

SEQ ID NO: 7990499 - DNA, 22 bp, Homo sapiens
aatcagccatttttccaaggag

SEQ ID NO: 7990500 - DNA, 22 bp, Homo sapiens
aatcaggagtgtgcactttgat

SEQ ID NO: 7990501 - DNA, 22 bp, Homo sapiens
aatcagctaaataaactagtca

SEQ ID NO: 7990502 - DNA, 22 bp, Homo sapiens
aatcaggacccactctacagtt

SEQ ID NO: 7990503 - DNA, 22 bp, Homo sapiens
aatcaggacccactctacagtt

SEQ ID NO: 7990504 - DNA, 22 bp, Homo sapiens
aatcagttagggtgttaatgag

SEQ ID NO: 7990505 - DNA, 22 bp, Homo sapiens
aatcataattcaaataagctta

SEQ ID NO: 7990506 - DNA, 22 bp, Homo sapiens
aatcataattcaaataagctta

SEQ ID NO: 7990507 - DNA, 22 bp, Homo sapiens
aatcataattcaaataagctta

SEQ ID NO: 7990508 - DNA, 22 bp, Homo sapiens
agaaatactttgtaaatctcac

SEQ ID NO: 7990509 - DNA, 22 bp, Homo sapiens
agaaatactttgtaaatctcac

SEQ ID NO: 7990510 - DNA, 19 bp, Homo sapiens
aatcaggctgaagtgtgtt

SEQ ID NO: 7990511 - DNA, 22 bp, Homo sapiens
aatcagtattggtatagaatga

SEQ ID NO: 7990512 - DNA, 22 bp, Homo sapiens
aatcaggccaagtgaagtggga

SEQ ID NO: 7990513 - DNA, 22 bp, Homo sapiens
aatcaggcacagcgactgcagc

SEQ ID NO: 7990514 - DNA, 22 bp, Homo sapiens
aatcaggcaaggaaaggagtta

SEQ ID NO: 7990515 - DNA, 22 bp, Homo sapiens
aatcagtggttcccagcccagg

SEQ ID NO: 7990516 - DNA, 23 bp, Homo sapiens
aatcagtgcagttttatgccaag

SEQ ID NO: 7990517 - DNA, 22 bp, Homo sapiens
aatcagtgtggtgacttgtctg

SEQ ID NO: 7990518 - DNA, 22 bp, Homo sapiens
aatcagtattggtatagaatga

SEQ ID NO: 7990519 - DNA, 22 bp, Homo sapiens
aatcagtctcatttagcaggga

SEQ ID NO: 7990520 - DNA, 22 bp, Homo sapiens
aatcagtgtgtaaagtggctgc

SEQ ID NO: 7990521 - DNA, 21 bp, Homo sapiens
aatcagtgttctcaggggcaa

SEQ ID NO: 7990522 - DNA, 22 bp, Homo sapiens
agaaatctttgaagtgtaatgt

SEQ ID NO: 7990523 - DNA, 22 bp, Homo sapiens
agaaatctttgaagtgtaatgt

SEQ ID NO: 7990524 - DNA, 22 bp, Homo sapiens
agaaatagaggaaaggtttgac

SEQ ID NO: 7990525 - DNA, 22 bp, Homo sapiens
agaaatactttgtaaatctcac

SEQ ID NO: 7990526 - DNA, 22 bp, Homo sapiens
agaaatctttgaagtgtaatgt

SEQ ID NO: 7990527 - DNA, 22 bp, Homo sapiens
agaaatgaaaccaaagcctaga

SEQ ID NO: 7990528 - DNA, 22 bp, Homo sapiens
agaaatgaaaccaaagcctaga

SEQ ID NO: 7990529 - DNA, 22 bp, Homo sapiens
agaaatgaaaccaaagcctaga

SEQ ID NO: 7990530 - DNA, 22 bp, Homo sapiens
agaaatgaaaccaaagcctaga

SEQ ID NO: 7990531 - DNA, 22 bp, Homo sapiens
agaaatgaaaccaaagcctaga

SEQ ID NO: 7990532 - DNA, 22 bp, Homo sapiens
agaaatgaagagagtcaaggtt

SEQ ID NO: 7990533 - DNA, 22 bp, Homo sapiens
agaaatgaagagagtcaaggtt

SEQ ID NO: 7990534 - DNA, 22 bp, Homo sapiens
agaaatgaaaccaaagcctaga

SEQ ID NO: 7990535 - DNA, 22 bp, Homo sapiens
agaaatgaagagagtcaaggtt

SEQ ID NO: 7990536 - DNA, 22 bp, Homo sapiens
agaaatgaagagagtcaaggtt

SEQ ID NO: 7990537 - DNA, 22 bp, Homo sapiens
agaaatgaagcaggagttatta

SEQ ID NO: 7990538 - DNA, 22 bp, Homo sapiens
agaaatgaagcaggagttatta

SEQ ID NO: 7990539 - DNA, 22 bp, Homo sapiens
agaaatgaagcaggagttatta

SEQ ID NO: 7990540 - DNA, 22 bp, Homo sapiens
agaaatgaagcaggagttatta

SEQ ID NO: 7990541 - DNA, 22 bp, Homo sapiens
agaaatgaagcaggagttatta

SEQ ID NO: 7990542 - DNA, 22 bp, Homo sapiens
agaaatgaagcaggagttatta

SEQ ID NO: 7990543 - DNA, 22 bp, Homo sapiens
agaaatgaatatgtagtggtta

SEQ ID NO: 7990544 - DNA, 22 bp, Homo sapiens
agaaatgaatatgtagtggtta

SEQ ID NO: 7990545 - DNA, 22 bp, Homo sapiens
agaaatgaatatgtagtggtta

SEQ ID NO: 7990546 - DNA, 22 bp, Homo sapiens
agaaatgaatatgtagtggtta

SEQ ID NO: 7990547 - DNA, 22 bp, Homo sapiens
agaaatgaagcaggagttatta

SEQ ID NO: 7990548 - DNA, 22 bp, Homo sapiens
agaaatgacaagactgatcagg

SEQ ID NO: 7990549 - DNA, 22 bp, Homo sapiens
agaaatgacaagactgatcagg

SEQ ID NO: 7990550 - DNA, 22 bp, Homo sapiens
agaaatgacaagactgatcagg

SEQ ID NO: 7990551 - DNA, 22 bp, Homo sapiens
agaaatgacaagactgatcagg

SEQ ID NO: 7990552 - DNA, 22 bp, Homo sapiens
agaaatgacaagactgatcagg

SEQ ID NO: 7990553 - DNA, 22 bp, Homo sapiens
agaaatgacaagactgatcagg

SEQ ID NO: 7990554 - DNA, 22 bp, Homo sapiens
agaaatgacaagactgatcagg

SEQ ID NO: 7990555 - DNA, 22 bp, Homo sapiens
aatgatggttaaacactggagg

SEQ ID NO: 7990556 - DNA, 22 bp, Homo sapiens
aatgatgtgagtttttattctc

SEQ ID NO: 7990557 - DNA, 22 bp, Homo sapiens
aatgatgtttttaaagaacata

SEQ ID NO: 7990558 - DNA, 22 bp, Homo sapiens
aatgatgtttttaaagaacata

SEQ ID NO: 7990559 - DNA, 22 bp, Homo sapiens
aatgattactgatcgcatagga

SEQ ID NO: 7990560 - DNA, 22 bp, Homo sapiens
aatgattgaggttatcgcagta

SEQ ID NO: 7990561 - DNA, 23 bp, Homo sapiens
aatgatttcatgatgatagcagc

SEQ ID NO: 7990562 - DNA, 23 bp, Homo sapiens
aatgatttcatgatgatagcagc

SEQ ID NO: 7990563 - DNA, 23 bp, Homo sapiens
aatgatttcatgatgatagcagc

SEQ ID NO: 7990564 - DNA, 22 bp, Homo sapiens
aatgattgtcattccaaaaagt

SEQ ID NO: 7990565 - DNA, 22 bp, Homo sapiens
aatgattgcaaacattgagaac

SEQ ID NO: 7990566 - DNA, 22 bp, Homo sapiens
aatgattggcactagatacaca

SEQ ID NO: 7990567 - DNA, 22 bp, Homo sapiens
aatgatgagttctaatagaccc

SEQ ID NO: 7990568 - DNA, 22 bp, Homo sapiens
aatgatggatttagacaagctg

SEQ ID NO: 7990569 - DNA, 22 bp, Homo sapiens
aatgatgggaaggagaaaagca

SEQ ID NO: 7990570 - DNA, 22 bp, Homo sapiens
aatgatggatttagacaagctg

SEQ ID NO: 7990571 - DNA, 22 bp, Homo sapiens
aatgatgtattagtacaacaca

SEQ ID NO: 7990572 - DNA, 22 bp, Homo sapiens
aatgatgtattagtacaacaca

SEQ ID NO: 7990573 - DNA, 22 bp, Homo sapiens
aatgatggttaaacactggagg

SEQ ID NO: 7990574 - DNA, 22 bp, Homo sapiens
aatgatggtttcatcacttgaa

SEQ ID NO: 7990575 - DNA, 23 bp, Homo sapiens
aatgatttcatgatgatagcagc

SEQ ID NO: 7990576 - DNA, 22 bp, Homo sapiens
aatgatttcccctacacagaag

SEQ ID NO: 7990577 - DNA, 22 bp, Homo sapiens
aatgatttcccctacacagaag

SEQ ID NO: 7990578 - DNA, 22 bp, Homo sapiens
aatgatttcccctacacagaag

SEQ ID NO: 7990579 - DNA, 22 bp, Homo sapiens
aatgatttcccctacacagaag

SEQ ID NO: 7990580 - DNA, 23 bp, Homo sapiens
aatgatttcatgatgatagcagc

SEQ ID NO: 7990581 - DNA, 22 bp, Homo sapiens
aatgatttggcaaaggaatcca

SEQ ID NO: 7990582 - DNA, 22 bp, Homo sapiens
aatgatttggcaaaggaatcca

SEQ ID NO: 7990583 - DNA, 22 bp, Homo sapiens
aatgcaaacagcccagaatcca

SEQ ID NO: 7990584 - DNA, 22 bp, Homo sapiens
aatgcaaacagcccagaatcca

SEQ ID NO: 7990585 - DNA, 22 bp, Homo sapiens
agaagcagaaaagggcactttt

SEQ ID NO: 7990586 - DNA, 22 bp, Homo sapiens
aatgcaaacagcccagaatcca

SEQ ID NO: 7990587 - DNA, 22 bp, Homo sapiens
aatgcaaacagcccagaatcca

SEQ ID NO: 7990588 - DNA, 22 bp, Homo sapiens
aatgcaaacagcccagaatcca

SEQ ID NO: 7990589 - DNA, 22 bp, Homo sapiens
aatgcaaacagcccagaatcca

SEQ ID NO: 7990590 - DNA, 22 bp, Homo sapiens
agaagcagaaactgggcttgtg

SEQ ID NO: 7990591 - DNA, 22 bp, Homo sapiens
agaagcagaaaagggcactttt

SEQ ID NO: 7990592 - DNA, 22 bp, Homo sapiens
agaagcagaaggaagcagggcc

SEQ ID NO: 7990593 - DNA, 22 bp, Homo sapiens
agaagcagaaggaagcagggcc

SEQ ID NO: 7990594 - DNA, 22 bp, Homo sapiens
agaagcagaaactgggcttgtg

SEQ ID NO: 7990595 - DNA, 22 bp, Homo sapiens
agaagcagaaactgggcttgtg

SEQ ID NO: 7990596 - DNA, 22 bp, Homo sapiens
agaagcagaaactgggcttgtg

SEQ ID NO: 7990597 - DNA, 22 bp, Homo sapiens
agaagcagaaggaagcagggcc

SEQ ID NO: 7990598 - DNA, 22 bp, Homo sapiens
agaagcagaaggaagcagggcc

SEQ ID NO: 7990599 - DNA, 22 bp, Homo sapiens
agaagcagaaggaagcagggcc

SEQ ID NO: 7990600 - DNA, 22 bp, Homo sapiens
agaagcagaaggaagcagggcc

SEQ ID NO: 7990601 - DNA, 22 bp, Homo sapiens
agaagcagaaggaagcagggcc

SEQ ID NO: 7990602 - DNA, 22 bp, Homo sapiens
agaagcagaaggaagcagggcc

SEQ ID NO: 7990603 - DNA, 22 bp, Homo sapiens
agaagcagaaggaagcagggcc

SEQ ID NO: 7990604 - DNA, 22 bp, Homo sapiens
agaacaatgttaaattattaag

SEQ ID NO: 7990605 - DNA, 22 bp, Homo sapiens
agaacaatgcgtattttactcc

SEQ ID NO: 7990606 - DNA, 22 bp, Homo sapiens
agaacaatgcgtattttactcc

SEQ ID NO: 7990607 - DNA, 22 bp, Homo sapiens
agaacaattgccccaaagcttg

SEQ ID NO: 7990608 - DNA, 23 bp, Homo sapiens
aatgagttgggcagcatacaggc

SEQ ID NO: 7990609 - DNA, 22 bp, Homo sapiens
aatgatgacaggataaagaaca

SEQ ID NO: 7990610 - DNA, 22 bp, Homo sapiens
agaacaaatcgatggaagcctg

SEQ ID NO: 7990611 - DNA, 22 bp, Homo sapiens
agaacaaatcgatggaagcctg

SEQ ID NO: 7990612 - DNA, 22 bp, Homo sapiens
agaacaaggctgtttccaatgc

SEQ ID NO: 7990613 - DNA, 22 bp, Homo sapiens
agaacaaatcgatggaagcctg

SEQ ID NO: 7990614 - DNA, 20 bp, Homo sapiens
agaacaagtactaaaggaga

SEQ ID NO: 7990615 - DNA, 20 bp, Homo sapiens
agaacaagtactaaaggaga

SEQ ID NO: 7990616 - DNA, 20 bp, Homo sapiens
agaacaagtactaaaggaga

SEQ ID NO: 7990617 - DNA, 20 bp, Homo sapiens
agaacaagtactaaaggaga

SEQ ID NO: 7990618 - DNA, 20 bp, Homo sapiens
agaacaagtactaaaggaga

SEQ ID NO: 7990619 - DNA, 22 bp, Homo sapiens
agaacaaaattagaggagtgca

SEQ ID NO: 7990620 - DNA, 22 bp, Homo sapiens
agaacaaaattagaggagtgca

SEQ ID NO: 7990621 - DNA, 22 bp, Homo sapiens
agaaattgccagaatgtcaggc

SEQ ID NO: 7990622 - DNA, 22 bp, Homo sapiens
agaacaaatcgatggaagcctg

SEQ ID NO: 7990623 - DNA, 22 bp, Homo sapiens
agaacaaatcgatggaagcctg

SEQ ID NO: 7990624 - DNA, 22 bp, Homo sapiens
agaacaaaattagaggagtgca

SEQ ID NO: 7990625 - DNA, 22 bp, Homo sapiens
agaacaaaattagaggagtgca

SEQ ID NO: 7990626 - DNA, 22 bp, Homo sapiens
agaaattcctaaggtacacaag

SEQ ID NO: 7990627 - DNA, 22 bp, Homo sapiens
agaaattcctaaggtacacaag

SEQ ID NO: 7990628 - DNA, 22 bp, Homo sapiens
agaaattcctaaggtacacaag

SEQ ID NO: 7990629 - DNA, 22 bp, Homo sapiens
agaaattctaagcatcaatagc

SEQ ID NO: 7990630 - DNA, 22 bp, Homo sapiens
agaaattctaagcatcaatagc

SEQ ID NO: 7990631 - DNA, 22 bp, Homo sapiens
agaaattctaagcatcaatagc

SEQ ID NO: 7990632 - DNA, 22 bp, Homo sapiens
agaaattcaattctaattagct

SEQ ID NO: 7990633 - DNA, 22 bp, Homo sapiens
agaaattcaattctaattagct

SEQ ID NO: 7990634 - DNA, 22 bp, Homo sapiens
agaaattcaattctaattagct

SEQ ID NO: 7990635 - DNA, 22 bp, Homo sapiens
agaaattattagtgaatagtct

SEQ ID NO: 7990636 - DNA, 22 bp, Homo sapiens
agaaattattagtgaatagtct

SEQ ID NO: 7990637 - DNA, 22 bp, Homo sapiens
agaaattattagtgaatagtct

SEQ ID NO: 7990638 - DNA, 22 bp, Homo sapiens
agaaattattagtgaatagtct

SEQ ID NO: 7990639 - DNA, 22 bp, Homo sapiens
agaaattattagtgaatagtct

SEQ ID NO: 7990640 - DNA, 22 bp, Homo sapiens
agaaattattagtgaatagtct

SEQ ID NO: 7990641 - DNA, 22 bp, Homo sapiens
agaaattattagtgaatagtct

SEQ ID NO: 7990642 - DNA, 22 bp, Homo sapiens
agaaattatgcagtagttttat

SEQ ID NO: 7990643 - DNA, 22 bp, Homo sapiens
agaaattatgcagtagttttat

SEQ ID NO: 7990644 - DNA, 22 bp, Homo sapiens
agaaattatgcagtagttttat

SEQ ID NO: 7990645 - DNA, 22 bp, Homo sapiens
agaaatgacacacatgagacat

SEQ ID NO: 7990646 - DNA, 22 bp, Homo sapiens
agaaatgacacacatgagacat

SEQ ID NO: 7990647 - DNA, 22 bp, Homo sapiens
agaaatgacacacatgagacat

SEQ ID NO: 7990648 - DNA, 22 bp, Homo sapiens
agaaatgacacacatgagacat

SEQ ID NO: 7990649 - DNA, 22 bp, Homo sapiens
agaaatgacacacatgagacat

SEQ ID NO: 7990650 - DNA, 22 bp, Homo sapiens
agaaatgacacacatgagacat

SEQ ID NO: 7990651 - DNA, 22 bp, Homo sapiens
agaaatgacacacatgagacat

SEQ ID NO: 7990652 - DNA, 22 bp, Homo sapiens
agaaatgacacacatgagacat

SEQ ID NO: 7990653 - DNA, 22 bp, Homo sapiens
aatatagttctggtattgttaa

SEQ ID NO: 7990654 - DNA, 22 bp, Homo sapiens
aatatagttctggtattgttaa

SEQ ID NO: 7990655 - DNA, 22 bp, Homo sapiens
aatatagttctggtattgttaa

SEQ ID NO: 7990656 - DNA, 22 bp, Homo sapiens
actgttcacagattagtcgatg

SEQ ID NO: 7990657 - DNA, 22 bp, Homo sapiens
actgttcaagcaaatgacattg

SEQ ID NO: 7990658 - DNA, 22 bp, Homo sapiens
aatatagttctggtattgttaa

SEQ ID NO: 7990659 - DNA, 22 bp, Homo sapiens
aatatagttctagaaatatttt

SEQ ID NO: 7990660 - DNA, 22 bp, Homo sapiens
aatatagttctggtattgttaa

SEQ ID NO: 7990661 - DNA, 22 bp, Homo sapiens
actgttcacccagcactagcag

SEQ ID NO: 7990662 - DNA, 22 bp, Homo sapiens
actgttcatattcttagaaatt

SEQ ID NO: 7990663 - DNA, 22 bp, Homo sapiens
actgttcatattcttagaaatt

SEQ ID NO: 7990664 - DNA, 21 bp, Homo sapiens
actgttcatttgatgaactgg

SEQ ID NO: 7990665 - DNA, 21 bp, Homo sapiens
actgttcatctgttcagaagc

SEQ ID NO: 7990666 - DNA, 22 bp, Homo sapiens
actgttcatctcttagaaagta

SEQ ID NO: 7990667 - DNA, 22 bp, Homo sapiens
aatatagtgttagctcatttga

SEQ ID NO: 7990668 - DNA, 22 bp, Homo sapiens
aatatagtgttagctcatttga

SEQ ID NO: 7990669 - DNA, 22 bp, Homo sapiens
aatatagctcactataccatgg

SEQ ID NO: 7990670 - DNA, 22 bp, Homo sapiens
aatatagtgttagctcatttga

SEQ ID NO: 7990671 - DNA, 22 bp, Homo sapiens
aatatagctcactataccatgg

SEQ ID NO: 7990672 - DNA, 22 bp, Homo sapiens
aatatagctcactataccatgg

SEQ ID NO: 7990673 - DNA, 22 bp, Homo sapiens
aatatagctcactataccatgg

SEQ ID NO: 7990674 - DNA, 22 bp, Homo sapiens
aatatagttctagaaatatttt

SEQ ID NO: 7990675 - DNA, 22 bp, Homo sapiens
aatatagttctagaaatatttt

SEQ ID NO: 7990676 - DNA, 22 bp, Homo sapiens
aatatagttctagaaatatttt

SEQ ID NO: 7990677 - DNA, 22 bp, Homo sapiens
aatatagttctagaaatatttt

SEQ ID NO: 7990678 - DNA, 22 bp, Homo sapiens
aatatagttctagaaatatttt

SEQ ID NO: 7990679 - DNA, 22 bp, Homo sapiens
aatatagttctagaaatatttt

SEQ ID NO: 7990680 - DNA, 22 bp, Homo sapiens
aatatagaatcactttccttca

SEQ ID NO: 7990681 - DNA, 22 bp, Homo sapiens
aatatagatttactcaagagaa

SEQ ID NO: 7990682 - DNA, 22 bp, Homo sapiens
aatatagcattgtatgactgtg

SEQ ID NO: 7990683 - DNA, 22 bp, Homo sapiens
aatatagatttactcaagagaa

SEQ ID NO: 7990684 - DNA, 22 bp, Homo sapiens
aatatagcattgtatgactgtg

SEQ ID NO: 7990685 - DNA, 22 bp, Homo sapiens
aatatactatactactttctgg

SEQ ID NO: 7990686 - DNA, 22 bp, Homo sapiens
aatatactatactactttctgg

SEQ ID NO: 7990687 - DNA, 22 bp, Homo sapiens
aatatagaatcactttccttca

SEQ ID NO: 7990688 - DNA, 22 bp, Homo sapiens
aatatactatactactttctgg

SEQ ID NO: 7990689 - DNA, 22 bp, Homo sapiens
aatatactatactactttctgg

SEQ ID NO: 7990690 - DNA, 22 bp, Homo sapiens
aatatactatactactttctgg

SEQ ID NO: 7990691 - DNA, 22 bp, Homo sapiens
aatataattttattcctagagt

SEQ ID NO: 7990692 - DNA, 22 bp, Homo sapiens
aatataattttattcctagagt

SEQ ID NO: 7990693 - DNA, 22 bp, Homo sapiens
aatataattttattcctagagt

SEQ ID NO: 7990694 - DNA, 22 bp, Homo sapiens
aatagtccttagtaagctgtga

SEQ ID NO: 7990695 - DNA, 22 bp, Homo sapiens
aatagtatttatttggaaaaag

SEQ ID NO: 7990696 - DNA, 19 bp, Homo sapiens
actgggcttgtcctcgtgg

SEQ ID NO: 7990697 - DNA, 22 bp, Homo sapiens
actgggcttcacttggcacatc

SEQ ID NO: 7990698 - DNA, 22 bp, Homo sapiens
actgggcttcacttggcacatc

SEQ ID NO: 7990699 - DNA, 22 bp, Homo sapiens
aatagtacaatctacagacata

SEQ ID NO: 7990700 - DNA, 22 bp, Homo sapiens
aatagtatttatttggaaaaag

SEQ ID NO: 7990701 - DNA, 22 bp, Homo sapiens
aatactgcatacagtttctcat

SEQ ID NO: 7990702 - DNA, 22 bp, Homo sapiens
aatactgcctgtgaggtaactc

SEQ ID NO: 7990703 - DNA, 22 bp, Homo sapiens
aatactgcctgtgaggtaactc

SEQ ID NO: 7990704 - DNA, 22 bp, Homo sapiens
aatactgcctgtgaggtaactc

SEQ ID NO: 7990705 - DNA, 22 bp, Homo sapiens
actgggctgcctggttcttcta

SEQ ID NO: 7990706 - DNA, 22 bp, Homo sapiens
aatactatgttgtgacacatga

SEQ ID NO: 7990707 - DNA, 22 bp, Homo sapiens
aatactatgttgtgacacatga

SEQ ID NO: 7990708 - DNA, 22 bp, Homo sapiens
aatactgagatcccacaaagca

SEQ ID NO: 7990709 - DNA, 22 bp, Homo sapiens
aatactgaattagttgagacaa

SEQ ID NO: 7990710 - DNA, 22 bp, Homo sapiens
aatactgaattagttgagacaa

SEQ ID NO: 7990711 - DNA, 22 bp, Homo sapiens
aatactatgtagccaaaataat

SEQ ID NO: 7990712 - DNA, 22 bp, Homo sapiens
aatactatgtagccaaaataat

SEQ ID NO: 7990713 - DNA, 22 bp, Homo sapiens
aatactatgtagccaaaataat

SEQ ID NO: 7990714 - DNA, 22 bp, Homo sapiens
aatactatgtagccaaaataat

SEQ ID NO: 7990715 - DNA, 22 bp, Homo sapiens
aatactagctgcatttaaaggt

SEQ ID NO: 7990716 - DNA, 22 bp, Homo sapiens
aatactagctgcatttaaaggt

SEQ ID NO: 7990717 - DNA, 20 bp, Homo sapiens
aatactaaacacaaagcagt

SEQ ID NO: 7990718 - DNA, 20 bp, Homo sapiens
aatactaaacacaaagcagt

SEQ ID NO: 7990719 - DNA, 22 bp, Homo sapiens
aatactagttaaatgaatgaat

SEQ ID NO: 7990720 - DNA, 22 bp, Homo sapiens
aatactagttattaaagctttt

SEQ ID NO: 7990721 - DNA, 22 bp, Homo sapiens
aatactagttaaatgaatgaat

SEQ ID NO: 7990722 - DNA, 20 bp, Homo sapiens
aatactaaacacaaagcagt

SEQ ID NO: 7990723 - DNA, 22 bp, Homo sapiens
actgggcttatgctgtggagta

SEQ ID NO: 7990724 - DNA, 22 bp, Homo sapiens
actgggcttatgctgtggagta

SEQ ID NO: 7990725 - DNA, 22 bp, Homo sapiens
actgggcttatttcttgtgaac

SEQ ID NO: 7990726 - DNA, 22 bp, Homo sapiens
actgggcttcacttggcacatc

SEQ ID NO: 7990727 - DNA, 22 bp, Homo sapiens
actgggcttcacttggcacatc

SEQ ID NO: 7990728 - DNA, 22 bp, Homo sapiens
actgggctgttttttgagtgga

SEQ ID NO: 7990729 - DNA, 22 bp, Homo sapiens
actgggctgttttttgagtgga

SEQ ID NO: 7990730 - DNA, 23 bp, Homo sapiens
actgggcttatgaggaggcttgt

SEQ ID NO: 7990731 - DNA, 22 bp, Homo sapiens
actgggctgttttttgagtgga

SEQ ID NO: 7990732 - DNA, 22 bp, Homo sapiens
actgggctgttttttgagtgga

SEQ ID NO: 7990733 - DNA, 23 bp, Homo sapiens
actgggcttatgaggaggcttgt

SEQ ID NO: 7990734 - DNA, 23 bp, Homo sapiens
actgggcttatgaggaggcttgt

SEQ ID NO: 7990735 - DNA, 22 bp, Homo sapiens
actgggcttatgctgtggagta

SEQ ID NO: 7990736 - DNA, 22 bp, Homo sapiens
actgggctgtaaagagaggcaa

SEQ ID NO: 7990737 - DNA, 22 bp, Homo sapiens
actgggctgtaaagagaggcaa

SEQ ID NO: 7990738 - DNA, 22 bp, Homo sapiens
actgggctgtggacacccagcg

SEQ ID NO: 7990739 - DNA, 22 bp, Homo sapiens
actgggctgtaaagagaggcaa

SEQ ID NO: 7990740 - DNA, 22 bp, Homo sapiens
actgggctgttccttatttcta

SEQ ID NO: 7990741 - DNA, 22 bp, Homo sapiens
actgggctgtggacacccagcg

SEQ ID NO: 7990742 - DNA, 22 bp, Homo sapiens
actgggctgtggacacccagcg

SEQ ID NO: 7990743 - DNA, 22 bp, Homo sapiens
actgggctgcttgagtgccttc

SEQ ID NO: 7990744 - DNA, 22 bp, Homo sapiens
actgggctgcttgagtgccttc

SEQ ID NO: 7990745 - DNA, 22 bp, Homo sapiens
actgggctggggctcattctcc

SEQ ID NO: 7990746 - DNA, 22 bp, Homo sapiens
actgggctggttagttttacta

SEQ ID NO: 7990747 - DNA, 22 bp, Homo sapiens
actgggctggggctcattctcc

SEQ ID NO: 7990748 - DNA, 22 bp, Homo sapiens
actgggctgtaaagagaggcaa

SEQ ID NO: 7990749 - DNA, 22 bp, Homo sapiens
actgggctgtaaagagaggcaa

SEQ ID NO: 7990750 - DNA, 22 bp, Homo sapiens
actttatttcctattgcatcca

SEQ ID NO: 7990751 - DNA, 22 bp, Homo sapiens
actttatttcctattgcatcca

SEQ ID NO: 7990752 - DNA, 22 bp, Homo sapiens
actttatttcctattgcatcca

SEQ ID NO: 7990753 - DNA, 22 bp, Homo sapiens
actttatttcctattgcatcca

SEQ ID NO: 7990754 - DNA, 22 bp, Homo sapiens
actttctgtggttaccagggag

SEQ ID NO: 7990755 - DNA, 22 bp, Homo sapiens
actttctgttagatgaatggat

SEQ ID NO: 7990756 - DNA, 22 bp, Homo sapiens
actttctgtggttaccagggag

SEQ ID NO: 7990757 - DNA, 21 bp, Homo sapiens
actttctgtgggttcaagcat

SEQ ID NO: 7990758 - DNA, 21 bp, Homo sapiens
actttctgtgggttcaagcat

SEQ ID NO: 7990759 - DNA, 22 bp, Homo sapiens
actttcttaggctgtataaatg

SEQ ID NO: 7990760 - DNA, 22 bp, Homo sapiens
actttcttaggctgtataaatg

SEQ ID NO: 7990761 - DNA, 22 bp, Homo sapiens
actttcttaggctgtataaatg

SEQ ID NO: 7990762 - DNA, 22 bp, Homo sapiens
actttcttaggctgtataaatg

SEQ ID NO: 7990763 - DNA, 22 bp, Homo sapiens
actttcttcttatgcattaagg

SEQ ID NO: 7990764 - DNA, 22 bp, Homo sapiens
actttcttggtcccatgtttga

SEQ ID NO: 7990765 - DNA, 22 bp, Homo sapiens
actttcttatccatgatctcac

SEQ ID NO: 7990766 - DNA, 22 bp, Homo sapiens
actttcttatccatgatctcac

SEQ ID NO: 7990767 - DNA, 22 bp, Homo sapiens
actttcttatccatgatctcac

SEQ ID NO: 7990768 - DNA, 22 bp, Homo sapiens
actttcttatccatgatctcac

SEQ ID NO: 7990769 - DNA, 22 bp, Homo sapiens
actttcttaggctgtataaatg

SEQ ID NO: 7990770 - DNA, 22 bp, Homo sapiens
actttcttctactacttggaga

SEQ ID NO: 7990771 - DNA, 22 bp, Homo sapiens
actttcttctactacttggaga

SEQ ID NO: 7990772 - DNA, 22 bp, Homo sapiens
actttgaaactaaaattcatta

SEQ ID NO: 7990773 - DNA, 22 bp, Homo sapiens
actttgaaactaaaattcatta

SEQ ID NO: 7990774 - DNA, 22 bp, Homo sapiens
actttgaaactaaaattcatta

SEQ ID NO: 7990775 - DNA, 22 bp, Homo sapiens
aatcacatctcattcaacagcc

SEQ ID NO: 7990776 - DNA, 22 bp, Homo sapiens
actttgaaatgtgtaagagaga

SEQ ID NO: 7990777 - DNA, 22 bp, Homo sapiens
actttgaaatgtgtaagagaga

SEQ ID NO: 7990778 - DNA, 19 bp, Homo sapiens
aatcagaaatatcgaggcc

SEQ ID NO: 7990779 - DNA, 22 bp, Homo sapiens
aatcagaaagatcttgatgaga

SEQ ID NO: 7990780 - DNA, 22 bp, Homo sapiens
aatcacatctcattcaacagcc

SEQ ID NO: 7990781 - DNA, 22 bp, Homo sapiens
aatcacatgaaaactgtgtgtt

SEQ ID NO: 7990782 - DNA, 22 bp, Homo sapiens
aatcagaaagaggtcatgttgc

SEQ ID NO: 7990783 - DNA, 22 bp, Homo sapiens
aatcagaaagaggtcatgttgc

SEQ ID NO: 7990784 - DNA, 22 bp, Homo sapiens
aatcacatctcattcaacagcc

SEQ ID NO: 7990785 - DNA, 23 bp, Homo sapiens
actttattgaccccaggtcagtt

SEQ ID NO: 7990786 - DNA, 23 bp, Homo sapiens
actttattgaccccaggtcagtt

SEQ ID NO: 7990787 - DNA, 23 bp, Homo sapiens
actttattgaccccaggtcagtt

SEQ ID NO: 7990788 - DNA, 23 bp, Homo sapiens
actttattgaccccaggtcagtt

SEQ ID NO: 7990789 - DNA, 23 bp, Homo sapiens
actttattgaccccaggtcagtt

SEQ ID NO: 7990790 - DNA, 22 bp, Homo sapiens
actttatttcctattgcatcca

SEQ ID NO: 7990791 - DNA, 22 bp, Homo sapiens
actttatttcctattgcatcca

SEQ ID NO: 7990792 - DNA, 22 bp, Homo sapiens
actttatttcctattgcatcca

SEQ ID NO: 7990793 - DNA, 22 bp, Homo sapiens
actttatttcctattgcatcca

SEQ ID NO: 7990794 - DNA, 23 bp, Homo sapiens
actttattgaccccaggtcagtt

SEQ ID NO: 7990795 - DNA, 23 bp, Homo sapiens
actttattgaccccaggtcagtt

SEQ ID NO: 7990796 - DNA, 20 bp, Homo sapiens
actttatgagttcaattttg

SEQ ID NO: 7990797 - DNA, 22 bp, Homo sapiens
actttatgtttgatatctatgg

SEQ ID NO: 7990798 - DNA, 23 bp, Homo sapiens
actttattgaccccaggtcagtt

SEQ ID NO: 7990799 - DNA, 23 bp, Homo sapiens
actttattgaccccaggtcagtt

SEQ ID NO: 7990800 - DNA, 22 bp, Homo sapiens
actgttctgccaagatcaacgt

SEQ ID NO: 7990801 - DNA, 22 bp, Homo sapiens
actgttctgccaagatcaacgt

SEQ ID NO: 7990802 - DNA, 22 bp, Homo sapiens
actgttctgcatgctgtgaggg

SEQ ID NO: 7990803 - DNA, 18 bp, Homo sapiens
actgttctctcctgccct

SEQ ID NO: 7990804 - DNA, 19 bp, Homo sapiens
actgttctaacttgcagct

SEQ ID NO: 7990805 - DNA, 22 bp, Homo sapiens
actgttcccagattctcacatt

SEQ ID NO: 7990806 - DNA, 19 bp, Homo sapiens
actgttctaacttgcagct

SEQ ID NO: 7990807 - DNA, 22 bp, Homo sapiens
actgttgaagtgccagcttgat

SEQ ID NO: 7990808 - DNA, 22 bp, Homo sapiens
actgttgaagtgccagcttgat

SEQ ID NO: 7990809 - DNA, 22 bp, Homo sapiens
actttaaaaagagccttctaac

SEQ ID NO: 7990810 - DNA, 22 bp, Homo sapiens
actttaaaaagagccttctaac

SEQ ID NO: 7990811 - DNA, 22 bp, Homo sapiens
actttaaaactgatcatcagag

SEQ ID NO: 7990812 - DNA, 19 bp, Homo sapiens
actgttctgtatgttgatt

SEQ ID NO: 7990813 - DNA, 22 bp, Homo sapiens
actgttcttcatttagcaaaga

SEQ ID NO: 7990814 - DNA, 19 bp, Homo sapiens
actgttctgtatgttgatt

SEQ ID NO: 7990815 - DNA, 22 bp, Homo sapiens
actgttgaagtgccagcttgat

SEQ ID NO: 7990816 - DNA, 22 bp, Homo sapiens
actgttcttgtaacacttaaat

SEQ ID NO: 7990817 - DNA, 22 bp, Homo sapiens
gtggccaccctcggcacacaca

SEQ ID NO: 7990818 - DNA, 22 bp, Homo sapiens
gtggccaccctcggcacacaca

SEQ ID NO: 7990819 - DNA, 22 bp, Homo sapiens
gtggccagaaccaggagaatga

SEQ ID NO: 7990820 - DNA, 22 bp, Homo sapiens
gtggccagaaccaggagaatga

SEQ ID NO: 7990821 - DNA, 22 bp, Homo sapiens
gtggccaccctcggcacacaca

SEQ ID NO: 7990822 - DNA, 22 bp, Homo sapiens
gtggccagaaccaggagaatga

SEQ ID NO: 7990823 - DNA, 22 bp, Homo sapiens
gtggccagaaccaggagaatga

SEQ ID NO: 7990824 - DNA, 22 bp, Homo sapiens
gtggccagaaccaggagaatga

SEQ ID NO: 7990825 - DNA, 22 bp, Homo sapiens
gtggccagaagactgcaatgct

SEQ ID NO: 7990826 - DNA, 22 bp, Homo sapiens
gtggccagaaccaggagaatga

SEQ ID NO: 7990827 - DNA, 22 bp, Homo sapiens
gtggccagaagactgcaatgct

SEQ ID NO: 7990828 - DNA, 22 bp, Homo sapiens
gtggccagaagactgcaatgct

SEQ ID NO: 7990829 - DNA, 22 bp, Homo sapiens
gtggccagaagttaagtggtta

SEQ ID NO: 7990830 - DNA, 22 bp, Homo sapiens
gtggccagaagttaagtggtta

SEQ ID NO: 7990831 - DNA, 22 bp, Homo sapiens
gtggccagaagttaagtggtta

SEQ ID NO: 7990832 - DNA, 22 bp, Homo sapiens
gtggccagaatcttgaggcctt

SEQ ID NO: 7990833 - DNA, 22 bp, Homo sapiens
gtggccagaatcttgaggcctt

SEQ ID NO: 7990834 - DNA, 22 bp, Homo sapiens
gtggccagaatcttgaggcctt

SEQ ID NO: 7990835 - DNA, 22 bp, Homo sapiens
gtggccagaatcttgaggcctt

SEQ ID NO: 7990836 - DNA, 22 bp, Homo sapiens
gtggccagaatcttgaggcctt

SEQ ID NO: 7990837 - DNA, 22 bp, Homo sapiens
gtggccagagattaaatagagt

SEQ ID NO: 7990838 - DNA, 22 bp, Homo sapiens
gtggccagagattaaatagagt

SEQ ID NO: 7990839 - DNA, 22 bp, Homo sapiens
gtggccagaatcttgaggcctt

SEQ ID NO: 7990840 - DNA, 22 bp, Homo sapiens
gtggccagaggtcccatgtgtc

SEQ ID NO: 7990841 - DNA, 22 bp, Homo sapiens
gtggccagaggatttgttcagt

SEQ ID NO: 7990842 - DNA, 22 bp, Homo sapiens
gtggccagaggtcccatgtgtc

SEQ ID NO: 7990843 - DNA, 22 bp, Homo sapiens
gtggccagaggtcccatgtgtc

SEQ ID NO: 7990844 - DNA, 22 bp, Homo sapiens
gtggccagaggtcccatgtgtc

SEQ ID NO: 7990845 - DNA, 22 bp, Homo sapiens
gtggccagaggtcccatgtgtc

SEQ ID NO: 7990846 - DNA, 22 bp, Homo sapiens
gtggccagaggtcccatgtgtc

SEQ ID NO: 7990847 - DNA, 22 bp, Homo sapiens
gtggccagaggatttgttcagt

SEQ ID NO: 7990848 - DNA, 22 bp, Homo sapiens
gtggccagagattaaatagagt

SEQ ID NO: 7990849 - DNA, 22 bp, Homo sapiens
gtggccagaggtcccatgtgtc

SEQ ID NO: 7990850 - DNA, 22 bp, Homo sapiens
gtggccagccagggtgctgatg

SEQ ID NO: 7990851 - DNA, 22 bp, Homo sapiens
gtggccagccagggtgctgatg

SEQ ID NO: 7990852 - DNA, 22 bp, Homo sapiens
gtggccagccagggtgctgatg

SEQ ID NO: 7990853 - DNA, 22 bp, Homo sapiens
gtggccagagtgtcattttatt

SEQ ID NO: 7990854 - DNA, 22 bp, Homo sapiens
gtggccagccagggtgctgatg

SEQ ID NO: 7990855 - DNA, 22 bp, Homo sapiens
gtggccagccagggtgctgatg

SEQ ID NO: 7990856 - DNA, 22 bp, Homo sapiens
gtggccagcaagtgctgcctct

SEQ ID NO: 7990857 - DNA, 22 bp, Homo sapiens
gtggccagcaagtgctgcctct

SEQ ID NO: 7990858 - DNA, 22 bp, Homo sapiens
gtggccagcaagtgctgcctct

SEQ ID NO: 7990859 - DNA, 22 bp, Homo sapiens
gtggccagagtgtcattttatt

SEQ ID NO: 7990860 - DNA, 22 bp, Homo sapiens
gtggccagaggtcccatgtgtc

SEQ ID NO: 7990861 - DNA, 22 bp, Homo sapiens
gtggccagaggtcccatgtgtc

SEQ ID NO: 7990862 - DNA, 22 bp, Homo sapiens
gtggccagcaagtgctgcctct

SEQ ID NO: 7990863 - DNA, 22 bp, Homo sapiens
gtggccagcaagtgctgcctct

SEQ ID NO: 7990864 - DNA, 22 bp, Homo sapiens
gtggccagcaagtgctgcctct

SEQ ID NO: 7990865 - DNA, 18 bp, Homo sapiens
gtggccagcctggtcttg

SEQ ID NO: 7990866 - DNA, 18 bp, Homo sapiens
gtggccagcctggtcttg

SEQ ID NO: 7990867 - DNA, 18 bp, Homo sapiens
gtggccagcctggtcttg

SEQ ID NO: 7990868 - DNA, 18 bp, Homo sapiens
gtggccagcctggtcttg

SEQ ID NO: 7990869 - DNA, 22 bp, Homo sapiens
gtggccagccccatggacagtt

SEQ ID NO: 7990870 - DNA, 18 bp, Homo sapiens
gtggccagcctggtcttg

SEQ ID NO: 7990871 - DNA, 22 bp, Homo sapiens
gtggccagccccatggacagtt

SEQ ID NO: 7990872 - DNA, 22 bp, Homo sapiens
gtggccagccagggtgctgatg

SEQ ID NO: 7990873 - DNA, 22 bp, Homo sapiens
gtggccagccccatggacagtt

SEQ ID NO: 7990874 - DNA, 22 bp, Homo sapiens
gtggccagccccatggacagtt

SEQ ID NO: 7990875 - DNA, 22 bp, Homo sapiens
gtggccagccccatggacagtt

SEQ ID NO: 7990876 - DNA, 22 bp, Homo sapiens
gtggccagccccatggacagtt

SEQ ID NO: 7990877 - DNA, 22 bp, Homo sapiens
gtggccagccagggtgctgatg

SEQ ID NO: 7990878 - DNA, 22 bp, Homo sapiens
gtggccagccccatggacagtt

SEQ ID NO: 7990879 - DNA, 22 bp, Homo sapiens
gtggccagccccatggacagtt

SEQ ID NO: 7990880 - DNA, 22 bp, Homo sapiens
gtggccaggacattgccaggca

SEQ ID NO: 7990881 - DNA, 22 bp, Homo sapiens
gtggccaggagaccttgggcat

SEQ ID NO: 7990882 - DNA, 22 bp, Homo sapiens
gtggccaggagaccttgggcat

SEQ ID NO: 7990883 - DNA, 22 bp, Homo sapiens
gtggccaggacattgccaggca

SEQ ID NO: 7990884 - DNA, 22 bp, Homo sapiens
gtggccaggacattgccaggca

SEQ ID NO: 7990885 - DNA, 22 bp, Homo sapiens
gtggccaggacattgccaggca

SEQ ID NO: 7990886 - DNA, 22 bp, Homo sapiens
gtggccaggacattgccaggca

SEQ ID NO: 7990887 - DNA, 22 bp, Homo sapiens
gtggccaggacattgccaggca

SEQ ID NO: 7990888 - DNA, 22 bp, Homo sapiens
gtggccaggacattgccaggca

SEQ ID NO: 7990889 - DNA, 22 bp, Homo sapiens
gtggccaggacattgccaggca

SEQ ID NO: 7990890 - DNA, 22 bp, Homo sapiens
gtggccagctgtcagcaccctt

SEQ ID NO: 7990891 - DNA, 22 bp, Homo sapiens
gtggccagctgtcagcaccctt

SEQ ID NO: 7990892 - DNA, 22 bp, Homo sapiens
gtggcccagccctacagaggac

SEQ ID NO: 7990893 - DNA, 22 bp, Homo sapiens
gtggcccagccctacagaggac

SEQ ID NO: 7990894 - DNA, 22 bp, Homo sapiens
gtggcccacttacgtcatgtgt

SEQ ID NO: 7990895 - DNA, 22 bp, Homo sapiens
gtggccaggccgactgccaggc

SEQ ID NO: 7990896 - DNA, 22 bp, Homo sapiens
gtggccaggccgactgccaggc

SEQ ID NO: 7990897 - DNA, 22 bp, Homo sapiens
gtggccaggccgactgccaggc

SEQ ID NO: 7990898 - DNA, 22 bp, Homo sapiens
gtggccaggccgactgccaggc

SEQ ID NO: 7990899 - DNA, 22 bp, Homo sapiens
gtggccaggacattgccaggca

SEQ ID NO: 7990900 - DNA, 22 bp, Homo sapiens
gtggccaggccgactgccaggc

SEQ ID NO: 7990901 - DNA, 22 bp, Homo sapiens
gtggccaggccgactgccaggc

SEQ ID NO: 7990902 - DNA, 22 bp, Homo sapiens
gtggccaggccgactgccaggc

SEQ ID NO: 7990903 - DNA, 22 bp, Homo sapiens
gtggccaggagagggtgggaca

SEQ ID NO: 7990904 - DNA, 22 bp, Homo sapiens
gtggccaggagagggtgggaca

SEQ ID NO: 7990905 - DNA, 22 bp, Homo sapiens
gtggccaggagagggtgggaca

SEQ ID NO: 7990906 - DNA, 22 bp, Homo sapiens
gtggccaggagagggtgggaca

SEQ ID NO: 7990907 - DNA, 22 bp, Homo sapiens
gtggccaggagagggtgggaca

SEQ ID NO: 7990908 - DNA, 22 bp, Homo sapiens
gtggccaggagagggtgggaca

SEQ ID NO: 7990909 - DNA, 22 bp, Homo sapiens
gtggccaggagagggtgggaca

SEQ ID NO: 7990910 - DNA, 22 bp, Homo sapiens
gtggccaggagaccttgggcat

SEQ ID NO: 7990911 - DNA, 22 bp, Homo sapiens
gtggccaggagaccttgggcat

SEQ ID NO: 7990912 - DNA, 22 bp, Homo sapiens
gtggccaggagaccttgggcat

SEQ ID NO: 7990913 - DNA, 22 bp, Homo sapiens
gtggccaggagaccttgggcat

SEQ ID NO: 7990914 - DNA, 22 bp, Homo sapiens
gtggccctcagcagttgccaag

SEQ ID NO: 7990915 - DNA, 22 bp, Homo sapiens
gtggccctatttgaggacccca

SEQ ID NO: 7990916 - DNA, 22 bp, Homo sapiens
gtggccctaacaccgtttctca

SEQ ID NO: 7990917 - DNA, 22 bp, Homo sapiens
gtggccctatttgaggacccca

SEQ ID NO: 7990918 - DNA, 22 bp, Homo sapiens
gtggccctaacaccgtttctca

SEQ ID NO: 7990919 - DNA, 22 bp, Homo sapiens
gtggccctcagcagttgccaag

SEQ ID NO: 7990920 - DNA, 22 bp, Homo sapiens
gtggccctctgatagggtcagg

SEQ ID NO: 7990921 - DNA, 22 bp, Homo sapiens
gtggccctcagcagttgccaag

SEQ ID NO: 7990922 - DNA, 22 bp, Homo sapiens
gtggccctctgatagggtcagg

SEQ ID NO: 7990923 - DNA, 21 bp, Homo sapiens
gtggccctgccgcagtgtcca

SEQ ID NO: 7990924 - DNA, 21 bp, Homo sapiens
gtggccctgccgcagtgtcca

SEQ ID NO: 7990925 - DNA, 22 bp, Homo sapiens
gtggccctctgatagggtcagg

SEQ ID NO: 7990926 - DNA, 22 bp, Homo sapiens
gtggccctgagccctttgacag

SEQ ID NO: 7990927 - DNA, 21 bp, Homo sapiens
gtggccctgccgcagtgtcca

SEQ ID NO: 7990928 - DNA, 22 bp, Homo sapiens
gtggccctggagttgtgacact

SEQ ID NO: 7990929 - DNA, 22 bp, Homo sapiens
gtggcccaggttggagtgcagt

SEQ ID NO: 7990930 - DNA, 22 bp, Homo sapiens
gtggcccaggcttggcgctggc

SEQ ID NO: 7990931 - DNA, 22 bp, Homo sapiens
gtggcccaggcttggcgctggc

SEQ ID NO: 7990932 - DNA, 22 bp, Homo sapiens
gtggcccatcacgtttcgcctt
